United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 223

SEQ ID NO: 9236586 - DNA, 22 bp, Homo sapiens
gatcaaaagctgggttctaaaa

SEQ ID NO: 9236587 - DNA, 22 bp, Homo sapiens
gatcaaaagctgggttctaaaa

SEQ ID NO: 9236588 - DNA, 22 bp, Homo sapiens
gatcaatactattaagatcata

SEQ ID NO: 9236589 - DNA, 22 bp, Homo sapiens
gatcacagtattttagatgtgt

SEQ ID NO: 9236590 - DNA, 22 bp, Homo sapiens
gatcacataatttggaaacagc

SEQ ID NO: 9236591 - DNA, 22 bp, Homo sapiens
gatcacatgaatggaatagaag

SEQ ID NO: 9236592 - DNA, 22 bp, Homo sapiens
gatcacatctttatgagtattt

SEQ ID NO: 9236593 - DNA, 22 bp, Homo sapiens
gatcacatgaatggaatagaag

SEQ ID NO: 9236594 - DNA, 22 bp, Homo sapiens
gatcagaattcttgtgtgtttc

SEQ ID NO: 9236595 - DNA, 22 bp, Homo sapiens
gatcagaatgggacatatcctg

SEQ ID NO: 9236596 - DNA, 22 bp, Homo sapiens
gatcagaatttacttataattg

SEQ ID NO: 9236597 - DNA, 22 bp, Homo sapiens
gatcagtaagtgaataatgagt

SEQ ID NO: 9236598 - DNA, 22 bp, Homo sapiens
gatattttcgcagggagaattc

SEQ ID NO: 9236599 - DNA, 22 bp, Homo sapiens
gatattttcattcggatgctca

SEQ ID NO: 9236600 - DNA, 22 bp, Homo sapiens
gatattttcagtctcctttcaa

SEQ ID NO: 9236601 - DNA, 22 bp, Homo sapiens
gatattttcagtctcctttcaa

SEQ ID NO: 9236602 - DNA, 22 bp, Homo sapiens
gatattttcagtctcctttcaa

SEQ ID NO: 9236603 - DNA, 22 bp, Homo sapiens
gatattttcagtctcctttcaa

SEQ ID NO: 9236604 - DNA, 22 bp, Homo sapiens
gatattttcattcggatgctca

SEQ ID NO: 9236605 - DNA, 22 bp, Homo sapiens
gatatttttaggtgatgcaggc

SEQ ID NO: 9236606 - DNA, 22 bp, Homo sapiens
gatattttgagaaatcctatga

SEQ ID NO: 9236607 - DNA, 22 bp, Homo sapiens
gatattttgagaaatcctatga

SEQ ID NO: 9236608 - DNA, 22 bp, Homo sapiens
gatatactgtctgtattacata

SEQ ID NO: 9236609 - DNA, 22 bp, Homo sapiens
gatataggttcatagtgttaca

SEQ ID NO: 9236610 - DNA, 18 bp, Homo sapiens
gatatataggaggaaagt

SEQ ID NO: 9236611 - DNA, 22 bp, Homo sapiens
gatatttattaagtggttggta

SEQ ID NO: 9236612 - DNA, 22 bp, Homo sapiens
gatactttgtggaatcctggat

SEQ ID NO: 9236613 - DNA, 22 bp, Homo sapiens
gatactttctcatttacccaag

SEQ ID NO: 9236614 - DNA, 22 bp, Homo sapiens
gatactttccatccaaatgcat

SEQ ID NO: 9236615 - DNA, 22 bp, Homo sapiens
gatataaattaatcaagtgcaa

SEQ ID NO: 9236616 - DNA, 22 bp, Homo sapiens
gatagtcacctcccttaacttt

SEQ ID NO: 9236617 - DNA, 22 bp, Homo sapiens
gatagtcacctcccttaacttt

SEQ ID NO: 9236618 - DNA, 19 bp, Homo sapiens
gatataaagagatggtgaa

SEQ ID NO: 9236619 - DNA, 22 bp, Homo sapiens
gatagctgctgggatattttta

SEQ ID NO: 9236620 - DNA, 22 bp, Homo sapiens
gatagggcttcactaggcggag

SEQ ID NO: 9236621 - DNA, 22 bp, Homo sapiens
gataagttatgtaacttgctca

SEQ ID NO: 9236622 - DNA, 22 bp, Homo sapiens
gataagctaacccaagcccttt

SEQ ID NO: 9236623 - DNA, 22 bp, Homo sapiens
gataagctaacccaagcccttt

SEQ ID NO: 9236624 - DNA, 22 bp, Homo sapiens
gataaattgcactttttcttac

SEQ ID NO: 9236625 - DNA, 22 bp, Homo sapiens
gataacccccaagaaggtcttt

SEQ ID NO: 9236626 - DNA, 22 bp, Homo sapiens
gatacacattttagctttgtct

SEQ ID NO: 9236627 - DNA, 22 bp, Homo sapiens
gatacattccgggagggctacc

SEQ ID NO: 9236628 - DNA, 22 bp, Homo sapiens
gatacatttcaaggaggactgg

SEQ ID NO: 9236629 - DNA, 22 bp, Homo sapiens
gatacattgagggtggaggacc

SEQ ID NO: 9236630 - DNA, 22 bp, Homo sapiens
gataccagacagggagggagaa

SEQ ID NO: 9236631 - DNA, 22 bp, Homo sapiens
gatacattttatctcctaacag

SEQ ID NO: 9236632 - DNA, 23 bp, Homo sapiens
gatacactccctgctgggcactg

SEQ ID NO: 9236633 - DNA, 22 bp, Homo sapiens
gatacactggccaagtggagga

SEQ ID NO: 9236634 - DNA, 22 bp, Homo sapiens
gatgcagggctggcaggagctt

SEQ ID NO: 9236635 - DNA, 22 bp, Homo sapiens
gatgcagggcagctctgggaca

SEQ ID NO: 9236636 - DNA, 22 bp, Homo sapiens
gatgcaggatagcttcacccag

SEQ ID NO: 9236637 - DNA, 22 bp, Homo sapiens
gatgcagaaagtagacaccatc

SEQ ID NO: 9236638 - DNA, 22 bp, Homo sapiens
gatgcagggctggcaggagctt

SEQ ID NO: 9236639 - DNA, 22 bp, Homo sapiens
gatgcagtgcttaaatcatttg

SEQ ID NO: 9236640 - DNA, 22 bp, Homo sapiens
gatgcatgtatggagtgagggt

SEQ ID NO: 9236641 - DNA, 22 bp, Homo sapiens
gatgatttctccattcccttct

SEQ ID NO: 9236642 - DNA, 22 bp, Homo sapiens
gatgattttctgtgttagaaga

SEQ ID NO: 9236643 - DNA, 22 bp, Homo sapiens
gatgatttgaggatttcatgag

SEQ ID NO: 9236644 - DNA, 22 bp, Homo sapiens
gatgattttagttgactaaact

SEQ ID NO: 9236645 - DNA, 22 bp, Homo sapiens
gatgattttgttggtgattcaa

SEQ ID NO: 9236646 - DNA, 22 bp, Homo sapiens
gatgattttgatgcagtaaaga

SEQ ID NO: 9236647 - DNA, 22 bp, Homo sapiens
gatgaggaaaccaaggctcagg

SEQ ID NO: 9236648 - DNA, 22 bp, Homo sapiens
gatgaggaatttgaggttagaa

SEQ ID NO: 9236649 - DNA, 22 bp, Homo sapiens
gatgagacagaatagcccaagg

SEQ ID NO: 9236650 - DNA, 22 bp, Homo sapiens
gatgacagcagctgtggctcac

SEQ ID NO: 9236651 - DNA, 22 bp, Homo sapiens
gatgacagttctagcatctgaa

SEQ ID NO: 9236652 - DNA, 22 bp, Homo sapiens
gatgacagttctagcatctgaa

SEQ ID NO: 9236653 - DNA, 21 bp, Homo sapiens
gatgaagcaatctttctgttg

SEQ ID NO: 9236654 - DNA, 22 bp, Homo sapiens
gatctttatactgtaataatga

SEQ ID NO: 9236655 - DNA, 22 bp, Homo sapiens
gatcttggaatggcacagctga

SEQ ID NO: 9236656 - DNA, 22 bp, Homo sapiens
gatcttggaatggcacagctga

SEQ ID NO: 9236657 - DNA, 22 bp, Homo sapiens
gatcttggggggatcaccatgg

SEQ ID NO: 9236658 - DNA, 22 bp, Homo sapiens
gatgaaatccagatcacaggtg

SEQ ID NO: 9236659 - DNA, 17 bp, Homo sapiens
gatgaaatgatgcacac

SEQ ID NO: 9236660 - DNA, 20 bp, Homo sapiens
gatgaaatcactgggcagcc

SEQ ID NO: 9236661 - DNA, 22 bp, Homo sapiens
gatgaaattgttttgatacttt

SEQ ID NO: 9236662 - DNA, 22 bp, Homo sapiens
gagtgtgggtctcagctttaag

SEQ ID NO: 9236663 - DNA, 22 bp, Homo sapiens
gagtgtgggtctcagctttaag

SEQ ID NO: 9236664 - DNA, 22 bp, Homo sapiens
gagtgtgggggtgctgaggaca

SEQ ID NO: 9236665 - DNA, 22 bp, Homo sapiens
gagtgtgggcacgggggccttg

SEQ ID NO: 9236666 - DNA, 22 bp, Homo sapiens
gagtgtggtgaacaggagcacc

SEQ ID NO: 9236667 - DNA, 22 bp, Homo sapiens
gagtgtggtgaacaggagcacc

SEQ ID NO: 9236668 - DNA, 22 bp, Homo sapiens
gagtgtggtgaacaggagcacc

SEQ ID NO: 9236669 - DNA, 22 bp, Homo sapiens
gagtgtggtgaacaggagcacc

SEQ ID NO: 9236670 - DNA, 22 bp, Homo sapiens
gagtgtggtatgctctgaggct

SEQ ID NO: 9236671 - DNA, 22 bp, Homo sapiens
gagtgtggatcccagaagcaga

SEQ ID NO: 9236672 - DNA, 22 bp, Homo sapiens
gagtgtggatcccagaagcaga

SEQ ID NO: 9236673 - DNA, 22 bp, Homo sapiens
gagtgtgggcacgggggccttg

SEQ ID NO: 9236674 - DNA, 18 bp, Homo sapiens
gagtgtggcactgggccc

SEQ ID NO: 9236675 - DNA, 22 bp, Homo sapiens
gagttaaaggaaaataacttta

SEQ ID NO: 9236676 - DNA, 22 bp, Homo sapiens
gagttctgaactgtgaaatgca

SEQ ID NO: 9236677 - DNA, 22 bp, Homo sapiens
gagttctattatggttagaagt

SEQ ID NO: 9236678 - DNA, 22 bp, Homo sapiens
gagttctcaagcaatcaaagag

SEQ ID NO: 9236679 - DNA, 22 bp, Homo sapiens
gagtgtggtgaacaggagcacc

SEQ ID NO: 9236680 - DNA, 22 bp, Homo sapiens
gagtgtggtgaacaggagcacc

SEQ ID NO: 9236681 - DNA, 22 bp, Homo sapiens
gagtgtgttattaaagatggaa

SEQ ID NO: 9236682 - DNA, 22 bp, Homo sapiens
gagtggttagaagtagtgtggc

SEQ ID NO: 9236683 - DNA, 22 bp, Homo sapiens
gagtgtaatctgaaaacttgaa

SEQ ID NO: 9236684 - DNA, 22 bp, Homo sapiens
gagtgtaaaaacttagtgagat

SEQ ID NO: 9236685 - DNA, 22 bp, Homo sapiens
gagtgtagttcattccgtccta

SEQ ID NO: 9236686 - DNA, 22 bp, Homo sapiens
gagtggggggtccgtctcagtg

SEQ ID NO: 9236687 - DNA, 22 bp, Homo sapiens
gagtggggggtccgtctcagtg

SEQ ID NO: 9236688 - DNA, 22 bp, Homo sapiens
gagtggggggtccgtctcagtg

SEQ ID NO: 9236689 - DNA, 22 bp, Homo sapiens
gagtggggctttaaaggctcag

SEQ ID NO: 9236690 - DNA, 22 bp, Homo sapiens
gagtggggtctgggcatcagtc

SEQ ID NO: 9236691 - DNA, 22 bp, Homo sapiens
gagtggggggtccgtctcagtg

SEQ ID NO: 9236692 - DNA, 22 bp, Homo sapiens
gagtggggtctgggcatcagtc

SEQ ID NO: 9236693 - DNA, 22 bp, Homo sapiens
gagtggggtctgggcatcagtc

SEQ ID NO: 9236694 - DNA, 22 bp, Homo sapiens
gagtggggtctgggcatcagtc

SEQ ID NO: 9236695 - DNA, 22 bp, Homo sapiens
gagtggggtctgggcatcagtc

SEQ ID NO: 9236696 - DNA, 20 bp, Homo sapiens
gataaattgtctcttaagtg

SEQ ID NO: 9236697 - DNA, 22 bp, Homo sapiens
gataacaatatgaagtagatat

SEQ ID NO: 9236698 - DNA, 22 bp, Homo sapiens
gataacatacttgcatgtgtat

SEQ ID NO: 9236699 - DNA, 22 bp, Homo sapiens
gataacattataagttcactgt

SEQ ID NO: 9236700 - DNA, 22 bp, Homo sapiens
gataacatggttagtgttttta

SEQ ID NO: 9236701 - DNA, 20 bp, Homo sapiens
gataaattgtctcttaagtg

SEQ ID NO: 9236702 - DNA, 22 bp, Homo sapiens
gataaatggctgaagaaatagt

SEQ ID NO: 9236703 - DNA, 22 bp, Homo sapiens
gataaagcaaggatgactgaag

SEQ ID NO: 9236704 - DNA, 21 bp, Homo sapiens
gataaagcagcttgcctaagg

SEQ ID NO: 9236705 - DNA, 22 bp, Homo sapiens
gataaaattcttattttacccg

SEQ ID NO: 9236706 - DNA, 22 bp, Homo sapiens
gataaaattcttattttacccg

SEQ ID NO: 9236707 - DNA, 21 bp, Homo sapiens
gataaaatgggccttggtcct

SEQ ID NO: 9236708 - DNA, 21 bp, Homo sapiens
gataaaatgggccttggtcct

SEQ ID NO: 9236709 - DNA, 22 bp, Homo sapiens
gataaaatatgtggcctttagt

SEQ ID NO: 9236710 - DNA, 22 bp, Homo sapiens
gataaaataactatggaatact

SEQ ID NO: 9236711 - DNA, 22 bp, Homo sapiens
gagttgaacatatgcaatctct

SEQ ID NO: 9236712 - DNA, 22 bp, Homo sapiens
gagttgatcattatttggtttc

SEQ ID NO: 9236713 - DNA, 22 bp, Homo sapiens
gagtttattcaggaaatagcca

SEQ ID NO: 9236714 - DNA, 22 bp, Homo sapiens
gataaaagaggaaatttgttca

SEQ ID NO: 9236715 - DNA, 22 bp, Homo sapiens
gataaaataactatggaatact

SEQ ID NO: 9236716 - DNA, 19 bp, Homo sapiens
gagtcctgtgctccttgtt

SEQ ID NO: 9236717 - DNA, 21 bp, Homo sapiens
gagtccttccaatgtcctcag

SEQ ID NO: 9236718 - DNA, 22 bp, Homo sapiens
gagtccttaatacactggtgga

SEQ ID NO: 9236719 - DNA, 22 bp, Homo sapiens
gagtctcctactggctgtcctt

SEQ ID NO: 9236720 - DNA, 22 bp, Homo sapiens
gagtctctgaccagggtgccaa

SEQ ID NO: 9236721 - DNA, 22 bp, Homo sapiens
gagtccttgtcataattcagtg

SEQ ID NO: 9236722 - DNA, 22 bp, Homo sapiens
gagtccttctggctggcaggat

SEQ ID NO: 9236723 - DNA, 22 bp, Homo sapiens
gagtctggccctgatgcatcat

SEQ ID NO: 9236724 - DNA, 22 bp, Homo sapiens
gagtctgaggggagagctgggt

SEQ ID NO: 9236725 - DNA, 22 bp, Homo sapiens
gagtctgatgtcccccaggcca

SEQ ID NO: 9236726 - DNA, 22 bp, Homo sapiens
gagtctgagaactgggctcagt

SEQ ID NO: 9236727 - DNA, 22 bp, Homo sapiens
gagtgagtggccaggaggcaga

SEQ ID NO: 9236728 - DNA, 22 bp, Homo sapiens
gagtgaggctggaatcatggct

SEQ ID NO: 9236729 - DNA, 22 bp, Homo sapiens
gagtgagggccaacatccagct

SEQ ID NO: 9236730 - DNA, 22 bp, Homo sapiens
gagtgagggccaacatccagct

SEQ ID NO: 9236731 - DNA, 22 bp, Homo sapiens
gagtgagggccaacatccagct

SEQ ID NO: 9236732 - DNA, 22 bp, Homo sapiens
gagtgccaagagaagaggctgg

SEQ ID NO: 9236733 - DNA, 22 bp, Homo sapiens
gagtgcagttggggtgagggga

SEQ ID NO: 9236734 - DNA, 22 bp, Homo sapiens
gagtgctcgggcctctgcctgc

SEQ ID NO: 9236735 - DNA, 22 bp, Homo sapiens
gagtgctcctggatggatttcc

SEQ ID NO: 9236736 - DNA, 22 bp, Homo sapiens
gagtgctccgtcttggacaggg

SEQ ID NO: 9236737 - DNA, 22 bp, Homo sapiens
gagtgcagtatgagaggctgct

SEQ ID NO: 9236738 - DNA, 22 bp, Homo sapiens
gagtgcagtggcgtgatctctg

SEQ ID NO: 9236739 - DNA, 22 bp, Homo sapiens
gagtgcagttggggtgagggga

SEQ ID NO: 9236740 - DNA, 23 bp, Homo sapiens
gagtgcagaatagacatgcagtg

SEQ ID NO: 9236741 - DNA, 22 bp, Homo sapiens
gagtgcagtatgagaggctgct

SEQ ID NO: 9236742 - DNA, 22 bp, Homo sapiens
gagtgctggaggtgtgagtggg

SEQ ID NO: 9236743 - DNA, 22 bp, Homo sapiens
gagtgctgcttgggatagtgag

SEQ ID NO: 9236744 - DNA, 22 bp, Homo sapiens
gagtgctgtaggactgagccct

SEQ ID NO: 9236745 - DNA, 17 bp, Homo sapiens
gagtgctggtggagctc

SEQ ID NO: 9236746 - DNA, 22 bp, Homo sapiens
gagtggagcaaaagaggtagat

SEQ ID NO: 9236747 - DNA, 22 bp, Homo sapiens
gagtggcatatgtgcctgtgaa

SEQ ID NO: 9236748 - DNA, 22 bp, Homo sapiens
gagtggagatcgtgccactgca

SEQ ID NO: 9236749 - DNA, 22 bp, Homo sapiens
gagtggagatcgtgccactgca

SEQ ID NO: 9236750 - DNA, 20 bp, Homo sapiens
gagtgctttggcttgctctc

SEQ ID NO: 9236751 - DNA, 21 bp, Homo sapiens
gagtggaacgctcttcacacc

SEQ ID NO: 9236752 - DNA, 22 bp, Homo sapiens
gagtggagatcgtgccactgca

SEQ ID NO: 9236753 - DNA, 22 bp, Homo sapiens
gagtggctgtgtacatgcccag

SEQ ID NO: 9236754 - DNA, 21 bp, Homo sapiens
gagtgggacatgggagtggtt

SEQ ID NO: 9236755 - DNA, 21 bp, Homo sapiens
gagtgggacatgggagtggtt

SEQ ID NO: 9236756 - DNA, 21 bp, Homo sapiens
gagtgggacatgggagtggtt

SEQ ID NO: 9236757 - DNA, 22 bp, Homo sapiens
gagtgggcaaaagaaagtaggc

SEQ ID NO: 9236758 - DNA, 22 bp, Homo sapiens
gagtggggctttaaaggctcag

SEQ ID NO: 9236759 - DNA, 22 bp, Homo sapiens
gagtgggcaccgtgggcacact

SEQ ID NO: 9236760 - DNA, 22 bp, Homo sapiens
gagtggggctttaaaggctcag

SEQ ID NO: 9236761 - DNA, 22 bp, Homo sapiens
gaggtaggtgtaggaggcctgc

SEQ ID NO: 9236762 - DNA, 22 bp, Homo sapiens
gaggtaacaactgaaatgagaa

SEQ ID NO: 9236763 - DNA, 22 bp, Homo sapiens
gaggtaggtgtaggaggcctgc

SEQ ID NO: 9236764 - DNA, 22 bp, Homo sapiens
gaggtaggtgtaggaggcctgc

SEQ ID NO: 9236765 - DNA, 22 bp, Homo sapiens
gaggtagtaagcagagtggggt

SEQ ID NO: 9236766 - DNA, 23 bp, Homo sapiens
gaggtcaaggctgcagtgattgc

SEQ ID NO: 9236767 - DNA, 22 bp, Homo sapiens
gaggtatcttagagagtgtaga

SEQ ID NO: 9236768 - DNA, 22 bp, Homo sapiens
gaggtatggatatctggagagg

SEQ ID NO: 9236769 - DNA, 22 bp, Homo sapiens
gaggggccggcatgtgcctctc

SEQ ID NO: 9236770 - DNA, 22 bp, Homo sapiens
gaggggcctggcactgagctgg

SEQ ID NO: 9236771 - DNA, 22 bp, Homo sapiens
gaggggcctggcactgagctgg

SEQ ID NO: 9236772 - DNA, 22 bp, Homo sapiens
gaggggcctggcgaggacatgt

SEQ ID NO: 9236773 - DNA, 22 bp, Homo sapiens
gaggggcctggcgaggacatgt

SEQ ID NO: 9236774 - DNA, 22 bp, Homo sapiens
gaggggcgtcctgagtgggcct

SEQ ID NO: 9236775 - DNA, 22 bp, Homo sapiens
gagggttggtgcaaatgggatg

SEQ ID NO: 9236776 - DNA, 22 bp, Homo sapiens
gaggggctcttgggcatgaagg

SEQ ID NO: 9236777 - DNA, 22 bp, Homo sapiens
gaggtccagagcaggttcagtg

SEQ ID NO: 9236778 - DNA, 22 bp, Homo sapiens
gaggtgggagggcagtccctaa

SEQ ID NO: 9236779 - DNA, 22 bp, Homo sapiens
gaggtcccccatggctgtgact

SEQ ID NO: 9236780 - DNA, 22 bp, Homo sapiens
gaggtccagggtggggcctgag

SEQ ID NO: 9236781 - DNA, 22 bp, Homo sapiens
gaggtgggatgtgtgtgctact

SEQ ID NO: 9236782 - DNA, 22 bp, Homo sapiens
gaggtgggatgtgtgtgctact

SEQ ID NO: 9236783 - DNA, 22 bp, Homo sapiens
gaggtgggcggatcacaaggtc

SEQ ID NO: 9236784 - DNA, 22 bp, Homo sapiens
gaggtggggttttgttcttgaa

SEQ ID NO: 9236785 - DNA, 22 bp, Homo sapiens
gaggtccactgaggcaacaggg

SEQ ID NO: 9236786 - DNA, 22 bp, Homo sapiens
gaggtccaacacaatgggtgtt

SEQ ID NO: 9236787 - DNA, 22 bp, Homo sapiens
gaggtcaggctcaagctgggcc

SEQ ID NO: 9236788 - DNA, 22 bp, Homo sapiens
gaggtcaggcttgcagcagggt

SEQ ID NO: 9236789 - DNA, 22 bp, Homo sapiens
gagtccagttgttcacagaggc

SEQ ID NO: 9236790 - DNA, 22 bp, Homo sapiens
gagtcccatgatgatagccaca

SEQ ID NO: 9236791 - DNA, 22 bp, Homo sapiens
gagtcagattgcagacagggct

SEQ ID NO: 9236792 - DNA, 22 bp, Homo sapiens
gaggtgggtgtatcacaggtca

SEQ ID NO: 9236793 - DNA, 22 bp, Homo sapiens
gaggtgggtgtatcacaggtca

SEQ ID NO: 9236794 - DNA, 19 bp, Homo sapiens
gaggtgggtccccgcagcc

SEQ ID NO: 9236795 - DNA, 19 bp, Homo sapiens
gaggtgggtccccgcagcc

SEQ ID NO: 9236796 - DNA, 22 bp, Homo sapiens
gaggtggggttttgttcttgaa

SEQ ID NO: 9236797 - DNA, 22 bp, Homo sapiens
gaggtggttcaggtagagccca

SEQ ID NO: 9236798 - DNA, 22 bp, Homo sapiens
gaggtggtggtggaggcatagc

SEQ ID NO: 9236799 - DNA, 22 bp, Homo sapiens
gaggtgggtgtatcacaggtca

SEQ ID NO: 9236800 - DNA, 22 bp, Homo sapiens
gagtcacattaatttaatttta

SEQ ID NO: 9236801 - DNA, 22 bp, Homo sapiens
gagtcacaaagcctttcttatt

SEQ ID NO: 9236802 - DNA, 22 bp, Homo sapiens
gaggcctgaggctgcctggagc

SEQ ID NO: 9236803 - DNA, 22 bp, Homo sapiens
gaggcctgaggctgcctggagc

SEQ ID NO: 9236804 - DNA, 22 bp, Homo sapiens
gaggctgcccaactggagtgga

SEQ ID NO: 9236805 - DNA, 22 bp, Homo sapiens
gaggctgcccaactggagtgga

SEQ ID NO: 9236806 - DNA, 22 bp, Homo sapiens
gaggctgcccacacctgcgccg

SEQ ID NO: 9236807 - DNA, 22 bp, Homo sapiens
gaggctggaatattagaaatgt

SEQ ID NO: 9236808 - DNA, 22 bp, Homo sapiens
gaggctggacgtgcatttctac

SEQ ID NO: 9236809 - DNA, 22 bp, Homo sapiens
gaggctggaggtcaaagatgaa

SEQ ID NO: 9236810 - DNA, 22 bp, Homo sapiens
gaggctggaggtcaaagatgaa

SEQ ID NO: 9236811 - DNA, 22 bp, Homo sapiens
gaggctggaggtcaaagatgaa

SEQ ID NO: 9236812 - DNA, 22 bp, Homo sapiens
gaggctggagatattccaatct

SEQ ID NO: 9236813 - DNA, 22 bp, Homo sapiens
gaggctggagatattccaatct

SEQ ID NO: 9236814 - DNA, 22 bp, Homo sapiens
gaggctggcagaaaagcacagg

SEQ ID NO: 9236815 - DNA, 22 bp, Homo sapiens
gaggctggcagaaaagcacagg

SEQ ID NO: 9236816 - DNA, 16 bp, Homo sapiens
gaggctggcagatgtc

SEQ ID NO: 9236817 - DNA, 16 bp, Homo sapiens
gaggctggcagatgtc

SEQ ID NO: 9236818 - DNA, 22 bp, Homo sapiens
gaggctggcagaaaagcacagg

SEQ ID NO: 9236819 - DNA, 22 bp, Homo sapiens
gaggctggcagaaaagcacagg

SEQ ID NO: 9236820 - DNA, 22 bp, Homo sapiens
gaggctgggggctgccttcctc

SEQ ID NO: 9236821 - DNA, 22 bp, Homo sapiens
gaggctgggaagtccaagatca

SEQ ID NO: 9236822 - DNA, 22 bp, Homo sapiens
gaggctgggaagtccaatatca

SEQ ID NO: 9236823 - DNA, 22 bp, Homo sapiens
gaggctgggaagtccaagacca

SEQ ID NO: 9236824 - DNA, 22 bp, Homo sapiens
gaggctgggaagtccaagatca

SEQ ID NO: 9236825 - DNA, 16 bp, Homo sapiens
gaggctggcagatgtc

SEQ ID NO: 9236826 - DNA, 22 bp, Homo sapiens
gaggctgggaagtccaagacca

SEQ ID NO: 9236827 - DNA, 22 bp, Homo sapiens
gaggctgggaagtccaagacca

SEQ ID NO: 9236828 - DNA, 22 bp, Homo sapiens
gaggctggggtctgcctttctg

SEQ ID NO: 9236829 - DNA, 22 bp, Homo sapiens
gagggcagagacagtgattcac

SEQ ID NO: 9236830 - DNA, 16 bp, Homo sapiens
gagggcagaggcggaa

SEQ ID NO: 9236831 - DNA, 16 bp, Homo sapiens
gagggcagaggcggaa

SEQ ID NO: 9236832 - DNA, 22 bp, Homo sapiens
gaggggcagttgattgtgctat

SEQ ID NO: 9236833 - DNA, 22 bp, Homo sapiens
gaggggcacagtaaagggtccc

SEQ ID NO: 9236834 - DNA, 22 bp, Homo sapiens
gaggggcacagcagctgttgca

SEQ ID NO: 9236835 - DNA, 22 bp, Homo sapiens
gaggggcaatgagggaaagagt

SEQ ID NO: 9236836 - DNA, 22 bp, Homo sapiens
gaggggagtaaagtcatgttac

SEQ ID NO: 9236837 - DNA, 22 bp, Homo sapiens
gaggggagtaaagtcatgttac

SEQ ID NO: 9236838 - DNA, 22 bp, Homo sapiens
gaggggagtgtcctccgggccc

SEQ ID NO: 9236839 - DNA, 22 bp, Homo sapiens
gaggggagtaaagtcatgttac

SEQ ID NO: 9236840 - DNA, 22 bp, Homo sapiens
gaggggagtgtcctccgggccc

SEQ ID NO: 9236841 - DNA, 22 bp, Homo sapiens
gaggggagtgtcctccgggccc

SEQ ID NO: 9236842 - DNA, 22 bp, Homo sapiens
gaggggagtgtcctccgggccc

SEQ ID NO: 9236843 - DNA, 22 bp, Homo sapiens
gagggccaaagagcaagagcct

SEQ ID NO: 9236844 - DNA, 22 bp, Homo sapiens
gagggccaactagcaccacttt

SEQ ID NO: 9236845 - DNA, 22 bp, Homo sapiens
gagggccaaagagcaagagcct

SEQ ID NO: 9236846 - DNA, 22 bp, Homo sapiens
gaggggaaagtgtgaggctgcg

SEQ ID NO: 9236847 - DNA, 22 bp, Homo sapiens
gagggccaatggatttcaactg

SEQ ID NO: 9236848 - DNA, 22 bp, Homo sapiens
gagggccaatggatttcaactg

SEQ ID NO: 9236849 - DNA, 22 bp, Homo sapiens
gagggccaatgtgtccctgagc

SEQ ID NO: 9236850 - DNA, 20 bp, Homo sapiens
gagggcaggcacccatttca

SEQ ID NO: 9236851 - DNA, 22 bp, Homo sapiens
gagggcagtagcctcgtaccct

SEQ ID NO: 9236852 - DNA, 22 bp, Homo sapiens
gagggcagtagcctcgtaccct

SEQ ID NO: 9236853 - DNA, 18 bp, Homo sapiens
gagctgggagaaggaagg

SEQ ID NO: 9236854 - DNA, 18 bp, Homo sapiens
gagctgggagaaggaagg

SEQ ID NO: 9236855 - DNA, 22 bp, Homo sapiens
gagctgggagttatagcatgtt

SEQ ID NO: 9236856 - DNA, 22 bp, Homo sapiens
gagctgggaggactgggaactt

SEQ ID NO: 9236857 - DNA, 22 bp, Homo sapiens
gaggaagggctgcctgccgggc

SEQ ID NO: 9236858 - DNA, 22 bp, Homo sapiens
gaggaagggctgcctgccgggc

SEQ ID NO: 9236859 - DNA, 22 bp, Homo sapiens
gaggaagggactttattatctg

SEQ ID NO: 9236860 - DNA, 22 bp, Homo sapiens
gaggaagggctgcctgccgggc

SEQ ID NO: 9236861 - DNA, 22 bp, Homo sapiens
gaggaagggctgcctgccgggc

SEQ ID NO: 9236862 - DNA, 22 bp, Homo sapiens
gaggaagaattggttattggag

SEQ ID NO: 9236863 - DNA, 22 bp, Homo sapiens
gaggacagagccgcctggcaag

SEQ ID NO: 9236864 - DNA, 22 bp, Homo sapiens
gaggacagcttagggcttcctg

SEQ ID NO: 9236865 - DNA, 22 bp, Homo sapiens
gaggacagcttagggcttcctg

SEQ ID NO: 9236866 - DNA, 22 bp, Homo sapiens
gaggaaggtcccatcagaattt

SEQ ID NO: 9236867 - DNA, 22 bp, Homo sapiens
gaggacaaagcccaggtgctgg

SEQ ID NO: 9236868 - DNA, 22 bp, Homo sapiens
gaggacacaaagtggctgagat

SEQ ID NO: 9236869 - DNA, 22 bp, Homo sapiens
gagctggctaatactgacttat

SEQ ID NO: 9236870 - DNA, 22 bp, Homo sapiens
gagctggcctcaggcacaggag

SEQ ID NO: 9236871 - DNA, 22 bp, Homo sapiens
gagctgggacatgggtcctctc

SEQ ID NO: 9236872 - DNA, 22 bp, Homo sapiens
gagctgggacatgggtcctctc

SEQ ID NO: 9236873 - DNA, 22 bp, Homo sapiens
gagctgggacttggaatccaca

SEQ ID NO: 9236874 - DNA, 22 bp, Homo sapiens
gagctgggaagatagcttgagc

SEQ ID NO: 9236875 - DNA, 22 bp, Homo sapiens
gagctggcaggaggctccccga

SEQ ID NO: 9236876 - DNA, 22 bp, Homo sapiens
gagctggccgcagagagggcag

SEQ ID NO: 9236877 - DNA, 22 bp, Homo sapiens
gagctggaggcagtgctgaggt

SEQ ID NO: 9236878 - DNA, 22 bp, Homo sapiens
gagctggaggcagtgctgaggt

SEQ ID NO: 9236879 - DNA, 22 bp, Homo sapiens
gagctggaggaccaggactggg

SEQ ID NO: 9236880 - DNA, 22 bp, Homo sapiens
gagctggactttcagatacatc

SEQ ID NO: 9236881 - DNA, 22 bp, Homo sapiens
gagctggaagtctgtggtcaga

SEQ ID NO: 9236882 - DNA, 22 bp, Homo sapiens
gagataaagctaccatgttgat

SEQ ID NO: 9236883 - DNA, 22 bp, Homo sapiens
gagataaagctaccatgttgat

SEQ ID NO: 9236884 - DNA, 22 bp, Homo sapiens
gagagtgtctggaggaagctaa

SEQ ID NO: 9236885 - DNA, 22 bp, Homo sapiens
gagagtgtctggaggaagctaa

SEQ ID NO: 9236886 - DNA, 22 bp, Homo sapiens
gagataatgatgctaacccagt

SEQ ID NO: 9236887 - DNA, 22 bp, Homo sapiens
gagatacagttggctgcaggct

SEQ ID NO: 9236888 - DNA, 22 bp, Homo sapiens
gagataataatagtacctatct

SEQ ID NO: 9236889 - DNA, 22 bp, Homo sapiens
gagagtctagtgcacctagttt

SEQ ID NO: 9236890 - DNA, 22 bp, Homo sapiens
gagagtgagatcctcctgggga

SEQ ID NO: 9236891 - DNA, 22 bp, Homo sapiens
gagagtgaggcatcaggggcag

SEQ ID NO: 9236892 - DNA, 22 bp, Homo sapiens
gagagtgaggcctgggaatcta

SEQ ID NO: 9236893 - DNA, 22 bp, Homo sapiens
gagagtgctgaacggcaagggt

SEQ ID NO: 9236894 - DNA, 22 bp, Homo sapiens
gagagtgtcgggggccccagga

SEQ ID NO: 9236895 - DNA, 17 bp, Homo sapiens
gagagtgtattggatgc

SEQ ID NO: 9236896 - DNA, 22 bp, Homo sapiens
gaggcagcaggctgaggaggat

SEQ ID NO: 9236897 - DNA, 22 bp, Homo sapiens
gaggcagctcttctgaatgggg

SEQ ID NO: 9236898 - DNA, 23 bp, Homo sapiens
gaggcagctcctgcagtgccctg

SEQ ID NO: 9236899 - DNA, 22 bp, Homo sapiens
gaggcccagggtacaggccgct

SEQ ID NO: 9236900 - DNA, 22 bp, Homo sapiens
gaggcccaggtcaagcagccac

SEQ ID NO: 9236901 - DNA, 22 bp, Homo sapiens
gaggcccagtcctgcaagcacg

SEQ ID NO: 9236902 - DNA, 22 bp, Homo sapiens
gaggcagctgaaggagtgacag

SEQ ID NO: 9236903 - DNA, 22 bp, Homo sapiens
gaggcagctgggctggtggttt

SEQ ID NO: 9236904 - DNA, 22 bp, Homo sapiens
gaggcctgaaaggggacctatg

SEQ ID NO: 9236905 - DNA, 18 bp, Homo sapiens
gaggcctgagaaccaggt

SEQ ID NO: 9236906 - DNA, 22 bp, Homo sapiens
gaggcctcctctgagacatctg

SEQ ID NO: 9236907 - DNA, 22 bp, Homo sapiens
gaggcctctgtcccaccaggga

SEQ ID NO: 9236908 - DNA, 19 bp, Homo sapiens
gaggcccatgagggtgctc

SEQ ID NO: 9236909 - DNA, 22 bp, Homo sapiens
gaggcccagtcctgcaagcacg

SEQ ID NO: 9236910 - DNA, 22 bp, Homo sapiens
gaggccctccagctgtcagctg

SEQ ID NO: 9236911 - DNA, 21 bp, Homo sapiens
gaggcccatgggacaggggct

SEQ ID NO: 9236912 - DNA, 22 bp, Homo sapiens
gaggcctataggcaagtgctgc

SEQ ID NO: 9236913 - DNA, 22 bp, Homo sapiens
gaggccctgaagacagctgggg

SEQ ID NO: 9236914 - DNA, 22 bp, Homo sapiens
gaggcagaggttgcagtgagct

SEQ ID NO: 9236915 - DNA, 22 bp, Homo sapiens
gaggcagcaaaatatatcataa

SEQ ID NO: 9236916 - DNA, 22 bp, Homo sapiens
gaggcagcagaacatggaagag

SEQ ID NO: 9236917 - DNA, 22 bp, Homo sapiens
gaggcagagtcacaaagagtct

SEQ ID NO: 9236918 - DNA, 22 bp, Homo sapiens
gaggcagagtgcaccccaggag

SEQ ID NO: 9236919 - DNA, 22 bp, Homo sapiens
gaggcagaggttgttgcagtga

SEQ ID NO: 9236920 - DNA, 22 bp, Homo sapiens
gaggcagagtcacaaagagtct

SEQ ID NO: 9236921 - DNA, 22 bp, Homo sapiens
gaggcagagtcacaaagagtct

SEQ ID NO: 9236922 - DNA, 22 bp, Homo sapiens
gaggaggcttccgggaggcacg

SEQ ID NO: 9236923 - DNA, 19 bp, Homo sapiens
gaggaggcttcagctttct

SEQ ID NO: 9236924 - DNA, 22 bp, Homo sapiens
gaggaggctggcgccgcctgcc

SEQ ID NO: 9236925 - DNA, 23 bp, Homo sapiens
gaggagggtctgacaagtgtagc

SEQ ID NO: 9236926 - DNA, 23 bp, Homo sapiens
gaggagggtctgacaagtgtagc

SEQ ID NO: 9236927 - DNA, 22 bp, Homo sapiens
gaggagggttggccttaggtag

SEQ ID NO: 9236928 - DNA, 23 bp, Homo sapiens
gaggagggtctgacaagtgtagc

SEQ ID NO: 9236929 - DNA, 22 bp, Homo sapiens
gaggagggagctggaagctctt

SEQ ID NO: 9236930 - DNA, 22 bp, Homo sapiens
gaggagggagctggaagctctt

SEQ ID NO: 9236931 - DNA, 22 bp, Homo sapiens
gaggagggagaattaggcttaa

SEQ ID NO: 9236932 - DNA, 22 bp, Homo sapiens
gctgcctgatgtccagcaggac

SEQ ID NO: 9236933 - DNA, 22 bp, Homo sapiens
gctgcctgctcacccggcctgg

SEQ ID NO: 9236934 - DNA, 22 bp, Homo sapiens
gctgcctgctcacccggcctgg

SEQ ID NO: 9236935 - DNA, 22 bp, Homo sapiens
gctgcctgccttgcctggagga

SEQ ID NO: 9236936 - DNA, 22 bp, Homo sapiens
gctgcctgctcggctcctggga

SEQ ID NO: 9236937 - DNA, 22 bp, Homo sapiens
gctgcctgctcggctcctggga

SEQ ID NO: 9236938 - DNA, 22 bp, Homo sapiens
gctgcctgctcggctcctggga

SEQ ID NO: 9236939 - DNA, 22 bp, Homo sapiens
gctgcctggaataacggctggc

SEQ ID NO: 9236940 - DNA, 22 bp, Homo sapiens
gctgcctggagctcagcctgcc

SEQ ID NO: 9236941 - DNA, 22 bp, Homo sapiens
gctgcctggagctcagcctgcc

SEQ ID NO: 9236942 - DNA, 22 bp, Homo sapiens
gctgcctggagctcagcctgcc

SEQ ID NO: 9236943 - DNA, 22 bp, Homo sapiens
gctgcctggatttgcaatcctc

SEQ ID NO: 9236944 - DNA, 22 bp, Homo sapiens
gctgcctggagctcagcctgcc

SEQ ID NO: 9236945 - DNA, 22 bp, Homo sapiens
gctgagctagaaaaggaccaca

SEQ ID NO: 9236946 - DNA, 22 bp, Homo sapiens
gctgagctagaaaaggaccaca

SEQ ID NO: 9236947 - DNA, 22 bp, Homo sapiens
gctgagctagaaaaggaccaca

SEQ ID NO: 9236948 - DNA, 22 bp, Homo sapiens
gctgagcctagctgtctcctgt

SEQ ID NO: 9236949 - DNA, 22 bp, Homo sapiens
gctgagctagaaaaggaccaca

SEQ ID NO: 9236950 - DNA, 22 bp, Homo sapiens
gctgagctcccagcagtatctg

SEQ ID NO: 9236951 - DNA, 22 bp, Homo sapiens
gctgaggatatagcaggaacaa

SEQ ID NO: 9236952 - DNA, 22 bp, Homo sapiens
gctgaggaggtgtggttaggtg

SEQ ID NO: 9236953 - DNA, 22 bp, Homo sapiens
gctgagccacaggcagtgcact

SEQ ID NO: 9236954 - DNA, 22 bp, Homo sapiens
gctgagcaggtttgatgctttt

SEQ ID NO: 9236955 - DNA, 22 bp, Homo sapiens
gctgagcaggtgtaaggaaggc

SEQ ID NO: 9236956 - DNA, 22 bp, Homo sapiens
gctgcctgatcatacaccaggg

SEQ ID NO: 9236957 - DNA, 22 bp, Homo sapiens
gctgaggcagtccacccttgtg

SEQ ID NO: 9236958 - DNA, 22 bp, Homo sapiens
gctgaggattgaagagttgcca

SEQ ID NO: 9236959 - DNA, 20 bp, Homo sapiens
gctgaggattcctggcccct

SEQ ID NO: 9236960 - DNA, 20 bp, Homo sapiens
gctgaggattcctggcccct

SEQ ID NO: 9236961 - DNA, 22 bp, Homo sapiens
gctgaggatatagcaggaacaa

SEQ ID NO: 9236962 - DNA, 22 bp, Homo sapiens
gctgaggatatagcaggaacaa

SEQ ID NO: 9236963 - DNA, 22 bp, Homo sapiens
gctgaggatatagcaggaacaa

SEQ ID NO: 9236964 - DNA, 22 bp, Homo sapiens
gctgaggattacttgaagtcag

SEQ ID NO: 9236965 - DNA, 22 bp, Homo sapiens
gctgaggattacttgaagtcag

SEQ ID NO: 9236966 - DNA, 22 bp, Homo sapiens
gctgctctggctctgcagtgtc

SEQ ID NO: 9236967 - DNA, 19 bp, Homo sapiens
gctgctctgggtctcatct

SEQ ID NO: 9236968 - DNA, 22 bp, Homo sapiens
gctgctctcatagatggcttca

SEQ ID NO: 9236969 - DNA, 22 bp, Homo sapiens
gctgctctccaagcctccttga

SEQ ID NO: 9236970 - DNA, 22 bp, Homo sapiens
gctgcctgggctggcattccca

SEQ ID NO: 9236971 - DNA, 22 bp, Homo sapiens
gctgcctggtttctcagctgca

SEQ ID NO: 9236972 - DNA, 22 bp, Homo sapiens
gctgcctgtcccaggatgagga

SEQ ID NO: 9236973 - DNA, 22 bp, Homo sapiens
gctgctctacccatgcatctgt

SEQ ID NO: 9236974 - DNA, 20 bp, Homo sapiens
gctgctcgctgcagtcactc

SEQ ID NO: 9236975 - DNA, 22 bp, Homo sapiens
gctgctctgttaattgctgtaa

SEQ ID NO: 9236976 - DNA, 22 bp, Homo sapiens
gctgctctgggtctgcccagct

SEQ ID NO: 9236977 - DNA, 22 bp, Homo sapiens
gctgctctgggtctgcccagct

SEQ ID NO: 9236978 - DNA, 22 bp, Homo sapiens
gctgctctgtgacagcctccgg

SEQ ID NO: 9236979 - DNA, 22 bp, Homo sapiens
gctgctgcctgtagccagggtg

SEQ ID NO: 9236980 - DNA, 22 bp, Homo sapiens
gctgctgctggtctggggccac

SEQ ID NO: 9236981 - DNA, 21 bp, Homo sapiens
gctggagagccaggcaggggc

SEQ ID NO: 9236982 - DNA, 21 bp, Homo sapiens
gctggagagccaggcaggggc

SEQ ID NO: 9236983 - DNA, 22 bp, Homo sapiens
gctggagaggggtcactctgag

SEQ ID NO: 9236984 - DNA, 22 bp, Homo sapiens
gctggcctcgcaggcaggatgt

SEQ ID NO: 9236985 - DNA, 22 bp, Homo sapiens
gctggcctgagggccgaggctc

SEQ ID NO: 9236986 - DNA, 22 bp, Homo sapiens
gctggccaggtgctttggttct

SEQ ID NO: 9236987 - DNA, 22 bp, Homo sapiens
gctggagctgcagcctgggcct

SEQ ID NO: 9236988 - DNA, 22 bp, Homo sapiens
gctggccagggctgctcgcgga

SEQ ID NO: 9236989 - DNA, 22 bp, Homo sapiens
gctggcccagtgacccacagtg

SEQ ID NO: 9236990 - DNA, 22 bp, Homo sapiens
gctggagctgagttccctgggc

SEQ ID NO: 9236991 - DNA, 22 bp, Homo sapiens
gctggagctgagttccctgggc

SEQ ID NO: 9236992 - DNA, 22 bp, Homo sapiens
gctggagctgagttccctgggc

SEQ ID NO: 9236993 - DNA, 22 bp, Homo sapiens
gctggagctgagttccctgggc

SEQ ID NO: 9236994 - DNA, 22 bp, Homo sapiens
gctggagcgtgatccttgatct

SEQ ID NO: 9236995 - DNA, 22 bp, Homo sapiens
gctggagcgggttcgggccgct

SEQ ID NO: 9236996 - DNA, 22 bp, Homo sapiens
gctggagccttctgctctgttg

SEQ ID NO: 9236997 - DNA, 22 bp, Homo sapiens
gctggagccttctgctctgttg

SEQ ID NO: 9236998 - DNA, 22 bp, Homo sapiens
gctggagccttctgctctgttg

SEQ ID NO: 9236999 - DNA, 22 bp, Homo sapiens
gctggagccaagctgctcttgg

SEQ ID NO: 9237000 - DNA, 22 bp, Homo sapiens
gctggagccattggcttggcct

SEQ ID NO: 9237001 - DNA, 22 bp, Homo sapiens
gctggagccaagctgctcttgg

SEQ ID NO: 9237002 - DNA, 22 bp, Homo sapiens
gctggagccattggcttggcct

SEQ ID NO: 9237003 - DNA, 22 bp, Homo sapiens
gctggagccattggcttggcct

SEQ ID NO: 9237004 - DNA, 22 bp, Homo sapiens
gctggagatgctatgcagaggg

SEQ ID NO: 9237005 - DNA, 22 bp, Homo sapiens
gctggagatgctatgcagaggg

SEQ ID NO: 9237006 - DNA, 22 bp, Homo sapiens
gctggagatgctatgcagaggg

SEQ ID NO: 9237007 - DNA, 22 bp, Homo sapiens
gctggagatagaatggccactg

SEQ ID NO: 9237008 - DNA, 22 bp, Homo sapiens
gctggagatactgctcagtatc

SEQ ID NO: 9237009 - DNA, 22 bp, Homo sapiens
gctggagatactgctcagtatc

SEQ ID NO: 9237010 - DNA, 22 bp, Homo sapiens
gctggagatagaatggccactg

SEQ ID NO: 9237011 - DNA, 22 bp, Homo sapiens
gctggagagtagtaagcagtta

SEQ ID NO: 9237012 - DNA, 22 bp, Homo sapiens
gctggagagtagtaagcagtta

SEQ ID NO: 9237013 - DNA, 22 bp, Homo sapiens
gctggagagtgaggggagcaag

SEQ ID NO: 9237014 - DNA, 22 bp, Homo sapiens
gctggagagtgaggggagcaag

SEQ ID NO: 9237015 - DNA, 22 bp, Homo sapiens
gctggagatactgctcagtatc

SEQ ID NO: 9237016 - DNA, 22 bp, Homo sapiens
gctggagatactgctcagtatc

SEQ ID NO: 9237017 - DNA, 22 bp, Homo sapiens
gctgggcagcccctacagagag

SEQ ID NO: 9237018 - DNA, 22 bp, Homo sapiens
gctgggcagcccctacagagag

SEQ ID NO: 9237019 - DNA, 22 bp, Homo sapiens
gctgggcagcccctacagagag

SEQ ID NO: 9237020 - DNA, 22 bp, Homo sapiens
gctgggcagcccctacagagag

SEQ ID NO: 9237021 - DNA, 22 bp, Homo sapiens
gctgggcagctgaggcctctca

SEQ ID NO: 9237022 - DNA, 22 bp, Homo sapiens
gctgggcagcctggccgctgcc

SEQ ID NO: 9237023 - DNA, 22 bp, Homo sapiens
gctgggcagcctggccgctgcc

SEQ ID NO: 9237024 - DNA, 22 bp, Homo sapiens
gctgggcagcctggccgctgcc

SEQ ID NO: 9237025 - DNA, 22 bp, Homo sapiens
gctgggcaggcctcgtgagggc

SEQ ID NO: 9237026 - DNA, 22 bp, Homo sapiens
gctgggcagtgagtgagtcctt

SEQ ID NO: 9237027 - DNA, 22 bp, Homo sapiens
gctgggcagtgagtgagtcctt

SEQ ID NO: 9237028 - DNA, 22 bp, Homo sapiens
gctgggcagctgaggcctctca

SEQ ID NO: 9237029 - DNA, 22 bp, Homo sapiens
gctgggcaggcctcgtgagggc

SEQ ID NO: 9237030 - DNA, 22 bp, Homo sapiens
gctgggcaacggaagagagaaa

SEQ ID NO: 9237031 - DNA, 22 bp, Homo sapiens
gctgggcaacgggcagaaagat

SEQ ID NO: 9237032 - DNA, 22 bp, Homo sapiens
gctgggcaaggctgaagctacc

SEQ ID NO: 9237033 - DNA, 22 bp, Homo sapiens
gctgggcaaggctgaagctacc

SEQ ID NO: 9237034 - DNA, 22 bp, Homo sapiens
gctgggcaacgggcagaaagat

SEQ ID NO: 9237035 - DNA, 22 bp, Homo sapiens
gctgggcaaggctgaagctacc

SEQ ID NO: 9237036 - DNA, 22 bp, Homo sapiens
gctgggcaatgccagagaggag

SEQ ID NO: 9237037 - DNA, 22 bp, Homo sapiens
gctgggcaatgccagagaggag

SEQ ID NO: 9237038 - DNA, 22 bp, Homo sapiens
gctgggcaagtgccttgggttt

SEQ ID NO: 9237039 - DNA, 22 bp, Homo sapiens
gctgggcaatgccagagaggag

SEQ ID NO: 9237040 - DNA, 22 bp, Homo sapiens
gctgggcaatgccagagaggag

SEQ ID NO: 9237041 - DNA, 22 bp, Homo sapiens
gctgggcaccggagagacccca

SEQ ID NO: 9237042 - DNA, 22 bp, Homo sapiens
gctgggcaccggagagacccca

SEQ ID NO: 9237043 - DNA, 22 bp, Homo sapiens
gctgggcaccggagagacccca

SEQ ID NO: 9237044 - DNA, 22 bp, Homo sapiens
gctgggcactgtcccataggct

SEQ ID NO: 9237045 - DNA, 22 bp, Homo sapiens
gctgggcacctctcccagattg

SEQ ID NO: 9237046 - DNA, 22 bp, Homo sapiens
gctgggcaccggagagacccca

SEQ ID NO: 9237047 - DNA, 22 bp, Homo sapiens
gctgggcactgtcccataggct

SEQ ID NO: 9237048 - DNA, 22 bp, Homo sapiens
gctgggcagcaggctctccggg

SEQ ID NO: 9237049 - DNA, 22 bp, Homo sapiens
gctgggcactgtcccataggct

SEQ ID NO: 9237050 - DNA, 22 bp, Homo sapiens
gctgggagtgggcaagatgaga

SEQ ID NO: 9237051 - DNA, 22 bp, Homo sapiens
gctgggagttactgtctccttt

SEQ ID NO: 9237052 - DNA, 22 bp, Homo sapiens
gctgggagttactgtctccttt

SEQ ID NO: 9237053 - DNA, 22 bp, Homo sapiens
gctgggagttactgtctccttt

SEQ ID NO: 9237054 - DNA, 22 bp, Homo sapiens
gctgggagtttgatttgactgg

SEQ ID NO: 9237055 - DNA, 22 bp, Homo sapiens
gctgggcaacggaagagagaaa

SEQ ID NO: 9237056 - DNA, 22 bp, Homo sapiens
gctgggatgcgtcttcccaggc

SEQ ID NO: 9237057 - DNA, 22 bp, Homo sapiens
gctgggatgcgtcttcccaggc

SEQ ID NO: 9237058 - DNA, 22 bp, Homo sapiens
gctgggatgcgtcttcccaggc

SEQ ID NO: 9237059 - DNA, 22 bp, Homo sapiens
gctggcctgggcagcctgtcgg

SEQ ID NO: 9237060 - DNA, 22 bp, Homo sapiens
gctggccttgtgtctgaggaag

SEQ ID NO: 9237061 - DNA, 22 bp, Homo sapiens
gctcactgccattctctagatg

SEQ ID NO: 9237062 - DNA, 22 bp, Homo sapiens
gctcactgcaagctccgcctcc

SEQ ID NO: 9237063 - DNA, 22 bp, Homo sapiens
gctcactgcaagctctgcctcc

SEQ ID NO: 9237064 - DNA, 22 bp, Homo sapiens
gctcactgcaagctccgcctcc

SEQ ID NO: 9237065 - DNA, 22 bp, Homo sapiens
gctcactgcaagctctgcctcc

SEQ ID NO: 9237066 - DNA, 22 bp, Homo sapiens
gctcactgcaacctccgccttc

SEQ ID NO: 9237067 - DNA, 22 bp, Homo sapiens
gctcactgcaacctctgcctcc

SEQ ID NO: 9237068 - DNA, 22 bp, Homo sapiens
gccttaattgcagagcaatata

SEQ ID NO: 9237069 - DNA, 22 bp, Homo sapiens
gctcactgcaacctccgccttc

SEQ ID NO: 9237070 - DNA, 22 bp, Homo sapiens
gccttagcatcttaaagctgtg

SEQ ID NO: 9237071 - DNA, 22 bp, Homo sapiens
gctcactgcaacctctgcctcc

SEQ ID NO: 9237072 - DNA, 22 bp, Homo sapiens
gctcactgcaacctctgcttcc

SEQ ID NO: 9237073 - DNA, 22 bp, Homo sapiens
gcctgtttgtttgcaaaggagc

SEQ ID NO: 9237074 - DNA, 22 bp, Homo sapiens
gcctgtttgttatgtcatggta

SEQ ID NO: 9237075 - DNA, 22 bp, Homo sapiens
gcctgtttccatcaacacatgc

SEQ ID NO: 9237076 - DNA, 22 bp, Homo sapiens
gctcagaaatggcagatggaga

SEQ ID NO: 9237077 - DNA, 22 bp, Homo sapiens
gctcagaagatatttgatgctg

SEQ ID NO: 9237078 - DNA, 22 bp, Homo sapiens
gctcactggcctgaagaggacg

SEQ ID NO: 9237079 - DNA, 22 bp, Homo sapiens
gctcacttaatttcatgctaca

SEQ ID NO: 9237080 - DNA, 22 bp, Homo sapiens
gctcagagatggggaatgaaaa

SEQ ID NO: 9237081 - DNA, 22 bp, Homo sapiens
gctcatgactgtaatcccagca

SEQ ID NO: 9237082 - DNA, 22 bp, Homo sapiens
gctcatgggcccagagcagccc

SEQ ID NO: 9237083 - DNA, 22 bp, Homo sapiens
gctccactgcccctgggcaccg

SEQ ID NO: 9237084 - DNA, 22 bp, Homo sapiens
gctcattcagccagggcccggt

SEQ ID NO: 9237085 - DNA, 21 bp, Homo sapiens
gctcatggtggagaaaagcag

SEQ ID NO: 9237086 - DNA, 21 bp, Homo sapiens
gctcatggtggagaaaagcag

SEQ ID NO: 9237087 - DNA, 22 bp, Homo sapiens
gctccacttccttctgccctca

SEQ ID NO: 9237088 - DNA, 22 bp, Homo sapiens
gctccacttgcagctaggcttg

SEQ ID NO: 9237089 - DNA, 22 bp, Homo sapiens
gctccacttgcagctaggcttg

SEQ ID NO: 9237090 - DNA, 22 bp, Homo sapiens
gctccaggagagggaagcagat

SEQ ID NO: 9237091 - DNA, 22 bp, Homo sapiens
gctcctggctccaggcagccaa

SEQ ID NO: 9237092 - DNA, 22 bp, Homo sapiens
gctcctggctctctgagggctg

SEQ ID NO: 9237093 - DNA, 22 bp, Homo sapiens
gctcctggccagcacagggccc

SEQ ID NO: 9237094 - DNA, 22 bp, Homo sapiens
gctcctggccagcacagggccc

SEQ ID NO: 9237095 - DNA, 22 bp, Homo sapiens
gctcctggcaggcagtgtgtgt

SEQ ID NO: 9237096 - DNA, 22 bp, Homo sapiens
gctccaggagctcacagctcgc

SEQ ID NO: 9237097 - DNA, 22 bp, Homo sapiens
gctctgttcatcagtttgttgg

SEQ ID NO: 9237098 - DNA, 22 bp, Homo sapiens
gctcttccatttctcttgaact

SEQ ID NO: 9237099 - DNA, 22 bp, Homo sapiens
gctcttctcagattgtacactc

SEQ ID NO: 9237100 - DNA, 22 bp, Homo sapiens
gctcttctaaagaatgtacagg

SEQ ID NO: 9237101 - DNA, 22 bp, Homo sapiens
gctctgtgtccacagctggaaa

SEQ ID NO: 9237102 - DNA, 22 bp, Homo sapiens
gctgagagtgggtgcagtgctt

SEQ ID NO: 9237103 - DNA, 21 bp, Homo sapiens
gctgaagaactctttattttc

SEQ ID NO: 9237104 - DNA, 22 bp, Homo sapiens
gctgagagtgggtgcagtgctt

SEQ ID NO: 9237105 - DNA, 22 bp, Homo sapiens
gctgagattacgggcatgagcc

SEQ ID NO: 9237106 - DNA, 22 bp, Homo sapiens
gctgagattacgggcatgagcc

SEQ ID NO: 9237107 - DNA, 18 bp, Homo sapiens
gctgagcaaattcctccc

SEQ ID NO: 9237108 - DNA, 22 bp, Homo sapiens
gctgagcagggtggggaaaggc

SEQ ID NO: 9237109 - DNA, 22 bp, Homo sapiens
gctgagcacacctagggtagag

SEQ ID NO: 9237110 - DNA, 22 bp, Homo sapiens
gctgaaatgtctttagcagtgt

SEQ ID NO: 9237111 - DNA, 22 bp, Homo sapiens
gctgaaattagactgcagaagt

SEQ ID NO: 9237112 - DNA, 22 bp, Homo sapiens
gctgaaattcagattcctaggc

SEQ ID NO: 9237113 - DNA, 22 bp, Homo sapiens
gctgaaattcagattcctaggc

SEQ ID NO: 9237114 - DNA, 18 bp, Homo sapiens
gctgaaattctaaacaaa

SEQ ID NO: 9237115 - DNA, 22 bp, Homo sapiens
gctgaaatgggcactgaaggcc

SEQ ID NO: 9237116 - DNA, 22 bp, Homo sapiens
gctgaaatgccttgtaaatatt

SEQ ID NO: 9237117 - DNA, 22 bp, Homo sapiens
gctcctgggtgtggctgcccct

SEQ ID NO: 9237118 - DNA, 22 bp, Homo sapiens
gctcctgggtgtggctgcccct

SEQ ID NO: 9237119 - DNA, 22 bp, Homo sapiens
gctcctggtctggagcttcaag

SEQ ID NO: 9237120 - DNA, 22 bp, Homo sapiens
gctctctttaaactgcatggct

SEQ ID NO: 9237121 - DNA, 22 bp, Homo sapiens
gctctctttaaactgcatggct

SEQ ID NO: 9237122 - DNA, 22 bp, Homo sapiens
gctctctttttccagtggtggt

SEQ ID NO: 9237123 - DNA, 22 bp, Homo sapiens
gctcctggctctggccaaggga

SEQ ID NO: 9237124 - DNA, 16 bp, Homo sapiens
gctcctgggccctcga

SEQ ID NO: 9237125 - DNA, 19 bp, Homo sapiens
gctcctgggcctcactcat

SEQ ID NO: 9237126 - DNA, 19 bp, Homo sapiens
gctcctgggcctcactcat

SEQ ID NO: 9237127 - DNA, 22 bp, Homo sapiens
gctctgaggagccaagaatgtg

SEQ ID NO: 9237128 - DNA, 22 bp, Homo sapiens
gctctgagtcacactgccctgt

SEQ ID NO: 9237129 - DNA, 22 bp, Homo sapiens
gctctgagtgatcagctgggaa

SEQ ID NO: 9237130 - DNA, 22 bp, Homo sapiens
gcctgggaaatggtggggtcag

SEQ ID NO: 9237131 - DNA, 22 bp, Homo sapiens
gcctgggaaagagtagggaaat

SEQ ID NO: 9237132 - DNA, 21 bp, Homo sapiens
gcctgggaaatctgggaagcc

SEQ ID NO: 9237133 - DNA, 22 bp, Homo sapiens
gcctggccgggtcttggatttt

SEQ ID NO: 9237134 - DNA, 23 bp, Homo sapiens
gcctggccaccccagggctgctt

SEQ ID NO: 9237135 - DNA, 22 bp, Homo sapiens
gcctggcccagggctcttgttg

SEQ ID NO: 9237136 - DNA, 22 bp, Homo sapiens
gcctggcccagggctccgcagg

SEQ ID NO: 9237137 - DNA, 22 bp, Homo sapiens
gcctggccgctccgagctccgc

SEQ ID NO: 9237138 - DNA, 22 bp, Homo sapiens
gcctggccgctccgagctccgc

SEQ ID NO: 9237139 - DNA, 22 bp, Homo sapiens
gcctggcagtgatgtcttttgg

SEQ ID NO: 9237140 - DNA, 21 bp, Homo sapiens
gcctggcaggtggaagggctc

SEQ ID NO: 9237141 - DNA, 21 bp, Homo sapiens
gcctggcaggtggaagggctc

SEQ ID NO: 9237142 - DNA, 22 bp, Homo sapiens
gcctggcaggggcctgggagtg

SEQ ID NO: 9237143 - DNA, 21 bp, Homo sapiens
gcctggcaggtggaagggctc

SEQ ID NO: 9237144 - DNA, 22 bp, Homo sapiens
gcctggagtactccttgaagtg

SEQ ID NO: 9237145 - DNA, 22 bp, Homo sapiens
gcctggagtagcatggcaagcc

SEQ ID NO: 9237146 - DNA, 22 bp, Homo sapiens
gcctggagtactccttgaagtg

SEQ ID NO: 9237147 - DNA, 22 bp, Homo sapiens
gcctggagtactccttgaagtg

SEQ ID NO: 9237148 - DNA, 22 bp, Homo sapiens
gcctggcaggcctgggccagca

SEQ ID NO: 9237149 - DNA, 22 bp, Homo sapiens
gcctggcaggcctgggccagca

SEQ ID NO: 9237150 - DNA, 22 bp, Homo sapiens
gcctggcagggcccggacggca

SEQ ID NO: 9237151 - DNA, 23 bp, Homo sapiens
gcctgggactcaggaggagctca

SEQ ID NO: 9237152 - DNA, 23 bp, Homo sapiens
gcctgggactcaggaggagctca

SEQ ID NO: 9237153 - DNA, 22 bp, Homo sapiens
gcctgggactgcagatccccag

SEQ ID NO: 9237154 - DNA, 23 bp, Homo sapiens
gcctgggactcaggaggagctca

SEQ ID NO: 9237155 - DNA, 23 bp, Homo sapiens
gcctgggactggtagtgtgacct

SEQ ID NO: 9237156 - DNA, 23 bp, Homo sapiens
gcctgggactggtagtgtgacct

SEQ ID NO: 9237157 - DNA, 23 bp, Homo sapiens
gcctgggactcaggaggagctca

SEQ ID NO: 9237158 - DNA, 21 bp, Homo sapiens
gcctgggaagagaaaggtaag

SEQ ID NO: 9237159 - DNA, 22 bp, Homo sapiens
gcctgggaagactaagtgggag

SEQ ID NO: 9237160 - DNA, 22 bp, Homo sapiens
gcctgggaactctgatctcctg

SEQ ID NO: 9237161 - DNA, 22 bp, Homo sapiens
gcctgggattcccagaggggca

SEQ ID NO: 9237162 - DNA, 22 bp, Homo sapiens
gcctgggattctcaaaggggtg

SEQ ID NO: 9237163 - DNA, 19 bp, Homo sapiens
gcctgggatgggcagaact

SEQ ID NO: 9237164 - DNA, 20 bp, Homo sapiens
gcctgggattatccactggt

SEQ ID NO: 9237165 - DNA, 19 bp, Homo sapiens
gcctgggatgggcagaact

SEQ ID NO: 9237166 - DNA, 21 bp, Homo sapiens
gcctgggatagtggcctccgg

SEQ ID NO: 9237167 - DNA, 22 bp, Homo sapiens
gcctgggatagaggcaatgcat

SEQ ID NO: 9237168 - DNA, 22 bp, Homo sapiens
gcctgggattgtgtaagtgaat

SEQ ID NO: 9237169 - DNA, 22 bp, Homo sapiens
gcctggtgtccagaggcgagtg

SEQ ID NO: 9237170 - DNA, 22 bp, Homo sapiens
gcctggtgtctccccaaggaag

SEQ ID NO: 9237171 - DNA, 22 bp, Homo sapiens
gcctggtgtgcgccgcgcagct

SEQ ID NO: 9237172 - DNA, 22 bp, Homo sapiens
gcctgtgtcatgtagtagcttc

SEQ ID NO: 9237173 - DNA, 22 bp, Homo sapiens
gcctgtgtggatgcgccggtgc

SEQ ID NO: 9237174 - DNA, 22 bp, Homo sapiens
gcctggagcctcagcaaggagg

SEQ ID NO: 9237175 - DNA, 20 bp, Homo sapiens
gcctggaggcaatgggaaga

SEQ ID NO: 9237176 - DNA, 22 bp, Homo sapiens
gcctggagcctcagcaaggagg

SEQ ID NO: 9237177 - DNA, 20 bp, Homo sapiens
gcctggaggcagagataaag

SEQ ID NO: 9237178 - DNA, 22 bp, Homo sapiens
gcctggagggatagaatgcaag

SEQ ID NO: 9237179 - DNA, 22 bp, Homo sapiens
gcctggagggctctagagaggc

SEQ ID NO: 9237180 - DNA, 22 bp, Homo sapiens
gcctggagggctctagagaggc

SEQ ID NO: 9237181 - DNA, 22 bp, Homo sapiens
gcctggagggctctagagaggc

SEQ ID NO: 9237182 - DNA, 22 bp, Homo sapiens
gcctggaggggacagtctctgg

SEQ ID NO: 9237183 - DNA, 22 bp, Homo sapiens
gcctggaggggacagtctctgg

SEQ ID NO: 9237184 - DNA, 22 bp, Homo sapiens
gcctggagggtccctctctgga

SEQ ID NO: 9237185 - DNA, 22 bp, Homo sapiens
gcctggagggtccctctctgga

SEQ ID NO: 9237186 - DNA, 22 bp, Homo sapiens
gcctggagggtccctctctgga

SEQ ID NO: 9237187 - DNA, 22 bp, Homo sapiens
gcctggaggggccagggtggta

SEQ ID NO: 9237188 - DNA, 22 bp, Homo sapiens
gcctgccttttggaggcacatt

SEQ ID NO: 9237189 - DNA, 22 bp, Homo sapiens
gcctgcctttgtgaggaagcgg

SEQ ID NO: 9237190 - DNA, 22 bp, Homo sapiens
gcctgcctttgtgaggaagcgg

SEQ ID NO: 9237191 - DNA, 22 bp, Homo sapiens
gcctgccttttggaggcacatt

SEQ ID NO: 9237192 - DNA, 22 bp, Homo sapiens
gcctgcttctcagtcagcttgg

SEQ ID NO: 9237193 - DNA, 22 bp, Homo sapiens
gcctgctttaagtctgttgcct

SEQ ID NO: 9237194 - DNA, 22 bp, Homo sapiens
gcctgctttgtgcctgatcttt

SEQ ID NO: 9237195 - DNA, 19 bp, Homo sapiens
gcctgcctgggtttctgag

SEQ ID NO: 9237196 - DNA, 19 bp, Homo sapiens
gcctgcctgggtttctgag

SEQ ID NO: 9237197 - DNA, 19 bp, Homo sapiens
gcctgcctgggtttctgag

SEQ ID NO: 9237198 - DNA, 22 bp, Homo sapiens
gcctgcctgttggctgaggtgc

SEQ ID NO: 9237199 - DNA, 22 bp, Homo sapiens
gcctgcctgttggctgaggtgc

SEQ ID NO: 9237200 - DNA, 22 bp, Homo sapiens
gcctgcctgttggctgaggtgc

SEQ ID NO: 9237201 - DNA, 22 bp, Homo sapiens
gcctgcctgttggctgaggtgc

SEQ ID NO: 9237202 - DNA, 22 bp, Homo sapiens
gcctgccttcggtgcgcagcgg

SEQ ID NO: 9237203 - DNA, 22 bp, Homo sapiens
gcctgcctttgtatgaccctga

SEQ ID NO: 9237204 - DNA, 22 bp, Homo sapiens
gcctgcctttgtatgaccctga

SEQ ID NO: 9237205 - DNA, 22 bp, Homo sapiens
gcctgcctttgtatgaccctga

SEQ ID NO: 9237206 - DNA, 22 bp, Homo sapiens
gcctgcctttgtgaggaagcgg

SEQ ID NO: 9237207 - DNA, 22 bp, Homo sapiens
gcctgccttcggtgcgcagcgg

SEQ ID NO: 9237208 - DNA, 22 bp, Homo sapiens
gcctgcctgctgtgtgcaagtt

SEQ ID NO: 9237209 - DNA, 22 bp, Homo sapiens
gcctgcctgctgtgtgcaagtt

SEQ ID NO: 9237210 - DNA, 22 bp, Homo sapiens
gcctgcctggagcttgaggtga

SEQ ID NO: 9237211 - DNA, 22 bp, Homo sapiens
gcctgcctggagcttgaggtga

SEQ ID NO: 9237212 - DNA, 22 bp, Homo sapiens
gcctgcctggagcttgaggtga

SEQ ID NO: 9237213 - DNA, 19 bp, Homo sapiens
gcctgcctgggtttctgag

SEQ ID NO: 9237214 - DNA, 22 bp, Homo sapiens
gcctgcctggagcttgaggtga

SEQ ID NO: 9237215 - DNA, 22 bp, Homo sapiens
gcctgcctgctgtcatctgcct

SEQ ID NO: 9237216 - DNA, 22 bp, Homo sapiens
gcctgcctgctgtcatctgcct

SEQ ID NO: 9237217 - DNA, 22 bp, Homo sapiens
gcctgcctgctgtcatctgcct

SEQ ID NO: 9237218 - DNA, 22 bp, Homo sapiens
gcctgcctgctgtcatctgcct

SEQ ID NO: 9237219 - DNA, 21 bp, Homo sapiens
gcctgcctgcgtgaccctctt

SEQ ID NO: 9237220 - DNA, 21 bp, Homo sapiens
gcctgcctgcgtgaccctctt

SEQ ID NO: 9237221 - DNA, 18 bp, Homo sapiens
gcctgcctagagcttgcc

SEQ ID NO: 9237222 - DNA, 22 bp, Homo sapiens
gcctgccacgcatgcagagtca

SEQ ID NO: 9237223 - DNA, 22 bp, Homo sapiens
gcctgccaaaagaagctgctgg

SEQ ID NO: 9237224 - DNA, 23 bp, Homo sapiens
gcctctggagccccagtgctcag

SEQ ID NO: 9237225 - DNA, 20 bp, Homo sapiens
gcctgcctcagctagctgag

SEQ ID NO: 9237226 - DNA, 20 bp, Homo sapiens
gcctgcctcagctagctgag

SEQ ID NO: 9237227 - DNA, 22 bp, Homo sapiens
gcctgcctcaaaatcccagttc

SEQ ID NO: 9237228 - DNA, 20 bp, Homo sapiens
gcctgcctcagctagctgag

SEQ ID NO: 9237229 - DNA, 18 bp, Homo sapiens
gcctgcctagagcttgcc

SEQ ID NO: 9237230 - DNA, 22 bp, Homo sapiens
gcctgcctcaaaatcccagttc

SEQ ID NO: 9237231 - DNA, 22 bp, Homo sapiens
gcctgcctcaaaatcccagttc

SEQ ID NO: 9237232 - DNA, 20 bp, Homo sapiens
gcctgcctcagctagctgag

SEQ ID NO: 9237233 - DNA, 22 bp, Homo sapiens
gcctgcctgaaggctgtaccag

SEQ ID NO: 9237234 - DNA, 22 bp, Homo sapiens
gcctgcctgaaggctgtaccag

SEQ ID NO: 9237235 - DNA, 21 bp, Homo sapiens
gcctgcctgcgtgaccctctt

SEQ ID NO: 9237236 - DNA, 23 bp, Homo sapiens
gcctgcctgacctgtgcaaagtc

SEQ ID NO: 9237237 - DNA, 23 bp, Homo sapiens
gcctgcctgacctgtgcaaagtc

SEQ ID NO: 9237238 - DNA, 22 bp, Homo sapiens
gcccaggctggagtgcagtggc

SEQ ID NO: 9237239 - DNA, 22 bp, Homo sapiens
gcccaggattctttcttcctta

SEQ ID NO: 9237240 - DNA, 22 bp, Homo sapiens
gcccaggattctttcttcctta

SEQ ID NO: 9237241 - DNA, 22 bp, Homo sapiens
gcccaggatggctggaggtgct

SEQ ID NO: 9237242 - DNA, 22 bp, Homo sapiens
gcccaggatggtgtgtagtggt

SEQ ID NO: 9237243 - DNA, 22 bp, Homo sapiens
gcccaggatggtgtgtagtggt

SEQ ID NO: 9237244 - DNA, 20 bp, Homo sapiens
gcccaggatctctgaggcat

SEQ ID NO: 9237245 - DNA, 20 bp, Homo sapiens
gcccaggatctctgaggcat

SEQ ID NO: 9237246 - DNA, 22 bp, Homo sapiens
gcccaggatggctggaggtgct

SEQ ID NO: 9237247 - DNA, 22 bp, Homo sapiens
gcccaggatggagaatagtggt

SEQ ID NO: 9237248 - DNA, 22 bp, Homo sapiens
gcccaggatggagaatagtggt

SEQ ID NO: 9237249 - DNA, 22 bp, Homo sapiens
gcccaggatctgctcagatcat

SEQ ID NO: 9237250 - DNA, 22 bp, Homo sapiens
gcccaggatctgctcagatcat

SEQ ID NO: 9237251 - DNA, 22 bp, Homo sapiens
gcccaggagttggtggctgcag

SEQ ID NO: 9237252 - DNA, 22 bp, Homo sapiens
gcccaggagtttgcattttaac

SEQ ID NO: 9237253 - DNA, 22 bp, Homo sapiens
gcccaggagttggtggctgcag

SEQ ID NO: 9237254 - DNA, 22 bp, Homo sapiens
gcccaggagttggaggctgcag

SEQ ID NO: 9237255 - DNA, 22 bp, Homo sapiens
gcccaggataatgctgtccctg

SEQ ID NO: 9237256 - DNA, 22 bp, Homo sapiens
gcccaggagtttgcattttaac

SEQ ID NO: 9237257 - DNA, 22 bp, Homo sapiens
gcccaggataatgctgtccctg

SEQ ID NO: 9237258 - DNA, 23 bp, Homo sapiens
gccatcacgttcaaccaaagcct

SEQ ID NO: 9237259 - DNA, 23 bp, Homo sapiens
gccatggctgccccacaggcctc

SEQ ID NO: 9237260 - DNA, 23 bp, Homo sapiens
gccatggctgccccacaggcctc

SEQ ID NO: 9237261 - DNA, 22 bp, Homo sapiens
gccatgggcaaatgcagagctg

SEQ ID NO: 9237262 - DNA, 19 bp, Homo sapiens
gccatgggctggcagcaga

SEQ ID NO: 9237263 - DNA, 22 bp, Homo sapiens
gccatggggctcagctgcacta

SEQ ID NO: 9237264 - DNA, 22 bp, Homo sapiens
gccatgggtctgctggctcagc

SEQ ID NO: 9237265 - DNA, 22 bp, Homo sapiens
gccatgtgggcagaggaggctg

SEQ ID NO: 9237266 - DNA, 22 bp, Homo sapiens
gcccaggaggagaggctgcagt

SEQ ID NO: 9237267 - DNA, 22 bp, Homo sapiens
gcccaggaggagaggctgcagt

SEQ ID NO: 9237268 - DNA, 22 bp, Homo sapiens
gcccaggagttgaatgcagcag

SEQ ID NO: 9237269 - DNA, 22 bp, Homo sapiens
gcccaggagttggaggctgcag

SEQ ID NO: 9237270 - DNA, 22 bp, Homo sapiens
gcccaggagttggaggctgcag

SEQ ID NO: 9237271 - DNA, 22 bp, Homo sapiens
gcccaggaggcagaggttgtgg

SEQ ID NO: 9237272 - DNA, 22 bp, Homo sapiens
gcccaggaggcagaggttgtgg

SEQ ID NO: 9237273 - DNA, 22 bp, Homo sapiens
gccagtggtgagattccctggg

SEQ ID NO: 9237274 - DNA, 22 bp, Homo sapiens
gccagtgtgcaagaggccacca

SEQ ID NO: 9237275 - DNA, 19 bp, Homo sapiens
gccagtgtgtggtacagtg

SEQ ID NO: 9237276 - DNA, 22 bp, Homo sapiens
gccagtgtttatagcagtgagg

SEQ ID NO: 9237277 - DNA, 22 bp, Homo sapiens
gccagttcctgtggagtcagag

SEQ ID NO: 9237278 - DNA, 22 bp, Homo sapiens
gccagtggtcactgaggaagaa

SEQ ID NO: 9237279 - DNA, 22 bp, Homo sapiens
gccagtggtcactgaggaagaa

SEQ ID NO: 9237280 - DNA, 22 bp, Homo sapiens
gccagtggtcactgaggaagaa

SEQ ID NO: 9237281 - DNA, 22 bp, Homo sapiens
gccagtggtcagtgggagggtg

SEQ ID NO: 9237282 - DNA, 22 bp, Homo sapiens
gccagtggtcagtgggagggtg

SEQ ID NO: 9237283 - DNA, 22 bp, Homo sapiens
gccaggctgtttttattactgt

SEQ ID NO: 9237284 - DNA, 22 bp, Homo sapiens
gccaggctgtttttattactgt

SEQ ID NO: 9237285 - DNA, 22 bp, Homo sapiens
gccaggctgtttttattactgt

SEQ ID NO: 9237286 - DNA, 22 bp, Homo sapiens
gccaggctgtttttattactgt

SEQ ID NO: 9237287 - DNA, 22 bp, Homo sapiens
gccaggctgtttttattactgt

SEQ ID NO: 9237288 - DNA, 22 bp, Homo sapiens
gccaggctgtggggaacttgaa

SEQ ID NO: 9237289 - DNA, 22 bp, Homo sapiens
gccaggctgtggggaacttgaa

SEQ ID NO: 9237290 - DNA, 22 bp, Homo sapiens
gccaggctgtggggaacttgaa

SEQ ID NO: 9237291 - DNA, 22 bp, Homo sapiens
gccaggctggtgtcacaactct

SEQ ID NO: 9237292 - DNA, 22 bp, Homo sapiens
gccaggctggtgtcacaactct

SEQ ID NO: 9237293 - DNA, 22 bp, Homo sapiens
gccaggctggtgcaaggatatt

SEQ ID NO: 9237294 - DNA, 22 bp, Homo sapiens
gccaggctggtgtcacaactct

SEQ ID NO: 9237295 - DNA, 22 bp, Homo sapiens
gccaggctgtggggaacttgaa

SEQ ID NO: 9237296 - DNA, 22 bp, Homo sapiens
gccaggctggttatttaatgag

SEQ ID NO: 9237297 - DNA, 22 bp, Homo sapiens
gccaggctggttatttaatgag

SEQ ID NO: 9237298 - DNA, 22 bp, Homo sapiens
gccaggctggtgtcacaactct

SEQ ID NO: 9237299 - DNA, 22 bp, Homo sapiens
gccaggctggtgtcacaactct

SEQ ID NO: 9237300 - DNA, 22 bp, Homo sapiens
gccaggctggttatttaatgag

SEQ ID NO: 9237301 - DNA, 22 bp, Homo sapiens
gccaggctgctggctgctgtcc

SEQ ID NO: 9237302 - DNA, 22 bp, Homo sapiens
gccaggctgctggctgctgtcc

SEQ ID NO: 9237303 - DNA, 22 bp, Homo sapiens
gccaggctgctccagggaggcc

SEQ ID NO: 9237304 - DNA, 22 bp, Homo sapiens
gccaggctgctccagggaggcc

SEQ ID NO: 9237305 - DNA, 22 bp, Homo sapiens
gccaggctgctccagggaggcc

SEQ ID NO: 9237306 - DNA, 22 bp, Homo sapiens
gccaggctgccttatctctagc

SEQ ID NO: 9237307 - DNA, 22 bp, Homo sapiens
gccaggctgccttatctctagc

SEQ ID NO: 9237308 - DNA, 22 bp, Homo sapiens
gccaggctgaggctctggaaga

SEQ ID NO: 9237309 - DNA, 22 bp, Homo sapiens
gccaggctgactcccccggcct

SEQ ID NO: 9237310 - DNA, 22 bp, Homo sapiens
gccaggctgaggctctggaaga

SEQ ID NO: 9237311 - DNA, 22 bp, Homo sapiens
gccaggctgaggctctggaaga

SEQ ID NO: 9237312 - DNA, 22 bp, Homo sapiens
gccaggctgccttatctctagc

SEQ ID NO: 9237313 - DNA, 22 bp, Homo sapiens
gccaggctgactcccccggcct

SEQ ID NO: 9237314 - DNA, 22 bp, Homo sapiens
gccaggctcttggttatgtttt

SEQ ID NO: 9237315 - DNA, 22 bp, Homo sapiens
gccaggctcttggttatgtttt

SEQ ID NO: 9237316 - DNA, 22 bp, Homo sapiens
gccaggctgactcccccggcct

SEQ ID NO: 9237317 - DNA, 22 bp, Homo sapiens
gccaggctcttggttatgtttt

SEQ ID NO: 9237318 - DNA, 22 bp, Homo sapiens
gccaggctcttggttatgtttt

SEQ ID NO: 9237319 - DNA, 22 bp, Homo sapiens
gccaggctcttccatttgggtc

SEQ ID NO: 9237320 - DNA, 22 bp, Homo sapiens
gccaggctcttccatttgggtc

SEQ ID NO: 9237321 - DNA, 19 bp, Homo sapiens
gccaggctcttattctgtg

SEQ ID NO: 9237322 - DNA, 22 bp, Homo sapiens
gccaggctctcagtgactgccc

SEQ ID NO: 9237323 - DNA, 19 bp, Homo sapiens
gccaggctcttattctgtg

SEQ ID NO: 9237324 - DNA, 22 bp, Homo sapiens
gccaggctctcagtgactgccc

SEQ ID NO: 9237325 - DNA, 19 bp, Homo sapiens
gccaggctcttattctgtg

SEQ ID NO: 9237326 - DNA, 22 bp, Homo sapiens
gccaggctctcagtgactgccc

SEQ ID NO: 9237327 - DNA, 22 bp, Homo sapiens
gccgaagacgctgggcgtgggc

SEQ ID NO: 9237328 - DNA, 22 bp, Homo sapiens
gccgaggctctgcccagctgct

SEQ ID NO: 9237329 - DNA, 22 bp, Homo sapiens
gccggggctggggagagacatg

SEQ ID NO: 9237330 - DNA, 22 bp, Homo sapiens
gccggggctggggagagacatg

SEQ ID NO: 9237331 - DNA, 22 bp, Homo sapiens
gccggggctggggagagacatg

SEQ ID NO: 9237332 - DNA, 22 bp, Homo sapiens
gccgggaccaaggccacggagc

SEQ ID NO: 9237333 - DNA, 19 bp, Homo sapiens
gccgggcccgggttggccg

SEQ ID NO: 9237334 - DNA, 22 bp, Homo sapiens
gccgggttcaagccattctcct

SEQ ID NO: 9237335 - DNA, 22 bp, Homo sapiens
gccgggttcaagccattctcct

SEQ ID NO: 9237336 - DNA, 22 bp, Homo sapiens
gccgttagataataacaagcat

SEQ ID NO: 9237337 - DNA, 22 bp, Homo sapiens
gccgtgggtgtcatggcccata

SEQ ID NO: 9237338 - DNA, 22 bp, Homo sapiens
gcctctgcatcatcactccagc

SEQ ID NO: 9237339 - DNA, 19 bp, Homo sapiens
gcctctgctggggacaggc

SEQ ID NO: 9237340 - DNA, 22 bp, Homo sapiens
gcctctgcggagctgtacatca

SEQ ID NO: 9237341 - DNA, 22 bp, Homo sapiens
gcccttataaacaaggcttcag

SEQ ID NO: 9237342 - DNA, 22 bp, Homo sapiens
gcccttagtcagcactttcact

SEQ ID NO: 9237343 - DNA, 22 bp, Homo sapiens
gcccttaggtactacttattct

SEQ ID NO: 9237344 - DNA, 22 bp, Homo sapiens
gcccttcagttactccttgatg

SEQ ID NO: 9237345 - DNA, 22 bp, Homo sapiens
gcccttgacagtggcagaagca

SEQ ID NO: 9237346 - DNA, 22 bp, Homo sapiens
gcccttgggaggttccactggg

SEQ ID NO: 9237347 - DNA, 22 bp, Homo sapiens
gcccttacagggtggtcagcca

SEQ ID NO: 9237348 - DNA, 22 bp, Homo sapiens
gcccttacagggtggtcagcca

SEQ ID NO: 9237349 - DNA, 22 bp, Homo sapiens
gccctgttttctgggttccttg

SEQ ID NO: 9237350 - DNA, 22 bp, Homo sapiens
gcccttagccttatagcctcta

SEQ ID NO: 9237351 - DNA, 22 bp, Homo sapiens
gcccttaggcaagcagaagccc

SEQ ID NO: 9237352 - DNA, 22 bp, Homo sapiens
gcccttaggcaagcagaagccc

SEQ ID NO: 9237353 - DNA, 22 bp, Homo sapiens
gcccttagggccactgtcactg

SEQ ID NO: 9237354 - DNA, 19 bp, Homo sapiens
gccctcaggcagctccatc

SEQ ID NO: 9237355 - DNA, 19 bp, Homo sapiens
gccctcaggcagctccatc

SEQ ID NO: 9237356 - DNA, 21 bp, Homo sapiens
gccctcaggggaggatggcct

SEQ ID NO: 9237357 - DNA, 22 bp, Homo sapiens
gccctcctttgcttctcctagt

SEQ ID NO: 9237358 - DNA, 22 bp, Homo sapiens
gccctcagtgaccactgattca

SEQ ID NO: 9237359 - DNA, 22 bp, Homo sapiens
gccctctcttctgcagcctcca

SEQ ID NO: 9237360 - DNA, 22 bp, Homo sapiens
gccctctcggcatagcaggggc

SEQ ID NO: 9237361 - DNA, 22 bp, Homo sapiens
gccctcagcaggaaagatcaac

SEQ ID NO: 9237362 - DNA, 22 bp, Homo sapiens
gccctcagagttccccacagtg

SEQ ID NO: 9237363 - DNA, 22 bp, Homo sapiens
gccagcagcccagaaggacttt

SEQ ID NO: 9237364 - DNA, 19 bp, Homo sapiens
gccagcagaatgatgaggc

SEQ ID NO: 9237365 - DNA, 19 bp, Homo sapiens
gccagcagaatgatgaggc

SEQ ID NO: 9237366 - DNA, 19 bp, Homo sapiens
gccagcagaatgatgaggc

SEQ ID NO: 9237367 - DNA, 22 bp, Homo sapiens
gccagcagccacagaagtcact

SEQ ID NO: 9237368 - DNA, 22 bp, Homo sapiens
gccacagctcacgttccccatt

SEQ ID NO: 9237369 - DNA, 22 bp, Homo sapiens
gccacagctcacgttccccatt

SEQ ID NO: 9237370 - DNA, 22 bp, Homo sapiens
gccacagctccagtcaggtgac

SEQ ID NO: 9237371 - DNA, 22 bp, Homo sapiens
gccacagctccagtcaggtgac

SEQ ID NO: 9237372 - DNA, 22 bp, Homo sapiens
gccacagcttagatcacagcct

SEQ ID NO: 9237373 - DNA, 22 bp, Homo sapiens
gccacagcttagatcacagcct

SEQ ID NO: 9237374 - DNA, 22 bp, Homo sapiens
gccacaggcacttaagggctgg

SEQ ID NO: 9237375 - DNA, 22 bp, Homo sapiens
gccacagcttttaacctcgggg

SEQ ID NO: 9237376 - DNA, 22 bp, Homo sapiens
gccacagcttagatcacagcct

SEQ ID NO: 9237377 - DNA, 20 bp, Homo sapiens
gccagaggccggcaggggct

SEQ ID NO: 9237378 - DNA, 22 bp, Homo sapiens
gccagatgtagatagcaaggta

SEQ ID NO: 9237379 - DNA, 22 bp, Homo sapiens
gccagcaaagcaagttgtcagc

SEQ ID NO: 9237380 - DNA, 22 bp, Homo sapiens
gccagatttacagatttgccct

SEQ ID NO: 9237381 - DNA, 22 bp, Homo sapiens
gccagatttacagatttgccct

SEQ ID NO: 9237382 - DNA, 22 bp, Homo sapiens
gccacaggctccagcatcagta

SEQ ID NO: 9237383 - DNA, 20 bp, Homo sapiens
gccagaggccggcaggggct

SEQ ID NO: 9237384 - DNA, 20 bp, Homo sapiens
gccagaggccggcaggggct

SEQ ID NO: 9237385 - DNA, 22 bp, Homo sapiens
gccacaggctccagcatcagta

SEQ ID NO: 9237386 - DNA, 22 bp, Homo sapiens
gccacagcagggccctctcagg

SEQ ID NO: 9237387 - DNA, 22 bp, Homo sapiens
gccacagcccgagcaccatgag

SEQ ID NO: 9237388 - DNA, 22 bp, Homo sapiens
gccacagcccgagcaccatgag

SEQ ID NO: 9237389 - DNA, 22 bp, Homo sapiens
gcatgtggaatctctccatggt

SEQ ID NO: 9237390 - DNA, 22 bp, Homo sapiens
gcatgggctttctcagagttct

SEQ ID NO: 9237391 - DNA, 22 bp, Homo sapiens
gcatggtggagtctgagcaggg

SEQ ID NO: 9237392 - DNA, 22 bp, Homo sapiens
gcatgggaggacagtctgggct

SEQ ID NO: 9237393 - DNA, 22 bp, Homo sapiens
gcagtgttgagccagctggggg

SEQ ID NO: 9237394 - DNA, 22 bp, Homo sapiens
gcatgggaggacagtctgggct

SEQ ID NO: 9237395 - DNA, 22 bp, Homo sapiens
gcatgggaggacagtctgggct

SEQ ID NO: 9237396 - DNA, 22 bp, Homo sapiens
gcatgggcaagaggactggggg

SEQ ID NO: 9237397 - DNA, 22 bp, Homo sapiens
gcatgtggcccaaggaggctgt

SEQ ID NO: 9237398 - DNA, 22 bp, Homo sapiens
gcatgtggccttcaggctggaa

SEQ ID NO: 9237399 - DNA, 22 bp, Homo sapiens
gcatgtggccttcaggctggaa

SEQ ID NO: 9237400 - DNA, 22 bp, Homo sapiens
gcatgtgggagggtcttcccac

SEQ ID NO: 9237401 - DNA, 22 bp, Homo sapiens
gcatgtgggaacacttaggcac

SEQ ID NO: 9237402 - DNA, 22 bp, Homo sapiens
gcatgtggtgggctggccactc

SEQ ID NO: 9237403 - DNA, 22 bp, Homo sapiens
gcatgtggtgctgaggctgtcg

SEQ ID NO: 9237404 - DNA, 22 bp, Homo sapiens
gcatgtgtccctcagtctgtgc

SEQ ID NO: 9237405 - DNA, 22 bp, Homo sapiens
gcatgtgtctccccagtggagg

SEQ ID NO: 9237406 - DNA, 22 bp, Homo sapiens
gcatgtgtggaggagatgtgct

SEQ ID NO: 9237407 - DNA, 22 bp, Homo sapiens
gcagtgttctaaattgggtgtg

SEQ ID NO: 9237408 - DNA, 22 bp, Homo sapiens
gcagtgttcttgttgcttttat

SEQ ID NO: 9237409 - DNA, 22 bp, Homo sapiens
gcagtgttgactatggtatgag

SEQ ID NO: 9237410 - DNA, 22 bp, Homo sapiens
gcagtgttgagtggtggctgaa

SEQ ID NO: 9237411 - DNA, 22 bp, Homo sapiens
gcagtgttgagccagctggggg

SEQ ID NO: 9237412 - DNA, 22 bp, Homo sapiens
gcagtgttcagtgaagcaggag

SEQ ID NO: 9237413 - DNA, 22 bp, Homo sapiens
gcagtgttccttctactggggc

SEQ ID NO: 9237414 - DNA, 22 bp, Homo sapiens
gcagtgttatgttttctataat

SEQ ID NO: 9237415 - DNA, 22 bp, Homo sapiens
gcagtgttaggaataaaaatga

SEQ ID NO: 9237416 - DNA, 22 bp, Homo sapiens
gcagtggggcaatcatagctca

SEQ ID NO: 9237417 - DNA, 22 bp, Homo sapiens
gcagtggggaatgctggggaga

SEQ ID NO: 9237418 - DNA, 22 bp, Homo sapiens
gcagtggggaatgctggggaga

SEQ ID NO: 9237419 - DNA, 22 bp, Homo sapiens
gcagtggtccagttcacaccca

SEQ ID NO: 9237420 - DNA, 22 bp, Homo sapiens
gcagtggggcgctgggagttgg

SEQ ID NO: 9237421 - DNA, 22 bp, Homo sapiens
gcagtgggcaacaagagctgga

SEQ ID NO: 9237422 - DNA, 22 bp, Homo sapiens
gcagtgggcaacaagagctgga

SEQ ID NO: 9237423 - DNA, 22 bp, Homo sapiens
gcagtgggcaacaagagctgga

SEQ ID NO: 9237424 - DNA, 22 bp, Homo sapiens
gcagtaggagaagaggatgctt

SEQ ID NO: 9237425 - DNA, 22 bp, Homo sapiens
gcagtaggggctggagggctgt

SEQ ID NO: 9237426 - DNA, 18 bp, Homo sapiens
gcagtaggcgcgcaggac

SEQ ID NO: 9237427 - DNA, 22 bp, Homo sapiens
gcagtgggagcttaggcagtgc

SEQ ID NO: 9237428 - DNA, 22 bp, Homo sapiens
gcagtaagttaatagtgctggt

SEQ ID NO: 9237429 - DNA, 22 bp, Homo sapiens
gcagtactttaagggatgaagc

SEQ ID NO: 9237430 - DNA, 22 bp, Homo sapiens
gcagtactttatcacatggaat

SEQ ID NO: 9237431 - DNA, 23 bp, Homo sapiens
gcaggtggttcgaacagaagttt

SEQ ID NO: 9237432 - DNA, 22 bp, Homo sapiens
gcagggtgccgacttcagggat

SEQ ID NO: 9237433 - DNA, 22 bp, Homo sapiens
gcagggtgatagtgaggctcag

SEQ ID NO: 9237434 - DNA, 22 bp, Homo sapiens
gcagggtgacgttgcccacctc

SEQ ID NO: 9237435 - DNA, 19 bp, Homo sapiens
gcagggtggcagagctctt

SEQ ID NO: 9237436 - DNA, 22 bp, Homo sapiens
gcaggtggaagcagcagactca

SEQ ID NO: 9237437 - DNA, 22 bp, Homo sapiens
gcaggtggagcagtagtctggt

SEQ ID NO: 9237438 - DNA, 22 bp, Homo sapiens
gcaggtggagcagtagtctggt

SEQ ID NO: 9237439 - DNA, 19 bp, Homo sapiens
gcaggtggatgtggtcagc

SEQ ID NO: 9237440 - DNA, 22 bp, Homo sapiens
gcaggtggattatcagaagtgc

SEQ ID NO: 9237441 - DNA, 22 bp, Homo sapiens
gcaggtggcagaggtgggatct

SEQ ID NO: 9237442 - DNA, 22 bp, Homo sapiens
gcaggtgggagccgctgcctga

SEQ ID NO: 9237443 - DNA, 22 bp, Homo sapiens
gcaggtggattatcagaagtgc

SEQ ID NO: 9237444 - DNA, 22 bp, Homo sapiens
gcaggtggcagaggtgggatct

SEQ ID NO: 9237445 - DNA, 22 bp, Homo sapiens
gcaggtgggagccgctgcctga

SEQ ID NO: 9237446 - DNA, 22 bp, Homo sapiens
gcaggtgggagccgctgcctga

SEQ ID NO: 9237447 - DNA, 22 bp, Homo sapiens
gcaggtggggctgctaccagaa

SEQ ID NO: 9237448 - DNA, 22 bp, Homo sapiens
gcaggtggggctgctaccagaa

SEQ ID NO: 9237449 - DNA, 16 bp, Homo sapiens
gcaggtggggcgcgca

SEQ ID NO: 9237450 - DNA, 22 bp, Homo sapiens
gcaggtggtccccgtggagtgg

SEQ ID NO: 9237451 - DNA, 22 bp, Homo sapiens
gcaggtgggggtcggtgcatct

SEQ ID NO: 9237452 - DNA, 22 bp, Homo sapiens
gcaggtgggggtcggtgcatct

SEQ ID NO: 9237453 - DNA, 22 bp, Homo sapiens
gcaggtgggggtcggtgcatct

SEQ ID NO: 9237454 - DNA, 22 bp, Homo sapiens
gcaggtgggggtcggtgcatct

SEQ ID NO: 9237455 - DNA, 22 bp, Homo sapiens
gcaggtgggggagaagttgtga

SEQ ID NO: 9237456 - DNA, 22 bp, Homo sapiens
gcaggtggtccccgtggagtgg

SEQ ID NO: 9237457 - DNA, 22 bp, Homo sapiens
gcaggtggtggggctatgatct

SEQ ID NO: 9237458 - DNA, 22 bp, Homo sapiens
gcaggtggtgggggagccgttc

SEQ ID NO: 9237459 - DNA, 22 bp, Homo sapiens
gcaggtggtgggggagccgttc

SEQ ID NO: 9237460 - DNA, 22 bp, Homo sapiens
gcaggtggtgggggagccgttc

SEQ ID NO: 9237461 - DNA, 22 bp, Homo sapiens
gcaggtggtgggggagccgttc

SEQ ID NO: 9237462 - DNA, 22 bp, Homo sapiens
gcaggtggttaaggtcccatgt

SEQ ID NO: 9237463 - DNA, 23 bp, Homo sapiens
gcaggtggttcgaacagaagttt

SEQ ID NO: 9237464 - DNA, 22 bp, Homo sapiens
gcagggggatggagttgaaatg

SEQ ID NO: 9237465 - DNA, 22 bp, Homo sapiens
gcagggggtcattcacgctggc

SEQ ID NO: 9237466 - DNA, 22 bp, Homo sapiens
gcagggggtcattcacgctggc

SEQ ID NO: 9237467 - DNA, 22 bp, Homo sapiens
gcagggggtcattcacgctggc

SEQ ID NO: 9237468 - DNA, 22 bp, Homo sapiens
gcaggggctgctgggaactcgg

SEQ ID NO: 9237469 - DNA, 22 bp, Homo sapiens
gcaggggctgctgggaactcgg

SEQ ID NO: 9237470 - DNA, 22 bp, Homo sapiens
gcaggggctgagcaccagcggg

SEQ ID NO: 9237471 - DNA, 22 bp, Homo sapiens
gcaggggctgctgggaactcgg

SEQ ID NO: 9237472 - DNA, 22 bp, Homo sapiens
gcaggggctgagcaccagcggg

SEQ ID NO: 9237473 - DNA, 22 bp, Homo sapiens
gcaggggctaaggacacagaga

SEQ ID NO: 9237474 - DNA, 22 bp, Homo sapiens
gcaggggcggctgggtttccag

SEQ ID NO: 9237475 - DNA, 22 bp, Homo sapiens
gcaggggcggctgggtttccag

SEQ ID NO: 9237476 - DNA, 22 bp, Homo sapiens
gcaggggctaaggacacagaga

SEQ ID NO: 9237477 - DNA, 22 bp, Homo sapiens
gcaggggctactctgagcttcc

SEQ ID NO: 9237478 - DNA, 22 bp, Homo sapiens
gcaggggctactctgagcttcc

SEQ ID NO: 9237479 - DNA, 22 bp, Homo sapiens
gcaggggcaggagatctcaggc

SEQ ID NO: 9237480 - DNA, 22 bp, Homo sapiens
gcaggggcaggagatctcaggc

SEQ ID NO: 9237481 - DNA, 22 bp, Homo sapiens
gcaggggcaggagatctcaggc

SEQ ID NO: 9237482 - DNA, 22 bp, Homo sapiens
gcagggcagaaggtgctgagga

SEQ ID NO: 9237483 - DNA, 22 bp, Homo sapiens
gcagggcacacaagaatgataa

SEQ ID NO: 9237484 - DNA, 22 bp, Homo sapiens
gcaggcagaggtggaggagaca

SEQ ID NO: 9237485 - DNA, 22 bp, Homo sapiens
gcaggcagagaggggtttccag

SEQ ID NO: 9237486 - DNA, 22 bp, Homo sapiens
gcaggcagagaaggaacattta

SEQ ID NO: 9237487 - DNA, 21 bp, Homo sapiens
gcaggcactctagaggagctg

SEQ ID NO: 9237488 - DNA, 17 bp, Homo sapiens
gcaggcactgctgcctg

SEQ ID NO: 9237489 - DNA, 22 bp, Homo sapiens
gcaggctgctgagatccttagg

SEQ ID NO: 9237490 - DNA, 22 bp, Homo sapiens
gcaggctgctgagatccttagg

SEQ ID NO: 9237491 - DNA, 22 bp, Homo sapiens
gcaggctgccctcttgtgttga

SEQ ID NO: 9237492 - DNA, 22 bp, Homo sapiens
gcaggctggaggctgttctggg

SEQ ID NO: 9237493 - DNA, 22 bp, Homo sapiens
gcaggctggaggctgttctggg

SEQ ID NO: 9237494 - DNA, 22 bp, Homo sapiens
gcaggctggaggctgttctggg

SEQ ID NO: 9237495 - DNA, 22 bp, Homo sapiens
gcaggctgccaccttctgagtt

SEQ ID NO: 9237496 - DNA, 22 bp, Homo sapiens
gcaggcagaggtggaggagaca

SEQ ID NO: 9237497 - DNA, 22 bp, Homo sapiens
gcaggcagaggtggaggagaca

SEQ ID NO: 9237498 - DNA, 22 bp, Homo sapiens
gcagggacgcagcactctccgt

SEQ ID NO: 9237499 - DNA, 22 bp, Homo sapiens
gcagggaagacccggagcagcg

SEQ ID NO: 9237500 - DNA, 19 bp, Homo sapiens
gcaggcttgggtctcccca

SEQ ID NO: 9237501 - DNA, 22 bp, Homo sapiens
gcagggaaacaggtgctaagga

SEQ ID NO: 9237502 - DNA, 22 bp, Homo sapiens
gcagggaagacccggagcagcg

SEQ ID NO: 9237503 - DNA, 22 bp, Homo sapiens
gcaggctgtggtatgttgggca

SEQ ID NO: 9237504 - DNA, 22 bp, Homo sapiens
gcaggctggggtagccccactt

SEQ ID NO: 9237505 - DNA, 21 bp, Homo sapiens
gcaggctggtcaaacctcagt

SEQ ID NO: 9237506 - DNA, 22 bp, Homo sapiens
gcaggctggtctgaccatccct

SEQ ID NO: 9237507 - DNA, 22 bp, Homo sapiens
gcaggcttgcccggcctccttc

SEQ ID NO: 9237508 - DNA, 22 bp, Homo sapiens
gcaggctggggtagccccactt

SEQ ID NO: 9237509 - DNA, 22 bp, Homo sapiens
gcaggctggggtagccccactt

SEQ ID NO: 9237510 - DNA, 22 bp, Homo sapiens
gcaggctggggtagccccactt

SEQ ID NO: 9237511 - DNA, 21 bp, Homo sapiens
gcaggctggtcaaacctcagt

SEQ ID NO: 9237512 - DNA, 21 bp, Homo sapiens
gcaggctggtcaaacctcagt

SEQ ID NO: 9237513 - DNA, 21 bp, Homo sapiens
gcaggctggtcaaacctcagt

SEQ ID NO: 9237514 - DNA, 20 bp, Homo sapiens
gcagctgaaagtatgacacc

SEQ ID NO: 9237515 - DNA, 22 bp, Homo sapiens
gcagctgaagctgcagttccag

SEQ ID NO: 9237516 - DNA, 22 bp, Homo sapiens
gcagctgaaagggatctctaca

SEQ ID NO: 9237517 - DNA, 22 bp, Homo sapiens
gcagctgaatgtccattgctgc

SEQ ID NO: 9237518 - DNA, 18 bp, Homo sapiens
gcagctgacactggagtt

SEQ ID NO: 9237519 - DNA, 18 bp, Homo sapiens
gcagctgacactggagtt

SEQ ID NO: 9237520 - DNA, 22 bp, Homo sapiens
gcagctctggggcaggcctgag

SEQ ID NO: 9237521 - DNA, 22 bp, Homo sapiens
gcagctctgattggttcagcct

SEQ ID NO: 9237522 - DNA, 22 bp, Homo sapiens
gcagctcctcctgggctggaga

SEQ ID NO: 9237523 - DNA, 22 bp, Homo sapiens
gcagctcctcctgggctggaga

SEQ ID NO: 9237524 - DNA, 22 bp, Homo sapiens
gcagctcacagtctccgccatc

SEQ ID NO: 9237525 - DNA, 22 bp, Homo sapiens
gcagctattgtctcctgggccc

SEQ ID NO: 9237526 - DNA, 22 bp, Homo sapiens
gcagagccttgcgtcatgtgcc

SEQ ID NO: 9237527 - DNA, 22 bp, Homo sapiens
gcagagccttgcgtcatgtgcc

SEQ ID NO: 9237528 - DNA, 22 bp, Homo sapiens
gcagagcctgtgtctgagcaaa

SEQ ID NO: 9237529 - DNA, 22 bp, Homo sapiens
gcagagcctgggggtctgcgga

SEQ ID NO: 9237530 - DNA, 21 bp, Homo sapiens
gcagagccggggcgagaaggc

SEQ ID NO: 9237531 - DNA, 21 bp, Homo sapiens
gcagagccggggcgagaaggc

SEQ ID NO: 9237532 - DNA, 20 bp, Homo sapiens
gcagagcctcactgcaaggg

SEQ ID NO: 9237533 - DNA, 22 bp, Homo sapiens
gcagctaccacccaggaaggac

SEQ ID NO: 9237534 - DNA, 18 bp, Homo sapiens
gcagctagccaggggggc

SEQ ID NO: 9237535 - DNA, 22 bp, Homo sapiens
gcagcctctgcagttcaggagg

SEQ ID NO: 9237536 - DNA, 22 bp, Homo sapiens
gcagagctcatgcctgcacctc

SEQ ID NO: 9237537 - DNA, 22 bp, Homo sapiens
gcagcctctgatgatggccgta

SEQ ID NO: 9237538 - DNA, 22 bp, Homo sapiens
gcagagctatcttctggatttg

SEQ ID NO: 9237539 - DNA, 22 bp, Homo sapiens
gcagagctcaaggtgttcagct

SEQ ID NO: 9237540 - DNA, 22 bp, Homo sapiens
gcaggagccctggcatgttctt

SEQ ID NO: 9237541 - DNA, 22 bp, Homo sapiens
gcaggagccacttcagggatgc

SEQ ID NO: 9237542 - DNA, 22 bp, Homo sapiens
gcaggagccaggccgagctggt

SEQ ID NO: 9237543 - DNA, 22 bp, Homo sapiens
gcaggagccaggccgagctggt

SEQ ID NO: 9237544 - DNA, 22 bp, Homo sapiens
gcaggagctcgtttccaggctg

SEQ ID NO: 9237545 - DNA, 22 bp, Homo sapiens
gcaggagctcgtttccaggctg

SEQ ID NO: 9237546 - DNA, 22 bp, Homo sapiens
gcaggagccctggcatgttctt

SEQ ID NO: 9237547 - DNA, 22 bp, Homo sapiens
gcaggagctcgtttccaggctg

SEQ ID NO: 9237548 - DNA, 22 bp, Homo sapiens
gcaggagctgctctcctgacga

SEQ ID NO: 9237549 - DNA, 22 bp, Homo sapiens
gcaggcactcctaggaccatca

SEQ ID NO: 9237550 - DNA, 22 bp, Homo sapiens
gcaggcacctcgtggagtggaa

SEQ ID NO: 9237551 - DNA, 22 bp, Homo sapiens
gcaggcaccgggttgctcccct

SEQ ID NO: 9237552 - DNA, 22 bp, Homo sapiens
gcaggcaccgcggcggcaggtt

SEQ ID NO: 9237553 - DNA, 19 bp, Homo sapiens
gcaggcacagccctgggtg

SEQ ID NO: 9237554 - DNA, 19 bp, Homo sapiens
gcaggcacagccctgggtg

SEQ ID NO: 9237555 - DNA, 22 bp, Homo sapiens
gcaggcaccacggctcaggtct

SEQ ID NO: 9237556 - DNA, 22 bp, Homo sapiens
gcaggcacatgggcgggtctgg

SEQ ID NO: 9237557 - DNA, 23 bp, Homo sapiens
gcaggagttcctggactccagga

SEQ ID NO: 9237558 - DNA, 19 bp, Homo sapiens
gcaggcacagccctgggtg

SEQ ID NO: 9237559 - DNA, 22 bp, Homo sapiens
gcaggacaggcgttggtccagt

SEQ ID NO: 9237560 - DNA, 22 bp, Homo sapiens
gcagctgagcgtgaggaagagt

SEQ ID NO: 9237561 - DNA, 22 bp, Homo sapiens
gcagctgagagaagaacagggc

SEQ ID NO: 9237562 - DNA, 22 bp, Homo sapiens
gcagctgacatctggctgggcc

SEQ ID NO: 9237563 - DNA, 22 bp, Homo sapiens
gcagctgagagaagaacagggc

SEQ ID NO: 9237564 - DNA, 22 bp, Homo sapiens
gcaggacttgaatccaggcagt

SEQ ID NO: 9237565 - DNA, 22 bp, Homo sapiens
gcaggagactggctgtggtagt

SEQ ID NO: 9237566 - DNA, 22 bp, Homo sapiens
gcaggagactggctgtggtagt

SEQ ID NO: 9237567 - DNA, 22 bp, Homo sapiens
gcaggagacaactgtaaggaga

SEQ ID NO: 9237568 - DNA, 22 bp, Homo sapiens
gcaggagacaactgtaaggaga

SEQ ID NO: 9237569 - DNA, 22 bp, Homo sapiens
gcaggagaaatgaagattgggt

SEQ ID NO: 9237570 - DNA, 22 bp, Homo sapiens
gcaggagaacaaagcaagctgc

SEQ ID NO: 9237571 - DNA, 22 bp, Homo sapiens
gatgcctgcatttcaggagagt

SEQ ID NO: 9237572 - DNA, 22 bp, Homo sapiens
gatgcgggcccgctccactgcc

SEQ ID NO: 9237573 - DNA, 22 bp, Homo sapiens
gatgctaaaataattattttga

SEQ ID NO: 9237574 - DNA, 22 bp, Homo sapiens
gatgcgggcccgctccactgcc

SEQ ID NO: 9237575 - DNA, 22 bp, Homo sapiens
gatgctgaagtgaagtgatctt

SEQ ID NO: 9237576 - DNA, 22 bp, Homo sapiens
gatgctgaagtgaagtgatctt

SEQ ID NO: 9237577 - DNA, 22 bp, Homo sapiens
gatgctgaccagctgtttcctt

SEQ ID NO: 9237578 - DNA, 22 bp, Homo sapiens
gatgctgggaccacagagtgtt

SEQ ID NO: 9237579 - DNA, 22 bp, Homo sapiens
gatgctgggaccacagagtgtt

SEQ ID NO: 9237580 - DNA, 22 bp, Homo sapiens
gatgctgattttactgttttct

SEQ ID NO: 9237581 - DNA, 22 bp, Homo sapiens
gatgctgattatttcttgctag

SEQ ID NO: 9237582 - DNA, 22 bp, Homo sapiens
gatgctgattttactgttttct

SEQ ID NO: 9237583 - DNA, 22 bp, Homo sapiens
gatgctgagctgtatggctggt

SEQ ID NO: 9237584 - DNA, 22 bp, Homo sapiens
gatgctgagaggtggagggaac

SEQ ID NO: 9237585 - DNA, 18 bp, Homo sapiens
gatggaaagtgtatgagt

SEQ ID NO: 9237586 - DNA, 22 bp, Homo sapiens
gatggaagaaaaatgcatgtct

SEQ ID NO: 9237587 - DNA, 22 bp, Homo sapiens
gatgcttaagatgttggtggca

SEQ ID NO: 9237588 - DNA, 22 bp, Homo sapiens
gatgcttacatagcccaagtgt

SEQ ID NO: 9237589 - DNA, 22 bp, Homo sapiens
gatgctttccaagaaatcctca

SEQ ID NO: 9237590 - DNA, 22 bp, Homo sapiens
gatgggaggaacctgggtccct

SEQ ID NO: 9237591 - DNA, 18 bp, Homo sapiens
gatgggagcaagagaaga

SEQ ID NO: 9237592 - DNA, 22 bp, Homo sapiens
gatgggattttttatgtgttca

SEQ ID NO: 9237593 - DNA, 22 bp, Homo sapiens
gatgggctgtctgagcgctgtg

SEQ ID NO: 9237594 - DNA, 22 bp, Homo sapiens
gatgggctggggagaaagcatg

SEQ ID NO: 9237595 - DNA, 22 bp, Homo sapiens
gatgggctgtctgagcgctgtg

SEQ ID NO: 9237596 - DNA, 22 bp, Homo sapiens
gatggcccgctagctggcctct

SEQ ID NO: 9237597 - DNA, 22 bp, Homo sapiens
gatggcctcagtgcccaaagga

SEQ ID NO: 9237598 - DNA, 22 bp, Homo sapiens
gatggcctgggtccccttccgg

SEQ ID NO: 9237599 - DNA, 22 bp, Homo sapiens
gatggccttgttttctcccttc

SEQ ID NO: 9237600 - DNA, 18 bp, Homo sapiens
gatgtaaaatagtagctt

SEQ ID NO: 9237601 - DNA, 22 bp, Homo sapiens
gatgggggccagggcctgcttt

SEQ ID NO: 9237602 - DNA, 22 bp, Homo sapiens
gatggggatgagaagtgagcag

SEQ ID NO: 9237603 - DNA, 22 bp, Homo sapiens
gatggggatgagaagtgagcag

SEQ ID NO: 9237604 - DNA, 22 bp, Homo sapiens
gatgggtgggttctgtgagagg

SEQ ID NO: 9237605 - DNA, 22 bp, Homo sapiens
gatgggtagaagtggaagaggt

SEQ ID NO: 9237606 - DNA, 22 bp, Homo sapiens
gatgggtactcgttggactgag

SEQ ID NO: 9237607 - DNA, 22 bp, Homo sapiens
gatggggttttgccaggctggt

SEQ ID NO: 9237608 - DNA, 22 bp, Homo sapiens
gatggtctttgtctctgataag

SEQ ID NO: 9237609 - DNA, 21 bp, Homo sapiens
gatggtagcctcatagaagta

SEQ ID NO: 9237610 - DNA, 22 bp, Homo sapiens
gatgtgtgtgccctgggcctgc

SEQ ID NO: 9237611 - DNA, 22 bp, Homo sapiens
gatgtcttaagcccagaagttc

SEQ ID NO: 9237612 - DNA, 22 bp, Homo sapiens
gatgtcttactaactagccttt

SEQ ID NO: 9237613 - DNA, 22 bp, Homo sapiens
gatgtagacacttggaggctta

SEQ ID NO: 9237614 - DNA, 22 bp, Homo sapiens
gatgtagacacttggaggctta

SEQ ID NO: 9237615 - DNA, 22 bp, Homo sapiens
gatgtagagggaagattttaaa

SEQ ID NO: 9237616 - DNA, 22 bp, Homo sapiens
gatgtagcggcagctgtttttc

SEQ ID NO: 9237617 - DNA, 22 bp, Homo sapiens
gattgctgtagttaaaatgatg

SEQ ID NO: 9237618 - DNA, 22 bp, Homo sapiens
gattgctgcaatcaacaagtat

SEQ ID NO: 9237619 - DNA, 22 bp, Homo sapiens
gattgagtctgaggatgctgca

SEQ ID NO: 9237620 - DNA, 22 bp, Homo sapiens
gattgagtctgaggatgctgca

SEQ ID NO: 9237621 - DNA, 22 bp, Homo sapiens
gattgagtctgaggatgctgca

SEQ ID NO: 9237622 - DNA, 22 bp, Homo sapiens
gattggagagtggaacatgctg

SEQ ID NO: 9237623 - DNA, 22 bp, Homo sapiens
gattggagagtggaacatgctg

SEQ ID NO: 9237624 - DNA, 19 bp, Homo sapiens
gatttaaacgtggctctat

SEQ ID NO: 9237625 - DNA, 22 bp, Homo sapiens
gatttaaagtagacctttgttt

SEQ ID NO: 9237626 - DNA, 22 bp, Homo sapiens
gattgtctgtgatcatgagcaa

SEQ ID NO: 9237627 - DNA, 22 bp, Homo sapiens
gatttattggtctttcattggt

SEQ ID NO: 9237628 - DNA, 22 bp, Homo sapiens
gatttattggtctttcattggt

SEQ ID NO: 9237629 - DNA, 22 bp, Homo sapiens
gatttattggtctttcattggt

SEQ ID NO: 9237630 - DNA, 22 bp, Homo sapiens
gatttattgtccctgtcctgct

SEQ ID NO: 9237631 - DNA, 22 bp, Homo sapiens
gatttatttttaatcagcaggg

SEQ ID NO: 9237632 - DNA, 22 bp, Homo sapiens
gatttatttttaatcagcaggg

SEQ ID NO: 9237633 - DNA, 22 bp, Homo sapiens
gatttatttttaatcagcaggg

SEQ ID NO: 9237634 - DNA, 22 bp, Homo sapiens
gatttatttttaatcagcaggg

SEQ ID NO: 9237635 - DNA, 22 bp, Homo sapiens
gatttacaggttaggtcctgta

SEQ ID NO: 9237636 - DNA, 22 bp, Homo sapiens
gatttacaggttaggtcctgta

SEQ ID NO: 9237637 - DNA, 22 bp, Homo sapiens
gatttagagaatgttttgtaag

SEQ ID NO: 9237638 - DNA, 21 bp, Homo sapiens
gattaaatttaagctacatgc

SEQ ID NO: 9237639 - DNA, 22 bp, Homo sapiens
gattaagagaagtttcttatcg

SEQ ID NO: 9237640 - DNA, 22 bp, Homo sapiens
gattaagagaagtttcttatcg

SEQ ID NO: 9237641 - DNA, 22 bp, Homo sapiens
gattaagattacatatttaagt

SEQ ID NO: 9237642 - DNA, 22 bp, Homo sapiens
gattaagattacatatttaagt

SEQ ID NO: 9237643 - DNA, 21 bp, Homo sapiens
gattaaatttaagctacatgc

SEQ ID NO: 9237644 - DNA, 22 bp, Homo sapiens
gattaaaaataacccatgctga

SEQ ID NO: 9237645 - DNA, 22 bp, Homo sapiens
gattaattcaggatcaggaaat

SEQ ID NO: 9237646 - DNA, 22 bp, Homo sapiens
gatgttaacttgttctgcctct

SEQ ID NO: 9237647 - DNA, 22 bp, Homo sapiens
gatgttaaaggttggtaagtca

SEQ ID NO: 9237648 - DNA, 22 bp, Homo sapiens
gatgttctagaagtgtggtgtt

SEQ ID NO: 9237649 - DNA, 22 bp, Homo sapiens
gatgtttcatgctagcatgtgt

SEQ ID NO: 9237650 - DNA, 22 bp, Homo sapiens
gattctttggcctttattgaca

SEQ ID NO: 9237651 - DNA, 22 bp, Homo sapiens
gattctttactcagattttgtt

SEQ ID NO: 9237652 - DNA, 22 bp, Homo sapiens
gattatggtagaaacaagaagt

SEQ ID NO: 9237653 - DNA, 22 bp, Homo sapiens
gattattttgtgcaataatcgg

SEQ ID NO: 9237654 - DNA, 22 bp, Homo sapiens
gattatggtaacaatgattaaa

SEQ ID NO: 9237655 - DNA, 22 bp, Homo sapiens
gattatggatggacagtggagc

SEQ ID NO: 9237656 - DNA, 22 bp, Homo sapiens
gattatggagaagaacaatgaa

SEQ ID NO: 9237657 - DNA, 22 bp, Homo sapiens
gattcaaagttaatgaagatgc

SEQ ID NO: 9237658 - DNA, 22 bp, Homo sapiens
gattatggagaaataattagaa

SEQ ID NO: 9237659 - DNA, 22 bp, Homo sapiens
gattatataatggaagctcttg

SEQ ID NO: 9237660 - DNA, 22 bp, Homo sapiens
gattatataatggaagctcttg

SEQ ID NO: 9237661 - DNA, 22 bp, Homo sapiens
gattagtatccttattaagaga

SEQ ID NO: 9237662 - DNA, 22 bp, Homo sapiens
gattagaatatgtcagtcataa

SEQ ID NO: 9237663 - DNA, 22 bp, Homo sapiens
gattagctctagatctgggcta

SEQ ID NO: 9237664 - DNA, 22 bp, Homo sapiens
gcaaacatgctgagaaataaga

SEQ ID NO: 9237665 - DNA, 22 bp, Homo sapiens
gcaaacatgctgagaaataaga

SEQ ID NO: 9237666 - DNA, 22 bp, Homo sapiens
gcaaacatcttagccatagagt

SEQ ID NO: 9237667 - DNA, 22 bp, Homo sapiens
gcaaacatctttatttggcaag

SEQ ID NO: 9237668 - DNA, 22 bp, Homo sapiens
gcaaacatgtgctcattttgtg

SEQ ID NO: 9237669 - DNA, 22 bp, Homo sapiens
gcaaacatgttgtgagatacca

SEQ ID NO: 9237670 - DNA, 22 bp, Homo sapiens
gcaaacattcaggagtacagga

SEQ ID NO: 9237671 - DNA, 22 bp, Homo sapiens
gcaaacatgttgtgagatacca

SEQ ID NO: 9237672 - DNA, 22 bp, Homo sapiens
gcaaacattccacagaaggaag

SEQ ID NO: 9237673 - DNA, 18 bp, Homo sapiens
gcaaacattcttccagtc

SEQ ID NO: 9237674 - DNA, 22 bp, Homo sapiens
gcaaacatttggtctagtgtgt

SEQ ID NO: 9237675 - DNA, 22 bp, Homo sapiens
gattttgtcaaattccaaatgt

SEQ ID NO: 9237676 - DNA, 22 bp, Homo sapiens
gattttgaatattaaagaagag

SEQ ID NO: 9237677 - DNA, 22 bp, Homo sapiens
gatttttatataaagtgagaaa

SEQ ID NO: 9237678 - DNA, 22 bp, Homo sapiens
gcaaacataatatgaagacact

SEQ ID NO: 9237679 - DNA, 22 bp, Homo sapiens
gcaaacatccactgcccttgta

SEQ ID NO: 9237680 - DNA, 22 bp, Homo sapiens
gatttttatataaagtgagaaa

SEQ ID NO: 9237681 - DNA, 22 bp, Homo sapiens
gatttttatataaagtgagaaa

SEQ ID NO: 9237682 - DNA, 17 bp, Homo sapiens
gcaatctcagtctcctt

SEQ ID NO: 9237683 - DNA, 22 bp, Homo sapiens
gcaatgcatatgtgggtagcat

SEQ ID NO: 9237684 - DNA, 22 bp, Homo sapiens
gcaatgtttttccttccatatt

SEQ ID NO: 9237685 - DNA, 20 bp, Homo sapiens
gcaatgttggttcctgtcac

SEQ ID NO: 9237686 - DNA, 22 bp, Homo sapiens
gcaatgttgtgttggcattcta

SEQ ID NO: 9237687 - DNA, 22 bp, Homo sapiens
gcacaagaaatcatggactgaa

SEQ ID NO: 9237688 - DNA, 22 bp, Homo sapiens
gcacaaactgcaattacttttg

SEQ ID NO: 9237689 - DNA, 22 bp, Homo sapiens
gatttcttcattcattagatgg

SEQ ID NO: 9237690 - DNA, 20 bp, Homo sapiens
gatttcaaagcagagtggcc

SEQ ID NO: 9237691 - DNA, 22 bp, Homo sapiens
gatttcttcaggagcagaggag

SEQ ID NO: 9237692 - DNA, 22 bp, Homo sapiens
gatttcaaggagttttcacagt

SEQ ID NO: 9237693 - DNA, 22 bp, Homo sapiens
gatttcttcattcattagatgg

SEQ ID NO: 9237694 - DNA, 22 bp, Homo sapiens
gatttcttgacccctgtctcag

SEQ ID NO: 9237695 - DNA, 22 bp, Homo sapiens
gatttcttctctcccaagagga

SEQ ID NO: 9237696 - DNA, 22 bp, Homo sapiens
gatttcttctctcccaagagga

SEQ ID NO: 9237697 - DNA, 22 bp, Homo sapiens
gatttcttgataagtagtgtga

SEQ ID NO: 9237698 - DNA, 22 bp, Homo sapiens
gatttcttgagcaagttgctta

SEQ ID NO: 9237699 - DNA, 22 bp, Homo sapiens
gatttctttgcaagctgtgttc

SEQ ID NO: 9237700 - DNA, 22 bp, Homo sapiens
gatttctttaggtgtaatagtg

SEQ ID NO: 9237701 - DNA, 22 bp, Homo sapiens
gattttcatgataaacttgtga

SEQ ID NO: 9237702 - DNA, 22 bp, Homo sapiens
gattttcatgataaacttgtga

SEQ ID NO: 9237703 - DNA, 22 bp, Homo sapiens
gattttcattatagctagtttc

SEQ ID NO: 9237704 - DNA, 22 bp, Homo sapiens
gattttcatttgcactctagaa

SEQ ID NO: 9237705 - DNA, 22 bp, Homo sapiens
gattttcattatagctagtttc

SEQ ID NO: 9237706 - DNA, 22 bp, Homo sapiens
gattttattagcccaaactttg

SEQ ID NO: 9237707 - DNA, 22 bp, Homo sapiens
gattttattagcccaaactttg

SEQ ID NO: 9237708 - DNA, 22 bp, Homo sapiens
gattttatctttgtgtgcagta

SEQ ID NO: 9237709 - DNA, 22 bp, Homo sapiens
gattttatctttgtgtgcagta

SEQ ID NO: 9237710 - DNA, 22 bp, Homo sapiens
gattttatcgtcatccttctgg

SEQ ID NO: 9237711 - DNA, 22 bp, Homo sapiens
gattttatcgtcatccttctgg

SEQ ID NO: 9237712 - DNA, 22 bp, Homo sapiens
gattttatatggcatactgtgg

SEQ ID NO: 9237713 - DNA, 22 bp, Homo sapiens
gattttatctttgtgtgcagta

SEQ ID NO: 9237714 - DNA, 22 bp, Homo sapiens
gattttatcgtcatccttctgg

SEQ ID NO: 9237715 - DNA, 22 bp, Homo sapiens
gattttaattataggaggtcct

SEQ ID NO: 9237716 - DNA, 21 bp, Homo sapiens
gattttaaagagactgccaca

SEQ ID NO: 9237717 - DNA, 22 bp, Homo sapiens
gatttgtttcaagttagcatct

SEQ ID NO: 9237718 - DNA, 22 bp, Homo sapiens
gatttgtccacagagtgatgaa

SEQ ID NO: 9237719 - DNA, 22 bp, Homo sapiens
gatttgtctatattcaaatatg

SEQ ID NO: 9237720 - DNA, 22 bp, Homo sapiens
gattttatagtcaggaaaaaga

SEQ ID NO: 9237721 - DNA, 22 bp, Homo sapiens
gattttatagtcaggaaaaaga

SEQ ID NO: 9237722 - DNA, 22 bp, Homo sapiens
gattttatatggcatactgtgg

SEQ ID NO: 9237723 - DNA, 22 bp, Homo sapiens
gattttatatggcatactgtgg

SEQ ID NO: 9237724 - DNA, 22 bp, Homo sapiens
gcacccagggcaggaagtgagg

SEQ ID NO: 9237725 - DNA, 22 bp, Homo sapiens
gcacccagggacttggctggcc

SEQ ID NO: 9237726 - DNA, 22 bp, Homo sapiens
gcacccagtgggatgcttagca

SEQ ID NO: 9237727 - DNA, 22 bp, Homo sapiens
gcacccagtgggatgcttagca

SEQ ID NO: 9237728 - DNA, 22 bp, Homo sapiens
gcacccatgctcttgtctcagg

SEQ ID NO: 9237729 - DNA, 22 bp, Homo sapiens
gcacccattgtgtgcagctctg

SEQ ID NO: 9237730 - DNA, 22 bp, Homo sapiens
gcacccagtttgtctcagggtt

SEQ ID NO: 9237731 - DNA, 22 bp, Homo sapiens
gcacccaggccggcgactgcag

SEQ ID NO: 9237732 - DNA, 22 bp, Homo sapiens
gcacccaggccggcgactgcag

SEQ ID NO: 9237733 - DNA, 22 bp, Homo sapiens
gcacccaggcttgggcagcaac

SEQ ID NO: 9237734 - DNA, 22 bp, Homo sapiens
gcacccaggcttgggcagcaac

SEQ ID NO: 9237735 - DNA, 22 bp, Homo sapiens
gcacccaggcttgggcagcaac

SEQ ID NO: 9237736 - DNA, 22 bp, Homo sapiens
gcacccagggacttggctggcc

SEQ ID NO: 9237737 - DNA, 22 bp, Homo sapiens
gcacccagggacttggctggcc

SEQ ID NO: 9237738 - DNA, 22 bp, Homo sapiens
gcacacacatgtgagtacatgc

SEQ ID NO: 9237739 - DNA, 22 bp, Homo sapiens
gcacacactgttttcctcacat

SEQ ID NO: 9237740 - DNA, 22 bp, Homo sapiens
gcacacactgttttcctcacat

SEQ ID NO: 9237741 - DNA, 22 bp, Homo sapiens
gcacccaggccggcgactgcag

SEQ ID NO: 9237742 - DNA, 22 bp, Homo sapiens
gcacccaggcactttcctttct

SEQ ID NO: 9237743 - DNA, 22 bp, Homo sapiens
gcacccaggcactttcctttct

SEQ ID NO: 9237744 - DNA, 16 bp, Homo sapiens
gcacacacatcaatga

SEQ ID NO: 9237745 - DNA, 22 bp, Homo sapiens
gcacaataacagccaaggttat

SEQ ID NO: 9237746 - DNA, 22 bp, Homo sapiens
gcaccctagagttgcctgagga

SEQ ID NO: 9237747 - DNA, 22 bp, Homo sapiens
gcaccctagagttgcctgagga

SEQ ID NO: 9237748 - DNA, 20 bp, Homo sapiens
gcacttggctgctgcttctc

SEQ ID NO: 9237749 - DNA, 22 bp, Homo sapiens
gcacctggacagtgaccctagc

SEQ ID NO: 9237750 - DNA, 22 bp, Homo sapiens
gcacctggctgcccaggtggag

SEQ ID NO: 9237751 - DNA, 22 bp, Homo sapiens
gcacctgcaggatgagccaggg

SEQ ID NO: 9237752 - DNA, 22 bp, Homo sapiens
gcagagccaggagcccaggatc

SEQ ID NO: 9237753 - DNA, 22 bp, Homo sapiens
gcagagccagaatggccaggac

SEQ ID NO: 9237754 - DNA, 22 bp, Homo sapiens
gcagagccaggagagacccttg

SEQ ID NO: 9237755 - DNA, 22 bp, Homo sapiens
gcagagccaggagagacccttg

SEQ ID NO: 9237756 - DNA, 22 bp, Homo sapiens
gcagagcccctcaagccagcct

SEQ ID NO: 9237757 - DNA, 22 bp, Homo sapiens
gcagagcccctcaagccagcct

SEQ ID NO: 9237758 - DNA, 22 bp, Homo sapiens
gcagagcccctcaagccagcct

SEQ ID NO: 9237759 - DNA, 22 bp, Homo sapiens
gcagagccaggctggggcaggt

SEQ ID NO: 9237760 - DNA, 22 bp, Homo sapiens
gcagagccaggctggggcaggt

SEQ ID NO: 9237761 - DNA, 22 bp, Homo sapiens
gcagagcagtgcttgcccagcg

SEQ ID NO: 9237762 - DNA, 22 bp, Homo sapiens
gcagagcatgtcctcaggacag

SEQ ID NO: 9237763 - DNA, 22 bp, Homo sapiens
gcagaagctgggcagcgaggtg

SEQ ID NO: 9237764 - DNA, 22 bp, Homo sapiens
gcagaagctgggcagcgaggtg

SEQ ID NO: 9237765 - DNA, 22 bp, Homo sapiens
gcagaagctgggcagcgaggtg

SEQ ID NO: 9237766 - DNA, 22 bp, Homo sapiens
gcagaagctgttcgaaggccgc

SEQ ID NO: 9237767 - DNA, 22 bp, Homo sapiens
gcagaaggatccgcaggtgcaa

SEQ ID NO: 9237768 - DNA, 17 bp, Homo sapiens
gcagaaaagtcaaggga

SEQ ID NO: 9237769 - DNA, 22 bp, Homo sapiens
gcactttgcccctcctttggca

SEQ ID NO: 9237770 - DNA, 22 bp, Homo sapiens
gcactttggaaaattttgagtt

SEQ ID NO: 9237771 - DNA, 22 bp, Homo sapiens
gcactttgtggattgtatttcc

SEQ ID NO: 9237772 - DNA, 22 bp, Homo sapiens
gcactttgtggattgtatttcc

SEQ ID NO: 9237773 - DNA, 22 bp, Homo sapiens
gcactttatagtagaaagagca

SEQ ID NO: 9237774 - DNA, 22 bp, Homo sapiens
gcagaaatatgatgcataaagg

SEQ ID NO: 9237775 - DNA, 22 bp, Homo sapiens
gcagaagcacaggtgacgggcc

SEQ ID NO: 9237776 - DNA, 22 bp, Homo sapiens
gcagaagcacaggtgacgggcc

SEQ ID NO: 9237777 - DNA, 22 bp, Homo sapiens
gcagaagcacaggtgacgggcc

SEQ ID NO: 9237778 - DNA, 22 bp, Homo sapiens
gcagaagaccatggtggaaaga

SEQ ID NO: 9237779 - DNA, 22 bp, Homo sapiens
gcagaacatttcacagtatctt

SEQ ID NO: 9237780 - DNA, 22 bp, Homo sapiens
gcagaacatttcacagtatctt

SEQ ID NO: 9237781 - DNA, 22 bp, Homo sapiens
gcagaagcccggtcagcgcacg

SEQ ID NO: 9237782 - DNA, 22 bp, Homo sapiens
gcagaagcagaggagcctatga

SEQ ID NO: 9237783 - DNA, 22 bp, Homo sapiens
gcagaagctgggagaagggatt

SEQ ID NO: 9237784 - DNA, 22 bp, Homo sapiens
gcagaagctgggagaagggatt

SEQ ID NO: 9237785 - DNA, 22 bp, Homo sapiens
ggctcaggacacagtggtttag

SEQ ID NO: 9237786 - DNA, 22 bp, Homo sapiens
ggctcaggatgagccttctcat

SEQ ID NO: 9237787 - DNA, 22 bp, Homo sapiens
ggctcaggagaggggctaaaag

SEQ ID NO: 9237788 - DNA, 22 bp, Homo sapiens
ggctcaggactgcagcgtagag

SEQ ID NO: 9237789 - DNA, 22 bp, Homo sapiens
ggccttgggaggagggtcagaa

SEQ ID NO: 9237790 - DNA, 22 bp, Homo sapiens
ggccttgatgttcttgggagat

SEQ ID NO: 9237791 - DNA, 21 bp, Homo sapiens
ggccttggcgggggccgaatt

SEQ ID NO: 9237792 - DNA, 18 bp, Homo sapiens
ggctcagcaggctctctc

SEQ ID NO: 9237793 - DNA, 22 bp, Homo sapiens
ggctcagcacagggctggcatc

SEQ ID NO: 9237794 - DNA, 22 bp, Homo sapiens
ggctcctgctgtcctttgaagc

SEQ ID NO: 9237795 - DNA, 21 bp, Homo sapiens
ggctcctgctttgtgaggggc

SEQ ID NO: 9237796 - DNA, 23 bp, Homo sapiens
ggctcctgcttcatgtcccacct

SEQ ID NO: 9237797 - DNA, 22 bp, Homo sapiens
ggctcctgcacctgtccctctg

SEQ ID NO: 9237798 - DNA, 22 bp, Homo sapiens
ggctcctgcacctgtccctctg

SEQ ID NO: 9237799 - DNA, 22 bp, Homo sapiens
ggctcaggccagaccacgactc

SEQ ID NO: 9237800 - DNA, 22 bp, Homo sapiens
ggctcaggccagaccacgactc

SEQ ID NO: 9237801 - DNA, 22 bp, Homo sapiens
ggctcaggtttaaagtgcttta

SEQ ID NO: 9237802 - DNA, 22 bp, Homo sapiens
ggctcatgtttcagaaagtgga

SEQ ID NO: 9237803 - DNA, 22 bp, Homo sapiens
ggctcatgtatgaaagggtgtg

SEQ ID NO: 9237804 - DNA, 22 bp, Homo sapiens
ggctcatatcccggccatcatt

SEQ ID NO: 9237805 - DNA, 20 bp, Homo sapiens
ggccttggaatagcacagct

SEQ ID NO: 9237806 - DNA, 22 bp, Homo sapiens
ggccttggagtcctccactgga

SEQ ID NO: 9237807 - DNA, 22 bp, Homo sapiens
ggccttggagtcctccactgga

SEQ ID NO: 9237808 - DNA, 22 bp, Homo sapiens
ggccttgatcctccagagcact

SEQ ID NO: 9237809 - DNA, 22 bp, Homo sapiens
ggccttgagagccagtgcaggc

SEQ ID NO: 9237810 - DNA, 22 bp, Homo sapiens
ggccttgagcagggagaaacca

SEQ ID NO: 9237811 - DNA, 19 bp, Homo sapiens
ggccttgatgagtggggag

SEQ ID NO: 9237812 - DNA, 22 bp, Homo sapiens
ggccttcctgctgctccgggcc

SEQ ID NO: 9237813 - DNA, 21 bp, Homo sapiens
ggccttcccctgcagtctccg

SEQ ID NO: 9237814 - DNA, 22 bp, Homo sapiens
ggccttcctggcggctcagggt

SEQ ID NO: 9237815 - DNA, 22 bp, Homo sapiens
ggccctgagctgaagtactgtg

SEQ ID NO: 9237816 - DNA, 22 bp, Homo sapiens
ggcctgggcccactgtcaagag

SEQ ID NO: 9237817 - DNA, 22 bp, Homo sapiens
ggcctgggcccactgtcaagag

SEQ ID NO: 9237818 - DNA, 22 bp, Homo sapiens
ggcctgggcccactgtcaagag

SEQ ID NO: 9237819 - DNA, 23 bp, Homo sapiens
ggcctgtgttttgtctgaagtac

SEQ ID NO: 9237820 - DNA, 22 bp, Homo sapiens
ggcctgggcctttgtgttttga

SEQ ID NO: 9237821 - DNA, 22 bp, Homo sapiens
ggccagagaagtcagacccttg

SEQ ID NO: 9237822 - DNA, 22 bp, Homo sapiens
ggccagagaagtcagacccttg

SEQ ID NO: 9237823 - DNA, 22 bp, Homo sapiens
ggccagactgagtgaggtcaag

SEQ ID NO: 9237824 - DNA, 22 bp, Homo sapiens
ggcaggtggaagttggcagagc

SEQ ID NO: 9237825 - DNA, 22 bp, Homo sapiens
ggcaggtggaagttggcagagc

SEQ ID NO: 9237826 - DNA, 22 bp, Homo sapiens
ggcaggtggaaggtctccattc

SEQ ID NO: 9237827 - DNA, 22 bp, Homo sapiens
ggcaggtgcttgtcgaaggcct

SEQ ID NO: 9237828 - DNA, 22 bp, Homo sapiens
ggcaggtgcttgtcgaaggcct

SEQ ID NO: 9237829 - DNA, 22 bp, Homo sapiens
ggcaggtgctctgtgggcctgg

SEQ ID NO: 9237830 - DNA, 22 bp, Homo sapiens
ggcaggtgctgggagcatctca

SEQ ID NO: 9237831 - DNA, 18 bp, Homo sapiens
ggccagagggagggtccc

SEQ ID NO: 9237832 - DNA, 18 bp, Homo sapiens
ggccagagggagggtccc

SEQ ID NO: 9237833 - DNA, 18 bp, Homo sapiens
ggccagagggagggtccc

SEQ ID NO: 9237834 - DNA, 22 bp, Homo sapiens
ggccatgggaagaggtggagag

SEQ ID NO: 9237835 - DNA, 22 bp, Homo sapiens
ggccagaggccatcctcctgct

SEQ ID NO: 9237836 - DNA, 17 bp, Homo sapiens
ggccagaggcggggctg

SEQ ID NO: 9237837 - DNA, 17 bp, Homo sapiens
ggccagaggcggggctg

SEQ ID NO: 9237838 - DNA, 18 bp, Homo sapiens
ggccagagggagggtccc

SEQ ID NO: 9237839 - DNA, 18 bp, Homo sapiens
ggccagagggagggtccc

SEQ ID NO: 9237840 - DNA, 22 bp, Homo sapiens
ggccagaggccacagctgtgtc

SEQ ID NO: 9237841 - DNA, 22 bp, Homo sapiens
ggccagaggccacagctgtgtc

SEQ ID NO: 9237842 - DNA, 22 bp, Homo sapiens
ggccagaggccatcctcctgct

SEQ ID NO: 9237843 - DNA, 22 bp, Homo sapiens
ggccagaggacctctcatagcc

SEQ ID NO: 9237844 - DNA, 22 bp, Homo sapiens
ggccagagagcagccaggattc

SEQ ID NO: 9237845 - DNA, 22 bp, Homo sapiens
ggcccagccggcgagtctcgcg

SEQ ID NO: 9237846 - DNA, 22 bp, Homo sapiens
ggcccacttgaaatggagctca

SEQ ID NO: 9237847 - DNA, 19 bp, Homo sapiens
ggcccaagtactgagtgcc

SEQ ID NO: 9237848 - DNA, 22 bp, Homo sapiens
ggcccaaggtgccaaggcctcc

SEQ ID NO: 9237849 - DNA, 22 bp, Homo sapiens
ggcccacaccaggggccacagt

SEQ ID NO: 9237850 - DNA, 22 bp, Homo sapiens
ggcccacactgacagctgagct

SEQ ID NO: 9237851 - DNA, 22 bp, Homo sapiens
ggcccacactgacagctgagct

SEQ ID NO: 9237852 - DNA, 22 bp, Homo sapiens
ggcccaaggcccaggtcgagct

SEQ ID NO: 9237853 - DNA, 22 bp, Homo sapiens
ggcccaaaccaagtacctcaaa

SEQ ID NO: 9237854 - DNA, 22 bp, Homo sapiens
ggccatggttggggaagacatg

SEQ ID NO: 9237855 - DNA, 22 bp, Homo sapiens
ggccatggttggggaagacatg

SEQ ID NO: 9237856 - DNA, 22 bp, Homo sapiens
ggccatggtcatgggtgagctt

SEQ ID NO: 9237857 - DNA, 22 bp, Homo sapiens
ggccatggtcatgggtgagctt

SEQ ID NO: 9237858 - DNA, 22 bp, Homo sapiens
ggccatggggacagagggtgaa

SEQ ID NO: 9237859 - DNA, 22 bp, Homo sapiens
ggccatggggacagagggtgaa

SEQ ID NO: 9237860 - DNA, 20 bp, Homo sapiens
ggccatgggttgcctgaggt

SEQ ID NO: 9237861 - DNA, 22 bp, Homo sapiens
ggccccacgggggagtcctagt

SEQ ID NO: 9237862 - DNA, 22 bp, Homo sapiens
ggccccagttcactcctggccg

SEQ ID NO: 9237863 - DNA, 22 bp, Homo sapiens
ggcccccagggtgggtgtagac

SEQ ID NO: 9237864 - DNA, 22 bp, Homo sapiens
ggcccctgcggactgcctagag

SEQ ID NO: 9237865 - DNA, 22 bp, Homo sapiens
ggcttcagtggccagagatgat

SEQ ID NO: 9237866 - DNA, 22 bp, Homo sapiens
ggcttcagtgagctgagctcac

SEQ ID NO: 9237867 - DNA, 22 bp, Homo sapiens
ggcttcagtgagctgagctcac

SEQ ID NO: 9237868 - DNA, 22 bp, Homo sapiens
ggcttcatttctgtccttgatt

SEQ ID NO: 9237869 - DNA, 23 bp, Homo sapiens
ggcttcagtgagagtccctgctg

SEQ ID NO: 9237870 - DNA, 22 bp, Homo sapiens
ggcttcaggggcccagtcagca

SEQ ID NO: 9237871 - DNA, 22 bp, Homo sapiens
ggcttcaggggcccagtcagca

SEQ ID NO: 9237872 - DNA, 21 bp, Homo sapiens
ggctgtgttcagggcatgcgg

SEQ ID NO: 9237873 - DNA, 22 bp, Homo sapiens
ggcttcaggggcccagtcagca

SEQ ID NO: 9237874 - DNA, 22 bp, Homo sapiens
ggctgtgtcctgtatgattatt

SEQ ID NO: 9237875 - DNA, 22 bp, Homo sapiens
ggctgtgtccccacctgagcag

SEQ ID NO: 9237876 - DNA, 22 bp, Homo sapiens
ggcttcccaggcggtccccaca

SEQ ID NO: 9237877 - DNA, 22 bp, Homo sapiens
ggcttccagctgggccttggag

SEQ ID NO: 9237878 - DNA, 22 bp, Homo sapiens
ggctggctgataaagggttgag

SEQ ID NO: 9237879 - DNA, 22 bp, Homo sapiens
ggctggcttgccaagctcaggg

SEQ ID NO: 9237880 - DNA, 22 bp, Homo sapiens
ggctggctggcttagcagagga

SEQ ID NO: 9237881 - DNA, 22 bp, Homo sapiens
gggaactgtttaacaggggttt

SEQ ID NO: 9237882 - DNA, 23 bp, Homo sapiens
gggaccaggcccttcctggtttg

SEQ ID NO: 9237883 - DNA, 22 bp, Homo sapiens
gggaagacttagtcggttcaat

SEQ ID NO: 9237884 - DNA, 22 bp, Homo sapiens
gggaagaagacatggtgaaggc

SEQ ID NO: 9237885 - DNA, 22 bp, Homo sapiens
gggaagagaggaggtggtttcg

SEQ ID NO: 9237886 - DNA, 22 bp, Homo sapiens
ggcttctccaggtactgagcat

SEQ ID NO: 9237887 - DNA, 22 bp, Homo sapiens
ggcttctcagcacactgtccac

SEQ ID NO: 9237888 - DNA, 19 bp, Homo sapiens
ggcttcgaggctggggaag

SEQ ID NO: 9237889 - DNA, 22 bp, Homo sapiens
ggctttgggattcagcatgaga

SEQ ID NO: 9237890 - DNA, 22 bp, Homo sapiens
ggctttggggtgtgcagagatg

SEQ ID NO: 9237891 - DNA, 22 bp, Homo sapiens
ggcttcctggggcctcctgcaa

SEQ ID NO: 9237892 - DNA, 22 bp, Homo sapiens
ggcttcctttcactaccctcag

SEQ ID NO: 9237893 - DNA, 22 bp, Homo sapiens
ggcttcctttcactaccctcag

SEQ ID NO: 9237894 - DNA, 22 bp, Homo sapiens
ggcttcctggagaaggtctgag

SEQ ID NO: 9237895 - DNA, 22 bp, Homo sapiens
ggcttcctgggcatgtgttcta

SEQ ID NO: 9237896 - DNA, 22 bp, Homo sapiens
ggcttcctaatactccctacac

SEQ ID NO: 9237897 - DNA, 22 bp, Homo sapiens
ggcttcctaatactccctacac

SEQ ID NO: 9237898 - DNA, 22 bp, Homo sapiens
ggcttcctatcccatctgagtg

SEQ ID NO: 9237899 - DNA, 22 bp, Homo sapiens
ggcttcctccttcctgctgtca

SEQ ID NO: 9237900 - DNA, 22 bp, Homo sapiens
gggaaaggatcagtgggaggct

SEQ ID NO: 9237901 - DNA, 22 bp, Homo sapiens
gggaaaggatcagtgggaggct

SEQ ID NO: 9237902 - DNA, 22 bp, Homo sapiens
gggaaaggatcagtgggaggct

SEQ ID NO: 9237903 - DNA, 22 bp, Homo sapiens
gggaaaggatttacagtttgat

SEQ ID NO: 9237904 - DNA, 22 bp, Homo sapiens
gggaaaggatcagtgggaggct

SEQ ID NO: 9237905 - DNA, 19 bp, Homo sapiens
gggaaattcacttgcttcc

SEQ ID NO: 9237906 - DNA, 21 bp, Homo sapiens
gggaaattaggattgctcatc

SEQ ID NO: 9237907 - DNA, 22 bp, Homo sapiens
gggaaatctcgtcctctattta

SEQ ID NO: 9237908 - DNA, 22 bp, Homo sapiens
ggctcctggaggcaccactggt

SEQ ID NO: 9237909 - DNA, 23 bp, Homo sapiens
ggctcctggattcaaatcctgcc

SEQ ID NO: 9237910 - DNA, 22 bp, Homo sapiens
ggctcctgggcagctgctccct

SEQ ID NO: 9237911 - DNA, 22 bp, Homo sapiens
ggctcctgggatgggactgagc

SEQ ID NO: 9237912 - DNA, 22 bp, Homo sapiens
ggctcctgggagatagaggtca

SEQ ID NO: 9237913 - DNA, 22 bp, Homo sapiens
ggctcctgttatttaatgagga

SEQ ID NO: 9237914 - DNA, 22 bp, Homo sapiens
ggctctagagactctagagaaa

SEQ ID NO: 9237915 - DNA, 22 bp, Homo sapiens
ggctctccactatggatgagaa

SEQ ID NO: 9237916 - DNA, 19 bp, Homo sapiens
ggctctcccttgagagagc

SEQ ID NO: 9237917 - DNA, 22 bp, Homo sapiens
ggctgagttgagaggattactt

SEQ ID NO: 9237918 - DNA, 22 bp, Homo sapiens
ggctgagttgagaggattactt

SEQ ID NO: 9237919 - DNA, 22 bp, Homo sapiens
ggctgatcaggtgcaaatgcat

SEQ ID NO: 9237920 - DNA, 22 bp, Homo sapiens
ggctgatgagcttagctagaga

SEQ ID NO: 9237921 - DNA, 22 bp, Homo sapiens
ggctgatgagcttagctagaga

SEQ ID NO: 9237922 - DNA, 22 bp, Homo sapiens
ggctgatgggcatgagctgtca

SEQ ID NO: 9237923 - DNA, 22 bp, Homo sapiens
ggctgcagaggcccccagtggg

SEQ ID NO: 9237924 - DNA, 22 bp, Homo sapiens
ggctgcagaggcgatctgaggt

SEQ ID NO: 9237925 - DNA, 19 bp, Homo sapiens
ggctgcagagccccggcgc

SEQ ID NO: 9237926 - DNA, 19 bp, Homo sapiens
ggctgcagagccccggcgc

SEQ ID NO: 9237927 - DNA, 22 bp, Homo sapiens
ggctgcagagctgggtgggcct

SEQ ID NO: 9237928 - DNA, 22 bp, Homo sapiens
ggctgcagagctgggtgggcct

SEQ ID NO: 9237929 - DNA, 23 bp, Homo sapiens
ggctggcccggggctgctcctga

SEQ ID NO: 9237930 - DNA, 22 bp, Homo sapiens
ggctggcctcagggtcctcgct

SEQ ID NO: 9237931 - DNA, 23 bp, Homo sapiens
ggctggcccggggctgctcctga

SEQ ID NO: 9237932 - DNA, 23 bp, Homo sapiens
ggctgctcttttcatgctgtttc

SEQ ID NO: 9237933 - DNA, 21 bp, Homo sapiens
ggctgcctgggaagaagaaga

SEQ ID NO: 9237934 - DNA, 22 bp, Homo sapiens
ggctgcctgggagccctcctct

SEQ ID NO: 9237935 - DNA, 22 bp, Homo sapiens
ggctgccttcagactccagctt

SEQ ID NO: 9237936 - DNA, 22 bp, Homo sapiens
ggctgcaggcagaggctgtctg

SEQ ID NO: 9237937 - DNA, 22 bp, Homo sapiens
ggctgcaggcagaggctgtctg

SEQ ID NO: 9237938 - DNA, 22 bp, Homo sapiens
ggctgcaggatgcccagccgtg

SEQ ID NO: 9237939 - DNA, 22 bp, Homo sapiens
ggctgcaggatgcccagccgtg

SEQ ID NO: 9237940 - DNA, 22 bp, Homo sapiens
ggctgcaggaacgacggagggg

SEQ ID NO: 9237941 - DNA, 22 bp, Homo sapiens
ggctgcaggaacgacggagggg

SEQ ID NO: 9237942 - DNA, 22 bp, Homo sapiens
gggcagcacgtttcaggaggat

SEQ ID NO: 9237943 - DNA, 22 bp, Homo sapiens
gggcagcacgtttcaggaggat

SEQ ID NO: 9237944 - DNA, 21 bp, Homo sapiens
gggcagcacgtcattcctgtg

SEQ ID NO: 9237945 - DNA, 21 bp, Homo sapiens
gggcagcacgtcattcctgtg

SEQ ID NO: 9237946 - DNA, 20 bp, Homo sapiens
gggcagcctcgggagtgggt

SEQ ID NO: 9237947 - DNA, 22 bp, Homo sapiens
gggcagatggggcacaggctga

SEQ ID NO: 9237948 - DNA, 22 bp, Homo sapiens
gggcagaggttcaacttcaaca

SEQ ID NO: 9237949 - DNA, 22 bp, Homo sapiens
gggcagaggttcaacttcaaca

SEQ ID NO: 9237950 - DNA, 22 bp, Homo sapiens
gggcagcaaatctgagtctggt

SEQ ID NO: 9237951 - DNA, 22 bp, Homo sapiens
gggcagcacagacagtgaaggc

SEQ ID NO: 9237952 - DNA, 22 bp, Homo sapiens
gggcagcacagacagtgaaggc

SEQ ID NO: 9237953 - DNA, 18 bp, Homo sapiens
gggcagcacagcagcctc

SEQ ID NO: 9237954 - DNA, 21 bp, Homo sapiens
gggccacaccttctgcagacc

SEQ ID NO: 9237955 - DNA, 22 bp, Homo sapiens
gggcagctcctgtggaatccac

SEQ ID NO: 9237956 - DNA, 22 bp, Homo sapiens
gggcagctagccctctagccca

SEQ ID NO: 9237957 - DNA, 22 bp, Homo sapiens
gggcagctagccctctagccca

SEQ ID NO: 9237958 - DNA, 22 bp, Homo sapiens
gggcagctagccctctagccca

SEQ ID NO: 9237959 - DNA, 20 bp, Homo sapiens
gggcagctcccctcattctg

SEQ ID NO: 9237960 - DNA, 20 bp, Homo sapiens
gggcagctcccctcattctg

SEQ ID NO: 9237961 - DNA, 22 bp, Homo sapiens
gggcagctcagccaccatgcag

SEQ ID NO: 9237962 - DNA, 22 bp, Homo sapiens
gggcagctcagccaccatgcag

SEQ ID NO: 9237963 - DNA, 22 bp, Homo sapiens
gggcagcctcggtgcctgctgc

SEQ ID NO: 9237964 - DNA, 20 bp, Homo sapiens
gggcagcctcgggagtgggt

SEQ ID NO: 9237965 - DNA, 22 bp, Homo sapiens
gggccaggtcggtgaatggtca

SEQ ID NO: 9237966 - DNA, 22 bp, Homo sapiens
gggccaggtcggtgaatggtca

SEQ ID NO: 9237967 - DNA, 22 bp, Homo sapiens
gggccaggtcggtgaatggtca

SEQ ID NO: 9237968 - DNA, 22 bp, Homo sapiens
gggccaggtcggtgaatggtca

SEQ ID NO: 9237969 - DNA, 22 bp, Homo sapiens
gggccagtagcacctgtgtgga

SEQ ID NO: 9237970 - DNA, 22 bp, Homo sapiens
gggccaggagtggagatatggg

SEQ ID NO: 9237971 - DNA, 22 bp, Homo sapiens
gggccaggtatcgtctttagta

SEQ ID NO: 9237972 - DNA, 22 bp, Homo sapiens
gggccacaggccttgcccgcag

SEQ ID NO: 9237973 - DNA, 22 bp, Homo sapiens
gggcctggtgcttctgactcct

SEQ ID NO: 9237974 - DNA, 22 bp, Homo sapiens
gggcccagcgtggttccatctg

SEQ ID NO: 9237975 - DNA, 22 bp, Homo sapiens
gggcccagcgtggttccatctg

SEQ ID NO: 9237976 - DNA, 22 bp, Homo sapiens
gggcctgtgcacagttctgtta

SEQ ID NO: 9237977 - DNA, 22 bp, Homo sapiens
gggcctgtgtgttcaggagcct

SEQ ID NO: 9237978 - DNA, 19 bp, Homo sapiens
gggcccagcatggagggtt

SEQ ID NO: 9237979 - DNA, 19 bp, Homo sapiens
gggcccagcatggagggtt

SEQ ID NO: 9237980 - DNA, 22 bp, Homo sapiens
gggcccagccctctgctcactg

SEQ ID NO: 9237981 - DNA, 22 bp, Homo sapiens
gggcccagcactggctgggatc

SEQ ID NO: 9237982 - DNA, 23 bp, Homo sapiens
gggcccagcacaggacctggcag

SEQ ID NO: 9237983 - DNA, 22 bp, Homo sapiens
gggccatgagaggttcatcaac

SEQ ID NO: 9237984 - DNA, 22 bp, Homo sapiens
gggccagtgagtcgggagagct

SEQ ID NO: 9237985 - DNA, 22 bp, Homo sapiens
gggccagtgaacaatgagggaa

SEQ ID NO: 9237986 - DNA, 22 bp, Homo sapiens
gggcggatcacctgaggtcagg

SEQ ID NO: 9237987 - DNA, 22 bp, Homo sapiens
gggcggatcatttgaggtcagg

SEQ ID NO: 9237988 - DNA, 22 bp, Homo sapiens
gggcgtggatggtcagtgcagg

SEQ ID NO: 9237989 - DNA, 22 bp, Homo sapiens
gggcgtggatggtcagtgcagg

SEQ ID NO: 9237990 - DNA, 22 bp, Homo sapiens
gggcggggggagctggaatgaa

SEQ ID NO: 9237991 - DNA, 22 bp, Homo sapiens
gggcggggtggctcatgcctgt

SEQ ID NO: 9237992 - DNA, 22 bp, Homo sapiens
gggctacagacatgctctaagc

SEQ ID NO: 9237993 - DNA, 22 bp, Homo sapiens
gggctacattgtgagagaagtt

SEQ ID NO: 9237994 - DNA, 22 bp, Homo sapiens
gggctagaagttagctagagaa

SEQ ID NO: 9237995 - DNA, 22 bp, Homo sapiens
gggaggcgccgagggtagctaa

SEQ ID NO: 9237996 - DNA, 22 bp, Homo sapiens
gggaggctcagtggtgtcctct

SEQ ID NO: 9237997 - DNA, 22 bp, Homo sapiens
gggaggcgccgagggtagctaa

SEQ ID NO: 9237998 - DNA, 18 bp, Homo sapiens
gggaggccccagcaggag

SEQ ID NO: 9237999 - DNA, 20 bp, Homo sapiens
gggaggccccagagtccagg

SEQ ID NO: 9238000 - DNA, 20 bp, Homo sapiens
gggaggcgagggctgagcag

SEQ ID NO: 9238001 - DNA, 22 bp, Homo sapiens
gggaggctctgctcagcccccg

SEQ ID NO: 9238002 - DNA, 22 bp, Homo sapiens
gggaggctgccatccttcagga

SEQ ID NO: 9238003 - DNA, 22 bp, Homo sapiens
gggaggctggctctggccacag

SEQ ID NO: 9238004 - DNA, 22 bp, Homo sapiens
gggagaaggaggactgtgctgt

SEQ ID NO: 9238005 - DNA, 20 bp, Homo sapiens
gggagaagggctgatgagag

SEQ ID NO: 9238006 - DNA, 22 bp, Homo sapiens
gggaggagcttggagattcact

SEQ ID NO: 9238007 - DNA, 22 bp, Homo sapiens
gggaggagggtgctggctaaac

SEQ ID NO: 9238008 - DNA, 22 bp, Homo sapiens
gggagaaatgtctggcctgctg

SEQ ID NO: 9238009 - DNA, 22 bp, Homo sapiens
gggagaaggagctagttcttga

SEQ ID NO: 9238010 - DNA, 22 bp, Homo sapiens
gggagaagaatgtgtcaattgt

SEQ ID NO: 9238011 - DNA, 22 bp, Homo sapiens
gggacgggcagtccaaggggtc

SEQ ID NO: 9238012 - DNA, 22 bp, Homo sapiens
gggacgacaggctctgtggtag

SEQ ID NO: 9238013 - DNA, 22 bp, Homo sapiens
gggacgggcacggagggccctc

SEQ ID NO: 9238014 - DNA, 22 bp, Homo sapiens
gggaccctcaacatctgcttct

SEQ ID NO: 9238015 - DNA, 22 bp, Homo sapiens
gggacctgcgccactcactgtc

SEQ ID NO: 9238016 - DNA, 22 bp, Homo sapiens
gggcagaggggcgcttccctct

SEQ ID NO: 9238017 - DNA, 22 bp, Homo sapiens
gggcagaggggcgcttccctct

SEQ ID NO: 9238018 - DNA, 22 bp, Homo sapiens
gggcagaggggcgcttccctct

SEQ ID NO: 9238019 - DNA, 19 bp, Homo sapiens
gggatgggccctcaccctc

SEQ ID NO: 9238020 - DNA, 22 bp, Homo sapiens
gggatggggagctggaaagggg

SEQ ID NO: 9238021 - DNA, 22 bp, Homo sapiens
gggatggggagctggaaagggg

SEQ ID NO: 9238022 - DNA, 22 bp, Homo sapiens
gggatgggagagcatttagaga

SEQ ID NO: 9238023 - DNA, 22 bp, Homo sapiens
gggatggagggtagagcaagtg

SEQ ID NO: 9238024 - DNA, 22 bp, Homo sapiens
gggatggactgacggtagcgcg

SEQ ID NO: 9238025 - DNA, 22 bp, Homo sapiens
gggatggctgcctgcatcagga

SEQ ID NO: 9238026 - DNA, 22 bp, Homo sapiens
gggatggctgcctgcatcagga

SEQ ID NO: 9238027 - DNA, 22 bp, Homo sapiens
gggatggctcaaaggagtcagg

SEQ ID NO: 9238028 - DNA, 22 bp, Homo sapiens
gggatggctcaaaggagtcagg

SEQ ID NO: 9238029 - DNA, 22 bp, Homo sapiens
gggatggctcaaaggagtcagg

SEQ ID NO: 9238030 - DNA, 22 bp, Homo sapiens
gggatggatcttggctgaggct

SEQ ID NO: 9238031 - DNA, 22 bp, Homo sapiens
gggatggatcttggctgaggct

SEQ ID NO: 9238032 - DNA, 22 bp, Homo sapiens
gggagggaaggaccttatgaat

SEQ ID NO: 9238033 - DNA, 22 bp, Homo sapiens
gggagggaaggaggcgccgtgt

SEQ ID NO: 9238034 - DNA, 22 bp, Homo sapiens
gggagggaaagcttgatctgtc

SEQ ID NO: 9238035 - DNA, 22 bp, Homo sapiens
gggagggaaggaccttatgaat

SEQ ID NO: 9238036 - DNA, 22 bp, Homo sapiens
gggagggaaggtacctgtgtga

SEQ ID NO: 9238037 - DNA, 22 bp, Homo sapiens
gggagggaaggtacctgtgtga

SEQ ID NO: 9238038 - DNA, 22 bp, Homo sapiens
gggagggaaggaggcgccgtgt

SEQ ID NO: 9238039 - DNA, 22 bp, Homo sapiens
gggagggaaagcttgatctgtc

SEQ ID NO: 9238040 - DNA, 22 bp, Homo sapiens
gggagggaaagcttgatctgtc

SEQ ID NO: 9238041 - DNA, 22 bp, Homo sapiens
gggagggaaggtacctgtgtga

SEQ ID NO: 9238042 - DNA, 22 bp, Homo sapiens
gggatccatccgtgcagcagag

SEQ ID NO: 9238043 - DNA, 22 bp, Homo sapiens
gggatgaggatcaatcagggag

SEQ ID NO: 9238044 - DNA, 22 bp, Homo sapiens
gggatgaggatcaatcagggag

SEQ ID NO: 9238045 - DNA, 22 bp, Homo sapiens
gggatgcagactacagggctta

SEQ ID NO: 9238046 - DNA, 22 bp, Homo sapiens
ggggacgggacttagcatgagt

SEQ ID NO: 9238047 - DNA, 22 bp, Homo sapiens
gggggctgtcctgtgcattgta

SEQ ID NO: 9238048 - DNA, 23 bp, Homo sapiens
gggggctggttgactctctgcag

SEQ ID NO: 9238049 - DNA, 22 bp, Homo sapiens
gggggctgtcctgtgcattgta

SEQ ID NO: 9238050 - DNA, 22 bp, Homo sapiens
gggggctggactttcccacaca

SEQ ID NO: 9238051 - DNA, 22 bp, Homo sapiens
gggggctgaggctgttctgagg

SEQ ID NO: 9238052 - DNA, 22 bp, Homo sapiens
gggggctggaatatccatcaac

SEQ ID NO: 9238053 - DNA, 22 bp, Homo sapiens
ggggtaggcaggtgatctgatc

SEQ ID NO: 9238054 - DNA, 22 bp, Homo sapiens
gggtccagctacatcagggtgg

SEQ ID NO: 9238055 - DNA, 22 bp, Homo sapiens
gggtccagctacatcagggtgg

SEQ ID NO: 9238056 - DNA, 22 bp, Homo sapiens
gggtccagctacatcagggtgg

SEQ ID NO: 9238057 - DNA, 16 bp, Homo sapiens
gggggtgagagagagt

SEQ ID NO: 9238058 - DNA, 22 bp, Homo sapiens
gggggtgaggacaggagcactg

SEQ ID NO: 9238059 - DNA, 22 bp, Homo sapiens
ggggtactggctggagccccac

SEQ ID NO: 9238060 - DNA, 22 bp, Homo sapiens
ggggtactggctggagccccac

SEQ ID NO: 9238061 - DNA, 22 bp, Homo sapiens
gggggtgacgatggcagctggt

SEQ ID NO: 9238062 - DNA, 22 bp, Homo sapiens
ggggggcagctgtcctggccat

SEQ ID NO: 9238063 - DNA, 22 bp, Homo sapiens
ggggggctgttctggacaggaa

SEQ ID NO: 9238064 - DNA, 22 bp, Homo sapiens
ggggggtgacaagtagaggttg

SEQ ID NO: 9238065 - DNA, 22 bp, Homo sapiens
gggtgaggagctgccagtcatg

SEQ ID NO: 9238066 - DNA, 22 bp, Homo sapiens
gggtgaggagctgccagtcatg

SEQ ID NO: 9238067 - DNA, 20 bp, Homo sapiens
gggtgagatgtaggagaggg

SEQ ID NO: 9238068 - DNA, 22 bp, Homo sapiens
gggtgggatgccgctgtctcca

SEQ ID NO: 9238069 - DNA, 22 bp, Homo sapiens
gggtgggatgccgctgtctcca

SEQ ID NO: 9238070 - DNA, 22 bp, Homo sapiens
gggtgggaacaggatgccagga

SEQ ID NO: 9238071 - DNA, 22 bp, Homo sapiens
gggtgggaacaggatgccagga

SEQ ID NO: 9238072 - DNA, 22 bp, Homo sapiens
gggtgggcctgtctggccatgt

SEQ ID NO: 9238073 - DNA, 22 bp, Homo sapiens
gggtgggccactgagcagcgtg

SEQ ID NO: 9238074 - DNA, 23 bp, Homo sapiens
gggtgggccaaattaggtagcct

SEQ ID NO: 9238075 - DNA, 23 bp, Homo sapiens
gggtgggccaaattaggtagcct

SEQ ID NO: 9238076 - DNA, 22 bp, Homo sapiens
gggtgggatggcaggagccgct

SEQ ID NO: 9238077 - DNA, 22 bp, Homo sapiens
gggtctcctaatggaggatgac

SEQ ID NO: 9238078 - DNA, 22 bp, Homo sapiens
gggtctcctgagagaagatgct

SEQ ID NO: 9238079 - DNA, 22 bp, Homo sapiens
gggtctctcctccccagctgtg

SEQ ID NO: 9238080 - DNA, 22 bp, Homo sapiens
gggtctggacggctgcaggaag

SEQ ID NO: 9238081 - DNA, 22 bp, Homo sapiens
gggtctggacggctgcaggaag

SEQ ID NO: 9238082 - DNA, 22 bp, Homo sapiens
gggtctggagatccgggtgaag

SEQ ID NO: 9238083 - DNA, 22 bp, Homo sapiens
gggtctggacggctgcaggaag

SEQ ID NO: 9238084 - DNA, 22 bp, Homo sapiens
gggtctggcatgctgagatgga

SEQ ID NO: 9238085 - DNA, 22 bp, Homo sapiens
gggtctgggcaggcgcttcctc

SEQ ID NO: 9238086 - DNA, 22 bp, Homo sapiens
gggtgaagctcctgcaggggcc

SEQ ID NO: 9238087 - DNA, 22 bp, Homo sapiens
gggtctggcatgctgagatgga

SEQ ID NO: 9238088 - DNA, 22 bp, Homo sapiens
gggtctggcatgctgagatgga

SEQ ID NO: 9238089 - DNA, 22 bp, Homo sapiens
gggtgagacagaaagagcaaaa

SEQ ID NO: 9238090 - DNA, 20 bp, Homo sapiens
gggtgagatgtaggagaggg

SEQ ID NO: 9238091 - DNA, 22 bp, Homo sapiens
gggtgagagtcaggcagagatt

SEQ ID NO: 9238092 - DNA, 22 bp, Homo sapiens
ggggacagtcgatctagtgatt

SEQ ID NO: 9238093 - DNA, 22 bp, Homo sapiens
ggggacagtcgatctagtgatt

SEQ ID NO: 9238094 - DNA, 23 bp, Homo sapiens
ggggacagttcccactggggtct

SEQ ID NO: 9238095 - DNA, 23 bp, Homo sapiens
ggggacagttcccactggggtct

SEQ ID NO: 9238096 - DNA, 22 bp, Homo sapiens
ggggaaggattgagttgaccca

SEQ ID NO: 9238097 - DNA, 16 bp, Homo sapiens
ggggaaggcaagaggg

SEQ ID NO: 9238098 - DNA, 22 bp, Homo sapiens
ggggaagggagtccaagtgtta

SEQ ID NO: 9238099 - DNA, 23 bp, Homo sapiens
ggggaagtggcagtgagtgaggc

SEQ ID NO: 9238100 - DNA, 22 bp, Homo sapiens
gggctggatctcctgcaggcag

SEQ ID NO: 9238101 - DNA, 22 bp, Homo sapiens
gggctggatctcctgcaggcag

SEQ ID NO: 9238102 - DNA, 17 bp, Homo sapiens
gggctggatggccatgg

SEQ ID NO: 9238103 - DNA, 22 bp, Homo sapiens
gggctggatctcctgcaggcag

SEQ ID NO: 9238104 - DNA, 22 bp, Homo sapiens
gggctggatgtttgatgacgaa

SEQ ID NO: 9238105 - DNA, 22 bp, Homo sapiens
gggctggatgggagccttggcc

SEQ ID NO: 9238106 - DNA, 22 bp, Homo sapiens
gggctggcaggacctgggctga

SEQ ID NO: 9238107 - DNA, 22 bp, Homo sapiens
gggctggcaggacctgggctga

SEQ ID NO: 9238108 - DNA, 22 bp, Homo sapiens
gggctggcaggacctgggctga

SEQ ID NO: 9238109 - DNA, 21 bp, Homo sapiens
gggctggacatggtggctcat

SEQ ID NO: 9238110 - DNA, 22 bp, Homo sapiens
gggctggaccgcgacccctgag

SEQ ID NO: 9238111 - DNA, 22 bp, Homo sapiens
gggctggagacaagtgagccgc

SEQ ID NO: 9238112 - DNA, 22 bp, Homo sapiens
gggctggagacaagtgagccgc

SEQ ID NO: 9238113 - DNA, 22 bp, Homo sapiens
gggctggagagtcccacgtggg

SEQ ID NO: 9238114 - DNA, 22 bp, Homo sapiens
gggctggagccagctgtggctg

SEQ ID NO: 9238115 - DNA, 22 bp, Homo sapiens
gggctggagccagctgtggctg

SEQ ID NO: 9238116 - DNA, 22 bp, Homo sapiens
gggctggagcctggcggtggtt

SEQ ID NO: 9238117 - DNA, 22 bp, Homo sapiens
gggctggagcctggcggtggtt

SEQ ID NO: 9238118 - DNA, 22 bp, Homo sapiens
gggctggagccagctgtggctg

SEQ ID NO: 9238119 - DNA, 22 bp, Homo sapiens
gggctctggtcctgaactgaag

SEQ ID NO: 9238120 - DNA, 22 bp, Homo sapiens
gggctctggtacttcctggctc

SEQ ID NO: 9238121 - DNA, 22 bp, Homo sapiens
gggctagcctcttccctgctcc

SEQ ID NO: 9238122 - DNA, 22 bp, Homo sapiens
gggctaggcttggccagcactg

SEQ ID NO: 9238123 - DNA, 22 bp, Homo sapiens
gggctaggcttggccagcactg

SEQ ID NO: 9238124 - DNA, 22 bp, Homo sapiens
gggctgagaattcagctttcct

SEQ ID NO: 9238125 - DNA, 22 bp, Homo sapiens
gggctgagaattcagctttcct

SEQ ID NO: 9238126 - DNA, 22 bp, Homo sapiens
gggctgagacgatggggtcttc

SEQ ID NO: 9238127 - DNA, 22 bp, Homo sapiens
gggctgagaattcagctttcct

SEQ ID NO: 9238128 - DNA, 22 bp, Homo sapiens
gggctgagaattcagctttcct

SEQ ID NO: 9238129 - DNA, 22 bp, Homo sapiens
gggctgagaattcagctttcct

SEQ ID NO: 9238130 - DNA, 22 bp, Homo sapiens
gggctgagagctggaatctgag

SEQ ID NO: 9238131 - DNA, 22 bp, Homo sapiens
gggctgagacgatggggtcttc

SEQ ID NO: 9238132 - DNA, 22 bp, Homo sapiens
gggctgagacgatggggtcttc

SEQ ID NO: 9238133 - DNA, 22 bp, Homo sapiens
gggctgagacgatggggtcttc

SEQ ID NO: 9238134 - DNA, 22 bp, Homo sapiens
gggctgagaattcagctttcct

SEQ ID NO: 9238135 - DNA, 22 bp, Homo sapiens
gggctgagaattcagctttcct

SEQ ID NO: 9238136 - DNA, 22 bp, Homo sapiens
gggctgagaagttgatcccaag

SEQ ID NO: 9238137 - DNA, 22 bp, Homo sapiens
gggctggaaaaacaacatacaa

SEQ ID NO: 9238138 - DNA, 22 bp, Homo sapiens
gggctggaagtgcattgatgct

SEQ ID NO: 9238139 - DNA, 22 bp, Homo sapiens
ggcagctgtgaagtgcctcaca

SEQ ID NO: 9238140 - DNA, 22 bp, Homo sapiens
ggcagctgtaagatgagtgaat

SEQ ID NO: 9238141 - DNA, 22 bp, Homo sapiens
ggcagctgtaagatgagtgaat

SEQ ID NO: 9238142 - DNA, 22 bp, Homo sapiens
ggcagctggggcagtgccctgt

SEQ ID NO: 9238143 - DNA, 23 bp, Homo sapiens
ggcagctgggcagcactcatggg

SEQ ID NO: 9238144 - DNA, 22 bp, Homo sapiens
ggcagctggggcagtgccctgt

SEQ ID NO: 9238145 - DNA, 22 bp, Homo sapiens
ggcagctgggttggccagaaac

SEQ ID NO: 9238146 - DNA, 22 bp, Homo sapiens
ggcagctgggtcacaccgatct

SEQ ID NO: 9238147 - DNA, 20 bp, Homo sapiens
ggcagctctagtcgaggccc

SEQ ID NO: 9238148 - DNA, 22 bp, Homo sapiens
ggcagaggaagctggaagtggg

SEQ ID NO: 9238149 - DNA, 22 bp, Homo sapiens
ggcagaggaagctggaagtggg

SEQ ID NO: 9238150 - DNA, 22 bp, Homo sapiens
ggcagaggaagctggaagtggg

SEQ ID NO: 9238151 - DNA, 22 bp, Homo sapiens
ggcagaggaagctggaagtggg

SEQ ID NO: 9238152 - DNA, 22 bp, Homo sapiens
ggcagaggaagctggaagtggg

SEQ ID NO: 9238153 - DNA, 22 bp, Homo sapiens
ggcagaggaagctggaagtggg

SEQ ID NO: 9238154 - DNA, 22 bp, Homo sapiens
ggcagctggcctcctcgcccac

SEQ ID NO: 9238155 - DNA, 22 bp, Homo sapiens
ggcaggcagcctccatccacag

SEQ ID NO: 9238156 - DNA, 22 bp, Homo sapiens
ggcaggctccaagcatcctatg

SEQ ID NO: 9238157 - DNA, 22 bp, Homo sapiens
ggcaggctgcttgggtcatgtc

SEQ ID NO: 9238158 - DNA, 22 bp, Homo sapiens
ggcaggctgggagtcatcagag

SEQ ID NO: 9238159 - DNA, 22 bp, Homo sapiens
ggcaggctggctttgttccagg

SEQ ID NO: 9238160 - DNA, 22 bp, Homo sapiens
ggcaggctgcttgggtcatgtc

SEQ ID NO: 9238161 - DNA, 22 bp, Homo sapiens
ggcaggtgctaagagaggtaaa

SEQ ID NO: 9238162 - DNA, 22 bp, Homo sapiens
ggcaggtgctctgtgggcctgg

SEQ ID NO: 9238163 - DNA, 20 bp, Homo sapiens
ggcaggtgctcgcttggtct

SEQ ID NO: 9238164 - DNA, 17 bp, Homo sapiens
ggcaggtgcggggccgc

SEQ ID NO: 9238165 - DNA, 22 bp, Homo sapiens
ggcaggtgctaagagaggtaaa

SEQ ID NO: 9238166 - DNA, 22 bp, Homo sapiens
ggcagactgtaataggagaatt

SEQ ID NO: 9238167 - DNA, 21 bp, Homo sapiens
ggcagagaagctggaagttgg

SEQ ID NO: 9238168 - DNA, 22 bp, Homo sapiens
ggcagactttttctctgaaggg

SEQ ID NO: 9238169 - DNA, 22 bp, Homo sapiens
ggcagactttttctctgaaggg

SEQ ID NO: 9238170 - DNA, 22 bp, Homo sapiens
ggcagacctctccagccccaca

SEQ ID NO: 9238171 - DNA, 22 bp, Homo sapiens
ggcagacacctttatgtctaat

SEQ ID NO: 9238172 - DNA, 22 bp, Homo sapiens
ggcagagactgggttggcagag

SEQ ID NO: 9238173 - DNA, 23 bp, Homo sapiens
ggcagagagcatggctggggccc

SEQ ID NO: 9238174 - DNA, 23 bp, Homo sapiens
ggcagagagcatggctggggccc

SEQ ID NO: 9238175 - DNA, 22 bp, Homo sapiens
ggcagagacaccgaatgactct

SEQ ID NO: 9238176 - DNA, 23 bp, Homo sapiens
ggcagagagcatggctggggccc

SEQ ID NO: 9238177 - DNA, 22 bp, Homo sapiens
ggcagagcttgttccttctgtt

SEQ ID NO: 9238178 - DNA, 22 bp, Homo sapiens
ggcagaggaagctggaagtggg

SEQ ID NO: 9238179 - DNA, 22 bp, Homo sapiens
ggcagaggaagctggaagtggg

SEQ ID NO: 9238180 - DNA, 22 bp, Homo sapiens
ggcacagagctccagccttggc

SEQ ID NO: 9238181 - DNA, 22 bp, Homo sapiens
ggcacagagttggcagagctgc

SEQ ID NO: 9238182 - DNA, 23 bp, Homo sapiens
ggcacagatgctgagcatgtgca

SEQ ID NO: 9238183 - DNA, 22 bp, Homo sapiens
ggcacagcaccttttcacattg

SEQ ID NO: 9238184 - DNA, 22 bp, Homo sapiens
ggagtggcagagagggtatact

SEQ ID NO: 9238185 - DNA, 22 bp, Homo sapiens
ggagtggcagcgaggatcagat

SEQ ID NO: 9238186 - DNA, 22 bp, Homo sapiens
ggagtggcctctcctgtgcagg

SEQ ID NO: 9238187 - DNA, 22 bp, Homo sapiens
ggagtggcctctcctgtgcagg

SEQ ID NO: 9238188 - DNA, 22 bp, Homo sapiens
ggagtggctatttgtgctggtt

SEQ ID NO: 9238189 - DNA, 22 bp, Homo sapiens
ggagtggccacgactgggagat

SEQ ID NO: 9238190 - DNA, 22 bp, Homo sapiens
ggagtgggcagcactgccctgt

SEQ ID NO: 9238191 - DNA, 22 bp, Homo sapiens
ggagtgggaacaatgacatggt

SEQ ID NO: 9238192 - DNA, 22 bp, Homo sapiens
ggagtgggaacaatgacatggt

SEQ ID NO: 9238193 - DNA, 22 bp, Homo sapiens
ggagtgggaacaatgacatggt

SEQ ID NO: 9238194 - DNA, 22 bp, Homo sapiens
ggagtggctgtttctgccccca

SEQ ID NO: 9238195 - DNA, 22 bp, Homo sapiens
ggagttcactgtgcaggctctg

SEQ ID NO: 9238196 - DNA, 22 bp, Homo sapiens
ggagtgtgggatggagctcagg

SEQ ID NO: 9238197 - DNA, 22 bp, Homo sapiens
ggagtgtggagaggacatgggt

SEQ ID NO: 9238198 - DNA, 22 bp, Homo sapiens
ggagtggtgtcactgagaggaa

SEQ ID NO: 9238199 - DNA, 22 bp, Homo sapiens
ggagtggtgtcactgagaggaa

SEQ ID NO: 9238200 - DNA, 22 bp, Homo sapiens
ggagtgtggagaggacatgggt

SEQ ID NO: 9238201 - DNA, 17 bp, Homo sapiens
ggagttctgcagtcagg

SEQ ID NO: 9238202 - DNA, 22 bp, Homo sapiens
ggagttgattttggatatatta

SEQ ID NO: 9238203 - DNA, 22 bp, Homo sapiens
ggagttgattttggatatatta

SEQ ID NO: 9238204 - DNA, 22 bp, Homo sapiens
ggcacagagaggccctggaagg

SEQ ID NO: 9238205 - DNA, 22 bp, Homo sapiens
ggcacacaggcagatggagtgt

SEQ ID NO: 9238206 - DNA, 22 bp, Homo sapiens
ggcacacatagatctgcactgg

SEQ ID NO: 9238207 - DNA, 22 bp, Homo sapiens
ggcacacatggtggttggtgaa

SEQ ID NO: 9238208 - DNA, 22 bp, Homo sapiens
ggcaaggccttgcccagcattc

SEQ ID NO: 9238209 - DNA, 22 bp, Homo sapiens
ggcaagggacggccgtgagaca

SEQ ID NO: 9238210 - DNA, 22 bp, Homo sapiens
ggcacacagatggagcactagc

SEQ ID NO: 9238211 - DNA, 22 bp, Homo sapiens
ggcacacagcttggcaggagat

SEQ ID NO: 9238212 - DNA, 22 bp, Homo sapiens
ggagggggaattcagccccagc

SEQ ID NO: 9238213 - DNA, 22 bp, Homo sapiens
ggagggggaattcagccccagc

SEQ ID NO: 9238214 - DNA, 22 bp, Homo sapiens
ggagggggaagaagctaaagac

SEQ ID NO: 9238215 - DNA, 22 bp, Homo sapiens
ggagggggaaactttggctgcc

SEQ ID NO: 9238216 - DNA, 22 bp, Homo sapiens
ggaggggctcctgttcgccccc

SEQ ID NO: 9238217 - DNA, 22 bp, Homo sapiens
ggaggggctgagcaactttcag

SEQ ID NO: 9238218 - DNA, 22 bp, Homo sapiens
ggaggggaggtccagctgatct

SEQ ID NO: 9238219 - DNA, 22 bp, Homo sapiens
ggaggggaggtccagctgatct

SEQ ID NO: 9238220 - DNA, 22 bp, Homo sapiens
ggaggggaggattaatgacaaa

SEQ ID NO: 9238221 - DNA, 22 bp, Homo sapiens
ggaggggagatgtttgggctca

SEQ ID NO: 9238222 - DNA, 22 bp, Homo sapiens
ggagggtctaagggagaactga

SEQ ID NO: 9238223 - DNA, 22 bp, Homo sapiens
ggagggtccccagcagcatgaa

SEQ ID NO: 9238224 - DNA, 22 bp, Homo sapiens
ggagggtgcattttaccctgtg

SEQ ID NO: 9238225 - DNA, 22 bp, Homo sapiens
ggaggggtggtcgcgaagagca

SEQ ID NO: 9238226 - DNA, 22 bp, Homo sapiens
ggagggtccactgtgaggcaga

SEQ ID NO: 9238227 - DNA, 22 bp, Homo sapiens
ggaggggtggtcacctggcagg

SEQ ID NO: 9238228 - DNA, 22 bp, Homo sapiens
ggaggggtggtcacctggcagg

SEQ ID NO: 9238229 - DNA, 22 bp, Homo sapiens
ggaggggtgctcagctgtcacg

SEQ ID NO: 9238230 - DNA, 22 bp, Homo sapiens
ggaggggtgctcagctgtcacg

SEQ ID NO: 9238231 - DNA, 22 bp, Homo sapiens
ggaggggtctctagcgaggaga

SEQ ID NO: 9238232 - DNA, 22 bp, Homo sapiens
ggaggggtctctagcgaggaga

SEQ ID NO: 9238233 - DNA, 22 bp, Homo sapiens
ggagggggactgacactgattt

SEQ ID NO: 9238234 - DNA, 22 bp, Homo sapiens
ggaggtgggagtttagttcttg

SEQ ID NO: 9238235 - DNA, 22 bp, Homo sapiens
ggaggtgggattaggacctaaa

SEQ ID NO: 9238236 - DNA, 22 bp, Homo sapiens
ggaggtgggattaggacctaaa

SEQ ID NO: 9238237 - DNA, 22 bp, Homo sapiens
ggaggtgggagcctccagtggt

SEQ ID NO: 9238238 - DNA, 22 bp, Homo sapiens
ggaggtgggagacataggcggc

SEQ ID NO: 9238239 - DNA, 22 bp, Homo sapiens
ggaggtggcctgaaaatgtggc

SEQ ID NO: 9238240 - DNA, 22 bp, Homo sapiens
ggaggtgggctaaggactctct

SEQ ID NO: 9238241 - DNA, 22 bp, Homo sapiens
ggaggtgggctaaggactctct

SEQ ID NO: 9238242 - DNA, 22 bp, Homo sapiens
ggaggtggtggcagtgacaatt

SEQ ID NO: 9238243 - DNA, 22 bp, Homo sapiens
ggaggtgggctaaggactctct

SEQ ID NO: 9238244 - DNA, 22 bp, Homo sapiens
ggaggtggtttgatttctatat

SEQ ID NO: 9238245 - DNA, 22 bp, Homo sapiens
ggagtagctgcattccgagcac

SEQ ID NO: 9238246 - DNA, 22 bp, Homo sapiens
ggagtagctgcattccgagcac

SEQ ID NO: 9238247 - DNA, 22 bp, Homo sapiens
ggaggtcaaatggagggctggg

SEQ ID NO: 9238248 - DNA, 22 bp, Homo sapiens
ggaggtagtctgagtcataggc

SEQ ID NO: 9238249 - DNA, 22 bp, Homo sapiens
ggagggttagcaaaggcacaga

SEQ ID NO: 9238250 - DNA, 22 bp, Homo sapiens
ggagggtggcagcgtcctgggc

SEQ ID NO: 9238251 - DNA, 22 bp, Homo sapiens
ggagggtggcagcgtcctgggc

SEQ ID NO: 9238252 - DNA, 22 bp, Homo sapiens
ggaggtcatagctgtgcaggta

SEQ ID NO: 9238253 - DNA, 22 bp, Homo sapiens
ggaggtggaggttgcagtgagc

SEQ ID NO: 9238254 - DNA, 22 bp, Homo sapiens
ggaggtggaggttgcagtgagc

SEQ ID NO: 9238255 - DNA, 22 bp, Homo sapiens
ggaggtggcagagggacattct

SEQ ID NO: 9238256 - DNA, 22 bp, Homo sapiens
ggaggtggcagagggacattct

SEQ ID NO: 9238257 - DNA, 22 bp, Homo sapiens
ggaggggaactaatcccgtgac

SEQ ID NO: 9238258 - DNA, 22 bp, Homo sapiens
ggagggctgccaggtggagcgg

SEQ ID NO: 9238259 - DNA, 22 bp, Homo sapiens
ggagggctgccaggtggagcgg

SEQ ID NO: 9238260 - DNA, 22 bp, Homo sapiens
ggagggccctgggtgcagctct

SEQ ID NO: 9238261 - DNA, 22 bp, Homo sapiens
ggagggctcaattgactcctga

SEQ ID NO: 9238262 - DNA, 22 bp, Homo sapiens
ggagggctccctgggagtggat

SEQ ID NO: 9238263 - DNA, 22 bp, Homo sapiens
ggagggctccctgggagtggat

SEQ ID NO: 9238264 - DNA, 22 bp, Homo sapiens
ggagggctgagactggggtctg

SEQ ID NO: 9238265 - DNA, 22 bp, Homo sapiens
ggagggctgccaggtggagcgg

SEQ ID NO: 9238266 - DNA, 22 bp, Homo sapiens
ggagggccatcttgggtgtgat

SEQ ID NO: 9238267 - DNA, 22 bp, Homo sapiens
ggagggcccctccagtgggcag

SEQ ID NO: 9238268 - DNA, 21 bp, Homo sapiens
ggagggcagcccagactggct

SEQ ID NO: 9238269 - DNA, 21 bp, Homo sapiens
ggagggcagcccagactggct

SEQ ID NO: 9238270 - DNA, 21 bp, Homo sapiens
ggagggcagcccagactggct

SEQ ID NO: 9238271 - DNA, 22 bp, Homo sapiens
ggagggagagtgaccctaccaa

SEQ ID NO: 9238272 - DNA, 22 bp, Homo sapiens
ggagggagagtgaccctaccaa

SEQ ID NO: 9238273 - DNA, 22 bp, Homo sapiens
ggagggacccactctagaggtg

SEQ ID NO: 9238274 - DNA, 22 bp, Homo sapiens
ggaggcttgatgatcttggata

SEQ ID NO: 9238275 - DNA, 22 bp, Homo sapiens
ggaggctcctaagctgacttga

SEQ ID NO: 9238276 - DNA, 22 bp, Homo sapiens
ggaggctctaaactttccttgg

SEQ ID NO: 9238277 - DNA, 22 bp, Homo sapiens
ggaggctctcctggccttgtct

SEQ ID NO: 9238278 - DNA, 22 bp, Homo sapiens
ggaggctgagaggtcgcagtgg

SEQ ID NO: 9238279 - DNA, 22 bp, Homo sapiens
ggaggctgagaagtccaagatc

SEQ ID NO: 9238280 - DNA, 22 bp, Homo sapiens
ggaggctgagaagtccaagatc

SEQ ID NO: 9238281 - DNA, 22 bp, Homo sapiens
ggaggctgctgcctcacgtggg

SEQ ID NO: 9238282 - DNA, 22 bp, Homo sapiens
ggaggcttcctggctcttgatt

SEQ ID NO: 9238283 - DNA, 22 bp, Homo sapiens
ggaggctgctgcctcacgtggg

SEQ ID NO: 9238284 - DNA, 22 bp, Homo sapiens
ggaggctgaggcaggcggatca

SEQ ID NO: 9238285 - DNA, 22 bp, Homo sapiens
ggaggctgaggcccctcacagg

SEQ ID NO: 9238286 - DNA, 22 bp, Homo sapiens
ggaggctgaggcccctcacagg

SEQ ID NO: 9238287 - DNA, 22 bp, Homo sapiens
ggaggctgaggcccctcacagg

SEQ ID NO: 9238288 - DNA, 22 bp, Homo sapiens
ggaggcctagaaaagtggttct

SEQ ID NO: 9238289 - DNA, 22 bp, Homo sapiens
ggaggccatgggcagaatcttt

SEQ ID NO: 9238290 - DNA, 22 bp, Homo sapiens
ggaggccttgaggccaggagct

SEQ ID NO: 9238291 - DNA, 22 bp, Homo sapiens
ggaggctccatgagctcctgca

SEQ ID NO: 9238292 - DNA, 22 bp, Homo sapiens
ggaggcggaggttgcagtgagt

SEQ ID NO: 9238293 - DNA, 22 bp, Homo sapiens
ggaggccagggtgggtggatcg

SEQ ID NO: 9238294 - DNA, 22 bp, Homo sapiens
ggaggccaggtgggagtcatct

SEQ ID NO: 9238295 - DNA, 22 bp, Homo sapiens
ggaggccagggacccagtcagc

SEQ ID NO: 9238296 - DNA, 22 bp, Homo sapiens
ggaggccagggacccagtcagc

SEQ ID NO: 9238297 - DNA, 15 bp, Homo sapiens
ggaggccaggctgtg

SEQ ID NO: 9238298 - DNA, 22 bp, Homo sapiens
ggaggccaggatgggaactcaa

SEQ ID NO: 9238299 - DNA, 22 bp, Homo sapiens
ggaggccaggaagagccgccct

SEQ ID NO: 9238300 - DNA, 22 bp, Homo sapiens
ggaggccaggatgggaactcaa

SEQ ID NO: 9238301 - DNA, 22 bp, Homo sapiens
ggaggccaggaaggctcggaga

SEQ ID NO: 9238302 - DNA, 22 bp, Homo sapiens
ggaggccagcctgaggctgagg

SEQ ID NO: 9238303 - DNA, 22 bp, Homo sapiens
ggaggccagcctgaggctgagg

SEQ ID NO: 9238304 - DNA, 22 bp, Homo sapiens
ggaggccatgaggctctaggtg

SEQ ID NO: 9238305 - DNA, 22 bp, Homo sapiens
ggaggccatctggctggaggct

SEQ ID NO: 9238306 - DNA, 22 bp, Homo sapiens
ggaggccatgaggctctaggtg

SEQ ID NO: 9238307 - DNA, 22 bp, Homo sapiens
ggaggccatctggctggaggct

SEQ ID NO: 9238308 - DNA, 22 bp, Homo sapiens
ggaggccatcagggagggcatt

SEQ ID NO: 9238309 - DNA, 22 bp, Homo sapiens
ggaggccatctggctggaggct

SEQ ID NO: 9238310 - DNA, 22 bp, Homo sapiens
ggaggccatagtttgggagtca

SEQ ID NO: 9238311 - DNA, 22 bp, Homo sapiens
ggaggccatcagggagggcatt

SEQ ID NO: 9238312 - DNA, 22 bp, Homo sapiens
ggaggccagtcctggccgggct

SEQ ID NO: 9238313 - DNA, 22 bp, Homo sapiens
ggaggccagtcctggccgggct

SEQ ID NO: 9238314 - DNA, 22 bp, Homo sapiens
ggaggccatagtttgggagtca

SEQ ID NO: 9238315 - DNA, 22 bp, Homo sapiens
ggaggaggcaagtaccagatgc

SEQ ID NO: 9238316 - DNA, 22 bp, Homo sapiens
ggaggaggcaagtaccagatgc

SEQ ID NO: 9238317 - DNA, 22 bp, Homo sapiens
ggaggcagaatagagtgtgggt

SEQ ID NO: 9238318 - DNA, 22 bp, Homo sapiens
ggaggccaaggcgggcggatca

SEQ ID NO: 9238319 - DNA, 22 bp, Homo sapiens
ggaggcagaatagagtgtgggt

SEQ ID NO: 9238320 - DNA, 22 bp, Homo sapiens
ggaggccacggtttagcaccga

SEQ ID NO: 9238321 - DNA, 22 bp, Homo sapiens
ggaggccagaatctgtgttgga

SEQ ID NO: 9238322 - DNA, 22 bp, Homo sapiens
ggaggccacggtttagcaccga

SEQ ID NO: 9238323 - DNA, 22 bp, Homo sapiens
ggaggccacctgacctgctgtt

SEQ ID NO: 9238324 - DNA, 22 bp, Homo sapiens
ggaggccacctgacctgctgtt

SEQ ID NO: 9238325 - DNA, 22 bp, Homo sapiens
ggaggccaattttctaactgca

SEQ ID NO: 9238326 - DNA, 22 bp, Homo sapiens
ggaggccaccatggagtcactt

SEQ ID NO: 9238327 - DNA, 22 bp, Homo sapiens
ggaggccaagtcactgacctgg

SEQ ID NO: 9238328 - DNA, 22 bp, Homo sapiens
ggaggccaaggtgggcggatca

SEQ ID NO: 9238329 - DNA, 22 bp, Homo sapiens
ggaggaagccctcggtgcccca

SEQ ID NO: 9238330 - DNA, 22 bp, Homo sapiens
ggaggaagtgcagttctactac

SEQ ID NO: 9238331 - DNA, 22 bp, Homo sapiens
ggaggaagcacacggcttgtat

SEQ ID NO: 9238332 - DNA, 22 bp, Homo sapiens
ggaggaagcacacggcttgtat

SEQ ID NO: 9238333 - DNA, 22 bp, Homo sapiens
ggaggaagaggttgttctctca

SEQ ID NO: 9238334 - DNA, 22 bp, Homo sapiens
ggaggagctgctgtgggggccc

SEQ ID NO: 9238335 - DNA, 22 bp, Homo sapiens
ggaggagcccactcaaagggga

SEQ ID NO: 9238336 - DNA, 22 bp, Homo sapiens
ggaggagcatgagagggtagtg

SEQ ID NO: 9238337 - DNA, 22 bp, Homo sapiens
ggaggagcatgagagggtagtg

SEQ ID NO: 9238338 - DNA, 22 bp, Homo sapiens
ggaggacactggctctgccttc

SEQ ID NO: 9238339 - DNA, 22 bp, Homo sapiens
ggaggacactggctctgccttc

SEQ ID NO: 9238340 - DNA, 22 bp, Homo sapiens
ggaggacaggggctgcagcaca

SEQ ID NO: 9238341 - DNA, 22 bp, Homo sapiens
ggagctgaaggggtgggctcag

SEQ ID NO: 9238342 - DNA, 22 bp, Homo sapiens
ggagctgatgacgtcaccatgg

SEQ ID NO: 9238343 - DNA, 22 bp, Homo sapiens
ggagctgcacgctctgaagcct

SEQ ID NO: 9238344 - DNA, 22 bp, Homo sapiens
ggaggaaatccttagtaaggca

SEQ ID NO: 9238345 - DNA, 22 bp, Homo sapiens
ggagacaatggaggccaaaaga

SEQ ID NO: 9238346 - DNA, 22 bp, Homo sapiens
ggagaatgattctttgctcact

SEQ ID NO: 9238347 - DNA, 17 bp, Homo sapiens
ggagacagggtctttaa

SEQ ID NO: 9238348 - DNA, 17 bp, Homo sapiens
ggagacagggtctttaa

SEQ ID NO: 9238349 - DNA, 22 bp, Homo sapiens
ggagacagggttgaaccacgca

SEQ ID NO: 9238350 - DNA, 22 bp, Homo sapiens
ggagacactggaaagtattaca

SEQ ID NO: 9238351 - DNA, 22 bp, Homo sapiens
ggagaaggaagaaagctactat

SEQ ID NO: 9238352 - DNA, 22 bp, Homo sapiens
ggagaaggaagaaagctactat

SEQ ID NO: 9238353 - DNA, 22 bp, Homo sapiens
ggagaaggaatattggagtagg

SEQ ID NO: 9238354 - DNA, 21 bp, Homo sapiens
ggagaaggacaatgttgagta

SEQ ID NO: 9238355 - DNA, 22 bp, Homo sapiens
ggagaaggaatattggagtagg

SEQ ID NO: 9238356 - DNA, 21 bp, Homo sapiens
ggagaaggacaatgttgagta

SEQ ID NO: 9238357 - DNA, 22 bp, Homo sapiens
ggaataaagaatctggttcccc

SEQ ID NO: 9238358 - DNA, 22 bp, Homo sapiens
ggaataaagaatctggttcccc

SEQ ID NO: 9238359 - DNA, 22 bp, Homo sapiens
ggaataaaaattgtttactgta

SEQ ID NO: 9238360 - DNA, 22 bp, Homo sapiens
ggaatactaaaggaagcaattg

SEQ ID NO: 9238361 - DNA, 22 bp, Homo sapiens
ggaatatagccagtaacagtca

SEQ ID NO: 9238362 - DNA, 19 bp, Homo sapiens
ggagaagcatctagaaata

SEQ ID NO: 9238363 - DNA, 22 bp, Homo sapiens
ggagaagccacacattgggtgt

SEQ ID NO: 9238364 - DNA, 22 bp, Homo sapiens
ggagaagcaggtgctttgggtc

SEQ ID NO: 9238365 - DNA, 19 bp, Homo sapiens
ggagaagcccaggaatcct

SEQ ID NO: 9238366 - DNA, 22 bp, Homo sapiens
ggaagtgtttccttgggcagca

SEQ ID NO: 9238367 - DNA, 18 bp, Homo sapiens
ggaaggtgctggagtgca

SEQ ID NO: 9238368 - DNA, 22 bp, Homo sapiens
ggagcctgtgggatgagatgtg

SEQ ID NO: 9238369 - DNA, 22 bp, Homo sapiens
ggagcctgttagttgagtgctc

SEQ ID NO: 9238370 - DNA, 22 bp, Homo sapiens
ggagcctgtggctgcttgaagc

SEQ ID NO: 9238371 - DNA, 22 bp, Homo sapiens
ggagcctgttagttgagtgctc

SEQ ID NO: 9238372 - DNA, 22 bp, Homo sapiens
ggagcctgtgggatgagatgtg

SEQ ID NO: 9238373 - DNA, 22 bp, Homo sapiens
ggagcctgtggctgcttgaagc

SEQ ID NO: 9238374 - DNA, 22 bp, Homo sapiens
ggagcctgtggccgtcacgact

SEQ ID NO: 9238375 - DNA, 22 bp, Homo sapiens
ggagatgcaatgtagaatctgg

SEQ ID NO: 9238376 - DNA, 20 bp, Homo sapiens
ggagatgcagcccaggtgcc

SEQ ID NO: 9238377 - DNA, 22 bp, Homo sapiens
ggagatgccagaattgcaaatt

SEQ ID NO: 9238378 - DNA, 22 bp, Homo sapiens
ggagatgccagaattgcaaatt

SEQ ID NO: 9238379 - DNA, 22 bp, Homo sapiens
ggagatgccagaattgcaaatt

SEQ ID NO: 9238380 - DNA, 22 bp, Homo sapiens
ggagatgctatgtagtttggtt

SEQ ID NO: 9238381 - DNA, 22 bp, Homo sapiens
ggagatgctttccagtggggat

SEQ ID NO: 9238382 - DNA, 22 bp, Homo sapiens
ggagatggaatagattctgact

SEQ ID NO: 9238383 - DNA, 22 bp, Homo sapiens
ggagcctgtgcccaagcccaga

SEQ ID NO: 9238384 - DNA, 22 bp, Homo sapiens
ggagcctggtcaggttggctcc

SEQ ID NO: 9238385 - DNA, 22 bp, Homo sapiens
ggagagggggctccctgcttgg

SEQ ID NO: 9238386 - DNA, 23 bp, Homo sapiens
ggagaggggtgtgggcatcttta

SEQ ID NO: 9238387 - DNA, 22 bp, Homo sapiens
ggagaggggaacttgttgcttg

SEQ ID NO: 9238388 - DNA, 22 bp, Homo sapiens
ggagagggtaggggtcctgccc

SEQ ID NO: 9238389 - DNA, 22 bp, Homo sapiens
ggagagggtaggggtcctgccc

SEQ ID NO: 9238390 - DNA, 22 bp, Homo sapiens
gctgggctccaccctcaactgt

SEQ ID NO: 9238391 - DNA, 22 bp, Homo sapiens
gctgggctccaggccagggtga

SEQ ID NO: 9238392 - DNA, 22 bp, Homo sapiens
gctgggcagtgagtgagtcctt

SEQ ID NO: 9238393 - DNA, 22 bp, Homo sapiens
gctgggccagagcagcagcact

SEQ ID NO: 9238394 - DNA, 22 bp, Homo sapiens
gctgggctcagacctagtgaac

SEQ ID NO: 9238395 - DNA, 22 bp, Homo sapiens
gctgggctgagaagttaagcaa

SEQ ID NO: 9238396 - DNA, 22 bp, Homo sapiens
gctgggctcttatcacctgtac

SEQ ID NO: 9238397 - DNA, 22 bp, Homo sapiens
gctgggctcttatcacctgtac

SEQ ID NO: 9238398 - DNA, 22 bp, Homo sapiens
gctgggctcttatcacctgtac

SEQ ID NO: 9238399 - DNA, 21 bp, Homo sapiens
gctgggctccagtctgccgct

SEQ ID NO: 9238400 - DNA, 22 bp, Homo sapiens
gctgggctcgttcccacacgcg

SEQ ID NO: 9238401 - DNA, 22 bp, Homo sapiens
gctgggctctgtcatgccttcc

SEQ ID NO: 9238402 - DNA, 22 bp, Homo sapiens
gctgggctctgtcatgccttcc

SEQ ID NO: 9238403 - DNA, 22 bp, Homo sapiens
gcttattttcaccttctctcag

SEQ ID NO: 9238404 - DNA, 22 bp, Homo sapiens
gcttagtcaattataaataggc

SEQ ID NO: 9238405 - DNA, 22 bp, Homo sapiens
gcttagaaagtgattgatacat

SEQ ID NO: 9238406 - DNA, 22 bp, Homo sapiens
gcttacaatcatttcagtttag

SEQ ID NO: 9238407 - DNA, 22 bp, Homo sapiens
gcttacaagatcgtgctccagt

SEQ ID NO: 9238408 - DNA, 22 bp, Homo sapiens
gcttacaagccagctgtaccac

SEQ ID NO: 9238409 - DNA, 22 bp, Homo sapiens
gcttacaagggtaggaagtcta

SEQ ID NO: 9238410 - DNA, 22 bp, Homo sapiens
gcttagcatcttacaatgctga

SEQ ID NO: 9238411 - DNA, 20 bp, Homo sapiens
gcttagcaggcatagtagct

SEQ ID NO: 9238412 - DNA, 22 bp, Homo sapiens
gcttagcaatgtgacaagatgc

SEQ ID NO: 9238413 - DNA, 22 bp, Homo sapiens
gctgggctgcccaacctctgac

SEQ ID NO: 9238414 - DNA, 22 bp, Homo sapiens
gctgggctgagctagacttggc

SEQ ID NO: 9238415 - DNA, 22 bp, Homo sapiens
gctgggctgagctagacttggc

SEQ ID NO: 9238416 - DNA, 22 bp, Homo sapiens
gcttacaagatcgtgctccagt

SEQ ID NO: 9238417 - DNA, 22 bp, Homo sapiens
gcttacaaacaacagaaattaa

SEQ ID NO: 9238418 - DNA, 22 bp, Homo sapiens
gcttaattctggctcagtttcc

SEQ ID NO: 9238419 - DNA, 22 bp, Homo sapiens
gcttaattctggctcagtttcc

SEQ ID NO: 9238420 - DNA, 22 bp, Homo sapiens
gcttcctgtccctcagccatga

SEQ ID NO: 9238421 - DNA, 22 bp, Homo sapiens
gcttcctgtccaggccccacat

SEQ ID NO: 9238422 - DNA, 17 bp, Homo sapiens
gcttcctgtgctgggga

SEQ ID NO: 9238423 - DNA, 22 bp, Homo sapiens
gcttcctgtaggcaggtccaag

SEQ ID NO: 9238424 - DNA, 22 bp, Homo sapiens
gcttcctgtatcctcctgtacc

SEQ ID NO: 9238425 - DNA, 22 bp, Homo sapiens
gcttcctgtatcctcctgtacc

SEQ ID NO: 9238426 - DNA, 22 bp, Homo sapiens
gcttccttattgttgccatagt

SEQ ID NO: 9238427 - DNA, 22 bp, Homo sapiens
gcttccttattgttgccatagt

SEQ ID NO: 9238428 - DNA, 22 bp, Homo sapiens
gcttccttctaccacatcatgc

SEQ ID NO: 9238429 - DNA, 22 bp, Homo sapiens
gcttccttccttacattggtgg

SEQ ID NO: 9238430 - DNA, 22 bp, Homo sapiens
gcttccttgggaaaattagatg

SEQ ID NO: 9238431 - DNA, 22 bp, Homo sapiens
gcttctgatgtcagacttctgg

SEQ ID NO: 9238432 - DNA, 22 bp, Homo sapiens
gcttctattactactttgagat

SEQ ID NO: 9238433 - DNA, 22 bp, Homo sapiens
gcttctattatttggagctgag

SEQ ID NO: 9238434 - DNA, 23 bp, Homo sapiens
gcttctagtcaatttcaccagga

SEQ ID NO: 9238435 - DNA, 22 bp, Homo sapiens
gcttcgctgctagctagttggt

SEQ ID NO: 9238436 - DNA, 22 bp, Homo sapiens
gcttcggggtccaagcgcgtgt

SEQ ID NO: 9238437 - DNA, 22 bp, Homo sapiens
gcttctgatgtcagacttctgg

SEQ ID NO: 9238438 - DNA, 23 bp, Homo sapiens
gcttctgccatttgctagctgtg

SEQ ID NO: 9238439 - DNA, 22 bp, Homo sapiens
gcttctgctgttgaagccacca

SEQ ID NO: 9238440 - DNA, 20 bp, Homo sapiens
gcttcagaacctgggtgctg

SEQ ID NO: 9238441 - DNA, 22 bp, Homo sapiens
gcttcagaagttgggctctgac

SEQ ID NO: 9238442 - DNA, 22 bp, Homo sapiens
gcttcaaagattcacagtttca

SEQ ID NO: 9238443 - DNA, 22 bp, Homo sapiens
gcttattttcaccttctctcag

SEQ ID NO: 9238444 - DNA, 22 bp, Homo sapiens
gcttcagactggagcagaggaa

SEQ ID NO: 9238445 - DNA, 22 bp, Homo sapiens
gcttcagaagttgggctctgac

SEQ ID NO: 9238446 - DNA, 22 bp, Homo sapiens
gcttcagactggagcagaggaa

SEQ ID NO: 9238447 - DNA, 22 bp, Homo sapiens
gcttcagactgtgcttctgttg

SEQ ID NO: 9238448 - DNA, 22 bp, Homo sapiens
gcttcagactgtgcttctgttg

SEQ ID NO: 9238449 - DNA, 22 bp, Homo sapiens
gcttcagattcctcttctgtaa

SEQ ID NO: 9238450 - DNA, 21 bp, Homo sapiens
gcttcagcaaggcttgctggt

SEQ ID NO: 9238451 - DNA, 22 bp, Homo sapiens
gcttcagcccatcccagtacat

SEQ ID NO: 9238452 - DNA, 22 bp, Homo sapiens
gcttcagccgggcacttaatga

SEQ ID NO: 9238453 - DNA, 22 bp, Homo sapiens
gcttcagattcctcttctgtaa

SEQ ID NO: 9238454 - DNA, 22 bp, Homo sapiens
gcttcagattcttttcatgtct

SEQ ID NO: 9238455 - DNA, 22 bp, Homo sapiens
gcttcagagatttcactagttt

SEQ ID NO: 9238456 - DNA, 22 bp, Homo sapiens
gcttcagattcttttcatgtct

SEQ ID NO: 9238457 - DNA, 22 bp, Homo sapiens
gcttcattactgacagtctgtg

SEQ ID NO: 9238458 - DNA, 22 bp, Homo sapiens
gcttcatgaaaatcactggtca

SEQ ID NO: 9238459 - DNA, 22 bp, Homo sapiens
gcttcaggaggtcggtctcctt

SEQ ID NO: 9238460 - DNA, 22 bp, Homo sapiens
gcttcagctttgtctccttggg

SEQ ID NO: 9238461 - DNA, 22 bp, Homo sapiens
gcttcagcctcacactgatatc

SEQ ID NO: 9238462 - DNA, 22 bp, Homo sapiens
gcttcctggagggagagagctg

SEQ ID NO: 9238463 - DNA, 22 bp, Homo sapiens
ggaagaaatgctcttctatgcg

SEQ ID NO: 9238464 - DNA, 22 bp, Homo sapiens
ggaagaaatgctcttctatgcg

SEQ ID NO: 9238465 - DNA, 22 bp, Homo sapiens
ggaagaaatctggttaagagat

SEQ ID NO: 9238466 - DNA, 22 bp, Homo sapiens
ggaagaaatctggttaagagat

SEQ ID NO: 9238467 - DNA, 22 bp, Homo sapiens
ggaaggggtgggtgagcctcag

SEQ ID NO: 9238468 - DNA, 22 bp, Homo sapiens
ggaagggcaataaaatctcagg

SEQ ID NO: 9238469 - DNA, 22 bp, Homo sapiens
ggaaggggtcacctcctgatga

SEQ ID NO: 9238470 - DNA, 21 bp, Homo sapiens
ggaaggggtcctcccaacagt

SEQ ID NO: 9238471 - DNA, 22 bp, Homo sapiens
ggaagggcaaaagagatgaact

SEQ ID NO: 9238472 - DNA, 22 bp, Homo sapiens
ggaagggcaaaagagatgaact

SEQ ID NO: 9238473 - DNA, 22 bp, Homo sapiens
ggaaggggtgtcgcccatggat

SEQ ID NO: 9238474 - DNA, 22 bp, Homo sapiens
ggaaggggtgtcgcccatggat

SEQ ID NO: 9238475 - DNA, 22 bp, Homo sapiens
ggaaggggttaggggtccctga

SEQ ID NO: 9238476 - DNA, 19 bp, Homo sapiens
ggaaggtgacagtggtgaa

SEQ ID NO: 9238477 - DNA, 17 bp, Homo sapiens
ggaagaaaaggatcatc

SEQ ID NO: 9238478 - DNA, 17 bp, Homo sapiens
ggaagaaaaggatcatc

SEQ ID NO: 9238479 - DNA, 18 bp, Homo sapiens
ggaagaaaaggaactcag

SEQ ID NO: 9238480 - DNA, 18 bp, Homo sapiens
ggaagaaaaggaactcag

SEQ ID NO: 9238481 - DNA, 22 bp, Homo sapiens
ggaactggagaatgccctcttt

SEQ ID NO: 9238482 - DNA, 22 bp, Homo sapiens
ggaactgggttagggtctcttc

SEQ ID NO: 9238483 - DNA, 22 bp, Homo sapiens
ggaagaaatctggttaagagat

SEQ ID NO: 9238484 - DNA, 22 bp, Homo sapiens
ggaagaaagtagaaaaccgtgg

SEQ ID NO: 9238485 - DNA, 22 bp, Homo sapiens
ggaagaaaggtggacaacaggt

SEQ ID NO: 9238486 - DNA, 22 bp, Homo sapiens
ggaagaaaggtggacaacaggt

SEQ ID NO: 9238487 - DNA, 22 bp, Homo sapiens
ggaagaaaggtggacaacaggt

SEQ ID NO: 9238488 - DNA, 22 bp, Homo sapiens
ggaagaaaatgggcaacaggtg

SEQ ID NO: 9238489 - DNA, 22 bp, Homo sapiens
ggaagaaaatgggcaacaggtg

SEQ ID NO: 9238490 - DNA, 22 bp, Homo sapiens
ggaagaaagacatttattttga

SEQ ID NO: 9238491 - DNA, 22 bp, Homo sapiens
ggaagaaagcacacaaacttga

SEQ ID NO: 9238492 - DNA, 22 bp, Homo sapiens
ggaagaaagcacacaaacttga

SEQ ID NO: 9238493 - DNA, 22 bp, Homo sapiens
ggaaaacaagagaatgatgttt

SEQ ID NO: 9238494 - DNA, 20 bp, Homo sapiens
ggaaaaatgcatgctcaaga

SEQ ID NO: 9238495 - DNA, 22 bp, Homo sapiens
ggaaaacaagagaatgatgttt

SEQ ID NO: 9238496 - DNA, 17 bp, Homo sapiens
gcttctggagcttctgt

SEQ ID NO: 9238497 - DNA, 22 bp, Homo sapiens
gcttctggaggagctgggctga

SEQ ID NO: 9238498 - DNA, 22 bp, Homo sapiens
gcttctggaagctgcttctgcc

SEQ ID NO: 9238499 - DNA, 22 bp, Homo sapiens
gcttctggaagctgcttctgcc

SEQ ID NO: 9238500 - DNA, 22 bp, Homo sapiens
gcttctggcagtgcagccacca

SEQ ID NO: 9238501 - DNA, 19 bp, Homo sapiens
ggaaacaggggccagagga

SEQ ID NO: 9238502 - DNA, 22 bp, Homo sapiens
ggaaacacatgatcagacatct

SEQ ID NO: 9238503 - DNA, 22 bp, Homo sapiens
ggaaactaaagaggtgtttttg

SEQ ID NO: 9238504 - DNA, 22 bp, Homo sapiens
ggaaactgcttacactagaggg

SEQ ID NO: 9238505 - DNA, 22 bp, Homo sapiens
ggaaacttggatgccagcactc

SEQ ID NO: 9238506 - DNA, 22 bp, Homo sapiens
ggaaacttggcataattttaag

SEQ ID NO: 9238507 - DNA, 22 bp, Homo sapiens
ggaaacttgttattgtattttc

SEQ ID NO: 9238508 - DNA, 22 bp, Homo sapiens
ggaaagagcccagcagtgcttg

SEQ ID NO: 9238509 - DNA, 23 bp, Homo sapiens
ggaaagagaggagttgtgcatag

SEQ ID NO: 9238510 - DNA, 22 bp, Homo sapiens
ggaaagacctgagataggaata

SEQ ID NO: 9238511 - DNA, 22 bp, Homo sapiens
ggaaagagaagttgggaggaat

SEQ ID NO: 9238512 - DNA, 22 bp, Homo sapiens
ggaactcctgctccaagcagct

SEQ ID NO: 9238513 - DNA, 22 bp, Homo sapiens
ggaactcctgctccaagcagct

SEQ ID NO: 9238514 - DNA, 22 bp, Homo sapiens
ggaactcctgctccaagcagct

SEQ ID NO: 9238515 - DNA, 22 bp, Homo sapiens
ggaaagccaggtgctctggtgt

SEQ ID NO: 9238516 - DNA, 22 bp, Homo sapiens
ggaaagaggatagtgggtaggt

SEQ ID NO: 9238517 - DNA, 22 bp, Homo sapiens
ggaaagagctaaaagggtgaga

SEQ ID NO: 9238518 - DNA, 22 bp, Homo sapiens
ggaaagagggacccagcttggt

SEQ ID NO: 9238519 - DNA, 22 bp, Homo sapiens
ggaaagaggatagtgggtaggt

SEQ ID NO: 9238520 - DNA, 22 bp, Homo sapiens
ggaaagagctaaaagggtgaga

SEQ ID NO: 9238521 - DNA, 22 bp, Homo sapiens
ggaaagagctaaaagggtgaga

SEQ ID NO: 9238522 - DNA, 22 bp, Homo sapiens
taagaaatttagttatagaatg

SEQ ID NO: 9238523 - DNA, 22 bp, Homo sapiens
taacagcactggcaggcactgt

SEQ ID NO: 9238524 - DNA, 22 bp, Homo sapiens
taacagcagggttacaggcatt

SEQ ID NO: 9238525 - DNA, 22 bp, Homo sapiens
taacagcactggcaggcactgt

SEQ ID NO: 9238526 - DNA, 22 bp, Homo sapiens
taacagcaaccacagtgctggt

SEQ ID NO: 9238527 - DNA, 22 bp, Homo sapiens
taacagagatagaaatgtaaag

SEQ ID NO: 9238528 - DNA, 22 bp, Homo sapiens
taacagaatttgctaaactccg

SEQ ID NO: 9238529 - DNA, 22 bp, Homo sapiens
taacagaatttgctaaactccg

SEQ ID NO: 9238530 - DNA, 22 bp, Homo sapiens
taacactgtggtgttctttgtc

SEQ ID NO: 9238531 - DNA, 22 bp, Homo sapiens
taacactgtccaaagaattcca

SEQ ID NO: 9238532 - DNA, 22 bp, Homo sapiens
taacactgtaaacctagatgtt

SEQ ID NO: 9238533 - DNA, 22 bp, Homo sapiens
taacactgtgcccagagtccca

SEQ ID NO: 9238534 - DNA, 22 bp, Homo sapiens
taacactgtccaaagaattcca

SEQ ID NO: 9238535 - DNA, 22 bp, Homo sapiens
taacactgtccaaagaattcca

SEQ ID NO: 9238536 - DNA, 22 bp, Homo sapiens
taagaaatttagttatagaatg

SEQ ID NO: 9238537 - DNA, 22 bp, Homo sapiens
taaatctcactgggtatattgg

SEQ ID NO: 9238538 - DNA, 22 bp, Homo sapiens
taaatctcagcctttctgctta

SEQ ID NO: 9238539 - DNA, 22 bp, Homo sapiens
taaatctcctgtttttcatcta

SEQ ID NO: 9238540 - DNA, 22 bp, Homo sapiens
taaatctcagggaatatattga

SEQ ID NO: 9238541 - DNA, 22 bp, Homo sapiens
taaatctctgctcctcttgggt

SEQ ID NO: 9238542 - DNA, 18 bp, Homo sapiens
taaatctctctttagtca

SEQ ID NO: 9238543 - DNA, 21 bp, Homo sapiens
taaatctctgtattcttcagt

SEQ ID NO: 9238544 - DNA, 22 bp, Homo sapiens
taaatgaaagggtttaatttat

SEQ ID NO: 9238545 - DNA, 22 bp, Homo sapiens
taaatctttaggaagctcaaac

SEQ ID NO: 9238546 - DNA, 22 bp, Homo sapiens
taaatgaaagggtttaatttat

SEQ ID NO: 9238547 - DNA, 22 bp, Homo sapiens
taaatcttgtggcaatgcttct

SEQ ID NO: 9238548 - DNA, 22 bp, Homo sapiens
taaatcttctacatcatcataa

SEQ ID NO: 9238549 - DNA, 22 bp, Homo sapiens
taaatagaatctaaactgctca

SEQ ID NO: 9238550 - DNA, 22 bp, Homo sapiens
taaatagaatctaaactgctca

SEQ ID NO: 9238551 - DNA, 22 bp, Homo sapiens
taaatcagtttctcttattggt

SEQ ID NO: 9238552 - DNA, 22 bp, Homo sapiens
taaatccagcttctaatttaga

SEQ ID NO: 9238553 - DNA, 22 bp, Homo sapiens
taaatcagtaaggcatattctc

SEQ ID NO: 9238554 - DNA, 22 bp, Homo sapiens
taaatcagtagatatggtatag

SEQ ID NO: 9238555 - DNA, 22 bp, Homo sapiens
taaatcagtttctcttattggt

SEQ ID NO: 9238556 - DNA, 22 bp, Homo sapiens
taacactatccagatatgataa

SEQ ID NO: 9238557 - DNA, 22 bp, Homo sapiens
taacactaagaatctaaattta

SEQ ID NO: 9238558 - DNA, 22 bp, Homo sapiens
taaatgataataatgctagtgt

SEQ ID NO: 9238559 - DNA, 22 bp, Homo sapiens
taaatgagggctgacatgattg

SEQ ID NO: 9238560 - DNA, 22 bp, Homo sapiens
taaatgaagctcatgggccaca

SEQ ID NO: 9238561 - DNA, 22 bp, Homo sapiens
taaatgacaacacctgcttttg

SEQ ID NO: 9238562 - DNA, 22 bp, Homo sapiens
taaatgacattcttaagtcttg

SEQ ID NO: 9238563 - DNA, 22 bp, Homo sapiens
taaatgaagaaatggagattgt

SEQ ID NO: 9238564 - DNA, 22 bp, Homo sapiens
taaatgacccatgctgacctca

SEQ ID NO: 9238565 - DNA, 22 bp, Homo sapiens
taaatgacattcttaagtcttg

SEQ ID NO: 9238566 - DNA, 22 bp, Homo sapiens
taaatgagatgtacataactca

SEQ ID NO: 9238567 - DNA, 22 bp, Homo sapiens
taaatgagatttgttcttttgt

SEQ ID NO: 9238568 - DNA, 22 bp, Homo sapiens
taacactgaaaatgatgcatgt

SEQ ID NO: 9238569 - DNA, 22 bp, Homo sapiens
taacactgaaaatgatgcatgt

SEQ ID NO: 9238570 - DNA, 22 bp, Homo sapiens
taacactgatttgttctcaggg

SEQ ID NO: 9238571 - DNA, 22 bp, Homo sapiens
taacactgatttgttctcaggg

SEQ ID NO: 9238572 - DNA, 22 bp, Homo sapiens
taacactggtatttcatttagt

SEQ ID NO: 9238573 - DNA, 22 bp, Homo sapiens
taaaggaacagaggactcattt

SEQ ID NO: 9238574 - DNA, 22 bp, Homo sapiens
taaagcttgtattgcaatattt

SEQ ID NO: 9238575 - DNA, 22 bp, Homo sapiens
taaagctatgcttaatttatca

SEQ ID NO: 9238576 - DNA, 22 bp, Homo sapiens
taaagctagaattgttccagca

SEQ ID NO: 9238577 - DNA, 22 bp, Homo sapiens
taaagcagtctgtgtatgtgaa

SEQ ID NO: 9238578 - DNA, 22 bp, Homo sapiens
taaagcaggtgctcagtgacca

SEQ ID NO: 9238579 - DNA, 21 bp, Homo sapiens
taaagctagaaccttagcttt

SEQ ID NO: 9238580 - DNA, 22 bp, Homo sapiens
taaagctagaaggtgctgtaca

SEQ ID NO: 9238581 - DNA, 22 bp, Homo sapiens
taaaacagcagggcagagaagt

SEQ ID NO: 9238582 - DNA, 22 bp, Homo sapiens
taaaaccataaggctggaagga

SEQ ID NO: 9238583 - DNA, 22 bp, Homo sapiens
taaaactagtggttgggactaa

SEQ ID NO: 9238584 - DNA, 22 bp, Homo sapiens
taaaactagaccgtgagtctaa

SEQ ID NO: 9238585 - DNA, 22 bp, Homo sapiens
taaaactagaccgtgagtctaa

SEQ ID NO: 9238586 - DNA, 22 bp, Homo sapiens
taaaactagtggttgggactaa

SEQ ID NO: 9238587 - DNA, 22 bp, Homo sapiens
taaagcaggccacatatgtgat

SEQ ID NO: 9238588 - DNA, 22 bp, Homo sapiens
taaagcaggccacatatgtgat

SEQ ID NO: 9238589 - DNA, 22 bp, Homo sapiens
taaatactttacaggatgtctc

SEQ ID NO: 9238590 - DNA, 22 bp, Homo sapiens
taaaggcatgcaggtgaatgta

SEQ ID NO: 9238591 - DNA, 22 bp, Homo sapiens
taaaggcagtaattcctgagtt

SEQ ID NO: 9238592 - DNA, 22 bp, Homo sapiens
taaaggcagcctaggaagtgtt

SEQ ID NO: 9238593 - DNA, 22 bp, Homo sapiens
taaaggcagccactgagctcaa

SEQ ID NO: 9238594 - DNA, 22 bp, Homo sapiens
taaaggaggagttaatgagact

SEQ ID NO: 9238595 - DNA, 18 bp, Homo sapiens
taaaggaagtgggagagg

SEQ ID NO: 9238596 - DNA, 22 bp, Homo sapiens
taaaggaatcagttttagagat

SEQ ID NO: 9238597 - DNA, 22 bp, Homo sapiens
gtttttctaggaccatgtgatt

SEQ ID NO: 9238598 - DNA, 22 bp, Homo sapiens
gtttttctaggaccatgtgatt

SEQ ID NO: 9238599 - DNA, 22 bp, Homo sapiens
gtttttctagaaatctcctcct

SEQ ID NO: 9238600 - DNA, 22 bp, Homo sapiens
gtttttctagactgggagtttg

SEQ ID NO: 9238601 - DNA, 20 bp, Homo sapiens
gtttttctctcttgccacta

SEQ ID NO: 9238602 - DNA, 20 bp, Homo sapiens
gtttttctctcttgccacta

SEQ ID NO: 9238603 - DNA, 22 bp, Homo sapiens
gtttttctctgaaatagttgac

SEQ ID NO: 9238604 - DNA, 20 bp, Homo sapiens
gtttttcttgggcgagctat

SEQ ID NO: 9238605 - DNA, 22 bp, Homo sapiens
gtttttctgtgagcggtaaagg

SEQ ID NO: 9238606 - DNA, 22 bp, Homo sapiens
gtttttctgtgagcggtaaagg

SEQ ID NO: 9238607 - DNA, 22 bp, Homo sapiens
gtttttctttgtgtgaagacaa

SEQ ID NO: 9238608 - DNA, 22 bp, Homo sapiens
gtttttctttgtgtgaagacaa

SEQ ID NO: 9238609 - DNA, 22 bp, Homo sapiens
gtttttgtccatggaggcaaac

SEQ ID NO: 9238610 - DNA, 22 bp, Homo sapiens
gtttttgtcgagttccttgacc

SEQ ID NO: 9238611 - DNA, 22 bp, Homo sapiens
gtttttctttgtgtgaagacaa

SEQ ID NO: 9238612 - DNA, 22 bp, Homo sapiens
gttttttcatgagtagttatct

SEQ ID NO: 9238613 - DNA, 22 bp, Homo sapiens
gttttttcatgagtagttatct

SEQ ID NO: 9238614 - DNA, 22 bp, Homo sapiens
gttttttcatgagtagttatct

SEQ ID NO: 9238615 - DNA, 22 bp, Homo sapiens
gttttttgggtgtatatcttct

SEQ ID NO: 9238616 - DNA, 22 bp, Homo sapiens
taaaacactcagcacctagcaa

SEQ ID NO: 9238617 - DNA, 22 bp, Homo sapiens
gtttaagaaaattcatgttgtt

SEQ ID NO: 9238618 - DNA, 22 bp, Homo sapiens
gtttaattcccacacctgccct

SEQ ID NO: 9238619 - DNA, 21 bp, Homo sapiens
gtttttcagccctgaggtgag

SEQ ID NO: 9238620 - DNA, 22 bp, Homo sapiens
gtttttctaagtagcgatattt

SEQ ID NO: 9238621 - DNA, 22 bp, Homo sapiens
gtttttctagaaatctcctcct

SEQ ID NO: 9238622 - DNA, 22 bp, Homo sapiens
gttgtttttgaacggtggtggc

SEQ ID NO: 9238623 - DNA, 19 bp, Homo sapiens
gttgtttttcttattatgg

SEQ ID NO: 9238624 - DNA, 22 bp, Homo sapiens
gttgttttgctgtctgtcttag

SEQ ID NO: 9238625 - DNA, 22 bp, Homo sapiens
gttgttttgctgtctgtcttag

SEQ ID NO: 9238626 - DNA, 22 bp, Homo sapiens
gttgttttcagcagtttatgac

SEQ ID NO: 9238627 - DNA, 22 bp, Homo sapiens
gttgttttgctgtctgtcttag

SEQ ID NO: 9238628 - DNA, 22 bp, Homo sapiens
gttgttttgcaggatccttaca

SEQ ID NO: 9238629 - DNA, 22 bp, Homo sapiens
gttgtttttgttctctatagct

SEQ ID NO: 9238630 - DNA, 22 bp, Homo sapiens
gttgtttttgttctctatagct

SEQ ID NO: 9238631 - DNA, 22 bp, Homo sapiens
gtttaaataattaggggcctgt

SEQ ID NO: 9238632 - DNA, 22 bp, Homo sapiens
gtgggcagaggagagaacatta

SEQ ID NO: 9238633 - DNA, 22 bp, Homo sapiens
gtgggcagatacatttgatatg

SEQ ID NO: 9238634 - DNA, 20 bp, Homo sapiens
gtgggcagatgtgtgcatgg

SEQ ID NO: 9238635 - DNA, 22 bp, Homo sapiens
gtgggcagcaccagggaagtgt

SEQ ID NO: 9238636 - DNA, 22 bp, Homo sapiens
gtgggcagattaatttctcaat

SEQ ID NO: 9238637 - DNA, 20 bp, Homo sapiens
gtgggcagatgtgtgcatgg

SEQ ID NO: 9238638 - DNA, 22 bp, Homo sapiens
gtgggcagattaatttctcaat

SEQ ID NO: 9238639 - DNA, 22 bp, Homo sapiens
gtgggcagcaccagggaagtgt

SEQ ID NO: 9238640 - DNA, 20 bp, Homo sapiens
gtgggcagcaggcatactgg

SEQ ID NO: 9238641 - DNA, 20 bp, Homo sapiens
gtgggcagcaggcatactgg

SEQ ID NO: 9238642 - DNA, 22 bp, Homo sapiens
gtgggcagacatgatagaagga

SEQ ID NO: 9238643 - DNA, 22 bp, Homo sapiens
gtgggcagacagtgctttgcag

SEQ ID NO: 9238644 - DNA, 22 bp, Homo sapiens
gtgggcagacagtgctttgcag

SEQ ID NO: 9238645 - DNA, 22 bp, Homo sapiens
gtgggcagaacatttgtaggct

SEQ ID NO: 9238646 - DNA, 22 bp, Homo sapiens
gtgggcaaggtccctgccagct

SEQ ID NO: 9238647 - DNA, 22 bp, Homo sapiens
gtgggcagaacatttgtaggct

SEQ ID NO: 9238648 - DNA, 22 bp, Homo sapiens
gtgggcagagcaagggaactca

SEQ ID NO: 9238649 - DNA, 20 bp, Homo sapiens
gtgggcagagcaccacctgg

SEQ ID NO: 9238650 - DNA, 20 bp, Homo sapiens
gtgggcagagcaccacctgg

SEQ ID NO: 9238651 - DNA, 22 bp, Homo sapiens
gtgggcagccccttcaaggcca

SEQ ID NO: 9238652 - DNA, 22 bp, Homo sapiens
gtgggcagcctcctttattttc

SEQ ID NO: 9238653 - DNA, 22 bp, Homo sapiens
gtgggcagttcaattctgggag

SEQ ID NO: 9238654 - DNA, 22 bp, Homo sapiens
gtgggcagttcaattctgggag

SEQ ID NO: 9238655 - DNA, 22 bp, Homo sapiens
gtgggcagtggtttgcgcggtc

SEQ ID NO: 9238656 - DNA, 22 bp, Homo sapiens
gtgggcagtggtttgcgcggtc

SEQ ID NO: 9238657 - DNA, 22 bp, Homo sapiens
gtgggcaggaggccctgccctg

SEQ ID NO: 9238658 - DNA, 22 bp, Homo sapiens
gtgggccactgggaggcaaggg

SEQ ID NO: 9238659 - DNA, 19 bp, Homo sapiens
gtgggccaggcagaaggct

SEQ ID NO: 9238660 - DNA, 22 bp, Homo sapiens
gtgggccaggccggagtgcaga

SEQ ID NO: 9238661 - DNA, 22 bp, Homo sapiens
gtgggccacatcccagggctct

SEQ ID NO: 9238662 - DNA, 22 bp, Homo sapiens
gtgggcagttggtgattctcgt

SEQ ID NO: 9238663 - DNA, 22 bp, Homo sapiens
gtggggctggaagatgggtact

SEQ ID NO: 9238664 - DNA, 22 bp, Homo sapiens
gtggggaggcctaagcaagttg

SEQ ID NO: 9238665 - DNA, 22 bp, Homo sapiens
gtggggaggcattcttctccct

SEQ ID NO: 9238666 - DNA, 22 bp, Homo sapiens
gtggggaaaggagtggggctca

SEQ ID NO: 9238667 - DNA, 22 bp, Homo sapiens
gtggggaaaggagtggggctca

SEQ ID NO: 9238668 - DNA, 22 bp, Homo sapiens
gtggggaaaggagtggggctca

SEQ ID NO: 9238669 - DNA, 22 bp, Homo sapiens
gtggggagcagccttagcccct

SEQ ID NO: 9238670 - DNA, 22 bp, Homo sapiens
gtgggggcaggcagtgctagga

SEQ ID NO: 9238671 - DNA, 22 bp, Homo sapiens
gtgggggatgctgagttggaaa

SEQ ID NO: 9238672 - DNA, 22 bp, Homo sapiens
gtggggcttcctggggcaagtt

SEQ ID NO: 9238673 - DNA, 22 bp, Homo sapiens
gtggggcttcctggggcaagtt

SEQ ID NO: 9238674 - DNA, 22 bp, Homo sapiens
gtgggcctcttgagggtggcta

SEQ ID NO: 9238675 - DNA, 22 bp, Homo sapiens
gtgggccttgcagggtgcaggg

SEQ ID NO: 9238676 - DNA, 22 bp, Homo sapiens
gtgggctgcccttgaggtcagc

SEQ ID NO: 9238677 - DNA, 22 bp, Homo sapiens
gtgggctgaggggacaccaagg

SEQ ID NO: 9238678 - DNA, 22 bp, Homo sapiens
gtgggctgcccttgaggtcagc

SEQ ID NO: 9238679 - DNA, 22 bp, Homo sapiens
gtgggctgaggggacaccaagg

SEQ ID NO: 9238680 - DNA, 22 bp, Homo sapiens
gtgggccttgcagggtgcaggg

SEQ ID NO: 9238681 - DNA, 22 bp, Homo sapiens
gtgggctggagcaatgatttca

SEQ ID NO: 9238682 - DNA, 22 bp, Homo sapiens
gtgggctgcttcctccttccac

SEQ ID NO: 9238683 - DNA, 22 bp, Homo sapiens
gtgggctgcccttgaggtcagc

SEQ ID NO: 9238684 - DNA, 22 bp, Homo sapiens
gtgggctggaccctcctgctcc

SEQ ID NO: 9238685 - DNA, 22 bp, Homo sapiens
gtggtctggggtcaggcctgag

SEQ ID NO: 9238686 - DNA, 22 bp, Homo sapiens
gtggtctggggtcaggcctgag

SEQ ID NO: 9238687 - DNA, 22 bp, Homo sapiens
gtggtcctggcaaccatggtga

SEQ ID NO: 9238688 - DNA, 22 bp, Homo sapiens
gtggtgaagccccatctctgct

SEQ ID NO: 9238689 - DNA, 22 bp, Homo sapiens
gtggtcctgccagccaggtcca

SEQ ID NO: 9238690 - DNA, 22 bp, Homo sapiens
gtggtccatcatgcagagctcc

SEQ ID NO: 9238691 - DNA, 22 bp, Homo sapiens
gtggtccatcatgcagagctcc

SEQ ID NO: 9238692 - DNA, 22 bp, Homo sapiens
gtggtgcaggccagcaggggcg

SEQ ID NO: 9238693 - DNA, 22 bp, Homo sapiens
gtggtgcaggaagcatctggct

SEQ ID NO: 9238694 - DNA, 22 bp, Homo sapiens
gtggtgagttcaggctggggtg

SEQ ID NO: 9238695 - DNA, 22 bp, Homo sapiens
gtggtgtaggtcacagttagga

SEQ ID NO: 9238696 - DNA, 22 bp, Homo sapiens
gtggtgcatccttgagtaagct

SEQ ID NO: 9238697 - DNA, 21 bp, Homo sapiens
gtggttctagagaaacagaat

SEQ ID NO: 9238698 - DNA, 22 bp, Homo sapiens
gtggttcagtgtcatattaacg

SEQ ID NO: 9238699 - DNA, 17 bp, Homo sapiens
gtgtacaagcagaaggc

SEQ ID NO: 9238700 - DNA, 22 bp, Homo sapiens
gtgtaatgttgtcagcatcatc

SEQ ID NO: 9238701 - DNA, 22 bp, Homo sapiens
gtgtcacaggcccagctcttca

SEQ ID NO: 9238702 - DNA, 22 bp, Homo sapiens
gtgtcacaagagcccaggaaac

SEQ ID NO: 9238703 - DNA, 22 bp, Homo sapiens
gtgtcacatggtttactgcagc

SEQ ID NO: 9238704 - DNA, 22 bp, Homo sapiens
gtgtcacaggcccagctcttca

SEQ ID NO: 9238705 - DNA, 22 bp, Homo sapiens
gtggtttgttttattcctggaa

SEQ ID NO: 9238706 - DNA, 22 bp, Homo sapiens
gtgtaaaaacatactatttcta

SEQ ID NO: 9238707 - DNA, 22 bp, Homo sapiens
gtgtaacttttattcatgctct

SEQ ID NO: 9238708 - DNA, 22 bp, Homo sapiens
gtgtaacttgctggaaaaacta

SEQ ID NO: 9238709 - DNA, 22 bp, Homo sapiens
gtgtaaagatgccaggaatctt

SEQ ID NO: 9238710 - DNA, 22 bp, Homo sapiens
gtgggtgcggggagccgaggcg

SEQ ID NO: 9238711 - DNA, 22 bp, Homo sapiens
gtgggtgcggggagccgaggcg

SEQ ID NO: 9238712 - DNA, 22 bp, Homo sapiens
gtgggtgcggggagccgaggcg

SEQ ID NO: 9238713 - DNA, 22 bp, Homo sapiens
gtgggtgctgtcaggcagggaa

SEQ ID NO: 9238714 - DNA, 22 bp, Homo sapiens
gtgggtggacggtgcttttgtt

SEQ ID NO: 9238715 - DNA, 22 bp, Homo sapiens
gtgggtggagactgggtgcaag

SEQ ID NO: 9238716 - DNA, 22 bp, Homo sapiens
gtgggtggagactgggtgcaag

SEQ ID NO: 9238717 - DNA, 22 bp, Homo sapiens
gtgggtggaggcgtcgagggca

SEQ ID NO: 9238718 - DNA, 22 bp, Homo sapiens
gtgggtggagactgggtgcaag

SEQ ID NO: 9238719 - DNA, 22 bp, Homo sapiens
gtggtcagcagcagtgggagtg

SEQ ID NO: 9238720 - DNA, 22 bp, Homo sapiens
gtggtcaggcagtgggagagaa

SEQ ID NO: 9238721 - DNA, 22 bp, Homo sapiens
gtggtcagtggtacagtttgaa

SEQ ID NO: 9238722 - DNA, 22 bp, Homo sapiens
gtggtcagagatgacagtgggt

SEQ ID NO: 9238723 - DNA, 22 bp, Homo sapiens
gtggtaggcacagagaacaaga

SEQ ID NO: 9238724 - DNA, 22 bp, Homo sapiens
gtggtcagaaatctcagtggca

SEQ ID NO: 9238725 - DNA, 22 bp, Homo sapiens
gtggggtgggctgagttaggcc

SEQ ID NO: 9238726 - DNA, 22 bp, Homo sapiens
gtggggtgtccagcagcgagct

SEQ ID NO: 9238727 - DNA, 22 bp, Homo sapiens
gtggggtctctctgtacctccc

SEQ ID NO: 9238728 - DNA, 22 bp, Homo sapiens
gtggggtgtccagcagcgagct

SEQ ID NO: 9238729 - DNA, 22 bp, Homo sapiens
gtggggtgtccagcagcgagct

SEQ ID NO: 9238730 - DNA, 18 bp, Homo sapiens
gtggggtgttgtgaggat

SEQ ID NO: 9238731 - DNA, 18 bp, Homo sapiens
gtggggtgttgtgaggat

SEQ ID NO: 9238732 - DNA, 18 bp, Homo sapiens
gtggggtgttgtgaggat

SEQ ID NO: 9238733 - DNA, 18 bp, Homo sapiens
gtggggtgttgtgaggat

SEQ ID NO: 9238734 - DNA, 18 bp, Homo sapiens
gtggggtgttgtgaggat

SEQ ID NO: 9238735 - DNA, 22 bp, Homo sapiens
gtgggggctggctcgtcctgtg

SEQ ID NO: 9238736 - DNA, 22 bp, Homo sapiens
gtggggggagctgcaagctgga

SEQ ID NO: 9238737 - DNA, 22 bp, Homo sapiens
gtggggggagctgcaagctgga

SEQ ID NO: 9238738 - DNA, 22 bp, Homo sapiens
gtggggggagctgcaagctgga

SEQ ID NO: 9238739 - DNA, 22 bp, Homo sapiens
gtgggggtggaaaggcaagttg

SEQ ID NO: 9238740 - DNA, 22 bp, Homo sapiens
gtgggggtttcattaagacaat

SEQ ID NO: 9238741 - DNA, 22 bp, Homo sapiens
gttctgagtcctcctttgaagg

SEQ ID NO: 9238742 - DNA, 22 bp, Homo sapiens
gttctgcagacttggaaggtgg

SEQ ID NO: 9238743 - DNA, 22 bp, Homo sapiens
gttgtacaggcagggaaactga

SEQ ID NO: 9238744 - DNA, 22 bp, Homo sapiens
gttgtcatcaccgttgttatca

SEQ ID NO: 9238745 - DNA, 22 bp, Homo sapiens
gttgtattcttcaatatcagag

SEQ ID NO: 9238746 - DNA, 22 bp, Homo sapiens
gttgtacatatgaggataagtt

SEQ ID NO: 9238747 - DNA, 22 bp, Homo sapiens
gttgtatagagggcatgaatct

SEQ ID NO: 9238748 - DNA, 22 bp, Homo sapiens
gttgttttataattgattgcaa

SEQ ID NO: 9238749 - DNA, 22 bp, Homo sapiens
gttgttttaaaatactccagaa

SEQ ID NO: 9238750 - DNA, 22 bp, Homo sapiens
gttgttttaaaatactccagaa

SEQ ID NO: 9238751 - DNA, 22 bp, Homo sapiens
gttgttttcacaaacccatgat

SEQ ID NO: 9238752 - DNA, 22 bp, Homo sapiens
gttgttttattgtgagtcccat

SEQ ID NO: 9238753 - DNA, 22 bp, Homo sapiens
gttgttttataggctcatgcct

SEQ ID NO: 9238754 - DNA, 22 bp, Homo sapiens
gttgttgatcacatgcatatct

SEQ ID NO: 9238755 - DNA, 22 bp, Homo sapiens
gttgtttgtaatgacaggagac

SEQ ID NO: 9238756 - DNA, 22 bp, Homo sapiens
gttgtcttagtcagaaatatgc

SEQ ID NO: 9238757 - DNA, 22 bp, Homo sapiens
gttgtgaatagtgccgcaataa

SEQ ID NO: 9238758 - DNA, 22 bp, Homo sapiens
gttgtgcaaccatcaccaccat

SEQ ID NO: 9238759 - DNA, 22 bp, Homo sapiens
gttgtgcaaacactggggtctg

SEQ ID NO: 9238760 - DNA, 22 bp, Homo sapiens
gttgtgcaccactgttgattga

SEQ ID NO: 9238761 - DNA, 22 bp, Homo sapiens
gttgtgcagaagtgcctcagta

SEQ ID NO: 9238762 - DNA, 21 bp, Homo sapiens
gttgtggttggggctgcagct

SEQ ID NO: 9238763 - DNA, 22 bp, Homo sapiens
gttgtgcagggcgaggacctga

SEQ ID NO: 9238764 - DNA, 22 bp, Homo sapiens
gttgtgcatttatgaagaagtt

SEQ ID NO: 9238765 - DNA, 22 bp, Homo sapiens
gttgtgcagtcagactgcctgg

SEQ ID NO: 9238766 - DNA, 20 bp, Homo sapiens
gttctcactgatctgcaggg

SEQ ID NO: 9238767 - DNA, 22 bp, Homo sapiens
gttctattctccagttacatat

SEQ ID NO: 9238768 - DNA, 22 bp, Homo sapiens
gttctcatagtggaaaataggt

SEQ ID NO: 9238769 - DNA, 22 bp, Homo sapiens
gttctccactgcagagtctctc

SEQ ID NO: 9238770 - DNA, 22 bp, Homo sapiens
gttctcctggctcccaccctgc

SEQ ID NO: 9238771 - DNA, 22 bp, Homo sapiens
gttctccttgtggctgcagcag

SEQ ID NO: 9238772 - DNA, 22 bp, Homo sapiens
gttctctcaaactttgtgtttg

SEQ ID NO: 9238773 - DNA, 22 bp, Homo sapiens
gttctccttgtggctgcagcag

SEQ ID NO: 9238774 - DNA, 22 bp, Homo sapiens
gttctctcagcctttgttatta

SEQ ID NO: 9238775 - DNA, 22 bp, Homo sapiens
gttctctctgcttccaagatgg

SEQ ID NO: 9238776 - DNA, 22 bp, Homo sapiens
gttctctcagcgatagtgatgg

SEQ ID NO: 9238777 - DNA, 22 bp, Homo sapiens
gttctctctcttgcctgggtgg

SEQ ID NO: 9238778 - DNA, 22 bp, Homo sapiens
gttctctgccggcacctacccg

SEQ ID NO: 9238779 - DNA, 22 bp, Homo sapiens
gttctgaatgtgcctgtactct

SEQ ID NO: 9238780 - DNA, 22 bp, Homo sapiens
gttcaagaccagcctggccaac

SEQ ID NO: 9238781 - DNA, 22 bp, Homo sapiens
gttcaagaccagcctggccaac

SEQ ID NO: 9238782 - DNA, 22 bp, Homo sapiens
gttcaaattttggctgtactgc

SEQ ID NO: 9238783 - DNA, 22 bp, Homo sapiens
gttcaaattttggctgtactgc

SEQ ID NO: 9238784 - DNA, 22 bp, Homo sapiens
gttcaaatctcaggacttcaga

SEQ ID NO: 9238785 - DNA, 21 bp, Homo sapiens
gttcaaatcctgacactacac

SEQ ID NO: 9238786 - DNA, 22 bp, Homo sapiens
gttcaaatggctgcagttacca

SEQ ID NO: 9238787 - DNA, 22 bp, Homo sapiens
gttcaaatggctgcagttacca

SEQ ID NO: 9238788 - DNA, 22 bp, Homo sapiens
gttcaaatctcaggacttcaga

SEQ ID NO: 9238789 - DNA, 22 bp, Homo sapiens
gttcaaatggctgcagttacca

SEQ ID NO: 9238790 - DNA, 22 bp, Homo sapiens
gttcaaattctatgaaatatgt

SEQ ID NO: 9238791 - DNA, 22 bp, Homo sapiens
gttcaaattgagatggtataaa

SEQ ID NO: 9238792 - DNA, 21 bp, Homo sapiens
gttcaaatgggtagattcaca

SEQ ID NO: 9238793 - DNA, 21 bp, Homo sapiens
gttcaaatgggtagattcaca

SEQ ID NO: 9238794 - DNA, 21 bp, Homo sapiens
gttcaaatgggtagattcaca

SEQ ID NO: 9238795 - DNA, 22 bp, Homo sapiens
gttcgcatcttgatcatggact

SEQ ID NO: 9238796 - DNA, 22 bp, Homo sapiens
gttcaaggttttacagagtgta

SEQ ID NO: 9238797 - DNA, 22 bp, Homo sapiens
gttcaaggaagggaggaaagcc

SEQ ID NO: 9238798 - DNA, 18 bp, Homo sapiens
gttcaaggtcaagagaga

SEQ ID NO: 9238799 - DNA, 22 bp, Homo sapiens
gttattttaacttctcagtaat

SEQ ID NO: 9238800 - DNA, 22 bp, Homo sapiens
gttattttaacttctcagtaat

SEQ ID NO: 9238801 - DNA, 22 bp, Homo sapiens
gttattttaacttctcagtaat

SEQ ID NO: 9238802 - DNA, 22 bp, Homo sapiens
gttattttaacttctcagtaat

SEQ ID NO: 9238803 - DNA, 22 bp, Homo sapiens
gtgtgtccctacaacagcttca

SEQ ID NO: 9238804 - DNA, 22 bp, Homo sapiens
gtgtgtcctcagtagtggcatg

SEQ ID NO: 9238805 - DNA, 22 bp, Homo sapiens
gtgtgtccaggcgggagtcaag

SEQ ID NO: 9238806 - DNA, 22 bp, Homo sapiens
gttattttcattggctcagact

SEQ ID NO: 9238807 - DNA, 22 bp, Homo sapiens
gttattttcattggctcagact

SEQ ID NO: 9238808 - DNA, 22 bp, Homo sapiens
gttattttcattggctcagact

SEQ ID NO: 9238809 - DNA, 22 bp, Homo sapiens
gttcaaaattcaaatggtatac

SEQ ID NO: 9238810 - DNA, 22 bp, Homo sapiens
gttcaaaattcaaatggtatac

SEQ ID NO: 9238811 - DNA, 22 bp, Homo sapiens
gttattttcattggctcagact

SEQ ID NO: 9238812 - DNA, 22 bp, Homo sapiens
gttattttcattggctcagact

SEQ ID NO: 9238813 - DNA, 22 bp, Homo sapiens
gttattttcattggctcagact

SEQ ID NO: 9238814 - DNA, 22 bp, Homo sapiens
gttattttatctctgagaggtt

SEQ ID NO: 9238815 - DNA, 22 bp, Homo sapiens
gttattttatctctgagaggtt

SEQ ID NO: 9238816 - DNA, 22 bp, Homo sapiens
gttattttatctctgagaggtt

SEQ ID NO: 9238817 - DNA, 21 bp, Homo sapiens
gttattttaagtgagctttgc

SEQ ID NO: 9238818 - DNA, 21 bp, Homo sapiens
gttattttaagtgagctttgc

SEQ ID NO: 9238819 - DNA, 21 bp, Homo sapiens
gttattttaagtgagctttgc

SEQ ID NO: 9238820 - DNA, 22 bp, Homo sapiens
gtgtgcagggatgagtgcaggt

SEQ ID NO: 9238821 - DNA, 22 bp, Homo sapiens
gtgtgcagggatgagtgcaggt

SEQ ID NO: 9238822 - DNA, 22 bp, Homo sapiens
gtgtgcagggctgcctgtgccg

SEQ ID NO: 9238823 - DNA, 22 bp, Homo sapiens
gtgtgcagggatgagtgcaggt

SEQ ID NO: 9238824 - DNA, 22 bp, Homo sapiens
gtgtgcaggccacaggccaggg

SEQ ID NO: 9238825 - DNA, 22 bp, Homo sapiens
gtgtgcaggccacaggccaggg

SEQ ID NO: 9238826 - DNA, 22 bp, Homo sapiens
gtgtgcagtagagaaagagcag

SEQ ID NO: 9238827 - DNA, 22 bp, Homo sapiens
gtgtgcaggtgtcagtgcagct

SEQ ID NO: 9238828 - DNA, 22 bp, Homo sapiens
gtgtgcaggtgtcagtgcagct

SEQ ID NO: 9238829 - DNA, 22 bp, Homo sapiens
gtgtgcaggtgtcagtgcagct

SEQ ID NO: 9238830 - DNA, 22 bp, Homo sapiens
gtgtgcagggggccagcgcagc

SEQ ID NO: 9238831 - DNA, 22 bp, Homo sapiens
gtgtgcagggggccagcgcagc

SEQ ID NO: 9238832 - DNA, 22 bp, Homo sapiens
gtgtgcacagagctccagtgtt

SEQ ID NO: 9238833 - DNA, 21 bp, Homo sapiens
gtgtgagtagcatgtgtctca

SEQ ID NO: 9238834 - DNA, 21 bp, Homo sapiens
gtgtgagtagcatgtgtctca

SEQ ID NO: 9238835 - DNA, 22 bp, Homo sapiens
gtgtgcagaagacacaagacat

SEQ ID NO: 9238836 - DNA, 22 bp, Homo sapiens
gtgtgcagaacagggagtgggt

SEQ ID NO: 9238837 - DNA, 22 bp, Homo sapiens
gtgtgcagaagacacaagacat

SEQ ID NO: 9238838 - DNA, 22 bp, Homo sapiens
gtgtgcagaggcaggaggtgct

SEQ ID NO: 9238839 - DNA, 22 bp, Homo sapiens
gtgtgcagcagagacaggactc

SEQ ID NO: 9238840 - DNA, 22 bp, Homo sapiens
gtgtgcagcagagacaggactc

SEQ ID NO: 9238841 - DNA, 22 bp, Homo sapiens
gtgtggggaggagagagccctt

SEQ ID NO: 9238842 - DNA, 22 bp, Homo sapiens
gtgtggggagctgcagccacat

SEQ ID NO: 9238843 - DNA, 22 bp, Homo sapiens
gtgtggggagctgcagccacat

SEQ ID NO: 9238844 - DNA, 22 bp, Homo sapiens
gtgtggggccaggatcagggct

SEQ ID NO: 9238845 - DNA, 22 bp, Homo sapiens
gtgtgggctgcagaggcacagc

SEQ ID NO: 9238846 - DNA, 22 bp, Homo sapiens
gtgtgcagtctgctaggcaggg

SEQ ID NO: 9238847 - DNA, 22 bp, Homo sapiens
gtgtgcagtctgctaggcaggg

SEQ ID NO: 9238848 - DNA, 22 bp, Homo sapiens
gtgtgcagggggccagcgcagc

SEQ ID NO: 9238849 - DNA, 22 bp, Homo sapiens
gtgtgggacgggtgagtggcca

SEQ ID NO: 9238850 - DNA, 22 bp, Homo sapiens
gtgtgggggcagctctgatatg

SEQ ID NO: 9238851 - DNA, 22 bp, Homo sapiens
gtgtggggctcagtgggaatgt

SEQ ID NO: 9238852 - DNA, 22 bp, Homo sapiens
gtgtggggctcagtgggaatgt

SEQ ID NO: 9238853 - DNA, 22 bp, Homo sapiens
gtgtggggtcttctcttggcct

SEQ ID NO: 9238854 - DNA, 22 bp, Homo sapiens
gtgtggggtcttctcttggcct

SEQ ID NO: 9238855 - DNA, 22 bp, Homo sapiens
gtgtgtcagagctcagagaagt

SEQ ID NO: 9238856 - DNA, 22 bp, Homo sapiens
gtgtcccaggagaggagacaat

SEQ ID NO: 9238857 - DNA, 22 bp, Homo sapiens
gtgtcccagcagcacattggct

SEQ ID NO: 9238858 - DNA, 22 bp, Homo sapiens
gtgtcccagccccacaggcctg

SEQ ID NO: 9238859 - DNA, 22 bp, Homo sapiens
gtgtcctgtttccctgtctata

SEQ ID NO: 9238860 - DNA, 22 bp, Homo sapiens
gtgtccttcattggaatctctc

SEQ ID NO: 9238861 - DNA, 22 bp, Homo sapiens
gtgtccttataagaagagatgc

SEQ ID NO: 9238862 - DNA, 22 bp, Homo sapiens
gtgtctcttcctttcaagtggg

SEQ ID NO: 9238863 - DNA, 22 bp, Homo sapiens
gtgtcccaaagattagaaatca

SEQ ID NO: 9238864 - DNA, 22 bp, Homo sapiens
gtgtcccaatctacttttccct

SEQ ID NO: 9238865 - DNA, 22 bp, Homo sapiens
gtgtcccactctggaggtgaag

SEQ ID NO: 9238866 - DNA, 22 bp, Homo sapiens
gtgtcccaatgttcaggacggc

SEQ ID NO: 9238867 - DNA, 22 bp, Homo sapiens
gtgtccagggccgtgttgtctt

SEQ ID NO: 9238868 - DNA, 22 bp, Homo sapiens
gtgtcagaaacaggaaggggaa

SEQ ID NO: 9238869 - DNA, 22 bp, Homo sapiens
gtgtcacatggtttactgcagc

SEQ ID NO: 9238870 - DNA, 22 bp, Homo sapiens
gtgtccagagaaactcacagct

SEQ ID NO: 9238871 - DNA, 22 bp, Homo sapiens
gtgtccacggctgagaatgatt

SEQ ID NO: 9238872 - DNA, 22 bp, Homo sapiens
gtggccagcaagtgctgcctct

SEQ ID NO: 9238873 - DNA, 22 bp, Homo sapiens
gtggccagaggtcccatgtgtc

SEQ ID NO: 9238874 - DNA, 22 bp, Homo sapiens
gtggccagaggtcccatgtgtc

SEQ ID NO: 9238875 - DNA, 22 bp, Homo sapiens
gtggccagcaagtgctgcctct

SEQ ID NO: 9238876 - DNA, 22 bp, Homo sapiens
gtggccagccagggtgctgatg

SEQ ID NO: 9238877 - DNA, 22 bp, Homo sapiens
gtggccagccccatggacagtt

SEQ ID NO: 9238878 - DNA, 22 bp, Homo sapiens
gtggccagagattaaatagagt

SEQ ID NO: 9238879 - DNA, 22 bp, Homo sapiens
gtggccagagattaaatagagt

SEQ ID NO: 9238880 - DNA, 22 bp, Homo sapiens
gtggccagaatcttgaggcctt

SEQ ID NO: 9238881 - DNA, 22 bp, Homo sapiens
gtggccagaatcttgaggcctt

SEQ ID NO: 9238882 - DNA, 22 bp, Homo sapiens
gtggccagaaccaggagaatga

SEQ ID NO: 9238883 - DNA, 22 bp, Homo sapiens
gtggccagaaccaggagaatga

SEQ ID NO: 9238884 - DNA, 22 bp, Homo sapiens
gtggccagaagactgcaatgct

SEQ ID NO: 9238885 - DNA, 22 bp, Homo sapiens
gtggccagaagactgcaatgct

SEQ ID NO: 9238886 - DNA, 22 bp, Homo sapiens
gtggccaggacattgccaggca

SEQ ID NO: 9238887 - DNA, 22 bp, Homo sapiens
gtggccaggacattgccaggca

SEQ ID NO: 9238888 - DNA, 22 bp, Homo sapiens
gtggccaggacattgccaggca

SEQ ID NO: 9238889 - DNA, 22 bp, Homo sapiens
gtggcccacacagacagcatct

SEQ ID NO: 9238890 - DNA, 22 bp, Homo sapiens
gtggcccacttacgtcatgtgt

SEQ ID NO: 9238891 - DNA, 22 bp, Homo sapiens
gtggccctctgatagggtcagg

SEQ ID NO: 9238892 - DNA, 21 bp, Homo sapiens
gtggccctgccgcagtgtcca

SEQ ID NO: 9238893 - DNA, 22 bp, Homo sapiens
gtggcccaggcttggcgctggc

SEQ ID NO: 9238894 - DNA, 22 bp, Homo sapiens
gtggcatcaagatttagattca

SEQ ID NO: 9238895 - DNA, 22 bp, Homo sapiens
gtggcagtggagacccgagcct

SEQ ID NO: 9238896 - DNA, 22 bp, Homo sapiens
gtggcaggggtattccagctga

SEQ ID NO: 9238897 - DNA, 22 bp, Homo sapiens
gtggcagggtgctcatcatgca

SEQ ID NO: 9238898 - DNA, 22 bp, Homo sapiens
gtggcattgacatgtaaacagt

SEQ ID NO: 9238899 - DNA, 22 bp, Homo sapiens
gtggcatgacagtgaatgggca

SEQ ID NO: 9238900 - DNA, 22 bp, Homo sapiens
gtggcatggagaaggaggcagt

SEQ ID NO: 9238901 - DNA, 22 bp, Homo sapiens
gtggccaaggcagagaaagagc

SEQ ID NO: 9238902 - DNA, 22 bp, Homo sapiens
gtggcaggagagacacagccat

SEQ ID NO: 9238903 - DNA, 22 bp, Homo sapiens
gtggcaggagggcatcacttgg

SEQ ID NO: 9238904 - DNA, 22 bp, Homo sapiens
gtggcaggatcacggctcactg

SEQ ID NO: 9238905 - DNA, 22 bp, Homo sapiens
gtggcagctgtgggacactggt

SEQ ID NO: 9238906 - DNA, 22 bp, Homo sapiens
gtggcagctgtgttgcagtttt

SEQ ID NO: 9238907 - DNA, 22 bp, Homo sapiens
gtggcaggagactggaagatgg

SEQ ID NO: 9238908 - DNA, 22 bp, Homo sapiens
gtggcaggagagacacagccat

SEQ ID NO: 9238909 - DNA, 22 bp, Homo sapiens
gtggcagggctttgctgttctt

SEQ ID NO: 9238910 - DNA, 22 bp, Homo sapiens
gtggcaggggcgggctgttccg

SEQ ID NO: 9238911 - DNA, 22 bp, Homo sapiens
gtggcagggcaatgctccctct

SEQ ID NO: 9238912 - DNA, 20 bp, Homo sapiens
gtggcaggcagtgaaggagc

SEQ ID NO: 9238913 - DNA, 22 bp, Homo sapiens
gtgggagctgcggaggcctggg

SEQ ID NO: 9238914 - DNA, 22 bp, Homo sapiens
gtgggagctgcggaggcctggg

SEQ ID NO: 9238915 - DNA, 22 bp, Homo sapiens
gtgggagctgcggaggcctggg

SEQ ID NO: 9238916 - DNA, 22 bp, Homo sapiens
gtgggagccctcagggaggtgc

SEQ ID NO: 9238917 - DNA, 22 bp, Homo sapiens
gtgggagctgcggaggcctggg

SEQ ID NO: 9238918 - DNA, 22 bp, Homo sapiens
gtgggatgcagtggtgagtggc

SEQ ID NO: 9238919 - DNA, 22 bp, Homo sapiens
gtgggatgcagtggtgagtggc

SEQ ID NO: 9238920 - DNA, 22 bp, Homo sapiens
gtgggatggtaggtaggtaata

SEQ ID NO: 9238921 - DNA, 22 bp, Homo sapiens
gtgggagctttggcatcaggct

SEQ ID NO: 9238922 - DNA, 22 bp, Homo sapiens
gtgggagccctcagggaggtgc

SEQ ID NO: 9238923 - DNA, 22 bp, Homo sapiens
gtgggagccctcagggaggtgc

SEQ ID NO: 9238924 - DNA, 22 bp, Homo sapiens
gtgggagcatggtcccagtgcc

SEQ ID NO: 9238925 - DNA, 22 bp, Homo sapiens
gtgggagaagatttggtcatct

SEQ ID NO: 9238926 - DNA, 22 bp, Homo sapiens
gtgggagaaattagctctagtt

SEQ ID NO: 9238927 - DNA, 22 bp, Homo sapiens
gtgggactcttctttggcagtg

SEQ ID NO: 9238928 - DNA, 22 bp, Homo sapiens
gtgggagaagatttggtcatct

SEQ ID NO: 9238929 - DNA, 22 bp, Homo sapiens
gtgggagaaattagctctagtt

SEQ ID NO: 9238930 - DNA, 22 bp, Homo sapiens
gtggctgctggtactctgggaa

SEQ ID NO: 9238931 - DNA, 22 bp, Homo sapiens
gtggctgcagcggctgtggaga

SEQ ID NO: 9238932 - DNA, 22 bp, Homo sapiens
gtggcttcaccccagttgtctc

SEQ ID NO: 9238933 - DNA, 22 bp, Homo sapiens
gtggctggtttcctgcatgcaa

SEQ ID NO: 9238934 - DNA, 22 bp, Homo sapiens
gtggctggtttcctgcatgcaa

SEQ ID NO: 9238935 - DNA, 22 bp, Homo sapiens
gtggctgggctccgagcggctt

SEQ ID NO: 9238936 - DNA, 22 bp, Homo sapiens
gtggcctggcgagctggcgcgg

SEQ ID NO: 9238937 - DNA, 22 bp, Homo sapiens
gtggcctggggtttgttctgag

SEQ ID NO: 9238938 - DNA, 22 bp, Homo sapiens
gtggctcagcggagctctgcac

SEQ ID NO: 9238939 - DNA, 22 bp, Homo sapiens
gtggcctggatgagcttcgaca

SEQ ID NO: 9238940 - DNA, 22 bp, Homo sapiens
gtggcctggcgagctggcgcgg

SEQ ID NO: 9238941 - DNA, 22 bp, Homo sapiens
gtggcctggatgagcttcgaca

SEQ ID NO: 9238942 - DNA, 19 bp, Homo sapiens
gtggctcatgtagtgggcc

SEQ ID NO: 9238943 - DNA, 19 bp, Homo sapiens
gtggctcatgtagtgggcc

SEQ ID NO: 9238944 - DNA, 22 bp, Homo sapiens
gtggctcagcggagctctgcac

SEQ ID NO: 9238945 - DNA, 22 bp, Homo sapiens
gtggctcagttaacttccatgt

SEQ ID NO: 9238946 - DNA, 22 bp, Homo sapiens
gtggctcagttaacttccatgt

SEQ ID NO: 9238947 - DNA, 19 bp, Homo sapiens
gtggctcatgtagtgggcc

SEQ ID NO: 9238948 - DNA, 22 bp, Homo sapiens
gtggctcatctttgggaagtaa

SEQ ID NO: 9238949 - DNA, 22 bp, Homo sapiens
gtggctcatctttgggaagtaa

SEQ ID NO: 9238950 - DNA, 22 bp, Homo sapiens
gtggctcatctttgggaagtaa

SEQ ID NO: 9238951 - DNA, 22 bp, Homo sapiens
gtggctgagcagcagagagctg

SEQ ID NO: 9238952 - DNA, 22 bp, Homo sapiens
gtggcctggaaaggctggtctg

SEQ ID NO: 9238953 - DNA, 22 bp, Homo sapiens
gtggcctggaaaggctggtctg

SEQ ID NO: 9238954 - DNA, 22 bp, Homo sapiens
gtggcctgccgtgtggtatggg

SEQ ID NO: 9238955 - DNA, 21 bp, Homo sapiens
gtggcctgattatgaatgggt

SEQ ID NO: 9238956 - DNA, 22 bp, Homo sapiens
gtggcctgccagcagatggcgc

SEQ ID NO: 9238957 - DNA, 21 bp, Homo sapiens
gtggccctggtgtggctgcac

SEQ ID NO: 9238958 - DNA, 22 bp, Homo sapiens
gtggccctgtcccaggcctcct

SEQ ID NO: 9238959 - DNA, 22 bp, Homo sapiens
gtggcctctgttggctcctagg

SEQ ID NO: 9238960 - DNA, 22 bp, Homo sapiens
gtggcctagaggtgcaaggaac

SEQ ID NO: 9238961 - DNA, 22 bp, Homo sapiens
gtgcctgtttcttttgaattca

SEQ ID NO: 9238962 - DNA, 22 bp, Homo sapiens
gtgcctggcatgcgccggtgct

SEQ ID NO: 9238963 - DNA, 20 bp, Homo sapiens
gtgcctggagaagaggctgt

SEQ ID NO: 9238964 - DNA, 22 bp, Homo sapiens
gtgcctggagctaatgtgtata

SEQ ID NO: 9238965 - DNA, 22 bp, Homo sapiens
gtgcctggcacacagaaggcaa

SEQ ID NO: 9238966 - DNA, 20 bp, Homo sapiens
gtgcctggagaagaggctgt

SEQ ID NO: 9238967 - DNA, 22 bp, Homo sapiens
gtgccttttcttcatagttact

SEQ ID NO: 9238968 - DNA, 22 bp, Homo sapiens
gtgcctttgagaagtttctctg

SEQ ID NO: 9238969 - DNA, 22 bp, Homo sapiens
gtgcctttgtgtctaaaacagc

SEQ ID NO: 9238970 - DNA, 21 bp, Homo sapiens
gtgcggatgccgtcattgtca

SEQ ID NO: 9238971 - DNA, 22 bp, Homo sapiens
gtgcggatcggtgtcctccaaa

SEQ ID NO: 9238972 - DNA, 22 bp, Homo sapiens
gtggaagggactgcctagagga

SEQ ID NO: 9238973 - DNA, 22 bp, Homo sapiens
gtggaaggaattaacagactag

SEQ ID NO: 9238974 - DNA, 22 bp, Homo sapiens
gtggaaggaattaacagactag

SEQ ID NO: 9238975 - DNA, 22 bp, Homo sapiens
gtggaaggtaatgcagcttact

SEQ ID NO: 9238976 - DNA, 22 bp, Homo sapiens
gtggaaggtaatgcagcttact

SEQ ID NO: 9238977 - DNA, 22 bp, Homo sapiens
gtggaaggtgctagaacaagga

SEQ ID NO: 9238978 - DNA, 22 bp, Homo sapiens
gtggaagtagatttgagaaggt

SEQ ID NO: 9238979 - DNA, 22 bp, Homo sapiens
gtgctttttataaggcagactg

SEQ ID NO: 9238980 - DNA, 22 bp, Homo sapiens
gtggaaaactgagaaaattgct

SEQ ID NO: 9238981 - DNA, 22 bp, Homo sapiens
gtgctacagactgagtacactt

SEQ ID NO: 9238982 - DNA, 22 bp, Homo sapiens
gtgctacatggtagtgtagtta

SEQ ID NO: 9238983 - DNA, 22 bp, Homo sapiens
gtggaaatagtttggttataga

SEQ ID NO: 9238984 - DNA, 22 bp, Homo sapiens
gtggaacagcctgtgcaaacct

SEQ ID NO: 9238985 - DNA, 22 bp, Homo sapiens
gtggaacatgtccatatacatt

SEQ ID NO: 9238986 - DNA, 22 bp, Homo sapiens
gtgacaaatgcaaattgggctg

SEQ ID NO: 9238987 - DNA, 22 bp, Homo sapiens
gtgacaaaggtcaagcttttga

SEQ ID NO: 9238988 - DNA, 22 bp, Homo sapiens
gtgacaaaaacactgattattt

SEQ ID NO: 9238989 - DNA, 22 bp, Homo sapiens
gtgaaggattggagggcatctt

SEQ ID NO: 9238990 - DNA, 22 bp, Homo sapiens
gtgaaggctacaagagatcaag

SEQ ID NO: 9238991 - DNA, 22 bp, Homo sapiens
gtgacagagttttagatctcat

SEQ ID NO: 9238992 - DNA, 22 bp, Homo sapiens
gtgacaggcccagtgggatgca

SEQ ID NO: 9238993 - DNA, 22 bp, Homo sapiens
gtgacaggccactgcggctctg

SEQ ID NO: 9238994 - DNA, 22 bp, Homo sapiens
gtgacaggcccagtgggatgca

SEQ ID NO: 9238995 - DNA, 22 bp, Homo sapiens
gtgacaggatagtcagctttgt

SEQ ID NO: 9238996 - DNA, 22 bp, Homo sapiens
gtgacatttttactgatgagag

SEQ ID NO: 9238997 - DNA, 22 bp, Homo sapiens
gtgacatttcgtgacgtgagaa

SEQ ID NO: 9238998 - DNA, 22 bp, Homo sapiens
gtgacagtcaaagacatgactt

SEQ ID NO: 9238999 - DNA, 22 bp, Homo sapiens
gtgacatgttatggactggcta

SEQ ID NO: 9239000 - DNA, 22 bp, Homo sapiens
gtgacattgctaggaacagatt

SEQ ID NO: 9239001 - DNA, 22 bp, Homo sapiens
gtgacatttacgaatcttatcc

SEQ ID NO: 9239002 - DNA, 22 bp, Homo sapiens
gtgacatttattagatgcttac

SEQ ID NO: 9239003 - DNA, 22 bp, Homo sapiens
gtgcctgctgcagagtcgctgt

SEQ ID NO: 9239004 - DNA, 22 bp, Homo sapiens
gtgcctgctacctgacttgttt

SEQ ID NO: 9239005 - DNA, 22 bp, Homo sapiens
gtgcctgcagcaatccatggca

SEQ ID NO: 9239006 - DNA, 22 bp, Homo sapiens
gtggcagagccgtgcaggtagg

SEQ ID NO: 9239007 - DNA, 22 bp, Homo sapiens
gtggcagagccgtgcaggtagg

SEQ ID NO: 9239008 - DNA, 22 bp, Homo sapiens
gtggcacagtgggagagcccca

SEQ ID NO: 9239009 - DNA, 22 bp, Homo sapiens
gtggatggattttgaggaatgg

SEQ ID NO: 9239010 - DNA, 22 bp, Homo sapiens
gtggatggagctggaagccatt

SEQ ID NO: 9239011 - DNA, 22 bp, Homo sapiens
gtggatggctagttgagaaggg

SEQ ID NO: 9239012 - DNA, 22 bp, Homo sapiens
gtggcaacaaaagagcctagtg

SEQ ID NO: 9239013 - DNA, 22 bp, Homo sapiens
gtggcaaggagcatgaaaagtc

SEQ ID NO: 9239014 - DNA, 22 bp, Homo sapiens
gtggcagagtgcggttctgacc

SEQ ID NO: 9239015 - DNA, 22 bp, Homo sapiens
gtggcagagggtgagctggact

SEQ ID NO: 9239016 - DNA, 22 bp, Homo sapiens
gtggcagagggtgagctggact

SEQ ID NO: 9239017 - DNA, 22 bp, Homo sapiens
gtggcagagggtgagctggact

SEQ ID NO: 9239018 - DNA, 22 bp, Homo sapiens
gtggcagcaaatgcctggacta

SEQ ID NO: 9239019 - DNA, 22 bp, Homo sapiens
gtggcagcagaggggtggtatg

SEQ ID NO: 9239020 - DNA, 22 bp, Homo sapiens
gtggcagcaaaatcctgcattc

SEQ ID NO: 9239021 - DNA, 22 bp, Homo sapiens
gtggcagcaggtactcacgcac

SEQ ID NO: 9239022 - DNA, 22 bp, Homo sapiens
gtggcagcaggtactcacgcac

SEQ ID NO: 9239023 - DNA, 16 bp, Homo sapiens
gtggcagccccttctc

SEQ ID NO: 9239024 - DNA, 22 bp, Homo sapiens
gtggcagctcatgttgttttaa

SEQ ID NO: 9239025 - DNA, 22 bp, Homo sapiens
gtggcagccgcaggccctgtgt

SEQ ID NO: 9239026 - DNA, 22 bp, Homo sapiens
gtggcagcggcccaggccgtct

SEQ ID NO: 9239027 - DNA, 22 bp, Homo sapiens
gtggaattgctggataatatca

SEQ ID NO: 9239028 - DNA, 22 bp, Homo sapiens
gtggacagcttctaggtgccag

SEQ ID NO: 9239029 - DNA, 22 bp, Homo sapiens
gtggaccaaggtggaagataaa

SEQ ID NO: 9239030 - DNA, 22 bp, Homo sapiens
gtggacatgcatacatatgttt

SEQ ID NO: 9239031 - DNA, 22 bp, Homo sapiens
gtggactggcagtgaccttggt

SEQ ID NO: 9239032 - DNA, 22 bp, Homo sapiens
gtggagagagataagcctggtc

SEQ ID NO: 9239033 - DNA, 22 bp, Homo sapiens
gtggagaggaacccagctctgt

SEQ ID NO: 9239034 - DNA, 22 bp, Homo sapiens
gtggagagagataagcctggtc

SEQ ID NO: 9239035 - DNA, 22 bp, Homo sapiens
gtggaggacaaaagaagccttt

SEQ ID NO: 9239036 - DNA, 22 bp, Homo sapiens
gtggaggtcccgggcaggagca

SEQ ID NO: 9239037 - DNA, 22 bp, Homo sapiens
gtggagggtttgcaatgtgcag

SEQ ID NO: 9239038 - DNA, 22 bp, Homo sapiens
gtggagtggcctggccctgaga

SEQ ID NO: 9239039 - DNA, 22 bp, Homo sapiens
gtggatgcttaggcagcctggg

SEQ ID NO: 9239040 - DNA, 22 bp, Homo sapiens
gtggatggacatgggcaagagg

SEQ ID NO: 9239041 - DNA, 22 bp, Homo sapiens
gtggagggtgattgccggctgt

SEQ ID NO: 9239042 - DNA, 18 bp, Homo sapiens
gtggagggttctcagaat

SEQ ID NO: 9239043 - DNA, 22 bp, Homo sapiens
gtggagggtttgcaatgtgcag

SEQ ID NO: 9239044 - DNA, 22 bp, Homo sapiens
gtggagggtttgcaatgtgcag

SEQ ID NO: 9239045 - DNA, 22 bp, Homo sapiens
gtggaggacaaaagaagccttt

SEQ ID NO: 9239046 - DNA, 22 bp, Homo sapiens
gtggagggaatgaatcttctct

SEQ ID NO: 9239047 - DNA, 22 bp, Homo sapiens
gtggagggaatgaatcttctct

SEQ ID NO: 9239048 - DNA, 22 bp, Homo sapiens
gtggagggtgagctcatgtttg

SEQ ID NO: 9239049 - DNA, 22 bp, Homo sapiens
ggtgcaggaatctgcaattgaa

SEQ ID NO: 9239050 - DNA, 22 bp, Homo sapiens
ggtgcaggagcggggtgctcgg

SEQ ID NO: 9239051 - DNA, 22 bp, Homo sapiens
ggtgcaggacgaagtgggggtt

SEQ ID NO: 9239052 - DNA, 22 bp, Homo sapiens
ggtgagtttcatggttgtttac

SEQ ID NO: 9239053 - DNA, 22 bp, Homo sapiens
ggtgatttatccattttctggt

SEQ ID NO: 9239054 - DNA, 22 bp, Homo sapiens
ggtgagggtaaatataggcaaa

SEQ ID NO: 9239055 - DNA, 22 bp, Homo sapiens
ggtgagggtaaatataggcaaa

SEQ ID NO: 9239056 - DNA, 22 bp, Homo sapiens
ggtgagtgcctggcctggccac

SEQ ID NO: 9239057 - DNA, 17 bp, Homo sapiens
ggtgagtgtccaggtgg

SEQ ID NO: 9239058 - DNA, 22 bp, Homo sapiens
ggtggcagaggtgcatcagccc

SEQ ID NO: 9239059 - DNA, 22 bp, Homo sapiens
ggtggcagaggtgcatcagccc

SEQ ID NO: 9239060 - DNA, 22 bp, Homo sapiens
ggtggcagcatggtcccagtgt

SEQ ID NO: 9239061 - DNA, 22 bp, Homo sapiens
ggtggcagaggtgcatcagccc

SEQ ID NO: 9239062 - DNA, 22 bp, Homo sapiens
ggtggcagaggtgcatcagccc

SEQ ID NO: 9239063 - DNA, 22 bp, Homo sapiens
ggtgcaggcggtggggcaagta

SEQ ID NO: 9239064 - DNA, 22 bp, Homo sapiens
gggtggggccaggcaatttgca

SEQ ID NO: 9239065 - DNA, 22 bp, Homo sapiens
gggtggggcccaggaaatctat

SEQ ID NO: 9239066 - DNA, 22 bp, Homo sapiens
gggtggggtgtatcggatccta

SEQ ID NO: 9239067 - DNA, 22 bp, Homo sapiens
gggtggggttcaggaatcttca

SEQ ID NO: 9239068 - DNA, 22 bp, Homo sapiens
ggtgagggtaaatataggcaaa

SEQ ID NO: 9239069 - DNA, 22 bp, Homo sapiens
ggtgaggggcgcctctgcccgg

SEQ ID NO: 9239070 - DNA, 22 bp, Homo sapiens
ggtgaggggctcctctgcccgg

SEQ ID NO: 9239071 - DNA, 22 bp, Homo sapiens
ggtgaggggcacctctgcccgg

SEQ ID NO: 9239072 - DNA, 22 bp, Homo sapiens
ggtgaggggagagtgaaagaaa

SEQ ID NO: 9239073 - DNA, 22 bp, Homo sapiens
ggtgaggggagagtgaaagaaa

SEQ ID NO: 9239074 - DNA, 22 bp, Homo sapiens
ggtgaggggcgcctctgcccag

SEQ ID NO: 9239075 - DNA, 22 bp, Homo sapiens
ggtggtggtcccgacttgggag

SEQ ID NO: 9239076 - DNA, 23 bp, Homo sapiens
ggtggtggtgagtcacgggctca

SEQ ID NO: 9239077 - DNA, 23 bp, Homo sapiens
ggtggtggtgagtcacgggctca

SEQ ID NO: 9239078 - DNA, 22 bp, Homo sapiens
ggtggttcacgcctataatccc

SEQ ID NO: 9239079 - DNA, 22 bp, Homo sapiens
ggtggccatggtcaggtagcgg

SEQ ID NO: 9239080 - DNA, 22 bp, Homo sapiens
ggtggttcacgcctataatccc

SEQ ID NO: 9239081 - DNA, 22 bp, Homo sapiens
ggtggttcacgcctataatccc

SEQ ID NO: 9239082 - DNA, 22 bp, Homo sapiens
ggtgtaagatgtcagctgagca

SEQ ID NO: 9239083 - DNA, 22 bp, Homo sapiens
ggtgtatacctacacatttttg

SEQ ID NO: 9239084 - DNA, 22 bp, Homo sapiens
ggtgtcatccaacaggacaggg

SEQ ID NO: 9239085 - DNA, 22 bp, Homo sapiens
ggtgtccatcaggctgtgcttc

SEQ ID NO: 9239086 - DNA, 21 bp, Homo sapiens
ggtgtccagaggagtccccag

SEQ ID NO: 9239087 - DNA, 22 bp, Homo sapiens
ggtgtccatcaggctgtgcttc

SEQ ID NO: 9239088 - DNA, 22 bp, Homo sapiens
ggtgtcccaggccagctgtgtg

SEQ ID NO: 9239089 - DNA, 22 bp, Homo sapiens
ggtggcaggccctgagcatccc

SEQ ID NO: 9239090 - DNA, 22 bp, Homo sapiens
ggtggcaggccctgagcatccc

SEQ ID NO: 9239091 - DNA, 22 bp, Homo sapiens
ggtggcaggctggcattggcaa

SEQ ID NO: 9239092 - DNA, 22 bp, Homo sapiens
ggtggcagcgtctatctgacat

SEQ ID NO: 9239093 - DNA, 22 bp, Homo sapiens
ggtggcagcgtctatctgacat

SEQ ID NO: 9239094 - DNA, 23 bp, Homo sapiens
ggtggcaggagtggatgctgagc

SEQ ID NO: 9239095 - DNA, 22 bp, Homo sapiens
ggtggcagcgtctatctgacat

SEQ ID NO: 9239096 - DNA, 22 bp, Homo sapiens
ggtggcagcatggtcccagtgt

SEQ ID NO: 9239097 - DNA, 23 bp, Homo sapiens
ggtggcaggagtggatgctgagc

SEQ ID NO: 9239098 - DNA, 23 bp, Homo sapiens
ggtggcaggagtggatgctgagc

SEQ ID NO: 9239099 - DNA, 22 bp, Homo sapiens
ggtggcaggccctgagcatccc

SEQ ID NO: 9239100 - DNA, 23 bp, Homo sapiens
ggtggcaggagtggatgctgagc

SEQ ID NO: 9239101 - DNA, 22 bp, Homo sapiens
ggtggcattcagaagagctggc

SEQ ID NO: 9239102 - DNA, 22 bp, Homo sapiens
ggtggcattcagaagagctggc

SEQ ID NO: 9239103 - DNA, 22 bp, Homo sapiens
ggtggcaggctggcattggcaa

SEQ ID NO: 9239104 - DNA, 22 bp, Homo sapiens
ggtggcagttacaggggcaaat

SEQ ID NO: 9239105 - DNA, 20 bp, Homo sapiens
gtatataaccatagtgacta

SEQ ID NO: 9239106 - DNA, 22 bp, Homo sapiens
gtatataaggtaaagcgattgt

SEQ ID NO: 9239107 - DNA, 22 bp, Homo sapiens
gtatataaggtaaagcgattgt

SEQ ID NO: 9239108 - DNA, 22 bp, Homo sapiens
gtatggaagtataagttttgaa

SEQ ID NO: 9239109 - DNA, 22 bp, Homo sapiens
gtacataattttcagccagttt

SEQ ID NO: 9239110 - DNA, 22 bp, Homo sapiens
gtacataaaggaggctctttgc

SEQ ID NO: 9239111 - DNA, 22 bp, Homo sapiens
gtacatatggcacatgctattt

SEQ ID NO: 9239112 - DNA, 22 bp, Homo sapiens
gtacatattaaaggtctataaa

SEQ ID NO: 9239113 - DNA, 19 bp, Homo sapiens
gtacagtggtaagctatga

SEQ ID NO: 9239114 - DNA, 22 bp, Homo sapiens
gtacagtagagccaggttcagt

SEQ ID NO: 9239115 - DNA, 22 bp, Homo sapiens
gtacaggtcttatctcctagga

SEQ ID NO: 9239116 - DNA, 22 bp, Homo sapiens
gtacattcatggttccaccagg

SEQ ID NO: 9239117 - DNA, 22 bp, Homo sapiens
gtacattctgtggacttggaca

SEQ ID NO: 9239118 - DNA, 22 bp, Homo sapiens
gtacattcagcttagcacttct

SEQ ID NO: 9239119 - DNA, 22 bp, Homo sapiens
gtacatttactgatgaaaagta

SEQ ID NO: 9239120 - DNA, 22 bp, Homo sapiens
gtacatttactgatgaaaagta

SEQ ID NO: 9239121 - DNA, 22 bp, Homo sapiens
gtacatgtgcacaacatgcatg

SEQ ID NO: 9239122 - DNA, 22 bp, Homo sapiens
gtacatgttggttgtttccagt

SEQ ID NO: 9239123 - DNA, 22 bp, Homo sapiens
gtacatgcagattatagctaat

SEQ ID NO: 9239124 - DNA, 22 bp, Homo sapiens
gtacatgattccccataaaaag

SEQ ID NO: 9239125 - DNA, 22 bp, Homo sapiens
gtaaatataaatgctagctgcc

SEQ ID NO: 9239126 - DNA, 22 bp, Homo sapiens
gtaaatataaatgctagctgcc

SEQ ID NO: 9239127 - DNA, 22 bp, Homo sapiens
gtaaatataaatgctagctgcc

SEQ ID NO: 9239128 - DNA, 22 bp, Homo sapiens
gtaaataactggtaattggggt

SEQ ID NO: 9239129 - DNA, 22 bp, Homo sapiens
gtaaataactggtaattggggt

SEQ ID NO: 9239130 - DNA, 22 bp, Homo sapiens
gtaaataactggtaattggggt

SEQ ID NO: 9239131 - DNA, 22 bp, Homo sapiens
gtaaataactggtaattggggt

SEQ ID NO: 9239132 - DNA, 22 bp, Homo sapiens
gtaaataactggtaattggggt

SEQ ID NO: 9239133 - DNA, 22 bp, Homo sapiens
gtaaatattaaaggctgctaga

SEQ ID NO: 9239134 - DNA, 22 bp, Homo sapiens
gtaaatattaaaggctgctaga

SEQ ID NO: 9239135 - DNA, 18 bp, Homo sapiens
gtacacaaagtcaaagta

SEQ ID NO: 9239136 - DNA, 22 bp, Homo sapiens
gtaaatattaaaggctgctaga

SEQ ID NO: 9239137 - DNA, 22 bp, Homo sapiens
gtaaatattaaaggctgctaga

SEQ ID NO: 9239138 - DNA, 22 bp, Homo sapiens
gtaaatataaatgctagctgcc

SEQ ID NO: 9239139 - DNA, 22 bp, Homo sapiens
gtaaatattaaaggctgctaga

SEQ ID NO: 9239140 - DNA, 22 bp, Homo sapiens
gtaaatataaatgctagctgcc

SEQ ID NO: 9239141 - DNA, 22 bp, Homo sapiens
gtacacacaatctctggtcagt

SEQ ID NO: 9239142 - DNA, 21 bp, Homo sapiens
gtacacacaggtggatgggct

SEQ ID NO: 9239143 - DNA, 22 bp, Homo sapiens
gtacaggcagcaaacaccataa

SEQ ID NO: 9239144 - DNA, 22 bp, Homo sapiens
gtacaggaaggagggagtttca

SEQ ID NO: 9239145 - DNA, 22 bp, Homo sapiens
gtacaggacatagacagagtag

SEQ ID NO: 9239146 - DNA, 22 bp, Homo sapiens
ggtgtcctcactatagcaagtc

SEQ ID NO: 9239147 - DNA, 22 bp, Homo sapiens
ggtgtcctcatgattttctaga

SEQ ID NO: 9239148 - DNA, 23 bp, Homo sapiens
gtaaaatacgcagtgcagtgtga

SEQ ID NO: 9239149 - DNA, 23 bp, Homo sapiens
gtaaaatacgcagtgcagtgtga

SEQ ID NO: 9239150 - DNA, 23 bp, Homo sapiens
gtaaaatacgcagtgcagtgtga

SEQ ID NO: 9239151 - DNA, 23 bp, Homo sapiens
gtaaaatacgcagtgcagtgtga

SEQ ID NO: 9239152 - DNA, 22 bp, Homo sapiens
gtaaacattactgtgctgtata

SEQ ID NO: 9239153 - DNA, 22 bp, Homo sapiens
gtaaacattttcatctgtgccc

SEQ ID NO: 9239154 - DNA, 22 bp, Homo sapiens
gtaaagcaaaatgtagagattg

SEQ ID NO: 9239155 - DNA, 22 bp, Homo sapiens
gtaaagaagtttttgaatgcat

SEQ ID NO: 9239156 - DNA, 22 bp, Homo sapiens
gtaaagaaggcaacctggttat

SEQ ID NO: 9239157 - DNA, 20 bp, Homo sapiens
gtaaagcattcttggcatac

SEQ ID NO: 9239158 - DNA, 22 bp, Homo sapiens
gtaaagctctcatttaatatca

SEQ ID NO: 9239159 - DNA, 21 bp, Homo sapiens
gtctgatgcttgatgcagttg

SEQ ID NO: 9239160 - DNA, 21 bp, Homo sapiens
gtctgatgcttgatgcagttg

SEQ ID NO: 9239161 - DNA, 22 bp, Homo sapiens
gtctgagggttgtgctggagga

SEQ ID NO: 9239162 - DNA, 22 bp, Homo sapiens
gtctggcagatcgagcagccca

SEQ ID NO: 9239163 - DNA, 22 bp, Homo sapiens
gtctggcatatgcaaagtgcat

SEQ ID NO: 9239164 - DNA, 22 bp, Homo sapiens
gtctgggcttagggacatggca

SEQ ID NO: 9239165 - DNA, 22 bp, Homo sapiens
gtctgggggtccgggtgcctgc

SEQ ID NO: 9239166 - DNA, 22 bp, Homo sapiens
gtctgggattggggtaaagaag

SEQ ID NO: 9239167 - DNA, 22 bp, Homo sapiens
gtctgaggggtttcccaggaca

SEQ ID NO: 9239168 - DNA, 22 bp, Homo sapiens
gtctgaggggtttcccaggaca

SEQ ID NO: 9239169 - DNA, 22 bp, Homo sapiens
gtctgaggcgaggcctgagaac

SEQ ID NO: 9239170 - DNA, 22 bp, Homo sapiens
gtctgagggacagagtcctggc

SEQ ID NO: 9239171 - DNA, 22 bp, Homo sapiens
gtctgaggcctgaggccctggg

SEQ ID NO: 9239172 - DNA, 22 bp, Homo sapiens
gtctgaggcctgaggccctggg

SEQ ID NO: 9239173 - DNA, 22 bp, Homo sapiens
gtctgaggaagatgcaggggga

SEQ ID NO: 9239174 - DNA, 22 bp, Homo sapiens
gtctgaggaagatgcaggggga

SEQ ID NO: 9239175 - DNA, 22 bp, Homo sapiens
gtctcttttatggtgagttgat

SEQ ID NO: 9239176 - DNA, 22 bp, Homo sapiens
gtctcttttatggtgagttgat

SEQ ID NO: 9239177 - DNA, 22 bp, Homo sapiens
gtctgaaaatatgattttgcct

SEQ ID NO: 9239178 - DNA, 22 bp, Homo sapiens
gtctctgagctctgagctggct

SEQ ID NO: 9239179 - DNA, 22 bp, Homo sapiens
gtctctgagctctgagctggct

SEQ ID NO: 9239180 - DNA, 22 bp, Homo sapiens
gtctgaaagtagggctgatcta

SEQ ID NO: 9239181 - DNA, 22 bp, Homo sapiens
gtctgaaacgcattgttatcga

SEQ ID NO: 9239182 - DNA, 22 bp, Homo sapiens
gtctgaaaatgccctacgattg

SEQ ID NO: 9239183 - DNA, 22 bp, Homo sapiens
gtctgaaatggaggtgggaact

SEQ ID NO: 9239184 - DNA, 22 bp, Homo sapiens
gtccttcatctggagcctggtc

SEQ ID NO: 9239185 - DNA, 22 bp, Homo sapiens
gtccttcttttcatccctggtt

SEQ ID NO: 9239186 - DNA, 22 bp, Homo sapiens
gtccttggagctcccctctgta

SEQ ID NO: 9239187 - DNA, 22 bp, Homo sapiens
gtccttggaggtgtggaatctg

SEQ ID NO: 9239188 - DNA, 22 bp, Homo sapiens
gtcccagggaggttcagggctt

SEQ ID NO: 9239189 - DNA, 22 bp, Homo sapiens
gtcccagggatgcagacatgag

SEQ ID NO: 9239190 - DNA, 22 bp, Homo sapiens
gtcctgtgtactcctgatactt

SEQ ID NO: 9239191 - DNA, 22 bp, Homo sapiens
gtcctgtgtgacttcccaaatg

SEQ ID NO: 9239192 - DNA, 22 bp, Homo sapiens
gtcctggtagggctctgtgtct

SEQ ID NO: 9239193 - DNA, 22 bp, Homo sapiens
gtcctggtagctggcttggtca

SEQ ID NO: 9239194 - DNA, 22 bp, Homo sapiens
gtcctgggtccccgcaggtcag

SEQ ID NO: 9239195 - DNA, 22 bp, Homo sapiens
gtcctgggtccccgcaggtcag

SEQ ID NO: 9239196 - DNA, 22 bp, Homo sapiens
gtcctgggtccccgcaggtcag

SEQ ID NO: 9239197 - DNA, 22 bp, Homo sapiens
gtccttatttcacttaaacgta

SEQ ID NO: 9239198 - DNA, 22 bp, Homo sapiens
gtcctgtgtcccagagaaagag

SEQ ID NO: 9239199 - DNA, 22 bp, Homo sapiens
gtcctgtgtgagtgcaccacct

SEQ ID NO: 9239200 - DNA, 22 bp, Homo sapiens
gtcctgttaagatgcagagtcc

SEQ ID NO: 9239201 - DNA, 22 bp, Homo sapiens
gtcctgtgtgttgccggctgaa

SEQ ID NO: 9239202 - DNA, 22 bp, Homo sapiens
gtcctgtttgtatttgctggaa

SEQ ID NO: 9239203 - DNA, 22 bp, Homo sapiens
gtcctgttggggtgttgcagtc

SEQ ID NO: 9239204 - DNA, 22 bp, Homo sapiens
gtccaggtctggaccctgagcc

SEQ ID NO: 9239205 - DNA, 22 bp, Homo sapiens
gtcccagggaagaaggcagcac

SEQ ID NO: 9239206 - DNA, 22 bp, Homo sapiens
gtcccagaaacatattgctggt

SEQ ID NO: 9239207 - DNA, 22 bp, Homo sapiens
gtcccagaaacatattgctggt

SEQ ID NO: 9239208 - DNA, 22 bp, Homo sapiens
gtcagctgtctccccagagtgg

SEQ ID NO: 9239209 - DNA, 22 bp, Homo sapiens
gtcagctgtctccccagagtgg

SEQ ID NO: 9239210 - DNA, 22 bp, Homo sapiens
gtcagctcagcaggtgggagtg

SEQ ID NO: 9239211 - DNA, 22 bp, Homo sapiens
gtcagctcatccatcccggtgg

SEQ ID NO: 9239212 - DNA, 22 bp, Homo sapiens
gtcagaggggacaagacacaga

SEQ ID NO: 9239213 - DNA, 18 bp, Homo sapiens
gtcagaggatggggaaat

SEQ ID NO: 9239214 - DNA, 22 bp, Homo sapiens
gtatgtcatgagccttgtgcgt

SEQ ID NO: 9239215 - DNA, 22 bp, Homo sapiens
gtatgtcaaaatctgcatgata

SEQ ID NO: 9239216 - DNA, 22 bp, Homo sapiens
gtatgtcacctctcctaagcac

SEQ ID NO: 9239217 - DNA, 22 bp, Homo sapiens
gtcaggccctggcagccgtgac

SEQ ID NO: 9239218 - DNA, 22 bp, Homo sapiens
gtcaggactctgacccgtcccg

SEQ ID NO: 9239219 - DNA, 22 bp, Homo sapiens
gtcaggactctgacccgtcccg

SEQ ID NO: 9239220 - DNA, 22 bp, Homo sapiens
gtcaggactctgacccgtcccg

SEQ ID NO: 9239221 - DNA, 22 bp, Homo sapiens
gtcaggacattttaccatcctg

SEQ ID NO: 9239222 - DNA, 22 bp, Homo sapiens
gtcaggatcaaattgaagttat

SEQ ID NO: 9239223 - DNA, 22 bp, Homo sapiens
ttccagctaactcacatccctt

SEQ ID NO: 9239224 - DNA, 22 bp, Homo sapiens
ttccagagtgactgtgccactt

SEQ ID NO: 9239225 - DNA, 22 bp, Homo sapiens
ttccagaggttctcagccctgt

SEQ ID NO: 9239226 - DNA, 22 bp, Homo sapiens
ttccagaggcttgaggaaaatt

SEQ ID NO: 9239227 - DNA, 22 bp, Homo sapiens
ttccagaggcttcagggaagaa

SEQ ID NO: 9239228 - DNA, 22 bp, Homo sapiens
ttccagctaactcacatccctt

SEQ ID NO: 9239229 - DNA, 22 bp, Homo sapiens
ttccagatttctacacaagacc

SEQ ID NO: 9239230 - DNA, 22 bp, Homo sapiens
ttcattcatctctaaaatgcct

SEQ ID NO: 9239231 - DNA, 22 bp, Homo sapiens
ttcattcatctctaaaatgcct

SEQ ID NO: 9239232 - DNA, 22 bp, Homo sapiens
ttcattcatctctaaaatgcct

SEQ ID NO: 9239233 - DNA, 22 bp, Homo sapiens
ttcattcagtgagactaggacg

SEQ ID NO: 9239234 - DNA, 22 bp, Homo sapiens
ttcattcacccaggaaacatct

SEQ ID NO: 9239235 - DNA, 23 bp, Homo sapiens
ttcattcaaaaggaaaagtcatg

SEQ ID NO: 9239236 - DNA, 22 bp, Homo sapiens
ttcattaagtataaaatgtggt

SEQ ID NO: 9239237 - DNA, 22 bp, Homo sapiens
ttcattaattcattcagtgact

SEQ ID NO: 9239238 - DNA, 22 bp, Homo sapiens
ttcattaattcattcagtgact

SEQ ID NO: 9239239 - DNA, 17 bp, Homo sapiens
ttcattaataaaagcaa

SEQ ID NO: 9239240 - DNA, 22 bp, Homo sapiens
ttcattagagattataaaatga

SEQ ID NO: 9239241 - DNA, 22 bp, Homo sapiens
ttcattagaaaagtaaaaatgc

SEQ ID NO: 9239242 - DNA, 22 bp, Homo sapiens
ttcattactgcggtagtcacac

SEQ ID NO: 9239243 - DNA, 22 bp, Homo sapiens
ttcaggaatcaaccaagtcatt

SEQ ID NO: 9239244 - DNA, 22 bp, Homo sapiens
ttcattgatagttttatgtatg

SEQ ID NO: 9239245 - DNA, 22 bp, Homo sapiens
ttcattgagctgtacacttagg

SEQ ID NO: 9239246 - DNA, 22 bp, Homo sapiens
ttcattgagctgtacacttagg

SEQ ID NO: 9239247 - DNA, 22 bp, Homo sapiens
ttcattgaagcacaagtgatct

SEQ ID NO: 9239248 - DNA, 22 bp, Homo sapiens
ttccagaggcctgggcacactc

SEQ ID NO: 9239249 - DNA, 22 bp, Homo sapiens
ttcattcttgtctttgtatagt

SEQ ID NO: 9239250 - DNA, 22 bp, Homo sapiens
ttcattctttgaatctgaggta

SEQ ID NO: 9239251 - DNA, 19 bp, Homo sapiens
ttcattctttctacttacc

SEQ ID NO: 9239252 - DNA, 22 bp, Homo sapiens
ttcacattgtgcagattatggt

SEQ ID NO: 9239253 - DNA, 22 bp, Homo sapiens
ttcacattgtgcagattatggt

SEQ ID NO: 9239254 - DNA, 18 bp, Homo sapiens
ttcaccagtgtgatgggt

SEQ ID NO: 9239255 - DNA, 18 bp, Homo sapiens
ttcaccagtgtgatgggt

SEQ ID NO: 9239256 - DNA, 19 bp, Homo sapiens
ttcacattttgctctgagg

SEQ ID NO: 9239257 - DNA, 20 bp, Homo sapiens
ttcacatttctgtagtgatt

SEQ ID NO: 9239258 - DNA, 22 bp, Homo sapiens
ttatttgacttcttgctatgct

SEQ ID NO: 9239259 - DNA, 22 bp, Homo sapiens
ttatttcctagggaatttgcct

SEQ ID NO: 9239260 - DNA, 22 bp, Homo sapiens
ttatttcctctctaatagggta

SEQ ID NO: 9239261 - DNA, 22 bp, Homo sapiens
ttatttcctgacacagctgatt

SEQ ID NO: 9239262 - DNA, 22 bp, Homo sapiens
ttatttgtgaatcatttatcta

SEQ ID NO: 9239263 - DNA, 22 bp, Homo sapiens
ttatttgtgaatcatttatcta

SEQ ID NO: 9239264 - DNA, 22 bp, Homo sapiens
ttatttgtaaaggtccatagta

SEQ ID NO: 9239265 - DNA, 22 bp, Homo sapiens
ttatttgattagtaaacctgta

SEQ ID NO: 9239266 - DNA, 22 bp, Homo sapiens
ttatttgccagaatttctcttg

SEQ ID NO: 9239267 - DNA, 22 bp, Homo sapiens
ttcagcagtcgtccaggaaaag

SEQ ID NO: 9239268 - DNA, 22 bp, Homo sapiens
ttcagcagtcgtccaggaaaag

SEQ ID NO: 9239269 - DNA, 22 bp, Homo sapiens
ttcagcagtgcagacacccagt

SEQ ID NO: 9239270 - DNA, 17 bp, Homo sapiens
ttcagcagtgtttctcc

SEQ ID NO: 9239271 - DNA, 22 bp, Homo sapiens
ttcagcatagcagcttcaggac

SEQ ID NO: 9239272 - DNA, 22 bp, Homo sapiens
ttcagcagcttttagtacattg

SEQ ID NO: 9239273 - DNA, 22 bp, Homo sapiens
ttcactgaattaatttccttct

SEQ ID NO: 9239274 - DNA, 22 bp, Homo sapiens
ttcaccccaaattcccagtgga

SEQ ID NO: 9239275 - DNA, 22 bp, Homo sapiens
ttcaccctggaccagaaattgg

SEQ ID NO: 9239276 - DNA, 22 bp, Homo sapiens
ttcaggaataattatcatatga

SEQ ID NO: 9239277 - DNA, 22 bp, Homo sapiens
ttcaggaaggtcctatagcaga

SEQ ID NO: 9239278 - DNA, 22 bp, Homo sapiens
ttcaggaaggtcctatagcaga

SEQ ID NO: 9239279 - DNA, 22 bp, Homo sapiens
ttcaggaagcctttcttggtct

SEQ ID NO: 9239280 - DNA, 22 bp, Homo sapiens
ttcagcttgctgactgcggcag

SEQ ID NO: 9239281 - DNA, 22 bp, Homo sapiens
ttcagcctgttcatgctgttgc

SEQ ID NO: 9239282 - DNA, 22 bp, Homo sapiens
ttcagctcctttcttccaccag

SEQ ID NO: 9239283 - DNA, 22 bp, Homo sapiens
ttacattcattgaagtgattca

SEQ ID NO: 9239284 - DNA, 22 bp, Homo sapiens
ttacattcagaaagatttgagt

SEQ ID NO: 9239285 - DNA, 22 bp, Homo sapiens
ttacattcaatttctagaggta

SEQ ID NO: 9239286 - DNA, 22 bp, Homo sapiens
ttacatttggctatgtcctcta

SEQ ID NO: 9239287 - DNA, 22 bp, Homo sapiens
ttacatttggctatgtcctcta

SEQ ID NO: 9239288 - DNA, 22 bp, Homo sapiens
ttacattttgcacagatgtccc

SEQ ID NO: 9239289 - DNA, 22 bp, Homo sapiens
ttacattttagttaacctgtga

SEQ ID NO: 9239290 - DNA, 21 bp, Homo sapiens
ttacatggtttatcatatgga

SEQ ID NO: 9239291 - DNA, 22 bp, Homo sapiens
ttacatggtaaacactctttta

SEQ ID NO: 9239292 - DNA, 22 bp, Homo sapiens
ttacatggttgttggaaatgct

SEQ ID NO: 9239293 - DNA, 22 bp, Homo sapiens
ttacatggttgttggaaatgct

SEQ ID NO: 9239294 - DNA, 21 bp, Homo sapiens
ttacatggtttatcatatgga

SEQ ID NO: 9239295 - DNA, 22 bp, Homo sapiens
ttacattagacccactttcatg

SEQ ID NO: 9239296 - DNA, 22 bp, Homo sapiens
ttacatgatgatttcataaaca

SEQ ID NO: 9239297 - DNA, 22 bp, Homo sapiens
ttacatgcaggtcagactgcat

SEQ ID NO: 9239298 - DNA, 22 bp, Homo sapiens
ttacatggatgtaaaaaagtta

SEQ ID NO: 9239299 - DNA, 22 bp, Homo sapiens
ttacatggtaaacactctttta

SEQ ID NO: 9239300 - DNA, 22 bp, Homo sapiens
ttacatgggcttgtgagtcctt

SEQ ID NO: 9239301 - DNA, 22 bp, Homo sapiens
ttacatgggccatttagacatg

SEQ ID NO: 9239302 - DNA, 22 bp, Homo sapiens
ttacagatggatctagcaaaat

SEQ ID NO: 9239303 - DNA, 22 bp, Homo sapiens
ttacagatggcagtttcttgag

SEQ ID NO: 9239304 - DNA, 22 bp, Homo sapiens
ttacagatggggttgcaataaa

SEQ ID NO: 9239305 - DNA, 22 bp, Homo sapiens
ttacagatgtaggaactgaagt

SEQ ID NO: 9239306 - DNA, 22 bp, Homo sapiens
ttacaattgagtctattgtatg

SEQ ID NO: 9239307 - DNA, 22 bp, Homo sapiens
ttacaatgggtatacttccatt

SEQ ID NO: 9239308 - DNA, 22 bp, Homo sapiens
ttacaattacttgatctcagct

SEQ ID NO: 9239309 - DNA, 22 bp, Homo sapiens
ttacaaggtaagttgttaagtc

SEQ ID NO: 9239310 - DNA, 22 bp, Homo sapiens
ttacaagggtcagtgtgtttgt

SEQ ID NO: 9239311 - DNA, 22 bp, Homo sapiens
ttacaaggaggatagcatttcc

SEQ ID NO: 9239312 - DNA, 20 bp, Homo sapiens
ttacaaggtagaggagggaa

SEQ ID NO: 9239313 - DNA, 22 bp, Homo sapiens
ttacaatgggagcccttggact

SEQ ID NO: 9239314 - DNA, 22 bp, Homo sapiens
ttacaagataacctgatgctgt

SEQ ID NO: 9239315 - DNA, 22 bp, Homo sapiens
ttacaagacagtgtggtaaata

SEQ ID NO: 9239316 - DNA, 22 bp, Homo sapiens
ttacaagacagtgtggtaaata

SEQ ID NO: 9239317 - DNA, 22 bp, Homo sapiens
ttacaagatctttgaaggcaag

SEQ ID NO: 9239318 - DNA, 22 bp, Homo sapiens
ttacaagatatgtgagaactag

SEQ ID NO: 9239319 - DNA, 22 bp, Homo sapiens
ttacacaaaaataagatatggc

SEQ ID NO: 9239320 - DNA, 22 bp, Homo sapiens
ttacacaaacacattccagata

SEQ ID NO: 9239321 - DNA, 22 bp, Homo sapiens
ttacagaaaaggggttgtcctt

SEQ ID NO: 9239322 - DNA, 22 bp, Homo sapiens
ttacagaatgttcttccaacag

SEQ ID NO: 9239323 - DNA, 22 bp, Homo sapiens
ttacagatacatttcttttgtt

SEQ ID NO: 9239324 - DNA, 22 bp, Homo sapiens
ttacagagctcatttctaaggg

SEQ ID NO: 9239325 - DNA, 22 bp, Homo sapiens
ttacagagggcttctctgaact

SEQ ID NO: 9239326 - DNA, 17 bp, Homo sapiens
ttacaacaattcatgag

SEQ ID NO: 9239327 - DNA, 21 bp, Homo sapiens
ttacaacatttgtgttctatg

SEQ ID NO: 9239328 - DNA, 17 bp, Homo sapiens
ttacaacgtcatctctg

SEQ ID NO: 9239329 - DNA, 22 bp, Homo sapiens
ttacaacatatttagcttgatt

SEQ ID NO: 9239330 - DNA, 22 bp, Homo sapiens
ttacaagacacagtgctgaagg

SEQ ID NO: 9239331 - DNA, 22 bp, Homo sapiens
ttacaaagtgttatgataaaca

SEQ ID NO: 9239332 - DNA, 22 bp, Homo sapiens
ttacaaagtgttatgataaaca

SEQ ID NO: 9239333 - DNA, 22 bp, Homo sapiens
ttacaaagtgttatgataaaca

SEQ ID NO: 9239334 - DNA, 22 bp, Homo sapiens
ttacaaagttctgagttcaaac

SEQ ID NO: 9239335 - DNA, 22 bp, Homo sapiens
ttacaaagtttaaggtggcact

SEQ ID NO: 9239336 - DNA, 22 bp, Homo sapiens
ttacaaagtgctgcaccatttt

SEQ ID NO: 9239337 - DNA, 21 bp, Homo sapiens
ttacaaagctacagatgttgc

SEQ ID NO: 9239338 - DNA, 21 bp, Homo sapiens
ttacaaagctacagatgttgc

SEQ ID NO: 9239339 - DNA, 22 bp, Homo sapiens
ttacaaagaaaattaggcattt

SEQ ID NO: 9239340 - DNA, 22 bp, Homo sapiens
ttacaaagaaaattaggcattt

SEQ ID NO: 9239341 - DNA, 20 bp, Homo sapiens
ttacaaagaggcatcgcttt

SEQ ID NO: 9239342 - DNA, 20 bp, Homo sapiens
ttacaaagaggcatcgcttt

SEQ ID NO: 9239343 - DNA, 22 bp, Homo sapiens
ttaattaaattcatgagcattg

SEQ ID NO: 9239344 - DNA, 22 bp, Homo sapiens
ttaattaactagccaaccacta

SEQ ID NO: 9239345 - DNA, 22 bp, Homo sapiens
ttaataagtagtagttattgtt

SEQ ID NO: 9239346 - DNA, 22 bp, Homo sapiens
ttaataataatgagcccatttt

SEQ ID NO: 9239347 - DNA, 22 bp, Homo sapiens
ttaataaagtatgaattggaaa

SEQ ID NO: 9239348 - DNA, 22 bp, Homo sapiens
ttaataaagtatgaattggaaa

SEQ ID NO: 9239349 - DNA, 22 bp, Homo sapiens
ttaataacattgtgtatcaccc

SEQ ID NO: 9239350 - DNA, 22 bp, Homo sapiens
ttaatgtcaacatttctgaaga

SEQ ID NO: 9239351 - DNA, 23 bp, Homo sapiens
ttaaacttcagtgcagaacactc

SEQ ID NO: 9239352 - DNA, 22 bp, Homo sapiens
ttaaagaggcaggttaaataat

SEQ ID NO: 9239353 - DNA, 22 bp, Homo sapiens
ttaaagagggaaagacttcaga

SEQ ID NO: 9239354 - DNA, 22 bp, Homo sapiens
ttaaagcaaaaactaggatgga

SEQ ID NO: 9239355 - DNA, 22 bp, Homo sapiens
ttaaagcaaaaactaggatgga

SEQ ID NO: 9239356 - DNA, 22 bp, Homo sapiens
ttaaagatgcagctttagagaa

SEQ ID NO: 9239357 - DNA, 22 bp, Homo sapiens
ttaaagcaaccatcaatttgga

SEQ ID NO: 9239358 - DNA, 22 bp, Homo sapiens
ttaaagcaagtagaagcctgag

SEQ ID NO: 9239359 - DNA, 22 bp, Homo sapiens
ttaaagcaacctcagccctctt

SEQ ID NO: 9239360 - DNA, 22 bp, Homo sapiens
ttaaagcagtttgtatacatgg

SEQ ID NO: 9239361 - DNA, 22 bp, Homo sapiens
ttaataaagtatgaattggaaa

SEQ ID NO: 9239362 - DNA, 22 bp, Homo sapiens
ttaataaagtatgaattggaaa

SEQ ID NO: 9239363 - DNA, 22 bp, Homo sapiens
ttaataaagtatgaattggaaa

SEQ ID NO: 9239364 - DNA, 22 bp, Homo sapiens
ttaaagcaggcatcattcctca

SEQ ID NO: 9239365 - DNA, 22 bp, Homo sapiens
ttaaagcactaaatgatgaggg

SEQ ID NO: 9239366 - DNA, 22 bp, Homo sapiens
ttaaagcacctccttggatgtg

SEQ ID NO: 9239367 - DNA, 22 bp, Homo sapiens
ttagaaaggttttgctctgaaa

SEQ ID NO: 9239368 - DNA, 22 bp, Homo sapiens
ttagaaaggagcttatttcttt

SEQ ID NO: 9239369 - DNA, 22 bp, Homo sapiens
ttacattttgcacagatgtccc

SEQ ID NO: 9239370 - DNA, 22 bp, Homo sapiens
ttagaacaaagccaccaggtga

SEQ ID NO: 9239371 - DNA, 22 bp, Homo sapiens
ttagaaatgtcacagatctgat

SEQ ID NO: 9239372 - DNA, 22 bp, Homo sapiens
ttagaaatgtcacagatctgat

SEQ ID NO: 9239373 - DNA, 22 bp, Homo sapiens
ttagaaatacaagtgaggttga

SEQ ID NO: 9239374 - DNA, 22 bp, Homo sapiens
ttagaaatcacctctgaagatc

SEQ ID NO: 9239375 - DNA, 22 bp, Homo sapiens
ttagaacaccattctatattac

SEQ ID NO: 9239376 - DNA, 22 bp, Homo sapiens
ttagaacatctgtgtctttatg

SEQ ID NO: 9239377 - DNA, 22 bp, Homo sapiens
ttagaacatttttagaccaata

SEQ ID NO: 9239378 - DNA, 22 bp, Homo sapiens
ttagataacagtagaatatcaa

SEQ ID NO: 9239379 - DNA, 22 bp, Homo sapiens
ttagataatgttattgtaattt

SEQ ID NO: 9239380 - DNA, 22 bp, Homo sapiens
ttagatacgcaggcagttttaa

SEQ ID NO: 9239381 - DNA, 22 bp, Homo sapiens
ttagatacattctcatttgttt

SEQ ID NO: 9239382 - DNA, 22 bp, Homo sapiens
ttagataggactcatagattgg

SEQ ID NO: 9239383 - DNA, 22 bp, Homo sapiens
ttagtaattagaaagtaattct

SEQ ID NO: 9239384 - DNA, 22 bp, Homo sapiens
ttagtaatgtgttaatatgaat

SEQ ID NO: 9239385 - DNA, 22 bp, Homo sapiens
ttagggttacaccagcctcctg

SEQ ID NO: 9239386 - DNA, 22 bp, Homo sapiens
ttaggtaaggatggtgacagta

SEQ ID NO: 9239387 - DNA, 22 bp, Homo sapiens
ttaggaacttctgtctcagtgt

SEQ ID NO: 9239388 - DNA, 22 bp, Homo sapiens
ttagggaagtgttattctcagg

SEQ ID NO: 9239389 - DNA, 22 bp, Homo sapiens
ttagggagctcagtcctcagat

SEQ ID NO: 9239390 - DNA, 22 bp, Homo sapiens
ttagggagctcagtcctcagat

SEQ ID NO: 9239391 - DNA, 22 bp, Homo sapiens
ttagggcttttctgaataggcc

SEQ ID NO: 9239392 - DNA, 19 bp, Homo sapiens
ttaggggtatgaagtggta

SEQ ID NO: 9239393 - DNA, 22 bp, Homo sapiens
ttagggaagtgttattctcagg

SEQ ID NO: 9239394 - DNA, 22 bp, Homo sapiens
ttagggaaatatttatatactt

SEQ ID NO: 9239395 - DNA, 22 bp, Homo sapiens
ttagcatttctggaatcacaag

SEQ ID NO: 9239396 - DNA, 22 bp, Homo sapiens
ttagcatttctggaatcacaag

SEQ ID NO: 9239397 - DNA, 22 bp, Homo sapiens
ttagcattttctgggctgaaat

SEQ ID NO: 9239398 - DNA, 22 bp, Homo sapiens
ttagcatttcatttcaagagga

SEQ ID NO: 9239399 - DNA, 22 bp, Homo sapiens
ttagcatttcagtacacatgtt

SEQ ID NO: 9239400 - DNA, 22 bp, Homo sapiens
ttagcattgtacatttgtgctt

SEQ ID NO: 9239401 - DNA, 22 bp, Homo sapiens
ttagcatttcagtacacatgtt

SEQ ID NO: 9239402 - DNA, 22 bp, Homo sapiens
ttagcaggaagagttggctgga

SEQ ID NO: 9239403 - DNA, 22 bp, Homo sapiens
ttagcattctctgtgtgcataa

SEQ ID NO: 9239404 - DNA, 22 bp, Homo sapiens
ttagcattctgcctcctatatc

SEQ ID NO: 9239405 - DNA, 22 bp, Homo sapiens
ttagcattcttctggggggcac

SEQ ID NO: 9239406 - DNA, 22 bp, Homo sapiens
ttagcattctcatttgcataaa

SEQ ID NO: 9239407 - DNA, 22 bp, Homo sapiens
ttagcattctcatttgcataaa

SEQ ID NO: 9239408 - DNA, 22 bp, Homo sapiens
ttagcatctgctgtaagcttat

SEQ ID NO: 9239409 - DNA, 22 bp, Homo sapiens
ttagcactttgattcatgcaga

SEQ ID NO: 9239410 - DNA, 22 bp, Homo sapiens
ttagatttatatgtgagaatgg

SEQ ID NO: 9239411 - DNA, 22 bp, Homo sapiens
ttagatttatatgtgagaatgg

SEQ ID NO: 9239412 - DNA, 22 bp, Homo sapiens
ttagatttacaagcactgttta

SEQ ID NO: 9239413 - DNA, 22 bp, Homo sapiens
ttagcaaaaatatctcatatta

SEQ ID NO: 9239414 - DNA, 22 bp, Homo sapiens
ttagcaaacccttgctggtgag

SEQ ID NO: 9239415 - DNA, 22 bp, Homo sapiens
ttattcatcagtgcattaattt

SEQ ID NO: 9239416 - DNA, 22 bp, Homo sapiens
ttattcatcagtgcattaattt

SEQ ID NO: 9239417 - DNA, 22 bp, Homo sapiens
ttatttcattgatttctaagac

SEQ ID NO: 9239418 - DNA, 22 bp, Homo sapiens
ttatttccacaatgtggtaggg

SEQ ID NO: 9239419 - DNA, 22 bp, Homo sapiens
ttatttccaaactggatatacc

SEQ ID NO: 9239420 - DNA, 22 bp, Homo sapiens
ttatttccagtccagaaattta

SEQ ID NO: 9239421 - DNA, 20 bp, Homo sapiens
ttatttccagtccaggtcct

SEQ ID NO: 9239422 - DNA, 22 bp, Homo sapiens
ttatttccctgagggttgcagg

SEQ ID NO: 9239423 - DNA, 22 bp, Homo sapiens
ttatttcctaaatctctttgtt

SEQ ID NO: 9239424 - DNA, 22 bp, Homo sapiens
ttattcttggatctgagtctct

SEQ ID NO: 9239425 - DNA, 22 bp, Homo sapiens
ttattcttggatctgagtctct

SEQ ID NO: 9239426 - DNA, 22 bp, Homo sapiens
ttatttatgttaacagtcgaga

SEQ ID NO: 9239427 - DNA, 22 bp, Homo sapiens
ttatttatggccctcacctgat

SEQ ID NO: 9239428 - DNA, 22 bp, Homo sapiens
ttattctgtcaaacttatacat

SEQ ID NO: 9239429 - DNA, 22 bp, Homo sapiens
ttagtgataggactttaaagcc

SEQ ID NO: 9239430 - DNA, 22 bp, Homo sapiens
ttagtattaggatcatatttga

SEQ ID NO: 9239431 - DNA, 22 bp, Homo sapiens
ttagtctctttgcattgccata

SEQ ID NO: 9239432 - DNA, 22 bp, Homo sapiens
ttagtcttcttccttatatgtt

SEQ ID NO: 9239433 - DNA, 22 bp, Homo sapiens
ttagtgaaaagaaaatgagtgg

SEQ ID NO: 9239434 - DNA, 22 bp, Homo sapiens
ttagtcacatgcccatctctga

SEQ ID NO: 9239435 - DNA, 22 bp, Homo sapiens
ttagtcacttcttccttcatca

SEQ ID NO: 9239436 - DNA, 20 bp, Homo sapiens
ttatctgtcaatctgtctca

SEQ ID NO: 9239437 - DNA, 22 bp, Homo sapiens
ttatcttagaggtgattgtatt

SEQ ID NO: 9239438 - DNA, 22 bp, Homo sapiens
ttatatgtttctgtttggaggc

SEQ ID NO: 9239439 - DNA, 22 bp, Homo sapiens
ttatctgaaaacctcaaaatat

SEQ ID NO: 9239440 - DNA, 18 bp, Homo sapiens
ttatctctggcatgtgcc

SEQ ID NO: 9239441 - DNA, 22 bp, Homo sapiens
ttatctgaaacttttgggacca

SEQ ID NO: 9239442 - DNA, 22 bp, Homo sapiens
ttatgatttgccacagattggt

SEQ ID NO: 9239443 - DNA, 22 bp, Homo sapiens
ttatgatttagaaagattcact

SEQ ID NO: 9239444 - DNA, 22 bp, Homo sapiens
ttatgatttgccacagattggt

SEQ ID NO: 9239445 - DNA, 22 bp, Homo sapiens
ttatgacaggaaaatcacagaa

SEQ ID NO: 9239446 - DNA, 22 bp, Homo sapiens
ttatgagactgttttacacact

SEQ ID NO: 9239447 - DNA, 22 bp, Homo sapiens
ttatgatttagaaagattcact

SEQ ID NO: 9239448 - DNA, 22 bp, Homo sapiens
ttatgagctaagttgtggcccc

SEQ ID NO: 9239449 - DNA, 22 bp, Homo sapiens
ttatgcaaagaaatagactaat

SEQ ID NO: 9239450 - DNA, 22 bp, Homo sapiens
ttatgatttgccacagattggt

SEQ ID NO: 9239451 - DNA, 22 bp, Homo sapiens
ttatgatttgccacagattggt

SEQ ID NO: 9239452 - DNA, 22 bp, Homo sapiens
ttatgacagaaatgaaaagctg

SEQ ID NO: 9239453 - DNA, 22 bp, Homo sapiens
ttatgaagttcctgttacagtg

SEQ ID NO: 9239454 - DNA, 19 bp, Homo sapiens
ttatgaatagcttcatcca

SEQ ID NO: 9239455 - DNA, 22 bp, Homo sapiens
ttatgaaagacatttctgttgg

SEQ ID NO: 9239456 - DNA, 22 bp, Homo sapiens
ttatgaaagacatttctgttgg

SEQ ID NO: 9239457 - DNA, 22 bp, Homo sapiens
ttatgaaaacaatcagtaggca

SEQ ID NO: 9239458 - DNA, 22 bp, Homo sapiens
ttatcttggtgttttagtaatt

SEQ ID NO: 9239459 - DNA, 22 bp, Homo sapiens
ttatcttgagtattgagattct

SEQ ID NO: 9239460 - DNA, 22 bp, Homo sapiens
tgttgactcaacactgtgggca

SEQ ID NO: 9239461 - DNA, 22 bp, Homo sapiens
tgttgagtatatacctacaagt

SEQ ID NO: 9239462 - DNA, 22 bp, Homo sapiens
tgttcttttctctaaactgata

SEQ ID NO: 9239463 - DNA, 18 bp, Homo sapiens
tgttgaaacttcaggtaa

SEQ ID NO: 9239464 - DNA, 22 bp, Homo sapiens
tgtttatgcatcgttaatacca

SEQ ID NO: 9239465 - DNA, 22 bp, Homo sapiens
tgtttatagggtctgtcacttg

SEQ ID NO: 9239466 - DNA, 22 bp, Homo sapiens
tgtttattcatggctaatgaaa

SEQ ID NO: 9239467 - DNA, 22 bp, Homo sapiens
tgtttattacagttcttggaat

SEQ ID NO: 9239468 - DNA, 22 bp, Homo sapiens
tgtttatgtgtgtgcatatata

SEQ ID NO: 9239469 - DNA, 22 bp, Homo sapiens
tgtttattgctgcaattgtgcc

SEQ ID NO: 9239470 - DNA, 22 bp, Homo sapiens
tgtttattttcaggatggattg

SEQ ID NO: 9239471 - DNA, 22 bp, Homo sapiens
tgtttattgcagtgctgggctg

SEQ ID NO: 9239472 - DNA, 22 bp, Homo sapiens
tgtttattgagtgcctactata

SEQ ID NO: 9239473 - DNA, 22 bp, Homo sapiens
tgtttattgagtgcctactata

SEQ ID NO: 9239474 - DNA, 18 bp, Homo sapiens
tgtttattctcctgacag

SEQ ID NO: 9239475 - DNA, 18 bp, Homo sapiens
tgtttattctcctgacag

SEQ ID NO: 9239476 - DNA, 18 bp, Homo sapiens
tgtttattctcctgacag

SEQ ID NO: 9239477 - DNA, 17 bp, Homo sapiens
tgttctgttggaaagca

SEQ ID NO: 9239478 - DNA, 22 bp, Homo sapiens
tgttcttacggaacttatcttt

SEQ ID NO: 9239479 - DNA, 22 bp, Homo sapiens
tgttaggactccccagaagctg

SEQ ID NO: 9239480 - DNA, 22 bp, Homo sapiens
tgttagctgtgctttagccttc

SEQ ID NO: 9239481 - DNA, 22 bp, Homo sapiens
tgttagatattcattaatagga

SEQ ID NO: 9239482 - DNA, 22 bp, Homo sapiens
tgttagattcctgatgaattta

SEQ ID NO: 9239483 - DNA, 22 bp, Homo sapiens
tgttctttcagttagacacagt

SEQ ID NO: 9239484 - DNA, 22 bp, Homo sapiens
tgttcttgggaatcttacagtt

SEQ ID NO: 9239485 - DNA, 22 bp, Homo sapiens
tgttcttgggaatcttacagtt

SEQ ID NO: 9239486 - DNA, 22 bp, Homo sapiens
tgttcttgagcctttagaccta

SEQ ID NO: 9239487 - DNA, 22 bp, Homo sapiens
tgttcttgagcctttagaccta

SEQ ID NO: 9239488 - DNA, 22 bp, Homo sapiens
tgttctttggcttcacagctct

SEQ ID NO: 9239489 - DNA, 22 bp, Homo sapiens
tgttacttatctcacgtgatgc

SEQ ID NO: 9239490 - DNA, 22 bp, Homo sapiens
tgttagaagactcttttaccta

SEQ ID NO: 9239491 - DNA, 22 bp, Homo sapiens
tgttactgatttgatatacagt

SEQ ID NO: 9239492 - DNA, 22 bp, Homo sapiens
tgttactgatttgatatacagt

SEQ ID NO: 9239493 - DNA, 22 bp, Homo sapiens
tgttaacttgcaagctgaagaa

SEQ ID NO: 9239494 - DNA, 22 bp, Homo sapiens
tgttaagagagtttctaatatt

SEQ ID NO: 9239495 - DNA, 22 bp, Homo sapiens
tgttaagagaagctctctctga

SEQ ID NO: 9239496 - DNA, 22 bp, Homo sapiens
tgttaaggagacacatgaaaaa

SEQ ID NO: 9239497 - DNA, 22 bp, Homo sapiens
tgttacattggagttgtttaga

SEQ ID NO: 9239498 - DNA, 22 bp, Homo sapiens
tgttacatttctctttcttgga

SEQ ID NO: 9239499 - DNA, 18 bp, Homo sapiens
tgttaaatgaagatttgc

SEQ ID NO: 9239500 - DNA, 22 bp, Homo sapiens
tgttaaatgttcctttactgga

SEQ ID NO: 9239501 - DNA, 22 bp, Homo sapiens
tgttaacagccagatttggtga

SEQ ID NO: 9239502 - DNA, 22 bp, Homo sapiens
tgttttaatctcccattgctct

SEQ ID NO: 9239503 - DNA, 22 bp, Homo sapiens
tgttttaagggtcaactgtcac

SEQ ID NO: 9239504 - DNA, 22 bp, Homo sapiens
tgttttaagggtcaactgtcac

SEQ ID NO: 9239505 - DNA, 22 bp, Homo sapiens
tgttttaatctcccattgctct

SEQ ID NO: 9239506 - DNA, 22 bp, Homo sapiens
tgttttaatctcccattgctct

SEQ ID NO: 9239507 - DNA, 22 bp, Homo sapiens
tgttttaagagcgcactttata

SEQ ID NO: 9239508 - DNA, 22 bp, Homo sapiens
tgttttaagagcgcactttata

SEQ ID NO: 9239509 - DNA, 22 bp, Homo sapiens
tgttttaagctctagaagggga

SEQ ID NO: 9239510 - DNA, 22 bp, Homo sapiens
tgttttaaagccattgcctttc

SEQ ID NO: 9239511 - DNA, 22 bp, Homo sapiens
tgttttatcaagatggcatgtc

SEQ ID NO: 9239512 - DNA, 22 bp, Homo sapiens
tgttttatataagcagagcggt

SEQ ID NO: 9239513 - DNA, 22 bp, Homo sapiens
tgttttatgagccatataacct

SEQ ID NO: 9239514 - DNA, 22 bp, Homo sapiens
tgttttatgagccatataacct

SEQ ID NO: 9239515 - DNA, 22 bp, Homo sapiens
tgtttttgtctccttgtctgct

SEQ ID NO: 9239516 - DNA, 22 bp, Homo sapiens
tgtttttccatgtgcagaacaa

SEQ ID NO: 9239517 - DNA, 22 bp, Homo sapiens
tgttttcaagtcaaggccaaat

SEQ ID NO: 9239518 - DNA, 22 bp, Homo sapiens
tgttttatttctccaagaggga

SEQ ID NO: 9239519 - DNA, 22 bp, Homo sapiens
tgttttatttctccaagaggga

SEQ ID NO: 9239520 - DNA, 22 bp, Homo sapiens
tgttttatgagccatataacct

SEQ ID NO: 9239521 - DNA, 22 bp, Homo sapiens
tgtttgtggaatattctttaag

SEQ ID NO: 9239522 - DNA, 22 bp, Homo sapiens
tgtttgtgctgcctggtgggca

SEQ ID NO: 9239523 - DNA, 22 bp, Homo sapiens
tgtttgcttacttgtatgctgc

SEQ ID NO: 9239524 - DNA, 22 bp, Homo sapiens
tgtttgcttggtcagtaagtag

SEQ ID NO: 9239525 - DNA, 22 bp, Homo sapiens
tgtttgctctgactatcttgcg

SEQ ID NO: 9239526 - DNA, 22 bp, Homo sapiens
tgtttgctctgactatcttgcg

SEQ ID NO: 9239527 - DNA, 22 bp, Homo sapiens
tgtttgctatatcctacttcat

SEQ ID NO: 9239528 - DNA, 22 bp, Homo sapiens
tgtttgcacattcgtttcaata

SEQ ID NO: 9239529 - DNA, 22 bp, Homo sapiens
tgtttcaaaggttatacagtca

SEQ ID NO: 9239530 - DNA, 22 bp, Homo sapiens
tgtttcaaaataacaagagggt

SEQ ID NO: 9239531 - DNA, 18 bp, Homo sapiens
tgtttatttttctcttac

SEQ ID NO: 9239532 - DNA, 18 bp, Homo sapiens
tgtttatttttctcttac

SEQ ID NO: 9239533 - DNA, 18 bp, Homo sapiens
tgtttatttttctcttac

SEQ ID NO: 9239534 - DNA, 22 bp, Homo sapiens
ttaaaatgcagattatgactca

SEQ ID NO: 9239535 - DNA, 22 bp, Homo sapiens
ttaaaatgcagattatgactca

SEQ ID NO: 9239536 - DNA, 22 bp, Homo sapiens
ttaaaatgcagattctgattca

SEQ ID NO: 9239537 - DNA, 22 bp, Homo sapiens
ttaaaagaatcctgttatcctc

SEQ ID NO: 9239538 - DNA, 22 bp, Homo sapiens
ttaaaaccatcagctgtaagat

SEQ ID NO: 9239539 - DNA, 22 bp, Homo sapiens
ttaaaacagcgtgaatctggca

SEQ ID NO: 9239540 - DNA, 22 bp, Homo sapiens
ttaaaaatatgtagggcccgat

SEQ ID NO: 9239541 - DNA, 22 bp, Homo sapiens
ttaaaaatatgtagggcccgat

SEQ ID NO: 9239542 - DNA, 22 bp, Homo sapiens
tgtttttttatatacctgaagt

SEQ ID NO: 9239543 - DNA, 17 bp, Homo sapiens
tgttttttccctgttct

SEQ ID NO: 9239544 - DNA, 17 bp, Homo sapiens
tgttttttccctgttct

SEQ ID NO: 9239545 - DNA, 22 bp, Homo sapiens
ttaaacacctgtctagtgtagc

SEQ ID NO: 9239546 - DNA, 22 bp, Homo sapiens
ttaaacacactgagatttatgt

SEQ ID NO: 9239547 - DNA, 22 bp, Homo sapiens
ttaaaatttccccaccatgtat

SEQ ID NO: 9239548 - DNA, 22 bp, Homo sapiens
ttaaaatttccccaccatgtat

SEQ ID NO: 9239549 - DNA, 22 bp, Homo sapiens
ttaaaatttccccaccatgtat

SEQ ID NO: 9239550 - DNA, 22 bp, Homo sapiens
ttaaaattatggcccatttgga

SEQ ID NO: 9239551 - DNA, 22 bp, Homo sapiens
ttaaaattatggcccatttgga

SEQ ID NO: 9239552 - DNA, 22 bp, Homo sapiens
ttaaaatttccccaccatgtat

SEQ ID NO: 9239553 - DNA, 23 bp, Homo sapiens
ttaaaatgtggtctctccctagt

SEQ ID NO: 9239554 - DNA, 22 bp, Homo sapiens
ttaaaatgtacaggggaaagtg

SEQ ID NO: 9239555 - DNA, 22 bp, Homo sapiens
ttaaacatttttgatgatcgat

SEQ ID NO: 9239556 - DNA, 22 bp, Homo sapiens
ttaaaccatagtttaacataag

SEQ ID NO: 9239557 - DNA, 22 bp, Homo sapiens
ttaaaccatagtttaacataag

SEQ ID NO: 9239558 - DNA, 22 bp, Homo sapiens
ttaaaccatagtttaacataag

SEQ ID NO: 9239559 - DNA, 22 bp, Homo sapiens
tgtgtgtgaaccattgagggct

SEQ ID NO: 9239560 - DNA, 22 bp, Homo sapiens
tgtgtgtgaaccattgagggct

SEQ ID NO: 9239561 - DNA, 22 bp, Homo sapiens
tgtgtgtgcacatgcatataca

SEQ ID NO: 9239562 - DNA, 22 bp, Homo sapiens
tgtgtgtgagtcctggctttcc

SEQ ID NO: 9239563 - DNA, 22 bp, Homo sapiens
tgtgtgtgactcatactagaac

SEQ ID NO: 9239564 - DNA, 22 bp, Homo sapiens
tgtgtgggagcacgggctgttg

SEQ ID NO: 9239565 - DNA, 22 bp, Homo sapiens
tgtgtgggagcacgggctgttg

SEQ ID NO: 9239566 - DNA, 22 bp, Homo sapiens
tgtgtggattcatctcaaagag

SEQ ID NO: 9239567 - DNA, 20 bp, Homo sapiens
tgtgtgctaggactacagtg

SEQ ID NO: 9239568 - DNA, 22 bp, Homo sapiens
tgtgtgctctaatgcctagtac

SEQ ID NO: 9239569 - DNA, 19 bp, Homo sapiens
tgtgtgctgactgccagag

SEQ ID NO: 9239570 - DNA, 20 bp, Homo sapiens
tgtgtgctaggactacagtg

SEQ ID NO: 9239571 - DNA, 22 bp, Homo sapiens
tgtgtggattcatctcaaagag

SEQ ID NO: 9239572 - DNA, 22 bp, Homo sapiens
tgtgtgccagcctacgaggagc

SEQ ID NO: 9239573 - DNA, 22 bp, Homo sapiens
tgtgtgccagatacaagcactg

SEQ ID NO: 9239574 - DNA, 22 bp, Homo sapiens
tgtgtgccagcctacgaggagc

SEQ ID NO: 9239575 - DNA, 22 bp, Homo sapiens
tgtgtgccagggcatgcacagg

SEQ ID NO: 9239576 - DNA, 22 bp, Homo sapiens
tgtgtgcctgagccgtgcctgg

SEQ ID NO: 9239577 - DNA, 22 bp, Homo sapiens
tgtgtgctaatgtatgctctaa

SEQ ID NO: 9239578 - DNA, 21 bp, Homo sapiens
tgtgtcactaactagaggcta

SEQ ID NO: 9239579 - DNA, 21 bp, Homo sapiens
tgtgtcactaactagaggcta

SEQ ID NO: 9239580 - DNA, 19 bp, Homo sapiens
tgtgtgtttatatatgtat

SEQ ID NO: 9239581 - DNA, 22 bp, Homo sapiens
tgttaaaaatgcagattcctat

SEQ ID NO: 9239582 - DNA, 22 bp, Homo sapiens
tgttaaaaattcagctctagat

SEQ ID NO: 9239583 - DNA, 18 bp, Homo sapiens
tgttaaatgaagatttgc

SEQ ID NO: 9239584 - DNA, 22 bp, Homo sapiens
tgttaaacctagtacaggtcct

SEQ ID NO: 9239585 - DNA, 22 bp, Homo sapiens
tgttaaacagctgtcttcttca

SEQ ID NO: 9239586 - DNA, 22 bp, Homo sapiens
tgttaaaaccacaggtgaggac

SEQ ID NO: 9239587 - DNA, 22 bp, Homo sapiens
tgtgtgtgtttataaatctaaa

SEQ ID NO: 9239588 - DNA, 22 bp, Homo sapiens
tgtgtgtgtttacagtttctca

SEQ ID NO: 9239589 - DNA, 22 bp, Homo sapiens
tgtgtgtgtttacagtttctca

SEQ ID NO: 9239590 - DNA, 22 bp, Homo sapiens
tgtgtgtgtttctgctcataca

SEQ ID NO: 9239591 - DNA, 22 bp, Homo sapiens
tgtgtgttatcttagttcatct

SEQ ID NO: 9239592 - DNA, 22 bp, Homo sapiens
tgtgtgtgcacgtgcgcgcgag

SEQ ID NO: 9239593 - DNA, 22 bp, Homo sapiens
tgtgtgtgcaggagagcaggtg

SEQ ID NO: 9239594 - DNA, 22 bp, Homo sapiens
tgtgtgtgcaggagagcaggtg

SEQ ID NO: 9239595 - DNA, 22 bp, Homo sapiens
tgtgtgtggggaggcagcagat

SEQ ID NO: 9239596 - DNA, 22 bp, Homo sapiens
tgtgtgtgtgcgcgcacgcata

SEQ ID NO: 9239597 - DNA, 22 bp, Homo sapiens
tgtgtgtgtcctcatttgcaga

SEQ ID NO: 9239598 - DNA, 22 bp, Homo sapiens
tgtgtgtgtcctcatttgcaga

SEQ ID NO: 9239599 - DNA, 20 bp, Homo sapiens
tgtgtgtgtacttctaaata

SEQ ID NO: 9239600 - DNA, 22 bp, Homo sapiens
tgtgtgtgtaaaagcatttata

SEQ ID NO: 9239601 - DNA, 23 bp, Homo sapiens
tgtgtgtgtattctacgcaaggt

SEQ ID NO: 9239602 - DNA, 22 bp, Homo sapiens
tgtggaatgggagtgagaagac

SEQ ID NO: 9239603 - DNA, 22 bp, Homo sapiens
tgtggaagggacactggactgg

SEQ ID NO: 9239604 - DNA, 22 bp, Homo sapiens
tgtggaagaaacaagacacttt

SEQ ID NO: 9239605 - DNA, 22 bp, Homo sapiens
tgtggaagaacttcttgcttgg

SEQ ID NO: 9239606 - DNA, 22 bp, Homo sapiens
tgtggaagaacttcttgcttgg

SEQ ID NO: 9239607 - DNA, 22 bp, Homo sapiens
tgtggctgactcctggtcccca

SEQ ID NO: 9239608 - DNA, 22 bp, Homo sapiens
tgtggctccactccacattaat

SEQ ID NO: 9239609 - DNA, 22 bp, Homo sapiens
tgtgggagaaggaagcaagctg

SEQ ID NO: 9239610 - DNA, 22 bp, Homo sapiens
tgtgggagaaggaagcaagctg

SEQ ID NO: 9239611 - DNA, 22 bp, Homo sapiens
tgtgggaggaacacagccagaa

SEQ ID NO: 9239612 - DNA, 23 bp, Homo sapiens
tgtgggaatgttggagaggaaac

SEQ ID NO: 9239613 - DNA, 22 bp, Homo sapiens
tgtgggaatcagccaggggggc

SEQ ID NO: 9239614 - DNA, 22 bp, Homo sapiens
tgtgggaatgacgaggaagagg

SEQ ID NO: 9239615 - DNA, 22 bp, Homo sapiens
tgtgggaagatgttgcaggaga

SEQ ID NO: 9239616 - DNA, 22 bp, Homo sapiens
tgtgggaaatgggagtggaaga

SEQ ID NO: 9239617 - DNA, 22 bp, Homo sapiens
tgtgggaagagcagtggcagca

SEQ ID NO: 9239618 - DNA, 22 bp, Homo sapiens
tgtggctgcaggcgatggagga

SEQ ID NO: 9239619 - DNA, 22 bp, Homo sapiens
tgtgtacatatctatcctagat

SEQ ID NO: 9239620 - DNA, 22 bp, Homo sapiens
tgtgtacatatacacaaataca

SEQ ID NO: 9239621 - DNA, 22 bp, Homo sapiens
tgtgtacatctcttctcacatt

SEQ ID NO: 9239622 - DNA, 22 bp, Homo sapiens
tgtgtacacagatagtaatggc

SEQ ID NO: 9239623 - DNA, 22 bp, Homo sapiens
tgtgtacacacagatatataca

SEQ ID NO: 9239624 - DNA, 22 bp, Homo sapiens
tgtgtacaggacagaaaggagg

SEQ ID NO: 9239625 - DNA, 22 bp, Homo sapiens
tgtgtacaggccttgctagact

SEQ ID NO: 9239626 - DNA, 22 bp, Homo sapiens
tgtggggacctggctgccaccc

SEQ ID NO: 9239627 - DNA, 22 bp, Homo sapiens
tgtggggacccatgccatgggc

SEQ ID NO: 9239628 - DNA, 22 bp, Homo sapiens
tgtggggactgagtggaggctt

SEQ ID NO: 9239629 - DNA, 22 bp, Homo sapiens
tgtgtacacaagtatatataca

SEQ ID NO: 9239630 - DNA, 23 bp, Homo sapiens
tgtgtacacaatagatgaggttt

SEQ ID NO: 9239631 - DNA, 23 bp, Homo sapiens
tgtgtacacaatagatgaggttt

SEQ ID NO: 9239632 - DNA, 22 bp, Homo sapiens
tgtgggcctcagcaggactcca

SEQ ID NO: 9239633 - DNA, 22 bp, Homo sapiens
tgtgggcaggcccgggtctgag

SEQ ID NO: 9239634 - DNA, 23 bp, Homo sapiens
tgtgggcgcattgtaagggtagc

SEQ ID NO: 9239635 - DNA, 22 bp, Homo sapiens
tgtgggctccccctcactctgt

SEQ ID NO: 9239636 - DNA, 22 bp, Homo sapiens
tgtgggctctaatggcagcaga

SEQ ID NO: 9239637 - DNA, 22 bp, Homo sapiens
tgtgggaggattcagaattggg

SEQ ID NO: 9239638 - DNA, 22 bp, Homo sapiens
tgtgggaggattcagaattggg

SEQ ID NO: 9239639 - DNA, 22 bp, Homo sapiens
tgtgggaggattcagaattggg

SEQ ID NO: 9239640 - DNA, 22 bp, Homo sapiens
tgtgggaggaattagaatggga

SEQ ID NO: 9239641 - DNA, 22 bp, Homo sapiens
tgtgggaggaattagaatggga

SEQ ID NO: 9239642 - DNA, 22 bp, Homo sapiens
tgtgggaggaattagaatggga

SEQ ID NO: 9239643 - DNA, 22 bp, Homo sapiens
tgtgggcaaagggtagctgggt

SEQ ID NO: 9239644 - DNA, 22 bp, Homo sapiens
tgtgggaggtctggaaggctcc

SEQ ID NO: 9239645 - DNA, 19 bp, Homo sapiens
tgtgggcaagggatggcag

SEQ ID NO: 9239646 - DNA, 22 bp, Homo sapiens
tgtgggcactaatgacatgcag

SEQ ID NO: 9239647 - DNA, 19 bp, Homo sapiens
tgtgggcaagggatggcag

SEQ ID NO: 9239648 - DNA, 22 bp, Homo sapiens
tgtctcctatttcctgctaagg

SEQ ID NO: 9239649 - DNA, 22 bp, Homo sapiens
tgtctcctatttcctgctaagg

SEQ ID NO: 9239650 - DNA, 22 bp, Homo sapiens
tgtctcctcaactcatgctcga

SEQ ID NO: 9239651 - DNA, 22 bp, Homo sapiens
tgtctcctcaactcatgctcga

SEQ ID NO: 9239652 - DNA, 22 bp, Homo sapiens
tgtctcctcaactcatgctcga

SEQ ID NO: 9239653 - DNA, 22 bp, Homo sapiens
tgtctcctcatactgtcatatt

SEQ ID NO: 9239654 - DNA, 19 bp, Homo sapiens
tgtctcctcatgcaagtgt

SEQ ID NO: 9239655 - DNA, 19 bp, Homo sapiens
tgtctcctccccgccgtct

SEQ ID NO: 9239656 - DNA, 22 bp, Homo sapiens
tgtctcctcggctgtccagcca

SEQ ID NO: 9239657 - DNA, 22 bp, Homo sapiens
tgtctccatgtgatagtggcct

SEQ ID NO: 9239658 - DNA, 22 bp, Homo sapiens
tgtctcctaatgtctgtttcct

SEQ ID NO: 9239659 - DNA, 22 bp, Homo sapiens
tgtctcctactgcctgtggatc

SEQ ID NO: 9239660 - DNA, 22 bp, Homo sapiens
tgtctcctactgcctgtggatc

SEQ ID NO: 9239661 - DNA, 22 bp, Homo sapiens
tgtctcctgggtcccttccacc

SEQ ID NO: 9239662 - DNA, 22 bp, Homo sapiens
tgtctcctgggtcccttccacc

SEQ ID NO: 9239663 - DNA, 21 bp, Homo sapiens
tgtctcctgttggcacatggc

SEQ ID NO: 9239664 - DNA, 22 bp, Homo sapiens
tgtctcctctgtcctgtcagga

SEQ ID NO: 9239665 - DNA, 22 bp, Homo sapiens
tgtctcctctgtcctgtcagga

SEQ ID NO: 9239666 - DNA, 22 bp, Homo sapiens
tgtctcctgagagctggacaga

SEQ ID NO: 9239667 - DNA, 22 bp, Homo sapiens
tgtctcctgggccctggccctg

SEQ ID NO: 9239668 - DNA, 22 bp, Homo sapiens
tgtctcctgggccctggccctg

SEQ ID NO: 9239669 - DNA, 22 bp, Homo sapiens
tgtctcctgagagctggacaga

SEQ ID NO: 9239670 - DNA, 22 bp, Homo sapiens
tgtctcctgcaggggtgtgggc

SEQ ID NO: 9239671 - DNA, 21 bp, Homo sapiens
tgtctcctgttggcacatggc

SEQ ID NO: 9239672 - DNA, 22 bp, Homo sapiens
tgtctccttgcttttccctgta

SEQ ID NO: 9239673 - DNA, 22 bp, Homo sapiens
tgtctccttgcttttccctgta

SEQ ID NO: 9239674 - DNA, 22 bp, Homo sapiens
tgtctacaaacgtgtacacatt

SEQ ID NO: 9239675 - DNA, 22 bp, Homo sapiens
tgtctacttgggctctacagca

SEQ ID NO: 9239676 - DNA, 22 bp, Homo sapiens
tgtctactgctgacactaacag

SEQ ID NO: 9239677 - DNA, 22 bp, Homo sapiens
tgtctactcctgtgctagctcc

SEQ ID NO: 9239678 - DNA, 20 bp, Homo sapiens
tgtctccagggctgagtgga

SEQ ID NO: 9239679 - DNA, 22 bp, Homo sapiens
tgtctccacaggtgtcagctca

SEQ ID NO: 9239680 - DNA, 22 bp, Homo sapiens
tgtctccaggggcaggccagcc

SEQ ID NO: 9239681 - DNA, 22 bp, Homo sapiens
tgtctccatagaagagactgca

SEQ ID NO: 9239682 - DNA, 22 bp, Homo sapiens
tgtctccatagagtagcttgat

SEQ ID NO: 9239683 - DNA, 22 bp, Homo sapiens
tgtctatagaatcatgcagttt

SEQ ID NO: 9239684 - DNA, 22 bp, Homo sapiens
tgtctccaaaacaatctcagat

SEQ ID NO: 9239685 - DNA, 23 bp, Homo sapiens
tgtctatgagaagttcaggctag

SEQ ID NO: 9239686 - DNA, 21 bp, Homo sapiens
tgtctgcctgcttcttcactc

SEQ ID NO: 9239687 - DNA, 22 bp, Homo sapiens
tgtctgcctgcgggccggcaca

SEQ ID NO: 9239688 - DNA, 22 bp, Homo sapiens
tgtctgcaaagtccagcacagg

SEQ ID NO: 9239689 - DNA, 22 bp, Homo sapiens
tgtctgagcacctgtgctgaac

SEQ ID NO: 9239690 - DNA, 22 bp, Homo sapiens
tgtctgagcgagaaagtagtgt

SEQ ID NO: 9239691 - DNA, 22 bp, Homo sapiens
tgtctgaaggcctgacctacat

SEQ ID NO: 9239692 - DNA, 22 bp, Homo sapiens
tgtctgaatcgcttcctagagg

SEQ ID NO: 9239693 - DNA, 22 bp, Homo sapiens
tgtctctctgcccccattgctc

SEQ ID NO: 9239694 - DNA, 22 bp, Homo sapiens
tgtctctgagatgactcccacc

SEQ ID NO: 9239695 - DNA, 22 bp, Homo sapiens
tgtctcttggctctatcactta

SEQ ID NO: 9239696 - DNA, 22 bp, Homo sapiens
tgtctctttgggttcctcttgg

SEQ ID NO: 9239697 - DNA, 22 bp, Homo sapiens
tgtctctttggcctcccatatg

SEQ ID NO: 9239698 - DNA, 22 bp, Homo sapiens
tgtctcttttcaagctaccctt

SEQ ID NO: 9239699 - DNA, 22 bp, Homo sapiens
tgtctgaaacttatgatatact

SEQ ID NO: 9239700 - DNA, 22 bp, Homo sapiens
tgtctgaaagaggacgagctgg

SEQ ID NO: 9239701 - DNA, 22 bp, Homo sapiens
tgtctgttattggtgtataaga

SEQ ID NO: 9239702 - DNA, 22 bp, Homo sapiens
tgtctgtgacctctttggagcc

SEQ ID NO: 9239703 - DNA, 22 bp, Homo sapiens
tgtctgtggcaattgtgggtaa

SEQ ID NO: 9239704 - DNA, 22 bp, Homo sapiens
tgtcttcaggagtaaatatcat

SEQ ID NO: 9239705 - DNA, 22 bp, Homo sapiens
tgtcttcacaaagcagaaggga

SEQ ID NO: 9239706 - DNA, 22 bp, Homo sapiens
tgtcttatgctgcatagactat

SEQ ID NO: 9239707 - DNA, 22 bp, Homo sapiens
tgtcttaatttggatgatgttt

SEQ ID NO: 9239708 - DNA, 22 bp, Homo sapiens
tgtctggcctcaaaagccattt

SEQ ID NO: 9239709 - DNA, 22 bp, Homo sapiens
tgtctggatgtctggagcatcg

SEQ ID NO: 9239710 - DNA, 22 bp, Homo sapiens
tgtctgggagggacagggctac

SEQ ID NO: 9239711 - DNA, 22 bp, Homo sapiens
tgtctgggatgttggcagccac

SEQ ID NO: 9239712 - DNA, 22 bp, Homo sapiens
tgtctgtgacctcttaggcaag

SEQ ID NO: 9239713 - DNA, 23 bp, Homo sapiens
tgtctggagcctgagcaggtgct

SEQ ID NO: 9239714 - DNA, 22 bp, Homo sapiens
tgtctttaagcaaacagtgttt

SEQ ID NO: 9239715 - DNA, 22 bp, Homo sapiens
tgtcttggccactaggagtgcc

SEQ ID NO: 9239716 - DNA, 22 bp, Homo sapiens
tgtcttctaccttgacagcatt

SEQ ID NO: 9239717 - DNA, 17 bp, Homo sapiens
tgtcttctgaagagagc

SEQ ID NO: 9239718 - DNA, 22 bp, Homo sapiens
tgtcttctaccttgacagcatt

SEQ ID NO: 9239719 - DNA, 22 bp, Homo sapiens
tgtcttcatctcagacacagtt

SEQ ID NO: 9239720 - DNA, 22 bp, Homo sapiens
tgtcttcagtaaaatacactat

SEQ ID NO: 9239721 - DNA, 22 bp, Homo sapiens
tgtcttcatctccatgcacaga

SEQ ID NO: 9239722 - DNA, 22 bp, Homo sapiens
tgtcttcattccccatgaagtc

SEQ ID NO: 9239723 - DNA, 22 bp, Homo sapiens
tgtcttttgccaaagatcagtt

SEQ ID NO: 9239724 - DNA, 22 bp, Homo sapiens
tgtcttttataactgacatata

SEQ ID NO: 9239725 - DNA, 21 bp, Homo sapiens
tgtctttggcctcattcccag

SEQ ID NO: 9239726 - DNA, 22 bp, Homo sapiens
tgtcttttacctaatgagctgg

SEQ ID NO: 9239727 - DNA, 22 bp, Homo sapiens
tgtcttttggagcatctttctt

SEQ ID NO: 9239728 - DNA, 22 bp, Homo sapiens
tgtgaaaaaagttctagaagga

SEQ ID NO: 9239729 - DNA, 22 bp, Homo sapiens
tgtgaaaaaagttctagaagga

SEQ ID NO: 9239730 - DNA, 22 bp, Homo sapiens
tgtgaaaaaagttctagaagga

SEQ ID NO: 9239731 - DNA, 22 bp, Homo sapiens
tgtgaaaagcaggctactttct

SEQ ID NO: 9239732 - DNA, 22 bp, Homo sapiens
tgtgaaaagcgtgtgttctagg

SEQ ID NO: 9239733 - DNA, 22 bp, Homo sapiens
tgtgaaaagcgtgtgttctagg

SEQ ID NO: 9239734 - DNA, 22 bp, Homo sapiens
tgtgaaaagggctttgtacaaa

SEQ ID NO: 9239735 - DNA, 22 bp, Homo sapiens
tgtgaaacggagtcagggaagg

SEQ ID NO: 9239736 - DNA, 22 bp, Homo sapiens
tgtgcacaggaagctattctct

SEQ ID NO: 9239737 - DNA, 22 bp, Homo sapiens
tgtgcacatatactcatattcc

SEQ ID NO: 9239738 - DNA, 22 bp, Homo sapiens
tgtgcacattctaggactagta

SEQ ID NO: 9239739 - DNA, 22 bp, Homo sapiens
tgtgcaatttcaatttacacag

SEQ ID NO: 9239740 - DNA, 22 bp, Homo sapiens
tgtgcaatcatattttaaaatg

SEQ ID NO: 9239741 - DNA, 18 bp, Homo sapiens
tgtgcaatattaaccacc

SEQ ID NO: 9239742 - DNA, 22 bp, Homo sapiens
tgtgcaaattaagtagattttc

SEQ ID NO: 9239743 - DNA, 22 bp, Homo sapiens
tgtgcaaagtgtacaaattaat

SEQ ID NO: 9239744 - DNA, 22 bp, Homo sapiens
tgtgcaatagaaagtggcatgg

SEQ ID NO: 9239745 - DNA, 22 bp, Homo sapiens
tgtgcaataatcatagtgattt

SEQ ID NO: 9239746 - DNA, 22 bp, Homo sapiens
tgtgcagctctagagccaagcc

SEQ ID NO: 9239747 - DNA, 22 bp, Homo sapiens
tgtgcagagttgaagacaggag

SEQ ID NO: 9239748 - DNA, 22 bp, Homo sapiens
tgtgcagagtaaggcagctgtt

SEQ ID NO: 9239749 - DNA, 20 bp, Homo sapiens
tgtgccctgcagacttcttt

SEQ ID NO: 9239750 - DNA, 22 bp, Homo sapiens
tgtgcccattccacttgagtac

SEQ ID NO: 9239751 - DNA, 22 bp, Homo sapiens
tgtgccaatctgctgactgtct

SEQ ID NO: 9239752 - DNA, 22 bp, Homo sapiens
tgtgcctactgatagagccaag

SEQ ID NO: 9239753 - DNA, 19 bp, Homo sapiens
tgtgcctctatagcatgtg

SEQ ID NO: 9239754 - DNA, 19 bp, Homo sapiens
tgtgcctcctcgtctccta

SEQ ID NO: 9239755 - DNA, 19 bp, Homo sapiens
tgtgcctctatagcatgtg

SEQ ID NO: 9239756 - DNA, 18 bp, Homo sapiens
tgtgcctctgcaggacgt

SEQ ID NO: 9239757 - DNA, 22 bp, Homo sapiens
tgtgcctgactaggtgaatcaa

SEQ ID NO: 9239758 - DNA, 22 bp, Homo sapiens
tgtgccaagatcaaacttttct

SEQ ID NO: 9239759 - DNA, 22 bp, Homo sapiens
tgtgccaagactatattgtgct

SEQ ID NO: 9239760 - DNA, 22 bp, Homo sapiens
tgtgcatcaagagaaaacagtg

SEQ ID NO: 9239761 - DNA, 22 bp, Homo sapiens
tgtgcagtttctatgttgtcca

SEQ ID NO: 9239762 - DNA, 22 bp, Homo sapiens
tgtgcctggcattctgggcttc

SEQ ID NO: 9239763 - DNA, 22 bp, Homo sapiens
tgtgcctggatctctgtgacaa

SEQ ID NO: 9239764 - DNA, 22 bp, Homo sapiens
tgtgcctggatctctgtgacaa

SEQ ID NO: 9239765 - DNA, 22 bp, Homo sapiens
tgtgcctgatggtcacgtggcc

SEQ ID NO: 9239766 - DNA, 22 bp, Homo sapiens
tgtgcctgagttggctgagtac

SEQ ID NO: 9239767 - DNA, 22 bp, Homo sapiens
tgtgcctttaaggggagctgag

SEQ ID NO: 9239768 - DNA, 22 bp, Homo sapiens
tgtgccttctcagtcctgctca

SEQ ID NO: 9239769 - DNA, 22 bp, Homo sapiens
tgtgcctttcatcatgcttttg

SEQ ID NO: 9239770 - DNA, 22 bp, Homo sapiens
tgtgccttatgaattctttctg

SEQ ID NO: 9239771 - DNA, 22 bp, Homo sapiens
tgtgcctgttggtgtagacata

SEQ ID NO: 9239772 - DNA, 22 bp, Homo sapiens
tgtgcctgtcaccctcagagag

SEQ ID NO: 9239773 - DNA, 22 bp, Homo sapiens
tgtgcctgtcccgcattctggt

SEQ ID NO: 9239774 - DNA, 22 bp, Homo sapiens
tgtgctcttgtctgtgactaac

SEQ ID NO: 9239775 - DNA, 22 bp, Homo sapiens
tgtgctctggagttgccttcac

SEQ ID NO: 9239776 - DNA, 22 bp, Homo sapiens
tgtgctctggagttgccttcac

SEQ ID NO: 9239777 - DNA, 22 bp, Homo sapiens
tgtggaaagtggtctaagcaca

SEQ ID NO: 9239778 - DNA, 22 bp, Homo sapiens
tgtgctcactctaaattaagat

SEQ ID NO: 9239779 - DNA, 22 bp, Homo sapiens
tgtgctcactctaaattaagat

SEQ ID NO: 9239780 - DNA, 17 bp, Homo sapiens
tgtgctctctcactcag

SEQ ID NO: 9239781 - DNA, 22 bp, Homo sapiens
tgtgctctgactttctcctggt

SEQ ID NO: 9239782 - DNA, 22 bp, Homo sapiens
tgtgctctgactttctcctggt

SEQ ID NO: 9239783 - DNA, 22 bp, Homo sapiens
tgtgctctgcccctgactgttt

SEQ ID NO: 9239784 - DNA, 22 bp, Homo sapiens
tgtgaaatgctatttccatgag

SEQ ID NO: 9239785 - DNA, 22 bp, Homo sapiens
tgtgaaatgtggatgttaatag

SEQ ID NO: 9239786 - DNA, 22 bp, Homo sapiens
tgtgaaatgagtatatttgaat

SEQ ID NO: 9239787 - DNA, 22 bp, Homo sapiens
tgtgaaatgctattgtgacaaa

SEQ ID NO: 9239788 - DNA, 22 bp, Homo sapiens
tgtgaaatgaagataattcttg

SEQ ID NO: 9239789 - DNA, 22 bp, Homo sapiens
tgtgaaattcttgaaatgcaca

SEQ ID NO: 9239790 - DNA, 22 bp, Homo sapiens
tgtgaaattacttaaaggaaat

SEQ ID NO: 9239791 - DNA, 22 bp, Homo sapiens
tgtgaaatgtgtgtataattaa

SEQ ID NO: 9239792 - DNA, 23 bp, Homo sapiens
tgtgaaatttgaggtcagtgctt

SEQ ID NO: 9239793 - DNA, 22 bp, Homo sapiens
tgtgaaattgagaaactttcac

SEQ ID NO: 9239794 - DNA, 22 bp, Homo sapiens
tgtgaaattgaatgcccattgc

SEQ ID NO: 9239795 - DNA, 22 bp, Homo sapiens
tgtgaaagtcaaattaattgaa

SEQ ID NO: 9239796 - DNA, 21 bp, Homo sapiens
tgtgaaatagctatgctacat

SEQ ID NO: 9239797 - DNA, 22 bp, Homo sapiens
tgtgaaagtcaaattaattgaa

SEQ ID NO: 9239798 - DNA, 22 bp, Homo sapiens
tgtgaaagagtcttatagtttc

SEQ ID NO: 9239799 - DNA, 22 bp, Homo sapiens
tgtgaaagcaagtctagttctc

SEQ ID NO: 9239800 - DNA, 22 bp, Homo sapiens
tgtgaaatattggcaatttcat

SEQ ID NO: 9239801 - DNA, 22 bp, Homo sapiens
tgtgaaatatttatatactcaa

SEQ ID NO: 9239802 - DNA, 22 bp, Homo sapiens
tgtgaaatcaattagctgcaga

SEQ ID NO: 9239803 - DNA, 22 bp, Homo sapiens
tgtgaaatcacaggctatttag

SEQ ID NO: 9239804 - DNA, 22 bp, Homo sapiens
tgtgaaatctgaactcaaagat

SEQ ID NO: 9239805 - DNA, 22 bp, Homo sapiens
tgtgaaatctgatgaattgacc

SEQ ID NO: 9239806 - DNA, 19 bp, Homo sapiens
tgtgacatcactgggcagc

SEQ ID NO: 9239807 - DNA, 22 bp, Homo sapiens
tgtgacagtcgttaggagctca

SEQ ID NO: 9239808 - DNA, 23 bp, Homo sapiens
tgtgacagtgacaatactgactt

SEQ ID NO: 9239809 - DNA, 23 bp, Homo sapiens
tgtgacagggtcattgaaaaggg

SEQ ID NO: 9239810 - DNA, 23 bp, Homo sapiens
tgtgacagggtcattgaaaaggg

SEQ ID NO: 9239811 - DNA, 22 bp, Homo sapiens
tgtgacagtcgttaggagctca

SEQ ID NO: 9239812 - DNA, 22 bp, Homo sapiens
tgtgacagccagtaaagtaagc

SEQ ID NO: 9239813 - DNA, 22 bp, Homo sapiens
tgtgacaagcattgtatattgg

SEQ ID NO: 9239814 - DNA, 22 bp, Homo sapiens
tgtgacagatctttaaataatg

SEQ ID NO: 9239815 - DNA, 22 bp, Homo sapiens
tgtgacagatctctatacatga

SEQ ID NO: 9239816 - DNA, 22 bp, Homo sapiens
tgtgaatgtatagtttgtatat

SEQ ID NO: 9239817 - DNA, 22 bp, Homo sapiens
tgtgaatgtctaggttttatgt

SEQ ID NO: 9239818 - DNA, 22 bp, Homo sapiens
tgtgaatggacaattaaatcta

SEQ ID NO: 9239819 - DNA, 22 bp, Homo sapiens
tgtgaatatccatttgtttcag

SEQ ID NO: 9239820 - DNA, 22 bp, Homo sapiens
tgtgaatatttccttctttgga

SEQ ID NO: 9239821 - DNA, 22 bp, Homo sapiens
tgtgaaggtttttatgggatat

SEQ ID NO: 9239822 - DNA, 22 bp, Homo sapiens
tgtgaacatttctggttatttg

SEQ ID NO: 9239823 - DNA, 22 bp, Homo sapiens
tgtgaatagattgaagctttgg

SEQ ID NO: 9239824 - DNA, 22 bp, Homo sapiens
tgtgaataccttgaattcatca

SEQ ID NO: 9239825 - DNA, 22 bp, Homo sapiens
tgtgatttcatctgaggccagg

SEQ ID NO: 9239826 - DNA, 22 bp, Homo sapiens
tgtgatttccagccattaaaaa

SEQ ID NO: 9239827 - DNA, 22 bp, Homo sapiens
tgtgcaaagtgtacaaattaat

SEQ ID NO: 9239828 - DNA, 22 bp, Homo sapiens
tgtgattctcagaagagggaag

SEQ ID NO: 9239829 - DNA, 19 bp, Homo sapiens
tgtgatagttgaacctgcc

SEQ ID NO: 9239830 - DNA, 22 bp, Homo sapiens
tgtgatctgccttggatctgca

SEQ ID NO: 9239831 - DNA, 22 bp, Homo sapiens
tgtgatggttcactgggcatga

SEQ ID NO: 9239832 - DNA, 22 bp, Homo sapiens
tgtgatggttcactgggcatga

SEQ ID NO: 9239833 - DNA, 22 bp, Homo sapiens
tgtgatgctggagtgcgaatat

SEQ ID NO: 9239834 - DNA, 22 bp, Homo sapiens
tgtgatgcatagtttttattgc

SEQ ID NO: 9239835 - DNA, 22 bp, Homo sapiens
tgtgagttcttagaaagtcagt

SEQ ID NO: 9239836 - DNA, 22 bp, Homo sapiens
tgtgagttattttcaggagttt

SEQ ID NO: 9239837 - DNA, 22 bp, Homo sapiens
tgtgagttgctcttttgctact

SEQ ID NO: 9239838 - DNA, 21 bp, Homo sapiens
tgtgataaactccaagtggga

SEQ ID NO: 9239839 - DNA, 22 bp, Homo sapiens
tgtgagcactggctgggaaagt

SEQ ID NO: 9239840 - DNA, 22 bp, Homo sapiens
tgtgagagcagaagacacatag

SEQ ID NO: 9239841 - DNA, 19 bp, Homo sapiens
tgtgagaggctagctgccc

SEQ ID NO: 9239842 - DNA, 22 bp, Homo sapiens
tgtgagcactatggctaggctc

SEQ ID NO: 9239843 - DNA, 22 bp, Homo sapiens
tgtgactggttgtcccgctttc

SEQ ID NO: 9239844 - DNA, 22 bp, Homo sapiens
tgtgactgagctgcagagtgtc

SEQ ID NO: 9239845 - DNA, 22 bp, Homo sapiens
tgtgactgaagtgtctagacct

SEQ ID NO: 9239846 - DNA, 22 bp, Homo sapiens
tgtgacgttcctgctggcgacc

SEQ ID NO: 9239847 - DNA, 17 bp, Homo sapiens
tgtgacattgggacatt

SEQ ID NO: 9239848 - DNA, 22 bp, Homo sapiens
tgtgagacaattgcatcagggc

SEQ ID NO: 9239849 - DNA, 22 bp, Homo sapiens
tgtgagaagggtgaggctttta

SEQ ID NO: 9239850 - DNA, 22 bp, Homo sapiens
tgtgacttctttttgagttcaa

SEQ ID NO: 9239851 - DNA, 22 bp, Homo sapiens
tgtgacttgatgtttgcaccag

SEQ ID NO: 9239852 - DNA, 22 bp, Homo sapiens
tgtgacttagggcaggtgagat

SEQ ID NO: 9239853 - DNA, 22 bp, Homo sapiens
tgtgactttgtcaagttgcata

SEQ ID NO: 9239854 - DNA, 22 bp, Homo sapiens
tgtgacttttcacaggctggtc

SEQ ID NO: 9239855 - DNA, 22 bp, Homo sapiens
tgtgacttaatccttgggtggg

SEQ ID NO: 9239856 - DNA, 16 bp, Homo sapiens
tggggaagctcgtgag

SEQ ID NO: 9239857 - DNA, 22 bp, Homo sapiens
tggggaaggatcaccacaatct

SEQ ID NO: 9239858 - DNA, 17 bp, Homo sapiens
tggggaagctcagattt

SEQ ID NO: 9239859 - DNA, 22 bp, Homo sapiens
tggggaaggcggagcttgcagc

SEQ ID NO: 9239860 - DNA, 22 bp, Homo sapiens
tggggaagggcaccctggagac

SEQ ID NO: 9239861 - DNA, 22 bp, Homo sapiens
tggggaagaataatgtatgtac

SEQ ID NO: 9239862 - DNA, 22 bp, Homo sapiens
tggggaagacagcagacactgt

SEQ ID NO: 9239863 - DNA, 22 bp, Homo sapiens
tggggaagcactttgaacttaa

SEQ ID NO: 9239864 - DNA, 17 bp, Homo sapiens
tggggaagctcagattt

SEQ ID NO: 9239865 - DNA, 22 bp, Homo sapiens
tggggaagacagcagacactgt

SEQ ID NO: 9239866 - DNA, 22 bp, Homo sapiens
tggggaaactatttccttgtcc

SEQ ID NO: 9239867 - DNA, 22 bp, Homo sapiens
tggggaaagatagttttctcta

SEQ ID NO: 9239868 - DNA, 22 bp, Homo sapiens
tgggcttcctggagcctgtgct

SEQ ID NO: 9239869 - DNA, 22 bp, Homo sapiens
tgggcttaggtcggaggcggcc

SEQ ID NO: 9239870 - DNA, 22 bp, Homo sapiens
tgggctggtgagggatcattta

SEQ ID NO: 9239871 - DNA, 22 bp, Homo sapiens
tgggctggctgaacttcaacct

SEQ ID NO: 9239872 - DNA, 22 bp, Homo sapiens
tgggctggctgaggcattcact

SEQ ID NO: 9239873 - DNA, 22 bp, Homo sapiens
tgggctggctgaggcattcact

SEQ ID NO: 9239874 - DNA, 22 bp, Homo sapiens
tgggctggctgaggcattcact

SEQ ID NO: 9239875 - DNA, 22 bp, Homo sapiens
tgggctggcgtggagagtttag

SEQ ID NO: 9239876 - DNA, 22 bp, Homo sapiens
tgggctggcgtggagagtttag

SEQ ID NO: 9239877 - DNA, 22 bp, Homo sapiens
tgggctggcgtggagagtttag

SEQ ID NO: 9239878 - DNA, 22 bp, Homo sapiens
tgggctggctgaacttcaacct

SEQ ID NO: 9239879 - DNA, 22 bp, Homo sapiens
tgggctggctgaacttcaacct

SEQ ID NO: 9239880 - DNA, 22 bp, Homo sapiens
tggggaggaagtcagatttcag

SEQ ID NO: 9239881 - DNA, 22 bp, Homo sapiens
tggggaggaagtcagatttcag

SEQ ID NO: 9239882 - DNA, 22 bp, Homo sapiens
tggggactgacagccaggcctc

SEQ ID NO: 9239883 - DNA, 22 bp, Homo sapiens
tggggaggaagtcagatttcag

SEQ ID NO: 9239884 - DNA, 22 bp, Homo sapiens
tggggacatagccagtctggct

SEQ ID NO: 9239885 - DNA, 22 bp, Homo sapiens
tggggacagggctcagcaattt

SEQ ID NO: 9239886 - DNA, 22 bp, Homo sapiens
tggggaggatatgtgagttatt

SEQ ID NO: 9239887 - DNA, 22 bp, Homo sapiens
tggggaggatatgtgagttatt

SEQ ID NO: 9239888 - DNA, 22 bp, Homo sapiens
tggggaggatatgtgagttatt

SEQ ID NO: 9239889 - DNA, 22 bp, Homo sapiens
tggggaggacgggcgccttcct

SEQ ID NO: 9239890 - DNA, 22 bp, Homo sapiens
tggggaggacgggcgccttcct

SEQ ID NO: 9239891 - DNA, 22 bp, Homo sapiens
tggggaggacgggcgccttcct

SEQ ID NO: 9239892 - DNA, 23 bp, Homo sapiens
tggggagggaagtcatttctgta

SEQ ID NO: 9239893 - DNA, 22 bp, Homo sapiens
tggggaggatatgtgagttatt

SEQ ID NO: 9239894 - DNA, 23 bp, Homo sapiens
tggggagggaagtcatttctgta

SEQ ID NO: 9239895 - DNA, 23 bp, Homo sapiens
tggggagggaagtcatttctgta

SEQ ID NO: 9239896 - DNA, 21 bp, Homo sapiens
tggggaggggacctgattatg

SEQ ID NO: 9239897 - DNA, 21 bp, Homo sapiens
tggggaggggacctgattatg

SEQ ID NO: 9239898 - DNA, 22 bp, Homo sapiens
tggggaggtaacaatttcaggc

SEQ ID NO: 9239899 - DNA, 22 bp, Homo sapiens
tggggaggtaacaatttcaggc

SEQ ID NO: 9239900 - DNA, 22 bp, Homo sapiens
tggggaggtaacaatttcaggc

SEQ ID NO: 9239901 - DNA, 22 bp, Homo sapiens
tggggaggtaacaatttcaggc

SEQ ID NO: 9239902 - DNA, 22 bp, Homo sapiens
tggggaggttcgggaatcttgt

SEQ ID NO: 9239903 - DNA, 22 bp, Homo sapiens
tggggaggttcgggaatcttgt

SEQ ID NO: 9239904 - DNA, 22 bp, Homo sapiens
tggggagtgatgcctcggataa

SEQ ID NO: 9239905 - DNA, 22 bp, Homo sapiens
tggggaggttcgggaatcttgt

SEQ ID NO: 9239906 - DNA, 22 bp, Homo sapiens
tggggaggttcgggaatcttgt

SEQ ID NO: 9239907 - DNA, 22 bp, Homo sapiens
tggggatggatgaatctttgct

SEQ ID NO: 9239908 - DNA, 22 bp, Homo sapiens
tggggatgaaacccaggcatct

SEQ ID NO: 9239909 - DNA, 20 bp, Homo sapiens
tggggagttgagcacgagca

SEQ ID NO: 9239910 - DNA, 22 bp, Homo sapiens
tggggagtgatgcctcggataa

SEQ ID NO: 9239911 - DNA, 22 bp, Homo sapiens
tggggatgtaaatgaggtgata

SEQ ID NO: 9239912 - DNA, 17 bp, Homo sapiens
tggggatggttcatgag

SEQ ID NO: 9239913 - DNA, 16 bp, Homo sapiens
tggggatggggaagag

SEQ ID NO: 9239914 - DNA, 22 bp, Homo sapiens
tggggatgtaaatgaggtgata

SEQ ID NO: 9239915 - DNA, 22 bp, Homo sapiens
tgggggagctcagtccagccca

SEQ ID NO: 9239916 - DNA, 22 bp, Homo sapiens
tgggggagccttcacagtagct

SEQ ID NO: 9239917 - DNA, 22 bp, Homo sapiens
tgggggcagccaggctgtcaag

SEQ ID NO: 9239918 - DNA, 22 bp, Homo sapiens
tgggggcatggaccagcctggc

SEQ ID NO: 9239919 - DNA, 22 bp, Homo sapiens
tgggggctccaggctccaggga

SEQ ID NO: 9239920 - DNA, 22 bp, Homo sapiens
tgggggctagaacccagggatt

SEQ ID NO: 9239921 - DNA, 17 bp, Homo sapiens
tgggggcgccagggtct

SEQ ID NO: 9239922 - DNA, 22 bp, Homo sapiens
tgggggctccaggctccaggga

SEQ ID NO: 9239923 - DNA, 22 bp, Homo sapiens
tggggctggcacagtctctatt

SEQ ID NO: 9239924 - DNA, 22 bp, Homo sapiens
tggggctggcacagtctctatt

SEQ ID NO: 9239925 - DNA, 22 bp, Homo sapiens
tggggctggctattgtctccct

SEQ ID NO: 9239926 - DNA, 22 bp, Homo sapiens
tggggctggctattgtctccct

SEQ ID NO: 9239927 - DNA, 22 bp, Homo sapiens
tggggctggctattgtctccct

SEQ ID NO: 9239928 - DNA, 22 bp, Homo sapiens
tggggctggggatcttgagcct

SEQ ID NO: 9239929 - DNA, 22 bp, Homo sapiens
tggggctggggatcttgagcct

SEQ ID NO: 9239930 - DNA, 22 bp, Homo sapiens
tggggctgtcccggtttggcga

SEQ ID NO: 9239931 - DNA, 22 bp, Homo sapiens
tggggctgtccttagtctgaga

SEQ ID NO: 9239932 - DNA, 22 bp, Homo sapiens
tgggggagattagagcttctta

SEQ ID NO: 9239933 - DNA, 22 bp, Homo sapiens
tgggggagattagagcttctta

SEQ ID NO: 9239934 - DNA, 22 bp, Homo sapiens
tgggggagattgtgcatctcta

SEQ ID NO: 9239935 - DNA, 22 bp, Homo sapiens
tgggggagagtttagatgattt

SEQ ID NO: 9239936 - DNA, 22 bp, Homo sapiens
tggggctgtccttagtctgaga

SEQ ID NO: 9239937 - DNA, 22 bp, Homo sapiens
tggggctggcacagtctctatt

SEQ ID NO: 9239938 - DNA, 22 bp, Homo sapiens
tggggctctccacagtgtctca

SEQ ID NO: 9239939 - DNA, 23 bp, Homo sapiens
tggggctctggcaggcctgaggt

SEQ ID NO: 9239940 - DNA, 22 bp, Homo sapiens
tggggctctccacagtgtctca

SEQ ID NO: 9239941 - DNA, 22 bp, Homo sapiens
tggggctcatgcctgctggaac

SEQ ID NO: 9239942 - DNA, 22 bp, Homo sapiens
tggggctaaacacgcctggcct

SEQ ID NO: 9239943 - DNA, 22 bp, Homo sapiens
tggggccttggcctcattagat

SEQ ID NO: 9239944 - DNA, 20 bp, Homo sapiens
tggggcctgtttctgtggtt

SEQ ID NO: 9239945 - DNA, 20 bp, Homo sapiens
tggggcctgtttctgtggtt

SEQ ID NO: 9239946 - DNA, 22 bp, Homo sapiens
tggggcctgcacaggctgaatg

SEQ ID NO: 9239947 - DNA, 22 bp, Homo sapiens
tggggcctgaggtggagctgca

SEQ ID NO: 9239948 - DNA, 22 bp, Homo sapiens
tggggcctgaggtggagctgca

SEQ ID NO: 9239949 - DNA, 22 bp, Homo sapiens
tggggcctgaggtggagctgca

SEQ ID NO: 9239950 - DNA, 22 bp, Homo sapiens
tggggcagagtaggattttggc

SEQ ID NO: 9239951 - DNA, 22 bp, Homo sapiens
tggggcagagtaggattttggc

SEQ ID NO: 9239952 - DNA, 22 bp, Homo sapiens
tggggcagcagacctttcttgg

SEQ ID NO: 9239953 - DNA, 22 bp, Homo sapiens
tggggcaagaagtgccctgaag

SEQ ID NO: 9239954 - DNA, 22 bp, Homo sapiens
tggggcacttatgatgtgccac

SEQ ID NO: 9239955 - DNA, 22 bp, Homo sapiens
tggggcagcagacctttcttgg

SEQ ID NO: 9239956 - DNA, 22 bp, Homo sapiens
tggggccacactgatctcccag

SEQ ID NO: 9239957 - DNA, 22 bp, Homo sapiens
tggggccagagctgcagggagc

SEQ ID NO: 9239958 - DNA, 22 bp, Homo sapiens
tggggccaggtggctgcaggtc

SEQ ID NO: 9239959 - DNA, 22 bp, Homo sapiens
tggggccaggtggctgcaggtc

SEQ ID NO: 9239960 - DNA, 19 bp, Homo sapiens
tggggcctcctgtccctgg

SEQ ID NO: 9239961 - DNA, 22 bp, Homo sapiens
tggggccagggaggaccagaca

SEQ ID NO: 9239962 - DNA, 22 bp, Homo sapiens
tggggccagcggggaggactca

SEQ ID NO: 9239963 - DNA, 22 bp, Homo sapiens
tgggtccagtgtcctggctatg

SEQ ID NO: 9239964 - DNA, 22 bp, Homo sapiens
tgggtccatggaacagaggtgc

SEQ ID NO: 9239965 - DNA, 22 bp, Homo sapiens
tgggtctgtagggctgtccaat

SEQ ID NO: 9239966 - DNA, 20 bp, Homo sapiens
tgggtctgcttggcttcagt

SEQ ID NO: 9239967 - DNA, 22 bp, Homo sapiens
tgggtaggggacgtggaagaaa

SEQ ID NO: 9239968 - DNA, 22 bp, Homo sapiens
tgggtaggggacgtggaagaaa

SEQ ID NO: 9239969 - DNA, 22 bp, Homo sapiens
tgggtaggggacgtggaagaaa

SEQ ID NO: 9239970 - DNA, 22 bp, Homo sapiens
tgggtccagtgcagctgcgcgt

SEQ ID NO: 9239971 - DNA, 22 bp, Homo sapiens
tgggtccacttctgcactgtgg

SEQ ID NO: 9239972 - DNA, 22 bp, Homo sapiens
tgggtccacggaagacttaggg

SEQ ID NO: 9239973 - DNA, 22 bp, Homo sapiens
tgggtaggaccagaaatgcact

SEQ ID NO: 9239974 - DNA, 22 bp, Homo sapiens
tgggtaggccaggaagcagtgt

SEQ ID NO: 9239975 - DNA, 22 bp, Homo sapiens
tgggtaggccaggaagcagtgt

SEQ ID NO: 9239976 - DNA, 22 bp, Homo sapiens
tgggtaggccaggaagcagtgt

SEQ ID NO: 9239977 - DNA, 22 bp, Homo sapiens
tgggtagggacttagctggctg

SEQ ID NO: 9239978 - DNA, 22 bp, Homo sapiens
tgggtaggaatcgagtgtatgg

SEQ ID NO: 9239979 - DNA, 22 bp, Homo sapiens
tgggtaggaatcgagtgtatgg

SEQ ID NO: 9239980 - DNA, 22 bp, Homo sapiens
tgggtagagtggagggataaga

SEQ ID NO: 9239981 - DNA, 22 bp, Homo sapiens
tgggtagagcaggctggggctt

SEQ ID NO: 9239982 - DNA, 22 bp, Homo sapiens
tgggtactcctattagttcagt

SEQ ID NO: 9239983 - DNA, 22 bp, Homo sapiens
tgggtactcctattagttcagt

SEQ ID NO: 9239984 - DNA, 22 bp, Homo sapiens
tgggtagaaacaaggctggact

SEQ ID NO: 9239985 - DNA, 22 bp, Homo sapiens
tggggttctttgtttcctgcct

SEQ ID NO: 9239986 - DNA, 23 bp, Homo sapiens
tggggttgaattgtagctgtgcc

SEQ ID NO: 9239987 - DNA, 23 bp, Homo sapiens
tggggttgaattgtagctgtgcc

SEQ ID NO: 9239988 - DNA, 22 bp, Homo sapiens
tggggtgaatctttgttgtccg

SEQ ID NO: 9239989 - DNA, 18 bp, Homo sapiens
tggggtctctcaggtaag

SEQ ID NO: 9239990 - DNA, 22 bp, Homo sapiens
tgggggtgccctatgaggaagc

SEQ ID NO: 9239991 - DNA, 22 bp, Homo sapiens
tgggggtgccctatgaggaagc

SEQ ID NO: 9239992 - DNA, 23 bp, Homo sapiens
tgggggtgcacgggccacatctt

SEQ ID NO: 9239993 - DNA, 22 bp, Homo sapiens
tgggggtgaaagtctggacagt

SEQ ID NO: 9239994 - DNA, 22 bp, Homo sapiens
tgggggtgaaagtctggacagt

SEQ ID NO: 9239995 - DNA, 22 bp, Homo sapiens
tgggggtcctcctctgcttaag

SEQ ID NO: 9239996 - DNA, 22 bp, Homo sapiens
tggggggcacttcagcacaatg

SEQ ID NO: 9239997 - DNA, 22 bp, Homo sapiens
tgggggctgtgcacaggctcac

SEQ ID NO: 9239998 - DNA, 22 bp, Homo sapiens
tggggtgggcatgcgctgtcct

SEQ ID NO: 9239999 - DNA, 22 bp, Homo sapiens
tggggtgggcatgcgctgtcct

SEQ ID NO: 9240000 - DNA, 22 bp, Homo sapiens
tggggtggggttactcattctg

SEQ ID NO: 9240001 - DNA, 22 bp, Homo sapiens
tggggtggtaatacaccgttct

SEQ ID NO: 9240002 - DNA, 22 bp, Homo sapiens
tggggtggggttactcattctg

SEQ ID NO: 9240003 - DNA, 22 bp, Homo sapiens
tggggtgacagtgcagtggtca

SEQ ID NO: 9240004 - DNA, 22 bp, Homo sapiens
tggggtggaacccttctgctgg

SEQ ID NO: 9240005 - DNA, 22 bp, Homo sapiens
tggggtggaacccttctgctgg

SEQ ID NO: 9240006 - DNA, 22 bp, Homo sapiens
tggggtggaacccttctgctgg

SEQ ID NO: 9240007 - DNA, 22 bp, Homo sapiens
tggggtggatagaaagtgatgt

SEQ ID NO: 9240008 - DNA, 22 bp, Homo sapiens
tggggtggaacccttctgctgg

SEQ ID NO: 9240009 - DNA, 22 bp, Homo sapiens
tggggtggatagaaagtgatgt

SEQ ID NO: 9240010 - DNA, 22 bp, Homo sapiens
tggggtgggcatgcgctgtcct

SEQ ID NO: 9240011 - DNA, 22 bp, Homo sapiens
tgggtggtttatgagtgggttt

SEQ ID NO: 9240012 - DNA, 22 bp, Homo sapiens
tgggtggtccaggctcagcaga

SEQ ID NO: 9240013 - DNA, 22 bp, Homo sapiens
tgggtggttgctgaggctcctt

SEQ ID NO: 9240014 - DNA, 22 bp, Homo sapiens
tgggtgtgcccagatggtgtcc

SEQ ID NO: 9240015 - DNA, 21 bp, Homo sapiens
tgggtgggcagagtctcttca

SEQ ID NO: 9240016 - DNA, 21 bp, Homo sapiens
tgggtgggcagagtctcttca

SEQ ID NO: 9240017 - DNA, 17 bp, Homo sapiens
tgggtggtagggagagg

SEQ ID NO: 9240018 - DNA, 17 bp, Homo sapiens
tgggtggtagggagagg

SEQ ID NO: 9240019 - DNA, 21 bp, Homo sapiens
tgggtgggcagagtctcttca

SEQ ID NO: 9240020 - DNA, 21 bp, Homo sapiens
tgggtgggcagagtctcttca

SEQ ID NO: 9240021 - DNA, 22 bp, Homo sapiens
tgggtgggagcgccctgtctgg

SEQ ID NO: 9240022 - DNA, 22 bp, Homo sapiens
tgggtgggagcgccctgtctgg

SEQ ID NO: 9240023 - DNA, 22 bp, Homo sapiens
tgggtgggagcgccctgtctgg

SEQ ID NO: 9240024 - DNA, 16 bp, Homo sapiens
tgggtgggaggagcgg

SEQ ID NO: 9240025 - DNA, 16 bp, Homo sapiens
tgggtgggaggagcgg

SEQ ID NO: 9240026 - DNA, 21 bp, Homo sapiens
tgggtggaagcgggaggccgc

SEQ ID NO: 9240027 - DNA, 21 bp, Homo sapiens
tgggtggaagcgggaggccgc

SEQ ID NO: 9240028 - DNA, 22 bp, Homo sapiens
tgggtggaataaatcagttctg

SEQ ID NO: 9240029 - DNA, 22 bp, Homo sapiens
tgggtgggagcgccctgtctgg

SEQ ID NO: 9240030 - DNA, 22 bp, Homo sapiens
tgggtgctctgcgaccgtaggg

SEQ ID NO: 9240031 - DNA, 22 bp, Homo sapiens
tgggtgcttcgtcagctctgag

SEQ ID NO: 9240032 - DNA, 22 bp, Homo sapiens
tgggtgaggagaggctgtctaa

SEQ ID NO: 9240033 - DNA, 22 bp, Homo sapiens
tgggtgaggatgatgaggcagc

SEQ ID NO: 9240034 - DNA, 22 bp, Homo sapiens
tgggtgaggagaggctgtctaa

SEQ ID NO: 9240035 - DNA, 22 bp, Homo sapiens
tgggtgagcggctgcacacccg

SEQ ID NO: 9240036 - DNA, 22 bp, Homo sapiens
tgggtgagccacaggagttgtc

SEQ ID NO: 9240037 - DNA, 22 bp, Homo sapiens
tgggtgagccacaggagttgtc

SEQ ID NO: 9240038 - DNA, 22 bp, Homo sapiens
tggtatgtaaattgtaactcaa

SEQ ID NO: 9240039 - DNA, 22 bp, Homo sapiens
tggtatgaccgtggtgcaagca

SEQ ID NO: 9240040 - DNA, 22 bp, Homo sapiens
tggtagggacactatgcagaaa

SEQ ID NO: 9240041 - DNA, 22 bp, Homo sapiens
tggtagggacactatgcagaaa

SEQ ID NO: 9240042 - DNA, 22 bp, Homo sapiens
tggtataagtaatcataattgc

SEQ ID NO: 9240043 - DNA, 22 bp, Homo sapiens
tggtataaaagagtaaactatg

SEQ ID NO: 9240044 - DNA, 22 bp, Homo sapiens
tggtatgtaaattgtaactcaa

SEQ ID NO: 9240045 - DNA, 22 bp, Homo sapiens
tggtatttaagacttcactcct

SEQ ID NO: 9240046 - DNA, 22 bp, Homo sapiens
tgggttggaagcaggaggcacc

SEQ ID NO: 9240047 - DNA, 19 bp, Homo sapiens
tgggttggaagggaatgaa

SEQ ID NO: 9240048 - DNA, 22 bp, Homo sapiens
tgggttctttcacttctcagtt

SEQ ID NO: 9240049 - DNA, 22 bp, Homo sapiens
tgggttctttcacttctcagtt

SEQ ID NO: 9240050 - DNA, 22 bp, Homo sapiens
tgggttctttcacttctcagtt

SEQ ID NO: 9240051 - DNA, 19 bp, Homo sapiens
tgggttggaagggaatgaa

SEQ ID NO: 9240052 - DNA, 22 bp, Homo sapiens
tgggttggtcagcataagatgg

SEQ ID NO: 9240053 - DNA, 22 bp, Homo sapiens
tggtaaggggtggaaccagagc

SEQ ID NO: 9240054 - DNA, 22 bp, Homo sapiens
tggtaagaacccatcagagaag

SEQ ID NO: 9240055 - DNA, 22 bp, Homo sapiens
tggtaaattatttttatatccc

SEQ ID NO: 9240056 - DNA, 22 bp, Homo sapiens
tggtaaatatgtccattctctt

SEQ ID NO: 9240057 - DNA, 22 bp, Homo sapiens
tggtaaatgctattcctatatt

SEQ ID NO: 9240058 - DNA, 22 bp, Homo sapiens
tgggcctcatcttcaatgagtc

SEQ ID NO: 9240059 - DNA, 22 bp, Homo sapiens
tgggcctcatcttcaatgagtc

SEQ ID NO: 9240060 - DNA, 22 bp, Homo sapiens
tgggcctcatcttcaatgagtc

SEQ ID NO: 9240061 - DNA, 22 bp, Homo sapiens
tgggcctcccatgtcttaggga

SEQ ID NO: 9240062 - DNA, 22 bp, Homo sapiens
tgggcctcctgccctggcctag

SEQ ID NO: 9240063 - DNA, 22 bp, Homo sapiens
tgggcctcctggaagaatgtgg

SEQ ID NO: 9240064 - DNA, 22 bp, Homo sapiens
tgggcctcaccttcttggcagc

SEQ ID NO: 9240065 - DNA, 19 bp, Homo sapiens
tgggcctcacaatgctccc

SEQ ID NO: 9240066 - DNA, 22 bp, Homo sapiens
tgggccagttggtgactacaaa

SEQ ID NO: 9240067 - DNA, 22 bp, Homo sapiens
tgggccagttggaatggatact

SEQ ID NO: 9240068 - DNA, 22 bp, Homo sapiens
tgggccagtcctgcctaaggtg

SEQ ID NO: 9240069 - DNA, 22 bp, Homo sapiens
tgggccagtcctgcctaaggtg

SEQ ID NO: 9240070 - DNA, 22 bp, Homo sapiens
tgggccagttatttcacctctg

SEQ ID NO: 9240071 - DNA, 23 bp, Homo sapiens
tgggccagttctgttgaaagcca

SEQ ID NO: 9240072 - DNA, 23 bp, Homo sapiens
tgggccagttctgttgaaagcca

SEQ ID NO: 9240073 - DNA, 22 bp, Homo sapiens
tgggccagttctttactcgtcc

SEQ ID NO: 9240074 - DNA, 22 bp, Homo sapiens
tgggccaggcatgtgatcagca

SEQ ID NO: 9240075 - DNA, 22 bp, Homo sapiens
tgggccaggcatgtgatcagca

SEQ ID NO: 9240076 - DNA, 23 bp, Homo sapiens
tgggccagggagtccggtttctt

SEQ ID NO: 9240077 - DNA, 23 bp, Homo sapiens
tgggccagggagtccggtttctt

SEQ ID NO: 9240078 - DNA, 22 bp, Homo sapiens
tgggccagggcacccagtccag

SEQ ID NO: 9240079 - DNA, 22 bp, Homo sapiens
tgggccaggtctgtgtcagctg

SEQ ID NO: 9240080 - DNA, 22 bp, Homo sapiens
tgggccaggtctgcggtcattt

SEQ ID NO: 9240081 - DNA, 22 bp, Homo sapiens
tgggccaggggcctcttctgat

SEQ ID NO: 9240082 - DNA, 21 bp, Homo sapiens
tgggccagtagaaaggaaggc

SEQ ID NO: 9240083 - DNA, 21 bp, Homo sapiens
tgggccagtagaaaggaaggc

SEQ ID NO: 9240084 - DNA, 22 bp, Homo sapiens
tgggccaggtgcagtgctttag

SEQ ID NO: 9240085 - DNA, 22 bp, Homo sapiens
tgggccagtccagccccaggga

SEQ ID NO: 9240086 - DNA, 22 bp, Homo sapiens
tgggccagtccagccccaggga

SEQ ID NO: 9240087 - DNA, 17 bp, Homo sapiens
tgggccagtagaaggga

SEQ ID NO: 9240088 - DNA, 17 bp, Homo sapiens
tgggccagtagaaggga

SEQ ID NO: 9240089 - DNA, 22 bp, Homo sapiens
tgggccagtagctactcgcaag

SEQ ID NO: 9240090 - DNA, 22 bp, Homo sapiens
tgggccagtagctactcgcaag

SEQ ID NO: 9240091 - DNA, 22 bp, Homo sapiens
tgggcctggggcagcccaaatc

SEQ ID NO: 9240092 - DNA, 22 bp, Homo sapiens
tgggcctgggtctttgctgcca

SEQ ID NO: 9240093 - DNA, 22 bp, Homo sapiens
tgggcctgggctcctgtcctct

SEQ ID NO: 9240094 - DNA, 22 bp, Homo sapiens
tgggcctgggctcctgtcctct

SEQ ID NO: 9240095 - DNA, 23 bp, Homo sapiens
tgggcctggaaagccttagagag

SEQ ID NO: 9240096 - DNA, 22 bp, Homo sapiens
tgggcctgctggggcattttca

SEQ ID NO: 9240097 - DNA, 19 bp, Homo sapiens
tgggcctgcatctgggtct

SEQ ID NO: 9240098 - DNA, 22 bp, Homo sapiens
tgggcctgccccaggcttcagc

SEQ ID NO: 9240099 - DNA, 22 bp, Homo sapiens
tgggcctgattcttgaatcctg

SEQ ID NO: 9240100 - DNA, 22 bp, Homo sapiens
tgggcctgactcacctgcctcc

SEQ ID NO: 9240101 - DNA, 22 bp, Homo sapiens
tgggcctgactcacctgcctcc

SEQ ID NO: 9240102 - DNA, 20 bp, Homo sapiens
tgggcctgagcctgtgggct

SEQ ID NO: 9240103 - DNA, 22 bp, Homo sapiens
tgggcctgactcacctgcctcc

SEQ ID NO: 9240104 - DNA, 22 bp, Homo sapiens
tgggcctgagtttgggaactgg

SEQ ID NO: 9240105 - DNA, 22 bp, Homo sapiens
tgggcctctgtttcctcatctg

SEQ ID NO: 9240106 - DNA, 22 bp, Homo sapiens
tgggcctgaaggagctgcgccc

SEQ ID NO: 9240107 - DNA, 22 bp, Homo sapiens
tgggcctcctttccattcagag

SEQ ID NO: 9240108 - DNA, 22 bp, Homo sapiens
tgggcctcggagcacaggagac

SEQ ID NO: 9240109 - DNA, 23 bp, Homo sapiens
tgggcctctccacccttttctgt

SEQ ID NO: 9240110 - DNA, 22 bp, Homo sapiens
tgggctcagccttcatgtggcc

SEQ ID NO: 9240111 - DNA, 22 bp, Homo sapiens
tgggctagcagggaagagagac

SEQ ID NO: 9240112 - DNA, 22 bp, Homo sapiens
tgggctactctgggagcctaac

SEQ ID NO: 9240113 - DNA, 22 bp, Homo sapiens
tgggcctgtgatgctgggctat

SEQ ID NO: 9240114 - DNA, 22 bp, Homo sapiens
tgggcctgtggcttggctctag

SEQ ID NO: 9240115 - DNA, 22 bp, Homo sapiens
tgggcctgtggcttggctctag

SEQ ID NO: 9240116 - DNA, 22 bp, Homo sapiens
tgggcctgtggcttggctctag

SEQ ID NO: 9240117 - DNA, 22 bp, Homo sapiens
tgggcctgggttcctcctgggc

SEQ ID NO: 9240118 - DNA, 22 bp, Homo sapiens
tgggcctgggttcctcctgggc

SEQ ID NO: 9240119 - DNA, 22 bp, Homo sapiens
tgggcctgtgatgctgggctat

SEQ ID NO: 9240120 - DNA, 22 bp, Homo sapiens
tgggcctgtgatgctgggctat

SEQ ID NO: 9240121 - DNA, 22 bp, Homo sapiens
tgggcgacagagcaagactccg

SEQ ID NO: 9240122 - DNA, 22 bp, Homo sapiens
tgggcctgttgcctgagtccat

SEQ ID NO: 9240123 - DNA, 22 bp, Homo sapiens
tgggcctgttggggttgagtta

SEQ ID NO: 9240124 - DNA, 22 bp, Homo sapiens
tgggctctctggcaggaaggct

SEQ ID NO: 9240125 - DNA, 22 bp, Homo sapiens
tgggctgaaatgctgtggacta

SEQ ID NO: 9240126 - DNA, 22 bp, Homo sapiens
tgggctgagcactgaggaagga

SEQ ID NO: 9240127 - DNA, 20 bp, Homo sapiens
tgggctgaggatcaggtgcc

SEQ ID NO: 9240128 - DNA, 22 bp, Homo sapiens
tgggctgagcactgaggaagga

SEQ ID NO: 9240129 - DNA, 22 bp, Homo sapiens
tgggctgagtgtggaactagtt

SEQ ID NO: 9240130 - DNA, 22 bp, Homo sapiens
tgggctgagtggcagccagagt

SEQ ID NO: 9240131 - DNA, 20 bp, Homo sapiens
tgggctgaggatcaggtgcc

SEQ ID NO: 9240132 - DNA, 22 bp, Homo sapiens
tgggctgaaatgctgtggacta

SEQ ID NO: 9240133 - DNA, 22 bp, Homo sapiens
tgggctctggtttcctggctgg

SEQ ID NO: 9240134 - DNA, 22 bp, Homo sapiens
tgggctgcaccctcagcctctg

SEQ ID NO: 9240135 - DNA, 22 bp, Homo sapiens
tgggctgcccaaggtggccatg

SEQ ID NO: 9240136 - DNA, 22 bp, Homo sapiens
tgggccagcaattgctgctcag

SEQ ID NO: 9240137 - DNA, 22 bp, Homo sapiens
tgggccacgtcatctcccacaa

SEQ ID NO: 9240138 - DNA, 22 bp, Homo sapiens
tgggccacgggggtggagagct

SEQ ID NO: 9240139 - DNA, 22 bp, Homo sapiens
tgggccacaagccatgggacca

SEQ ID NO: 9240140 - DNA, 22 bp, Homo sapiens
tgggccacacacagaagaatca

SEQ ID NO: 9240141 - DNA, 22 bp, Homo sapiens
tgggccacaagccatgggacca

SEQ ID NO: 9240142 - DNA, 22 bp, Homo sapiens
tgggccacagctcacacatcca

SEQ ID NO: 9240143 - DNA, 22 bp, Homo sapiens
tgggccacattccaaaccagct

SEQ ID NO: 9240144 - DNA, 22 bp, Homo sapiens
tgggccagctgaagtgccgccc

SEQ ID NO: 9240145 - DNA, 22 bp, Homo sapiens
tgggccagctgaagtgccgccc

SEQ ID NO: 9240146 - DNA, 22 bp, Homo sapiens
tgggccaggatttcaagaccct

SEQ ID NO: 9240147 - DNA, 22 bp, Homo sapiens
tgggccaggatttcaagaccct

SEQ ID NO: 9240148 - DNA, 22 bp, Homo sapiens
tgggccaggatttcaagaccct

SEQ ID NO: 9240149 - DNA, 22 bp, Homo sapiens
tgggccagcactgggtgctcat

SEQ ID NO: 9240150 - DNA, 22 bp, Homo sapiens
tgggccagctccctgcccctgg

SEQ ID NO: 9240151 - DNA, 19 bp, Homo sapiens
tgggcagtgccagggctta

SEQ ID NO: 9240152 - DNA, 19 bp, Homo sapiens
tgggcagtgccagggctta

SEQ ID NO: 9240153 - DNA, 22 bp, Homo sapiens
tgggcatgaagaaggaagtggg

SEQ ID NO: 9240154 - DNA, 23 bp, Homo sapiens
tgggcatctcctctgtgccaggc

SEQ ID NO: 9240155 - DNA, 22 bp, Homo sapiens
tgggcagttgctcctcagaccc

SEQ ID NO: 9240156 - DNA, 22 bp, Homo sapiens
tgggcatcatggacagcagagg

SEQ ID NO: 9240157 - DNA, 23 bp, Homo sapiens
tgggcatctcctctgtgccaggc

SEQ ID NO: 9240158 - DNA, 19 bp, Homo sapiens
tgggcaggttcagtaatgg

SEQ ID NO: 9240159 - DNA, 19 bp, Homo sapiens
tgggcaggttcagtaatgg

SEQ ID NO: 9240160 - DNA, 19 bp, Homo sapiens
tgggcaggttcagtaatgg

SEQ ID NO: 9240161 - DNA, 22 bp, Homo sapiens
tgggcaggggccctgcttccgt

SEQ ID NO: 9240162 - DNA, 22 bp, Homo sapiens
tgggcaggggccctgcttccgt

SEQ ID NO: 9240163 - DNA, 22 bp, Homo sapiens
tgggcaggggccctgcttccgt

SEQ ID NO: 9240164 - DNA, 22 bp, Homo sapiens
tgggcaggggccctgcttccgt

SEQ ID NO: 9240165 - DNA, 22 bp, Homo sapiens
tgggcagggtctctgttatcag

SEQ ID NO: 9240166 - DNA, 23 bp, Homo sapiens
tgggcagcttctgcatgcccacc

SEQ ID NO: 9240167 - DNA, 19 bp, Homo sapiens
tgggcagctccctctgtcc

SEQ ID NO: 9240168 - DNA, 22 bp, Homo sapiens
tgggcagccatcccagcctctc

SEQ ID NO: 9240169 - DNA, 22 bp, Homo sapiens
tgggcagcatcctccacagtca

SEQ ID NO: 9240170 - DNA, 22 bp, Homo sapiens
tgggcaggagagaagctaaaga

SEQ ID NO: 9240171 - DNA, 22 bp, Homo sapiens
tgggcaggagagaagctaaaga

SEQ ID NO: 9240172 - DNA, 22 bp, Homo sapiens
tgggcagggatctcttttgcaa

SEQ ID NO: 9240173 - DNA, 22 bp, Homo sapiens
tgggcagggagctggaaccaca

SEQ ID NO: 9240174 - DNA, 22 bp, Homo sapiens
tgggcagggagctggaaccaca

SEQ ID NO: 9240175 - DNA, 22 bp, Homo sapiens
tgggcagggagctggaaccaca

SEQ ID NO: 9240176 - DNA, 22 bp, Homo sapiens
tgggcaggggccctgcttccgt

SEQ ID NO: 9240177 - DNA, 22 bp, Homo sapiens
tgggcagggatctcttttgcaa

SEQ ID NO: 9240178 - DNA, 22 bp, Homo sapiens
tgggcaggggccctgcttccgt

SEQ ID NO: 9240179 - DNA, 22 bp, Homo sapiens
tgggcagagtcgtggggaatag

SEQ ID NO: 9240180 - DNA, 22 bp, Homo sapiens
tgggcagatctttggtggctag

SEQ ID NO: 9240181 - DNA, 22 bp, Homo sapiens
tgggcagattaatgcagtggct

SEQ ID NO: 9240182 - DNA, 22 bp, Homo sapiens
tgggcagatgtcctctgaagtg

SEQ ID NO: 9240183 - DNA, 22 bp, Homo sapiens
tgggcagattaatgcagtggct

SEQ ID NO: 9240184 - DNA, 22 bp, Homo sapiens
tgggcagattaatgcagtggct

SEQ ID NO: 9240185 - DNA, 22 bp, Homo sapiens
tgggcagattaatgcagtggct

SEQ ID NO: 9240186 - DNA, 20 bp, Homo sapiens
tgggcagcactgctggctgg

SEQ ID NO: 9240187 - DNA, 20 bp, Homo sapiens
tgggcagcactgctggctgg

SEQ ID NO: 9240188 - DNA, 22 bp, Homo sapiens
tgggcagcaaagactgtgtgct

SEQ ID NO: 9240189 - DNA, 22 bp, Homo sapiens
tgggcagcagcaaagccagact

SEQ ID NO: 9240190 - DNA, 22 bp, Homo sapiens
tgggcagcagcaaagccagact

SEQ ID NO: 9240191 - DNA, 22 bp, Homo sapiens
tgggcagcatcctccacagtca

SEQ ID NO: 9240192 - DNA, 20 bp, Homo sapiens
tgggcagcactgctggctgg

SEQ ID NO: 9240193 - DNA, 22 bp, Homo sapiens
tgggcagcagaaccaggccgac

SEQ ID NO: 9240194 - DNA, 22 bp, Homo sapiens
tgggaggcaggtaggtgatgat

SEQ ID NO: 9240195 - DNA, 22 bp, Homo sapiens
tgggaggccaaggcaggcggat

SEQ ID NO: 9240196 - DNA, 22 bp, Homo sapiens
tgggaggccgaggcaggtggat

SEQ ID NO: 9240197 - DNA, 22 bp, Homo sapiens
tgggaggcttccagaccttgct

SEQ ID NO: 9240198 - DNA, 22 bp, Homo sapiens
tgggaggtctcttgcggcctag

SEQ ID NO: 9240199 - DNA, 20 bp, Homo sapiens
tgggagtacaatcatgagca

SEQ ID NO: 9240200 - DNA, 22 bp, Homo sapiens
tgggagtagatgaggagtgggc

SEQ ID NO: 9240201 - DNA, 22 bp, Homo sapiens
tgggatagtagctgagagacaa

SEQ ID NO: 9240202 - DNA, 22 bp, Homo sapiens
tgggatgagaagtgcgagggtt

SEQ ID NO: 9240203 - DNA, 22 bp, Homo sapiens
tgggatgaatacaatgggatca

SEQ ID NO: 9240204 - DNA, 22 bp, Homo sapiens
tgggatagattgatggatagag

SEQ ID NO: 9240205 - DNA, 22 bp, Homo sapiens
tgggatagggctattgctcaca

SEQ ID NO: 9240206 - DNA, 22 bp, Homo sapiens
tgggagtgatacagtatggaat

SEQ ID NO: 9240207 - DNA, 23 bp, Homo sapiens
tgggatggattcaccagtgtgct

SEQ ID NO: 9240208 - DNA, 23 bp, Homo sapiens
tgggatggattcaccagtgtgct

SEQ ID NO: 9240209 - DNA, 23 bp, Homo sapiens
tgggatggattcaccagtgtgct

SEQ ID NO: 9240210 - DNA, 22 bp, Homo sapiens
tgggatggagcctgagtatagt

SEQ ID NO: 9240211 - DNA, 23 bp, Homo sapiens
tgggatggattcaccagtgtgct

SEQ ID NO: 9240212 - DNA, 22 bp, Homo sapiens
tgggatggcatcctgggccttg

SEQ ID NO: 9240213 - DNA, 23 bp, Homo sapiens
tgggatggattcaccagtgtgct

SEQ ID NO: 9240214 - DNA, 18 bp, Homo sapiens
tgggatggagagtaactg

SEQ ID NO: 9240215 - DNA, 18 bp, Homo sapiens
tgggatggagagtaactg

SEQ ID NO: 9240216 - DNA, 22 bp, Homo sapiens
tgggatgccctgaccctctgga

SEQ ID NO: 9240217 - DNA, 18 bp, Homo sapiens
tgggatggagagtaactg

SEQ ID NO: 9240218 - DNA, 22 bp, Homo sapiens
tgggcagagtcatacaggagac

SEQ ID NO: 9240219 - DNA, 22 bp, Homo sapiens
tgggcagagtcatacaggagac

SEQ ID NO: 9240220 - DNA, 22 bp, Homo sapiens
tgggcagagtcatacaggagac

SEQ ID NO: 9240221 - DNA, 22 bp, Homo sapiens
tgggcagagtcatacaggagac

SEQ ID NO: 9240222 - DNA, 22 bp, Homo sapiens
tgggcagagtcgtggggaatag

SEQ ID NO: 9240223 - DNA, 22 bp, Homo sapiens
tgggcagaggacagggaagatc

SEQ ID NO: 9240224 - DNA, 22 bp, Homo sapiens
tgggcagaggacagggaagatc

SEQ ID NO: 9240225 - DNA, 22 bp, Homo sapiens
tgggcagaggctctgaagtcca

SEQ ID NO: 9240226 - DNA, 22 bp, Homo sapiens
tgggcagaggacagggaagatc

SEQ ID NO: 9240227 - DNA, 22 bp, Homo sapiens
tgggcagagatctggatcaaac

SEQ ID NO: 9240228 - DNA, 22 bp, Homo sapiens
tgggcagagagtagaggcaacg

SEQ ID NO: 9240229 - DNA, 22 bp, Homo sapiens
tgggcagagatctggatcaaac

SEQ ID NO: 9240230 - DNA, 22 bp, Homo sapiens
tgggcacatagttttatggtca

SEQ ID NO: 9240231 - DNA, 22 bp, Homo sapiens
tgggcacaggggtaggaatgag

SEQ ID NO: 9240232 - DNA, 22 bp, Homo sapiens
tgggcacaggggaatggatgaa

SEQ ID NO: 9240233 - DNA, 22 bp, Homo sapiens
tgggcagagagtagaggcaacg

SEQ ID NO: 9240234 - DNA, 22 bp, Homo sapiens
tgggcactatggctctgtgcac

SEQ ID NO: 9240235 - DNA, 22 bp, Homo sapiens
tgggcactcaggctgaggccgt

SEQ ID NO: 9240236 - DNA, 22 bp, Homo sapiens
tgggcacaaacatctgcctgtt

SEQ ID NO: 9240237 - DNA, 22 bp, Homo sapiens
tgggcacaaacatctgcctgtt

SEQ ID NO: 9240238 - DNA, 22 bp, Homo sapiens
tgggcacaaacatctgcctgtt

SEQ ID NO: 9240239 - DNA, 18 bp, Homo sapiens
tgggcacaatgaacagca

SEQ ID NO: 9240240 - DNA, 22 bp, Homo sapiens
tgggcacagagtcccatctgcc

SEQ ID NO: 9240241 - DNA, 22 bp, Homo sapiens
tgggcacagagtcccatctgcc

SEQ ID NO: 9240242 - DNA, 22 bp, Homo sapiens
tgggcacagaatagatggccca

SEQ ID NO: 9240243 - DNA, 22 bp, Homo sapiens
tgggcacagaatagatggccca

SEQ ID NO: 9240244 - DNA, 22 bp, Homo sapiens
tgggcaagtcacttctgtcttt

SEQ ID NO: 9240245 - DNA, 22 bp, Homo sapiens
tgggcaagtatcggactctgag

SEQ ID NO: 9240246 - DNA, 22 bp, Homo sapiens
tgggcaagtatcggactctgag

SEQ ID NO: 9240247 - DNA, 22 bp, Homo sapiens
tgggcaagggacaggcctggct

SEQ ID NO: 9240248 - DNA, 22 bp, Homo sapiens
tgggatggcatcctgggccttg

SEQ ID NO: 9240249 - DNA, 22 bp, Homo sapiens
tgggatggcctttgaaagccag

SEQ ID NO: 9240250 - DNA, 22 bp, Homo sapiens
tgggatgggatctcgctgtgtc

SEQ ID NO: 9240251 - DNA, 21 bp, Homo sapiens
tgggatgggtctgggaccagc

SEQ ID NO: 9240252 - DNA, 21 bp, Homo sapiens
tgggatgggtctgggaccagc

SEQ ID NO: 9240253 - DNA, 22 bp, Homo sapiens
tgggatgggatctcgctgtgtc

SEQ ID NO: 9240254 - DNA, 22 bp, Homo sapiens
tgggatgtctttaggggaagag

SEQ ID NO: 9240255 - DNA, 21 bp, Homo sapiens
tgggatgggtctgggaccagc

SEQ ID NO: 9240256 - DNA, 22 bp, Homo sapiens
tgggatgtggccatggttctct

SEQ ID NO: 9240257 - DNA, 22 bp, Homo sapiens
tgggattcaccatgggcttcag

SEQ ID NO: 9240258 - DNA, 22 bp, Homo sapiens
tgggcaaatgtcactttctttt

SEQ ID NO: 9240259 - DNA, 19 bp, Homo sapiens
tgtcaggggtgtgctgtgc

SEQ ID NO: 9240260 - DNA, 18 bp, Homo sapiens
tgtcagtaaagtgacaga

SEQ ID NO: 9240261 - DNA, 22 bp, Homo sapiens
tgtcagaactctattgatgtcc

SEQ ID NO: 9240262 - DNA, 22 bp, Homo sapiens
tgtcaggagggtccagagaaaa

SEQ ID NO: 9240263 - DNA, 22 bp, Homo sapiens
tgtcactttggggagagttttg

SEQ ID NO: 9240264 - DNA, 21 bp, Homo sapiens
tgtcagaaataagcatgtgat

SEQ ID NO: 9240265 - DNA, 22 bp, Homo sapiens
tgtcacttggagaagctgatcc

SEQ ID NO: 9240266 - DNA, 19 bp, Homo sapiens
tgtcactgtcatggcccag

SEQ ID NO: 9240267 - DNA, 22 bp, Homo sapiens
tgtcacttcaggaatgcaggga

SEQ ID NO: 9240268 - DNA, 22 bp, Homo sapiens
tgtcactacatcataaatatat

SEQ ID NO: 9240269 - DNA, 22 bp, Homo sapiens
tgtcagtggtagacccagaggt

SEQ ID NO: 9240270 - DNA, 22 bp, Homo sapiens
tgtcagtggtcatagtagaaaa

SEQ ID NO: 9240271 - DNA, 22 bp, Homo sapiens
tgtcagtgtctatgaagaattt

SEQ ID NO: 9240272 - DNA, 22 bp, Homo sapiens
tgtcagtgtatacatacagtat

SEQ ID NO: 9240273 - DNA, 20 bp, Homo sapiens
tgtcagtgcctgaggcacag

SEQ ID NO: 9240274 - DNA, 22 bp, Homo sapiens
tgtcagtgagttagttgcaagt

SEQ ID NO: 9240275 - DNA, 22 bp, Homo sapiens
tgtcagtttagttgaagaaaga

SEQ ID NO: 9240276 - DNA, 22 bp, Homo sapiens
tgtcagttcaattatagtaatt

SEQ ID NO: 9240277 - DNA, 22 bp, Homo sapiens
tgtcagttcaattatagtaatt

SEQ ID NO: 9240278 - DNA, 22 bp, Homo sapiens
tgtcataacttagtgacaaatc

SEQ ID NO: 9240279 - DNA, 22 bp, Homo sapiens
tgtcatttggactttggtatta

SEQ ID NO: 9240280 - DNA, 22 bp, Homo sapiens
tgtcattttagtgcatcactca

SEQ ID NO: 9240281 - DNA, 22 bp, Homo sapiens
tgtcatttattttgctgtctgt

SEQ ID NO: 9240282 - DNA, 22 bp, Homo sapiens
tgtcatttcacaatatcactca

SEQ ID NO: 9240283 - DNA, 22 bp, Homo sapiens
tgtcatttcacaatatcactca

SEQ ID NO: 9240284 - DNA, 22 bp, Homo sapiens
tgtcatttcacaatatcactca

SEQ ID NO: 9240285 - DNA, 22 bp, Homo sapiens
tgtcatttcctgaatgctgagt

SEQ ID NO: 9240286 - DNA, 22 bp, Homo sapiens
tgtcatttcacaatatcactca

SEQ ID NO: 9240287 - DNA, 22 bp, Homo sapiens
tgtcattttctaatctgttgtc

SEQ ID NO: 9240288 - DNA, 22 bp, Homo sapiens
tgtcattttctaatctgttgtc

SEQ ID NO: 9240289 - DNA, 22 bp, Homo sapiens
tgtcattttcatcctaaggagc

SEQ ID NO: 9240290 - DNA, 22 bp, Homo sapiens
tgtcattttcagcttatgcttc

SEQ ID NO: 9240291 - DNA, 22 bp, Homo sapiens
tgtcattttcagcttatgcttc

SEQ ID NO: 9240292 - DNA, 22 bp, Homo sapiens
tgtccacatcactcacttgtca

SEQ ID NO: 9240293 - DNA, 22 bp, Homo sapiens
tgtccacatcactcacttgtca

SEQ ID NO: 9240294 - DNA, 22 bp, Homo sapiens
tgtcattttgtctcactgctat

SEQ ID NO: 9240295 - DNA, 22 bp, Homo sapiens
tgtcattttcagcttatgcttc

SEQ ID NO: 9240296 - DNA, 22 bp, Homo sapiens
tgtcatttaatagatatgatgg

SEQ ID NO: 9240297 - DNA, 22 bp, Homo sapiens
tgtcatttactccataccctca

SEQ ID NO: 9240298 - DNA, 22 bp, Homo sapiens
tgtcatttactccataccctca

SEQ ID NO: 9240299 - DNA, 22 bp, Homo sapiens
tgtcatttaatagatatgatgg

SEQ ID NO: 9240300 - DNA, 22 bp, Homo sapiens
tgtcatttagtcctctgtgtgt

SEQ ID NO: 9240301 - DNA, 22 bp, Homo sapiens
tgtcatttaaagctttccagat

SEQ ID NO: 9240302 - DNA, 22 bp, Homo sapiens
tgtcattggtacaaattgattg

SEQ ID NO: 9240303 - DNA, 20 bp, Homo sapiens
tgtcattcttctttcacagg

SEQ ID NO: 9240304 - DNA, 20 bp, Homo sapiens
tgtcatttatttatcaaatg

SEQ ID NO: 9240305 - DNA, 22 bp, Homo sapiens
tgtcatttattttgctgtctgt

SEQ ID NO: 9240306 - DNA, 20 bp, Homo sapiens
tgtcatttatttatcaaatg

SEQ ID NO: 9240307 - DNA, 22 bp, Homo sapiens
tgtcatttattctcttattcta

SEQ ID NO: 9240308 - DNA, 22 bp, Homo sapiens
tgtcatttattctcttattcta

SEQ ID NO: 9240309 - DNA, 22 bp, Homo sapiens
tgtcatttatcttatagtaatc

SEQ ID NO: 9240310 - DNA, 22 bp, Homo sapiens
tgtcatttatgcttcttcagtg

SEQ ID NO: 9240311 - DNA, 22 bp, Homo sapiens
tgtcatttatcttatagtaatc

SEQ ID NO: 9240312 - DNA, 22 bp, Homo sapiens
tgtcatctcactgatatagatg

SEQ ID NO: 9240313 - DNA, 22 bp, Homo sapiens
tgtcatcatttgagagaagaaa

SEQ ID NO: 9240314 - DNA, 22 bp, Homo sapiens
tgtcatctgcgggtggcactgc

SEQ ID NO: 9240315 - DNA, 22 bp, Homo sapiens
tgtcattccttcaatgtagata

SEQ ID NO: 9240316 - DNA, 22 bp, Homo sapiens
tgtcatgatgtgcacaccacag

SEQ ID NO: 9240317 - DNA, 22 bp, Homo sapiens
tgtccccaaggttcagcccaca

SEQ ID NO: 9240318 - DNA, 20 bp, Homo sapiens
tgtccccaccaaaatttcat

SEQ ID NO: 9240319 - DNA, 22 bp, Homo sapiens
tgtcccatggataccaggctat

SEQ ID NO: 9240320 - DNA, 22 bp, Homo sapiens
tgtccccaggtcctctgccgtc

SEQ ID NO: 9240321 - DNA, 22 bp, Homo sapiens
tgtccccagagcctgttcctgc

SEQ ID NO: 9240322 - DNA, 22 bp, Homo sapiens
tgtccccacccaaatctcatct

SEQ ID NO: 9240323 - DNA, 20 bp, Homo sapiens
tgtcccctagatcccagctc

SEQ ID NO: 9240324 - DNA, 20 bp, Homo sapiens
tgtcccctagatcccagctc

SEQ ID NO: 9240325 - DNA, 22 bp, Homo sapiens
tgtcccctgcccagggatggga

SEQ ID NO: 9240326 - DNA, 22 bp, Homo sapiens
tgtccctcattgacgctgtgcc

SEQ ID NO: 9240327 - DNA, 22 bp, Homo sapiens
tgtcccctttctttccttcgta

SEQ ID NO: 9240328 - DNA, 22 bp, Homo sapiens
tgtcccctttacctccgcagcc

SEQ ID NO: 9240329 - DNA, 18 bp, Homo sapiens
tgtccctgcaaataacat

SEQ ID NO: 9240330 - DNA, 18 bp, Homo sapiens
tgtccctgcaaataacat

SEQ ID NO: 9240331 - DNA, 18 bp, Homo sapiens
tgtccctgcaaataacat

SEQ ID NO: 9240332 - DNA, 22 bp, Homo sapiens
tgtccctgctgtacttagagca

SEQ ID NO: 9240333 - DNA, 22 bp, Homo sapiens
tgtccctctgaggcttccctgg

SEQ ID NO: 9240334 - DNA, 22 bp, Homo sapiens
tgtccctggagcttctgtcccc

SEQ ID NO: 9240335 - DNA, 20 bp, Homo sapiens
tgtcctaatagacaagcaga

SEQ ID NO: 9240336 - DNA, 22 bp, Homo sapiens
tgtccctggagcttctgtcccc

SEQ ID NO: 9240337 - DNA, 22 bp, Homo sapiens
tgtccctggaactatggctcca

SEQ ID NO: 9240338 - DNA, 22 bp, Homo sapiens
tgtccaggtgtgtctaaagaga

SEQ ID NO: 9240339 - DNA, 22 bp, Homo sapiens
tgtcccagcagctgggttctct

SEQ ID NO: 9240340 - DNA, 22 bp, Homo sapiens
tgtcccagtcaaggctgtcatc

SEQ ID NO: 9240341 - DNA, 22 bp, Homo sapiens
tgtcccagttgggtattgaatt

SEQ ID NO: 9240342 - DNA, 22 bp, Homo sapiens
tgtcccagttcccagggttgct

SEQ ID NO: 9240343 - DNA, 22 bp, Homo sapiens
tgtcccagtttatctgggactg

SEQ ID NO: 9240344 - DNA, 22 bp, Homo sapiens
tgtcccatggacacaacttctt

SEQ ID NO: 9240345 - DNA, 22 bp, Homo sapiens
tgtcccagttttgcaggttaga

SEQ ID NO: 9240346 - DNA, 22 bp, Homo sapiens
tgtcccaggctgaagtacagtg

SEQ ID NO: 9240347 - DNA, 22 bp, Homo sapiens
tgtcccaggcctcatgttgcca

SEQ ID NO: 9240348 - DNA, 22 bp, Homo sapiens
tgtcccaggtcctagatgacca

SEQ ID NO: 9240349 - DNA, 22 bp, Homo sapiens
tgtcccagggaaggcccagcac

SEQ ID NO: 9240350 - DNA, 22 bp, Homo sapiens
tgtcctgggtggatgcttcatt

SEQ ID NO: 9240351 - DNA, 22 bp, Homo sapiens
tgtcctggtgctccaggtggct

SEQ ID NO: 9240352 - DNA, 22 bp, Homo sapiens
tgtcctggtgctccaggtggct

SEQ ID NO: 9240353 - DNA, 22 bp, Homo sapiens
tgtcctgtgccaccttcctgag

SEQ ID NO: 9240354 - DNA, 22 bp, Homo sapiens
tgtccttagaagaagtgaaaga

SEQ ID NO: 9240355 - DNA, 22 bp, Homo sapiens
tgtccttagggatataaaatat

SEQ ID NO: 9240356 - DNA, 22 bp, Homo sapiens
tgtccttataagaaaaggaaat

SEQ ID NO: 9240357 - DNA, 22 bp, Homo sapiens
tgtccttatctccaaacaatca

SEQ ID NO: 9240358 - DNA, 22 bp, Homo sapiens
tgtccttgatgaatatgaaatt

SEQ ID NO: 9240359 - DNA, 22 bp, Homo sapiens
tgtcctgttctggcgtgagtgg

SEQ ID NO: 9240360 - DNA, 22 bp, Homo sapiens
tgtcctgttatatgttgggtag

SEQ ID NO: 9240361 - DNA, 22 bp, Homo sapiens
tgtcctttactgattgcttctg

SEQ ID NO: 9240362 - DNA, 22 bp, Homo sapiens
tgtccttgttcctaatgtaaaa

SEQ ID NO: 9240363 - DNA, 22 bp, Homo sapiens
tgtcctttatgaaatggtgttt

SEQ ID NO: 9240364 - DNA, 22 bp, Homo sapiens
tgtcctttgtgtatctatagta

SEQ ID NO: 9240365 - DNA, 22 bp, Homo sapiens
tgtcctttgttccctgtctctg

SEQ ID NO: 9240366 - DNA, 22 bp, Homo sapiens
tgtcctttttcttaggaaatat

SEQ ID NO: 9240367 - DNA, 22 bp, Homo sapiens
tgtccttttggctgtctatggt

SEQ ID NO: 9240368 - DNA, 22 bp, Homo sapiens
tgtcctgggaatgggatgcagt

SEQ ID NO: 9240369 - DNA, 22 bp, Homo sapiens
tgtcctggggacaagaggccct

SEQ ID NO: 9240370 - DNA, 22 bp, Homo sapiens
tgtcctcagatatgtctactct

SEQ ID NO: 9240371 - DNA, 22 bp, Homo sapiens
tgtcctcagatatgtctactct

SEQ ID NO: 9240372 - DNA, 22 bp, Homo sapiens
tgtcctcaaggagcttcagtct

SEQ ID NO: 9240373 - DNA, 19 bp, Homo sapiens
tgtcctcacagagcataac

SEQ ID NO: 9240374 - DNA, 22 bp, Homo sapiens
tgtcctcacaggaatgaacttt

SEQ ID NO: 9240375 - DNA, 22 bp, Homo sapiens
tgtcctcacaggaatgaacttt

SEQ ID NO: 9240376 - DNA, 22 bp, Homo sapiens
tgtagatgagtcagggtgcacc

SEQ ID NO: 9240377 - DNA, 22 bp, Homo sapiens
tgtagatgagtcagggtgcatg

SEQ ID NO: 9240378 - DNA, 22 bp, Homo sapiens
tgtagatatagaaaaagactga

SEQ ID NO: 9240379 - DNA, 22 bp, Homo sapiens
tgtagcagagtatctctgtttt

SEQ ID NO: 9240380 - DNA, 19 bp, Homo sapiens
tgtagcagtttaaaacaac

SEQ ID NO: 9240381 - DNA, 22 bp, Homo sapiens
tgtagcagtgtctaccacatta

SEQ ID NO: 9240382 - DNA, 22 bp, Homo sapiens
tgtagcacaagatagatacttc

SEQ ID NO: 9240383 - DNA, 20 bp, Homo sapiens
tgtagccagcctctcaatgc

SEQ ID NO: 9240384 - DNA, 22 bp, Homo sapiens
tgtagcattttatgtaataagt

SEQ ID NO: 9240385 - DNA, 22 bp, Homo sapiens
tgtagctctccagccagcaagg

SEQ ID NO: 9240386 - DNA, 23 bp, Homo sapiens
tgtagctttatacaagatctgtt

SEQ ID NO: 9240387 - DNA, 22 bp, Homo sapiens
tgtaggaaaaacaatgatctgc

SEQ ID NO: 9240388 - DNA, 22 bp, Homo sapiens
tgtataaaccatggacagcttt

SEQ ID NO: 9240389 - DNA, 22 bp, Homo sapiens
tgtagaagttcttcaggagaat

SEQ ID NO: 9240390 - DNA, 22 bp, Homo sapiens
tgtagacagtgggatctctggg

SEQ ID NO: 9240391 - DNA, 18 bp, Homo sapiens
tgtagagccaggtttgcc

SEQ ID NO: 9240392 - DNA, 22 bp, Homo sapiens
tgtagaagtaggagtcatctca

SEQ ID NO: 9240393 - DNA, 22 bp, Homo sapiens
tgtagaagctagcctggagcca

SEQ ID NO: 9240394 - DNA, 22 bp, Homo sapiens
tgtagaactgacattttggact

SEQ ID NO: 9240395 - DNA, 22 bp, Homo sapiens
tgtagaacctgtttattataga

SEQ ID NO: 9240396 - DNA, 22 bp, Homo sapiens
tgtagaaattagtaagatcaac

SEQ ID NO: 9240397 - DNA, 22 bp, Homo sapiens
tgtagaaattagtaagatcaac

SEQ ID NO: 9240398 - DNA, 22 bp, Homo sapiens
tgtagaaagaatatgtttcata

SEQ ID NO: 9240399 - DNA, 22 bp, Homo sapiens
tgtagaaagaatatgtttcata

SEQ ID NO: 9240400 - DNA, 22 bp, Homo sapiens
tgtagaaagctcttctgaaatc

SEQ ID NO: 9240401 - DNA, 22 bp, Homo sapiens
tgtactaatgcatttaactaac

SEQ ID NO: 9240402 - DNA, 22 bp, Homo sapiens
tgtacttccccaatgacagcac

SEQ ID NO: 9240403 - DNA, 22 bp, Homo sapiens
tgtagaaaattggagcattcat

SEQ ID NO: 9240404 - DNA, 22 bp, Homo sapiens
tgtacttgcttattagaaatct

SEQ ID NO: 9240405 - DNA, 22 bp, Homo sapiens
tgtatacattctcttgggtttg

SEQ ID NO: 9240406 - DNA, 22 bp, Homo sapiens
tgtatacatttaactagataga

SEQ ID NO: 9240407 - DNA, 22 bp, Homo sapiens
tgtatataagcatttacttgtt

SEQ ID NO: 9240408 - DNA, 22 bp, Homo sapiens
tgtatagagttggaagatgact

SEQ ID NO: 9240409 - DNA, 22 bp, Homo sapiens
tgtatagagttggaagatgact

SEQ ID NO: 9240410 - DNA, 22 bp, Homo sapiens
tgtataaacttaagcaggaacc

SEQ ID NO: 9240411 - DNA, 22 bp, Homo sapiens
tgtataaatttaaattcctgct

SEQ ID NO: 9240412 - DNA, 22 bp, Homo sapiens
tgtataaatttaaattcctgct

SEQ ID NO: 9240413 - DNA, 22 bp, Homo sapiens
tgtataaatttaaattcctgct

SEQ ID NO: 9240414 - DNA, 22 bp, Homo sapiens
tgtataaacttaagcaggaacc

SEQ ID NO: 9240415 - DNA, 22 bp, Homo sapiens
tgtataagtgtgtagagtaaga

SEQ ID NO: 9240416 - DNA, 22 bp, Homo sapiens
tgtataagcctagtgaaatttc

SEQ ID NO: 9240417 - DNA, 21 bp, Homo sapiens
tgtataacaactatgcaatgt

SEQ ID NO: 9240418 - DNA, 23 bp, Homo sapiens
tgtatacaccctgtgcatctggg

SEQ ID NO: 9240419 - DNA, 22 bp, Homo sapiens
tgtatgaatgggaaaaggaaac

SEQ ID NO: 9240420 - DNA, 22 bp, Homo sapiens
tgtatgaggcatacatcaggca

SEQ ID NO: 9240421 - DNA, 22 bp, Homo sapiens
tgtatgaacctttaatatagtg

SEQ ID NO: 9240422 - DNA, 22 bp, Homo sapiens
tgtatgaaaaggaatagattga

SEQ ID NO: 9240423 - DNA, 22 bp, Homo sapiens
tgtatctttctgtacttttatg

SEQ ID NO: 9240424 - DNA, 22 bp, Homo sapiens
tgtatgaaaaggaatagattga

SEQ ID NO: 9240425 - DNA, 22 bp, Homo sapiens
tgtatcaaaccaaattaattct

SEQ ID NO: 9240426 - DNA, 22 bp, Homo sapiens
tgtatcaaaccaaattaattct

SEQ ID NO: 9240427 - DNA, 22 bp, Homo sapiens
tgtatcaaaccaaattaattct

SEQ ID NO: 9240428 - DNA, 22 bp, Homo sapiens
tgtatcaagggtttatgtaagc

SEQ ID NO: 9240429 - DNA, 22 bp, Homo sapiens
tgtatcaagggtttatgtaagc

SEQ ID NO: 9240430 - DNA, 22 bp, Homo sapiens
tgtatatacatacacacatgaa

SEQ ID NO: 9240431 - DNA, 22 bp, Homo sapiens
tgtatatatttctttcattcta

SEQ ID NO: 9240432 - DNA, 22 bp, Homo sapiens
tgtatatatttctttcattcta

SEQ ID NO: 9240433 - DNA, 22 bp, Homo sapiens
tgtcacagtttgtactttatag

SEQ ID NO: 9240434 - DNA, 22 bp, Homo sapiens
tgtcacataggcaaaatgtttt

SEQ ID NO: 9240435 - DNA, 22 bp, Homo sapiens
tgtcacataggcaaaatgtttt

SEQ ID NO: 9240436 - DNA, 22 bp, Homo sapiens
tgtcacataatttatctgtagg

SEQ ID NO: 9240437 - DNA, 22 bp, Homo sapiens
tgtcaccatgcgaggctaattt

SEQ ID NO: 9240438 - DNA, 22 bp, Homo sapiens
tgtcacctctttggctgcagct

SEQ ID NO: 9240439 - DNA, 22 bp, Homo sapiens
tgtcaccatgccagcttctgcc

SEQ ID NO: 9240440 - DNA, 22 bp, Homo sapiens
tgtcaccatgccagcttctgcc

SEQ ID NO: 9240441 - DNA, 22 bp, Homo sapiens
tgtcaccaagttgatgaatgca

SEQ ID NO: 9240442 - DNA, 22 bp, Homo sapiens
tgtcaccactggctgaaacacc

SEQ ID NO: 9240443 - DNA, 22 bp, Homo sapiens
tgtcaccagttccaggaaataa

SEQ ID NO: 9240444 - DNA, 22 bp, Homo sapiens
tgtcaccagctgctcctcagga

SEQ ID NO: 9240445 - DNA, 22 bp, Homo sapiens
tgtcacatgtttaatgtggact

SEQ ID NO: 9240446 - DNA, 22 bp, Homo sapiens
tgtcacatgtgtggcatttttc

SEQ ID NO: 9240447 - DNA, 22 bp, Homo sapiens
tgtcacatgacacaaatatcta

SEQ ID NO: 9240448 - DNA, 22 bp, Homo sapiens
tgtcacattgaatatgatttat

SEQ ID NO: 9240449 - DNA, 22 bp, Homo sapiens
tgtcacattgaatatgatttat

SEQ ID NO: 9240450 - DNA, 22 bp, Homo sapiens
tgtcacattgaatatgatttat

SEQ ID NO: 9240451 - DNA, 23 bp, Homo sapiens
tgtcacatttagttggcattgtt

SEQ ID NO: 9240452 - DNA, 22 bp, Homo sapiens
tgtatttttaggaatgcgctat

SEQ ID NO: 9240453 - DNA, 22 bp, Homo sapiens
tgtcaaaaagctgggacaagca

SEQ ID NO: 9240454 - DNA, 22 bp, Homo sapiens
tgtcaaaaataagagagattgt

SEQ ID NO: 9240455 - DNA, 22 bp, Homo sapiens
tgtatttttagacctttagacc

SEQ ID NO: 9240456 - DNA, 22 bp, Homo sapiens
tgtatttttagacctttagacc

SEQ ID NO: 9240457 - DNA, 22 bp, Homo sapiens
tgtatttttagacctttagacc

SEQ ID NO: 9240458 - DNA, 22 bp, Homo sapiens
tgtcaaaaccagcaattttgtt

SEQ ID NO: 9240459 - DNA, 22 bp, Homo sapiens
tgtcaaaaataagagagattgt

SEQ ID NO: 9240460 - DNA, 22 bp, Homo sapiens
tgtcaaaaccagcaattttgtt

SEQ ID NO: 9240461 - DNA, 22 bp, Homo sapiens
tgtcaaaaccttggaggcaagg

SEQ ID NO: 9240462 - DNA, 22 bp, Homo sapiens
tgtcacaaggccatgaaaagaa

SEQ ID NO: 9240463 - DNA, 22 bp, Homo sapiens
tgtcacaaaaatcagtaattgc

SEQ ID NO: 9240464 - DNA, 22 bp, Homo sapiens
tgtcaattatgtgacacatctt

SEQ ID NO: 9240465 - DNA, 22 bp, Homo sapiens
tgtcaaagtatcagtctctggc

SEQ ID NO: 9240466 - DNA, 22 bp, Homo sapiens
tgtcaatgaagatatgaataat

SEQ ID NO: 9240467 - DNA, 22 bp, Homo sapiens
tgtcaatgtgtacaggagctca

SEQ ID NO: 9240468 - DNA, 22 bp, Homo sapiens
tgtattttgtgaggatcactct

SEQ ID NO: 9240469 - DNA, 22 bp, Homo sapiens
tgtattttgagtccaatctcct

SEQ ID NO: 9240470 - DNA, 22 bp, Homo sapiens
tgtattttcttctggaagctta

SEQ ID NO: 9240471 - DNA, 22 bp, Homo sapiens
tgtattttctgaggagcattag

SEQ ID NO: 9240472 - DNA, 22 bp, Homo sapiens
tgtattttcagagtggcatttc

SEQ ID NO: 9240473 - DNA, 22 bp, Homo sapiens
tgtattttcagagtggcatttc

SEQ ID NO: 9240474 - DNA, 22 bp, Homo sapiens
tgtattttcagagtggcatttc

SEQ ID NO: 9240475 - DNA, 22 bp, Homo sapiens
tgtattttctgaggagcattag

SEQ ID NO: 9240476 - DNA, 22 bp, Homo sapiens
tgtattttctgaggagcattag

SEQ ID NO: 9240477 - DNA, 22 bp, Homo sapiens
tgtattttctgaagataatcaa

SEQ ID NO: 9240478 - DNA, 22 bp, Homo sapiens
tgtatttattcaggatgtaact

SEQ ID NO: 9240479 - DNA, 22 bp, Homo sapiens
tgtatttcgctaggtactccct

SEQ ID NO: 9240480 - DNA, 22 bp, Homo sapiens
tgtatttaagctttacctaaaa

SEQ ID NO: 9240481 - DNA, 22 bp, Homo sapiens
tgtattgaattgtgttatatct

SEQ ID NO: 9240482 - DNA, 22 bp, Homo sapiens
tgtattgaattgtgttatatct

SEQ ID NO: 9240483 - DNA, 20 bp, Homo sapiens
tgtatttaatgaaggctttt

SEQ ID NO: 9240484 - DNA, 22 bp, Homo sapiens
tgtatttaattgtatcatcaca

SEQ ID NO: 9240485 - DNA, 20 bp, Homo sapiens
tgtattcttctccttcctcc

SEQ ID NO: 9240486 - DNA, 22 bp, Homo sapiens
tgtatgtatacacatagatacg

SEQ ID NO: 9240487 - DNA, 22 bp, Homo sapiens
tgtattctctcaatatttcata

SEQ ID NO: 9240488 - DNA, 22 bp, Homo sapiens
tgtatgtaaagtttgtaataga

SEQ ID NO: 9240489 - DNA, 22 bp, Homo sapiens
tgtatgctttccttctttctgg

SEQ ID NO: 9240490 - DNA, 22 bp, Homo sapiens
tgtatgcttgagtgtgtatact

SEQ ID NO: 9240491 - DNA, 18 bp, Homo sapiens
tggtgaagggtggaggag

SEQ ID NO: 9240492 - DNA, 22 bp, Homo sapiens
tggtgacaccccatctctaaag

SEQ ID NO: 9240493 - DNA, 22 bp, Homo sapiens
tggtgacacgaagtttgctatc

SEQ ID NO: 9240494 - DNA, 19 bp, Homo sapiens
tggtctctgtctctttgca

SEQ ID NO: 9240495 - DNA, 22 bp, Homo sapiens
tggtctctgtaggctaccccat

SEQ ID NO: 9240496 - DNA, 22 bp, Homo sapiens
tggtctctgctgcagcttctca

SEQ ID NO: 9240497 - DNA, 22 bp, Homo sapiens
tggtctctgcaggccaggctca

SEQ ID NO: 9240498 - DNA, 22 bp, Homo sapiens
tggtctctgctgcagcttctca

SEQ ID NO: 9240499 - DNA, 22 bp, Homo sapiens
tggtgactgggactggatatga

SEQ ID NO: 9240500 - DNA, 22 bp, Homo sapiens
tggtgaggccaaagccatgaca

SEQ ID NO: 9240501 - DNA, 22 bp, Homo sapiens
tggtgcagagagggatctaggg

SEQ ID NO: 9240502 - DNA, 22 bp, Homo sapiens
tggtgcagacaggagccccgct

SEQ ID NO: 9240503 - DNA, 22 bp, Homo sapiens
tggtgcaagtctctgaggaggg

SEQ ID NO: 9240504 - DNA, 22 bp, Homo sapiens
tggtgcaagtctctgaggaggg

SEQ ID NO: 9240505 - DNA, 22 bp, Homo sapiens
tggtgaggtcatagagaactgt

SEQ ID NO: 9240506 - DNA, 22 bp, Homo sapiens
tggtgcaaaactaattgcggtt

SEQ ID NO: 9240507 - DNA, 22 bp, Homo sapiens
tggtgatcagtcaactgtcttc

SEQ ID NO: 9240508 - DNA, 22 bp, Homo sapiens
tggtcgaccagttggaaagtaa

SEQ ID NO: 9240509 - DNA, 22 bp, Homo sapiens
tggtcgaccagttggaaagtaa

SEQ ID NO: 9240510 - DNA, 23 bp, Homo sapiens
tggtctcacttggtaagatgaag

SEQ ID NO: 9240511 - DNA, 22 bp, Homo sapiens
tggtccttctctgcctgcagtg

SEQ ID NO: 9240512 - DNA, 22 bp, Homo sapiens
tggtctctgagccttcctgtgg

SEQ ID NO: 9240513 - DNA, 22 bp, Homo sapiens
tggtctctccatgccctccacc

SEQ ID NO: 9240514 - DNA, 23 bp, Homo sapiens
tggtctcagcctgtgagagctga

SEQ ID NO: 9240515 - DNA, 22 bp, Homo sapiens
tggtcctggtcatctgggctgg

SEQ ID NO: 9240516 - DNA, 22 bp, Homo sapiens
tggtcctgtagcacttgattag

SEQ ID NO: 9240517 - DNA, 22 bp, Homo sapiens
tggtcctgtgttcttcctgcct

SEQ ID NO: 9240518 - DNA, 22 bp, Homo sapiens
tggtcctcaggttctctgtgcg

SEQ ID NO: 9240519 - DNA, 22 bp, Homo sapiens
tggtcctgagaatcctgtcctc

SEQ ID NO: 9240520 - DNA, 22 bp, Homo sapiens
tggtcctgatcaccgctgggca

SEQ ID NO: 9240521 - DNA, 22 bp, Homo sapiens
tggtcctgaggcttgtttccac

SEQ ID NO: 9240522 - DNA, 17 bp, Homo sapiens
tggtccaggtggagcca

SEQ ID NO: 9240523 - DNA, 22 bp, Homo sapiens
tggtccagggtgtagtacagag

SEQ ID NO: 9240524 - DNA, 22 bp, Homo sapiens
tggtccagggtgtagtacagag

SEQ ID NO: 9240525 - DNA, 20 bp, Homo sapiens
tggtccaggacctggtgtcc

SEQ ID NO: 9240526 - DNA, 20 bp, Homo sapiens
tggtccaggacctggtgtcc

SEQ ID NO: 9240527 - DNA, 22 bp, Homo sapiens
tggtcctggaaggtcctgaggg

SEQ ID NO: 9240528 - DNA, 22 bp, Homo sapiens
tggtcctggagagtgttccata

SEQ ID NO: 9240529 - DNA, 22 bp, Homo sapiens
tggtcctggagagtgttccata

SEQ ID NO: 9240530 - DNA, 22 bp, Homo sapiens
tggtcctggaaggtcctgaggg

SEQ ID NO: 9240531 - DNA, 22 bp, Homo sapiens
tggtcaggctgctctgcggcgt

SEQ ID NO: 9240532 - DNA, 22 bp, Homo sapiens
tggtcaggggcttctgagctgt

SEQ ID NO: 9240533 - DNA, 22 bp, Homo sapiens
tggtcagcttcagagtgttcca

SEQ ID NO: 9240534 - DNA, 22 bp, Homo sapiens
tggtcagcgtttgtcagagcag

SEQ ID NO: 9240535 - DNA, 22 bp, Homo sapiens
tggtcacccactgggactgcgg

SEQ ID NO: 9240536 - DNA, 22 bp, Homo sapiens
tggtcagacaaaggagaatgtt

SEQ ID NO: 9240537 - DNA, 22 bp, Homo sapiens
tggtcagttgcatcagagaagt

SEQ ID NO: 9240538 - DNA, 22 bp, Homo sapiens
tggtcagttgtgactagaacac

SEQ ID NO: 9240539 - DNA, 22 bp, Homo sapiens
tggtcaggtacctctggctgtc

SEQ ID NO: 9240540 - DNA, 22 bp, Homo sapiens
tggtccagatgccttggcttta

SEQ ID NO: 9240541 - DNA, 22 bp, Homo sapiens
tggtccacagggagtccgtgct

SEQ ID NO: 9240542 - DNA, 22 bp, Homo sapiens
tggtggcaacattgctggagtg

SEQ ID NO: 9240543 - DNA, 21 bp, Homo sapiens
tggtggagtgtgctgagcatg

SEQ ID NO: 9240544 - DNA, 21 bp, Homo sapiens
tggtggagtgtgctgagcatg

SEQ ID NO: 9240545 - DNA, 21 bp, Homo sapiens
tggtggagtgtgctgagcatg

SEQ ID NO: 9240546 - DNA, 19 bp, Homo sapiens
tggtggaggtgcacctgac

SEQ ID NO: 9240547 - DNA, 22 bp, Homo sapiens
tggtggagctgtggccacgacc

SEQ ID NO: 9240548 - DNA, 19 bp, Homo sapiens
tggtggaggccccatgttc

SEQ ID NO: 9240549 - DNA, 22 bp, Homo sapiens
tggtggagggaactatttccag

SEQ ID NO: 9240550 - DNA, 22 bp, Homo sapiens
tggtggagcctaggctaagtct

SEQ ID NO: 9240551 - DNA, 22 bp, Homo sapiens
tggtgcctccagctgcttctcc

SEQ ID NO: 9240552 - DNA, 20 bp, Homo sapiens
tggtggactttggcatggct

SEQ ID NO: 9240553 - DNA, 22 bp, Homo sapiens
tggtggagacctcgctaacccc

SEQ ID NO: 9240554 - DNA, 21 bp, Homo sapiens
tggtggaccagtgctgggaga

SEQ ID NO: 9240555 - DNA, 22 bp, Homo sapiens
tggtggacctggcattgaacct

SEQ ID NO: 9240556 - DNA, 22 bp, Homo sapiens
tggtgcagtccaaagggagcag

SEQ ID NO: 9240557 - DNA, 22 bp, Homo sapiens
tggtgcagtccaaagggagcag

SEQ ID NO: 9240558 - DNA, 22 bp, Homo sapiens
tggtgcagtcattggcccaggg

SEQ ID NO: 9240559 - DNA, 22 bp, Homo sapiens
tggtgcagtccaaagggagcag

SEQ ID NO: 9240560 - DNA, 22 bp, Homo sapiens
tggtgccaagcatgaggactct

SEQ ID NO: 9240561 - DNA, 22 bp, Homo sapiens
tggtgcaggccaagctgcgagc

SEQ ID NO: 9240562 - DNA, 22 bp, Homo sapiens
tggtgcaggccaagctgcgagc

SEQ ID NO: 9240563 - DNA, 22 bp, Homo sapiens
tggtgcaggccaagctgcgagc

SEQ ID NO: 9240564 - DNA, 22 bp, Homo sapiens
tggtgcaggagttggcagggac

SEQ ID NO: 9240565 - DNA, 22 bp, Homo sapiens
tggtgcagatgcaggtcactgg

SEQ ID NO: 9240566 - DNA, 22 bp, Homo sapiens
tggtgcagatagtggtgtagta

SEQ ID NO: 9240567 - DNA, 22 bp, Homo sapiens
tggtgcagtcattggcccaggg

SEQ ID NO: 9240568 - DNA, 22 bp, Homo sapiens
tggtgcagtagagctgtctggg

SEQ ID NO: 9240569 - DNA, 22 bp, Homo sapiens
tggtgcagtagagctgtctggg

SEQ ID NO: 9240570 - DNA, 22 bp, Homo sapiens
tggtgcagtagagctgtctggg

SEQ ID NO: 9240571 - DNA, 22 bp, Homo sapiens
tggtgcaggtgttgatgcagga

SEQ ID NO: 9240572 - DNA, 22 bp, Homo sapiens
tggtggggctttccttctgctt

SEQ ID NO: 9240573 - DNA, 22 bp, Homo sapiens
tggtgggggaggctgtctagca

SEQ ID NO: 9240574 - DNA, 22 bp, Homo sapiens
tggtgggggaggctgtctagca

SEQ ID NO: 9240575 - DNA, 22 bp, Homo sapiens
tggtggggccagacttcagctc

SEQ ID NO: 9240576 - DNA, 22 bp, Homo sapiens
tggtggggattccctccctggc

SEQ ID NO: 9240577 - DNA, 16 bp, Homo sapiens
tggtggggaggacagc

SEQ ID NO: 9240578 - DNA, 16 bp, Homo sapiens
tggtggggaggacagc

SEQ ID NO: 9240579 - DNA, 22 bp, Homo sapiens
tggtgggcacagtgcccaggct

SEQ ID NO: 9240580 - DNA, 22 bp, Homo sapiens
tggtgggcacagtgcccaggct

SEQ ID NO: 9240581 - DNA, 22 bp, Homo sapiens
tggtgggagtgagggcatgcca

SEQ ID NO: 9240582 - DNA, 22 bp, Homo sapiens
tggtgggagtgagggcatgcca

SEQ ID NO: 9240583 - DNA, 22 bp, Homo sapiens
tggtgggagtccgctgtgctgc

SEQ ID NO: 9240584 - DNA, 22 bp, Homo sapiens
tggtgggagtgagggcatgcca

SEQ ID NO: 9240585 - DNA, 22 bp, Homo sapiens
tggtggcagtgagaaggagagg

SEQ ID NO: 9240586 - DNA, 22 bp, Homo sapiens
tggtggcatgatagtgtgaatg

SEQ ID NO: 9240587 - DNA, 22 bp, Homo sapiens
tggtggcagagcaagagctgga

SEQ ID NO: 9240588 - DNA, 23 bp, Homo sapiens
tggtggcagaagtagcagatgac

SEQ ID NO: 9240589 - DNA, 22 bp, Homo sapiens
tggtggcacaagggagagaatc

SEQ ID NO: 9240590 - DNA, 22 bp, Homo sapiens
tggtggcaatgtcctggagaag

SEQ ID NO: 9240591 - DNA, 22 bp, Homo sapiens
tggtggcaatgtcctggagaag

SEQ ID NO: 9240592 - DNA, 22 bp, Homo sapiens
tgtacagtgccatgcagtttgc

SEQ ID NO: 9240593 - DNA, 22 bp, Homo sapiens
tgtacagtatatttcaaagcca

SEQ ID NO: 9240594 - DNA, 22 bp, Homo sapiens
tgtacactgcaggatgcattgc

SEQ ID NO: 9240595 - DNA, 22 bp, Homo sapiens
tgtacagactgtatttacaagt

SEQ ID NO: 9240596 - DNA, 22 bp, Homo sapiens
tgtacacaattcttaacataca

SEQ ID NO: 9240597 - DNA, 22 bp, Homo sapiens
tgtacacatatcatttgtggga

SEQ ID NO: 9240598 - DNA, 22 bp, Homo sapiens
tgtacacacacgtgtgtatcta

SEQ ID NO: 9240599 - DNA, 22 bp, Homo sapiens
tgtacaatgtggccagtgttaa

SEQ ID NO: 9240600 - DNA, 22 bp, Homo sapiens
tgtacacaatgataaattatta

SEQ ID NO: 9240601 - DNA, 19 bp, Homo sapiens
tgtacaaggattatgcagg

SEQ ID NO: 9240602 - DNA, 22 bp, Homo sapiens
tgtacaaattcattgaactgta

SEQ ID NO: 9240603 - DNA, 22 bp, Homo sapiens
tgtacaaattcattgaactgta

SEQ ID NO: 9240604 - DNA, 22 bp, Homo sapiens
tgtacaaattcagttctagggt

SEQ ID NO: 9240605 - DNA, 22 bp, Homo sapiens
tgtacaatctgatgatgtatgg

SEQ ID NO: 9240606 - DNA, 22 bp, Homo sapiens
tgtacaatcttggtccctttat

SEQ ID NO: 9240607 - DNA, 22 bp, Homo sapiens
tgtacaatgccagggaacacca

SEQ ID NO: 9240608 - DNA, 22 bp, Homo sapiens
tgtacaaggccatctacatgct

SEQ ID NO: 9240609 - DNA, 22 bp, Homo sapiens
tgtaagatattcagcttattga

SEQ ID NO: 9240610 - DNA, 22 bp, Homo sapiens
tgtaagatatgagtacatgtaa

SEQ ID NO: 9240611 - DNA, 22 bp, Homo sapiens
tgtaagatgctgggatagatga

SEQ ID NO: 9240612 - DNA, 22 bp, Homo sapiens
tgtacaaagccagaactcccaa

SEQ ID NO: 9240613 - DNA, 22 bp, Homo sapiens
tgtacaaagccagaactcccaa

SEQ ID NO: 9240614 - DNA, 22 bp, Homo sapiens
tgtacaaagttaaacctatata

SEQ ID NO: 9240615 - DNA, 22 bp, Homo sapiens
tgtacaaaggtactttgatgtt

SEQ ID NO: 9240616 - DNA, 22 bp, Homo sapiens
tgtacaaagttaaacctatata

SEQ ID NO: 9240617 - DNA, 22 bp, Homo sapiens
tgtacaaagttaaacctatata

SEQ ID NO: 9240618 - DNA, 22 bp, Homo sapiens
tgtacaaaacaagatgggggta

SEQ ID NO: 9240619 - DNA, 22 bp, Homo sapiens
tgtacaaagagtatagctttga

SEQ ID NO: 9240620 - DNA, 22 bp, Homo sapiens
tgtaaggtgctcatgtatttct

SEQ ID NO: 9240621 - DNA, 22 bp, Homo sapiens
tgtaaggagtgtgagtttgagt

SEQ ID NO: 9240622 - DNA, 23 bp, Homo sapiens
tgtaacaatttcatatacatgca

SEQ ID NO: 9240623 - DNA, 22 bp, Homo sapiens
tgtaacagtaagcctgtgagct

SEQ ID NO: 9240624 - DNA, 22 bp, Homo sapiens
tgtaacatatagcatgttcttg

SEQ ID NO: 9240625 - DNA, 22 bp, Homo sapiens
tgtaacatggttcttactctca

SEQ ID NO: 9240626 - DNA, 22 bp, Homo sapiens
tgtaaatgtgaatttccttttc

SEQ ID NO: 9240627 - DNA, 22 bp, Homo sapiens
tgtaaattctatacacttaaaa

SEQ ID NO: 9240628 - DNA, 23 bp, Homo sapiens
tgtaaaatggggtagtgttacca

SEQ ID NO: 9240629 - DNA, 22 bp, Homo sapiens
tgtaaacagccccatggagagc

SEQ ID NO: 9240630 - DNA, 22 bp, Homo sapiens
tgtaaagtccaagatcaaagag

SEQ ID NO: 9240631 - DNA, 20 bp, Homo sapiens
tgtaaataggcattgtagtt

SEQ ID NO: 9240632 - DNA, 22 bp, Homo sapiens
tgtaaatgaaacagctaaatcc

SEQ ID NO: 9240633 - DNA, 22 bp, Homo sapiens
tgtaaataatgcatgtaaatca

SEQ ID NO: 9240634 - DNA, 22 bp, Homo sapiens
tgtaaataatgcatgtaaatca

SEQ ID NO: 9240635 - DNA, 22 bp, Homo sapiens
tgtaaataattcctaggctttt

SEQ ID NO: 9240636 - DNA, 22 bp, Homo sapiens
tgtaaataatgcatgtaaatca

SEQ ID NO: 9240637 - DNA, 22 bp, Homo sapiens
tgtaaataatgcatgtaaatca

SEQ ID NO: 9240638 - DNA, 22 bp, Homo sapiens
tgtaaataatgcatgtaaatca

SEQ ID NO: 9240639 - DNA, 22 bp, Homo sapiens
tgtaaaacaaaatttgtggaga

SEQ ID NO: 9240640 - DNA, 22 bp, Homo sapiens
tgtaaaataattctccatgttt

SEQ ID NO: 9240641 - DNA, 23 bp, Homo sapiens
tgtaaaatggggtagtgttacca

SEQ ID NO: 9240642 - DNA, 23 bp, Homo sapiens
tgtaaaatggggtagtgttacca

SEQ ID NO: 9240643 - DNA, 22 bp, Homo sapiens
tgtaaaataccattccttgtca

SEQ ID NO: 9240644 - DNA, 22 bp, Homo sapiens
tggtttgtatatgtttgtgaga

SEQ ID NO: 9240645 - DNA, 22 bp, Homo sapiens
tggtttgtctaaatgagtaata

SEQ ID NO: 9240646 - DNA, 18 bp, Homo sapiens
tggtttgtcatgagaatt

SEQ ID NO: 9240647 - DNA, 22 bp, Homo sapiens
tggttttaaaaacatgctgcat

SEQ ID NO: 9240648 - DNA, 22 bp, Homo sapiens
tggtttgtttgttcatgtaaaa

SEQ ID NO: 9240649 - DNA, 22 bp, Homo sapiens
tggttttaaaagatgtttgaga

SEQ ID NO: 9240650 - DNA, 22 bp, Homo sapiens
tggtttgacaatgaggactggt

SEQ ID NO: 9240651 - DNA, 22 bp, Homo sapiens
tggtttctttccactctccacc

SEQ ID NO: 9240652 - DNA, 22 bp, Homo sapiens
tggtttctttccactctccacc

SEQ ID NO: 9240653 - DNA, 22 bp, Homo sapiens
tggttttagatgcctttactgc

SEQ ID NO: 9240654 - DNA, 22 bp, Homo sapiens
tggttttagagtatattcaggg

SEQ ID NO: 9240655 - DNA, 22 bp, Homo sapiens
tggttttagggaatcaatctat

SEQ ID NO: 9240656 - DNA, 22 bp, Homo sapiens
tggttttagggaatcaatctat

SEQ ID NO: 9240657 - DNA, 22 bp, Homo sapiens
tggttttatttatgttgagtca

SEQ ID NO: 9240658 - DNA, 22 bp, Homo sapiens
tggtggggtcatcgtcagatgc

SEQ ID NO: 9240659 - DNA, 22 bp, Homo sapiens
tggtggggtcatcgtcagatgc

SEQ ID NO: 9240660 - DNA, 23 bp, Homo sapiens
tggtggggtcttggagacagcac

SEQ ID NO: 9240661 - DNA, 22 bp, Homo sapiens
tggtggtcatagcagaggccgt

SEQ ID NO: 9240662 - DNA, 18 bp, Homo sapiens
tggtggtgacagggtcat

SEQ ID NO: 9240663 - DNA, 22 bp, Homo sapiens
tggtgtgggcgtggcaggcaag

SEQ ID NO: 9240664 - DNA, 22 bp, Homo sapiens
tggtgtggggataagcactctg

SEQ ID NO: 9240665 - DNA, 22 bp, Homo sapiens
tggttaaaatgcagattcagta

SEQ ID NO: 9240666 - DNA, 21 bp, Homo sapiens
tggttaaagttgtgtcatccc

SEQ ID NO: 9240667 - DNA, 21 bp, Homo sapiens
tggttaaagttgtgtcatccc

SEQ ID NO: 9240668 - DNA, 23 bp, Homo sapiens
tggttctaggcctataattatat

SEQ ID NO: 9240669 - DNA, 22 bp, Homo sapiens
tggttcctcagggcagctgtac

SEQ ID NO: 9240670 - DNA, 22 bp, Homo sapiens
tggttaaatgctccgatcttgg

SEQ ID NO: 9240671 - DNA, 22 bp, Homo sapiens
tggttccttctgcattttcagc

SEQ ID NO: 9240672 - DNA, 22 bp, Homo sapiens
tggtttctctgaactctacgac

SEQ ID NO: 9240673 - DNA, 22 bp, Homo sapiens
tggtttctcagactctttgcag

SEQ ID NO: 9240674 - DNA, 22 bp, Homo sapiens
tggtttctgggtttgtctagga

SEQ ID NO: 9240675 - DNA, 22 bp, Homo sapiens
tggtttctgggtttgtctagga

SEQ ID NO: 9240676 - DNA, 22 bp, Homo sapiens
tggtttctgccctcagagctca

SEQ ID NO: 9240677 - DNA, 22 bp, Homo sapiens
tgcctgggtgtaaagggccaac

SEQ ID NO: 9240678 - DNA, 22 bp, Homo sapiens
tgcctgggtgtaaagggccaac

SEQ ID NO: 9240679 - DNA, 22 bp, Homo sapiens
tgcctgggttcccaccccaaag

SEQ ID NO: 9240680 - DNA, 22 bp, Homo sapiens
tgcctgggttgactcttagctg

SEQ ID NO: 9240681 - DNA, 22 bp, Homo sapiens
tgcctgtcagggggagtgggaa

SEQ ID NO: 9240682 - DNA, 22 bp, Homo sapiens
tgcctgggtgccctctgctcct

SEQ ID NO: 9240683 - DNA, 22 bp, Homo sapiens
tgcctgggtgtaaagggccaac

SEQ ID NO: 9240684 - DNA, 22 bp, Homo sapiens
tgcctgtcttcaggagtgtcac

SEQ ID NO: 9240685 - DNA, 22 bp, Homo sapiens
tgcctgtcttcaggagtgtcac

SEQ ID NO: 9240686 - DNA, 22 bp, Homo sapiens
tgcctgtcttaatatctggaaa

SEQ ID NO: 9240687 - DNA, 22 bp, Homo sapiens
tgcctgtctctgactgccatta

SEQ ID NO: 9240688 - DNA, 22 bp, Homo sapiens
tgcctgtctcctctgcagggtg

SEQ ID NO: 9240689 - DNA, 22 bp, Homo sapiens
tgcctgtcctgaggatgagggt

SEQ ID NO: 9240690 - DNA, 19 bp, Homo sapiens
tgcctgtcagtagatctca

SEQ ID NO: 9240691 - DNA, 22 bp, Homo sapiens
tgcctgtcttggagtcctggcc

SEQ ID NO: 9240692 - DNA, 22 bp, Homo sapiens
tgcctgtcttggagtcctggcc

SEQ ID NO: 9240693 - DNA, 22 bp, Homo sapiens
tgcctgtctttcctccctcgta

SEQ ID NO: 9240694 - DNA, 22 bp, Homo sapiens
tgcctggggttggcaaactgct

SEQ ID NO: 9240695 - DNA, 22 bp, Homo sapiens
tgcctgggtccaggccaagcct

SEQ ID NO: 9240696 - DNA, 22 bp, Homo sapiens
tgcctgggggactaaggccaaa

SEQ ID NO: 9240697 - DNA, 22 bp, Homo sapiens
tgcctgggggactaaggccaaa

SEQ ID NO: 9240698 - DNA, 22 bp, Homo sapiens
tgcctgggggactaaggccaaa

SEQ ID NO: 9240699 - DNA, 22 bp, Homo sapiens
tgcctggggattgctctgggcc

SEQ ID NO: 9240700 - DNA, 22 bp, Homo sapiens
tgcctgggctcggtagccatcg

SEQ ID NO: 9240701 - DNA, 22 bp, Homo sapiens
tgcctgggaaccaatcctggct

SEQ ID NO: 9240702 - DNA, 22 bp, Homo sapiens
tgcctggccctgacagccctgg

SEQ ID NO: 9240703 - DNA, 22 bp, Homo sapiens
tgccttcttctccctggctcag

SEQ ID NO: 9240704 - DNA, 22 bp, Homo sapiens
tgcctgtgtcacagtgatgttt

SEQ ID NO: 9240705 - DNA, 22 bp, Homo sapiens
tgcctgtgtcacagtgatgttt

SEQ ID NO: 9240706 - DNA, 22 bp, Homo sapiens
tgccttgacagttgtaagacct

SEQ ID NO: 9240707 - DNA, 22 bp, Homo sapiens
tgcctgtgtatgtgcatgcaca

SEQ ID NO: 9240708 - DNA, 22 bp, Homo sapiens
tgcctgtgccctttgctgggag

SEQ ID NO: 9240709 - DNA, 22 bp, Homo sapiens
tgccttttccagtttctagggg

SEQ ID NO: 9240710 - DNA, 22 bp, Homo sapiens
tgccttttccagcttccaggag

SEQ ID NO: 9240711 - DNA, 22 bp, Homo sapiens
tgccttttatggctagcctcag

SEQ ID NO: 9240712 - DNA, 20 bp, Homo sapiens
tgcctttcctgtttcatctt

SEQ ID NO: 9240713 - DNA, 22 bp, Homo sapiens
tgccttttctgtagctctggaa

SEQ ID NO: 9240714 - DNA, 22 bp, Homo sapiens
tgccttttgaagcctcacaggt

SEQ ID NO: 9240715 - DNA, 22 bp, Homo sapiens
tgcgatggcgtagacaaatccc

SEQ ID NO: 9240716 - DNA, 22 bp, Homo sapiens
tgccttgggatatatggacact

SEQ ID NO: 9240717 - DNA, 22 bp, Homo sapiens
tgccttggtggcagtctgcggt

SEQ ID NO: 9240718 - DNA, 22 bp, Homo sapiens
tgccttggtgcttcttcatgtg

SEQ ID NO: 9240719 - DNA, 22 bp, Homo sapiens
tgccttggtttccccatctgta

SEQ ID NO: 9240720 - DNA, 22 bp, Homo sapiens
tgcgggttggtggcatatgcag

SEQ ID NO: 9240721 - DNA, 22 bp, Homo sapiens
tgcgggtcccagggtcacaggc

SEQ ID NO: 9240722 - DNA, 22 bp, Homo sapiens
tgcgttgcgctcctgcagcagg

SEQ ID NO: 9240723 - DNA, 22 bp, Homo sapiens
tgctaaataacttacatagtgg

SEQ ID NO: 9240724 - DNA, 22 bp, Homo sapiens
tgctaaataagtggaatagaca

SEQ ID NO: 9240725 - DNA, 22 bp, Homo sapiens
tgctaaattcattattgattta

SEQ ID NO: 9240726 - DNA, 22 bp, Homo sapiens
tgctaaataagtggaatagaca

SEQ ID NO: 9240727 - DNA, 22 bp, Homo sapiens
tgcgcaggagctctgccaggag

SEQ ID NO: 9240728 - DNA, 22 bp, Homo sapiens
tgcgcgctggcgtcacttagca

SEQ ID NO: 9240729 - DNA, 22 bp, Homo sapiens
tgcggcaggagaaggtgttatg

SEQ ID NO: 9240730 - DNA, 22 bp, Homo sapiens
tgcggcagccaccgcgtggccc

SEQ ID NO: 9240731 - DNA, 22 bp, Homo sapiens
tgctataagtagacattcaaca

SEQ ID NO: 9240732 - DNA, 22 bp, Homo sapiens
tgctataagaattatattactc

SEQ ID NO: 9240733 - DNA, 22 bp, Homo sapiens
tgctagtgtgtgagatgttcaa

SEQ ID NO: 9240734 - DNA, 22 bp, Homo sapiens
tgctataagtagacattcaaca

SEQ ID NO: 9240735 - DNA, 22 bp, Homo sapiens
tgctataagaattatattactc

SEQ ID NO: 9240736 - DNA, 22 bp, Homo sapiens
tgctatttgggggctacatgat

SEQ ID NO: 9240737 - DNA, 22 bp, Homo sapiens
tgctatttttatcttgatcaaa

SEQ ID NO: 9240738 - DNA, 22 bp, Homo sapiens
tgctatttttatcttgatcaaa

SEQ ID NO: 9240739 - DNA, 22 bp, Homo sapiens
tgctccagcaccaagagctcca

SEQ ID NO: 9240740 - DNA, 22 bp, Homo sapiens
tgctccagcaacaggcttagct

SEQ ID NO: 9240741 - DNA, 22 bp, Homo sapiens
tgctccagcaacaggcttagct

SEQ ID NO: 9240742 - DNA, 22 bp, Homo sapiens
tgctccagaacctgaccatgct

SEQ ID NO: 9240743 - DNA, 22 bp, Homo sapiens
tgctccagaacctgaccatgct

SEQ ID NO: 9240744 - DNA, 22 bp, Homo sapiens
tgctccagaaaaacttgagact

SEQ ID NO: 9240745 - DNA, 22 bp, Homo sapiens
tgctccagaaaaacttgagact

SEQ ID NO: 9240746 - DNA, 22 bp, Homo sapiens
tgctcattgctgatttacatgt

SEQ ID NO: 9240747 - DNA, 22 bp, Homo sapiens
tgctcagtcctaccttggctcc

SEQ ID NO: 9240748 - DNA, 22 bp, Homo sapiens
tgctcagtagcagtgtgctgct

SEQ ID NO: 9240749 - DNA, 22 bp, Homo sapiens
tgctcagtcctaccttggctcc

SEQ ID NO: 9240750 - DNA, 22 bp, Homo sapiens
tgctcagtcctcctgcagtgcc

SEQ ID NO: 9240751 - DNA, 22 bp, Homo sapiens
tgctcagtcctcctgcagtgcc

SEQ ID NO: 9240752 - DNA, 21 bp, Homo sapiens
tgctcagtctgtctccagctt

SEQ ID NO: 9240753 - DNA, 22 bp, Homo sapiens
tgctcattaggactgcaaattc

SEQ ID NO: 9240754 - DNA, 22 bp, Homo sapiens
tgctcagttccatgagtggagt

SEQ ID NO: 9240755 - DNA, 22 bp, Homo sapiens
tgctcagaaacgaggtgcagcc

SEQ ID NO: 9240756 - DNA, 22 bp, Homo sapiens
tgctcactgaactcttgctgtc

SEQ ID NO: 9240757 - DNA, 22 bp, Homo sapiens
tgctcactgaactcttgctgtc

SEQ ID NO: 9240758 - DNA, 19 bp, Homo sapiens
tgctcactctcagtccctc

SEQ ID NO: 9240759 - DNA, 22 bp, Homo sapiens
tgctcacagcccagaacataat

SEQ ID NO: 9240760 - DNA, 22 bp, Homo sapiens
tgctcaacagatatgtaacatg

SEQ ID NO: 9240761 - DNA, 22 bp, Homo sapiens
tgctcacagcccagaacataat

SEQ ID NO: 9240762 - DNA, 21 bp, Homo sapiens
tgctcacagatgtgctcagtg

SEQ ID NO: 9240763 - DNA, 22 bp, Homo sapiens
tgctcagacaagctgaacagta

SEQ ID NO: 9240764 - DNA, 22 bp, Homo sapiens
tgctcagagctctggtgcaggt

SEQ ID NO: 9240765 - DNA, 22 bp, Homo sapiens
tgctctgggttcttgctgttac

SEQ ID NO: 9240766 - DNA, 18 bp, Homo sapiens
tgctctggtctcacttgg

SEQ ID NO: 9240767 - DNA, 22 bp, Homo sapiens
tgctctggtaactcacttccat

SEQ ID NO: 9240768 - DNA, 22 bp, Homo sapiens
tgctctggtaactcacttccat

SEQ ID NO: 9240769 - DNA, 22 bp, Homo sapiens
tgctctgtcaagaaaagatgcc

SEQ ID NO: 9240770 - DNA, 22 bp, Homo sapiens
tgctctgtccagtgcaccatca

SEQ ID NO: 9240771 - DNA, 22 bp, Homo sapiens
tgctctgtcaagaaaagatgcc

SEQ ID NO: 9240772 - DNA, 22 bp, Homo sapiens
tgctctgtaggggaaagagagc

SEQ ID NO: 9240773 - DNA, 18 bp, Homo sapiens
tgctctgtttaatgattt

SEQ ID NO: 9240774 - DNA, 22 bp, Homo sapiens
tgctcttaattccattagactt

SEQ ID NO: 9240775 - DNA, 22 bp, Homo sapiens
tgctctgttcagtgtatcttgt

SEQ ID NO: 9240776 - DNA, 22 bp, Homo sapiens
tgctcttcacagtttcagcatc

SEQ ID NO: 9240777 - DNA, 22 bp, Homo sapiens
tgctcttcaccattacatcatg

SEQ ID NO: 9240778 - DNA, 22 bp, Homo sapiens
tgctcttcggggccactgcttg

SEQ ID NO: 9240779 - DNA, 22 bp, Homo sapiens
tgctgaaacaataacatactgg

SEQ ID NO: 9240780 - DNA, 22 bp, Homo sapiens
tgctgaaagaccgtatttatct

SEQ ID NO: 9240781 - DNA, 22 bp, Homo sapiens
tgctgaaagaccgtatttatct

SEQ ID NO: 9240782 - DNA, 22 bp, Homo sapiens
tgctgaaaatgcgtatcttcca

SEQ ID NO: 9240783 - DNA, 22 bp, Homo sapiens
tgctgaaaatgcgtatcttcca

SEQ ID NO: 9240784 - DNA, 22 bp, Homo sapiens
tgctgaaaactcaaccattgtg

SEQ ID NO: 9240785 - DNA, 22 bp, Homo sapiens
tgctgaaacaataacatactgg

SEQ ID NO: 9240786 - DNA, 22 bp, Homo sapiens
tgctgaaagtcccaaatctcat

SEQ ID NO: 9240787 - DNA, 22 bp, Homo sapiens
tgctgaaattagaacattgagg

SEQ ID NO: 9240788 - DNA, 22 bp, Homo sapiens
tgctgaaggcaggggaggtggc

SEQ ID NO: 9240789 - DNA, 22 bp, Homo sapiens
tgctgagcccagaacggcctgg

SEQ ID NO: 9240790 - DNA, 22 bp, Homo sapiens
tgctgagcgcatccggcggccg

SEQ ID NO: 9240791 - DNA, 22 bp, Homo sapiens
tgctgagcgcatccggcggccg

SEQ ID NO: 9240792 - DNA, 22 bp, Homo sapiens
tgctgaggaggtggctgtgctt

SEQ ID NO: 9240793 - DNA, 22 bp, Homo sapiens
tgctgaggagggcacccggggg

SEQ ID NO: 9240794 - DNA, 22 bp, Homo sapiens
tgctgaggaggtggctgtgctt

SEQ ID NO: 9240795 - DNA, 22 bp, Homo sapiens
tgctgaggactaaaggagatga

SEQ ID NO: 9240796 - DNA, 22 bp, Homo sapiens
tgctgaggagggcacccggggg

SEQ ID NO: 9240797 - DNA, 22 bp, Homo sapiens
tgctgaggaggtggctgtgctt

SEQ ID NO: 9240798 - DNA, 22 bp, Homo sapiens
tgctgaggaggtggctgtgctt

SEQ ID NO: 9240799 - DNA, 19 bp, Homo sapiens
tgctgaggatgcaagatcc

SEQ ID NO: 9240800 - DNA, 22 bp, Homo sapiens
tgctgaggacacctagccttct

SEQ ID NO: 9240801 - DNA, 22 bp, Homo sapiens
tgctgaggacacctagccttct

SEQ ID NO: 9240802 - DNA, 22 bp, Homo sapiens
tgctgaggactaaaggagatga

SEQ ID NO: 9240803 - DNA, 22 bp, Homo sapiens
tgctgaggaaagaggataaaag

SEQ ID NO: 9240804 - DNA, 22 bp, Homo sapiens
tgctgaggaaaaatgtgactct

SEQ ID NO: 9240805 - DNA, 22 bp, Homo sapiens
tgctgaggaaaaatgtgactct

SEQ ID NO: 9240806 - DNA, 22 bp, Homo sapiens
tgctgaggaaaaatgtgactct

SEQ ID NO: 9240807 - DNA, 22 bp, Homo sapiens
tgctgaggaataattgttcctg

SEQ ID NO: 9240808 - DNA, 22 bp, Homo sapiens
tgctgaggaataattgttcctg

SEQ ID NO: 9240809 - DNA, 22 bp, Homo sapiens
tgctgaggaatttggtttatgt

SEQ ID NO: 9240810 - DNA, 22 bp, Homo sapiens
tgctgaggtcaccttgctgcta

SEQ ID NO: 9240811 - DNA, 22 bp, Homo sapiens
tgctgaggtaaccatatcctgc

SEQ ID NO: 9240812 - DNA, 22 bp, Homo sapiens
tgctgagggctgttaaggaagc

SEQ ID NO: 9240813 - DNA, 22 bp, Homo sapiens
tgctgagggcagatgaattaga

SEQ ID NO: 9240814 - DNA, 22 bp, Homo sapiens
tgctgaggctagacctggaagt

SEQ ID NO: 9240815 - DNA, 22 bp, Homo sapiens
tgctgagggagcatcaaagaaa

SEQ ID NO: 9240816 - DNA, 22 bp, Homo sapiens
tgctgagggagcatcaaagaaa

SEQ ID NO: 9240817 - DNA, 22 bp, Homo sapiens
tgctgagggaggggttttccag

SEQ ID NO: 9240818 - DNA, 22 bp, Homo sapiens
tgctgagggaggggttttccag

SEQ ID NO: 9240819 - DNA, 20 bp, Homo sapiens
tgctgaggttgacatgccca

SEQ ID NO: 9240820 - DNA, 20 bp, Homo sapiens
tgctgaggttgacatgccca

SEQ ID NO: 9240821 - DNA, 22 bp, Homo sapiens
tgctgaggtcatttccaagtga

SEQ ID NO: 9240822 - DNA, 22 bp, Homo sapiens
tgctgaggtcatttccaagtga

SEQ ID NO: 9240823 - DNA, 22 bp, Homo sapiens
tgctgaggtcacggcggccaga

SEQ ID NO: 9240824 - DNA, 22 bp, Homo sapiens
tgctgaggtcaccttgctgcta

SEQ ID NO: 9240825 - DNA, 22 bp, Homo sapiens
tgctgaggtcaccttgctgcta

SEQ ID NO: 9240826 - DNA, 22 bp, Homo sapiens
tgctgaggtcacggcggccaga

SEQ ID NO: 9240827 - DNA, 22 bp, Homo sapiens
tgctgaggtcacggcggccaga

SEQ ID NO: 9240828 - DNA, 22 bp, Homo sapiens
tgctgaggtcacggcggccaga

SEQ ID NO: 9240829 - DNA, 22 bp, Homo sapiens
tgctgaggcatttggacagagt

SEQ ID NO: 9240830 - DNA, 22 bp, Homo sapiens
tgctgaggcccaggagcacttt

SEQ ID NO: 9240831 - DNA, 22 bp, Homo sapiens
tgctgaggctagacctggaagt

SEQ ID NO: 9240832 - DNA, 20 bp, Homo sapiens
tgctgaggcctgaggcctgg

SEQ ID NO: 9240833 - DNA, 20 bp, Homo sapiens
tgctgaggcctgaggcctgg

SEQ ID NO: 9240834 - DNA, 20 bp, Homo sapiens
tgctgaggcctgaggcctgg

SEQ ID NO: 9240835 - DNA, 22 bp, Homo sapiens
tgctgaggcagtcctaacagga

SEQ ID NO: 9240836 - DNA, 22 bp, Homo sapiens
tgctgaggcatttggacagagt

SEQ ID NO: 9240837 - DNA, 22 bp, Homo sapiens
tgctgaggcagatgtctgtgac

SEQ ID NO: 9240838 - DNA, 22 bp, Homo sapiens
tgctgaggcagatgtctgtgac

SEQ ID NO: 9240839 - DNA, 22 bp, Homo sapiens
tgctgaggcagatgtctgtgac

SEQ ID NO: 9240840 - DNA, 22 bp, Homo sapiens
tgctgaggcagatgtctgtgac

SEQ ID NO: 9240841 - DNA, 22 bp, Homo sapiens
tgctgaggcagatgtctgtgac

SEQ ID NO: 9240842 - DNA, 22 bp, Homo sapiens
tgctgcagtgtttgctgaagtt

SEQ ID NO: 9240843 - DNA, 22 bp, Homo sapiens
tgctgcagtgtttgctgaagtt

SEQ ID NO: 9240844 - DNA, 22 bp, Homo sapiens
tgctgcaggccttggctgggaa

SEQ ID NO: 9240845 - DNA, 22 bp, Homo sapiens
tgctgcaggccttggctgggaa

SEQ ID NO: 9240846 - DNA, 22 bp, Homo sapiens
tgctgcaggcagcccctctact

SEQ ID NO: 9240847 - DNA, 22 bp, Homo sapiens
tgctgcagggatttcagagaca

SEQ ID NO: 9240848 - DNA, 22 bp, Homo sapiens
tgctgagtcgtattatttttta

SEQ ID NO: 9240849 - DNA, 22 bp, Homo sapiens
tgctgatatattctagttttct

SEQ ID NO: 9240850 - DNA, 22 bp, Homo sapiens
tgctgagtctgaaacagctcag

SEQ ID NO: 9240851 - DNA, 22 bp, Homo sapiens
tgctgaggttgtggagtgcatt

SEQ ID NO: 9240852 - DNA, 22 bp, Homo sapiens
tgctgaggttgtggagtgcatt

SEQ ID NO: 9240853 - DNA, 22 bp, Homo sapiens
tgctgaggttgtggagtgcatt

SEQ ID NO: 9240854 - DNA, 22 bp, Homo sapiens
tgctgaggtttctgactatgga

SEQ ID NO: 9240855 - DNA, 22 bp, Homo sapiens
tgctgaggtttcgtctgcttgc

SEQ ID NO: 9240856 - DNA, 22 bp, Homo sapiens
tgctgaggtttcgtctgcttgc

SEQ ID NO: 9240857 - DNA, 22 bp, Homo sapiens
tgctgaggtttcgtctgcttgc

SEQ ID NO: 9240858 - DNA, 22 bp, Homo sapiens
tgctcgccccacatgccctcat

SEQ ID NO: 9240859 - DNA, 22 bp, Homo sapiens
tgctcgccccacatgccctcat

SEQ ID NO: 9240860 - DNA, 22 bp, Homo sapiens
tgctccttcctcatcctgtgca

SEQ ID NO: 9240861 - DNA, 22 bp, Homo sapiens
tgctccttcccttcccagtgag

SEQ ID NO: 9240862 - DNA, 22 bp, Homo sapiens
tgctcctttcatccaattctca

SEQ ID NO: 9240863 - DNA, 22 bp, Homo sapiens
tgctctaagaactctaggaatt

SEQ ID NO: 9240864 - DNA, 22 bp, Homo sapiens
tgctcctgtttcatcagctata

SEQ ID NO: 9240865 - DNA, 22 bp, Homo sapiens
tgctcctgtttcatcagctata

SEQ ID NO: 9240866 - DNA, 22 bp, Homo sapiens
tgctcctgtttcatcagctata

SEQ ID NO: 9240867 - DNA, 22 bp, Homo sapiens
tgctcctgtttcatcagctata

SEQ ID NO: 9240868 - DNA, 17 bp, Homo sapiens
tgctcctgtggcagcct

SEQ ID NO: 9240869 - DNA, 22 bp, Homo sapiens
tgctcctggatgaggtactcca

SEQ ID NO: 9240870 - DNA, 22 bp, Homo sapiens
tgctctggctggagcaatgact

SEQ ID NO: 9240871 - DNA, 22 bp, Homo sapiens
tgctctgggaccgtcattaaaa

SEQ ID NO: 9240872 - DNA, 22 bp, Homo sapiens
tgctctggctgggatgagtgca

SEQ ID NO: 9240873 - DNA, 19 bp, Homo sapiens
tgctctctggtgcttcatg

SEQ ID NO: 9240874 - DNA, 22 bp, Homo sapiens
tgctctgggctcaatggcagct

SEQ ID NO: 9240875 - DNA, 22 bp, Homo sapiens
tgctctgggattcagcagcctg

SEQ ID NO: 9240876 - DNA, 22 bp, Homo sapiens
tgctctgggcaacagcctccct

SEQ ID NO: 9240877 - DNA, 22 bp, Homo sapiens
tgctctggggctccccaccaga

SEQ ID NO: 9240878 - DNA, 22 bp, Homo sapiens
tgctctggggagctcctctgcg

SEQ ID NO: 9240879 - DNA, 23 bp, Homo sapiens
tgctcccaggtgacgctgctgtt

SEQ ID NO: 9240880 - DNA, 22 bp, Homo sapiens
tgctcccagggactctggctgg

SEQ ID NO: 9240881 - DNA, 22 bp, Homo sapiens
tgctccctgacccaggtcttct

SEQ ID NO: 9240882 - DNA, 22 bp, Homo sapiens
tgctccagggcctccagtgggg

SEQ ID NO: 9240883 - DNA, 22 bp, Homo sapiens
tgctccagggcctccagtgggg

SEQ ID NO: 9240884 - DNA, 22 bp, Homo sapiens
tgctcccaggcattctctgttg

SEQ ID NO: 9240885 - DNA, 22 bp, Homo sapiens
tgctcccaggctctgtggtctg

SEQ ID NO: 9240886 - DNA, 22 bp, Homo sapiens
tgctcccagggactctggctgg

SEQ ID NO: 9240887 - DNA, 22 bp, Homo sapiens
tgctcctgatatctaatgtgta

SEQ ID NO: 9240888 - DNA, 22 bp, Homo sapiens
tgctcctgatatctaatgtgta

SEQ ID NO: 9240889 - DNA, 22 bp, Homo sapiens
tgctcctgaacacagccctatg

SEQ ID NO: 9240890 - DNA, 22 bp, Homo sapiens
tgctcctgctgcatgcatctcc

SEQ ID NO: 9240891 - DNA, 22 bp, Homo sapiens
tgctcctgctgcatgcatctcc

SEQ ID NO: 9240892 - DNA, 22 bp, Homo sapiens
tgctccagcgctgccaccagtt

SEQ ID NO: 9240893 - DNA, 22 bp, Homo sapiens
tgctccagctggagatgggggc

SEQ ID NO: 9240894 - DNA, 20 bp, Homo sapiens
tgctccaggaacactggccg

SEQ ID NO: 9240895 - DNA, 20 bp, Homo sapiens
tgctccaggaacactggccg

SEQ ID NO: 9240896 - DNA, 22 bp, Homo sapiens
tgctccaggagcaacctttgag

SEQ ID NO: 9240897 - DNA, 22 bp, Homo sapiens
tgctccaggagcaacctttgag

SEQ ID NO: 9240898 - DNA, 22 bp, Homo sapiens
tgctccagcctatgctctccgg

SEQ ID NO: 9240899 - DNA, 23 bp, Homo sapiens
tgctccagcctctttgatagtgt

SEQ ID NO: 9240900 - DNA, 22 bp, Homo sapiens
tgctccagcctatgctctccgg

SEQ ID NO: 9240901 - DNA, 22 bp, Homo sapiens
tgctccagcatgaccctcaatg

SEQ ID NO: 9240902 - DNA, 22 bp, Homo sapiens
tgctccagcatgaccctcaatg

SEQ ID NO: 9240903 - DNA, 18 bp, Homo sapiens
tgctccaggcccatgggc

SEQ ID NO: 9240904 - DNA, 22 bp, Homo sapiens
tgctccaggcaagctgagagtt

SEQ ID NO: 9240905 - DNA, 21 bp, Homo sapiens
tgctccaggagggggcagtcc

SEQ ID NO: 9240906 - DNA, 22 bp, Homo sapiens
tgctccaggagcactttccatt

SEQ ID NO: 9240907 - DNA, 22 bp, Homo sapiens
tgctccaggagcactttccatt

SEQ ID NO: 9240908 - DNA, 21 bp, Homo sapiens
tgctccaggagggggcagtcc

SEQ ID NO: 9240909 - DNA, 22 bp, Homo sapiens
tgctccaggccgcctggggctg

SEQ ID NO: 9240910 - DNA, 22 bp, Homo sapiens
tgctccaggctgctgaagatct

SEQ ID NO: 9240911 - DNA, 19 bp, Homo sapiens
tgctccaggccttgccgca

SEQ ID NO: 9240912 - DNA, 21 bp, Homo sapiens
tgctccagggcagcttccagc

SEQ ID NO: 9240913 - DNA, 21 bp, Homo sapiens
tgctccagggcagcttccagc

SEQ ID NO: 9240914 - DNA, 22 bp, Homo sapiens
tgctccaggctgctgaagatct

SEQ ID NO: 9240915 - DNA, 22 bp, Homo sapiens
tgctggtaccgcgcctccgcca

SEQ ID NO: 9240916 - DNA, 22 bp, Homo sapiens
tgctggtcccctgcagcctgtg

SEQ ID NO: 9240917 - DNA, 22 bp, Homo sapiens
tgctggtcctggagctgggttc

SEQ ID NO: 9240918 - DNA, 22 bp, Homo sapiens
tgctggtcccctgcagcctgtg

SEQ ID NO: 9240919 - DNA, 22 bp, Homo sapiens
tgctggtcctggagctgggttc

SEQ ID NO: 9240920 - DNA, 22 bp, Homo sapiens
tgctgtagggagaaagagttga

SEQ ID NO: 9240921 - DNA, 22 bp, Homo sapiens
tgctgtagccctgcacagtgca

SEQ ID NO: 9240922 - DNA, 22 bp, Homo sapiens
tgctgtaatacttaaggttaag

SEQ ID NO: 9240923 - DNA, 22 bp, Homo sapiens
tgctgtcagttggcaggatgag

SEQ ID NO: 9240924 - DNA, 22 bp, Homo sapiens
tgctgtcccccgtgtctgggct

SEQ ID NO: 9240925 - DNA, 22 bp, Homo sapiens
tgctgggcttgaaagctgctaa

SEQ ID NO: 9240926 - DNA, 22 bp, Homo sapiens
tgctgggcttgaaagctgctaa

SEQ ID NO: 9240927 - DNA, 22 bp, Homo sapiens
tgctgggcttcaactgcctgag

SEQ ID NO: 9240928 - DNA, 21 bp, Homo sapiens
tgctgggctgcaggggatgca

SEQ ID NO: 9240929 - DNA, 22 bp, Homo sapiens
tgctgggctggagctgccaggg

SEQ ID NO: 9240930 - DNA, 22 bp, Homo sapiens
tgctgggctagggtggagctct

SEQ ID NO: 9240931 - DNA, 22 bp, Homo sapiens
tgctgggctagggtggagctct

SEQ ID NO: 9240932 - DNA, 22 bp, Homo sapiens
tgctgggctagaagctgaggcc

SEQ ID NO: 9240933 - DNA, 22 bp, Homo sapiens
tgctgggctagaagctgaggcc

SEQ ID NO: 9240934 - DNA, 22 bp, Homo sapiens
tgctgggctagggtggagctct

SEQ ID NO: 9240935 - DNA, 22 bp, Homo sapiens
tgctgggctagaagctgaggcc

SEQ ID NO: 9240936 - DNA, 22 bp, Homo sapiens
tgctgggctagaagctgaggcc

SEQ ID NO: 9240937 - DNA, 22 bp, Homo sapiens
tgctgggctagaagctgaggcc

SEQ ID NO: 9240938 - DNA, 22 bp, Homo sapiens
tgctgggcctttacctccaggg

SEQ ID NO: 9240939 - DNA, 23 bp, Homo sapiens
tgctgggcagagctggtgctgag

SEQ ID NO: 9240940 - DNA, 23 bp, Homo sapiens
tgctgggcagagctggtgctgag

SEQ ID NO: 9240941 - DNA, 20 bp, Homo sapiens
tgctgggcatgcagtggaaa

SEQ ID NO: 9240942 - DNA, 23 bp, Homo sapiens
tgctgggcagagctggtgctgag

SEQ ID NO: 9240943 - DNA, 22 bp, Homo sapiens
tgctgggcatcgtaggaggtac

SEQ ID NO: 9240944 - DNA, 22 bp, Homo sapiens
tgctgggcccagggagcctctg

SEQ ID NO: 9240945 - DNA, 22 bp, Homo sapiens
tgctgggcccccagtgaccttc

SEQ ID NO: 9240946 - DNA, 22 bp, Homo sapiens
tgctgggcctcttccctggata

SEQ ID NO: 9240947 - DNA, 22 bp, Homo sapiens
tgctgggccaaagcagggtttt

SEQ ID NO: 9240948 - DNA, 22 bp, Homo sapiens
tgctgggcatttatgcagatgg

SEQ ID NO: 9240949 - DNA, 22 bp, Homo sapiens
tgctgggcatttatgcagatgg

SEQ ID NO: 9240950 - DNA, 21 bp, Homo sapiens
tgcttctctagatcaactact

SEQ ID NO: 9240951 - DNA, 22 bp, Homo sapiens
tgcttctcccaaccagggcctg

SEQ ID NO: 9240952 - DNA, 23 bp, Homo sapiens
tgcttctctgcttgacagttctg

SEQ ID NO: 9240953 - DNA, 22 bp, Homo sapiens
tgcttctgaaatgcaggtcttc

SEQ ID NO: 9240954 - DNA, 22 bp, Homo sapiens
tgcttctgatgtgagcagcccc

SEQ ID NO: 9240955 - DNA, 22 bp, Homo sapiens
tgcttctgcaacttgaatgtac

SEQ ID NO: 9240956 - DNA, 22 bp, Homo sapiens
tgcttctgcaggagctcctgat

SEQ ID NO: 9240957 - DNA, 22 bp, Homo sapiens
tgcttctgactaagctgcatga

SEQ ID NO: 9240958 - DNA, 22 bp, Homo sapiens
tgcttctgagttgcaggacttg

SEQ ID NO: 9240959 - DNA, 22 bp, Homo sapiens
tgcttctgaactcagcatgtgg

SEQ ID NO: 9240960 - DNA, 22 bp, Homo sapiens
tgcttctgaactcagcatgtgg

SEQ ID NO: 9240961 - DNA, 22 bp, Homo sapiens
tgcttcaggagatgtcaccatg

SEQ ID NO: 9240962 - DNA, 22 bp, Homo sapiens
tgcttcagtgctctgagcctgt

SEQ ID NO: 9240963 - DNA, 22 bp, Homo sapiens
tgcttcaggaagaaacgccagg

SEQ ID NO: 9240964 - DNA, 22 bp, Homo sapiens
tgcttcaggagatgtcaccatg

SEQ ID NO: 9240965 - DNA, 22 bp, Homo sapiens
tgcttcagtgtgtcattattta

SEQ ID NO: 9240966 - DNA, 17 bp, Homo sapiens
tgcttcatcccgatcct

SEQ ID NO: 9240967 - DNA, 22 bp, Homo sapiens
tgcttcagaggaaaggcaaaag

SEQ ID NO: 9240968 - DNA, 22 bp, Homo sapiens
tgcttcagcactttgagagcct

SEQ ID NO: 9240969 - DNA, 22 bp, Homo sapiens
tgcttcaagttgaaatattctt

SEQ ID NO: 9240970 - DNA, 22 bp, Homo sapiens
tgcttcaaggccatgtcaagct

SEQ ID NO: 9240971 - DNA, 22 bp, Homo sapiens
tgcttcaaaaagttgttagagg

SEQ ID NO: 9240972 - DNA, 22 bp, Homo sapiens
tgcttcaagttgaaatattctt

SEQ ID NO: 9240973 - DNA, 22 bp, Homo sapiens
tgcttcacaagaattcaggacc

SEQ ID NO: 9240974 - DNA, 22 bp, Homo sapiens
tgcttattaaacatgcatattc

SEQ ID NO: 9240975 - DNA, 22 bp, Homo sapiens
tgcttattgctttcaagactgt

SEQ ID NO: 9240976 - DNA, 22 bp, Homo sapiens
tgcttcaaggacactgactttt

SEQ ID NO: 9240977 - DNA, 22 bp, Homo sapiens
tgcttaatattgtgatgtaata

SEQ ID NO: 9240978 - DNA, 22 bp, Homo sapiens
tgcttaataggagttgaacatt

SEQ ID NO: 9240979 - DNA, 22 bp, Homo sapiens
tgcttaaatttcagcagcttaa

SEQ ID NO: 9240980 - DNA, 22 bp, Homo sapiens
tgcttaaatttcagcagcttaa

SEQ ID NO: 9240981 - DNA, 22 bp, Homo sapiens
tgcttacaactttattgaggaa

SEQ ID NO: 9240982 - DNA, 22 bp, Homo sapiens
tgcttaaaggatagtttaaact

SEQ ID NO: 9240983 - DNA, 22 bp, Homo sapiens
tgcttagaatctggacttgttg

SEQ ID NO: 9240984 - DNA, 22 bp, Homo sapiens
tgcttagacgtcaagtacagcc

SEQ ID NO: 9240985 - DNA, 22 bp, Homo sapiens
tgcttaaaccctgatcatgtgt

SEQ ID NO: 9240986 - DNA, 22 bp, Homo sapiens
tgcttaaagctgctcagttgta

SEQ ID NO: 9240987 - DNA, 22 bp, Homo sapiens
tgcttaaagctgctcagttgta

SEQ ID NO: 9240988 - DNA, 22 bp, Homo sapiens
tgcttaaagtagtggattgtta

SEQ ID NO: 9240989 - DNA, 22 bp, Homo sapiens
tgcttaaacacatacatacata

SEQ ID NO: 9240990 - DNA, 22 bp, Homo sapiens
tgcttaaacatactatttatat

SEQ ID NO: 9240991 - DNA, 22 bp, Homo sapiens
tgcttaaacacatacatacata

SEQ ID NO: 9240992 - DNA, 22 bp, Homo sapiens
tgcttaaaatagttcatttttg

SEQ ID NO: 9240993 - DNA, 22 bp, Homo sapiens
tgctgtgacccaaaaaagacct

SEQ ID NO: 9240994 - DNA, 22 bp, Homo sapiens
tgctgtccctaagtctcttcaa

SEQ ID NO: 9240995 - DNA, 22 bp, Homo sapiens
tgcttaaaatgatgattatttt

SEQ ID NO: 9240996 - DNA, 22 bp, Homo sapiens
tgcttaaaaacagtatggtagt

SEQ ID NO: 9240997 - DNA, 22 bp, Homo sapiens
tgcttaaaaagtaactgctgat

SEQ ID NO: 9240998 - DNA, 22 bp, Homo sapiens
tgctgtgaggttgagaaggaag

SEQ ID NO: 9240999 - DNA, 22 bp, Homo sapiens
tgctgtgaggttgagaaggaag

SEQ ID NO: 9241000 - DNA, 22 bp, Homo sapiens
tgctgtgaggttgagaaggaag

SEQ ID NO: 9241001 - DNA, 20 bp, Homo sapiens
tgctgcctactaagccctca

SEQ ID NO: 9241002 - DNA, 22 bp, Homo sapiens
tgctgcctccttcctgccagga

SEQ ID NO: 9241003 - DNA, 22 bp, Homo sapiens
tgctgccatgcagagcaacaga

SEQ ID NO: 9241004 - DNA, 22 bp, Homo sapiens
tgctgccatggtcgctggtgtc

SEQ ID NO: 9241005 - DNA, 22 bp, Homo sapiens
tgctgcccgtacctgtgcactt

SEQ ID NO: 9241006 - DNA, 22 bp, Homo sapiens
tgctgcccactgtatttctcca

SEQ ID NO: 9241007 - DNA, 22 bp, Homo sapiens
tgctgcctccttcctgccagga

SEQ ID NO: 9241008 - DNA, 22 bp, Homo sapiens
tgctgctcgccacggcccaggg

SEQ ID NO: 9241009 - DNA, 21 bp, Homo sapiens
tgctgctgatcggggttggct

SEQ ID NO: 9241010 - DNA, 22 bp, Homo sapiens
tgctgctgatgcatagtctgct

SEQ ID NO: 9241011 - DNA, 22 bp, Homo sapiens
tgctgctgatcatttatagtct

SEQ ID NO: 9241012 - DNA, 22 bp, Homo sapiens
tgctgctgacatttggggcttg

SEQ ID NO: 9241013 - DNA, 22 bp, Homo sapiens
tgctgccagagagacagggact

SEQ ID NO: 9241014 - DNA, 22 bp, Homo sapiens
tgctgccactggtagtctcatt

SEQ ID NO: 9241015 - DNA, 22 bp, Homo sapiens
tgctgccagccaggccatggag

SEQ ID NO: 9241016 - DNA, 22 bp, Homo sapiens
tgctgccagccaggccatggag

SEQ ID NO: 9241017 - DNA, 21 bp, Homo sapiens
tgctgccatagacctgaggga

SEQ ID NO: 9241018 - DNA, 21 bp, Homo sapiens
tgctgccatcatgcagagatg

SEQ ID NO: 9241019 - DNA, 22 bp, Homo sapiens
tgctgccagggctctgcccaca

SEQ ID NO: 9241020 - DNA, 22 bp, Homo sapiens
tgctgccaggtcttgctgtcca

SEQ ID NO: 9241021 - DNA, 22 bp, Homo sapiens
tgctgccaggtcttgctgtcca

SEQ ID NO: 9241022 - DNA, 22 bp, Homo sapiens
tgctgccacatttaaagagggg

SEQ ID NO: 9241023 - DNA, 22 bp, Homo sapiens
tgctgccacccctcaccagagc

SEQ ID NO: 9241024 - DNA, 22 bp, Homo sapiens
tgctgccacctggtggctgaag

SEQ ID NO: 9241025 - DNA, 22 bp, Homo sapiens
tgctgccacaaattcagctgcc

SEQ ID NO: 9241026 - DNA, 17 bp, Homo sapiens
tgctgccaagtcccaac

SEQ ID NO: 9241027 - DNA, 22 bp, Homo sapiens
tgctgcatagcagctcctgaaa

SEQ ID NO: 9241028 - DNA, 20 bp, Homo sapiens
tgctgcagtttcatgggact

SEQ ID NO: 9241029 - DNA, 22 bp, Homo sapiens
tgctgcattcaggagcacagtt

SEQ ID NO: 9241030 - DNA, 22 bp, Homo sapiens
tgctgccaagcccgtgctcctg

SEQ ID NO: 9241031 - DNA, 22 bp, Homo sapiens
tgctgccaaatgcgagctctgt

SEQ ID NO: 9241032 - DNA, 20 bp, Homo sapiens
tgctgctttgccactagttg

SEQ ID NO: 9241033 - DNA, 22 bp, Homo sapiens
tgctgcttttgtatatcagaga

SEQ ID NO: 9241034 - DNA, 22 bp, Homo sapiens
tgctgcttttagttggatagaa

SEQ ID NO: 9241035 - DNA, 22 bp, Homo sapiens
tgctgctttgatgtgtaaatca

SEQ ID NO: 9241036 - DNA, 22 bp, Homo sapiens
tgctgcttcacctgttgtacag

SEQ ID NO: 9241037 - DNA, 22 bp, Homo sapiens
tgctgctgttgacggctgtcca

SEQ ID NO: 9241038 - DNA, 20 bp, Homo sapiens
tgctgctgtgagcgtccctg

SEQ ID NO: 9241039 - DNA, 22 bp, Homo sapiens
tgctgctgtatccttagtgtca

SEQ ID NO: 9241040 - DNA, 19 bp, Homo sapiens
tgctgctgtccttgcaggg

SEQ ID NO: 9241041 - DNA, 22 bp, Homo sapiens
tgctgctgggtttgacagtcac

SEQ ID NO: 9241042 - DNA, 22 bp, Homo sapiens
tgctgctgtatcatgccttcat

SEQ ID NO: 9241043 - DNA, 20 bp, Homo sapiens
tgctgctgcctccgcctctg

SEQ ID NO: 9241044 - DNA, 22 bp, Homo sapiens
tgctgctgatggcacctaggca

SEQ ID NO: 9241045 - DNA, 20 bp, Homo sapiens
tgctgctgcttcacccccat

SEQ ID NO: 9241046 - DNA, 22 bp, Homo sapiens
tgctgctgcttctgtacagcct

SEQ ID NO: 9241047 - DNA, 22 bp, Homo sapiens
tgctgctggatcttactcatct

SEQ ID NO: 9241048 - DNA, 22 bp, Homo sapiens
tgctggagaagctcctgggact

SEQ ID NO: 9241049 - DNA, 22 bp, Homo sapiens
tgctggagcggaggtgagccag

SEQ ID NO: 9241050 - DNA, 22 bp, Homo sapiens
tgctggagaactgctctgtgtt

SEQ ID NO: 9241051 - DNA, 22 bp, Homo sapiens
tgctggagaactgctctgtgtt

SEQ ID NO: 9241052 - DNA, 21 bp, Homo sapiens
tgctggaaaaagtggttctag

SEQ ID NO: 9241053 - DNA, 21 bp, Homo sapiens
tgctggctgaaaggcacagag

SEQ ID NO: 9241054 - DNA, 21 bp, Homo sapiens
tgctggctgaaaggcacagag

SEQ ID NO: 9241055 - DNA, 23 bp, Homo sapiens
tgctggctgaaacagccaaagga

SEQ ID NO: 9241056 - DNA, 22 bp, Homo sapiens
tgctggctcccaggagccgctg

SEQ ID NO: 9241057 - DNA, 22 bp, Homo sapiens
tgctggctcctcgaggcttcgt

SEQ ID NO: 9241058 - DNA, 22 bp, Homo sapiens
tgctggctactgatggcaggcc

SEQ ID NO: 9241059 - DNA, 23 bp, Homo sapiens
tgctggctgtgttattgccaaca

SEQ ID NO: 9241060 - DNA, 22 bp, Homo sapiens
tgctggctgtgtaccatctcaa

SEQ ID NO: 9241061 - DNA, 22 bp, Homo sapiens
tgctggcttcctgtgcacagca

SEQ ID NO: 9241062 - DNA, 22 bp, Homo sapiens
tgctggctgttctagggaggcc

SEQ ID NO: 9241063 - DNA, 22 bp, Homo sapiens
tgctggctgcagtgctgtcaaa

SEQ ID NO: 9241064 - DNA, 22 bp, Homo sapiens
tgctggctggcctggcctggac

SEQ ID NO: 9241065 - DNA, 22 bp, Homo sapiens
tgctggctgtatatgtgagagt

SEQ ID NO: 9241066 - DNA, 22 bp, Homo sapiens
tgctggcatgcatgctgtagga

SEQ ID NO: 9241067 - DNA, 22 bp, Homo sapiens
tgctggcagccatgccttggaa

SEQ ID NO: 9241068 - DNA, 22 bp, Homo sapiens
tgctggcacgtgactgggaagt

SEQ ID NO: 9241069 - DNA, 22 bp, Homo sapiens
tgctggcacatagagactggct

SEQ ID NO: 9241070 - DNA, 23 bp, Homo sapiens
tgctggagtttactcaggccagc

SEQ ID NO: 9241071 - DNA, 23 bp, Homo sapiens
tgctggagtttactcaggccagc

SEQ ID NO: 9241072 - DNA, 23 bp, Homo sapiens
tgctggagtttactcaggccagc

SEQ ID NO: 9241073 - DNA, 22 bp, Homo sapiens
tgctggatgcttgattttgagg

SEQ ID NO: 9241074 - DNA, 22 bp, Homo sapiens
tgctggagttcgacattgcaaa

SEQ ID NO: 9241075 - DNA, 22 bp, Homo sapiens
tgctggagttcgacattgcaaa

SEQ ID NO: 9241076 - DNA, 22 bp, Homo sapiens
tgctggagtggcactgtgtggc

SEQ ID NO: 9241077 - DNA, 22 bp, Homo sapiens
tgctggaggcagtggaggtgcc

SEQ ID NO: 9241078 - DNA, 22 bp, Homo sapiens
tgctggaggattaaacaagtca

SEQ ID NO: 9241079 - DNA, 22 bp, Homo sapiens
tgctggaggagtttactgtggc

SEQ ID NO: 9241080 - DNA, 22 bp, Homo sapiens
tgctggaggcctgactgtgttt

SEQ ID NO: 9241081 - DNA, 22 bp, Homo sapiens
tgctggaggccgagaagcagca

SEQ ID NO: 9241082 - DNA, 19 bp, Homo sapiens
tgctggagggtagtgagtc

SEQ ID NO: 9241083 - DNA, 22 bp, Homo sapiens
tgctggagggggtaccactcaa

SEQ ID NO: 9241084 - DNA, 22 bp, Homo sapiens
tgctggaggggcctgaccagga

SEQ ID NO: 9241085 - DNA, 22 bp, Homo sapiens
tgctggagtaacaagacactca

SEQ ID NO: 9241086 - DNA, 19 bp, Homo sapiens
tgctggaggttgacagggt

SEQ ID NO: 9241087 - DNA, 19 bp, Homo sapiens
tgctggaggttgacagggt

SEQ ID NO: 9241088 - DNA, 19 bp, Homo sapiens
tgctggaggttgacagggt

SEQ ID NO: 9241089 - DNA, 22 bp, Homo sapiens
tggaggagaactccctggctac

SEQ ID NO: 9241090 - DNA, 22 bp, Homo sapiens
tggaggagaatttatggtcgaa

SEQ ID NO: 9241091 - DNA, 22 bp, Homo sapiens
tggaggagaccattccactcag

SEQ ID NO: 9241092 - DNA, 22 bp, Homo sapiens
tggaggagaccattccactcag

SEQ ID NO: 9241093 - DNA, 19 bp, Homo sapiens
tggaggagaggaaaagtca

SEQ ID NO: 9241094 - DNA, 22 bp, Homo sapiens
tggaggaggaacttcttatctc

SEQ ID NO: 9241095 - DNA, 22 bp, Homo sapiens
tggaggagggctggtgtctgta

SEQ ID NO: 9241096 - DNA, 22 bp, Homo sapiens
tggaggagggctggtgtctgta

SEQ ID NO: 9241097 - DNA, 22 bp, Homo sapiens
tggaggattaatctggaaagat

SEQ ID NO: 9241098 - DNA, 22 bp, Homo sapiens
tggaggcaactgaagatgtagt

SEQ ID NO: 9241099 - DNA, 22 bp, Homo sapiens
tggaggatgcctggggaggcct

SEQ ID NO: 9241100 - DNA, 22 bp, Homo sapiens
tggaggagggctggtgtctgta

SEQ ID NO: 9241101 - DNA, 23 bp, Homo sapiens
tggagctgggctcagaccctggg

SEQ ID NO: 9241102 - DNA, 22 bp, Homo sapiens
tggagctggggtttgaatctgg

SEQ ID NO: 9241103 - DNA, 23 bp, Homo sapiens
tggagctgggctcagaccctggg

SEQ ID NO: 9241104 - DNA, 22 bp, Homo sapiens
tggagctggggtttgaatctgg

SEQ ID NO: 9241105 - DNA, 22 bp, Homo sapiens
tggagctggtaaacagtgacat

SEQ ID NO: 9241106 - DNA, 22 bp, Homo sapiens
tggagctgggagtcctgggctg

SEQ ID NO: 9241107 - DNA, 22 bp, Homo sapiens
tggagctgggagtcctgggctg

SEQ ID NO: 9241108 - DNA, 23 bp, Homo sapiens
tggagctgggctcagaccctggg

SEQ ID NO: 9241109 - DNA, 22 bp, Homo sapiens
tggagctggtaaacagtgacat

SEQ ID NO: 9241110 - DNA, 20 bp, Homo sapiens
tggagctgtaatcttgtctg

SEQ ID NO: 9241111 - DNA, 22 bp, Homo sapiens
tggagctgtcactcagaaccaa

SEQ ID NO: 9241112 - DNA, 22 bp, Homo sapiens
tggagcttgggactcttggtag

SEQ ID NO: 9241113 - DNA, 22 bp, Homo sapiens
tggagcttgggactcttggtag

SEQ ID NO: 9241114 - DNA, 22 bp, Homo sapiens
tggaggaaaaaaccaggcagag

SEQ ID NO: 9241115 - DNA, 20 bp, Homo sapiens
tggagctgtggtaaggagca

SEQ ID NO: 9241116 - DNA, 19 bp, Homo sapiens
tggaggccaggacacaggt

SEQ ID NO: 9241117 - DNA, 22 bp, Homo sapiens
tggaggccagtgaaagtagatt

SEQ ID NO: 9241118 - DNA, 22 bp, Homo sapiens
tggaggcagtaactgagcaaca

SEQ ID NO: 9241119 - DNA, 22 bp, Homo sapiens
tggaggcagtaactgagcaaca

SEQ ID NO: 9241120 - DNA, 22 bp, Homo sapiens
tggaggcagtaactgagcaaca

SEQ ID NO: 9241121 - DNA, 22 bp, Homo sapiens
tggaggcagtcaaatgactgac

SEQ ID NO: 9241122 - DNA, 22 bp, Homo sapiens
tggaggcagtcaaatgactgac

SEQ ID NO: 9241123 - DNA, 22 bp, Homo sapiens
tggaggcagtcacctgaagtca

SEQ ID NO: 9241124 - DNA, 19 bp, Homo sapiens
tggaggcctcaggaaaaga

SEQ ID NO: 9241125 - DNA, 22 bp, Homo sapiens
tggaggcctaggttgatgtgtg

SEQ ID NO: 9241126 - DNA, 22 bp, Homo sapiens
tggaggctggagtgcagtggcg

SEQ ID NO: 9241127 - DNA, 22 bp, Homo sapiens
tggaggccgaattagagcgttg

SEQ ID NO: 9241128 - DNA, 22 bp, Homo sapiens
tggaggccgcgtagtctgagca

SEQ ID NO: 9241129 - DNA, 22 bp, Homo sapiens
tggaggcaactgaagatgtagt

SEQ ID NO: 9241130 - DNA, 22 bp, Homo sapiens
tggaggcaactgaagatgtagt

SEQ ID NO: 9241131 - DNA, 22 bp, Homo sapiens
tggaggcactaaatggccacaa

SEQ ID NO: 9241132 - DNA, 20 bp, Homo sapiens
tggaggcagagccagaggga

SEQ ID NO: 9241133 - DNA, 20 bp, Homo sapiens
tggaggcacctgtggagatc

SEQ ID NO: 9241134 - DNA, 22 bp, Homo sapiens
tggaggcaggggatacaggtca

SEQ ID NO: 9241135 - DNA, 22 bp, Homo sapiens
tggaggcaggagacagggcaaa

SEQ ID NO: 9241136 - DNA, 22 bp, Homo sapiens
tggaggcaggtggaggagtgaa

SEQ ID NO: 9241137 - DNA, 18 bp, Homo sapiens
tggaggcagagttctggc

SEQ ID NO: 9241138 - DNA, 18 bp, Homo sapiens
tggaggcagagttctggc

SEQ ID NO: 9241139 - DNA, 22 bp, Homo sapiens
tggaggcaggagacagggcaaa

SEQ ID NO: 9241140 - DNA, 22 bp, Homo sapiens
tggataaactcactgtaagttg

SEQ ID NO: 9241141 - DNA, 23 bp, Homo sapiens
tggataaagctgtgctgcatagg

SEQ ID NO: 9241142 - DNA, 21 bp, Homo sapiens
tggataaaggcacttttcatc

SEQ ID NO: 9241143 - DNA, 22 bp, Homo sapiens
tggagtgggcaatgtaggcaag

SEQ ID NO: 9241144 - DNA, 22 bp, Homo sapiens
tggagtgggcaatgtaggcaag

SEQ ID NO: 9241145 - DNA, 20 bp, Homo sapiens
tggatgctgcacgtagatgg

SEQ ID NO: 9241146 - DNA, 22 bp, Homo sapiens
tggatgctgagaacactgcctg

SEQ ID NO: 9241147 - DNA, 22 bp, Homo sapiens
tggatgctatggagtatttaga

SEQ ID NO: 9241148 - DNA, 22 bp, Homo sapiens
tggatggggcagcttaggtgtg

SEQ ID NO: 9241149 - DNA, 22 bp, Homo sapiens
tggatgcttaaatcgtttgaat

SEQ ID NO: 9241150 - DNA, 22 bp, Homo sapiens
tggatgctgtaggacacgctct

SEQ ID NO: 9241151 - DNA, 22 bp, Homo sapiens
tggatgctgtaggacacgctct

SEQ ID NO: 9241152 - DNA, 16 bp, Homo sapiens
tggaggtgtttctagt

SEQ ID NO: 9241153 - DNA, 22 bp, Homo sapiens
tggaggtgtccaactcgtgggt

SEQ ID NO: 9241154 - DNA, 22 bp, Homo sapiens
tggaggtgtccaactcgtgggt

SEQ ID NO: 9241155 - DNA, 22 bp, Homo sapiens
tggagtgaagtaaagaggacaa

SEQ ID NO: 9241156 - DNA, 22 bp, Homo sapiens
tggagtcatgatggctgctgat

SEQ ID NO: 9241157 - DNA, 22 bp, Homo sapiens
tggagtggacttcatgaggcca

SEQ ID NO: 9241158 - DNA, 22 bp, Homo sapiens
tggagtgcaatagtaataaggt

SEQ ID NO: 9241159 - DNA, 22 bp, Homo sapiens
tggagtgaagtaaagaggacaa

SEQ ID NO: 9241160 - DNA, 22 bp, Homo sapiens
tggaggctgtgtgcatgagacc

SEQ ID NO: 9241161 - DNA, 22 bp, Homo sapiens
tggaggctgtgtgcatgagacc

SEQ ID NO: 9241162 - DNA, 22 bp, Homo sapiens
tggaggctgtgtgcatgagacc

SEQ ID NO: 9241163 - DNA, 22 bp, Homo sapiens
tggaggctggtttctgctgagg

SEQ ID NO: 9241164 - DNA, 22 bp, Homo sapiens
tggaggctgtgtgcatgagacc

SEQ ID NO: 9241165 - DNA, 22 bp, Homo sapiens
tggaggctggtttctgctgagg

SEQ ID NO: 9241166 - DNA, 22 bp, Homo sapiens
tggagggaacccaggctgctct

SEQ ID NO: 9241167 - DNA, 22 bp, Homo sapiens
tggagggaacccaggctgctct

SEQ ID NO: 9241168 - DNA, 22 bp, Homo sapiens
tggagggaacaaaggagtccca

SEQ ID NO: 9241169 - DNA, 22 bp, Homo sapiens
tggagggaacccaggctgctct

SEQ ID NO: 9241170 - DNA, 22 bp, Homo sapiens
tggagggcatctgtggtcaggc

SEQ ID NO: 9241171 - DNA, 22 bp, Homo sapiens
tggagggcatagctgttctttc

SEQ ID NO: 9241172 - DNA, 23 bp, Homo sapiens
tggagggcagaataacagactac

SEQ ID NO: 9241173 - DNA, 22 bp, Homo sapiens
tggagggatacaaagatgaaaa

SEQ ID NO: 9241174 - DNA, 22 bp, Homo sapiens
tggagggcatctgtggtcaggc

SEQ ID NO: 9241175 - DNA, 22 bp, Homo sapiens
tggagggcgcttagatggaggg

SEQ ID NO: 9241176 - DNA, 22 bp, Homo sapiens
tggagggctctttcacctggta

SEQ ID NO: 9241177 - DNA, 22 bp, Homo sapiens
tggaggtggagttggaaactga

SEQ ID NO: 9241178 - DNA, 22 bp, Homo sapiens
tggaggtggagttggaaactga

SEQ ID NO: 9241179 - DNA, 22 bp, Homo sapiens
tggagggctaagctgagggata

SEQ ID NO: 9241180 - DNA, 22 bp, Homo sapiens
tggagggctaagctgagggata

SEQ ID NO: 9241181 - DNA, 22 bp, Homo sapiens
tggagggctctttcacctggta

SEQ ID NO: 9241182 - DNA, 22 bp, Homo sapiens
tggagggcgcttagatggaggg

SEQ ID NO: 9241183 - DNA, 22 bp, Homo sapiens
tggagggctaagctgagggata

SEQ ID NO: 9241184 - DNA, 22 bp, Homo sapiens
tggaggtggcacaagggaggtc

SEQ ID NO: 9241185 - DNA, 22 bp, Homo sapiens
tggaggtggcatctgacagctg

SEQ ID NO: 9241186 - DNA, 22 bp, Homo sapiens
tggaggtgggagggactgtcct

SEQ ID NO: 9241187 - DNA, 22 bp, Homo sapiens
tggaggtgggagggactgtcct

SEQ ID NO: 9241188 - DNA, 20 bp, Homo sapiens
tggaggtggtctgctgtcct

SEQ ID NO: 9241189 - DNA, 22 bp, Homo sapiens
tggaggtggggctcaggaatct

SEQ ID NO: 9241190 - DNA, 22 bp, Homo sapiens
tggaggtggtgcccagcaattt

SEQ ID NO: 9241191 - DNA, 22 bp, Homo sapiens
tggaggtgtataaggtagcttc

SEQ ID NO: 9241192 - DNA, 22 bp, Homo sapiens
tggaggtgtataaggtagcttc

SEQ ID NO: 9241193 - DNA, 20 bp, Homo sapiens
tggaggtggtctgctgtcct

SEQ ID NO: 9241194 - DNA, 20 bp, Homo sapiens
tggagagcctctggactgtg

SEQ ID NO: 9241195 - DNA, 22 bp, Homo sapiens
tggagagcagggctggagttca

SEQ ID NO: 9241196 - DNA, 22 bp, Homo sapiens
tggagagcaagtcgcagacatg

SEQ ID NO: 9241197 - DNA, 22 bp, Homo sapiens
tggagagcaagtcgcagacatg

SEQ ID NO: 9241198 - DNA, 22 bp, Homo sapiens
tggagagcaagtcgcagacatg

SEQ ID NO: 9241199 - DNA, 18 bp, Homo sapiens
tggagagcagcagtgggg

SEQ ID NO: 9241200 - DNA, 22 bp, Homo sapiens
tggagagcaatgaggggcaggc

SEQ ID NO: 9241201 - DNA, 22 bp, Homo sapiens
tggagagctggttcaaagcaga

SEQ ID NO: 9241202 - DNA, 22 bp, Homo sapiens
tggagagcgtgcttagcactct

SEQ ID NO: 9241203 - DNA, 19 bp, Homo sapiens
tggagaggaaatgctgctc

SEQ ID NO: 9241204 - DNA, 22 bp, Homo sapiens
tggagaaaaggttgaatccatc

SEQ ID NO: 9241205 - DNA, 22 bp, Homo sapiens
tggagaagattggtcaccattc

SEQ ID NO: 9241206 - DNA, 22 bp, Homo sapiens
tggagaaagctgcatatggaaa

SEQ ID NO: 9241207 - DNA, 22 bp, Homo sapiens
tggagaagctgtaggtggactc

SEQ ID NO: 9241208 - DNA, 22 bp, Homo sapiens
tggagaagctgtaggtggactc

SEQ ID NO: 9241209 - DNA, 22 bp, Homo sapiens
tggagaaggggcagggtctcca

SEQ ID NO: 9241210 - DNA, 22 bp, Homo sapiens
tggagaaggggcagggtctcca

SEQ ID NO: 9241211 - DNA, 22 bp, Homo sapiens
tggagaaggccggccaggagtg

SEQ ID NO: 9241212 - DNA, 22 bp, Homo sapiens
tggagaaggacagcctgagaaa

SEQ ID NO: 9241213 - DNA, 22 bp, Homo sapiens
tggagaaggacagcctgagaaa

SEQ ID NO: 9241214 - DNA, 22 bp, Homo sapiens
tggagaaggacagcctgagaaa

SEQ ID NO: 9241215 - DNA, 22 bp, Homo sapiens
tggagaagtcaaagtgaacagg

SEQ ID NO: 9241216 - DNA, 22 bp, Homo sapiens
tggagaagtcaaagtgaacagg

SEQ ID NO: 9241217 - DNA, 22 bp, Homo sapiens
tggagagaagaggcagtgtgct

SEQ ID NO: 9241218 - DNA, 22 bp, Homo sapiens
tggagagaagaggcagtgtgct

SEQ ID NO: 9241219 - DNA, 22 bp, Homo sapiens
tggagcagccatgatgacagag

SEQ ID NO: 9241220 - DNA, 22 bp, Homo sapiens
tggagcagccatgatgacagag

SEQ ID NO: 9241221 - DNA, 22 bp, Homo sapiens
tggagcagccatgatgacagag

SEQ ID NO: 9241222 - DNA, 22 bp, Homo sapiens
tggagcagccttttctaagcaa

SEQ ID NO: 9241223 - DNA, 22 bp, Homo sapiens
tggagcagccttttctaagcaa

SEQ ID NO: 9241224 - DNA, 22 bp, Homo sapiens
tggagcagctaagcctctgaga

SEQ ID NO: 9241225 - DNA, 22 bp, Homo sapiens
tggagcagccatgatgacagag

SEQ ID NO: 9241226 - DNA, 22 bp, Homo sapiens
tggagcagcacaagaaagggga

SEQ ID NO: 9241227 - DNA, 22 bp, Homo sapiens
tggagcagcatcactttgagct

SEQ ID NO: 9241228 - DNA, 22 bp, Homo sapiens
tggagcagaggaagaaggcttt

SEQ ID NO: 9241229 - DNA, 22 bp, Homo sapiens
tggagcagaggaagaaggcttt

SEQ ID NO: 9241230 - DNA, 22 bp, Homo sapiens
tggagcagaggaagaaggcttt

SEQ ID NO: 9241231 - DNA, 22 bp, Homo sapiens
tggagcagaggctgaggttggg

SEQ ID NO: 9241232 - DNA, 22 bp, Homo sapiens
tggagcagaggaagaaggcttt

SEQ ID NO: 9241233 - DNA, 22 bp, Homo sapiens
tggagcagagatggtggccttc

SEQ ID NO: 9241234 - DNA, 22 bp, Homo sapiens
tggagcagagttcagcggggag

SEQ ID NO: 9241235 - DNA, 22 bp, Homo sapiens
tggagcagcacaagaaagggga

SEQ ID NO: 9241236 - DNA, 22 bp, Homo sapiens
tggagcagcacaagaaagggga

SEQ ID NO: 9241237 - DNA, 22 bp, Homo sapiens
tggagagtctctgagccagggc

SEQ ID NO: 9241238 - DNA, 22 bp, Homo sapiens
tggagagtctctgagccagggc

SEQ ID NO: 9241239 - DNA, 22 bp, Homo sapiens
tggagagtctcaaggcaggaaa

SEQ ID NO: 9241240 - DNA, 22 bp, Homo sapiens
tggagagtggtttgggggacat

SEQ ID NO: 9241241 - DNA, 22 bp, Homo sapiens
tggagagtggatatgggagcaa

SEQ ID NO: 9241242 - DNA, 22 bp, Homo sapiens
tggagcagagatgggagcccaa

SEQ ID NO: 9241243 - DNA, 22 bp, Homo sapiens
tggagcagagatggtggccttc

SEQ ID NO: 9241244 - DNA, 22 bp, Homo sapiens
tggagcagagatgggagcccaa

SEQ ID NO: 9241245 - DNA, 22 bp, Homo sapiens
tggagaggtttaaacaaaagtt

SEQ ID NO: 9241246 - DNA, 22 bp, Homo sapiens
tggagagtaaatggcagaatca

SEQ ID NO: 9241247 - DNA, 18 bp, Homo sapiens
tggagccattgccaccat

SEQ ID NO: 9241248 - DNA, 22 bp, Homo sapiens
tggagctgaactttgaggccag

SEQ ID NO: 9241249 - DNA, 21 bp, Homo sapiens
tggagctgaatttttggcatc

SEQ ID NO: 9241250 - DNA, 22 bp, Homo sapiens
tggagctgaactttgaggccag

SEQ ID NO: 9241251 - DNA, 18 bp, Homo sapiens
tggagctgagtgctgtgc

SEQ ID NO: 9241252 - DNA, 22 bp, Homo sapiens
tggagccttttgttctgggaca

SEQ ID NO: 9241253 - DNA, 22 bp, Homo sapiens
tggagctgaactttgaggccag

SEQ ID NO: 9241254 - DNA, 22 bp, Homo sapiens
tggagctggaagaatgtagacg

SEQ ID NO: 9241255 - DNA, 17 bp, Homo sapiens
tggagctgcgtgtgttc

SEQ ID NO: 9241256 - DNA, 17 bp, Homo sapiens
tggagctgcgtgtgttc

SEQ ID NO: 9241257 - DNA, 17 bp, Homo sapiens
tggagctgcgtgtgttc

SEQ ID NO: 9241258 - DNA, 21 bp, Homo sapiens
tggagctgccacttgagctgc

SEQ ID NO: 9241259 - DNA, 21 bp, Homo sapiens
tggagctgccacttgtcctcc

SEQ ID NO: 9241260 - DNA, 18 bp, Homo sapiens
tggagctgagtgctgtgc

SEQ ID NO: 9241261 - DNA, 22 bp, Homo sapiens
tggagctgatacagctggcttt

SEQ ID NO: 9241262 - DNA, 22 bp, Homo sapiens
tggagctgatacagctggcttt

SEQ ID NO: 9241263 - DNA, 22 bp, Homo sapiens
tggagctgatacagctggcttt

SEQ ID NO: 9241264 - DNA, 22 bp, Homo sapiens
tggagctgatacagctggcttt

SEQ ID NO: 9241265 - DNA, 22 bp, Homo sapiens
tggagctggaatttgagctgga

SEQ ID NO: 9241266 - DNA, 22 bp, Homo sapiens
tggagctggaatttgagctgga

SEQ ID NO: 9241267 - DNA, 22 bp, Homo sapiens
tggagctggaatttctgggcct

SEQ ID NO: 9241268 - DNA, 22 bp, Homo sapiens
tggagctggaatttctgggcct

SEQ ID NO: 9241269 - DNA, 22 bp, Homo sapiens
tggagctggaatttgagctgga

SEQ ID NO: 9241270 - DNA, 22 bp, Homo sapiens
tggagctggaatttgagctgga

SEQ ID NO: 9241271 - DNA, 22 bp, Homo sapiens
tggagctggcttgtggaagttg

SEQ ID NO: 9241272 - DNA, 22 bp, Homo sapiens
tggagctgggagtcctgggctg

SEQ ID NO: 9241273 - DNA, 22 bp, Homo sapiens
tggagctggcttgtggaagttg

SEQ ID NO: 9241274 - DNA, 22 bp, Homo sapiens
tggagccagcccaggcccctct

SEQ ID NO: 9241275 - DNA, 20 bp, Homo sapiens
tggagccacagtcaggttcc

SEQ ID NO: 9241276 - DNA, 18 bp, Homo sapiens
tggagccagctctaggat

SEQ ID NO: 9241277 - DNA, 22 bp, Homo sapiens
tggagcagtggtcctggagatg

SEQ ID NO: 9241278 - DNA, 22 bp, Homo sapiens
tggagcatactaacccactctg

SEQ ID NO: 9241279 - DNA, 22 bp, Homo sapiens
tggagccaatgaacatttgctg

SEQ ID NO: 9241280 - DNA, 22 bp, Homo sapiens
tggagcaggtgctcagggtaat

SEQ ID NO: 9241281 - DNA, 22 bp, Homo sapiens
tggagcaggtgctcagggtaat

SEQ ID NO: 9241282 - DNA, 22 bp, Homo sapiens
tggagcaggtgggatgtcgtga

SEQ ID NO: 9241283 - DNA, 22 bp, Homo sapiens
tggagcaggaagtctatggctg

SEQ ID NO: 9241284 - DNA, 18 bp, Homo sapiens
tggagcaggaagcctggc

SEQ ID NO: 9241285 - DNA, 22 bp, Homo sapiens
tggagcaggaagtctatggctg

SEQ ID NO: 9241286 - DNA, 18 bp, Homo sapiens
tggagcaggaagcctggc

SEQ ID NO: 9241287 - DNA, 18 bp, Homo sapiens
tggagcaggaagcctggc

SEQ ID NO: 9241288 - DNA, 22 bp, Homo sapiens
tggagcaggtgccaggtgtgtg

SEQ ID NO: 9241289 - DNA, 22 bp, Homo sapiens
tggagcaggtgccaggtgtgtg

SEQ ID NO: 9241290 - DNA, 22 bp, Homo sapiens
tggagcaggtgccaggtgtgtg

SEQ ID NO: 9241291 - DNA, 22 bp, Homo sapiens
tggagcaggtgccaggtgtgtg

SEQ ID NO: 9241292 - DNA, 22 bp, Homo sapiens
tggagcaggtgccaggtgtgtg

SEQ ID NO: 9241293 - DNA, 18 bp, Homo sapiens
tggagcaggtaggcatga

SEQ ID NO: 9241294 - DNA, 18 bp, Homo sapiens
tggagcaggtaggcatga

SEQ ID NO: 9241295 - DNA, 22 bp, Homo sapiens
tggagcaggaagtctatggctg

SEQ ID NO: 9241296 - DNA, 22 bp, Homo sapiens
tggagcaggacggggagtggta

SEQ ID NO: 9241297 - DNA, 22 bp, Homo sapiens
tggagcaggacggggagtggta

SEQ ID NO: 9241298 - DNA, 22 bp, Homo sapiens
tggaaacactcaagcttatatt

SEQ ID NO: 9241299 - DNA, 22 bp, Homo sapiens
tggaaacactcaagcttatatt

SEQ ID NO: 9241300 - DNA, 22 bp, Homo sapiens
tggaaacactgcatgttcaccc

SEQ ID NO: 9241301 - DNA, 22 bp, Homo sapiens
tggaaacagatcataactaagc

SEQ ID NO: 9241302 - DNA, 21 bp, Homo sapiens
tggaaacagcgccatctgccg

SEQ ID NO: 9241303 - DNA, 22 bp, Homo sapiens
tggaaagaggaagtgcccagca

SEQ ID NO: 9241304 - DNA, 22 bp, Homo sapiens
tggaaagatgaagatgtttaag

SEQ ID NO: 9241305 - DNA, 21 bp, Homo sapiens
tggaaagattcaaagaccagg

SEQ ID NO: 9241306 - DNA, 21 bp, Homo sapiens
tggaaagattcaaagaccagg

SEQ ID NO: 9241307 - DNA, 22 bp, Homo sapiens
tggaaagaggtagaggatctgg

SEQ ID NO: 9241308 - DNA, 22 bp, Homo sapiens
tggaaagaggtagaggatctgg

SEQ ID NO: 9241309 - DNA, 22 bp, Homo sapiens
tggaaaacaaagctctcattat

SEQ ID NO: 9241310 - DNA, 19 bp, Homo sapiens
tggaaaatggattgaatca

SEQ ID NO: 9241311 - DNA, 22 bp, Homo sapiens
tggaaaatcaggggacattgat

SEQ ID NO: 9241312 - DNA, 20 bp, Homo sapiens
tgcttttatacctataatga

SEQ ID NO: 9241313 - DNA, 19 bp, Homo sapiens
tgctttgctcttggactca

SEQ ID NO: 9241314 - DNA, 22 bp, Homo sapiens
tgctttgtgacagattagtttt

SEQ ID NO: 9241315 - DNA, 22 bp, Homo sapiens
tgcttttaggagattaaaatta

SEQ ID NO: 9241316 - DNA, 22 bp, Homo sapiens
tgctttgtgtttgaatagataa

SEQ ID NO: 9241317 - DNA, 22 bp, Homo sapiens
tgctttgtgatatgctgtgtct

SEQ ID NO: 9241318 - DNA, 22 bp, Homo sapiens
tgctttgtgacagattagtttt

SEQ ID NO: 9241319 - DNA, 22 bp, Homo sapiens
tggaacactttgttgaaatgca

SEQ ID NO: 9241320 - DNA, 22 bp, Homo sapiens
tggaacactgtggatgagaaga

SEQ ID NO: 9241321 - DNA, 22 bp, Homo sapiens
tggaacacatctcgctgcaggg

SEQ ID NO: 9241322 - DNA, 22 bp, Homo sapiens
tggaacaccttgctccagaaag

SEQ ID NO: 9241323 - DNA, 22 bp, Homo sapiens
tggaacactgatcattgccttt

SEQ ID NO: 9241324 - DNA, 22 bp, Homo sapiens
tggaacacacttcaaggagaaa

SEQ ID NO: 9241325 - DNA, 22 bp, Homo sapiens
tggaacaattcttgaagggaat

SEQ ID NO: 9241326 - DNA, 22 bp, Homo sapiens
tggaacacatctaaggaagcag

SEQ ID NO: 9241327 - DNA, 22 bp, Homo sapiens
tggaacacagtgattgatagcg

SEQ ID NO: 9241328 - DNA, 22 bp, Homo sapiens
tggaacacaggactatcagctg

SEQ ID NO: 9241329 - DNA, 23 bp, Homo sapiens
tggaagaaaatggtttggctgtg

SEQ ID NO: 9241330 - DNA, 22 bp, Homo sapiens
tggaacaagacagcatagagct

SEQ ID NO: 9241331 - DNA, 22 bp, Homo sapiens
tggaacaagaagcaggtcgctt

SEQ ID NO: 9241332 - DNA, 22 bp, Homo sapiens
tggaacaactccctcggagcct

SEQ ID NO: 9241333 - DNA, 22 bp, Homo sapiens
tggaacaagggcgtggcggtcg

SEQ ID NO: 9241334 - DNA, 22 bp, Homo sapiens
tggaacaagggttcatttaaat

SEQ ID NO: 9241335 - DNA, 22 bp, Homo sapiens
tggaacaatcccggtttagctc

SEQ ID NO: 9241336 - DNA, 22 bp, Homo sapiens
tggaacaaaatatttatgtttg

SEQ ID NO: 9241337 - DNA, 22 bp, Homo sapiens
tggaacaaacatggtgatggct

SEQ ID NO: 9241338 - DNA, 19 bp, Homo sapiens
tggaacaaactgcaatgac

SEQ ID NO: 9241339 - DNA, 22 bp, Homo sapiens
tggaacaaattacaattaactt

SEQ ID NO: 9241340 - DNA, 22 bp, Homo sapiens
tggaacaaattttggggacctt

SEQ ID NO: 9241341 - DNA, 22 bp, Homo sapiens
tggaacaacatgctggaaaatt

SEQ ID NO: 9241342 - DNA, 22 bp, Homo sapiens
tggaaatacaagaagtatgtca

SEQ ID NO: 9241343 - DNA, 22 bp, Homo sapiens
tggaaaggtaggatttcaagac

SEQ ID NO: 9241344 - DNA, 22 bp, Homo sapiens
tggaaaggtgtaaagcagaacc

SEQ ID NO: 9241345 - DNA, 22 bp, Homo sapiens
tggaaaggaggcttgtggaata

SEQ ID NO: 9241346 - DNA, 22 bp, Homo sapiens
tggaaaggaggcttgtggaata

SEQ ID NO: 9241347 - DNA, 22 bp, Homo sapiens
tggaaagggacttatgagttcc

SEQ ID NO: 9241348 - DNA, 21 bp, Homo sapiens
tggaaagattcaaagaccagg

SEQ ID NO: 9241349 - DNA, 22 bp, Homo sapiens
tggaaagcagttcttagaatcg

SEQ ID NO: 9241350 - DNA, 22 bp, Homo sapiens
tggaaagcgaggagttggcatt

SEQ ID NO: 9241351 - DNA, 22 bp, Homo sapiens
tggaaaggacagttgctgatag

SEQ ID NO: 9241352 - DNA, 22 bp, Homo sapiens
tggaaatacttgccataaaact

SEQ ID NO: 9241353 - DNA, 22 bp, Homo sapiens
tggaaatagctccagtttcatt

SEQ ID NO: 9241354 - DNA, 22 bp, Homo sapiens
tgctttaaaccatggatgtgag

SEQ ID NO: 9241355 - DNA, 22 bp, Homo sapiens
tgctttaaaccatggatgtgag

SEQ ID NO: 9241356 - DNA, 22 bp, Homo sapiens
tgctttaaagtatttctcgcaa

SEQ ID NO: 9241357 - DNA, 22 bp, Homo sapiens
tgctttaaatatgaattagcat

SEQ ID NO: 9241358 - DNA, 22 bp, Homo sapiens
tgctttaaaatggactgttttg

SEQ ID NO: 9241359 - DNA, 22 bp, Homo sapiens
tgctttaaaatggactgttttg

SEQ ID NO: 9241360 - DNA, 22 bp, Homo sapiens
tgctttaagagattgttagtac

SEQ ID NO: 9241361 - DNA, 22 bp, Homo sapiens
tgctttaaccatcttgtttgga

SEQ ID NO: 9241362 - DNA, 22 bp, Homo sapiens
tgctttaacataagatatcttt

SEQ ID NO: 9241363 - DNA, 22 bp, Homo sapiens
tgctttaaccatcttgtttgga

SEQ ID NO: 9241364 - DNA, 22 bp, Homo sapiens
tgctttaacgctgagggtctca

SEQ ID NO: 9241365 - DNA, 22 bp, Homo sapiens
tgctttaagacactaagtttga

SEQ ID NO: 9241366 - DNA, 22 bp, Homo sapiens
tgcttgcaagagatgcaatgac

SEQ ID NO: 9241367 - DNA, 22 bp, Homo sapiens
tgcttgacttagtttctcattt

SEQ ID NO: 9241368 - DNA, 17 bp, Homo sapiens
tgcttgactctcttgtt

SEQ ID NO: 9241369 - DNA, 22 bp, Homo sapiens
tgcttgaagcctacattcgtca

SEQ ID NO: 9241370 - DNA, 22 bp, Homo sapiens
tgcttgaagatatactacttcc

SEQ ID NO: 9241371 - DNA, 19 bp, Homo sapiens
tgcttgcctgcctttccca

SEQ ID NO: 9241372 - DNA, 22 bp, Homo sapiens
tgcttctttactataggcaatt

SEQ ID NO: 9241373 - DNA, 22 bp, Homo sapiens
tgcttctgtttgtttctgtcat

SEQ ID NO: 9241374 - DNA, 22 bp, Homo sapiens
tgcttctgtttcattgatctta

SEQ ID NO: 9241375 - DNA, 22 bp, Homo sapiens
tgcttctgttctttcacctacg

SEQ ID NO: 9241376 - DNA, 22 bp, Homo sapiens
tgcttctgtctcttatgccttg

SEQ ID NO: 9241377 - DNA, 22 bp, Homo sapiens
tgcttctgtctcttatgccttg

SEQ ID NO: 9241378 - DNA, 17 bp, Homo sapiens
tgcttctgtattgctgg

SEQ ID NO: 9241379 - DNA, 22 bp, Homo sapiens
tgcttctgggtcccagcctggc

SEQ ID NO: 9241380 - DNA, 22 bp, Homo sapiens
tgcttctgggtaggcctcagga

SEQ ID NO: 9241381 - DNA, 22 bp, Homo sapiens
tgcttctgggtaggcctcagga

SEQ ID NO: 9241382 - DNA, 19 bp, Homo sapiens
tgcttctggggcttctcca

SEQ ID NO: 9241383 - DNA, 22 bp, Homo sapiens
tgcttctggcttatctcgtgcc

SEQ ID NO: 9241384 - DNA, 19 bp, Homo sapiens
tgcttctggaatgcaaggc

SEQ ID NO: 9241385 - DNA, 22 bp, Homo sapiens
tgcttctggagtaacagggtga

SEQ ID NO: 9241386 - DNA, 22 bp, Homo sapiens
tgcttctggaaacagtggctgt

SEQ ID NO: 9241387 - DNA, 22 bp, Homo sapiens
tgctttataacttagtttatgg

SEQ ID NO: 9241388 - DNA, 22 bp, Homo sapiens
tgctttatcaaagctatagtga

SEQ ID NO: 9241389 - DNA, 21 bp, Homo sapiens
tgctttatgggaaaaatgtca

SEQ ID NO: 9241390 - DNA, 22 bp, Homo sapiens
tgctttctgctcttgtccacac

SEQ ID NO: 9241391 - DNA, 22 bp, Homo sapiens
tgctttctgtttttcatataat

SEQ ID NO: 9241392 - DNA, 22 bp, Homo sapiens
tgctttctttagctcctgagtc

SEQ ID NO: 9241393 - DNA, 20 bp, Homo sapiens
tgctttgatggaaatacagc

SEQ ID NO: 9241394 - DNA, 22 bp, Homo sapiens
tgctttctctctaccccacttt

SEQ ID NO: 9241395 - DNA, 22 bp, Homo sapiens
tggactctaagcagaggatcta

SEQ ID NO: 9241396 - DNA, 22 bp, Homo sapiens
tggactctatgatgcgccagca

SEQ ID NO: 9241397 - DNA, 23 bp, Homo sapiens
tggacctgaaccagtgcctctgt

SEQ ID NO: 9241398 - DNA, 22 bp, Homo sapiens
tggacctgctggatgggcaggt

SEQ ID NO: 9241399 - DNA, 20 bp, Homo sapiens
tggaccataaacaccaggta

SEQ ID NO: 9241400 - DNA, 22 bp, Homo sapiens
tggaccatgagctgcaggtgtt

SEQ ID NO: 9241401 - DNA, 22 bp, Homo sapiens
tggacaggtgagtgactcaggg

SEQ ID NO: 9241402 - DNA, 22 bp, Homo sapiens
tggacaggtgagtgactcaggg

SEQ ID NO: 9241403 - DNA, 22 bp, Homo sapiens
tggacaggggctgctgttgtca

SEQ ID NO: 9241404 - DNA, 23 bp, Homo sapiens
tggacagggtaactggtggtttt

SEQ ID NO: 9241405 - DNA, 18 bp, Homo sapiens
tggacagggtggagaaaa

SEQ ID NO: 9241406 - DNA, 18 bp, Homo sapiens
tggacagggtggagaaaa

SEQ ID NO: 9241407 - DNA, 22 bp, Homo sapiens
tggacagggcagagaccgagtc

SEQ ID NO: 9241408 - DNA, 22 bp, Homo sapiens
tggacagggcagagaccgagtc

SEQ ID NO: 9241409 - DNA, 22 bp, Homo sapiens
tggacaggctcctaggggttcc

SEQ ID NO: 9241410 - DNA, 22 bp, Homo sapiens
tggacaggctcctaggggttcc

SEQ ID NO: 9241411 - DNA, 20 bp, Homo sapiens
tggacaggggcataggttgc

SEQ ID NO: 9241412 - DNA, 20 bp, Homo sapiens
tggacaggggcataggttgc

SEQ ID NO: 9241413 - DNA, 23 bp, Homo sapiens
tggacaggacccccttcggaccc

SEQ ID NO: 9241414 - DNA, 22 bp, Homo sapiens
tggacaggatagtgcagtacgc

SEQ ID NO: 9241415 - DNA, 22 bp, Homo sapiens
tggacaggcaagcaagacatac

SEQ ID NO: 9241416 - DNA, 22 bp, Homo sapiens
tggacaggcaagcaagacatac

SEQ ID NO: 9241417 - DNA, 22 bp, Homo sapiens
tggacaggatctgagactgaga

SEQ ID NO: 9241418 - DNA, 22 bp, Homo sapiens
tggacaggatctgagactgaga

SEQ ID NO: 9241419 - DNA, 22 bp, Homo sapiens
tggacaggatagtgcagtacgc

SEQ ID NO: 9241420 - DNA, 18 bp, Homo sapiens
tggacacatggcctgggt

SEQ ID NO: 9241421 - DNA, 22 bp, Homo sapiens
tggacacacatgtatgtcagag

SEQ ID NO: 9241422 - DNA, 22 bp, Homo sapiens
tggacacaatgttgccttaggg

SEQ ID NO: 9241423 - DNA, 22 bp, Homo sapiens
tggaatgaaaagtacttcagaa

SEQ ID NO: 9241424 - DNA, 22 bp, Homo sapiens
tggaatgaaggagatggccttt

SEQ ID NO: 9241425 - DNA, 22 bp, Homo sapiens
tggaatgagctggctaataacc

SEQ ID NO: 9241426 - DNA, 22 bp, Homo sapiens
tggaatggaaacaaactgagga

SEQ ID NO: 9241427 - DNA, 22 bp, Homo sapiens
tggaatgccgggccaggctccg

SEQ ID NO: 9241428 - DNA, 22 bp, Homo sapiens
tggaatgcatggctctgtgacg

SEQ ID NO: 9241429 - DNA, 22 bp, Homo sapiens
tggaatgtttgacttattcagt

SEQ ID NO: 9241430 - DNA, 22 bp, Homo sapiens
tggaattttgtattagctttga

SEQ ID NO: 9241431 - DNA, 22 bp, Homo sapiens
tggacaaatagcatgacacttg

SEQ ID NO: 9241432 - DNA, 22 bp, Homo sapiens
tggacaacatagtgagacctca

SEQ ID NO: 9241433 - DNA, 22 bp, Homo sapiens
tggaaggggttacgcagcagga

SEQ ID NO: 9241434 - DNA, 22 bp, Homo sapiens
tggaaggggccaggcgcggagt

SEQ ID NO: 9241435 - DNA, 22 bp, Homo sapiens
tggaaggagctaaggacctggg

SEQ ID NO: 9241436 - DNA, 22 bp, Homo sapiens
tggaaggagctaaggacctggg

SEQ ID NO: 9241437 - DNA, 22 bp, Homo sapiens
tggaaggagactgggaagtgtg

SEQ ID NO: 9241438 - DNA, 22 bp, Homo sapiens
tggaaggaagccaaggaaggtt

SEQ ID NO: 9241439 - DNA, 22 bp, Homo sapiens
tggaaggggagctggaaagggg

SEQ ID NO: 9241440 - DNA, 22 bp, Homo sapiens
tggaagggagtgacagtcagag

SEQ ID NO: 9241441 - DNA, 22 bp, Homo sapiens
tggaagggagtgacagtcagag

SEQ ID NO: 9241442 - DNA, 22 bp, Homo sapiens
tggaagtggcagaaaatgaaca

SEQ ID NO: 9241443 - DNA, 22 bp, Homo sapiens
tggaagtggcagaaaatgaaca

SEQ ID NO: 9241444 - DNA, 22 bp, Homo sapiens
tggaagtgctcttctgaccaac

SEQ ID NO: 9241445 - DNA, 22 bp, Homo sapiens
tggaagttgaatctcagtcatg

SEQ ID NO: 9241446 - DNA, 22 bp, Homo sapiens
tggaataactcaccaaggtcat

SEQ ID NO: 9241447 - DNA, 22 bp, Homo sapiens
tggaatactgtaaagaaaaatc

SEQ ID NO: 9241448 - DNA, 20 bp, Homo sapiens
tggaataagttaagttgttt

SEQ ID NO: 9241449 - DNA, 22 bp, Homo sapiens
tggaataactcaccaaggtcat

SEQ ID NO: 9241450 - DNA, 22 bp, Homo sapiens
tggaataatgaccacagaaaca

SEQ ID NO: 9241451 - DNA, 22 bp, Homo sapiens
tggaagcacttgggttttgttg

SEQ ID NO: 9241452 - DNA, 22 bp, Homo sapiens
tggaagcagtgattcttgtctg

SEQ ID NO: 9241453 - DNA, 22 bp, Homo sapiens
tggaagcatcacttcttgcctg

SEQ ID NO: 9241454 - DNA, 22 bp, Homo sapiens
tggaagcatcacttcttgcctg

SEQ ID NO: 9241455 - DNA, 22 bp, Homo sapiens
tggaaggaagccaaggaaggtt

SEQ ID NO: 9241456 - DNA, 22 bp, Homo sapiens
tggaaggaaaggtagcagagaa

SEQ ID NO: 9241457 - DNA, 22 bp, Homo sapiens
tggaaggaagccaaggaaggtt

SEQ ID NO: 9241458 - DNA, 22 bp, Homo sapiens
tggaaggaaaggtagcagagaa

SEQ ID NO: 9241459 - DNA, 22 bp, Homo sapiens
tggaaggaaaggtagcagagaa

SEQ ID NO: 9241460 - DNA, 18 bp, Homo sapiens
tggaagctggtgagcaga

SEQ ID NO: 9241461 - DNA, 18 bp, Homo sapiens
tggaagctggtgagcaga

SEQ ID NO: 9241462 - DNA, 17 bp, Homo sapiens
tggaagcttcatgttgg

SEQ ID NO: 9241463 - DNA, 22 bp, Homo sapiens
tggaagctgtggcataactgag

SEQ ID NO: 9241464 - DNA, 22 bp, Homo sapiens
tggaagctcaaggcagggtgag

SEQ ID NO: 9241465 - DNA, 22 bp, Homo sapiens
tggaagcggtgctggcccatgg

SEQ ID NO: 9241466 - DNA, 22 bp, Homo sapiens
tggaagcggacgttgtggggtg

SEQ ID NO: 9241467 - DNA, 22 bp, Homo sapiens
tggaagcgagacagagatctcc

SEQ ID NO: 9241468 - DNA, 22 bp, Homo sapiens
tggaagagaaaggagtggatct

SEQ ID NO: 9241469 - DNA, 19 bp, Homo sapiens
tggaagaggaagggaaata

SEQ ID NO: 9241470 - DNA, 22 bp, Homo sapiens
tggaagacatactgttttctta

SEQ ID NO: 9241471 - DNA, 22 bp, Homo sapiens
tggaagacattttggaccttgg

SEQ ID NO: 9241472 - DNA, 22 bp, Homo sapiens
tggaagaccagacttcccgaac

SEQ ID NO: 9241473 - DNA, 22 bp, Homo sapiens
tggaagaccagacttcccgaac

SEQ ID NO: 9241474 - DNA, 23 bp, Homo sapiens
tggaagactcctctcttggctgc

SEQ ID NO: 9241475 - DNA, 22 bp, Homo sapiens
tggaagaggtggaagtggcttc

SEQ ID NO: 9241476 - DNA, 22 bp, Homo sapiens
tggaagataagagattgggaag

SEQ ID NO: 9241477 - DNA, 22 bp, Homo sapiens
tggaagagggagctgggtggcc

SEQ ID NO: 9241478 - DNA, 22 bp, Homo sapiens
tggaagaggccagaaagtggga

SEQ ID NO: 9241479 - DNA, 22 bp, Homo sapiens
tgggaggacttgtgggcttcat

SEQ ID NO: 9241480 - DNA, 22 bp, Homo sapiens
tgggagctcctggagggcagga

SEQ ID NO: 9241481 - DNA, 22 bp, Homo sapiens
tgggaggcaggtaggtgatgat

SEQ ID NO: 9241482 - DNA, 22 bp, Homo sapiens
tgggaggatcgcttgagcccag

SEQ ID NO: 9241483 - DNA, 22 bp, Homo sapiens
tgggaggatctcttgaggccag

SEQ ID NO: 9241484 - DNA, 22 bp, Homo sapiens
tgggaggagccctctgggaagg

SEQ ID NO: 9241485 - DNA, 22 bp, Homo sapiens
tgggaggagccctctgggaagg

SEQ ID NO: 9241486 - DNA, 22 bp, Homo sapiens
tgggagcagctttgcgagggag

SEQ ID NO: 9241487 - DNA, 22 bp, Homo sapiens
tgggagctcctggagggcagga

SEQ ID NO: 9241488 - DNA, 22 bp, Homo sapiens
tgggagcagccaacatggcctt

SEQ ID NO: 9241489 - DNA, 22 bp, Homo sapiens
tgggagcagccaacatggcctt

SEQ ID NO: 9241490 - DNA, 22 bp, Homo sapiens
tgggagcagcagggagatgcgg

SEQ ID NO: 9241491 - DNA, 22 bp, Homo sapiens
tgggagcaccttgagggcagaa

SEQ ID NO: 9241492 - DNA, 22 bp, Homo sapiens
tgggagcaccctgaggagcttc

SEQ ID NO: 9241493 - DNA, 22 bp, Homo sapiens
tgggagcaccttgagggcagaa

SEQ ID NO: 9241494 - DNA, 22 bp, Homo sapiens
tgggagcaccttgagggcagaa

SEQ ID NO: 9241495 - DNA, 22 bp, Homo sapiens
tgggagcactctttgggaagca

SEQ ID NO: 9241496 - DNA, 22 bp, Homo sapiens
tgggagcactctttgggaagca

SEQ ID NO: 9241497 - DNA, 22 bp, Homo sapiens
tgggagcaagctggtgctggag

SEQ ID NO: 9241498 - DNA, 22 bp, Homo sapiens
tgggagcaagctggtgctggag

SEQ ID NO: 9241499 - DNA, 22 bp, Homo sapiens
tgggagcaccctgaggagcttc

SEQ ID NO: 9241500 - DNA, 22 bp, Homo sapiens
tgggagcaccctgaggagcttc

SEQ ID NO: 9241501 - DNA, 22 bp, Homo sapiens
tgggagcaagctggtgctggag

SEQ ID NO: 9241502 - DNA, 22 bp, Homo sapiens
tgggacttaatatgcccttgat

SEQ ID NO: 9241503 - DNA, 22 bp, Homo sapiens
tgggacttcaatgcaatgaggt

SEQ ID NO: 9241504 - DNA, 22 bp, Homo sapiens
tgggacttcaatgcaatgaggt

SEQ ID NO: 9241505 - DNA, 22 bp, Homo sapiens
tgggagaaactgtctctcccac

SEQ ID NO: 9241506 - DNA, 22 bp, Homo sapiens
tgggagaaagaaccctgagtga

SEQ ID NO: 9241507 - DNA, 22 bp, Homo sapiens
tgggagaacactgctctggatg

SEQ ID NO: 9241508 - DNA, 22 bp, Homo sapiens
tgggagaagcagcagccaagtg

SEQ ID NO: 9241509 - DNA, 22 bp, Homo sapiens
tgggagaagagaaattactgcc

SEQ ID NO: 9241510 - DNA, 22 bp, Homo sapiens
tgggagaagcagcagccaagtg

SEQ ID NO: 9241511 - DNA, 22 bp, Homo sapiens
tgggagaacccagggtcaggct

SEQ ID NO: 9241512 - DNA, 22 bp, Homo sapiens
tgggagaagacgtactttagac

SEQ ID NO: 9241513 - DNA, 20 bp, Homo sapiens
tgggagaagaacactggaac

SEQ ID NO: 9241514 - DNA, 22 bp, Homo sapiens
tgggagaagcatggggtgcaga

SEQ ID NO: 9241515 - DNA, 22 bp, Homo sapiens
tgggagaatatatttaaaactt

SEQ ID NO: 9241516 - DNA, 22 bp, Homo sapiens
tgggagaatcttgctctgctac

SEQ ID NO: 9241517 - DNA, 22 bp, Homo sapiens
tgggagaatcttgctctgctac

SEQ ID NO: 9241518 - DNA, 22 bp, Homo sapiens
tgggagaatatatttaaaactt

SEQ ID NO: 9241519 - DNA, 22 bp, Homo sapiens
tgggagaagcagtgggacagta

SEQ ID NO: 9241520 - DNA, 22 bp, Homo sapiens
tgggagagcttcatgccttcag

SEQ ID NO: 9241521 - DNA, 21 bp, Homo sapiens
tgggagacacagccttgagct

SEQ ID NO: 9241522 - DNA, 22 bp, Homo sapiens
tgggagacactggtgggagctt

SEQ ID NO: 9241523 - DNA, 21 bp, Homo sapiens
tgggagagggctcagctaccc

SEQ ID NO: 9241524 - DNA, 21 bp, Homo sapiens
tgggagagggctcagctaccc

SEQ ID NO: 9241525 - DNA, 21 bp, Homo sapiens
tgggagagggctcagctaccc

SEQ ID NO: 9241526 - DNA, 22 bp, Homo sapiens
tgggagaggctgccatcttgca

SEQ ID NO: 9241527 - DNA, 19 bp, Homo sapiens
tgggagaggcaacagagta

SEQ ID NO: 9241528 - DNA, 22 bp, Homo sapiens
tgggagcaagctacttagggaa

SEQ ID NO: 9241529 - DNA, 22 bp, Homo sapiens
tgggagcaaatgactgggagat

SEQ ID NO: 9241530 - DNA, 22 bp, Homo sapiens
tgggagatggttctgagacttt

SEQ ID NO: 9241531 - DNA, 22 bp, Homo sapiens
tgggaaggggagctggaaagga

SEQ ID NO: 9241532 - DNA, 22 bp, Homo sapiens
tgggaaggggagctggaaagga

SEQ ID NO: 9241533 - DNA, 22 bp, Homo sapiens
tgggaagggcctgcccttcctc

SEQ ID NO: 9241534 - DNA, 22 bp, Homo sapiens
tgggaagggtcaacagctggaa

SEQ ID NO: 9241535 - DNA, 22 bp, Homo sapiens
tgggaagggtcaacagctggaa

SEQ ID NO: 9241536 - DNA, 22 bp, Homo sapiens
tgggaagggtcaacagctggaa

SEQ ID NO: 9241537 - DNA, 22 bp, Homo sapiens
tgggaaggggagctggaaagga

SEQ ID NO: 9241538 - DNA, 22 bp, Homo sapiens
tgggaagggtcaacagctggaa

SEQ ID NO: 9241539 - DNA, 22 bp, Homo sapiens
tgggaaggtacacgggaaagag

SEQ ID NO: 9241540 - DNA, 22 bp, Homo sapiens
tgggaaggtacacgggaaagag

SEQ ID NO: 9241541 - DNA, 22 bp, Homo sapiens
tgggaaggtgtagaaagaacaa

SEQ ID NO: 9241542 - DNA, 22 bp, Homo sapiens
tgggaaggtacacgggaaagag

SEQ ID NO: 9241543 - DNA, 22 bp, Homo sapiens
tgggaagggtcaacagctggaa

SEQ ID NO: 9241544 - DNA, 22 bp, Homo sapiens
tgggaaggcgtggaagtagaag

SEQ ID NO: 9241545 - DNA, 22 bp, Homo sapiens
tgggaagggagagtgtcctgga

SEQ ID NO: 9241546 - DNA, 22 bp, Homo sapiens
tgggaaggcgtggaagtagaag

SEQ ID NO: 9241547 - DNA, 22 bp, Homo sapiens
tgggaaggcgtggaagtagaag

SEQ ID NO: 9241548 - DNA, 22 bp, Homo sapiens
tgggaagggccgatggagcctc

SEQ ID NO: 9241549 - DNA, 22 bp, Homo sapiens
tgggaagggccgatggagcctc

SEQ ID NO: 9241550 - DNA, 22 bp, Homo sapiens
tgggaagatggagtgacaggca

SEQ ID NO: 9241551 - DNA, 22 bp, Homo sapiens
tgggaagatgataattcacagt

SEQ ID NO: 9241552 - DNA, 22 bp, Homo sapiens
tgggaagatggagtgacaggca

SEQ ID NO: 9241553 - DNA, 22 bp, Homo sapiens
tgggaagatatgagtgaccaac

SEQ ID NO: 9241554 - DNA, 22 bp, Homo sapiens
tgggaagagttagagacagctg

SEQ ID NO: 9241555 - DNA, 23 bp, Homo sapiens
tgggaagatatgtatgttcaagg

SEQ ID NO: 9241556 - DNA, 23 bp, Homo sapiens
tgggaagatatgtatgttcaagg

SEQ ID NO: 9241557 - DNA, 22 bp, Homo sapiens
tgggaagaggcgggaggctgtt

SEQ ID NO: 9241558 - DNA, 22 bp, Homo sapiens
tgggacagttgtcctccactct

SEQ ID NO: 9241559 - DNA, 22 bp, Homo sapiens
tgggacagtgtgccttgctcct

SEQ ID NO: 9241560 - DNA, 22 bp, Homo sapiens
tgggacagtgaccccagaggtc

SEQ ID NO: 9241561 - DNA, 22 bp, Homo sapiens
tgggacagtgaccccagaggtc

SEQ ID NO: 9241562 - DNA, 22 bp, Homo sapiens
tgggactcactcttttggccag

SEQ ID NO: 9241563 - DNA, 22 bp, Homo sapiens
tgggactgagaatatgatgggg

SEQ ID NO: 9241564 - DNA, 22 bp, Homo sapiens
tgggactgctcttgctggggtc

SEQ ID NO: 9241565 - DNA, 22 bp, Homo sapiens
tgggacaggttggagagaagca

SEQ ID NO: 9241566 - DNA, 22 bp, Homo sapiens
tgggacaggttggagagaagca

SEQ ID NO: 9241567 - DNA, 22 bp, Homo sapiens
tgggacaccctcacgcctgcac

SEQ ID NO: 9241568 - DNA, 22 bp, Homo sapiens
tgggaatgtggcaaggcataga

SEQ ID NO: 9241569 - DNA, 22 bp, Homo sapiens
tgggaatgggcctagaaggctg

SEQ ID NO: 9241570 - DNA, 22 bp, Homo sapiens
tgggaagttgtaccttctgtta

SEQ ID NO: 9241571 - DNA, 22 bp, Homo sapiens
tggcttctctgtgtgagggaga

SEQ ID NO: 9241572 - DNA, 22 bp, Homo sapiens
tggcttctctgttttagtattt

SEQ ID NO: 9241573 - DNA, 22 bp, Homo sapiens
tggcttctgagcattgaaacgt

SEQ ID NO: 9241574 - DNA, 22 bp, Homo sapiens
tggcttctgcatatttttagag

SEQ ID NO: 9241575 - DNA, 22 bp, Homo sapiens
tggcttctccctctgcctgatt

SEQ ID NO: 9241576 - DNA, 22 bp, Homo sapiens
tggcttctgctttcagtggagg

SEQ ID NO: 9241577 - DNA, 23 bp, Homo sapiens
tggcttctgccccattctctcca

SEQ ID NO: 9241578 - DNA, 19 bp, Homo sapiens
tggcttctgttttcatgtt

SEQ ID NO: 9241579 - DNA, 22 bp, Homo sapiens
tggcttctattgctgtggcatt

SEQ ID NO: 9241580 - DNA, 18 bp, Homo sapiens
tggcttctattttactca

SEQ ID NO: 9241581 - DNA, 22 bp, Homo sapiens
tggcttctcagtttcataatga

SEQ ID NO: 9241582 - DNA, 22 bp, Homo sapiens
tggcttcctgtgtaatgaggtg

SEQ ID NO: 9241583 - DNA, 22 bp, Homo sapiens
tggcttcctgtttcccagaaag

SEQ ID NO: 9241584 - DNA, 22 bp, Homo sapiens
tggcttcctggacagatgcggt

SEQ ID NO: 9241585 - DNA, 22 bp, Homo sapiens
tggcttctaaagtttcttttag

SEQ ID NO: 9241586 - DNA, 22 bp, Homo sapiens
tggcttcctgtttcccagaaag

SEQ ID NO: 9241587 - DNA, 22 bp, Homo sapiens
tggcttctagcagtgttgattt

SEQ ID NO: 9241588 - DNA, 22 bp, Homo sapiens
tggcttcagagtctgagttctt

SEQ ID NO: 9241589 - DNA, 22 bp, Homo sapiens
tggcttcagagtctgagttctt

SEQ ID NO: 9241590 - DNA, 17 bp, Homo sapiens
tggcttccctgggccac

SEQ ID NO: 9241591 - DNA, 22 bp, Homo sapiens
tggcttccgccgcgggcctcgg

SEQ ID NO: 9241592 - DNA, 22 bp, Homo sapiens
tggcttcctaggagcccgtgct

SEQ ID NO: 9241593 - DNA, 22 bp, Homo sapiens
tggcttcctaaactgatttcca

SEQ ID NO: 9241594 - DNA, 19 bp, Homo sapiens
tggcttcctgactctcatc

SEQ ID NO: 9241595 - DNA, 22 bp, Homo sapiens
tggcttcctgcatggatcctct

SEQ ID NO: 9241596 - DNA, 22 bp, Homo sapiens
tgggaaagtgttgaggtgtctt

SEQ ID NO: 9241597 - DNA, 22 bp, Homo sapiens
tgggaaatataatttagctgtg

SEQ ID NO: 9241598 - DNA, 22 bp, Homo sapiens
tgggaaatattctaaaagtctt

SEQ ID NO: 9241599 - DNA, 22 bp, Homo sapiens
tgggaaattgtatttctatttc

SEQ ID NO: 9241600 - DNA, 22 bp, Homo sapiens
tgggaacaacatgcactgccac

SEQ ID NO: 9241601 - DNA, 22 bp, Homo sapiens
tgggaaattgtatttctatttc

SEQ ID NO: 9241602 - DNA, 22 bp, Homo sapiens
tgggaagactcctcaggaggcg

SEQ ID NO: 9241603 - DNA, 22 bp, Homo sapiens
tgggaagactcctcaggaggcg

SEQ ID NO: 9241604 - DNA, 22 bp, Homo sapiens
tgggaagactcctcaggaggcg

SEQ ID NO: 9241605 - DNA, 22 bp, Homo sapiens
tgggaacattttgagctgagag

SEQ ID NO: 9241606 - DNA, 22 bp, Homo sapiens
tgggaacagtagctgctgagct

SEQ ID NO: 9241607 - DNA, 22 bp, Homo sapiens
tgggaagaagcagagaactgga

SEQ ID NO: 9241608 - DNA, 18 bp, Homo sapiens
tgggaagaaattcttctc

SEQ ID NO: 9241609 - DNA, 22 bp, Homo sapiens
tggctttcgctatagagcacgg

SEQ ID NO: 9241610 - DNA, 22 bp, Homo sapiens
tggctttctcccccagcttctc

SEQ ID NO: 9241611 - DNA, 22 bp, Homo sapiens
tggcttcttagaccagtggcct

SEQ ID NO: 9241612 - DNA, 22 bp, Homo sapiens
tggcttcttagaccagtggcct

SEQ ID NO: 9241613 - DNA, 19 bp, Homo sapiens
tggcttcttcggtgttccc

SEQ ID NO: 9241614 - DNA, 22 bp, Homo sapiens
tggcttcttgggatgggtcatt

SEQ ID NO: 9241615 - DNA, 22 bp, Homo sapiens
tggcttcttgatcttggacttg

SEQ ID NO: 9241616 - DNA, 22 bp, Homo sapiens
tggcttcaaaatctagtggtct

SEQ ID NO: 9241617 - DNA, 22 bp, Homo sapiens
tggcttcaaaatctagtggtct

SEQ ID NO: 9241618 - DNA, 22 bp, Homo sapiens
tggcttcaaaggtagcatacaa

SEQ ID NO: 9241619 - DNA, 22 bp, Homo sapiens
tggctgtgggatgagagcctca

SEQ ID NO: 9241620 - DNA, 22 bp, Homo sapiens
tggctgtgcctctttccaggcc

SEQ ID NO: 9241621 - DNA, 22 bp, Homo sapiens
tggctgtgatttgcacgagatg

SEQ ID NO: 9241622 - DNA, 19 bp, Homo sapiens
tggctgggtgccaatggcc

SEQ ID NO: 9241623 - DNA, 19 bp, Homo sapiens
tggctgggtgccaatggcc

SEQ ID NO: 9241624 - DNA, 22 bp, Homo sapiens
tggctgggccgggccttgtgcc

SEQ ID NO: 9241625 - DNA, 22 bp, Homo sapiens
tggctggagtgggagaagttta

SEQ ID NO: 9241626 - DNA, 22 bp, Homo sapiens
tggctggagtctggtgctagcc

SEQ ID NO: 9241627 - DNA, 22 bp, Homo sapiens
tggctggattattggctagtac

SEQ ID NO: 9241628 - DNA, 22 bp, Homo sapiens
tggctggacagtgggcagtgga

SEQ ID NO: 9241629 - DNA, 22 bp, Homo sapiens
tggctggaatggagctgagcct

SEQ ID NO: 9241630 - DNA, 22 bp, Homo sapiens
tggctgggagctggaactgggc

SEQ ID NO: 9241631 - DNA, 22 bp, Homo sapiens
tggctgggagctggaactgggc

SEQ ID NO: 9241632 - DNA, 20 bp, Homo sapiens
tggctcctgcggtggaacca

SEQ ID NO: 9241633 - DNA, 22 bp, Homo sapiens
tggctcccgcttgcacctaaga

SEQ ID NO: 9241634 - DNA, 22 bp, Homo sapiens
tggctcctatcaaggagtgggt

SEQ ID NO: 9241635 - DNA, 22 bp, Homo sapiens
tggctcccaaggagctcctgcc

SEQ ID NO: 9241636 - DNA, 22 bp, Homo sapiens
tggctcccacaaactcactact

SEQ ID NO: 9241637 - DNA, 22 bp, Homo sapiens
tggctccaggggacacgcagta

SEQ ID NO: 9241638 - DNA, 22 bp, Homo sapiens
tggctccatcatccatgcaaga

SEQ ID NO: 9241639 - DNA, 22 bp, Homo sapiens
tggctccatcatccatgcaaga

SEQ ID NO: 9241640 - DNA, 22 bp, Homo sapiens
tggctccacaggccagggtgtg

SEQ ID NO: 9241641 - DNA, 22 bp, Homo sapiens
tggctcatttctaaacccagct

SEQ ID NO: 9241642 - DNA, 22 bp, Homo sapiens
tggctcatgcctgtaatcttag

SEQ ID NO: 9241643 - DNA, 22 bp, Homo sapiens
tggctcattctactctccctgg

SEQ ID NO: 9241644 - DNA, 22 bp, Homo sapiens
tggctcatggaattagctatta

SEQ ID NO: 9241645 - DNA, 22 bp, Homo sapiens
tggctcattctttagaatatac

SEQ ID NO: 9241646 - DNA, 22 bp, Homo sapiens
tggctcattctggggaagtcag

SEQ ID NO: 9241647 - DNA, 22 bp, Homo sapiens
tggctcagttccatcatctgga

SEQ ID NO: 9241648 - DNA, 22 bp, Homo sapiens
tggctcagttccatcatctgga

SEQ ID NO: 9241649 - DNA, 22 bp, Homo sapiens
tggctccaccgccgcggagctc

SEQ ID NO: 9241650 - DNA, 22 bp, Homo sapiens
tggctccactactgggtgtgtt

SEQ ID NO: 9241651 - DNA, 22 bp, Homo sapiens
tggctccaccgccgcggagctc

SEQ ID NO: 9241652 - DNA, 22 bp, Homo sapiens
tggctccagaagggagggcgcc

SEQ ID NO: 9241653 - DNA, 22 bp, Homo sapiens
tggctccagaagggagggcgcc

SEQ ID NO: 9241654 - DNA, 22 bp, Homo sapiens
tggctccagatttcctgctgca

SEQ ID NO: 9241655 - DNA, 22 bp, Homo sapiens
tggctccagccctgagcaagct

SEQ ID NO: 9241656 - DNA, 22 bp, Homo sapiens
tggctccagccctgagcaagct

SEQ ID NO: 9241657 - DNA, 22 bp, Homo sapiens
tggctccagcgtccacgtcctg

SEQ ID NO: 9241658 - DNA, 23 bp, Homo sapiens
tggctccaggagaagccagaagc

SEQ ID NO: 9241659 - DNA, 23 bp, Homo sapiens
tggctcagggtctcttatgaagt

SEQ ID NO: 9241660 - DNA, 22 bp, Homo sapiens
tggctcaggggtctggctctgt

SEQ ID NO: 9241661 - DNA, 22 bp, Homo sapiens
tggctcaggggtctggctctgt

SEQ ID NO: 9241662 - DNA, 23 bp, Homo sapiens
tggctcagggtctcttatgaagt

SEQ ID NO: 9241663 - DNA, 22 bp, Homo sapiens
tggctcaggtgtgagctgaaga

SEQ ID NO: 9241664 - DNA, 22 bp, Homo sapiens
tggctcagtagcagtgtggtca

SEQ ID NO: 9241665 - DNA, 22 bp, Homo sapiens
tggctcagtagcagtgtggtca

SEQ ID NO: 9241666 - DNA, 22 bp, Homo sapiens
tggctcagtggcagccgcagct

SEQ ID NO: 9241667 - DNA, 22 bp, Homo sapiens
tggctcagtgcattcacagtaa

SEQ ID NO: 9241668 - DNA, 22 bp, Homo sapiens
tggctcagtgaagagataactt

SEQ ID NO: 9241669 - DNA, 22 bp, Homo sapiens
tggctcagtctgggttgactga

SEQ ID NO: 9241670 - DNA, 22 bp, Homo sapiens
tggctcagtcatggatgagtaa

SEQ ID NO: 9241671 - DNA, 22 bp, Homo sapiens
tggctcagcattcactggtctt

SEQ ID NO: 9241672 - DNA, 22 bp, Homo sapiens
tggctcagatttttgtaggctt

SEQ ID NO: 9241673 - DNA, 22 bp, Homo sapiens
tggctcagcaagacattgacct

SEQ ID NO: 9241674 - DNA, 22 bp, Homo sapiens
tggctcagcaagacattgacct

SEQ ID NO: 9241675 - DNA, 22 bp, Homo sapiens
tggctcagctgtcacagcctgg

SEQ ID NO: 9241676 - DNA, 22 bp, Homo sapiens
tggctcagccagccctaggaac

SEQ ID NO: 9241677 - DNA, 22 bp, Homo sapiens
tggctcagctttccccatctgg

SEQ ID NO: 9241678 - DNA, 22 bp, Homo sapiens
tggctcaggagggatctttgct

SEQ ID NO: 9241679 - DNA, 22 bp, Homo sapiens
tggctcaggatctaagcagaat

SEQ ID NO: 9241680 - DNA, 22 bp, Homo sapiens
tggctcaggcttgaaaatagat

SEQ ID NO: 9241681 - DNA, 22 bp, Homo sapiens
tggcgcagtttctctgctgcct

SEQ ID NO: 9241682 - DNA, 18 bp, Homo sapiens
tggcgatggtcatttttc

SEQ ID NO: 9241683 - DNA, 22 bp, Homo sapiens
tggccttggtcctctttgcaat

SEQ ID NO: 9241684 - DNA, 20 bp, Homo sapiens
tggccttggggagctcacac

SEQ ID NO: 9241685 - DNA, 22 bp, Homo sapiens
tggcctgtcttgttgtgctaga

SEQ ID NO: 9241686 - DNA, 22 bp, Homo sapiens
tggcctgtggcttaaggtctgt

SEQ ID NO: 9241687 - DNA, 22 bp, Homo sapiens
tggccttggcagtgagaagagt

SEQ ID NO: 9241688 - DNA, 22 bp, Homo sapiens
tggccttgataactggggagag

SEQ ID NO: 9241689 - DNA, 22 bp, Homo sapiens
tggccttgattatgccagtaga

SEQ ID NO: 9241690 - DNA, 22 bp, Homo sapiens
tggccttgagatgcagcagcca

SEQ ID NO: 9241691 - DNA, 22 bp, Homo sapiens
tggcctggccctgaggccctgt

SEQ ID NO: 9241692 - DNA, 22 bp, Homo sapiens
tggcctggctcacagtgagatt

SEQ ID NO: 9241693 - DNA, 22 bp, Homo sapiens
tggcctgggtcacaccagggtc

SEQ ID NO: 9241694 - DNA, 22 bp, Homo sapiens
tggcctggctcacagtgagatt

SEQ ID NO: 9241695 - DNA, 22 bp, Homo sapiens
tggcctggtaccacatagattt

SEQ ID NO: 9241696 - DNA, 22 bp, Homo sapiens
tggcctggtccttgtcaaggca

SEQ ID NO: 9241697 - DNA, 22 bp, Homo sapiens
tggcctggtaccacatagattt

SEQ ID NO: 9241698 - DNA, 22 bp, Homo sapiens
tggcctgggtgctgctgacatc

SEQ ID NO: 9241699 - DNA, 22 bp, Homo sapiens
tggcctgggtgctgctgacatc

SEQ ID NO: 9241700 - DNA, 22 bp, Homo sapiens
tggcctggttatattgctatca

SEQ ID NO: 9241701 - DNA, 22 bp, Homo sapiens
tggcctggttatattgctatca

SEQ ID NO: 9241702 - DNA, 22 bp, Homo sapiens
tggcctggttgttgctgccgtt

SEQ ID NO: 9241703 - DNA, 22 bp, Homo sapiens
tggcctggttgttgctgccgtt

SEQ ID NO: 9241704 - DNA, 22 bp, Homo sapiens
tggcctggttgttgctgccgtt

SEQ ID NO: 9241705 - DNA, 22 bp, Homo sapiens
tggcctggtgtctgcgaggcct

SEQ ID NO: 9241706 - DNA, 22 bp, Homo sapiens
tggcctggtgtctgcgaggcct

SEQ ID NO: 9241707 - DNA, 22 bp, Homo sapiens
tggcctggtgtctgcgaggcct

SEQ ID NO: 9241708 - DNA, 22 bp, Homo sapiens
tggcctggtccttgtcaaggca

SEQ ID NO: 9241709 - DNA, 22 bp, Homo sapiens
tggcctggtgctcaggcagtag

SEQ ID NO: 9241710 - DNA, 22 bp, Homo sapiens
tggctcagaactacttctagtt

SEQ ID NO: 9241711 - DNA, 22 bp, Homo sapiens
tggctcagaactacttctagtt

SEQ ID NO: 9241712 - DNA, 22 bp, Homo sapiens
tggctcagaagaaaaggtaaac

SEQ ID NO: 9241713 - DNA, 22 bp, Homo sapiens
tggctcacttccgtggagaggt

SEQ ID NO: 9241714 - DNA, 22 bp, Homo sapiens
tggctcagaactacttctagtt

SEQ ID NO: 9241715 - DNA, 22 bp, Homo sapiens
tggctatgaggagcgcaggtgt

SEQ ID NO: 9241716 - DNA, 22 bp, Homo sapiens
tggctcacaatctcccatgaag

SEQ ID NO: 9241717 - DNA, 22 bp, Homo sapiens
tggctcactgtagccttgacct

SEQ ID NO: 9241718 - DNA, 22 bp, Homo sapiens
tggcggctcaggaggggcagtt

SEQ ID NO: 9241719 - DNA, 22 bp, Homo sapiens
tggcggctcaggaggggcagtt

SEQ ID NO: 9241720 - DNA, 22 bp, Homo sapiens
tggcgcgacgtgccccctgctt

SEQ ID NO: 9241721 - DNA, 22 bp, Homo sapiens
tggctcagatgctcttccagtg

SEQ ID NO: 9241722 - DNA, 22 bp, Homo sapiens
tggctcagatttttgtaggctt

SEQ ID NO: 9241723 - DNA, 22 bp, Homo sapiens
tggctcagataattcaaggggc

SEQ ID NO: 9241724 - DNA, 22 bp, Homo sapiens
tggctcagagcagggactctgg

SEQ ID NO: 9241725 - DNA, 22 bp, Homo sapiens
tggctcagagccttgagagctg

SEQ ID NO: 9241726 - DNA, 22 bp, Homo sapiens
tggctcagagagggagtgtgga

SEQ ID NO: 9241727 - DNA, 22 bp, Homo sapiens
tggctcagaaggctgccttcac

SEQ ID NO: 9241728 - DNA, 22 bp, Homo sapiens
tggctcagagagggagtgtgga

SEQ ID NO: 9241729 - DNA, 22 bp, Homo sapiens
tggctcagaaggctgccttcac

SEQ ID NO: 9241730 - DNA, 21 bp, Homo sapiens
tggctgcactgtggctttcat

SEQ ID NO: 9241731 - DNA, 22 bp, Homo sapiens
tggctgcagacacctatggcag

SEQ ID NO: 9241732 - DNA, 22 bp, Homo sapiens
tggctgcagatcaagggcaggc

SEQ ID NO: 9241733 - DNA, 22 bp, Homo sapiens
tggctgcagatcaagggcaggc

SEQ ID NO: 9241734 - DNA, 22 bp, Homo sapiens
tggctgagtttcatgcatcatg

SEQ ID NO: 9241735 - DNA, 22 bp, Homo sapiens
tggctgagtttcatgcatcatg

SEQ ID NO: 9241736 - DNA, 22 bp, Homo sapiens
tggctgagttctccaggagtag

SEQ ID NO: 9241737 - DNA, 22 bp, Homo sapiens
tggctgagttctccaggagtag

SEQ ID NO: 9241738 - DNA, 21 bp, Homo sapiens
tggctgcaagcagctgcctcc

SEQ ID NO: 9241739 - DNA, 22 bp, Homo sapiens
tggctgagttacgaacagagca

SEQ ID NO: 9241740 - DNA, 22 bp, Homo sapiens
tggctgagttcctggcacacgg

SEQ ID NO: 9241741 - DNA, 22 bp, Homo sapiens
tggctgagttacgaacagagca

SEQ ID NO: 9241742 - DNA, 22 bp, Homo sapiens
tggctgagttacgaacagagca

SEQ ID NO: 9241743 - DNA, 22 bp, Homo sapiens
tggctgagttcctggcacacgg

SEQ ID NO: 9241744 - DNA, 22 bp, Homo sapiens
tggctgagttctccaggagtag

SEQ ID NO: 9241745 - DNA, 22 bp, Homo sapiens
tggctgagttctccaggagtag

SEQ ID NO: 9241746 - DNA, 22 bp, Homo sapiens
tggctgagtgaacatgtccatt

SEQ ID NO: 9241747 - DNA, 22 bp, Homo sapiens
tggctgagtgatatttgcaaag

SEQ ID NO: 9241748 - DNA, 21 bp, Homo sapiens
tggctgagtggatgcatgaat

SEQ ID NO: 9241749 - DNA, 22 bp, Homo sapiens
tggctgagtgatatttgcaaag

SEQ ID NO: 9241750 - DNA, 22 bp, Homo sapiens
tggctgagtgttccaaggagca

SEQ ID NO: 9241751 - DNA, 21 bp, Homo sapiens
tggctgagtggatgcatgaat

SEQ ID NO: 9241752 - DNA, 22 bp, Homo sapiens
tggctgagtgttccaaggagca

SEQ ID NO: 9241753 - DNA, 22 bp, Homo sapiens
tggctgagtgttccaaggagca

SEQ ID NO: 9241754 - DNA, 21 bp, Homo sapiens
tggctgctggccctctctcca

SEQ ID NO: 9241755 - DNA, 22 bp, Homo sapiens
tggctgctgcttggtcttcttc

SEQ ID NO: 9241756 - DNA, 22 bp, Homo sapiens
tggctgctgcagacagacagga

SEQ ID NO: 9241757 - DNA, 22 bp, Homo sapiens
tggctgctgcagacagacagga

SEQ ID NO: 9241758 - DNA, 22 bp, Homo sapiens
tggctggaaacaggagattcag

SEQ ID NO: 9241759 - DNA, 22 bp, Homo sapiens
tggctgcttaaaattgctgcaa

SEQ ID NO: 9241760 - DNA, 22 bp, Homo sapiens
tggctgctgagaaggcagctgt

SEQ ID NO: 9241761 - DNA, 22 bp, Homo sapiens
tggctgccatgacgcctgggga

SEQ ID NO: 9241762 - DNA, 22 bp, Homo sapiens
tggctgccccctcccgtggaca

SEQ ID NO: 9241763 - DNA, 22 bp, Homo sapiens
tggctgcagttcacaggagcaa

SEQ ID NO: 9241764 - DNA, 22 bp, Homo sapiens
tggctgcagtgcttgagatgtc

SEQ ID NO: 9241765 - DNA, 21 bp, Homo sapiens
tggctgagccaggtgtgtgga

SEQ ID NO: 9241766 - DNA, 21 bp, Homo sapiens
tggctgagccaggtgtgtgga

SEQ ID NO: 9241767 - DNA, 21 bp, Homo sapiens
tggctgagccaggtgtgtgga

SEQ ID NO: 9241768 - DNA, 21 bp, Homo sapiens
tggctgagccaggtgtgtgga

SEQ ID NO: 9241769 - DNA, 22 bp, Homo sapiens
tggctgagccacttgttcagat

SEQ ID NO: 9241770 - DNA, 22 bp, Homo sapiens
tggctgagcctttggggctttc

SEQ ID NO: 9241771 - DNA, 22 bp, Homo sapiens
tggctgagcctttggggctttc

SEQ ID NO: 9241772 - DNA, 23 bp, Homo sapiens
tggctgagcccactatcttggcc

SEQ ID NO: 9241773 - DNA, 23 bp, Homo sapiens
tggctgagcccactatcttggcc

SEQ ID NO: 9241774 - DNA, 23 bp, Homo sapiens
tggctgagcccactatcttggcc

SEQ ID NO: 9241775 - DNA, 23 bp, Homo sapiens
tggctgagatcctactgtttgct

SEQ ID NO: 9241776 - DNA, 23 bp, Homo sapiens
tggctgagatcctactgtttgct

SEQ ID NO: 9241777 - DNA, 23 bp, Homo sapiens
tggctgagatcctactgtttgct

SEQ ID NO: 9241778 - DNA, 22 bp, Homo sapiens
tggctgagccacttgttcagat

SEQ ID NO: 9241779 - DNA, 22 bp, Homo sapiens
tggctgagccacttgttcagat

SEQ ID NO: 9241780 - DNA, 22 bp, Homo sapiens
tggctgagagtcatcctgtgtg

SEQ ID NO: 9241781 - DNA, 22 bp, Homo sapiens
tggctgagagtcatcctgtgtg

SEQ ID NO: 9241782 - DNA, 22 bp, Homo sapiens
tggctgagagtcatcctgtgtg

SEQ ID NO: 9241783 - DNA, 22 bp, Homo sapiens
tggctgagagcaattgactctg

SEQ ID NO: 9241784 - DNA, 22 bp, Homo sapiens
tggctgagaagttctggtggga

SEQ ID NO: 9241785 - DNA, 22 bp, Homo sapiens
tggctgagagcaattgactctg

SEQ ID NO: 9241786 - DNA, 22 bp, Homo sapiens
tggctgacaatgtagcagtaac

SEQ ID NO: 9241787 - DNA, 22 bp, Homo sapiens
tggctgagaaaaaagagctata

SEQ ID NO: 9241788 - DNA, 21 bp, Homo sapiens
tggctgactcttcctatcatt

SEQ ID NO: 9241789 - DNA, 22 bp, Homo sapiens
tggctgagaaaaaagagctata

SEQ ID NO: 9241790 - DNA, 22 bp, Homo sapiens
tggctgagaaaatggttttagg

SEQ ID NO: 9241791 - DNA, 22 bp, Homo sapiens
tggctgagaaaaaagagctata

SEQ ID NO: 9241792 - DNA, 22 bp, Homo sapiens
tggctgagaagttctggtggga

SEQ ID NO: 9241793 - DNA, 22 bp, Homo sapiens
tggctgagaagttctggtggga

SEQ ID NO: 9241794 - DNA, 22 bp, Homo sapiens
tggctgagaagttctggtggga

SEQ ID NO: 9241795 - DNA, 22 bp, Homo sapiens
tggctgagaaaatggttttagg

SEQ ID NO: 9241796 - DNA, 22 bp, Homo sapiens
tggctgagaaaatggttttagg

SEQ ID NO: 9241797 - DNA, 22 bp, Homo sapiens
tggctgaggctggagtgcagtg

SEQ ID NO: 9241798 - DNA, 22 bp, Homo sapiens
tggctgaggctggagtgcagtg

SEQ ID NO: 9241799 - DNA, 22 bp, Homo sapiens
tggctgaggctggagtgcagtg

SEQ ID NO: 9241800 - DNA, 22 bp, Homo sapiens
tggctgagggcactatgaagcc

SEQ ID NO: 9241801 - DNA, 22 bp, Homo sapiens
tggctgagggcactatgaagcc

SEQ ID NO: 9241802 - DNA, 22 bp, Homo sapiens
tggctgaggcttttcttaaaga

SEQ ID NO: 9241803 - DNA, 22 bp, Homo sapiens
tggctgaggctggagtgcagtg

SEQ ID NO: 9241804 - DNA, 22 bp, Homo sapiens
tggctgaggcttttcttaaaga

SEQ ID NO: 9241805 - DNA, 22 bp, Homo sapiens
tggctgagggcactatgaagcc

SEQ ID NO: 9241806 - DNA, 22 bp, Homo sapiens
tggctgaggttatgctggttgt

SEQ ID NO: 9241807 - DNA, 22 bp, Homo sapiens
tggctgaggttatgctggttgt

SEQ ID NO: 9241808 - DNA, 22 bp, Homo sapiens
tggctgaggtctggggcttctg

SEQ ID NO: 9241809 - DNA, 22 bp, Homo sapiens
tggctgagtaagttgtgatatg

SEQ ID NO: 9241810 - DNA, 22 bp, Homo sapiens
tggctgagtgaacatgtccatt

SEQ ID NO: 9241811 - DNA, 22 bp, Homo sapiens
tggctgagtaagttgtgatatg

SEQ ID NO: 9241812 - DNA, 22 bp, Homo sapiens
tggctgaggtctggggcttctg

SEQ ID NO: 9241813 - DNA, 22 bp, Homo sapiens
tggctgagtaagttgtgatatg

SEQ ID NO: 9241814 - DNA, 22 bp, Homo sapiens
tggctgaggttatgctggttgt

SEQ ID NO: 9241815 - DNA, 22 bp, Homo sapiens
tggctgaggttatgctggttgt

SEQ ID NO: 9241816 - DNA, 22 bp, Homo sapiens
tggctgagctgcagcgtggctt

SEQ ID NO: 9241817 - DNA, 22 bp, Homo sapiens
tggctgagctgcagcgtggctt

SEQ ID NO: 9241818 - DNA, 19 bp, Homo sapiens
tggctgagctggactgagg

SEQ ID NO: 9241819 - DNA, 19 bp, Homo sapiens
tggctgagctggactgagg

SEQ ID NO: 9241820 - DNA, 22 bp, Homo sapiens
tggctgagcctttggggctttc

SEQ ID NO: 9241821 - DNA, 22 bp, Homo sapiens
tggctgagctccctgtgtgttg

SEQ ID NO: 9241822 - DNA, 22 bp, Homo sapiens
tggctgagcctttggggctttc

SEQ ID NO: 9241823 - DNA, 22 bp, Homo sapiens
tggctgagctgcagcgtggctt

SEQ ID NO: 9241824 - DNA, 22 bp, Homo sapiens
tggctgagctgcagcgtggctt

SEQ ID NO: 9241825 - DNA, 22 bp, Homo sapiens
tggctgagctccctgtgtgttg

SEQ ID NO: 9241826 - DNA, 22 bp, Homo sapiens
tggctgaggagagggcggaagt

SEQ ID NO: 9241827 - DNA, 22 bp, Homo sapiens
tggctgaggagagggcggaagt

SEQ ID NO: 9241828 - DNA, 19 bp, Homo sapiens
tggctgagctggactgagg

SEQ ID NO: 9241829 - DNA, 22 bp, Homo sapiens
tggctgaggcacagctgccgcc

SEQ ID NO: 9241830 - DNA, 22 bp, Homo sapiens
tggctgaggcacagctgccgcc

SEQ ID NO: 9241831 - DNA, 22 bp, Homo sapiens
tggctgaggcacagctgccgcc

SEQ ID NO: 9241832 - DNA, 22 bp, Homo sapiens
tggctgaggagggtcttctggt

SEQ ID NO: 9241833 - DNA, 22 bp, Homo sapiens
tggctgaggagggtcttctggt

SEQ ID NO: 9241834 - DNA, 22 bp, Homo sapiens
tggctgaggagggtcttctggt

SEQ ID NO: 9241835 - DNA, 22 bp, Homo sapiens
tggctctgttgtgctgagccag

SEQ ID NO: 9241836 - DNA, 22 bp, Homo sapiens
tggctctgtgtctcccagcagc

SEQ ID NO: 9241837 - DNA, 22 bp, Homo sapiens
tggctctgtgtctcccagcagc

SEQ ID NO: 9241838 - DNA, 22 bp, Homo sapiens
tggctctgttcgccatcaggag

SEQ ID NO: 9241839 - DNA, 22 bp, Homo sapiens
tggctctgttgaggtatggatt

SEQ ID NO: 9241840 - DNA, 22 bp, Homo sapiens
tggctctgggcaccgtgtccac

SEQ ID NO: 9241841 - DNA, 22 bp, Homo sapiens
tggctctggattaatctaggaa

SEQ ID NO: 9241842 - DNA, 21 bp, Homo sapiens
tggctctgctcagagcagtcc

SEQ ID NO: 9241843 - DNA, 21 bp, Homo sapiens
tggctctgctcagagcagtcc

SEQ ID NO: 9241844 - DNA, 22 bp, Homo sapiens
tggctctgatcagatgtccagt

SEQ ID NO: 9241845 - DNA, 18 bp, Homo sapiens
tggctctgcagccagatg

SEQ ID NO: 9241846 - DNA, 18 bp, Homo sapiens
tggctctgcagccagatg

SEQ ID NO: 9241847 - DNA, 22 bp, Homo sapiens
tggctctgccactaacttggta

SEQ ID NO: 9241848 - DNA, 22 bp, Homo sapiens
tggctctgagacacaggctctc

SEQ ID NO: 9241849 - DNA, 22 bp, Homo sapiens
tggctctgagacacaggctctc

SEQ ID NO: 9241850 - DNA, 21 bp, Homo sapiens
tggctcgatttatagcatttc

SEQ ID NO: 9241851 - DNA, 20 bp, Homo sapiens
tggctcctggctcctccctc

SEQ ID NO: 9241852 - DNA, 21 bp, Homo sapiens
tggctctgagcctcatggctg

SEQ ID NO: 9241853 - DNA, 23 bp, Homo sapiens
tggctctgagaggttcagatgct

SEQ ID NO: 9241854 - DNA, 22 bp, Homo sapiens
tggcagggagccaccggtcatg

SEQ ID NO: 9241855 - DNA, 22 bp, Homo sapiens
tggcagggagccaccggtcatg

SEQ ID NO: 9241856 - DNA, 18 bp, Homo sapiens
tggcagggaggaaatata

SEQ ID NO: 9241857 - DNA, 22 bp, Homo sapiens
tggcagggagttcgttcacaac

SEQ ID NO: 9241858 - DNA, 19 bp, Homo sapiens
tggcagggagtgatattag

SEQ ID NO: 9241859 - DNA, 22 bp, Homo sapiens
tggcaggcagagagcggccttt

SEQ ID NO: 9241860 - DNA, 22 bp, Homo sapiens
tggcagggtacaccttaacacc

SEQ ID NO: 9241861 - DNA, 21 bp, Homo sapiens
tggcaggggtagtagtacagc

SEQ ID NO: 9241862 - DNA, 18 bp, Homo sapiens
tggcaggggcagtacgcc

SEQ ID NO: 9241863 - DNA, 22 bp, Homo sapiens
tggcaggggaggtgcttgctta

SEQ ID NO: 9241864 - DNA, 22 bp, Homo sapiens
tggcagggagttgcaggatttc

SEQ ID NO: 9241865 - DNA, 22 bp, Homo sapiens
tggcagggagttgcaggatttc

SEQ ID NO: 9241866 - DNA, 22 bp, Homo sapiens
tggcaggggaggtgcttgctta

SEQ ID NO: 9241867 - DNA, 22 bp, Homo sapiens
tggcagggcctgaatcttatac

SEQ ID NO: 9241868 - DNA, 20 bp, Homo sapiens
tggcaggaggcagcagtgga

SEQ ID NO: 9241869 - DNA, 22 bp, Homo sapiens
tggcaggaggttttctccagga

SEQ ID NO: 9241870 - DNA, 22 bp, Homo sapiens
tggcaggatctttgagagtgaa

SEQ ID NO: 9241871 - DNA, 22 bp, Homo sapiens
tggcaggatctttgagagtgaa

SEQ ID NO: 9241872 - DNA, 22 bp, Homo sapiens
tggcaggaggatgaggcggcta

SEQ ID NO: 9241873 - DNA, 22 bp, Homo sapiens
tggcaggaggatgaggcggcta

SEQ ID NO: 9241874 - DNA, 20 bp, Homo sapiens
tggcaggaatagggccagag

SEQ ID NO: 9241875 - DNA, 20 bp, Homo sapiens
tggcaggaatagggccagag

SEQ ID NO: 9241876 - DNA, 20 bp, Homo sapiens
tggcaggactggctccaccc

SEQ ID NO: 9241877 - DNA, 22 bp, Homo sapiens
tggcaggagacacatggcatag

SEQ ID NO: 9241878 - DNA, 22 bp, Homo sapiens
tggcaggagacacatggcatag

SEQ ID NO: 9241879 - DNA, 22 bp, Homo sapiens
tggcaggaaataccctgcctag

SEQ ID NO: 9241880 - DNA, 22 bp, Homo sapiens
tggcaggaaagtaacagagcac

SEQ ID NO: 9241881 - DNA, 18 bp, Homo sapiens
tggcaggaaatgcacttt

SEQ ID NO: 9241882 - DNA, 22 bp, Homo sapiens
tggcaggaaccaggaggctctc

SEQ ID NO: 9241883 - DNA, 22 bp, Homo sapiens
tggcaggaagacgtggggcacc

SEQ ID NO: 9241884 - DNA, 22 bp, Homo sapiens
tggcaggaaccttaaccacaaa

SEQ ID NO: 9241885 - DNA, 22 bp, Homo sapiens
tggcagctgccatgtccacgtg

SEQ ID NO: 9241886 - DNA, 22 bp, Homo sapiens
tggcagctgcaggcctcctgag

SEQ ID NO: 9241887 - DNA, 22 bp, Homo sapiens
tggcaggaaagtaacagagcac

SEQ ID NO: 9241888 - DNA, 22 bp, Homo sapiens
tggcagctgcgttgtgtttctg

SEQ ID NO: 9241889 - DNA, 22 bp, Homo sapiens
tggcaggaaaaagggccagagg

SEQ ID NO: 9241890 - DNA, 22 bp, Homo sapiens
tggcagctgaggggaggctttg

SEQ ID NO: 9241891 - DNA, 22 bp, Homo sapiens
tggcagctgaggggaggctttg

SEQ ID NO: 9241892 - DNA, 22 bp, Homo sapiens
tggcagctgattagatggtgcc

SEQ ID NO: 9241893 - DNA, 22 bp, Homo sapiens
tggcagctgagtgcaccccctc

SEQ ID NO: 9241894 - DNA, 20 bp, Homo sapiens
tggcagagttgtcccaccca

SEQ ID NO: 9241895 - DNA, 20 bp, Homo sapiens
tggcagagttgtcccaccca

SEQ ID NO: 9241896 - DNA, 22 bp, Homo sapiens
tggcagagttggaggtggaaga

SEQ ID NO: 9241897 - DNA, 21 bp, Homo sapiens
tggcagagttgagtagttatg

SEQ ID NO: 9241898 - DNA, 22 bp, Homo sapiens
tggcagagttatgggtatttat

SEQ ID NO: 9241899 - DNA, 18 bp, Homo sapiens
tggcagagtgtctgttct

SEQ ID NO: 9241900 - DNA, 22 bp, Homo sapiens
tggcagagtggaccatactcaa

SEQ ID NO: 9241901 - DNA, 18 bp, Homo sapiens
tggcagagtgtctgttct

SEQ ID NO: 9241902 - DNA, 18 bp, Homo sapiens
tggcagagtgtctgttct

SEQ ID NO: 9241903 - DNA, 22 bp, Homo sapiens
tggcagagttcgctcctattca

SEQ ID NO: 9241904 - DNA, 22 bp, Homo sapiens
tggcagagttcgctcctattca

SEQ ID NO: 9241905 - DNA, 22 bp, Homo sapiens
tggcagagttcgctgtgccttt

SEQ ID NO: 9241906 - DNA, 22 bp, Homo sapiens
tggcagagttcgctgtgccttt

SEQ ID NO: 9241907 - DNA, 22 bp, Homo sapiens
tggcagagtggaccatactcaa

SEQ ID NO: 9241908 - DNA, 22 bp, Homo sapiens
tggcagagtgcggcatcccctg

SEQ ID NO: 9241909 - DNA, 22 bp, Homo sapiens
tggcagagtggaccatactcaa

SEQ ID NO: 9241910 - DNA, 22 bp, Homo sapiens
tggcagagtgcggcatcccctg

SEQ ID NO: 9241911 - DNA, 22 bp, Homo sapiens
tggcagagtgcggcatcccctg

SEQ ID NO: 9241912 - DNA, 21 bp, Homo sapiens
tggcagagtgcagtctataca

SEQ ID NO: 9241913 - DNA, 22 bp, Homo sapiens
tggcagagtgcagaagaggcat

SEQ ID NO: 9241914 - DNA, 21 bp, Homo sapiens
tggcagagtgcagtctataca

SEQ ID NO: 9241915 - DNA, 22 bp, Homo sapiens
tggcagagtgcagaagaggcat

SEQ ID NO: 9241916 - DNA, 22 bp, Homo sapiens
tggcagagtgcagaagaggcat

SEQ ID NO: 9241917 - DNA, 22 bp, Homo sapiens
tggcagagtaggatggccctgt

SEQ ID NO: 9241918 - DNA, 22 bp, Homo sapiens
tggcagagtaggatggccctgt

SEQ ID NO: 9241919 - DNA, 22 bp, Homo sapiens
tggcagagtcatcacatctgga

SEQ ID NO: 9241920 - DNA, 22 bp, Homo sapiens
tggcagagtcatcacatctgga

SEQ ID NO: 9241921 - DNA, 22 bp, Homo sapiens
tggcagagtctgggcttgggca

SEQ ID NO: 9241922 - DNA, 22 bp, Homo sapiens
tggcagagtctgggcttgggca

SEQ ID NO: 9241923 - DNA, 22 bp, Homo sapiens
tggcagagtctctcctttccag

SEQ ID NO: 9241924 - DNA, 22 bp, Homo sapiens
tggcagagtctctcctttccag

SEQ ID NO: 9241925 - DNA, 22 bp, Homo sapiens
tggcagcagacaaaaggccatt

SEQ ID NO: 9241926 - DNA, 22 bp, Homo sapiens
tggcagcagacaaaaggccatt

SEQ ID NO: 9241927 - DNA, 23 bp, Homo sapiens
tggcagcagatcttaaagtgacc

SEQ ID NO: 9241928 - DNA, 22 bp, Homo sapiens
tggcagcagccatggaaggccc

SEQ ID NO: 9241929 - DNA, 22 bp, Homo sapiens
tggcagcagggaggccagtgtt

SEQ ID NO: 9241930 - DNA, 18 bp, Homo sapiens
tggcagcaggaagccatt

SEQ ID NO: 9241931 - DNA, 22 bp, Homo sapiens
tggcagcagtagccaccccagc

SEQ ID NO: 9241932 - DNA, 22 bp, Homo sapiens
tggcagcatgttatgtaaggaa

SEQ ID NO: 9241933 - DNA, 22 bp, Homo sapiens
tggcagccacatctcgtggatt

SEQ ID NO: 9241934 - DNA, 22 bp, Homo sapiens
tggcagccatctgagggtgggg

SEQ ID NO: 9241935 - DNA, 22 bp, Homo sapiens
tggcagctacagacagaggtga

SEQ ID NO: 9241936 - DNA, 22 bp, Homo sapiens
tggcagctatggtctaagggcc

SEQ ID NO: 9241937 - DNA, 22 bp, Homo sapiens
tggcagctagctgttttcatgc

SEQ ID NO: 9241938 - DNA, 22 bp, Homo sapiens
tggcagctagatagtgtgttta

SEQ ID NO: 9241939 - DNA, 22 bp, Homo sapiens
tggcagctacagacagaggtga

SEQ ID NO: 9241940 - DNA, 22 bp, Homo sapiens
tggcagctcctggggccagcac

SEQ ID NO: 9241941 - DNA, 22 bp, Homo sapiens
tggcagctccgggtaggggctg

SEQ ID NO: 9241942 - DNA, 22 bp, Homo sapiens
tggcagctattacaaggaagtc

SEQ ID NO: 9241943 - DNA, 22 bp, Homo sapiens
tggcagctcccagagcttccaa

SEQ ID NO: 9241944 - DNA, 22 bp, Homo sapiens
tggcagaggaaaaagtcactgg

SEQ ID NO: 9241945 - DNA, 16 bp, Homo sapiens
tggcagaggttcagcc

SEQ ID NO: 9241946 - DNA, 22 bp, Homo sapiens
tggcagagccttgccaaactcc

SEQ ID NO: 9241947 - DNA, 22 bp, Homo sapiens
tggcagagctggctgcggatga

SEQ ID NO: 9241948 - DNA, 22 bp, Homo sapiens
tggcagagatgaagagttgttt

SEQ ID NO: 9241949 - DNA, 22 bp, Homo sapiens
tggcagagatgaagagttgttt

SEQ ID NO: 9241950 - DNA, 22 bp, Homo sapiens
tggcagagcaaaaagatagaat

SEQ ID NO: 9241951 - DNA, 22 bp, Homo sapiens
tggcagagcccagaactgagca

SEQ ID NO: 9241952 - DNA, 22 bp, Homo sapiens
tggcagagcccagactccagtc

SEQ ID NO: 9241953 - DNA, 22 bp, Homo sapiens
tggcagagcccagactccagtc

SEQ ID NO: 9241954 - DNA, 22 bp, Homo sapiens
tggcagagcccagactccagtc

SEQ ID NO: 9241955 - DNA, 22 bp, Homo sapiens
tggcagagcccagaactgagca

SEQ ID NO: 9241956 - DNA, 22 bp, Homo sapiens
tggcagagagactctccttgat

SEQ ID NO: 9241957 - DNA, 22 bp, Homo sapiens
tggcagagagactctccttgat

SEQ ID NO: 9241958 - DNA, 22 bp, Homo sapiens
tggcagagagagtgcagtcgac

SEQ ID NO: 9241959 - DNA, 22 bp, Homo sapiens
tggcagagagagtgcagtcgac

SEQ ID NO: 9241960 - DNA, 23 bp, Homo sapiens
tggcagagacccagaatctacat

SEQ ID NO: 9241961 - DNA, 22 bp, Homo sapiens
tggcagagactcctcctgggag

SEQ ID NO: 9241962 - DNA, 22 bp, Homo sapiens
tggcagagactcctcctgggag

SEQ ID NO: 9241963 - DNA, 22 bp, Homo sapiens
tggcagagactcctcctgggag

SEQ ID NO: 9241964 - DNA, 22 bp, Homo sapiens
tggcagagactcctcctgggag

SEQ ID NO: 9241965 - DNA, 22 bp, Homo sapiens
tggcagagagactctccttgat

SEQ ID NO: 9241966 - DNA, 22 bp, Homo sapiens
tggcagagaacacggctgatct

SEQ ID NO: 9241967 - DNA, 22 bp, Homo sapiens
tggcagagaacacggctgatct

SEQ ID NO: 9241968 - DNA, 22 bp, Homo sapiens
tggcagagaataaatcttgact

SEQ ID NO: 9241969 - DNA, 22 bp, Homo sapiens
tggcagagaacctgggctttgt

SEQ ID NO: 9241970 - DNA, 22 bp, Homo sapiens
tggcagagaacctgggctttgt

SEQ ID NO: 9241971 - DNA, 22 bp, Homo sapiens
tggcagagacaaggccgggcct

SEQ ID NO: 9241972 - DNA, 22 bp, Homo sapiens
tggcagagaataaatcttgact

SEQ ID NO: 9241973 - DNA, 22 bp, Homo sapiens
tggcagagacaaggccgggcct

SEQ ID NO: 9241974 - DNA, 22 bp, Homo sapiens
tggcagagacaaggccgggcct

SEQ ID NO: 9241975 - DNA, 21 bp, Homo sapiens
tggcactgcttagcaggttcc

SEQ ID NO: 9241976 - DNA, 21 bp, Homo sapiens
tggcactgcttagcaggttcc

SEQ ID NO: 9241977 - DNA, 22 bp, Homo sapiens
tggcactgcctggcagggcccc

SEQ ID NO: 9241978 - DNA, 22 bp, Homo sapiens
tggcactgcctggcagggcccc

SEQ ID NO: 9241979 - DNA, 22 bp, Homo sapiens
tggcactggaatcgtagccttg

SEQ ID NO: 9241980 - DNA, 22 bp, Homo sapiens
tggcactggaatcgtagccttg

SEQ ID NO: 9241981 - DNA, 22 bp, Homo sapiens
tggcactggaatcgtagccttg

SEQ ID NO: 9241982 - DNA, 22 bp, Homo sapiens
tggcactgagcagccgcggcag

SEQ ID NO: 9241983 - DNA, 22 bp, Homo sapiens
tggcactgaccccaggcctgtg

SEQ ID NO: 9241984 - DNA, 22 bp, Homo sapiens
tggcactgaccccaggcctgtg

SEQ ID NO: 9241985 - DNA, 22 bp, Homo sapiens
tggcactgaccccaggcctgtg

SEQ ID NO: 9241986 - DNA, 22 bp, Homo sapiens
tggcactgccaacctgctaggt

SEQ ID NO: 9241987 - DNA, 22 bp, Homo sapiens
tggcactgccaacctgctaggt

SEQ ID NO: 9241988 - DNA, 22 bp, Homo sapiens
tggcactgagcagccgcggcag

SEQ ID NO: 9241989 - DNA, 22 bp, Homo sapiens
tggcactgccaacctgctaggt

SEQ ID NO: 9241990 - DNA, 22 bp, Homo sapiens
tggcactgccaacctgctaggt

SEQ ID NO: 9241991 - DNA, 22 bp, Homo sapiens
tggcactgccaacctgctaggt

SEQ ID NO: 9241992 - DNA, 22 bp, Homo sapiens
tggcactgtcaccaatgctgtc

SEQ ID NO: 9241993 - DNA, 22 bp, Homo sapiens
tggcactgtggatttcacaagt

SEQ ID NO: 9241994 - DNA, 22 bp, Homo sapiens
tggcagagaacacggctgatct

SEQ ID NO: 9241995 - DNA, 22 bp, Homo sapiens
tggcactgggacagatgctctc

SEQ ID NO: 9241996 - DNA, 22 bp, Homo sapiens
tggcactggcgcaggatggcgg

SEQ ID NO: 9241997 - DNA, 22 bp, Homo sapiens
tggcactgggacagatgctctc

SEQ ID NO: 9241998 - DNA, 22 bp, Homo sapiens
tggcactgggatgctactgtta

SEQ ID NO: 9241999 - DNA, 22 bp, Homo sapiens
tggcactgggatgctactgtta

SEQ ID NO: 9242000 - DNA, 22 bp, Homo sapiens
tggcactgggatgctactgtta

SEQ ID NO: 9242001 - DNA, 22 bp, Homo sapiens
tggcactgtagccactactgcc

SEQ ID NO: 9242002 - DNA, 22 bp, Homo sapiens
tggcactgtagccactactgcc

SEQ ID NO: 9242003 - DNA, 22 bp, Homo sapiens
tggcactgtcaccaatgctgtc

SEQ ID NO: 9242004 - DNA, 22 bp, Homo sapiens
tggcactgtcaccaatgctgtc

SEQ ID NO: 9242005 - DNA, 22 bp, Homo sapiens
tggcactgaagctggaaagcct

SEQ ID NO: 9242006 - DNA, 22 bp, Homo sapiens
tggcactgacagggtgctcaag

SEQ ID NO: 9242007 - DNA, 22 bp, Homo sapiens
tggcacgacaattggcaccaat

SEQ ID NO: 9242008 - DNA, 22 bp, Homo sapiens
tggcacctgaacttagaggtgt

SEQ ID NO: 9242009 - DNA, 22 bp, Homo sapiens
tggcacagttaaagttgtagaa

SEQ ID NO: 9242010 - DNA, 22 bp, Homo sapiens
tggcacatccacagaatctgga

SEQ ID NO: 9242011 - DNA, 22 bp, Homo sapiens
tggcacatggttaatcataatt

SEQ ID NO: 9242012 - DNA, 22 bp, Homo sapiens
tggattcacaccattctcctgc

SEQ ID NO: 9242013 - DNA, 22 bp, Homo sapiens
tggatgggttgaaatgtgagcc

SEQ ID NO: 9242014 - DNA, 22 bp, Homo sapiens
tggatgggttgaaatgtgagcc

SEQ ID NO: 9242015 - DNA, 22 bp, Homo sapiens
tggattcacaccattctcctgc

SEQ ID NO: 9242016 - DNA, 22 bp, Homo sapiens
tggattagttaagaaatgttag

SEQ ID NO: 9242017 - DNA, 22 bp, Homo sapiens
tggattcacaccattctcctgc

SEQ ID NO: 9242018 - DNA, 22 bp, Homo sapiens
tggattcacaccattctcctgc

SEQ ID NO: 9242019 - DNA, 20 bp, Homo sapiens
tggattctggagctgccctc

SEQ ID NO: 9242020 - DNA, 21 bp, Homo sapiens
tggattgaggtgacagtgtgc

SEQ ID NO: 9242021 - DNA, 22 bp, Homo sapiens
tggattgataagagacaagtga

SEQ ID NO: 9242022 - DNA, 22 bp, Homo sapiens
tggatttaacagaataccaggt

SEQ ID NO: 9242023 - DNA, 22 bp, Homo sapiens
tggatttagttcttcacaggcc

SEQ ID NO: 9242024 - DNA, 22 bp, Homo sapiens
tggcaaaggaaatgatttaaga

SEQ ID NO: 9242025 - DNA, 22 bp, Homo sapiens
tggcaaaggaaatgatttaaga

SEQ ID NO: 9242026 - DNA, 22 bp, Homo sapiens
tggcaaagacgctagctaagat

SEQ ID NO: 9242027 - DNA, 22 bp, Homo sapiens
tggcaaccgcatggcctgcttc

SEQ ID NO: 9242028 - DNA, 22 bp, Homo sapiens
tggcaacacctggaagacatgg

SEQ ID NO: 9242029 - DNA, 22 bp, Homo sapiens
tggcaatatgctttcagtggcc

SEQ ID NO: 9242030 - DNA, 22 bp, Homo sapiens
tggcaatatgctttcagtggcc

SEQ ID NO: 9242031 - DNA, 22 bp, Homo sapiens
tggcacagagggacccagcagc

SEQ ID NO: 9242032 - DNA, 22 bp, Homo sapiens
tggcacagagggacccagcagc

SEQ ID NO: 9242033 - DNA, 17 bp, Homo sapiens
tggcacagaggtgctat

SEQ ID NO: 9242034 - DNA, 21 bp, Homo sapiens
tggcacagcaagtgggctcat

SEQ ID NO: 9242035 - DNA, 17 bp, Homo sapiens
tggcacagaggtgctat

SEQ ID NO: 9242036 - DNA, 23 bp, Homo sapiens
tggcacagaggaccatgctttgc

SEQ ID NO: 9242037 - DNA, 23 bp, Homo sapiens
tggcacagaggaccatgctttgc

SEQ ID NO: 9242038 - DNA, 22 bp, Homo sapiens
tggcacagactgggccaaggaa

SEQ ID NO: 9242039 - DNA, 22 bp, Homo sapiens
tggcacagcccagagctcttga

SEQ ID NO: 9242040 - DNA, 21 bp, Homo sapiens
tggcacagcaagtgggctcat

SEQ ID NO: 9242041 - DNA, 23 bp, Homo sapiens
tggcacagcaggtgtgctttgtt

SEQ ID NO: 9242042 - DNA, 22 bp, Homo sapiens
tggcacagccactgaatcggga

SEQ ID NO: 9242043 - DNA, 20 bp, Homo sapiens
tggcacagaacccttgccta

SEQ ID NO: 9242044 - DNA, 22 bp, Homo sapiens
tggcacagacagatcaggagtc

SEQ ID NO: 9242045 - DNA, 21 bp, Homo sapiens
tggcacagaaaggaaagttca

SEQ ID NO: 9242046 - DNA, 22 bp, Homo sapiens
tggcacagacagatcaggagtc

SEQ ID NO: 9242047 - DNA, 22 bp, Homo sapiens
tggcacagacagcacagcaatg

SEQ ID NO: 9242048 - DNA, 22 bp, Homo sapiens
tggcacagaccttatcttctct

SEQ ID NO: 9242049 - DNA, 22 bp, Homo sapiens
tggcacaagggctattccttag

SEQ ID NO: 9242050 - DNA, 22 bp, Homo sapiens
tggcaatgagcaggtgctctgg

SEQ ID NO: 9242051 - DNA, 22 bp, Homo sapiens
tggcaatgtaaattgaactaga

SEQ ID NO: 9242052 - DNA, 22 bp, Homo sapiens
tggcaattgtccactgtctgcc

SEQ ID NO: 9242053 - DNA, 22 bp, Homo sapiens
tggcagggtgccagttgcgagt

SEQ ID NO: 9242054 - DNA, 22 bp, Homo sapiens
tggcagggtcttgctgtgttgc

SEQ ID NO: 9242055 - DNA, 22 bp, Homo sapiens
tggcagtgatgcggcaggacat

SEQ ID NO: 9242056 - DNA, 23 bp, Homo sapiens
tggcagtgcccagggagatgatc

SEQ ID NO: 9242057 - DNA, 22 bp, Homo sapiens
tggcagtgccccttgaccagtg

SEQ ID NO: 9242058 - DNA, 23 bp, Homo sapiens
tggcagtgatcaaaagcttacat

SEQ ID NO: 9242059 - DNA, 18 bp, Homo sapiens
tggcagtgaggtaggcat

SEQ ID NO: 9242060 - DNA, 18 bp, Homo sapiens
tggcagtgaggtaggcat

SEQ ID NO: 9242061 - DNA, 22 bp, Homo sapiens
tggcagtcttgtaggcatctcc

SEQ ID NO: 9242062 - DNA, 22 bp, Homo sapiens
tggcagtcccctgtgcctggaa

SEQ ID NO: 9242063 - DNA, 22 bp, Homo sapiens
tggcagtccagaccctggactc

SEQ ID NO: 9242064 - DNA, 22 bp, Homo sapiens
tggcagtctgggttggcagtta

SEQ ID NO: 9242065 - DNA, 22 bp, Homo sapiens
tggcatggcatttagagaatta

SEQ ID NO: 9242066 - DNA, 22 bp, Homo sapiens
tggcatggccagtgctgggagt

SEQ ID NO: 9242067 - DNA, 22 bp, Homo sapiens
tggcatggctactggaatggcg

SEQ ID NO: 9242068 - DNA, 22 bp, Homo sapiens
tggcatggcgtggcatcgtgtg

SEQ ID NO: 9242069 - DNA, 22 bp, Homo sapiens
tggcatgggccagggagagctg

SEQ ID NO: 9242070 - DNA, 22 bp, Homo sapiens
tggcatctttgtcccagaagct

SEQ ID NO: 9242071 - DNA, 17 bp, Homo sapiens
tggcatcttttgctcat

SEQ ID NO: 9242072 - DNA, 22 bp, Homo sapiens
tggcatctttgtcccagaagct

SEQ ID NO: 9242073 - DNA, 22 bp, Homo sapiens
tggcatgaagtcagcagctggg

SEQ ID NO: 9242074 - DNA, 23 bp, Homo sapiens
tggcatcttggcatcttgctgct

SEQ ID NO: 9242075 - DNA, 19 bp, Homo sapiens
tggcatctgggccctccag

SEQ ID NO: 9242076 - DNA, 22 bp, Homo sapiens
tggcatctgtgttgcggttgtc

SEQ ID NO: 9242077 - DNA, 22 bp, Homo sapiens
tggcatctccgacagtcttgat

SEQ ID NO: 9242078 - DNA, 22 bp, Homo sapiens
tggcatctccgacagtcttgat

SEQ ID NO: 9242079 - DNA, 22 bp, Homo sapiens
tggcatctcaaacaggcagatt

SEQ ID NO: 9242080 - DNA, 22 bp, Homo sapiens
tggcatggaccttggaagaatt

SEQ ID NO: 9242081 - DNA, 22 bp, Homo sapiens
tggcatgcaagaggaggctccc

SEQ ID NO: 9242082 - DNA, 22 bp, Homo sapiens
tggcatgataggaggtgcagaa

SEQ ID NO: 9242083 - DNA, 22 bp, Homo sapiens
tggcatgataggaggtgcagaa

SEQ ID NO: 9242084 - DNA, 22 bp, Homo sapiens
tggcatgcaagaggaggctccc

SEQ ID NO: 9242085 - DNA, 22 bp, Homo sapiens
tggcatgagtataggcttctca

SEQ ID NO: 9242086 - DNA, 17 bp, Homo sapiens
tggcatgagggtgtggg

SEQ ID NO: 9242087 - DNA, 22 bp, Homo sapiens
tggcagtggctcagagtgcaga

SEQ ID NO: 9242088 - DNA, 22 bp, Homo sapiens
tggcagtggctcagagtgcaga

SEQ ID NO: 9242089 - DNA, 22 bp, Homo sapiens
tggcagtgtttctaaggggctc

SEQ ID NO: 9242090 - DNA, 22 bp, Homo sapiens
tggcagtgccccttgaccagtg

SEQ ID NO: 9242091 - DNA, 22 bp, Homo sapiens
tggcagtggataggggagcggt

SEQ ID NO: 9242092 - DNA, 22 bp, Homo sapiens
tggcagtggctcagagtgcaga

SEQ ID NO: 9242093 - DNA, 22 bp, Homo sapiens
tggcatccagataccctgaggg

SEQ ID NO: 9242094 - DNA, 22 bp, Homo sapiens
tggcatccagccatgtgatttt

SEQ ID NO: 9242095 - DNA, 22 bp, Homo sapiens
tggcatcctctcttctgagtgc

SEQ ID NO: 9242096 - DNA, 22 bp, Homo sapiens
tggcagtttcatgtgattcaac

SEQ ID NO: 9242097 - DNA, 22 bp, Homo sapiens
tggcagtttacagagttctgaa

SEQ ID NO: 9242098 - DNA, 22 bp, Homo sapiens
tggcagttctaattgaccattt

SEQ ID NO: 9242099 - DNA, 22 bp, Homo sapiens
tggcagttgtgaggttcatatt

SEQ ID NO: 9242100 - DNA, 22 bp, Homo sapiens
tggcagttggggatgaagtgag

SEQ ID NO: 9242101 - DNA, 22 bp, Homo sapiens
tggcagttcaggctgcaatcat

SEQ ID NO: 9242102 - DNA, 22 bp, Homo sapiens
tggcagttattaatcaagtctt

SEQ ID NO: 9242103 - DNA, 22 bp, Homo sapiens
tggcattgcttctgaagtggag

SEQ ID NO: 9242104 - DNA, 19 bp, Homo sapiens
tggcattggtccagataaa

SEQ ID NO: 9242105 - DNA, 22 bp, Homo sapiens
tggcatgtttcatggctgcaaa

SEQ ID NO: 9242106 - DNA, 22 bp, Homo sapiens
tggcatgtttaatgtactgtat

SEQ ID NO: 9242107 - DNA, 22 bp, Homo sapiens
tggcatgggtggagagagcaca

SEQ ID NO: 9242108 - DNA, 22 bp, Homo sapiens
tggcatttagttgcgtattgca

SEQ ID NO: 9242109 - DNA, 22 bp, Homo sapiens
tggcatttcagtattttcataa

SEQ ID NO: 9242110 - DNA, 22 bp, Homo sapiens
tggccacagcctctgccagttc

SEQ ID NO: 9242111 - DNA, 23 bp, Homo sapiens
tggccacagggtgctccattgta

SEQ ID NO: 9242112 - DNA, 22 bp, Homo sapiens
tggccacccctttctctgcact

SEQ ID NO: 9242113 - DNA, 22 bp, Homo sapiens
tggccacccctttctctgcact

SEQ ID NO: 9242114 - DNA, 22 bp, Homo sapiens
tggccaccaccaatacttgcct

SEQ ID NO: 9242115 - DNA, 22 bp, Homo sapiens
tggccaccaccaatacttgcct

SEQ ID NO: 9242116 - DNA, 22 bp, Homo sapiens
tggccacagtgtccagcagcag

SEQ ID NO: 9242117 - DNA, 22 bp, Homo sapiens
tggccacagtgtccagcagcag

SEQ ID NO: 9242118 - DNA, 22 bp, Homo sapiens
tggccacatcctttccttgtca

SEQ ID NO: 9242119 - DNA, 22 bp, Homo sapiens
tggccacatcctttccttgtca

SEQ ID NO: 9242120 - DNA, 22 bp, Homo sapiens
tggccaccttatggctattgga

SEQ ID NO: 9242121 - DNA, 22 bp, Homo sapiens
tggccagaactcagacatgtgg

SEQ ID NO: 9242122 - DNA, 22 bp, Homo sapiens
tggccagaactcagacatgtgg

SEQ ID NO: 9242123 - DNA, 22 bp, Homo sapiens
tggccagacagagaggctttgt

SEQ ID NO: 9242124 - DNA, 22 bp, Homo sapiens
tggccagaacctgcagtaggcc

SEQ ID NO: 9242125 - DNA, 22 bp, Homo sapiens
tggccagagtccagtgagcctt

SEQ ID NO: 9242126 - DNA, 22 bp, Homo sapiens
tggccaggttgggctttgcagc

SEQ ID NO: 9242127 - DNA, 19 bp, Homo sapiens
tggccaggtactgtctgct

SEQ ID NO: 9242128 - DNA, 19 bp, Homo sapiens
tggccaggtactgtctgct

SEQ ID NO: 9242129 - DNA, 19 bp, Homo sapiens
tggccaggtactgtctgct

SEQ ID NO: 9242130 - DNA, 19 bp, Homo sapiens
tggccaggtactgtctgct

SEQ ID NO: 9242131 - DNA, 23 bp, Homo sapiens
tggccaggtagaggaggtagtga

SEQ ID NO: 9242132 - DNA, 22 bp, Homo sapiens
tggccaggctggtctggaacgc

SEQ ID NO: 9242133 - DNA, 22 bp, Homo sapiens
tggccaggcctcttggtgccca

SEQ ID NO: 9242134 - DNA, 22 bp, Homo sapiens
tggccaggcattcagataagac

SEQ ID NO: 9242135 - DNA, 22 bp, Homo sapiens
tggccaggccggggacagaact

SEQ ID NO: 9242136 - DNA, 22 bp, Homo sapiens
tggccaggccggggacagaact

SEQ ID NO: 9242137 - DNA, 22 bp, Homo sapiens
tggccaggcattcagataagac

SEQ ID NO: 9242138 - DNA, 21 bp, Homo sapiens
tggccagctgctcgtctcctc

SEQ ID NO: 9242139 - DNA, 22 bp, Homo sapiens
tggccagattcatgcatgtatc

SEQ ID NO: 9242140 - DNA, 22 bp, Homo sapiens
tggccagagtccagtgagcctt

SEQ ID NO: 9242141 - DNA, 22 bp, Homo sapiens
tggccagcccttcagccatgcc

SEQ ID NO: 9242142 - DNA, 22 bp, Homo sapiens
tggccagccataaaagaaccca

SEQ ID NO: 9242143 - DNA, 22 bp, Homo sapiens
tggccatgaaggaggcagcaga

SEQ ID NO: 9242144 - DNA, 22 bp, Homo sapiens
tggcccagccctgctctagggc

SEQ ID NO: 9242145 - DNA, 15 bp, Homo sapiens
tggcccacccgttga

SEQ ID NO: 9242146 - DNA, 22 bp, Homo sapiens
tggcccaaagcagcccagcagg

SEQ ID NO: 9242147 - DNA, 22 bp, Homo sapiens
tggcccaggggctcttggtgtt

SEQ ID NO: 9242148 - DNA, 22 bp, Homo sapiens
tggcccagggcacagcagggag

SEQ ID NO: 9242149 - DNA, 22 bp, Homo sapiens
tggcccagctgcagatggtgga

SEQ ID NO: 9242150 - DNA, 22 bp, Homo sapiens
tggcccagctgcagatggtgga

SEQ ID NO: 9242151 - DNA, 22 bp, Homo sapiens
tggcccaggaggccagagggca

SEQ ID NO: 9242152 - DNA, 22 bp, Homo sapiens
tggcccagtcagcaggagaggg

SEQ ID NO: 9242153 - DNA, 22 bp, Homo sapiens
tggcccagtcagcaggagaggg

SEQ ID NO: 9242154 - DNA, 22 bp, Homo sapiens
tggcccagtatgtataatctta

SEQ ID NO: 9242155 - DNA, 22 bp, Homo sapiens
tggccctgaatcaaggccagca

SEQ ID NO: 9242156 - DNA, 23 bp, Homo sapiens
tggccctgaatctgtcctggagg

SEQ ID NO: 9242157 - DNA, 22 bp, Homo sapiens
tggccctgacacgtggtactgg

SEQ ID NO: 9242158 - DNA, 22 bp, Homo sapiens
tggccctcgtccgacaggtggg

SEQ ID NO: 9242159 - DNA, 22 bp, Homo sapiens
tggccctgcagaactagcctgg

SEQ ID NO: 9242160 - DNA, 22 bp, Homo sapiens
tggccctgcacccagagcagtt

SEQ ID NO: 9242161 - DNA, 22 bp, Homo sapiens
tggccctgaggggctgtgcccc

SEQ ID NO: 9242162 - DNA, 22 bp, Homo sapiens
tggccctgaggggctgtgcccc

SEQ ID NO: 9242163 - DNA, 22 bp, Homo sapiens
tggccctgaggacccagtgtgg

SEQ ID NO: 9242164 - DNA, 22 bp, Homo sapiens
tggccctgacttggaggcctga

SEQ ID NO: 9242165 - DNA, 22 bp, Homo sapiens
tggccctgacacgtggtactgg

SEQ ID NO: 9242166 - DNA, 22 bp, Homo sapiens
tggccctgacacgtggtactgg

SEQ ID NO: 9242167 - DNA, 22 bp, Homo sapiens
tggcctggaaaaatgcagatgg

SEQ ID NO: 9242168 - DNA, 22 bp, Homo sapiens
tggcctggaaaaatgcagatgg

SEQ ID NO: 9242169 - DNA, 22 bp, Homo sapiens
tggcctggaacctggcagggac

SEQ ID NO: 9242170 - DNA, 22 bp, Homo sapiens
tggcctggaacctggcagggac

SEQ ID NO: 9242171 - DNA, 22 bp, Homo sapiens
tggcctggaagagaggtcgagg

SEQ ID NO: 9242172 - DNA, 22 bp, Homo sapiens
tggcctggaacctggcagggac

SEQ ID NO: 9242173 - DNA, 22 bp, Homo sapiens
tggcctggaaaaatgcagatgg

SEQ ID NO: 9242174 - DNA, 22 bp, Homo sapiens
tggcctggaaaaatgcagatgg

SEQ ID NO: 9242175 - DNA, 22 bp, Homo sapiens
tggcctggaaaaatgcagatgg

SEQ ID NO: 9242176 - DNA, 22 bp, Homo sapiens
tggcctgcctgggagcagcagg

SEQ ID NO: 9242177 - DNA, 22 bp, Homo sapiens
tggcctggccacatccagcagg

SEQ ID NO: 9242178 - DNA, 22 bp, Homo sapiens
tggcctggccacatccagcagg

SEQ ID NO: 9242179 - DNA, 22 bp, Homo sapiens
tggcctggcagagcaaggcctg

SEQ ID NO: 9242180 - DNA, 22 bp, Homo sapiens
tggcctggaagagaggtcgagg

SEQ ID NO: 9242181 - DNA, 22 bp, Homo sapiens
tggcctggaagagaggtcgagg

SEQ ID NO: 9242182 - DNA, 18 bp, Homo sapiens
tggcctggagacaactct

SEQ ID NO: 9242183 - DNA, 23 bp, Homo sapiens
tggcctggagagaaaagatgagt

SEQ ID NO: 9242184 - DNA, 23 bp, Homo sapiens
tggcctggagagaaaagatgagt

SEQ ID NO: 9242185 - DNA, 18 bp, Homo sapiens
tggcctggagacaactct

SEQ ID NO: 9242186 - DNA, 18 bp, Homo sapiens
tggcctggagacaactct

SEQ ID NO: 9242187 - DNA, 23 bp, Homo sapiens
tggcctggagagaaaagatgagt

SEQ ID NO: 9242188 - DNA, 22 bp, Homo sapiens
tggcctctgaggcacctttgcc

SEQ ID NO: 9242189 - DNA, 22 bp, Homo sapiens
tggcctctgcaatggattcacc

SEQ ID NO: 9242190 - DNA, 22 bp, Homo sapiens
tggcctctgcactgggctcccc

SEQ ID NO: 9242191 - DNA, 22 bp, Homo sapiens
tggcctctgcactgggctcccc

SEQ ID NO: 9242192 - DNA, 22 bp, Homo sapiens
tggcctcttaggacatcctcta

SEQ ID NO: 9242193 - DNA, 22 bp, Homo sapiens
tggcctgactgtcaggctgtat

SEQ ID NO: 9242194 - DNA, 22 bp, Homo sapiens
tggcctgaattatggcagatct

SEQ ID NO: 9242195 - DNA, 22 bp, Homo sapiens
tggcccttgtcctgggagagtt

SEQ ID NO: 9242196 - DNA, 22 bp, Homo sapiens
tggcctatttcatcagttcaat

SEQ ID NO: 9242197 - DNA, 22 bp, Homo sapiens
tggccctgtggaggtcagtgag

SEQ ID NO: 9242198 - DNA, 22 bp, Homo sapiens
tggccctgtgtcctgctgccag

SEQ ID NO: 9242199 - DNA, 22 bp, Homo sapiens
tggccctgtggaggtcagtgag

SEQ ID NO: 9242200 - DNA, 22 bp, Homo sapiens
tggccctgtggaggtcagtgag

SEQ ID NO: 9242201 - DNA, 22 bp, Homo sapiens
tggccctgtgtgcaggctgcac

SEQ ID NO: 9242202 - DNA, 22 bp, Homo sapiens
tggccctgccctcttcatcttt

SEQ ID NO: 9242203 - DNA, 22 bp, Homo sapiens
tggccctggctgagttagattt

SEQ ID NO: 9242204 - DNA, 22 bp, Homo sapiens
tggccctgtgactgagttctag

SEQ ID NO: 9242205 - DNA, 22 bp, Homo sapiens
tggccctgtcctcatttcatct

SEQ ID NO: 9242206 - DNA, 21 bp, Homo sapiens
tgacatttccaatataaagcc

SEQ ID NO: 9242207 - DNA, 22 bp, Homo sapiens
tgacatttatcttctacaatga

SEQ ID NO: 9242208 - DNA, 22 bp, Homo sapiens
tgacatttcagatatggtattt

SEQ ID NO: 9242209 - DNA, 21 bp, Homo sapiens
tgacatttagtagcattgtca

SEQ ID NO: 9242210 - DNA, 21 bp, Homo sapiens
tgacatttagtagcattgtca

SEQ ID NO: 9242211 - DNA, 22 bp, Homo sapiens
tgacatttactattcctggtta

SEQ ID NO: 9242212 - DNA, 22 bp, Homo sapiens
tgacatttatcttctacaatga

SEQ ID NO: 9242213 - DNA, 22 bp, Homo sapiens
tgacatttatcaaagaaatggt

SEQ ID NO: 9242214 - DNA, 22 bp, Homo sapiens
tgacatgttagggaaatgtgat

SEQ ID NO: 9242215 - DNA, 22 bp, Homo sapiens
tgacatttaatccctaaatatt

SEQ ID NO: 9242216 - DNA, 22 bp, Homo sapiens
tgacatttaatccctaaatatt

SEQ ID NO: 9242217 - DNA, 22 bp, Homo sapiens
tgacatttaattaacgaatgct

SEQ ID NO: 9242218 - DNA, 22 bp, Homo sapiens
tgacattgtgtgcatttaaagt

SEQ ID NO: 9242219 - DNA, 22 bp, Homo sapiens
tgacattggttgcaaggtactc

SEQ ID NO: 9242220 - DNA, 22 bp, Homo sapiens
tgacatttaagcctctgatttc

SEQ ID NO: 9242221 - DNA, 22 bp, Homo sapiens
tgacatttaagcctctgatttc

SEQ ID NO: 9242222 - DNA, 22 bp, Homo sapiens
tgacatttcggtgtatgtgatg

SEQ ID NO: 9242223 - DNA, 22 bp, Homo sapiens
tgacatttcttgttgatataaa

SEQ ID NO: 9242224 - DNA, 22 bp, Homo sapiens
tgacatttcttgttgatataaa

SEQ ID NO: 9242225 - DNA, 22 bp, Homo sapiens
tgacatttcctagtgctttgtg

SEQ ID NO: 9242226 - DNA, 18 bp, Homo sapiens
tgacatttccagagtgta

SEQ ID NO: 9242227 - DNA, 22 bp, Homo sapiens
tgacatttcctagtgctttgtg

SEQ ID NO: 9242228 - DNA, 22 bp, Homo sapiens
tgacatttcttgttgatataaa

SEQ ID NO: 9242229 - DNA, 22 bp, Homo sapiens
tgacatttgagagagatataca

SEQ ID NO: 9242230 - DNA, 22 bp, Homo sapiens
tgacatttgagcatacatgtaa

SEQ ID NO: 9242231 - DNA, 21 bp, Homo sapiens
tgacatttggattcatagtaa

SEQ ID NO: 9242232 - DNA, 22 bp, Homo sapiens
tgacatttgagcatacatgtaa

SEQ ID NO: 9242233 - DNA, 22 bp, Homo sapiens
tgacatttttaaaaccactagt

SEQ ID NO: 9242234 - DNA, 22 bp, Homo sapiens
tgacatttttaaaaccactagt

SEQ ID NO: 9242235 - DNA, 22 bp, Homo sapiens
tgacattttatcaatatcacag

SEQ ID NO: 9242236 - DNA, 22 bp, Homo sapiens
tgacattttatcaatatcacag

SEQ ID NO: 9242237 - DNA, 21 bp, Homo sapiens
tgacatttggattcatagtaa

SEQ ID NO: 9242238 - DNA, 22 bp, Homo sapiens
tgacctattagatttccttgcc

SEQ ID NO: 9242239 - DNA, 22 bp, Homo sapiens
tgactgccccttccattcctgc

SEQ ID NO: 9242240 - DNA, 19 bp, Homo sapiens
tgactgcctcaggggtgga

SEQ ID NO: 9242241 - DNA, 22 bp, Homo sapiens
tgactggagacctcagtagggt

SEQ ID NO: 9242242 - DNA, 22 bp, Homo sapiens
tgactgaaattgcattttaaaa

SEQ ID NO: 9242243 - DNA, 21 bp, Homo sapiens
tgactgaggcttcttcacaca

SEQ ID NO: 9242244 - DNA, 22 bp, Homo sapiens
tgactgccatgagggtgagggc

SEQ ID NO: 9242245 - DNA, 22 bp, Homo sapiens
tgacttcctgcactcaggtgat

SEQ ID NO: 9242246 - DNA, 22 bp, Homo sapiens
tgacttcctgcactcaggtgat

SEQ ID NO: 9242247 - DNA, 22 bp, Homo sapiens
tgacttcaaaggctctactcct

SEQ ID NO: 9242248 - DNA, 22 bp, Homo sapiens
tgacttcaaaggctctactcct

SEQ ID NO: 9242249 - DNA, 22 bp, Homo sapiens
tgacttctagcatttagcaacc

SEQ ID NO: 9242250 - DNA, 22 bp, Homo sapiens
tgacttgtctctttgggagaca

SEQ ID NO: 9242251 - DNA, 22 bp, Homo sapiens
tgacctttctctgggtgcttgg

SEQ ID NO: 9242252 - DNA, 22 bp, Homo sapiens
tgacctctgtcctgcagtctgg

SEQ ID NO: 9242253 - DNA, 22 bp, Homo sapiens
tgacgtcaactgcaaaggcctt

SEQ ID NO: 9242254 - DNA, 22 bp, Homo sapiens
tgactacaacctccacctcccg

SEQ ID NO: 9242255 - DNA, 22 bp, Homo sapiens
tgactacaacctccacctcccg

SEQ ID NO: 9242256 - DNA, 22 bp, Homo sapiens
tgactcagtacatctggagttg

SEQ ID NO: 9242257 - DNA, 18 bp, Homo sapiens
tgactcaccctgtcagtg

SEQ ID NO: 9242258 - DNA, 22 bp, Homo sapiens
tgactctgtacctgtctgcctt

SEQ ID NO: 9242259 - DNA, 20 bp, Homo sapiens
tgactctgcaaccgtctctc

SEQ ID NO: 9242260 - DNA, 22 bp, Homo sapiens
tgacagcagccacctctcaccc

SEQ ID NO: 9242261 - DNA, 22 bp, Homo sapiens
tgacagcagccacctctcaccc

SEQ ID NO: 9242262 - DNA, 22 bp, Homo sapiens
tgacagcataacactggtcttg

SEQ ID NO: 9242263 - DNA, 22 bp, Homo sapiens
tgacagcataacactggtcttg

SEQ ID NO: 9242264 - DNA, 22 bp, Homo sapiens
tgacagggacagtggagatgga

SEQ ID NO: 9242265 - DNA, 22 bp, Homo sapiens
tgacaggattggttgcttctga

SEQ ID NO: 9242266 - DNA, 22 bp, Homo sapiens
tgacaggagtggctagtgggag

SEQ ID NO: 9242267 - DNA, 22 bp, Homo sapiens
tgacaggatgatgagcaggggg

SEQ ID NO: 9242268 - DNA, 19 bp, Homo sapiens
tgacaggttttatgtgttt

SEQ ID NO: 9242269 - DNA, 22 bp, Homo sapiens
tgacagtctgcagttttaaaaa

SEQ ID NO: 9242270 - DNA, 22 bp, Homo sapiens
tgacagtgagcttggggtactt

SEQ ID NO: 9242271 - DNA, 22 bp, Homo sapiens
tgacagggggcagaggtggctg

SEQ ID NO: 9242272 - DNA, 22 bp, Homo sapiens
tgacagggtgattatgagagct

SEQ ID NO: 9242273 - DNA, 22 bp, Homo sapiens
tgacagggtcagagctgagctg

SEQ ID NO: 9242274 - DNA, 22 bp, Homo sapiens
tgacaggtgattgtgaactaag

SEQ ID NO: 9242275 - DNA, 22 bp, Homo sapiens
tgacagggggcagaggtggctg

SEQ ID NO: 9242276 - DNA, 22 bp, Homo sapiens
tgacagggacagtggagatgga

SEQ ID NO: 9242277 - DNA, 22 bp, Homo sapiens
tgacagggcaggcttactggtt

SEQ ID NO: 9242278 - DNA, 22 bp, Homo sapiens
tgacagggctagaggcaatgca

SEQ ID NO: 9242279 - DNA, 22 bp, Homo sapiens
tgacagaacaggttgggagcaa

SEQ ID NO: 9242280 - DNA, 18 bp, Homo sapiens
tgacagaacctggagcct

SEQ ID NO: 9242281 - DNA, 22 bp, Homo sapiens
tgacagacagcttctcatttta

SEQ ID NO: 9242282 - DNA, 22 bp, Homo sapiens
tgacagaatgtgactctcagat

SEQ ID NO: 9242283 - DNA, 23 bp, Homo sapiens
tgacagaccttcccagacagtca

SEQ ID NO: 9242284 - DNA, 22 bp, Homo sapiens
tgacactgcaaatataaatatt

SEQ ID NO: 9242285 - DNA, 22 bp, Homo sapiens
tgacactgacctaaagacctgg

SEQ ID NO: 9242286 - DNA, 22 bp, Homo sapiens
tgacactgacctaaagacctgg

SEQ ID NO: 9242287 - DNA, 22 bp, Homo sapiens
tgacactgccgaaactgtagag

SEQ ID NO: 9242288 - DNA, 22 bp, Homo sapiens
tgacactgccgaaactgtagag

SEQ ID NO: 9242289 - DNA, 22 bp, Homo sapiens
tgacactgcatatattgaagtt

SEQ ID NO: 9242290 - DNA, 22 bp, Homo sapiens
tgacactgcatatattgaagtt

SEQ ID NO: 9242291 - DNA, 22 bp, Homo sapiens
tgacacttgggctttgagaggt

SEQ ID NO: 9242292 - DNA, 22 bp, Homo sapiens
tgacagaaatagttcttaattt

SEQ ID NO: 9242293 - DNA, 22 bp, Homo sapiens
tgacagaaagaatatgtcaatc

SEQ ID NO: 9242294 - DNA, 22 bp, Homo sapiens
tgacacagattagagacatacc

SEQ ID NO: 9242295 - DNA, 22 bp, Homo sapiens
tgacacagaaattaagctgtca

SEQ ID NO: 9242296 - DNA, 22 bp, Homo sapiens
tgacacagaaattaagctgtca

SEQ ID NO: 9242297 - DNA, 22 bp, Homo sapiens
tgacacaggggaaggagtctgg

SEQ ID NO: 9242298 - DNA, 22 bp, Homo sapiens
tgacacagggaaagcggatcca

SEQ ID NO: 9242299 - DNA, 22 bp, Homo sapiens
tgacacaggcagctcccagcac

SEQ ID NO: 9242300 - DNA, 22 bp, Homo sapiens
tgacacagtatcaaacatgatt

SEQ ID NO: 9242301 - DNA, 22 bp, Homo sapiens
tgacacattaaatgctcacaaa

SEQ ID NO: 9242302 - DNA, 23 bp, Homo sapiens
tgacacatttcctttccactgca

SEQ ID NO: 9242303 - DNA, 22 bp, Homo sapiens
tgaagccataggacagaggata

SEQ ID NO: 9242304 - DNA, 22 bp, Homo sapiens
tgaagccagtcaatgttaagtt

SEQ ID NO: 9242305 - DNA, 22 bp, Homo sapiens
tgaagccactttccagaatcac

SEQ ID NO: 9242306 - DNA, 22 bp, Homo sapiens
tgaagccagctttggaagacac

SEQ ID NO: 9242307 - DNA, 22 bp, Homo sapiens
tgaagccaccgaaccagaagag

SEQ ID NO: 9242308 - DNA, 22 bp, Homo sapiens
tgaagccactttccagaatcac

SEQ ID NO: 9242309 - DNA, 22 bp, Homo sapiens
tgaagcataagagggttctttt

SEQ ID NO: 9242310 - DNA, 22 bp, Homo sapiens
tgaagccaaggatgcctttctc

SEQ ID NO: 9242311 - DNA, 22 bp, Homo sapiens
tgaagccaatctgccaggcaga

SEQ ID NO: 9242312 - DNA, 22 bp, Homo sapiens
tgaagcatctggtctgagaatt

SEQ ID NO: 9242313 - DNA, 22 bp, Homo sapiens
tgaagccacactagcttgtcct

SEQ ID NO: 9242314 - DNA, 22 bp, Homo sapiens
tgaagccacagagcatctgcct

SEQ ID NO: 9242315 - DNA, 22 bp, Homo sapiens
tgaagccacagagcatctgcct

SEQ ID NO: 9242316 - DNA, 22 bp, Homo sapiens
tgaagccctgtgtcagcttcca

SEQ ID NO: 9242317 - DNA, 21 bp, Homo sapiens
tgaagcctgaggcatagcccc

SEQ ID NO: 9242318 - DNA, 22 bp, Homo sapiens
tgaagccattactgtgttaggg

SEQ ID NO: 9242319 - DNA, 23 bp, Homo sapiens
tgaagcccagtgattttgtttca

SEQ ID NO: 9242320 - DNA, 22 bp, Homo sapiens
tgaagccatcaggaagccagca

SEQ ID NO: 9242321 - DNA, 22 bp, Homo sapiens
tgaagccatcaggaagccagca

SEQ ID NO: 9242322 - DNA, 22 bp, Homo sapiens
tgaagccatccctcagatggcc

SEQ ID NO: 9242323 - DNA, 22 bp, Homo sapiens
tgaagccatccctcagatggcc

SEQ ID NO: 9242324 - DNA, 22 bp, Homo sapiens
tgaaggcacttgcctaggggca

SEQ ID NO: 9242325 - DNA, 22 bp, Homo sapiens
tgaaggcacttgcctaggggca

SEQ ID NO: 9242326 - DNA, 22 bp, Homo sapiens
tgaaggcacgtgggtggatact

SEQ ID NO: 9242327 - DNA, 22 bp, Homo sapiens
tgaaggcaacctctgtggtcct

SEQ ID NO: 9242328 - DNA, 22 bp, Homo sapiens
tgaaggcaacctctgtggtcct

SEQ ID NO: 9242329 - DNA, 22 bp, Homo sapiens
tgaaggagggaagaaggctctg

SEQ ID NO: 9242330 - DNA, 22 bp, Homo sapiens
tgaaggaggaatgtggcctcca

SEQ ID NO: 9242331 - DNA, 22 bp, Homo sapiens
tgaaggaggaatgtggcctcca

SEQ ID NO: 9242332 - DNA, 22 bp, Homo sapiens
tgaaggagctgatgtaaggggt

SEQ ID NO: 9242333 - DNA, 19 bp, Homo sapiens
tgaaggagggggatggcca

SEQ ID NO: 9242334 - DNA, 19 bp, Homo sapiens
tgaaggagggggatggcca

SEQ ID NO: 9242335 - DNA, 19 bp, Homo sapiens
tgaaggagggggatggcca

SEQ ID NO: 9242336 - DNA, 19 bp, Homo sapiens
tgaaggagggggatggcca

SEQ ID NO: 9242337 - DNA, 19 bp, Homo sapiens
tgaaggagggggatggcca

SEQ ID NO: 9242338 - DNA, 22 bp, Homo sapiens
tgaaggagatttttagggaggc

SEQ ID NO: 9242339 - DNA, 22 bp, Homo sapiens
tgaaggagctgatgtaaggggt

SEQ ID NO: 9242340 - DNA, 22 bp, Homo sapiens
tgaaggagctgatgtaaggggt

SEQ ID NO: 9242341 - DNA, 22 bp, Homo sapiens
tgaaggagctcaggagatagtc

SEQ ID NO: 9242342 - DNA, 22 bp, Homo sapiens
tgaaggagctcaggagatagtc

SEQ ID NO: 9242343 - DNA, 22 bp, Homo sapiens
tgaaggagctcaggagatagtc

SEQ ID NO: 9242344 - DNA, 22 bp, Homo sapiens
tgaaggcatttgagttggtgag

SEQ ID NO: 9242345 - DNA, 17 bp, Homo sapiens
tgaaggccatgaccacg

SEQ ID NO: 9242346 - DNA, 22 bp, Homo sapiens
tgaaggcattgatgaaggaatc

SEQ ID NO: 9242347 - DNA, 22 bp, Homo sapiens
tgaaggcataaatcttgggaac

SEQ ID NO: 9242348 - DNA, 22 bp, Homo sapiens
tgaaggcagcatgcacactagt

SEQ ID NO: 9242349 - DNA, 21 bp, Homo sapiens
tgaaggggtggcagtgtgctt

SEQ ID NO: 9242350 - DNA, 21 bp, Homo sapiens
tgaaggggtggcagtgtgctt

SEQ ID NO: 9242351 - DNA, 22 bp, Homo sapiens
tgaaggggttcagcatgggggt

SEQ ID NO: 9242352 - DNA, 22 bp, Homo sapiens
tgaaggtaaaggaaggaggctt

SEQ ID NO: 9242353 - DNA, 21 bp, Homo sapiens
tgaagggcagcctcaggctcc

SEQ ID NO: 9242354 - DNA, 22 bp, Homo sapiens
tgaagggggagatatatgtgtg

SEQ ID NO: 9242355 - DNA, 22 bp, Homo sapiens
tgaagggcaaccccaggcccag

SEQ ID NO: 9242356 - DNA, 22 bp, Homo sapiens
tgaaggcttgactgaggcagga

SEQ ID NO: 9242357 - DNA, 22 bp, Homo sapiens
tgaaggctgggctcagccagct

SEQ ID NO: 9242358 - DNA, 22 bp, Homo sapiens
tgaaggtggcataggagagatg

SEQ ID NO: 9242359 - DNA, 22 bp, Homo sapiens
tgaaggtgagcatttgctgatt

SEQ ID NO: 9242360 - DNA, 22 bp, Homo sapiens
tgaaggtggaagggtggttctg

SEQ ID NO: 9242361 - DNA, 22 bp, Homo sapiens
tgaaggtgaatgtctatgggga

SEQ ID NO: 9242362 - DNA, 23 bp, Homo sapiens
tgaaggtattacctgagatgctc

SEQ ID NO: 9242363 - DNA, 22 bp, Homo sapiens
tgaaggtgacctgacagtggct

SEQ ID NO: 9242364 - DNA, 22 bp, Homo sapiens
tgaataagaattattataatga

SEQ ID NO: 9242365 - DNA, 22 bp, Homo sapiens
tgaataaatcaaagactgccct

SEQ ID NO: 9242366 - DNA, 22 bp, Homo sapiens
tgaataaattgagagcgaatgt

SEQ ID NO: 9242367 - DNA, 21 bp, Homo sapiens
tgaataaagctgctgtcgata

SEQ ID NO: 9242368 - DNA, 22 bp, Homo sapiens
tgaataaagtatgtcctgggaa

SEQ ID NO: 9242369 - DNA, 22 bp, Homo sapiens
tgaataatcatgtccatagtgt

SEQ ID NO: 9242370 - DNA, 22 bp, Homo sapiens
tgaataatcatgtccatagtgt

SEQ ID NO: 9242371 - DNA, 22 bp, Homo sapiens
tgaataatccacagtcattcat

SEQ ID NO: 9242372 - DNA, 22 bp, Homo sapiens
tgaataatcttgggtattaata

SEQ ID NO: 9242373 - DNA, 22 bp, Homo sapiens
tgaataatcttgggtattaata

SEQ ID NO: 9242374 - DNA, 22 bp, Homo sapiens
tgaagttttactaggtgaattt

SEQ ID NO: 9242375 - DNA, 22 bp, Homo sapiens
tgaataaactatgaggaggaat

SEQ ID NO: 9242376 - DNA, 22 bp, Homo sapiens
tgaataaactatgaggaggaat

SEQ ID NO: 9242377 - DNA, 22 bp, Homo sapiens
tgaataaactatgaggaggaat

SEQ ID NO: 9242378 - DNA, 22 bp, Homo sapiens
tgacaaaccctgcaaatagctc

SEQ ID NO: 9242379 - DNA, 22 bp, Homo sapiens
tgacaaagcatgatggtgacag

SEQ ID NO: 9242380 - DNA, 22 bp, Homo sapiens
tgacaaagtgaggtcttcagta

SEQ ID NO: 9242381 - DNA, 22 bp, Homo sapiens
tgacaaaggtgttgccagaggg

SEQ ID NO: 9242382 - DNA, 22 bp, Homo sapiens
tgacaaatacaataagatctgt

SEQ ID NO: 9242383 - DNA, 20 bp, Homo sapiens
tgacacaaattgctttctca

SEQ ID NO: 9242384 - DNA, 22 bp, Homo sapiens
tgacacaaaggaaagcataatc

SEQ ID NO: 9242385 - DNA, 22 bp, Homo sapiens
tgaattcttaatgaaatctact

SEQ ID NO: 9242386 - DNA, 22 bp, Homo sapiens
tgaattctggctcttctgttta

SEQ ID NO: 9242387 - DNA, 20 bp, Homo sapiens
tgaattctgggtttatctgc

SEQ ID NO: 9242388 - DNA, 22 bp, Homo sapiens
tgaattctggccctctcactta

SEQ ID NO: 9242389 - DNA, 22 bp, Homo sapiens
tgaatttaaaataaatgtagtt

SEQ ID NO: 9242390 - DNA, 22 bp, Homo sapiens
tgaatttatcaaagattcttaa

SEQ ID NO: 9242391 - DNA, 23 bp, Homo sapiens
tgaatttggaactcagagaatta

SEQ ID NO: 9242392 - DNA, 21 bp, Homo sapiens
tgaatttcggtatggctataa

SEQ ID NO: 9242393 - DNA, 23 bp, Homo sapiens
tgaattttggcatattctgaaat

SEQ ID NO: 9242394 - DNA, 22 bp, Homo sapiens
tgaataattatgggagtcctaa

SEQ ID NO: 9242395 - DNA, 22 bp, Homo sapiens
tgaataattcctttttgtcaag

SEQ ID NO: 9242396 - DNA, 22 bp, Homo sapiens
tgaataattcctttttgtcaag

SEQ ID NO: 9242397 - DNA, 22 bp, Homo sapiens
tgaatactatttcataatgtgg

SEQ ID NO: 9242398 - DNA, 22 bp, Homo sapiens
tgaatcctagttgaagataagg

SEQ ID NO: 9242399 - DNA, 22 bp, Homo sapiens
tgaatcctaattctatcactta

SEQ ID NO: 9242400 - DNA, 22 bp, Homo sapiens
tgaatcatggataaatagctta

SEQ ID NO: 9242401 - DNA, 22 bp, Homo sapiens
tgaatccagagctatttcgtcc

SEQ ID NO: 9242402 - DNA, 22 bp, Homo sapiens
tgaatatgctttgcaatcctaa

SEQ ID NO: 9242403 - DNA, 22 bp, Homo sapiens
tgaatgcttggagtcataaaat

SEQ ID NO: 9242404 - DNA, 22 bp, Homo sapiens
tgaatgcttggagtcataaaat

SEQ ID NO: 9242405 - DNA, 22 bp, Homo sapiens
tgaatgagtgagttcagacctc

SEQ ID NO: 9242406 - DNA, 22 bp, Homo sapiens
tgaatgaggatccttgacctta

SEQ ID NO: 9242407 - DNA, 21 bp, Homo sapiens
tgaatgagcatctggactttt

SEQ ID NO: 9242408 - DNA, 22 bp, Homo sapiens
tgaatctatgttgccccataat

SEQ ID NO: 9242409 - DNA, 22 bp, Homo sapiens
tgaatgtgatgctaaacatatg

SEQ ID NO: 9242410 - DNA, 22 bp, Homo sapiens
tgaatgtgatgctaaacatatg

SEQ ID NO: 9242411 - DNA, 22 bp, Homo sapiens
tgaatgttctctaaatactcct

SEQ ID NO: 9242412 - DNA, 22 bp, Homo sapiens
tgaatgttgatatgagtacaga

SEQ ID NO: 9242413 - DNA, 22 bp, Homo sapiens
tgaatgtgatgctaaacatatg

SEQ ID NO: 9242414 - DNA, 22 bp, Homo sapiens
tgaatgtttgatgagaaataga

SEQ ID NO: 9242415 - DNA, 22 bp, Homo sapiens
tgaaagacaaggttttttcaga

SEQ ID NO: 9242416 - DNA, 21 bp, Homo sapiens
tgaaagaggatgtggtcattc

SEQ ID NO: 9242417 - DNA, 22 bp, Homo sapiens
tgaaagaactagcatcttcaag

SEQ ID NO: 9242418 - DNA, 22 bp, Homo sapiens
tgaaagaactagcatcttcaag

SEQ ID NO: 9242419 - DNA, 22 bp, Homo sapiens
tgaaagaagggtggaaaatgta

SEQ ID NO: 9242420 - DNA, 22 bp, Homo sapiens
tgaaagaagggtggaaaatgta

SEQ ID NO: 9242421 - DNA, 22 bp, Homo sapiens
tgaaacttataagaatatgaat

SEQ ID NO: 9242422 - DNA, 22 bp, Homo sapiens
tgaaactgaaaggtatttatag

SEQ ID NO: 9242423 - DNA, 22 bp, Homo sapiens
tgaaaccccagattaccacaaa

SEQ ID NO: 9242424 - DNA, 22 bp, Homo sapiens
tgaaacggaatgttctttatcg

SEQ ID NO: 9242425 - DNA, 22 bp, Homo sapiens
tgaaaccattctcaggtacact

SEQ ID NO: 9242426 - DNA, 22 bp, Homo sapiens
tgaaaccccagattaccacaaa

SEQ ID NO: 9242427 - DNA, 22 bp, Homo sapiens
tgaaagaaacaggtatattggg

SEQ ID NO: 9242428 - DNA, 22 bp, Homo sapiens
tgaaagaaacaggtatattggg

SEQ ID NO: 9242429 - DNA, 22 bp, Homo sapiens
tgaaacttattcagtttctacc

SEQ ID NO: 9242430 - DNA, 22 bp, Homo sapiens
tgaaacttttgaggttcttcca

SEQ ID NO: 9242431 - DNA, 22 bp, Homo sapiens
tgaaacagtctccagacttgga

SEQ ID NO: 9242432 - DNA, 22 bp, Homo sapiens
tgaaacagtctccagacttgga

SEQ ID NO: 9242433 - DNA, 22 bp, Homo sapiens
tgaaacattgcactgtatgaat

SEQ ID NO: 9242434 - DNA, 23 bp, Homo sapiens
tgaaacatttagggtagaatttc

SEQ ID NO: 9242435 - DNA, 22 bp, Homo sapiens
tgaaacatttgatgatctttgg

SEQ ID NO: 9242436 - DNA, 22 bp, Homo sapiens
tgaaacattaggaaatcattat

SEQ ID NO: 9242437 - DNA, 22 bp, Homo sapiens
tgaaacattatagaatatttat

SEQ ID NO: 9242438 - DNA, 22 bp, Homo sapiens
tgaaacattatagaatatttat

SEQ ID NO: 9242439 - DNA, 22 bp, Homo sapiens
tgaaacattaggaaatcattat

SEQ ID NO: 9242440 - DNA, 22 bp, Homo sapiens
tgaaacataaagttatcttcag

SEQ ID NO: 9242441 - DNA, 22 bp, Homo sapiens
tgaaaatggcctgaagaagcaa

SEQ ID NO: 9242442 - DNA, 22 bp, Homo sapiens
tgaaaattaagcagatgaatga

SEQ ID NO: 9242443 - DNA, 22 bp, Homo sapiens
tgaaaattcatctcatagcaga

SEQ ID NO: 9242444 - DNA, 22 bp, Homo sapiens
tgaaaattctcaggctcacccc

SEQ ID NO: 9242445 - DNA, 22 bp, Homo sapiens
tgaaaatgccctctatgtctca

SEQ ID NO: 9242446 - DNA, 22 bp, Homo sapiens
tgaaaattaagcagatgaatga

SEQ ID NO: 9242447 - DNA, 22 bp, Homo sapiens
tgaaaattgttgtacttgataa

SEQ ID NO: 9242448 - DNA, 22 bp, Homo sapiens
tgaaaatatagttttccagact

SEQ ID NO: 9242449 - DNA, 22 bp, Homo sapiens
tgaaaatatagttttccagact

SEQ ID NO: 9242450 - DNA, 22 bp, Homo sapiens
tgaaaagactgcaagagagcat

SEQ ID NO: 9242451 - DNA, 22 bp, Homo sapiens
tgaaaagggtagatccctaagt

SEQ ID NO: 9242452 - DNA, 22 bp, Homo sapiens
tgaaaaaacaagttggcccatt

SEQ ID NO: 9242453 - DNA, 22 bp, Homo sapiens
tgaaaaaacaagttggcccatt

SEQ ID NO: 9242454 - DNA, 22 bp, Homo sapiens
tgaaaaacactaattggaaagc

SEQ ID NO: 9242455 - DNA, 22 bp, Homo sapiens
tgaaaactccaagtttcatcag

SEQ ID NO: 9242456 - DNA, 22 bp, Homo sapiens
tgaaaaactttaatccataaag

SEQ ID NO: 9242457 - DNA, 22 bp, Homo sapiens
tctttttatattgacaaaaggt

SEQ ID NO: 9242458 - DNA, 22 bp, Homo sapiens
tctttttatattgacaaaaggt

SEQ ID NO: 9242459 - DNA, 22 bp, Homo sapiens
tctttttcttattcccacactg

SEQ ID NO: 9242460 - DNA, 22 bp, Homo sapiens
tctttggaatgctagcattcta

SEQ ID NO: 9242461 - DNA, 22 bp, Homo sapiens
tctttgcacacagcgattcttc

SEQ ID NO: 9242462 - DNA, 22 bp, Homo sapiens
tctttgcagtggtgaataaaga

SEQ ID NO: 9242463 - DNA, 22 bp, Homo sapiens
tctttgcagttctgattaaata

SEQ ID NO: 9242464 - DNA, 22 bp, Homo sapiens
tctttgctccacactctagaga

SEQ ID NO: 9242465 - DNA, 22 bp, Homo sapiens
tctttgctccacactctagaga

SEQ ID NO: 9242466 - DNA, 22 bp, Homo sapiens
tctttgcatgtgcttcttggcc

SEQ ID NO: 9242467 - DNA, 22 bp, Homo sapiens
tctttgctattgtgaatagtgc

SEQ ID NO: 9242468 - DNA, 22 bp, Homo sapiens
tctttgcatgcattttccctta

SEQ ID NO: 9242469 - DNA, 22 bp, Homo sapiens
tctttggaatgctagcattcta

SEQ ID NO: 9242470 - DNA, 22 bp, Homo sapiens
tcttttatagtgaattttcttg

SEQ ID NO: 9242471 - DNA, 22 bp, Homo sapiens
tcttttatagtgaattttcttg

SEQ ID NO: 9242472 - DNA, 22 bp, Homo sapiens
tcttttatagtgaattttcttg

SEQ ID NO: 9242473 - DNA, 22 bp, Homo sapiens
tcttttaacctaactagcttgg

SEQ ID NO: 9242474 - DNA, 21 bp, Homo sapiens
tcttttaacaccaggaattcc

SEQ ID NO: 9242475 - DNA, 20 bp, Homo sapiens
tctttgttaattttatctcc

SEQ ID NO: 9242476 - DNA, 22 bp, Homo sapiens
tctttgttattgctttatctat

SEQ ID NO: 9242477 - DNA, 22 bp, Homo sapiens
tctttgtttgcctttatcaaga

SEQ ID NO: 9242478 - DNA, 18 bp, Homo sapiens
tcttttccttccacttcc

SEQ ID NO: 9242479 - DNA, 18 bp, Homo sapiens
tcttttccttccacttcc

SEQ ID NO: 9242480 - DNA, 21 bp, Homo sapiens
tcttttctctgcaggattcct

SEQ ID NO: 9242481 - DNA, 21 bp, Homo sapiens
tcttttctctgcaggattcct

SEQ ID NO: 9242482 - DNA, 22 bp, Homo sapiens
tcttttcattgagaacacactg

SEQ ID NO: 9242483 - DNA, 19 bp, Homo sapiens
tcttttcacgcattttgaa

SEQ ID NO: 9242484 - DNA, 19 bp, Homo sapiens
tcttttcacgcattttgaa

SEQ ID NO: 9242485 - DNA, 23 bp, Homo sapiens
tcttttcaatggttctttatgtg

SEQ ID NO: 9242486 - DNA, 22 bp, Homo sapiens
tcttttcacagacaaatggaga

SEQ ID NO: 9242487 - DNA, 22 bp, Homo sapiens
tcttttatcctacatttagctc

SEQ ID NO: 9242488 - DNA, 22 bp, Homo sapiens
tcttttatctgttgtgtaacaa

SEQ ID NO: 9242489 - DNA, 22 bp, Homo sapiens
tcttttattaggctgaaatggg

SEQ ID NO: 9242490 - DNA, 22 bp, Homo sapiens
tcttttattaggctgaaatggg

SEQ ID NO: 9242491 - DNA, 22 bp, Homo sapiens
tgaaatgttctggagtttctgt

SEQ ID NO: 9242492 - DNA, 22 bp, Homo sapiens
tgaaatgtgttctagtgttttg

SEQ ID NO: 9242493 - DNA, 22 bp, Homo sapiens
tgaaatgtgttctagtgttttg

SEQ ID NO: 9242494 - DNA, 22 bp, Homo sapiens
tgaaatgtttgggtccagaagt

SEQ ID NO: 9242495 - DNA, 22 bp, Homo sapiens
tgaaatgttggtaattttatat

SEQ ID NO: 9242496 - DNA, 22 bp, Homo sapiens
tgaaatgtctttgcaattgaaa

SEQ ID NO: 9242497 - DNA, 22 bp, Homo sapiens
tgaaatgtgtccatgttatttc

SEQ ID NO: 9242498 - DNA, 22 bp, Homo sapiens
tgaaatgtcagtgttttataag

SEQ ID NO: 9242499 - DNA, 22 bp, Homo sapiens
tgaaatgtagattaggcattct

SEQ ID NO: 9242500 - DNA, 22 bp, Homo sapiens
tgaaatgtacaagtgctttttt

SEQ ID NO: 9242501 - DNA, 22 bp, Homo sapiens
tgaaatgcttgggaccagaagt

SEQ ID NO: 9242502 - DNA, 22 bp, Homo sapiens
tgaaatgcttttacaggatatt

SEQ ID NO: 9242503 - DNA, 22 bp, Homo sapiens
tgaaatgcttaggaccagaagg

SEQ ID NO: 9242504 - DNA, 22 bp, Homo sapiens
tgaaatgctgtagagactgtat

SEQ ID NO: 9242505 - DNA, 22 bp, Homo sapiens
tgaaatgctgtagagactgtat

SEQ ID NO: 9242506 - DNA, 22 bp, Homo sapiens
tgaaatgcaacagttatttttg

SEQ ID NO: 9242507 - DNA, 22 bp, Homo sapiens
tgaaatcatgagatagtgtcac

SEQ ID NO: 9242508 - DNA, 22 bp, Homo sapiens
tgaaatctcctctttatatatc

SEQ ID NO: 9242509 - DNA, 22 bp, Homo sapiens
tgaaatctaccctattcagggt

SEQ ID NO: 9242510 - DNA, 23 bp, Homo sapiens
tgaaatattcttttgcatgagct

SEQ ID NO: 9242511 - DNA, 22 bp, Homo sapiens
tgaaatatttagagagtaagtt

SEQ ID NO: 9242512 - DNA, 17 bp, Homo sapiens
tgaaatcagcacccagg

SEQ ID NO: 9242513 - DNA, 22 bp, Homo sapiens
tgaaatatcattttcatctccc

SEQ ID NO: 9242514 - DNA, 22 bp, Homo sapiens
tgaaataggaaacagatgtttc

SEQ ID NO: 9242515 - DNA, 22 bp, Homo sapiens
tgaaatacacaaatttagtaag

SEQ ID NO: 9242516 - DNA, 22 bp, Homo sapiens
tgaaagtatttgatttctatta

SEQ ID NO: 9242517 - DNA, 22 bp, Homo sapiens
tgaaaggttaaaagtagtattg

SEQ ID NO: 9242518 - DNA, 22 bp, Homo sapiens
tgaaaggttatttaggtctgct

SEQ ID NO: 9242519 - DNA, 22 bp, Homo sapiens
tgaaaggtgtccaatatttctc

SEQ ID NO: 9242520 - DNA, 20 bp, Homo sapiens
tgaaaggtgggaattgtggg

SEQ ID NO: 9242521 - DNA, 22 bp, Homo sapiens
tgaaaggtgacatttcttggat

SEQ ID NO: 9242522 - DNA, 22 bp, Homo sapiens
tgaaataacttttgggtgagtt

SEQ ID NO: 9242523 - DNA, 22 bp, Homo sapiens
tgaaagcactcacttctgctct

SEQ ID NO: 9242524 - DNA, 22 bp, Homo sapiens
tgaaagcactcacttctgctct

SEQ ID NO: 9242525 - DNA, 22 bp, Homo sapiens
tgaaagcacaagttctaacagg

SEQ ID NO: 9242526 - DNA, 22 bp, Homo sapiens
tgaaagcacaagttctaacagg

SEQ ID NO: 9242527 - DNA, 22 bp, Homo sapiens
tgaaaggtagctggcctcatag

SEQ ID NO: 9242528 - DNA, 23 bp, Homo sapiens
tgaaagcaatgggtctatagtat

SEQ ID NO: 9242529 - DNA, 22 bp, Homo sapiens
tgaaagatgctcaatgaatggt

SEQ ID NO: 9242530 - DNA, 22 bp, Homo sapiens
tgaaagcaacctgtaacagtga

SEQ ID NO: 9242531 - DNA, 22 bp, Homo sapiens
tgaaagcaacctgtaacagtga

SEQ ID NO: 9242532 - DNA, 22 bp, Homo sapiens
tgaaagagtttgacatgattct

SEQ ID NO: 9242533 - DNA, 22 bp, Homo sapiens
tgaaagataagttattatgtac

SEQ ID NO: 9242534 - DNA, 22 bp, Homo sapiens
tgaacgcaggtccacatggctc

SEQ ID NO: 9242535 - DNA, 22 bp, Homo sapiens
tgaactcctgacctcatgatcc

SEQ ID NO: 9242536 - DNA, 22 bp, Homo sapiens
tgaactcctgacctcatgatcc

SEQ ID NO: 9242537 - DNA, 22 bp, Homo sapiens
tgaactcctgacctcatgatcc

SEQ ID NO: 9242538 - DNA, 22 bp, Homo sapiens
tgaactcctgacctcatgatcc

SEQ ID NO: 9242539 - DNA, 22 bp, Homo sapiens
tgaacttcagtgatttgctgca

SEQ ID NO: 9242540 - DNA, 22 bp, Homo sapiens
tgaacatattcacctctaaata

SEQ ID NO: 9242541 - DNA, 22 bp, Homo sapiens
tgaacatgctgttgatggcctg

SEQ ID NO: 9242542 - DNA, 22 bp, Homo sapiens
tgaacattagttgagtaaagtc

SEQ ID NO: 9242543 - DNA, 22 bp, Homo sapiens
tgaacattggcacaaggcagca

SEQ ID NO: 9242544 - DNA, 22 bp, Homo sapiens
tgaacattcctgaatgaagcat

SEQ ID NO: 9242545 - DNA, 22 bp, Homo sapiens
tgaacattgtcacattcctagc

SEQ ID NO: 9242546 - DNA, 22 bp, Homo sapiens
tgaaccagagtctccagtggtt

SEQ ID NO: 9242547 - DNA, 22 bp, Homo sapiens
tgaaccaggaggcagccagcac

SEQ ID NO: 9242548 - DNA, 22 bp, Homo sapiens
tgaacacacacatcttaataat

SEQ ID NO: 9242549 - DNA, 22 bp, Homo sapiens
tgaacacacacatcttaataat

SEQ ID NO: 9242550 - DNA, 22 bp, Homo sapiens
tgaacaactgcaaaaatctcca

SEQ ID NO: 9242551 - DNA, 22 bp, Homo sapiens
tgaaattcaaaacacatttgtc

SEQ ID NO: 9242552 - DNA, 22 bp, Homo sapiens
tgaaattatgcattgttgtacc

SEQ ID NO: 9242553 - DNA, 22 bp, Homo sapiens
tgaaattagtgaagttacagtt

SEQ ID NO: 9242554 - DNA, 22 bp, Homo sapiens
tgaacaaactgcattcttcact

SEQ ID NO: 9242555 - DNA, 22 bp, Homo sapiens
tgaaattcattgttttatgtgt

SEQ ID NO: 9242556 - DNA, 22 bp, Homo sapiens
tgaaattcattgttttatgtgt

SEQ ID NO: 9242557 - DNA, 22 bp, Homo sapiens
tgaaattcaaaacacatttgtc

SEQ ID NO: 9242558 - DNA, 22 bp, Homo sapiens
tgaagacacatacaagggaatg

SEQ ID NO: 9242559 - DNA, 22 bp, Homo sapiens
tgaagacacatacaagggaatg

SEQ ID NO: 9242560 - DNA, 22 bp, Homo sapiens
tgaagacaagtgtgctggtgtt

SEQ ID NO: 9242561 - DNA, 22 bp, Homo sapiens
tgaagacacatacaagggaatg

SEQ ID NO: 9242562 - DNA, 22 bp, Homo sapiens
tgaagacagaccaaggagaatg

SEQ ID NO: 9242563 - DNA, 22 bp, Homo sapiens
tgaagacagaccaaggagaatg

SEQ ID NO: 9242564 - DNA, 22 bp, Homo sapiens
tgaagacacatacaagggaatg

SEQ ID NO: 9242565 - DNA, 22 bp, Homo sapiens
tgaagaatcccagggaatttgg

SEQ ID NO: 9242566 - DNA, 22 bp, Homo sapiens
tgaagaatgttgcagtgagcat

SEQ ID NO: 9242567 - DNA, 22 bp, Homo sapiens
tgaagacaaagtcaggcccaga

SEQ ID NO: 9242568 - DNA, 22 bp, Homo sapiens
tgaagacaaagtcaggcccaga

SEQ ID NO: 9242569 - DNA, 22 bp, Homo sapiens
tgaagactcagaagctaagata

SEQ ID NO: 9242570 - DNA, 22 bp, Homo sapiens
tgaagacagaccaaggagaatg

SEQ ID NO: 9242571 - DNA, 22 bp, Homo sapiens
tgaagacagaccaaggagaatg

SEQ ID NO: 9242572 - DNA, 22 bp, Homo sapiens
tgaagacagggtctttaacgag

SEQ ID NO: 9242573 - DNA, 22 bp, Homo sapiens
tgaagacagttttactcatgag

SEQ ID NO: 9242574 - DNA, 22 bp, Homo sapiens
tgaagaagccaattggtaggct

SEQ ID NO: 9242575 - DNA, 22 bp, Homo sapiens
tgaagaaaggtgtgggatactc

SEQ ID NO: 9242576 - DNA, 22 bp, Homo sapiens
tgaagaaaggtgtgggatactc

SEQ ID NO: 9242577 - DNA, 22 bp, Homo sapiens
tgaagaaacgcagagaggtagg

SEQ ID NO: 9242578 - DNA, 22 bp, Homo sapiens
tgaagaaacagaccaagaggat

SEQ ID NO: 9242579 - DNA, 19 bp, Homo sapiens
tgaagcaggcagagaagat

SEQ ID NO: 9242580 - DNA, 22 bp, Homo sapiens
tgaagcaggcattgactgatga

SEQ ID NO: 9242581 - DNA, 22 bp, Homo sapiens
tgaagcaggatcgtttgcttca

SEQ ID NO: 9242582 - DNA, 22 bp, Homo sapiens
tgaagcaggtgaatggatgtcg

SEQ ID NO: 9242583 - DNA, 22 bp, Homo sapiens
tgaagcagttactgggtgttaa

SEQ ID NO: 9242584 - DNA, 20 bp, Homo sapiens
tgaagcagccttgattctgt

SEQ ID NO: 9242585 - DNA, 22 bp, Homo sapiens
tgaagcagcaaatgatgggaga

SEQ ID NO: 9242586 - DNA, 22 bp, Homo sapiens
tgaagcagcaaatgatgggaga

SEQ ID NO: 9242587 - DNA, 22 bp, Homo sapiens
tgaagcagatggtctggtcatt

SEQ ID NO: 9242588 - DNA, 22 bp, Homo sapiens
tgaagcaggaaacttcttgttt

SEQ ID NO: 9242589 - DNA, 22 bp, Homo sapiens
tgaagcaggaaacttcttgttt

SEQ ID NO: 9242590 - DNA, 22 bp, Homo sapiens
tgaagcagcttctttctgtcaa

SEQ ID NO: 9242591 - DNA, 20 bp, Homo sapiens
tgaagcagccttgattctgt

SEQ ID NO: 9242592 - DNA, 20 bp, Homo sapiens
tgaagcagccttgattctgt

SEQ ID NO: 9242593 - DNA, 22 bp, Homo sapiens
tgaagattttcgggtacttgat

SEQ ID NO: 9242594 - DNA, 20 bp, Homo sapiens
tgaagattttgtgtttagaa

SEQ ID NO: 9242595 - DNA, 22 bp, Homo sapiens
tgaagattttgtagctttcagc

SEQ ID NO: 9242596 - DNA, 22 bp, Homo sapiens
tgaagcaaattgtttagcctga

SEQ ID NO: 9242597 - DNA, 22 bp, Homo sapiens
tgaagcaaacgcttctgttcct

SEQ ID NO: 9242598 - DNA, 22 bp, Homo sapiens
tgaagcaatgatcttttggtgg

SEQ ID NO: 9242599 - DNA, 22 bp, Homo sapiens
tgaagcagagtgaaggtgaatt

SEQ ID NO: 9242600 - DNA, 22 bp, Homo sapiens
tgaggcaggactgagcgggatg

SEQ ID NO: 9242601 - DNA, 22 bp, Homo sapiens
tgaggcaggagaatcacatgaa

SEQ ID NO: 9242602 - DNA, 20 bp, Homo sapiens
tgaggcaggagaatggcatg

SEQ ID NO: 9242603 - DNA, 22 bp, Homo sapiens
tgaggcaggagaatcacatgaa

SEQ ID NO: 9242604 - DNA, 22 bp, Homo sapiens
tgaggcaggagaatcacatgaa

SEQ ID NO: 9242605 - DNA, 22 bp, Homo sapiens
tgaggcactgggagagcacact

SEQ ID NO: 9242606 - DNA, 22 bp, Homo sapiens
tgaggcagaaaatagcagttca

SEQ ID NO: 9242607 - DNA, 22 bp, Homo sapiens
tgaggcagcctgcattaaagag

SEQ ID NO: 9242608 - DNA, 22 bp, Homo sapiens
tgaggcagctttttctgtgtgt

SEQ ID NO: 9242609 - DNA, 22 bp, Homo sapiens
tgaggcagctttttctgtgtgt

SEQ ID NO: 9242610 - DNA, 22 bp, Homo sapiens
tgaggcagctttttctgtgtgt

SEQ ID NO: 9242611 - DNA, 22 bp, Homo sapiens
tgaggcagctttttctgtgtgt

SEQ ID NO: 9242612 - DNA, 22 bp, Homo sapiens
tgaggcaggaatggggaaaagt

SEQ ID NO: 9242613 - DNA, 22 bp, Homo sapiens
tgaggcaggacatggacaactg

SEQ ID NO: 9242614 - DNA, 22 bp, Homo sapiens
tgaggcaggaatggggaaaagt

SEQ ID NO: 9242615 - DNA, 22 bp, Homo sapiens
tgaggcaggacatggacaactg

SEQ ID NO: 9242616 - DNA, 22 bp, Homo sapiens
tgaggcaggacatggacaactg

SEQ ID NO: 9242617 - DNA, 22 bp, Homo sapiens
tgaggcaggactgagcgggatg

SEQ ID NO: 9242618 - DNA, 22 bp, Homo sapiens
tgaggatggtgttggagagggc

SEQ ID NO: 9242619 - DNA, 22 bp, Homo sapiens
tgaggattggcaaaactcaggg

SEQ ID NO: 9242620 - DNA, 22 bp, Homo sapiens
tgaggcactccaggatgctgtt

SEQ ID NO: 9242621 - DNA, 22 bp, Homo sapiens
tgaggcacatccaggccagctc

SEQ ID NO: 9242622 - DNA, 19 bp, Homo sapiens
tgaggcactagtctggtcc

SEQ ID NO: 9242623 - DNA, 22 bp, Homo sapiens
tgaggatggcagtgtgctcagc

SEQ ID NO: 9242624 - DNA, 22 bp, Homo sapiens
tgaggatggaatgctgtgcaag

SEQ ID NO: 9242625 - DNA, 22 bp, Homo sapiens
tgaggagtttttctagagctaa

SEQ ID NO: 9242626 - DNA, 22 bp, Homo sapiens
tgaggatgacgatggcaatggc

SEQ ID NO: 9242627 - DNA, 22 bp, Homo sapiens
tgaggatgagatgagataacac

SEQ ID NO: 9242628 - DNA, 21 bp, Homo sapiens
tgaggataagtaaagctgaag

SEQ ID NO: 9242629 - DNA, 22 bp, Homo sapiens
tgaggatgacgatggcaatggc

SEQ ID NO: 9242630 - DNA, 22 bp, Homo sapiens
tgaggaggtcagagtctggctg

SEQ ID NO: 9242631 - DNA, 22 bp, Homo sapiens
tgaggaggtgggcacacagagt

SEQ ID NO: 9242632 - DNA, 22 bp, Homo sapiens
tgaggagccactctagcagtca

SEQ ID NO: 9242633 - DNA, 23 bp, Homo sapiens
tgaggagcatagctgactgacag

SEQ ID NO: 9242634 - DNA, 22 bp, Homo sapiens
tgaggagaaatgctcagagcca

SEQ ID NO: 9242635 - DNA, 22 bp, Homo sapiens
tgaggaagttgatctcatcagt

SEQ ID NO: 9242636 - DNA, 22 bp, Homo sapiens
tgaggaagtggttgtatggttt

SEQ ID NO: 9242637 - DNA, 18 bp, Homo sapiens
tgaggaaggggaagtatt

SEQ ID NO: 9242638 - DNA, 22 bp, Homo sapiens
tgaggaagggtgtgacggcacc

SEQ ID NO: 9242639 - DNA, 22 bp, Homo sapiens
tgaggaagggtgtgacggcacc

SEQ ID NO: 9242640 - DNA, 22 bp, Homo sapiens
tgaggaagaacaagaatttaga

SEQ ID NO: 9242641 - DNA, 22 bp, Homo sapiens
tgaggaagcaaaggcttgtgtg

SEQ ID NO: 9242642 - DNA, 22 bp, Homo sapiens
tgaggaagccaaacagctacac

SEQ ID NO: 9242643 - DNA, 22 bp, Homo sapiens
tgaggcctctgtgccatccagg

SEQ ID NO: 9242644 - DNA, 22 bp, Homo sapiens
tgaggcctgaagcctgaagtga

SEQ ID NO: 9242645 - DNA, 21 bp, Homo sapiens
tgaggcctctcctgggctggc

SEQ ID NO: 9242646 - DNA, 22 bp, Homo sapiens
tgaggcctctgaggcctaggct

SEQ ID NO: 9242647 - DNA, 22 bp, Homo sapiens
tgaggcctgaagcctggagcct

SEQ ID NO: 9242648 - DNA, 17 bp, Homo sapiens
tgaggcctgcatcagtg

SEQ ID NO: 9242649 - DNA, 22 bp, Homo sapiens
tgaggcctgcattgaactagaa

SEQ ID NO: 9242650 - DNA, 21 bp, Homo sapiens
tgaggcctgccagtctcagaa

SEQ ID NO: 9242651 - DNA, 17 bp, Homo sapiens
tgaggcctgcatcagtg

SEQ ID NO: 9242652 - DNA, 17 bp, Homo sapiens
tgaggcctgcatcagtg

SEQ ID NO: 9242653 - DNA, 22 bp, Homo sapiens
tgaggccaggacccccagcagg

SEQ ID NO: 9242654 - DNA, 22 bp, Homo sapiens
tgaggccaggatcccaggctct

SEQ ID NO: 9242655 - DNA, 22 bp, Homo sapiens
tgaggccccgaagctgaggttt

SEQ ID NO: 9242656 - DNA, 22 bp, Homo sapiens
tgaggccaggatcccaggctct

SEQ ID NO: 9242657 - DNA, 22 bp, Homo sapiens
tgaggccccgaagctgaggttt

SEQ ID NO: 9242658 - DNA, 18 bp, Homo sapiens
tgaggcccgcagaggtgg

SEQ ID NO: 9242659 - DNA, 22 bp, Homo sapiens
tgaggcccgggtggaggaatgc

SEQ ID NO: 9242660 - DNA, 22 bp, Homo sapiens
tgaggccctagggcatgggaga

SEQ ID NO: 9242661 - DNA, 22 bp, Homo sapiens
tgaggccctagggcatgggaga

SEQ ID NO: 9242662 - DNA, 22 bp, Homo sapiens
tgaggccctagggcatgggaga

SEQ ID NO: 9242663 - DNA, 22 bp, Homo sapiens
tgaggccctctgggctggtcct

SEQ ID NO: 9242664 - DNA, 22 bp, Homo sapiens
tgaggcctcatttagggagagg

SEQ ID NO: 9242665 - DNA, 22 bp, Homo sapiens
tgaggccaatgaccctgggcag

SEQ ID NO: 9242666 - DNA, 22 bp, Homo sapiens
tgaggccaatgaccctgggcag

SEQ ID NO: 9242667 - DNA, 22 bp, Homo sapiens
tgaggccacaggaaagggcccg

SEQ ID NO: 9242668 - DNA, 22 bp, Homo sapiens
tgaggccaatgaccctgggcag

SEQ ID NO: 9242669 - DNA, 21 bp, Homo sapiens
tgaggccaatagcccctggac

SEQ ID NO: 9242670 - DNA, 21 bp, Homo sapiens
tgaggccaatagcccctggac

SEQ ID NO: 9242671 - DNA, 22 bp, Homo sapiens
tgaggccacttccccacagccc

SEQ ID NO: 9242672 - DNA, 22 bp, Homo sapiens
tgaggccacttccccacagccc

SEQ ID NO: 9242673 - DNA, 22 bp, Homo sapiens
tgaggccagagagtttgcattt

SEQ ID NO: 9242674 - DNA, 22 bp, Homo sapiens
tgaggccagactgaaaccaaca

SEQ ID NO: 9242675 - DNA, 22 bp, Homo sapiens
tgaggccagactgaaaccaaca

SEQ ID NO: 9242676 - DNA, 22 bp, Homo sapiens
tgaggccacagtatcagaacag

SEQ ID NO: 9242677 - DNA, 22 bp, Homo sapiens
tgaggccagagtttttaattcc

SEQ ID NO: 9242678 - DNA, 22 bp, Homo sapiens
tgaggccagccacagccaccct

SEQ ID NO: 9242679 - DNA, 16 bp, Homo sapiens
tgaggccagccatttc

SEQ ID NO: 9242680 - DNA, 18 bp, Homo sapiens
tgaggccagagtgggcat

SEQ ID NO: 9242681 - DNA, 22 bp, Homo sapiens
tgaggccagcttcagcagtgga

SEQ ID NO: 9242682 - DNA, 19 bp, Homo sapiens
tgaggccagctggcatttt

SEQ ID NO: 9242683 - DNA, 22 bp, Homo sapiens
tgaggccagcttcagcagtgga

SEQ ID NO: 9242684 - DNA, 22 bp, Homo sapiens
tgaggcaggaggttgagaactg

SEQ ID NO: 9242685 - DNA, 22 bp, Homo sapiens
tgaggcaggaggattgcaggat

SEQ ID NO: 9242686 - DNA, 22 bp, Homo sapiens
tgaggcaggaggattgcaggat

SEQ ID NO: 9242687 - DNA, 22 bp, Homo sapiens
tgaggcaggaggattgcaggat

SEQ ID NO: 9242688 - DNA, 22 bp, Homo sapiens
tgaggcaggaggattgcaggat

SEQ ID NO: 9242689 - DNA, 22 bp, Homo sapiens
tgaggcaggagaatggcgggaa

SEQ ID NO: 9242690 - DNA, 22 bp, Homo sapiens
tgaggcaggagaatggcgggaa

SEQ ID NO: 9242691 - DNA, 20 bp, Homo sapiens
tgaggcaggagaatggcatg

SEQ ID NO: 9242692 - DNA, 20 bp, Homo sapiens
tgaggcaggagaatggcatg

SEQ ID NO: 9242693 - DNA, 22 bp, Homo sapiens
tgaggcaggagttcaggctgcg

SEQ ID NO: 9242694 - DNA, 22 bp, Homo sapiens
tgaggcaggagttcaggctgcg

SEQ ID NO: 9242695 - DNA, 22 bp, Homo sapiens
tgaggcaggagttcaggctgcg

SEQ ID NO: 9242696 - DNA, 22 bp, Homo sapiens
tgaggcaggagttaatgtgctc

SEQ ID NO: 9242697 - DNA, 22 bp, Homo sapiens
tgaggcaggagttcaggctgcg

SEQ ID NO: 9242698 - DNA, 22 bp, Homo sapiens
tgaggcaggagttcaggctgcg

SEQ ID NO: 9242699 - DNA, 22 bp, Homo sapiens
tgaggcaggagttcaggctgcg

SEQ ID NO: 9242700 - DNA, 22 bp, Homo sapiens
tgaggcaggagttcaggctgcg

SEQ ID NO: 9242701 - DNA, 22 bp, Homo sapiens
tgaggcaggatgcttgcacagg

SEQ ID NO: 9242702 - DNA, 23 bp, Homo sapiens
tgaggcaggcggatcacgaggtc

SEQ ID NO: 9242703 - DNA, 23 bp, Homo sapiens
tgaggcaggcggatcacgaggtc

SEQ ID NO: 9242704 - DNA, 22 bp, Homo sapiens
tgaggcagttcttacttgtatt

SEQ ID NO: 9242705 - DNA, 22 bp, Homo sapiens
tgaggcagttcttacttgtatt

SEQ ID NO: 9242706 - DNA, 22 bp, Homo sapiens
tgaggcagtgtgagataataaa

SEQ ID NO: 9242707 - DNA, 22 bp, Homo sapiens
tgaggcagggagtttaattgtc

SEQ ID NO: 9242708 - DNA, 21 bp, Homo sapiens
tgaggcaggggtgcttttgtc

SEQ ID NO: 9242709 - DNA, 22 bp, Homo sapiens
tgaggcagggagagtggatatg

SEQ ID NO: 9242710 - DNA, 22 bp, Homo sapiens
tgaggcagggagagtggatatg

SEQ ID NO: 9242711 - DNA, 22 bp, Homo sapiens
tgaggcagggagagtggatatg

SEQ ID NO: 9242712 - DNA, 23 bp, Homo sapiens
tgaggcaggcggatcacgaggtc

SEQ ID NO: 9242713 - DNA, 23 bp, Homo sapiens
tgaggcaggcggatcacgaggtc

SEQ ID NO: 9242714 - DNA, 22 bp, Homo sapiens
tgaggccaactagggagatgga

SEQ ID NO: 9242715 - DNA, 22 bp, Homo sapiens
tgaggccaaaatgactcaaatg

SEQ ID NO: 9242716 - DNA, 22 bp, Homo sapiens
tgaggccaactagggagatgga

SEQ ID NO: 9242717 - DNA, 22 bp, Homo sapiens
tgaggcattaaagggaggtcaa

SEQ ID NO: 9242718 - DNA, 22 bp, Homo sapiens
tgaggcagttgagcttcctgag

SEQ ID NO: 9242719 - DNA, 22 bp, Homo sapiens
tgaggccaagcctcctctgcca

SEQ ID NO: 9242720 - DNA, 22 bp, Homo sapiens
tgaggccaagaaaagctgggtg

SEQ ID NO: 9242721 - DNA, 19 bp, Homo sapiens
tgaggccaaggtcacagat

SEQ ID NO: 9242722 - DNA, 19 bp, Homo sapiens
tgaggccaaggtcacagat

SEQ ID NO: 9242723 - DNA, 22 bp, Homo sapiens
tgagggtctggaatctgggctt

SEQ ID NO: 9242724 - DNA, 22 bp, Homo sapiens
tgagggtatatattgtgtggag

SEQ ID NO: 9242725 - DNA, 22 bp, Homo sapiens
tgagggtaacctggagctgctg

SEQ ID NO: 9242726 - DNA, 21 bp, Homo sapiens
tgaggggttataacagggtgg

SEQ ID NO: 9242727 - DNA, 22 bp, Homo sapiens
tgaggggttgtgagaaatgtag

SEQ ID NO: 9242728 - DNA, 22 bp, Homo sapiens
tgaggggggtaatcactgggtt

SEQ ID NO: 9242729 - DNA, 22 bp, Homo sapiens
tgaggggggtaatcactgggtt

SEQ ID NO: 9242730 - DNA, 22 bp, Homo sapiens
tgaggggggtaatcactgggtt

SEQ ID NO: 9242731 - DNA, 22 bp, Homo sapiens
tgaggggggtaatcactgggtt

SEQ ID NO: 9242732 - DNA, 22 bp, Homo sapiens
tgaggggtaagtaaaggaattg

SEQ ID NO: 9242733 - DNA, 22 bp, Homo sapiens
tgaggggccgcccaagcacttc

SEQ ID NO: 9242734 - DNA, 22 bp, Homo sapiens
tgaggggcagagaggtgtccag

SEQ ID NO: 9242735 - DNA, 22 bp, Homo sapiens
tgaggggcgctggcaggttcct

SEQ ID NO: 9242736 - DNA, 22 bp, Homo sapiens
tgaggggcggcctgcagaggcc

SEQ ID NO: 9242737 - DNA, 19 bp, Homo sapiens
tgaggggctcacagtctca

SEQ ID NO: 9242738 - DNA, 19 bp, Homo sapiens
tgaggggctcacagtctca

SEQ ID NO: 9242739 - DNA, 22 bp, Homo sapiens
tgaggggcggcctgcagaggcc

SEQ ID NO: 9242740 - DNA, 22 bp, Homo sapiens
tgaggtagaaaaagcttgtagt

SEQ ID NO: 9242741 - DNA, 22 bp, Homo sapiens
tgaggtagaagcctgggttgag

SEQ ID NO: 9242742 - DNA, 22 bp, Homo sapiens
tgaggtaaattctggcccaaac

SEQ ID NO: 9242743 - DNA, 21 bp, Homo sapiens
tgaggtagccagtgagatgga

SEQ ID NO: 9242744 - DNA, 22 bp, Homo sapiens
tgaggtagagattgtgactgta

SEQ ID NO: 9242745 - DNA, 22 bp, Homo sapiens
tgaggtagaagttgggctgctt

SEQ ID NO: 9242746 - DNA, 22 bp, Homo sapiens
tgaggtagctgctatttgtagt

SEQ ID NO: 9242747 - DNA, 18 bp, Homo sapiens
tgaggtagctttcctcct

SEQ ID NO: 9242748 - DNA, 22 bp, Homo sapiens
tgaggtagctgtttagaaagac

SEQ ID NO: 9242749 - DNA, 22 bp, Homo sapiens
tgaggtgagtcatgcattggag

SEQ ID NO: 9242750 - DNA, 22 bp, Homo sapiens
tgaggtgaatggtgtccctgga

SEQ ID NO: 9242751 - DNA, 22 bp, Homo sapiens
tgaggtcttttatagtgtgtca

SEQ ID NO: 9242752 - DNA, 22 bp, Homo sapiens
tgaggtaggaatttgtattggg

SEQ ID NO: 9242753 - DNA, 22 bp, Homo sapiens
tgaggtaggagtgggaaagtag

SEQ ID NO: 9242754 - DNA, 22 bp, Homo sapiens
tgaggtaggagggtgatcagca

SEQ ID NO: 9242755 - DNA, 22 bp, Homo sapiens
tgaggtaggaggattgattgag

SEQ ID NO: 9242756 - DNA, 22 bp, Homo sapiens
tgaggtctgcagggctgtgcat

SEQ ID NO: 9242757 - DNA, 22 bp, Homo sapiens
tgaggtggctagggaggcactc

SEQ ID NO: 9242758 - DNA, 22 bp, Homo sapiens
tgaggtggctagggaggcactc

SEQ ID NO: 9242759 - DNA, 22 bp, Homo sapiens
tgaggtgggtgtcaggtcagag

SEQ ID NO: 9242760 - DNA, 22 bp, Homo sapiens
tgaggtgggcttgtggatttgc

SEQ ID NO: 9242761 - DNA, 22 bp, Homo sapiens
tgaggtggccgaggagcaggac

SEQ ID NO: 9242762 - DNA, 22 bp, Homo sapiens
tgaggtggctagggaggcactc

SEQ ID NO: 9242763 - DNA, 22 bp, Homo sapiens
tgaggtgccacccaagagcctt

SEQ ID NO: 9242764 - DNA, 22 bp, Homo sapiens
tgaggtgtgtccccagggaggt

SEQ ID NO: 9242765 - DNA, 22 bp, Homo sapiens
tgaggtggttactgtggtgctc

SEQ ID NO: 9242766 - DNA, 22 bp, Homo sapiens
tgaggtggttcaagagccttgt

SEQ ID NO: 9242767 - DNA, 22 bp, Homo sapiens
tgaggtggttactgtggtgctc

SEQ ID NO: 9242768 - DNA, 22 bp, Homo sapiens
tgaggtggtttgtatcactggg

SEQ ID NO: 9242769 - DNA, 22 bp, Homo sapiens
tgaggtgggtgtcaggtcagag

SEQ ID NO: 9242770 - DNA, 22 bp, Homo sapiens
tgaggtgggtgtcaggtcagag

SEQ ID NO: 9242771 - DNA, 22 bp, Homo sapiens
tgaggtggtccaaagactgttt

SEQ ID NO: 9242772 - DNA, 22 bp, Homo sapiens
tgaggtggttactgtggtgctc

SEQ ID NO: 9242773 - DNA, 22 bp, Homo sapiens
tgaggtggtgctaatctctgct

SEQ ID NO: 9242774 - DNA, 22 bp, Homo sapiens
tgagtcacacatttcttcatac

SEQ ID NO: 9242775 - DNA, 22 bp, Homo sapiens
tgagtatcaattacatagttgt

SEQ ID NO: 9242776 - DNA, 22 bp, Homo sapiens
tgagtagagaattcagctaagg

SEQ ID NO: 9242777 - DNA, 22 bp, Homo sapiens
tgagtaggatagggtggggctt

SEQ ID NO: 9242778 - DNA, 22 bp, Homo sapiens
tgagtaggatagggtggggctt

SEQ ID NO: 9242779 - DNA, 22 bp, Homo sapiens
tgagtagcggctatgtgtaact

SEQ ID NO: 9242780 - DNA, 22 bp, Homo sapiens
tgagtagagaattcagctaagg

SEQ ID NO: 9242781 - DNA, 22 bp, Homo sapiens
tgaggctaaaggtgaccagatt

SEQ ID NO: 9242782 - DNA, 22 bp, Homo sapiens
tgaggctcaagaaagatttgtt

SEQ ID NO: 9242783 - DNA, 22 bp, Homo sapiens
tgaggctcaagaatagacagta

SEQ ID NO: 9242784 - DNA, 22 bp, Homo sapiens
tgaggcctgggcacataacctc

SEQ ID NO: 9242785 - DNA, 22 bp, Homo sapiens
tgaggcctggagggaggagttt

SEQ ID NO: 9242786 - DNA, 22 bp, Homo sapiens
tgaggcctggactctgcatgga

SEQ ID NO: 9242787 - DNA, 22 bp, Homo sapiens
tgaggcctgcttggaattgaat

SEQ ID NO: 9242788 - DNA, 21 bp, Homo sapiens
tgaggcctgccagtctcagaa

SEQ ID NO: 9242789 - DNA, 22 bp, Homo sapiens
tgaggctcagagaagtgctgtt

SEQ ID NO: 9242790 - DNA, 22 bp, Homo sapiens
tgaggctcagagaagtgctgtt

SEQ ID NO: 9242791 - DNA, 22 bp, Homo sapiens
tgaggctcagaaatgtaagttt

SEQ ID NO: 9242792 - DNA, 22 bp, Homo sapiens
tgaggctcagagaacagtgact

SEQ ID NO: 9242793 - DNA, 22 bp, Homo sapiens
tgaggctcacgaacagaagact

SEQ ID NO: 9242794 - DNA, 22 bp, Homo sapiens
tgaggctcattctgcatgccaa

SEQ ID NO: 9242795 - DNA, 22 bp, Homo sapiens
tgaggctccttgtagagagtgg

SEQ ID NO: 9242796 - DNA, 22 bp, Homo sapiens
tgaggctccagccaggccagca

SEQ ID NO: 9242797 - DNA, 22 bp, Homo sapiens
tgaggctcagagcacctgctcc

SEQ ID NO: 9242798 - DNA, 20 bp, Homo sapiens
tgaggctcagagaggttgag

SEQ ID NO: 9242799 - DNA, 22 bp, Homo sapiens
tgaggctgttctaccagggcca

SEQ ID NO: 9242800 - DNA, 22 bp, Homo sapiens
tgaggctgttctaccagggcca

SEQ ID NO: 9242801 - DNA, 22 bp, Homo sapiens
tgaggctgttctaccagggcca

SEQ ID NO: 9242802 - DNA, 21 bp, Homo sapiens
tgaggctgttgtaccagggag

SEQ ID NO: 9242803 - DNA, 21 bp, Homo sapiens
tgaggctgttgtaccagggag

SEQ ID NO: 9242804 - DNA, 21 bp, Homo sapiens
tgaggctgttgtaccagggag

SEQ ID NO: 9242805 - DNA, 22 bp, Homo sapiens
tgaggctgttctaccagggcca

SEQ ID NO: 9242806 - DNA, 22 bp, Homo sapiens
tgaggctgttctaccagggcca

SEQ ID NO: 9242807 - DNA, 22 bp, Homo sapiens
tgaggctgttctaccagggcca

SEQ ID NO: 9242808 - DNA, 22 bp, Homo sapiens
tgaggcttgatttgcccgagag

SEQ ID NO: 9242809 - DNA, 21 bp, Homo sapiens
tgaggctgttgtaccagggag

SEQ ID NO: 9242810 - DNA, 17 bp, Homo sapiens
tgaggctcggtgaggag

SEQ ID NO: 9242811 - DNA, 22 bp, Homo sapiens
tgaggctctatgtggtagatta

SEQ ID NO: 9242812 - DNA, 22 bp, Homo sapiens
tgaggctctccaagcagatgag

SEQ ID NO: 9242813 - DNA, 22 bp, Homo sapiens
tgaggctgccttgggaagaggg

SEQ ID NO: 9242814 - DNA, 22 bp, Homo sapiens
tgaggctgccttgggaagaggg

SEQ ID NO: 9242815 - DNA, 22 bp, Homo sapiens
tgaggctgccttgggaagaggg

SEQ ID NO: 9242816 - DNA, 22 bp, Homo sapiens
tgaggctggatgggatgcctcc

SEQ ID NO: 9242817 - DNA, 22 bp, Homo sapiens
tgaggctggatgggatgcctcc

SEQ ID NO: 9242818 - DNA, 22 bp, Homo sapiens
tgaggctggcaaggctggtatt

SEQ ID NO: 9242819 - DNA, 22 bp, Homo sapiens
tgaggctggcaaggctggtatt

SEQ ID NO: 9242820 - DNA, 22 bp, Homo sapiens
tgaggctggcaaggctggtatt

SEQ ID NO: 9242821 - DNA, 22 bp, Homo sapiens
tgaggggaggttggggcacatc

SEQ ID NO: 9242822 - DNA, 19 bp, Homo sapiens
tgaggggaggagaggcctg

SEQ ID NO: 9242823 - DNA, 19 bp, Homo sapiens
tgaggggaggagaggcctg

SEQ ID NO: 9242824 - DNA, 22 bp, Homo sapiens
tgaggggaactgatgcccattg

SEQ ID NO: 9242825 - DNA, 22 bp, Homo sapiens
tgaggggagaagcagcagcctg

SEQ ID NO: 9242826 - DNA, 22 bp, Homo sapiens
tgagggagttgggtgtatagga

SEQ ID NO: 9242827 - DNA, 22 bp, Homo sapiens
tgagggagttgggtgtatagga

SEQ ID NO: 9242828 - DNA, 22 bp, Homo sapiens
tgagggagctgacctttctgtg

SEQ ID NO: 9242829 - DNA, 22 bp, Homo sapiens
tgaggcttggaggctccagtgg

SEQ ID NO: 9242830 - DNA, 22 bp, Homo sapiens
tgagggagagggcgaaaatgaa

SEQ ID NO: 9242831 - DNA, 22 bp, Homo sapiens
tgagccaggttaagacaggagc

SEQ ID NO: 9242832 - DNA, 20 bp, Homo sapiens
tgagccagtcaagctacatt

SEQ ID NO: 9242833 - DNA, 22 bp, Homo sapiens
tgagccaggttttccatcattc

SEQ ID NO: 9242834 - DNA, 22 bp, Homo sapiens
tgagccaggttaagacaggagc

SEQ ID NO: 9242835 - DNA, 22 bp, Homo sapiens
tgagccagtctctcagaaccct

SEQ ID NO: 9242836 - DNA, 22 bp, Homo sapiens
tgagccagtctctcagaaccct

SEQ ID NO: 9242837 - DNA, 22 bp, Homo sapiens
tgagccagtctgtctgggtgaa

SEQ ID NO: 9242838 - DNA, 22 bp, Homo sapiens
tgagccagtctgtctgggtgaa

SEQ ID NO: 9242839 - DNA, 22 bp, Homo sapiens
tgagccagtctgtctgggtgaa

SEQ ID NO: 9242840 - DNA, 22 bp, Homo sapiens
tgagcccagtctgtctgacatg

SEQ ID NO: 9242841 - DNA, 22 bp, Homo sapiens
tgagccctaagggtcaagcagg

SEQ ID NO: 9242842 - DNA, 23 bp, Homo sapiens
tgagcccagttttccctcttgcc

SEQ ID NO: 9242843 - DNA, 22 bp, Homo sapiens
tgagccgtggtctctgagggtg

SEQ ID NO: 9242844 - DNA, 21 bp, Homo sapiens
tgagcccttgcctcagagccc

SEQ ID NO: 9242845 - DNA, 22 bp, Homo sapiens
tgagcctgagttcaaggctgca

SEQ ID NO: 9242846 - DNA, 22 bp, Homo sapiens
tgagcctgcaataagcacagcc

SEQ ID NO: 9242847 - DNA, 22 bp, Homo sapiens
tgagcctggcctgcagagacca

SEQ ID NO: 9242848 - DNA, 22 bp, Homo sapiens
tgagcctggcggaagcagcgtg

SEQ ID NO: 9242849 - DNA, 22 bp, Homo sapiens
tgagcctggagtcgtggagggg

SEQ ID NO: 9242850 - DNA, 22 bp, Homo sapiens
tgagcctgctgtcgctggaccc

SEQ ID NO: 9242851 - DNA, 22 bp, Homo sapiens
tgagctcatagctcttattatg

SEQ ID NO: 9242852 - DNA, 22 bp, Homo sapiens
tgagctagggctggtgaggagc

SEQ ID NO: 9242853 - DNA, 22 bp, Homo sapiens
tgagcctgtggggtgacaacca

SEQ ID NO: 9242854 - DNA, 22 bp, Homo sapiens
tgagcctgtcctgtgcatgtga

SEQ ID NO: 9242855 - DNA, 23 bp, Homo sapiens
tgagcctgttaatactggctctg

SEQ ID NO: 9242856 - DNA, 22 bp, Homo sapiens
tgagcctgggtggtcgaggctg

SEQ ID NO: 9242857 - DNA, 22 bp, Homo sapiens
tgagcctggggcctgggcagcg

SEQ ID NO: 9242858 - DNA, 22 bp, Homo sapiens
tgagcctgggtggtcgaggctg

SEQ ID NO: 9242859 - DNA, 22 bp, Homo sapiens
tgagcctgggagatggaggctg

SEQ ID NO: 9242860 - DNA, 22 bp, Homo sapiens
tgagcctgggctttctctggag

SEQ ID NO: 9242861 - DNA, 22 bp, Homo sapiens
tgagcctgggagatggaggctg

SEQ ID NO: 9242862 - DNA, 22 bp, Homo sapiens
tgagctggatccaactccgttt

SEQ ID NO: 9242863 - DNA, 22 bp, Homo sapiens
tgagctggtcactccttctgaa

SEQ ID NO: 9242864 - DNA, 22 bp, Homo sapiens
tgagctggtcttgagtgtagct

SEQ ID NO: 9242865 - DNA, 22 bp, Homo sapiens
tgagctggttcttgaggcatga

SEQ ID NO: 9242866 - DNA, 22 bp, Homo sapiens
tgagctgtaaggctgtcactga

SEQ ID NO: 9242867 - DNA, 22 bp, Homo sapiens
tgagctggaggacaggagggta

SEQ ID NO: 9242868 - DNA, 22 bp, Homo sapiens
tgagctggaggacaggagggta

SEQ ID NO: 9242869 - DNA, 22 bp, Homo sapiens
tgagctggagtctgtggctcct

SEQ ID NO: 9242870 - DNA, 22 bp, Homo sapiens
tgagctctgttagggctggaac

SEQ ID NO: 9242871 - DNA, 22 bp, Homo sapiens
tgagctcctggtcacaattatc

SEQ ID NO: 9242872 - DNA, 22 bp, Homo sapiens
tgagcttcaaagttggatctga

SEQ ID NO: 9242873 - DNA, 22 bp, Homo sapiens
tgagcttacgtgggaacagact

SEQ ID NO: 9242874 - DNA, 22 bp, Homo sapiens
tgagcttacgtgggaacagact

SEQ ID NO: 9242875 - DNA, 22 bp, Homo sapiens
tgagctgtttctctggtggctt

SEQ ID NO: 9242876 - DNA, 22 bp, Homo sapiens
tgagcttacttctgtacacaga

SEQ ID NO: 9242877 - DNA, 22 bp, Homo sapiens
tgagctgtgtcctgggggcagt

SEQ ID NO: 9242878 - DNA, 22 bp, Homo sapiens
tgagctgtgtgacattgagcca

SEQ ID NO: 9242879 - DNA, 22 bp, Homo sapiens
tgagctgtgtcttggtgagagt

SEQ ID NO: 9242880 - DNA, 22 bp, Homo sapiens
tgagctgtggtggggtagagga

SEQ ID NO: 9242881 - DNA, 22 bp, Homo sapiens
tgagctgtgctacgccctggga

SEQ ID NO: 9242882 - DNA, 22 bp, Homo sapiens
tgagctgtgattaactctgaga

SEQ ID NO: 9242883 - DNA, 22 bp, Homo sapiens
tgagctgtgattaactctgaga

SEQ ID NO: 9242884 - DNA, 22 bp, Homo sapiens
tgagctgtgatctatgataaat

SEQ ID NO: 9242885 - DNA, 22 bp, Homo sapiens
tgagctgtgagggtacagatat

SEQ ID NO: 9242886 - DNA, 22 bp, Homo sapiens
tgagctgtctgaatggtgagga

SEQ ID NO: 9242887 - DNA, 22 bp, Homo sapiens
tgagctgtatattgttttaata

SEQ ID NO: 9242888 - DNA, 22 bp, Homo sapiens
tgagctgtctatggtcctgtct

SEQ ID NO: 9242889 - DNA, 22 bp, Homo sapiens
tgagctgtcaaggtacagtgaa

SEQ ID NO: 9242890 - DNA, 22 bp, Homo sapiens
tgagctgtagcagatgctgttg

SEQ ID NO: 9242891 - DNA, 22 bp, Homo sapiens
tgagctgtactcctccccaggg

SEQ ID NO: 9242892 - DNA, 22 bp, Homo sapiens
tgagctgtagcagatgctgttg

SEQ ID NO: 9242893 - DNA, 22 bp, Homo sapiens
tgagctgtagcagatgctgttg

SEQ ID NO: 9242894 - DNA, 22 bp, Homo sapiens
tgaggaaactgaggcacagatg

SEQ ID NO: 9242895 - DNA, 22 bp, Homo sapiens
tgaggaaacttacaaggcagaa

SEQ ID NO: 9242896 - DNA, 22 bp, Homo sapiens
tgaggaaacttacaaggcagaa

SEQ ID NO: 9242897 - DNA, 22 bp, Homo sapiens
tgagcttcctccctgcatccat

SEQ ID NO: 9242898 - DNA, 22 bp, Homo sapiens
tgagcttccctcctgcactaca

SEQ ID NO: 9242899 - DNA, 22 bp, Homo sapiens
tgagcttccctcctgcactaca

SEQ ID NO: 9242900 - DNA, 22 bp, Homo sapiens
tgagcttcctccctgcatccat

SEQ ID NO: 9242901 - DNA, 22 bp, Homo sapiens
tgagcttgctacatagatcaga

SEQ ID NO: 9242902 - DNA, 22 bp, Homo sapiens
tgagcagggactttggagtctg

SEQ ID NO: 9242903 - DNA, 22 bp, Homo sapiens
tgagcagggactttggagtctg

SEQ ID NO: 9242904 - DNA, 22 bp, Homo sapiens
tgagcagggagctgggctgagc

SEQ ID NO: 9242905 - DNA, 22 bp, Homo sapiens
tgagcatggtgggtgcagagca

SEQ ID NO: 9242906 - DNA, 19 bp, Homo sapiens
tgagcatgcgagctgagaa

SEQ ID NO: 9242907 - DNA, 22 bp, Homo sapiens
tgagccagagtggagtgtgcct

SEQ ID NO: 9242908 - DNA, 22 bp, Homo sapiens
tgagccagagtggagtgtgcct

SEQ ID NO: 9242909 - DNA, 22 bp, Homo sapiens
tgagccagataagggctcacgc

SEQ ID NO: 9242910 - DNA, 22 bp, Homo sapiens
tgagccagagaggttgaggcta

SEQ ID NO: 9242911 - DNA, 22 bp, Homo sapiens
tgagccagaggaggctgtgtgg

SEQ ID NO: 9242912 - DNA, 22 bp, Homo sapiens
tgagccagagaggttgaggcta

SEQ ID NO: 9242913 - DNA, 22 bp, Homo sapiens
tgagccaagatcatgccgttgt

SEQ ID NO: 9242914 - DNA, 19 bp, Homo sapiens
tgagccagggaggccatgc

SEQ ID NO: 9242915 - DNA, 19 bp, Homo sapiens
tgagccagggaggccatgc

SEQ ID NO: 9242916 - DNA, 21 bp, Homo sapiens
tgagccaggctgacggctgtg

SEQ ID NO: 9242917 - DNA, 22 bp, Homo sapiens
tgagccaggctccatgccacct

SEQ ID NO: 9242918 - DNA, 21 bp, Homo sapiens
tgagccaggctgacggctgtg

SEQ ID NO: 9242919 - DNA, 22 bp, Homo sapiens
tgagccaggcccagtggggtca

SEQ ID NO: 9242920 - DNA, 22 bp, Homo sapiens
tgagccaggctcaagtgatcct

SEQ ID NO: 9242921 - DNA, 22 bp, Homo sapiens
tgagccaggctcaagtgatcct

SEQ ID NO: 9242922 - DNA, 20 bp, Homo sapiens
tgagccaggctaggaagggc

SEQ ID NO: 9242923 - DNA, 22 bp, Homo sapiens
tgagccaggagtttgaggctgt

SEQ ID NO: 9242924 - DNA, 22 bp, Homo sapiens
tgagccaggagtttgaggctgt

SEQ ID NO: 9242925 - DNA, 22 bp, Homo sapiens
tgagccagataagggctcacgc

SEQ ID NO: 9242926 - DNA, 22 bp, Homo sapiens
tgagccagcctcagaagtcacg

SEQ ID NO: 9242927 - DNA, 22 bp, Homo sapiens
tgagccagccttgcagctgtgc

SEQ ID NO: 9242928 - DNA, 22 bp, Homo sapiens
tgagccagccttgcagctgtgc

SEQ ID NO: 9242929 - DNA, 23 bp, Homo sapiens
tgagcagctaaaggtgatgcggg

SEQ ID NO: 9242930 - DNA, 22 bp, Homo sapiens
tgagcagatgtgccaaactgta

SEQ ID NO: 9242931 - DNA, 22 bp, Homo sapiens
tgagcagatgtgccaaactgta

SEQ ID NO: 9242932 - DNA, 22 bp, Homo sapiens
tgagcagatttgttctaggggt

SEQ ID NO: 9242933 - DNA, 22 bp, Homo sapiens
tgagcaggactcactgcagcct

SEQ ID NO: 9242934 - DNA, 22 bp, Homo sapiens
tgagcaggactcactgcagcct

SEQ ID NO: 9242935 - DNA, 22 bp, Homo sapiens
tgagcaggcgcagcaggaggtc

SEQ ID NO: 9242936 - DNA, 22 bp, Homo sapiens
tgagcaggattcgcctcttgca

SEQ ID NO: 9242937 - DNA, 22 bp, Homo sapiens
tgagcagggactttgagtgtag

SEQ ID NO: 9242938 - DNA, 22 bp, Homo sapiens
tgagcagggactttgagtgtag

SEQ ID NO: 9242939 - DNA, 22 bp, Homo sapiens
tgagcaggcgcagcaggaggtc

SEQ ID NO: 9242940 - DNA, 22 bp, Homo sapiens
tgagcagagatgactgggcatt

SEQ ID NO: 9242941 - DNA, 22 bp, Homo sapiens
tgagcagagatgactgggcatt

SEQ ID NO: 9242942 - DNA, 22 bp, Homo sapiens
tgagcagagcaggctgcgccct

SEQ ID NO: 9242943 - DNA, 22 bp, Homo sapiens
tgagcagagcaataggactctc

SEQ ID NO: 9242944 - DNA, 22 bp, Homo sapiens
tgagcagagacttcaagggcag

SEQ ID NO: 9242945 - DNA, 22 bp, Homo sapiens
tgagcaagagaaactgactgta

SEQ ID NO: 9242946 - DNA, 22 bp, Homo sapiens
tgagcaagacccggcctctgcc

SEQ ID NO: 9242947 - DNA, 22 bp, Homo sapiens
tgagcacagctttcactagaaa

SEQ ID NO: 9242948 - DNA, 18 bp, Homo sapiens
tgagcagagtaaggcttt

SEQ ID NO: 9242949 - DNA, 22 bp, Homo sapiens
tgagcagagttgtttctcctga

SEQ ID NO: 9242950 - DNA, 22 bp, Homo sapiens
tgagcagagtcgctccagagtg

SEQ ID NO: 9242951 - DNA, 22 bp, Homo sapiens
tgagcagatggaggcttctgca

SEQ ID NO: 9242952 - DNA, 22 bp, Homo sapiens
tgagcagatggaggcttctgca

SEQ ID NO: 9242953 - DNA, 22 bp, Homo sapiens
tgagcagatgtctaacttttac

SEQ ID NO: 9242954 - DNA, 22 bp, Homo sapiens
tgagcagaggaggctgccaact

SEQ ID NO: 9242955 - DNA, 22 bp, Homo sapiens
tgagcagagcagtaacaggagc

SEQ ID NO: 9242956 - DNA, 22 bp, Homo sapiens
tgagcagagcagtaacaggagc

SEQ ID NO: 9242957 - DNA, 22 bp, Homo sapiens
tgagcagaggccagcacctggg

SEQ ID NO: 9242958 - DNA, 22 bp, Homo sapiens
tgagcagaggagtgacgtaggt

SEQ ID NO: 9242959 - DNA, 22 bp, Homo sapiens
tgagcagaggagtgacgtaggt

SEQ ID NO: 9242960 - DNA, 22 bp, Homo sapiens
tgagatgaataactcctgctaa

SEQ ID NO: 9242961 - DNA, 22 bp, Homo sapiens
tgagatgctaaagggctgctca

SEQ ID NO: 9242962 - DNA, 22 bp, Homo sapiens
tgagatgatgggataagagggc

SEQ ID NO: 9242963 - DNA, 21 bp, Homo sapiens
tgagatgctagaaggcaggga

SEQ ID NO: 9242964 - DNA, 22 bp, Homo sapiens
tgagatgctgctgtaacaaata

SEQ ID NO: 9242965 - DNA, 22 bp, Homo sapiens
tgagatggaaggtgaggcagta

SEQ ID NO: 9242966 - DNA, 17 bp, Homo sapiens
tgagatggaagaagact

SEQ ID NO: 9242967 - DNA, 22 bp, Homo sapiens
tgagatggagtcttgctctgtt

SEQ ID NO: 9242968 - DNA, 22 bp, Homo sapiens
tgagatggagttctgctcttgt

SEQ ID NO: 9242969 - DNA, 22 bp, Homo sapiens
tgagatggagtctcactctgtt

SEQ ID NO: 9242970 - DNA, 22 bp, Homo sapiens
tgagatggagccactgcactct

SEQ ID NO: 9242971 - DNA, 22 bp, Homo sapiens
tgagatggagtctcgctctgtt

SEQ ID NO: 9242972 - DNA, 22 bp, Homo sapiens
tgagatgaaagcagaaagactt

SEQ ID NO: 9242973 - DNA, 23 bp, Homo sapiens
tgagatcgcccagctggtaggca

SEQ ID NO: 9242974 - DNA, 22 bp, Homo sapiens
tgagatggctgggccccaggag

SEQ ID NO: 9242975 - DNA, 22 bp, Homo sapiens
tgagatgggatgtgcacttggc

SEQ ID NO: 9242976 - DNA, 22 bp, Homo sapiens
tgagatggattgggttggttcc

SEQ ID NO: 9242977 - DNA, 22 bp, Homo sapiens
tgagatggcaacaccagctttg

SEQ ID NO: 9242978 - DNA, 22 bp, Homo sapiens
tgagatggagttttggggatat

SEQ ID NO: 9242979 - DNA, 22 bp, Homo sapiens
tgagatgggtggggagctcagg

SEQ ID NO: 9242980 - DNA, 22 bp, Homo sapiens
tgagatgggtcatcaggtttgg

SEQ ID NO: 9242981 - DNA, 22 bp, Homo sapiens
tgagatgggtggggagctcagg

SEQ ID NO: 9242982 - DNA, 22 bp, Homo sapiens
tgagatggggtcatgctttgtc

SEQ ID NO: 9242983 - DNA, 22 bp, Homo sapiens
tgagatggggagggctgcagaa

SEQ ID NO: 9242984 - DNA, 22 bp, Homo sapiens
tgagatggggagggctgcagaa

SEQ ID NO: 9242985 - DNA, 22 bp, Homo sapiens
tgagatggttgaccagagagca

SEQ ID NO: 9242986 - DNA, 22 bp, Homo sapiens
tgagatgggtgggtagccaagg

SEQ ID NO: 9242987 - DNA, 22 bp, Homo sapiens
tgagatgggtgtccagggagga

SEQ ID NO: 9242988 - DNA, 22 bp, Homo sapiens
tgagatggtgaagaagacagca

SEQ ID NO: 9242989 - DNA, 22 bp, Homo sapiens
tgagatggttcacagagaaggc

SEQ ID NO: 9242990 - DNA, 19 bp, Homo sapiens
tgagatttcttaggtgatt

SEQ ID NO: 9242991 - DNA, 21 bp, Homo sapiens
tgagcaaaatttagagtgatg

SEQ ID NO: 9242992 - DNA, 21 bp, Homo sapiens
tgagcaaaatttagagtgatg

SEQ ID NO: 9242993 - DNA, 22 bp, Homo sapiens
tgagagagcctgaatctcttac

SEQ ID NO: 9242994 - DNA, 18 bp, Homo sapiens
tgagagaatgttcatgct

SEQ ID NO: 9242995 - DNA, 22 bp, Homo sapiens
tgagacttgtgagtccttctag

SEQ ID NO: 9242996 - DNA, 22 bp, Homo sapiens
tgagagagtaattgagtggtaa

SEQ ID NO: 9242997 - DNA, 22 bp, Homo sapiens
tgagagagtaattgagtggtaa

SEQ ID NO: 9242998 - DNA, 22 bp, Homo sapiens
tgagagagcgcctgggatcatt

SEQ ID NO: 9242999 - DNA, 22 bp, Homo sapiens
tgagagattttcatgagtgctt

SEQ ID NO: 9243000 - DNA, 22 bp, Homo sapiens
tgagagattgctgtatgttttg

SEQ ID NO: 9243001 - DNA, 22 bp, Homo sapiens
tgagagatgaagttagttgttc

SEQ ID NO: 9243002 - DNA, 18 bp, Homo sapiens
tgagaggctattttttgc

SEQ ID NO: 9243003 - DNA, 22 bp, Homo sapiens
tgagagggcccagagcacacca

SEQ ID NO: 9243004 - DNA, 22 bp, Homo sapiens
tgagagggcccagagcacacca

SEQ ID NO: 9243005 - DNA, 22 bp, Homo sapiens
tgagaggtaggaaatgaacaag

SEQ ID NO: 9243006 - DNA, 22 bp, Homo sapiens
tgagaggtaggaaatgaacaag

SEQ ID NO: 9243007 - DNA, 22 bp, Homo sapiens
tgagagggttcccaggggtttc

SEQ ID NO: 9243008 - DNA, 19 bp, Homo sapiens
tgagaggcttaaggcagct

SEQ ID NO: 9243009 - DNA, 22 bp, Homo sapiens
tgagaggagtgattgtaaaatt

SEQ ID NO: 9243010 - DNA, 22 bp, Homo sapiens
tgagaggatattttgggaggat

SEQ ID NO: 9243011 - DNA, 22 bp, Homo sapiens
tgagagctgctgagactgtcct

SEQ ID NO: 9243012 - DNA, 22 bp, Homo sapiens
tgagaggaacaggcagtaggtt

SEQ ID NO: 9243013 - DNA, 22 bp, Homo sapiens
tgagaggaacaggcagtaggtt

SEQ ID NO: 9243014 - DNA, 22 bp, Homo sapiens
tgagagcttgagtatcactggc

SEQ ID NO: 9243015 - DNA, 20 bp, Homo sapiens
tgagagctgggcagggatac

SEQ ID NO: 9243016 - DNA, 22 bp, Homo sapiens
tgagagctgtccacctgtggga

SEQ ID NO: 9243017 - DNA, 17 bp, Homo sapiens
tgagacagggcaggccc

SEQ ID NO: 9243018 - DNA, 22 bp, Homo sapiens
tgagacagggtcttgctctgtt

SEQ ID NO: 9243019 - DNA, 17 bp, Homo sapiens
tgagacagggcaggccc

SEQ ID NO: 9243020 - DNA, 17 bp, Homo sapiens
tgagacagggcaggccc

SEQ ID NO: 9243021 - DNA, 22 bp, Homo sapiens
tgagacagggtcttgctctgtt

SEQ ID NO: 9243022 - DNA, 22 bp, Homo sapiens
tgagacagggtcttgctctgtt

SEQ ID NO: 9243023 - DNA, 22 bp, Homo sapiens
tgagacagttctgcagctgggt

SEQ ID NO: 9243024 - DNA, 22 bp, Homo sapiens
tgagacagtatcgccccaaggc

SEQ ID NO: 9243025 - DNA, 22 bp, Homo sapiens
tgagacagtcaccaggcaggcc

SEQ ID NO: 9243026 - DNA, 22 bp, Homo sapiens
tgagacagtcaccaggcaggcc

SEQ ID NO: 9243027 - DNA, 17 bp, Homo sapiens
tgagacagggcaggccc

SEQ ID NO: 9243028 - DNA, 19 bp, Homo sapiens
tgagacagggattcaggtg

SEQ ID NO: 9243029 - DNA, 19 bp, Homo sapiens
tgagacagggattcaggtg

SEQ ID NO: 9243030 - DNA, 22 bp, Homo sapiens
tgagacaggagaggcccctcct

SEQ ID NO: 9243031 - DNA, 22 bp, Homo sapiens
tgagacaggcttccttcttggg

SEQ ID NO: 9243032 - DNA, 18 bp, Homo sapiens
tgagacagctaccacttg

SEQ ID NO: 9243033 - DNA, 22 bp, Homo sapiens
tgagacagcctctgcactcatg

SEQ ID NO: 9243034 - DNA, 22 bp, Homo sapiens
tgagacagcctctgcactcatg

SEQ ID NO: 9243035 - DNA, 22 bp, Homo sapiens
tgagacagcctctgcactcatg

SEQ ID NO: 9243036 - DNA, 22 bp, Homo sapiens
tgagacagcccttctgcacagg

SEQ ID NO: 9243037 - DNA, 22 bp, Homo sapiens
tgagacagcccttctgcacagg

SEQ ID NO: 9243038 - DNA, 22 bp, Homo sapiens
tgagacagcccttctgcacagg

SEQ ID NO: 9243039 - DNA, 22 bp, Homo sapiens
tgagacagcagtcagggaaata

SEQ ID NO: 9243040 - DNA, 22 bp, Homo sapiens
tgagacagcagtcagggaaata

SEQ ID NO: 9243041 - DNA, 19 bp, Homo sapiens
tgagacagaagatgagcct

SEQ ID NO: 9243042 - DNA, 19 bp, Homo sapiens
tgagacagaagatgagcct

SEQ ID NO: 9243043 - DNA, 20 bp, Homo sapiens
tgagacaaggctggagagac

SEQ ID NO: 9243044 - DNA, 22 bp, Homo sapiens
tgagaattttcagtttcacttt

SEQ ID NO: 9243045 - DNA, 22 bp, Homo sapiens
tgagaatttttggcagaaacaa

SEQ ID NO: 9243046 - DNA, 22 bp, Homo sapiens
tgagaatttgtgaacttttctc

SEQ ID NO: 9243047 - DNA, 22 bp, Homo sapiens
tgagaattacaaatgagtcaca

SEQ ID NO: 9243048 - DNA, 20 bp, Homo sapiens
tgagaagctcctgtctcctc

SEQ ID NO: 9243049 - DNA, 22 bp, Homo sapiens
tgagaagctgctgacttagcct

SEQ ID NO: 9243050 - DNA, 22 bp, Homo sapiens
tgagaagctgcttgtgctgtat

SEQ ID NO: 9243051 - DNA, 22 bp, Homo sapiens
tgagaattacaaatgagtcaca

SEQ ID NO: 9243052 - DNA, 18 bp, Homo sapiens
tgagaatgtaagaaatgg

SEQ ID NO: 9243053 - DNA, 22 bp, Homo sapiens
tgagaaagtgggtgcctagcaa

SEQ ID NO: 9243054 - DNA, 22 bp, Homo sapiens
tgagaaatgggtctgctgaaga

SEQ ID NO: 9243055 - DNA, 22 bp, Homo sapiens
tgagaaacatatgagagatttg

SEQ ID NO: 9243056 - DNA, 22 bp, Homo sapiens
tgagaaaattactataattgtc

SEQ ID NO: 9243057 - DNA, 22 bp, Homo sapiens
tgagaaaattactataattgtc

SEQ ID NO: 9243058 - DNA, 22 bp, Homo sapiens
tgagaaaatccagaggctagtt

SEQ ID NO: 9243059 - DNA, 22 bp, Homo sapiens
tgagaaaagtgtggaggtcaat

SEQ ID NO: 9243060 - DNA, 22 bp, Homo sapiens
tgagaacagttggaagcagtca

SEQ ID NO: 9243061 - DNA, 22 bp, Homo sapiens
tgagaacatacaaacagagaaa

SEQ ID NO: 9243062 - DNA, 22 bp, Homo sapiens
tgagaacattgggaaagctatg

SEQ ID NO: 9243063 - DNA, 22 bp, Homo sapiens
tgagaacatttgcagggagagt

SEQ ID NO: 9243064 - DNA, 22 bp, Homo sapiens
tgagaaccatgaaaagctgtca

SEQ ID NO: 9243065 - DNA, 18 bp, Homo sapiens
tgagaactaggcattgca

SEQ ID NO: 9243066 - DNA, 22 bp, Homo sapiens
tgagaacggatactaagggctg

SEQ ID NO: 9243067 - DNA, 22 bp, Homo sapiens
tgagaacggatactaagggctg

SEQ ID NO: 9243068 - DNA, 22 bp, Homo sapiens
tgagaacttgtgctattgcaca

SEQ ID NO: 9243069 - DNA, 22 bp, Homo sapiens
tgagaagcccacactctttcct

SEQ ID NO: 9243070 - DNA, 23 bp, Homo sapiens
tgagaagccattagagcaggtgg

SEQ ID NO: 9243071 - DNA, 23 bp, Homo sapiens
tgagaagccaggggagcgtgagg

SEQ ID NO: 9243072 - DNA, 22 bp, Homo sapiens
tgagaagattgggcagagtgga

SEQ ID NO: 9243073 - DNA, 22 bp, Homo sapiens
tgagaagcagcttacaggtgtc

SEQ ID NO: 9243074 - DNA, 22 bp, Homo sapiens
tgagaagatttgctcttctgag

SEQ ID NO: 9243075 - DNA, 22 bp, Homo sapiens
tgagaagcagtttcagtaagaa

SEQ ID NO: 9243076 - DNA, 22 bp, Homo sapiens
tgagaagcagcttacaggtgtc

SEQ ID NO: 9243077 - DNA, 22 bp, Homo sapiens
tgcagtgtttttcagggcatat

SEQ ID NO: 9243078 - DNA, 22 bp, Homo sapiens
tgcagtgtgacctgtagcgagc

SEQ ID NO: 9243079 - DNA, 22 bp, Homo sapiens
tgcagtggttgagagcccagac

SEQ ID NO: 9243080 - DNA, 22 bp, Homo sapiens
tgcagtgggccggaggccaggg

SEQ ID NO: 9243081 - DNA, 22 bp, Homo sapiens
tgcagtgggccggaggccaggg

SEQ ID NO: 9243082 - DNA, 22 bp, Homo sapiens
tgcagtgggccggaggccaggg

SEQ ID NO: 9243083 - DNA, 22 bp, Homo sapiens
tgcagtggcgccatctcagctc

SEQ ID NO: 9243084 - DNA, 22 bp, Homo sapiens
tgcagtggcgccatctcagctc

SEQ ID NO: 9243085 - DNA, 22 bp, Homo sapiens
tgcagtggtggtaaagatgctc

SEQ ID NO: 9243086 - DNA, 22 bp, Homo sapiens
tgcagtggtggtaaagatgctc

SEQ ID NO: 9243087 - DNA, 22 bp, Homo sapiens
tgcagtggtgtccaggtgtact

SEQ ID NO: 9243088 - DNA, 22 bp, Homo sapiens
tgcagtcctaaatatatagctg

SEQ ID NO: 9243089 - DNA, 22 bp, Homo sapiens
tgcagtccctggcccactttaa

SEQ ID NO: 9243090 - DNA, 22 bp, Homo sapiens
tgcagtccaagagtctcctggt

SEQ ID NO: 9243091 - DNA, 21 bp, Homo sapiens
tgcagtcctttgacatgattc

SEQ ID NO: 9243092 - DNA, 22 bp, Homo sapiens
tgcagtcctggtgaggggacat

SEQ ID NO: 9243093 - DNA, 21 bp, Homo sapiens
tgcagtatgtatttgtatcca

SEQ ID NO: 9243094 - DNA, 22 bp, Homo sapiens
tgcaggtgtctccagggcaggt

SEQ ID NO: 9243095 - DNA, 22 bp, Homo sapiens
tgcaggtggtttggacactgct

SEQ ID NO: 9243096 - DNA, 22 bp, Homo sapiens
tgcaggtggtttggacactgct

SEQ ID NO: 9243097 - DNA, 22 bp, Homo sapiens
tgcaggtggtttggacactgct

SEQ ID NO: 9243098 - DNA, 20 bp, Homo sapiens
tgcaggtgggcccttctggg

SEQ ID NO: 9243099 - DNA, 20 bp, Homo sapiens
tgcaggtgggcccttctggg

SEQ ID NO: 9243100 - DNA, 22 bp, Homo sapiens
tgcaggtggtccttcctctgct

SEQ ID NO: 9243101 - DNA, 22 bp, Homo sapiens
tgcaggtggtccttcctctgct

SEQ ID NO: 9243102 - DNA, 22 bp, Homo sapiens
tgcaggtgtggttcctcagcca

SEQ ID NO: 9243103 - DNA, 22 bp, Homo sapiens
tgcaggtgtgtgcaagggaggg

SEQ ID NO: 9243104 - DNA, 22 bp, Homo sapiens
tgcaggtgtgggcaggggagca

SEQ ID NO: 9243105 - DNA, 22 bp, Homo sapiens
tgcaggtctccattggcagact

SEQ ID NO: 9243106 - DNA, 22 bp, Homo sapiens
tgcaggtgagtgcaggggctca

SEQ ID NO: 9243107 - DNA, 23 bp, Homo sapiens
tgcagggtgttcctgcctttgct

SEQ ID NO: 9243108 - DNA, 22 bp, Homo sapiens
tgcaggtacttgacaacttggg

SEQ ID NO: 9243109 - DNA, 22 bp, Homo sapiens
tgcaggtaaatttgtggaggat

SEQ ID NO: 9243110 - DNA, 22 bp, Homo sapiens
tgcaggtaaatttgtggaggat

SEQ ID NO: 9243111 - DNA, 22 bp, Homo sapiens
tgcagggtgtccggaggatcac

SEQ ID NO: 9243112 - DNA, 22 bp, Homo sapiens
tgcagggtgtccggaggatcac

SEQ ID NO: 9243113 - DNA, 22 bp, Homo sapiens
tgcaggtggctccagggactgc

SEQ ID NO: 9243114 - DNA, 22 bp, Homo sapiens
tgcaggtggctccagggactgc

SEQ ID NO: 9243115 - DNA, 22 bp, Homo sapiens
tgcaggtgattctgatgcagtt

SEQ ID NO: 9243116 - DNA, 22 bp, Homo sapiens
tgcaggtggacacgggagacgg

SEQ ID NO: 9243117 - DNA, 22 bp, Homo sapiens
tgcagggcttcctcttggagtt

SEQ ID NO: 9243118 - DNA, 22 bp, Homo sapiens
tgcagggcttcctcttggagtt

SEQ ID NO: 9243119 - DNA, 22 bp, Homo sapiens
tgcagggcttcctcttggagtt

SEQ ID NO: 9243120 - DNA, 19 bp, Homo sapiens
tgcagggctgcgcctgggg

SEQ ID NO: 9243121 - DNA, 22 bp, Homo sapiens
tgcaggggcttgtctgggcctg

SEQ ID NO: 9243122 - DNA, 22 bp, Homo sapiens
tgcaggggcttgtctgggcctg

SEQ ID NO: 9243123 - DNA, 22 bp, Homo sapiens
tgcaggggcttgtctgggcctg

SEQ ID NO: 9243124 - DNA, 22 bp, Homo sapiens
tgcagggtagatgcaggctgtg

SEQ ID NO: 9243125 - DNA, 22 bp, Homo sapiens
tgcagggcagtggaggttgagt

SEQ ID NO: 9243126 - DNA, 22 bp, Homo sapiens
tgcagggcagctagggagcttt

SEQ ID NO: 9243127 - DNA, 22 bp, Homo sapiens
tgcagggcagctagggagcttt

SEQ ID NO: 9243128 - DNA, 22 bp, Homo sapiens
tgcagggcacacgcacgggtgt

SEQ ID NO: 9243129 - DNA, 22 bp, Homo sapiens
tgcagggcacggtgcgcgtggg

SEQ ID NO: 9243130 - DNA, 23 bp, Homo sapiens
tgcagggcaagttagagacccca

SEQ ID NO: 9243131 - DNA, 22 bp, Homo sapiens
tgcagggcccttggggttgaac

SEQ ID NO: 9243132 - DNA, 22 bp, Homo sapiens
tgcagggctacaggactacaac

SEQ ID NO: 9243133 - DNA, 22 bp, Homo sapiens
tgcagggccatggtggcggctg

SEQ ID NO: 9243134 - DNA, 22 bp, Homo sapiens
tgcagggccagactgggttgga

SEQ ID NO: 9243135 - DNA, 22 bp, Homo sapiens
tgcagggccatggtggcggctg

SEQ ID NO: 9243136 - DNA, 22 bp, Homo sapiens
tgcagggcagtttgtttcggca

SEQ ID NO: 9243137 - DNA, 22 bp, Homo sapiens
tgcagggcatctttgaagtgtg

SEQ ID NO: 9243138 - DNA, 22 bp, Homo sapiens
tgcagggccagactgggttgga

SEQ ID NO: 9243139 - DNA, 22 bp, Homo sapiens
tgcagggaagtcccagctcctg

SEQ ID NO: 9243140 - DNA, 22 bp, Homo sapiens
tgcagggaacttggacagctag

SEQ ID NO: 9243141 - DNA, 22 bp, Homo sapiens
tgcagggaacttggacagctag

SEQ ID NO: 9243142 - DNA, 21 bp, Homo sapiens
tgcaggctgtgcgctcctgcc

SEQ ID NO: 9243143 - DNA, 22 bp, Homo sapiens
tgcaggctttagccccatggct

SEQ ID NO: 9243144 - DNA, 22 bp, Homo sapiens
tgcaggctgccttcacagagcc

SEQ ID NO: 9243145 - DNA, 22 bp, Homo sapiens
tgcaggctgccttcacagagcc

SEQ ID NO: 9243146 - DNA, 22 bp, Homo sapiens
tgcaggctgctggcagtagctt

SEQ ID NO: 9243147 - DNA, 22 bp, Homo sapiens
tgcaggctgtaatctgaggcta

SEQ ID NO: 9243148 - DNA, 22 bp, Homo sapiens
tgcaggctgtaatctgaggcta

SEQ ID NO: 9243149 - DNA, 22 bp, Homo sapiens
tgcaggctggggaggcagactt

SEQ ID NO: 9243150 - DNA, 22 bp, Homo sapiens
tgcaggctctctgctgccagat

SEQ ID NO: 9243151 - DNA, 22 bp, Homo sapiens
tgcaggctccatgaggacaggc

SEQ ID NO: 9243152 - DNA, 17 bp, Homo sapiens
tgcaggctcctgtccct

SEQ ID NO: 9243153 - DNA, 22 bp, Homo sapiens
tgcaggctctgtgtgtgcctgg

SEQ ID NO: 9243154 - DNA, 22 bp, Homo sapiens
tgcatgctgcacacatgcgtag

SEQ ID NO: 9243155 - DNA, 22 bp, Homo sapiens
tgcatggaacggtctcctggtc

SEQ ID NO: 9243156 - DNA, 22 bp, Homo sapiens
tgcatggagatatactatttga

SEQ ID NO: 9243157 - DNA, 22 bp, Homo sapiens
tgcatgcatgctactgggaggt

SEQ ID NO: 9243158 - DNA, 22 bp, Homo sapiens
tgcatgcagctggtcgggcgcc

SEQ ID NO: 9243159 - DNA, 22 bp, Homo sapiens
tgcatgcacttggctggcacgt

SEQ ID NO: 9243160 - DNA, 22 bp, Homo sapiens
tgcatctgttcattcgttccca

SEQ ID NO: 9243161 - DNA, 22 bp, Homo sapiens
tgcatgaggactcagagcttct

SEQ ID NO: 9243162 - DNA, 22 bp, Homo sapiens
tgcatgagcgaatgtgtcctgt

SEQ ID NO: 9243163 - DNA, 22 bp, Homo sapiens
tgcatgatagagatggtattag

SEQ ID NO: 9243164 - DNA, 22 bp, Homo sapiens
tgcatgcactatctagatgatg

SEQ ID NO: 9243165 - DNA, 22 bp, Homo sapiens
tgcatgcagcatatgaggcctc

SEQ ID NO: 9243166 - DNA, 22 bp, Homo sapiens
tgcatgcacgtatctgcgtgtg

SEQ ID NO: 9243167 - DNA, 22 bp, Homo sapiens
tgcatgcacatgtaggtatggt

SEQ ID NO: 9243168 - DNA, 22 bp, Homo sapiens
tgcatgcacccagccgggtatt

SEQ ID NO: 9243169 - DNA, 22 bp, Homo sapiens
tgcatgttaagaaaatattgag

SEQ ID NO: 9243170 - DNA, 22 bp, Homo sapiens
tgcattccatgtgtttcctgag

SEQ ID NO: 9243171 - DNA, 23 bp, Homo sapiens
tgcattcctcacagggcagaaga

SEQ ID NO: 9243172 - DNA, 22 bp, Homo sapiens
tgcattccacataaagcgataa

SEQ ID NO: 9243173 - DNA, 22 bp, Homo sapiens
tgcatgtgtttcccagcaagct

SEQ ID NO: 9243174 - DNA, 19 bp, Homo sapiens
tgcatgtgttctcccattg

SEQ ID NO: 9243175 - DNA, 22 bp, Homo sapiens
tgcatgtggacccctggtgcct

SEQ ID NO: 9243176 - DNA, 22 bp, Homo sapiens
tgcatgtgtcgggcctgtgcta

SEQ ID NO: 9243177 - DNA, 22 bp, Homo sapiens
tgcatgtgtgacaaggacagtt

SEQ ID NO: 9243178 - DNA, 22 bp, Homo sapiens
tgcatggataaaagtatattat

SEQ ID NO: 9243179 - DNA, 22 bp, Homo sapiens
tgcatggagtaattgatgcttg

SEQ ID NO: 9243180 - DNA, 21 bp, Homo sapiens
tgcatggaggaaagttataga

SEQ ID NO: 9243181 - DNA, 22 bp, Homo sapiens
tgcatggaggaagatgaatgca

SEQ ID NO: 9243182 - DNA, 22 bp, Homo sapiens
tgcatgtggacccctggtgcct

SEQ ID NO: 9243183 - DNA, 22 bp, Homo sapiens
tgcatgtgcccactctggctta

SEQ ID NO: 9243184 - DNA, 19 bp, Homo sapiens
tgcataaattatatacttt

SEQ ID NO: 9243185 - DNA, 22 bp, Homo sapiens
tgcataaagtgccatagtatta

SEQ ID NO: 9243186 - DNA, 22 bp, Homo sapiens
tgcataaagtgccatagtatta

SEQ ID NO: 9243187 - DNA, 22 bp, Homo sapiens
tgcataaagtgccatagtatta

SEQ ID NO: 9243188 - DNA, 22 bp, Homo sapiens
tgcataaaatatgagaaatgta

SEQ ID NO: 9243189 - DNA, 22 bp, Homo sapiens
tgcataaacagatacttcatgt

SEQ ID NO: 9243190 - DNA, 21 bp, Homo sapiens
tgcataaagaaatacaaatac

SEQ ID NO: 9243191 - DNA, 22 bp, Homo sapiens
tgcataaaacatgatttctgct

SEQ ID NO: 9243192 - DNA, 22 bp, Homo sapiens
tgcagttttctcacccccacaa

SEQ ID NO: 9243193 - DNA, 22 bp, Homo sapiens
tgcagttttccttcaacattgt

SEQ ID NO: 9243194 - DNA, 22 bp, Homo sapiens
tgcagttttatcacatatatag

SEQ ID NO: 9243195 - DNA, 22 bp, Homo sapiens
tgcagttttcaaaagtttacag

SEQ ID NO: 9243196 - DNA, 22 bp, Homo sapiens
tgcagttttgccaggcaatgga

SEQ ID NO: 9243197 - DNA, 22 bp, Homo sapiens
tgcagttctatcacccaccccg

SEQ ID NO: 9243198 - DNA, 22 bp, Homo sapiens
tgcagttctatcacccaccccg

SEQ ID NO: 9243199 - DNA, 22 bp, Homo sapiens
tgcagttctaagtagacaagtc

SEQ ID NO: 9243200 - DNA, 22 bp, Homo sapiens
tgcagtttaaacttggcaactt

SEQ ID NO: 9243201 - DNA, 22 bp, Homo sapiens
tgcagtttgccctttgctcact

SEQ ID NO: 9243202 - DNA, 20 bp, Homo sapiens
tgcagtttgtcaaggttcct

SEQ ID NO: 9243203 - DNA, 22 bp, Homo sapiens
tgcatagaggatccagtgtggt

SEQ ID NO: 9243204 - DNA, 19 bp, Homo sapiens
tgcataaattatatacttt

SEQ ID NO: 9243205 - DNA, 22 bp, Homo sapiens
tgcataatggatgatttcacaa

SEQ ID NO: 9243206 - DNA, 22 bp, Homo sapiens
tgcatctgattctcaggcagaa

SEQ ID NO: 9243207 - DNA, 22 bp, Homo sapiens
tgcatctgttcagagctgtcga

SEQ ID NO: 9243208 - DNA, 22 bp, Homo sapiens
tgcatctgtagtggaaacctta

SEQ ID NO: 9243209 - DNA, 22 bp, Homo sapiens
tgcatccttcccatttaaacca

SEQ ID NO: 9243210 - DNA, 22 bp, Homo sapiens
tgcatcagagtttgctgctgct

SEQ ID NO: 9243211 - DNA, 22 bp, Homo sapiens
tgcatcatataatgtctatgga

SEQ ID NO: 9243212 - DNA, 22 bp, Homo sapiens
tgcatcatttataatgtctttg

SEQ ID NO: 9243213 - DNA, 22 bp, Homo sapiens
tgccagagttacatgagggtca

SEQ ID NO: 9243214 - DNA, 22 bp, Homo sapiens
tgccagatgcaggaggtaaggc

SEQ ID NO: 9243215 - DNA, 23 bp, Homo sapiens
tgccagaggcagtcacagtggtg

SEQ ID NO: 9243216 - DNA, 22 bp, Homo sapiens
tgccagcacttctggctgtctg

SEQ ID NO: 9243217 - DNA, 22 bp, Homo sapiens
tgccagagccaggctttaggaa

SEQ ID NO: 9243218 - DNA, 23 bp, Homo sapiens
tgccagaggcagtcacagtggtg

SEQ ID NO: 9243219 - DNA, 19 bp, Homo sapiens
tgccagagatactcccaga

SEQ ID NO: 9243220 - DNA, 22 bp, Homo sapiens
tgccagagagtggctgggtgtc

SEQ ID NO: 9243221 - DNA, 22 bp, Homo sapiens
tgccagagaagacccagtcact

SEQ ID NO: 9243222 - DNA, 22 bp, Homo sapiens
tgccagagaagacccagtcact

SEQ ID NO: 9243223 - DNA, 22 bp, Homo sapiens
tgccagagaatcacctctcctt

SEQ ID NO: 9243224 - DNA, 22 bp, Homo sapiens
tgccagagaggagaaagcattt

SEQ ID NO: 9243225 - DNA, 21 bp, Homo sapiens
tgccagcatgtaggctagttg

SEQ ID NO: 9243226 - DNA, 19 bp, Homo sapiens
tgccagcattaggctgaag

SEQ ID NO: 9243227 - DNA, 21 bp, Homo sapiens
tgccagcatgtaggctagttg

SEQ ID NO: 9243228 - DNA, 22 bp, Homo sapiens
tgccagcagtagcagtaggcca

SEQ ID NO: 9243229 - DNA, 22 bp, Homo sapiens
tgccacagtttcatggattctg

SEQ ID NO: 9243230 - DNA, 22 bp, Homo sapiens
tgccacagtttcatggattctg

SEQ ID NO: 9243231 - DNA, 22 bp, Homo sapiens
tgccacagttgtttgtgctcta

SEQ ID NO: 9243232 - DNA, 22 bp, Homo sapiens
tgccacagttgtttgtgctcta

SEQ ID NO: 9243233 - DNA, 22 bp, Homo sapiens
tgccaccatctggctgtgttga

SEQ ID NO: 9243234 - DNA, 22 bp, Homo sapiens
tgccagagaagacccagtcact

SEQ ID NO: 9243235 - DNA, 22 bp, Homo sapiens
tgccactggacccagaactctt

SEQ ID NO: 9243236 - DNA, 22 bp, Homo sapiens
tgccactggctcaatggtgcag

SEQ ID NO: 9243237 - DNA, 22 bp, Homo sapiens
tgccactggctcaatggtgcag

SEQ ID NO: 9243238 - DNA, 22 bp, Homo sapiens
tgccactgggcatgcagatgtc

SEQ ID NO: 9243239 - DNA, 22 bp, Homo sapiens
tgcattcctttgtctgttaaag

SEQ ID NO: 9243240 - DNA, 22 bp, Homo sapiens
tgcattcctttctaggatagct

SEQ ID NO: 9243241 - DNA, 22 bp, Homo sapiens
tgcattctatgatatcaaaaca

SEQ ID NO: 9243242 - DNA, 22 bp, Homo sapiens
tgcattctgacttagttaatat

SEQ ID NO: 9243243 - DNA, 22 bp, Homo sapiens
tgcattgggttgacatactaaa

SEQ ID NO: 9243244 - DNA, 22 bp, Homo sapiens
tgcattggaaactcagcagcac

SEQ ID NO: 9243245 - DNA, 22 bp, Homo sapiens
tgcatttagttatgagaaaaac

SEQ ID NO: 9243246 - DNA, 18 bp, Homo sapiens
tgcatttagtacatctag

SEQ ID NO: 9243247 - DNA, 22 bp, Homo sapiens
tgcattgtttagaactctttgg

SEQ ID NO: 9243248 - DNA, 17 bp, Homo sapiens
tgcattgtaggctagcc

SEQ ID NO: 9243249 - DNA, 22 bp, Homo sapiens
tgcattgtaggatgtttagcag

SEQ ID NO: 9243250 - DNA, 22 bp, Homo sapiens
tgcatttaagaaaacatgagtc

SEQ ID NO: 9243251 - DNA, 22 bp, Homo sapiens
tgcattttcttccaccaatatc

SEQ ID NO: 9243252 - DNA, 22 bp, Homo sapiens
tgcatttggggcagactagcag

SEQ ID NO: 9243253 - DNA, 22 bp, Homo sapiens
tgcatttttaacaaggctaatt

SEQ ID NO: 9243254 - DNA, 22 bp, Homo sapiens
tgcatttttgaggttaactcaa

SEQ ID NO: 9243255 - DNA, 22 bp, Homo sapiens
tgccaaaatggccaaaagctag

SEQ ID NO: 9243256 - DNA, 22 bp, Homo sapiens
tgccaaaatgggctttataccg

SEQ ID NO: 9243257 - DNA, 22 bp, Homo sapiens
tgcatttccagatttctggagt

SEQ ID NO: 9243258 - DNA, 22 bp, Homo sapiens
tgcatttcagaagaaaattcgg

SEQ ID NO: 9243259 - DNA, 22 bp, Homo sapiens
tgcatttcttttgagtatatgc

SEQ ID NO: 9243260 - DNA, 22 bp, Homo sapiens
tgcatttcacagactgagaaat

SEQ ID NO: 9243261 - DNA, 22 bp, Homo sapiens
tgcctcagagacctgacagtac

SEQ ID NO: 9243262 - DNA, 22 bp, Homo sapiens
tgcctcagagacctgacagtac

SEQ ID NO: 9243263 - DNA, 22 bp, Homo sapiens
tgcctcagagacctgacagtac

SEQ ID NO: 9243264 - DNA, 22 bp, Homo sapiens
tgcctcagagtgggcttgctat

SEQ ID NO: 9243265 - DNA, 22 bp, Homo sapiens
tgcctaggaaacctcatgcttc

SEQ ID NO: 9243266 - DNA, 22 bp, Homo sapiens
tgcctaggaaacctcatgcttc

SEQ ID NO: 9243267 - DNA, 22 bp, Homo sapiens
tgcctagaactttattctttat

SEQ ID NO: 9243268 - DNA, 22 bp, Homo sapiens
tgcctaggctggaatgcagtgg

SEQ ID NO: 9243269 - DNA, 22 bp, Homo sapiens
tgcctaggaaacctcatgcttc

SEQ ID NO: 9243270 - DNA, 22 bp, Homo sapiens
tgcctaggctggagtgcaatgg

SEQ ID NO: 9243271 - DNA, 22 bp, Homo sapiens
tgcctaggctggagtgtagtgg

SEQ ID NO: 9243272 - DNA, 22 bp, Homo sapiens
tgcctagggcctaaccagagcc

SEQ ID NO: 9243273 - DNA, 22 bp, Homo sapiens
tgcctaactccaccaggcaggt

SEQ ID NO: 9243274 - DNA, 22 bp, Homo sapiens
tgcctacattccttgcttatgg

SEQ ID NO: 9243275 - DNA, 22 bp, Homo sapiens
tgccgctgtcgccaccatggct

SEQ ID NO: 9243276 - DNA, 22 bp, Homo sapiens
tgccgcagtgcggggagggccc

SEQ ID NO: 9243277 - DNA, 22 bp, Homo sapiens
tgccctgggaacacagatgcca

SEQ ID NO: 9243278 - DNA, 22 bp, Homo sapiens
tgccctggctggagtgcagtgg

SEQ ID NO: 9243279 - DNA, 22 bp, Homo sapiens
tgccctgtcgctcactcccacc

SEQ ID NO: 9243280 - DNA, 22 bp, Homo sapiens
tgccctgtctaagctgtcagta

SEQ ID NO: 9243281 - DNA, 22 bp, Homo sapiens
tgccctgtctaagctgtcagta

SEQ ID NO: 9243282 - DNA, 22 bp, Homo sapiens
tgccgcagtgcggggagggccc

SEQ ID NO: 9243283 - DNA, 22 bp, Homo sapiens
tgcccttgaaatacgcttgggg

SEQ ID NO: 9243284 - DNA, 22 bp, Homo sapiens
tgcccttgggatttaggtaagg

SEQ ID NO: 9243285 - DNA, 22 bp, Homo sapiens
tgcccttaggaaggctcaccaa

SEQ ID NO: 9243286 - DNA, 22 bp, Homo sapiens
tgcccttataaaggaggcctga

SEQ ID NO: 9243287 - DNA, 22 bp, Homo sapiens
tgcccttatgaaagaggcccaa

SEQ ID NO: 9243288 - DNA, 22 bp, Homo sapiens
tgccctgttcctgcctccagct

SEQ ID NO: 9243289 - DNA, 22 bp, Homo sapiens
tgcccttacacatggaaaggga

SEQ ID NO: 9243290 - DNA, 22 bp, Homo sapiens
tgccctgttcctgcctccagct

SEQ ID NO: 9243291 - DNA, 22 bp, Homo sapiens
tgccctgtgccagacttcctgg

SEQ ID NO: 9243292 - DNA, 22 bp, Homo sapiens
tgccctgtgtgtgcaagcactg

SEQ ID NO: 9243293 - DNA, 22 bp, Homo sapiens
tgccctgttatcttggaagagt

SEQ ID NO: 9243294 - DNA, 22 bp, Homo sapiens
tgcccctcttgctggccctgtc

SEQ ID NO: 9243295 - DNA, 19 bp, Homo sapiens
tgccccttaagagtttctc

SEQ ID NO: 9243296 - DNA, 22 bp, Homo sapiens
tgccccttctacccgtctctgt

SEQ ID NO: 9243297 - DNA, 22 bp, Homo sapiens
tgccctgcagtgagtgcgtctg

SEQ ID NO: 9243298 - DNA, 22 bp, Homo sapiens
tgccctgccaagaccaagtggt

SEQ ID NO: 9243299 - DNA, 22 bp, Homo sapiens
tgccctgcatgcagggagctgt

SEQ ID NO: 9243300 - DNA, 22 bp, Homo sapiens
tgccctgccaagactcagtggt

SEQ ID NO: 9243301 - DNA, 22 bp, Homo sapiens
tgccctgcggctatctagatga

SEQ ID NO: 9243302 - DNA, 22 bp, Homo sapiens
tgccctgctaaccttggttcca

SEQ ID NO: 9243303 - DNA, 22 bp, Homo sapiens
tgccctgctgtgcctggagcca

SEQ ID NO: 9243304 - DNA, 22 bp, Homo sapiens
tgccctggctcctcccacgctg

SEQ ID NO: 9243305 - DNA, 22 bp, Homo sapiens
tgccctggcacacacacagctg

SEQ ID NO: 9243306 - DNA, 22 bp, Homo sapiens
tgccctggcattgggttggata

SEQ ID NO: 9243307 - DNA, 22 bp, Homo sapiens
tgccctggaaatgagaggtgtg

SEQ ID NO: 9243308 - DNA, 22 bp, Homo sapiens
tgccctgctgtggctctgccca

SEQ ID NO: 9243309 - DNA, 22 bp, Homo sapiens
tgccctgctgtggctctgccca

SEQ ID NO: 9243310 - DNA, 22 bp, Homo sapiens
tgcctctgtgggccttcctggc

SEQ ID NO: 9243311 - DNA, 22 bp, Homo sapiens
tgcctctgtgggccttcctggc

SEQ ID NO: 9243312 - DNA, 22 bp, Homo sapiens
tgcctctgtgggcagagctgcc

SEQ ID NO: 9243313 - DNA, 22 bp, Homo sapiens
tgcctctgtgggccttcctggc

SEQ ID NO: 9243314 - DNA, 22 bp, Homo sapiens
tgcctctgtgggcagagctgcc

SEQ ID NO: 9243315 - DNA, 22 bp, Homo sapiens
tgcctctggttatctggtacct

SEQ ID NO: 9243316 - DNA, 22 bp, Homo sapiens
tgcctctggttatctggtacct

SEQ ID NO: 9243317 - DNA, 22 bp, Homo sapiens
tgcctctgggtgaccaaggagc

SEQ ID NO: 9243318 - DNA, 22 bp, Homo sapiens
tgcctcttggagcctttcctct

SEQ ID NO: 9243319 - DNA, 22 bp, Homo sapiens
tgcctgaacatgaatagtttat

SEQ ID NO: 9243320 - DNA, 22 bp, Homo sapiens
tgcctgaacatgaatagtttat

SEQ ID NO: 9243321 - DNA, 22 bp, Homo sapiens
tgcctgaattcaattcctggct

SEQ ID NO: 9243322 - DNA, 22 bp, Homo sapiens
tgcctgaatgatcagtcagatt

SEQ ID NO: 9243323 - DNA, 22 bp, Homo sapiens
tgcctgaggtggtctgcaaatg

SEQ ID NO: 9243324 - DNA, 22 bp, Homo sapiens
tgcctgagtgatgtggcagcca

SEQ ID NO: 9243325 - DNA, 22 bp, Homo sapiens
tgcctgagtgatgtggcagcca

SEQ ID NO: 9243326 - DNA, 22 bp, Homo sapiens
tgcctgaggagtcagggcaggt

SEQ ID NO: 9243327 - DNA, 22 bp, Homo sapiens
tgcctctgaggaagattgtgtt

SEQ ID NO: 9243328 - DNA, 22 bp, Homo sapiens
tgcctctgaggaagattgtgtt

SEQ ID NO: 9243329 - DNA, 22 bp, Homo sapiens
tgcctctgcctccattgttagt

SEQ ID NO: 9243330 - DNA, 23 bp, Homo sapiens
tgcctctgcctccctagtctgca

SEQ ID NO: 9243331 - DNA, 23 bp, Homo sapiens
tgcctctgcctccctagtctgca

SEQ ID NO: 9243332 - DNA, 22 bp, Homo sapiens
tgcctcgtgtctgagtctgttc

SEQ ID NO: 9243333 - DNA, 22 bp, Homo sapiens
tgcctccctggcaagtctctcc

SEQ ID NO: 9243334 - DNA, 22 bp, Homo sapiens
tgcctcagctgaggccgctcca

SEQ ID NO: 9243335 - DNA, 22 bp, Homo sapiens
tgcctcagagttgtccctacca

SEQ ID NO: 9243336 - DNA, 22 bp, Homo sapiens
tgcctcagagtgggcttgctat

SEQ ID NO: 9243337 - DNA, 22 bp, Homo sapiens
tgcctcagctgaggccgctcca

SEQ ID NO: 9243338 - DNA, 22 bp, Homo sapiens
tgcctcagctgaggccgctcca

SEQ ID NO: 9243339 - DNA, 22 bp, Homo sapiens
tgcctcagctgaggccgctcca

SEQ ID NO: 9243340 - DNA, 22 bp, Homo sapiens
tgcctcaggcacctggcaggtt

SEQ ID NO: 9243341 - DNA, 22 bp, Homo sapiens
tgcctcaggcacctggcaggtt

SEQ ID NO: 9243342 - DNA, 22 bp, Homo sapiens
tgcctcagtcagcttccctggg

SEQ ID NO: 9243343 - DNA, 22 bp, Homo sapiens
tgcctcagtctaaagtctctca

SEQ ID NO: 9243344 - DNA, 19 bp, Homo sapiens
tgcctcagggctttgagga

SEQ ID NO: 9243345 - DNA, 22 bp, Homo sapiens
tgcctcaggcacctggcaggtt

SEQ ID NO: 9243346 - DNA, 22 bp, Homo sapiens
tgcctcagtcagcttccctggg

SEQ ID NO: 9243347 - DNA, 22 bp, Homo sapiens
tgcctcagtcagcttccctggg

SEQ ID NO: 9243348 - DNA, 19 bp, Homo sapiens
tgcctcagggctttgagga

SEQ ID NO: 9243349 - DNA, 22 bp, Homo sapiens
tgcctgcttgtttacctactcc

SEQ ID NO: 9243350 - DNA, 22 bp, Homo sapiens
tgcctgcttgtgtacctggtga

SEQ ID NO: 9243351 - DNA, 22 bp, Homo sapiens
tgcctgctgccactgctgttac

SEQ ID NO: 9243352 - DNA, 22 bp, Homo sapiens
tgcctgccccacaaggggttgc

SEQ ID NO: 9243353 - DNA, 22 bp, Homo sapiens
tgcctgctgattggagttgaat

SEQ ID NO: 9243354 - DNA, 22 bp, Homo sapiens
tgcctgctttctgggctgccat

SEQ ID NO: 9243355 - DNA, 22 bp, Homo sapiens
tgcctgccatgcagaaagctga

SEQ ID NO: 9243356 - DNA, 22 bp, Homo sapiens
tgcctgccaggtgcttcttcat

SEQ ID NO: 9243357 - DNA, 22 bp, Homo sapiens
tgcctgagtttaaccctcagag

SEQ ID NO: 9243358 - DNA, 22 bp, Homo sapiens
tgcctgatgcaggagtatcaga

SEQ ID NO: 9243359 - DNA, 22 bp, Homo sapiens
tgcctgatgcaggagtatcaga

SEQ ID NO: 9243360 - DNA, 22 bp, Homo sapiens
tgcctgcaagagttggggctac

SEQ ID NO: 9243361 - DNA, 22 bp, Homo sapiens
tgcctggcaactgtggtgggct

SEQ ID NO: 9243362 - DNA, 22 bp, Homo sapiens
tgcctggatgtgctggcctcac

SEQ ID NO: 9243363 - DNA, 22 bp, Homo sapiens
tgcctggcaatgccagaagcca

SEQ ID NO: 9243364 - DNA, 22 bp, Homo sapiens
tgcctggcaccccagtctgcac

SEQ ID NO: 9243365 - DNA, 19 bp, Homo sapiens
tgcccccagcacctccctg

SEQ ID NO: 9243366 - DNA, 20 bp, Homo sapiens
tgccccaggcctgcacctgc

SEQ ID NO: 9243367 - DNA, 20 bp, Homo sapiens
tgccccaggcctgcacctgc

SEQ ID NO: 9243368 - DNA, 22 bp, Homo sapiens
tgccccagactctgctcacctc

SEQ ID NO: 9243369 - DNA, 22 bp, Homo sapiens
tgccccagacctactgaatggg

SEQ ID NO: 9243370 - DNA, 22 bp, Homo sapiens
tgcccagggtggagtgcagcgg

SEQ ID NO: 9243371 - DNA, 22 bp, Homo sapiens
tgcccagggtggagtgcagtgg

SEQ ID NO: 9243372 - DNA, 22 bp, Homo sapiens
tgcccagggtggagtgcagtgg

SEQ ID NO: 9243373 - DNA, 22 bp, Homo sapiens
tgcccaggtttgagtgcccaag

SEQ ID NO: 9243374 - DNA, 22 bp, Homo sapiens
tgcccaggtttgagtgcccaag

SEQ ID NO: 9243375 - DNA, 22 bp, Homo sapiens
tgcccatgtttctctgtatccc

SEQ ID NO: 9243376 - DNA, 22 bp, Homo sapiens
tgcccaggcttcaccctcagag

SEQ ID NO: 9243377 - DNA, 22 bp, Homo sapiens
tgcccaggctggagtgcagagg

SEQ ID NO: 9243378 - DNA, 22 bp, Homo sapiens
tgcccaggctggagtgcagagg

SEQ ID NO: 9243379 - DNA, 22 bp, Homo sapiens
tgcccaggctggagtgcagagg

SEQ ID NO: 9243380 - DNA, 22 bp, Homo sapiens
tgcccaggctggagtgcagtgg

SEQ ID NO: 9243381 - DNA, 22 bp, Homo sapiens
tgcccaggctggagtgcagtgg

SEQ ID NO: 9243382 - DNA, 19 bp, Homo sapiens
tgcccaggccaggttgggc

SEQ ID NO: 9243383 - DNA, 19 bp, Homo sapiens
tgcccaggccaggttgggc

SEQ ID NO: 9243384 - DNA, 22 bp, Homo sapiens
tgcccaggattgtgaggtcagg

SEQ ID NO: 9243385 - DNA, 22 bp, Homo sapiens
tgcccaggattgtgaggtcagg

SEQ ID NO: 9243386 - DNA, 22 bp, Homo sapiens
tgcccaggctcctcgcagcctt

SEQ ID NO: 9243387 - DNA, 22 bp, Homo sapiens
tgcccaggctggaatgcagtgg

SEQ ID NO: 9243388 - DNA, 22 bp, Homo sapiens
tgcccaggctggagtacagtgg

SEQ ID NO: 9243389 - DNA, 22 bp, Homo sapiens
tgcccagcacccagcatgatgc

SEQ ID NO: 9243390 - DNA, 22 bp, Homo sapiens
tgcccagcaataaaccagaaga

SEQ ID NO: 9243391 - DNA, 22 bp, Homo sapiens
tgcccagcactgtgccagtcac

SEQ ID NO: 9243392 - DNA, 22 bp, Homo sapiens
tgcccacattctgaagctccct

SEQ ID NO: 9243393 - DNA, 22 bp, Homo sapiens
tgcccacctttactgtgattta

SEQ ID NO: 9243394 - DNA, 22 bp, Homo sapiens
tgcccacctaacagtgtttgga

SEQ ID NO: 9243395 - DNA, 18 bp, Homo sapiens
tgcccaccagaagaggga

SEQ ID NO: 9243396 - DNA, 20 bp, Homo sapiens
tgcccagcaagagtgcagtt

SEQ ID NO: 9243397 - DNA, 20 bp, Homo sapiens
tgcccagcaagagtgcagtt

SEQ ID NO: 9243398 - DNA, 18 bp, Homo sapiens
tgcccagaaaagcaggga

SEQ ID NO: 9243399 - DNA, 20 bp, Homo sapiens
tgcccacatcactcaggagt

SEQ ID NO: 9243400 - DNA, 22 bp, Homo sapiens
tgccatttctttcaatattctt

SEQ ID NO: 9243401 - DNA, 20 bp, Homo sapiens
tgccatggtaacagagtgtg

SEQ ID NO: 9243402 - DNA, 22 bp, Homo sapiens
tgccaggctccggaacgacagt

SEQ ID NO: 9243403 - DNA, 20 bp, Homo sapiens
tgccaggctgcacgcctgcc

SEQ ID NO: 9243404 - DNA, 22 bp, Homo sapiens
tgccaggctgaacagggtctta

SEQ ID NO: 9243405 - DNA, 22 bp, Homo sapiens
tgccaggctgaacagggtctta

SEQ ID NO: 9243406 - DNA, 22 bp, Homo sapiens
tgccaggctgtcctgggcctgg

SEQ ID NO: 9243407 - DNA, 22 bp, Homo sapiens
tgccaggctgtcaattcaccca

SEQ ID NO: 9243408 - DNA, 20 bp, Homo sapiens
tgccaggctgcacgcctgcc

SEQ ID NO: 9243409 - DNA, 22 bp, Homo sapiens
tgccaggctgccctccagtctg

SEQ ID NO: 9243410 - DNA, 22 bp, Homo sapiens
tgccaggcttagagcaggggct

SEQ ID NO: 9243411 - DNA, 22 bp, Homo sapiens
tgccaggctttggtcaaaggct

SEQ ID NO: 9243412 - DNA, 22 bp, Homo sapiens
tgccaggctttggtcaaaggct

SEQ ID NO: 9243413 - DNA, 22 bp, Homo sapiens
tgccagggagccctgctgacca

SEQ ID NO: 9243414 - DNA, 21 bp, Homo sapiens
tgccagggatttacagagcct

SEQ ID NO: 9243415 - DNA, 22 bp, Homo sapiens
tgccagggagccctgctgacca

SEQ ID NO: 9243416 - DNA, 20 bp, Homo sapiens
tgccagggccagcagaggct

SEQ ID NO: 9243417 - DNA, 22 bp, Homo sapiens
tgccagggccatagggagtcta

SEQ ID NO: 9243418 - DNA, 22 bp, Homo sapiens
tgccaggggacctagggatgtc

SEQ ID NO: 9243419 - DNA, 22 bp, Homo sapiens
tgccaggggacctagggatgtc

SEQ ID NO: 9243420 - DNA, 23 bp, Homo sapiens
tgccagggccctgtgtgcaatgc

SEQ ID NO: 9243421 - DNA, 22 bp, Homo sapiens
tgccagggtcagctgcagctct

SEQ ID NO: 9243422 - DNA, 22 bp, Homo sapiens
tgccagggtcctgagggccttg

SEQ ID NO: 9243423 - DNA, 22 bp, Homo sapiens
tgccagggtgtcaggagagcta

SEQ ID NO: 9243424 - DNA, 22 bp, Homo sapiens
tgccagtcagtggtttaaaagt

SEQ ID NO: 9243425 - DNA, 22 bp, Homo sapiens
tgccatccaacagttccatctt

SEQ ID NO: 9243426 - DNA, 22 bp, Homo sapiens
tgccatggaagtggccagacct

SEQ ID NO: 9243427 - DNA, 22 bp, Homo sapiens
tgccatcttccttcctctgcac

SEQ ID NO: 9243428 - DNA, 22 bp, Homo sapiens
tgccatctgcacccacctgccc

SEQ ID NO: 9243429 - DNA, 22 bp, Homo sapiens
tgccatctgcacccacctgccc

SEQ ID NO: 9243430 - DNA, 22 bp, Homo sapiens
tgccatctcttcctcgtgctgc

SEQ ID NO: 9243431 - DNA, 20 bp, Homo sapiens
tgccaggcacggagtgcatg

SEQ ID NO: 9243432 - DNA, 22 bp, Homo sapiens
tgccaggcacgtgagagtggcc

SEQ ID NO: 9243433 - DNA, 22 bp, Homo sapiens
tgccaggcaggaccctagaacc

SEQ ID NO: 9243434 - DNA, 22 bp, Homo sapiens
tgccaggcacgtgagagtggcc

SEQ ID NO: 9243435 - DNA, 22 bp, Homo sapiens
tgccaggcaggaccctagaacc

SEQ ID NO: 9243436 - DNA, 22 bp, Homo sapiens
tgccaggcagtgtcagattgag

SEQ ID NO: 9243437 - DNA, 22 bp, Homo sapiens
tgccaggcatatggcctctttg

SEQ ID NO: 9243438 - DNA, 22 bp, Homo sapiens
tgccaggcatgtagtagacttg

SEQ ID NO: 9243439 - DNA, 22 bp, Homo sapiens
tgccaggcatatggcctctttg

SEQ ID NO: 9243440 - DNA, 22 bp, Homo sapiens
tgccaggcatgtagtagacttg

SEQ ID NO: 9243441 - DNA, 22 bp, Homo sapiens
tgccagctcccttttctcctcc

SEQ ID NO: 9243442 - DNA, 22 bp, Homo sapiens
tgccaggcaactgcccagccat

SEQ ID NO: 9243443 - DNA, 20 bp, Homo sapiens
tgccaggcacggagtgcatg

SEQ ID NO: 9243444 - DNA, 22 bp, Homo sapiens
tgccaggcccagctccagagct

SEQ ID NO: 9243445 - DNA, 22 bp, Homo sapiens
tgccaggcccagcagggcggcc

SEQ ID NO: 9243446 - DNA, 22 bp, Homo sapiens
tgccaggcccagctccagagct

SEQ ID NO: 9243447 - DNA, 22 bp, Homo sapiens
tgccaggcccagcagggcggcc

SEQ ID NO: 9243448 - DNA, 22 bp, Homo sapiens
tgccaggccacgtagcttcaag

SEQ ID NO: 9243449 - DNA, 22 bp, Homo sapiens
tgccaggccaatgaaggcaggg

SEQ ID NO: 9243450 - DNA, 22 bp, Homo sapiens
tgccaggccaattctatttgac

SEQ ID NO: 9243451 - DNA, 22 bp, Homo sapiens
tgccaggccaatgaaggcaggg

SEQ ID NO: 9243452 - DNA, 22 bp, Homo sapiens
tgccaggcatttgacagacact

SEQ ID NO: 9243453 - DNA, 22 bp, Homo sapiens
tgccaggccctgtgctggatgc

SEQ ID NO: 9243454 - DNA, 22 bp, Homo sapiens
tgccaggctaagtggaggactt

SEQ ID NO: 9243455 - DNA, 22 bp, Homo sapiens
tgccaggccctgtgctggatgc

SEQ ID NO: 9243456 - DNA, 22 bp, Homo sapiens
tgccaggctaagtggaggactt

SEQ ID NO: 9243457 - DNA, 22 bp, Homo sapiens
tgccaggctcagcccctatctt

SEQ ID NO: 9243458 - DNA, 22 bp, Homo sapiens
tgccaggctcaggatgtccctg

SEQ ID NO: 9243459 - DNA, 22 bp, Homo sapiens
tgccaggcccagctccagagct

SEQ ID NO: 9243460 - DNA, 22 bp, Homo sapiens
tgccaggccctcccacagatta

SEQ ID NO: 9243461 - DNA, 22 bp, Homo sapiens
tgccaggccctgtgctggatgc

SEQ ID NO: 9243462 - DNA, 22 bp, Homo sapiens
tgccaggccctgcggggtccca

SEQ ID NO: 9243463 - DNA, 22 bp, Homo sapiens
tgatgggaggtgctgcaggacc

SEQ ID NO: 9243464 - DNA, 22 bp, Homo sapiens
tgatgggaggtgctgcaggacc

SEQ ID NO: 9243465 - DNA, 22 bp, Homo sapiens
tgatgggactgccagctgctga

SEQ ID NO: 9243466 - DNA, 22 bp, Homo sapiens
tgatgggaaaatgaggcctggg

SEQ ID NO: 9243467 - DNA, 23 bp, Homo sapiens
tgatgggaaggaacgactaccac

SEQ ID NO: 9243468 - DNA, 22 bp, Homo sapiens
tgatgggaaaatgaggcctggg

SEQ ID NO: 9243469 - DNA, 22 bp, Homo sapiens
tgatgggaaaatgaggcctggg

SEQ ID NO: 9243470 - DNA, 22 bp, Homo sapiens
tgatgggaggtgctgcaggacc

SEQ ID NO: 9243471 - DNA, 20 bp, Homo sapiens
tgatggtattaggaggtgtg

SEQ ID NO: 9243472 - DNA, 22 bp, Homo sapiens
tgatggtcaggatgcatggaga

SEQ ID NO: 9243473 - DNA, 22 bp, Homo sapiens
tgatggaaatgttctgtatctg

SEQ ID NO: 9243474 - DNA, 22 bp, Homo sapiens
tgatgaatgtcatacataatga

SEQ ID NO: 9243475 - DNA, 18 bp, Homo sapiens
tgatctttgagtataatg

SEQ ID NO: 9243476 - DNA, 18 bp, Homo sapiens
tgatctttgagtataatg

SEQ ID NO: 9243477 - DNA, 22 bp, Homo sapiens
tgatctttggtagtacgataat

SEQ ID NO: 9243478 - DNA, 22 bp, Homo sapiens
tgatctttttggtcatttgggt

SEQ ID NO: 9243479 - DNA, 22 bp, Homo sapiens
tgatgatttcatttctagctgt

SEQ ID NO: 9243480 - DNA, 22 bp, Homo sapiens
tgatgcattgccgacttactgg

SEQ ID NO: 9243481 - DNA, 22 bp, Homo sapiens
tgatgcccccaaatctggctca

SEQ ID NO: 9243482 - DNA, 22 bp, Homo sapiens
tgatgctgagcctgggactgac

SEQ ID NO: 9243483 - DNA, 22 bp, Homo sapiens
tgatgcctatgaattgtaatgt

SEQ ID NO: 9243484 - DNA, 22 bp, Homo sapiens
tgatttaaaagaaacattgtct

SEQ ID NO: 9243485 - DNA, 22 bp, Homo sapiens
tgattgtatgattgaaatattt

SEQ ID NO: 9243486 - DNA, 21 bp, Homo sapiens
tgattgatatttgcaaacaga

SEQ ID NO: 9243487 - DNA, 21 bp, Homo sapiens
tgattctgttttatcatcagc

SEQ ID NO: 9243488 - DNA, 22 bp, Homo sapiens
tgattctgtaaacatgtcttta

SEQ ID NO: 9243489 - DNA, 22 bp, Homo sapiens
tgattctttgaccaaaaaattg

SEQ ID NO: 9243490 - DNA, 22 bp, Homo sapiens
tgattcctaggcactcttctcc

SEQ ID NO: 9243491 - DNA, 22 bp, Homo sapiens
tgattcatcagaataggagttt

SEQ ID NO: 9243492 - DNA, 19 bp, Homo sapiens
tgattcatctaactgcctc

SEQ ID NO: 9243493 - DNA, 21 bp, Homo sapiens
tgattctgcatttctaacagg

SEQ ID NO: 9243494 - DNA, 22 bp, Homo sapiens
tgattctgatcatcatcatggt

SEQ ID NO: 9243495 - DNA, 23 bp, Homo sapiens
tgattctgctttgagaatcatgg

SEQ ID NO: 9243496 - DNA, 22 bp, Homo sapiens
tgattcagtctcttcaggagaa

SEQ ID NO: 9243497 - DNA, 22 bp, Homo sapiens
tgattaactgtctattaatcat

SEQ ID NO: 9243498 - DNA, 22 bp, Homo sapiens
tgattacaaaagattgtttgaa

SEQ ID NO: 9243499 - DNA, 23 bp, Homo sapiens
tgattacaagggccaaagaaagg

SEQ ID NO: 9243500 - DNA, 22 bp, Homo sapiens
tgatgtctgccagggtcctggg

SEQ ID NO: 9243501 - DNA, 22 bp, Homo sapiens
tgatgtagctggtattcacgtg

SEQ ID NO: 9243502 - DNA, 22 bp, Homo sapiens
tgattaaaatttaacttagtta

SEQ ID NO: 9243503 - DNA, 22 bp, Homo sapiens
tgatgtttaatactatgctttt

SEQ ID NO: 9243504 - DNA, 22 bp, Homo sapiens
tgagtgagctggggagccggtg

SEQ ID NO: 9243505 - DNA, 22 bp, Homo sapiens
tgagtgaggtgcttagggcaca

SEQ ID NO: 9243506 - DNA, 22 bp, Homo sapiens
tgagtgaaattctggtaaagga

SEQ ID NO: 9243507 - DNA, 22 bp, Homo sapiens
tgagtgaattcaagtaaagggc

SEQ ID NO: 9243508 - DNA, 19 bp, Homo sapiens
tgagtgaaggccgtggtgg

SEQ ID NO: 9243509 - DNA, 22 bp, Homo sapiens
tgagtgcctgaacatagagtag

SEQ ID NO: 9243510 - DNA, 22 bp, Homo sapiens
tgagtgctctgtatgtgccaga

SEQ ID NO: 9243511 - DNA, 20 bp, Homo sapiens
tgagtgctccattctgccca

SEQ ID NO: 9243512 - DNA, 22 bp, Homo sapiens
tgagtgaggtgcttagggcaca

SEQ ID NO: 9243513 - DNA, 22 bp, Homo sapiens
tgagtgggacctgcgtgtgtca

SEQ ID NO: 9243514 - DNA, 22 bp, Homo sapiens
tgagtgggattaaatgaggtga

SEQ ID NO: 9243515 - DNA, 19 bp, Homo sapiens
tgagtgggagcccaggtat

SEQ ID NO: 9243516 - DNA, 22 bp, Homo sapiens
tgagttatggagaataaagtca

SEQ ID NO: 9243517 - DNA, 22 bp, Homo sapiens
tgagttattgagaaataactgc

SEQ ID NO: 9243518 - DNA, 22 bp, Homo sapiens
tgagttatctaaaatagtcaaa

SEQ ID NO: 9243519 - DNA, 22 bp, Homo sapiens
tgagttatctaaaatagtcaaa

SEQ ID NO: 9243520 - DNA, 22 bp, Homo sapiens
tgagttaaatgagaacatgaaa

SEQ ID NO: 9243521 - DNA, 22 bp, Homo sapiens
tgagttataatgaatatttgaa

SEQ ID NO: 9243522 - DNA, 22 bp, Homo sapiens
tgagttatatatactggctctg

SEQ ID NO: 9243523 - DNA, 22 bp, Homo sapiens
tgagttagctctattcttttgg

SEQ ID NO: 9243524 - DNA, 19 bp, Homo sapiens
tgagtgtgtgtttctctaa

SEQ ID NO: 9243525 - DNA, 22 bp, Homo sapiens
tgagtgttgtaaccatatgatt

SEQ ID NO: 9243526 - DNA, 22 bp, Homo sapiens
tgagtgtatatgaaggttgtaa

SEQ ID NO: 9243527 - DNA, 19 bp, Homo sapiens
tgagtgggcccctgcagac

SEQ ID NO: 9243528 - DNA, 22 bp, Homo sapiens
tgagtgggattaaatgaggtga

SEQ ID NO: 9243529 - DNA, 22 bp, Homo sapiens
tgatcacaagtctgaagaatga

SEQ ID NO: 9243530 - DNA, 22 bp, Homo sapiens
tgatcacaagtctgaagaatga

SEQ ID NO: 9243531 - DNA, 22 bp, Homo sapiens
tgatcaaaacattactccacca

SEQ ID NO: 9243532 - DNA, 22 bp, Homo sapiens
tgatatttttcactggcctctg

SEQ ID NO: 9243533 - DNA, 22 bp, Homo sapiens
tgatcaaaacattactccacca

SEQ ID NO: 9243534 - DNA, 22 bp, Homo sapiens
tgatattttatgagctttcata

SEQ ID NO: 9243535 - DNA, 22 bp, Homo sapiens
tgatcagacagttatgtgcatg

SEQ ID NO: 9243536 - DNA, 22 bp, Homo sapiens
tgatctggtcctactgtgggca

SEQ ID NO: 9243537 - DNA, 22 bp, Homo sapiens
tgatcccaatctttcctgctcc

SEQ ID NO: 9243538 - DNA, 22 bp, Homo sapiens
tgatctcctgaccttgtaatcc

SEQ ID NO: 9243539 - DNA, 22 bp, Homo sapiens
tgatctaggttggcttcaactg

SEQ ID NO: 9243540 - DNA, 22 bp, Homo sapiens
tgatagaatcagataaaaggat

SEQ ID NO: 9243541 - DNA, 22 bp, Homo sapiens
tgatagaaaggaaattaattgg

SEQ ID NO: 9243542 - DNA, 22 bp, Homo sapiens
tgatacttttcttttagactaa

SEQ ID NO: 9243543 - DNA, 22 bp, Homo sapiens
tgagttctcatgaaatctagtt

SEQ ID NO: 9243544 - DNA, 22 bp, Homo sapiens
tgagttctcacccattcttctt

SEQ ID NO: 9243545 - DNA, 22 bp, Homo sapiens
tgatatgcatgtaagggagaca

SEQ ID NO: 9243546 - DNA, 22 bp, Homo sapiens
tgatatgtaactactccttata

SEQ ID NO: 9243547 - DNA, 22 bp, Homo sapiens
tgatatgtgaagctattagttc

SEQ ID NO: 9243548 - DNA, 22 bp, Homo sapiens
tgatatttgctgactgcattgt

SEQ ID NO: 9243549 - DNA, 22 bp, Homo sapiens
tgatatttgctgactgcattgt

SEQ ID NO: 9243550 - DNA, 22 bp, Homo sapiens
tgatatttaagcaaaaatatgg

SEQ ID NO: 9243551 - DNA, 20 bp, Homo sapiens
tgatatttctggaagtggag

SEQ ID NO: 9243552 - DNA, 20 bp, Homo sapiens
tgcaaacacagagtgtatga

SEQ ID NO: 9243553 - DNA, 20 bp, Homo sapiens
tgcaaacacagagtgtatga

SEQ ID NO: 9243554 - DNA, 22 bp, Homo sapiens
tgcaaacaatttcctataaagt

SEQ ID NO: 9243555 - DNA, 22 bp, Homo sapiens
tgcaaacaccacagagacaatt

SEQ ID NO: 9243556 - DNA, 17 bp, Homo sapiens
tgcaaacaatcacatat

SEQ ID NO: 9243557 - DNA, 23 bp, Homo sapiens
tgcaaaatttgcagagttcgatg

SEQ ID NO: 9243558 - DNA, 22 bp, Homo sapiens
tgcaaaatgacttctgaaaaga

SEQ ID NO: 9243559 - DNA, 23 bp, Homo sapiens
tgcaaaatttgcagagttcgatg

SEQ ID NO: 9243560 - DNA, 23 bp, Homo sapiens
tgcaaaatttgcagagttcgatg

SEQ ID NO: 9243561 - DNA, 22 bp, Homo sapiens
tgcaaacaactgtttaatgctg

SEQ ID NO: 9243562 - DNA, 22 bp, Homo sapiens
tgcaaactagcatcaactagta

SEQ ID NO: 9243563 - DNA, 22 bp, Homo sapiens
tgcaaacaggcatttcacaaac

SEQ ID NO: 9243564 - DNA, 22 bp, Homo sapiens
tgcaaacagttaagatgcaggc

SEQ ID NO: 9243565 - DNA, 22 bp, Homo sapiens
tgcaaacagttaagatgcaggc

SEQ ID NO: 9243566 - DNA, 22 bp, Homo sapiens
tgcaaatgcccatttattttct

SEQ ID NO: 9243567 - DNA, 22 bp, Homo sapiens
tgcaaagaagcaacatccttgt

SEQ ID NO: 9243568 - DNA, 22 bp, Homo sapiens
tgcaaagaagcctttgccttct

SEQ ID NO: 9243569 - DNA, 22 bp, Homo sapiens
tgcaaagatgaaatattaaagg

SEQ ID NO: 9243570 - DNA, 22 bp, Homo sapiens
tgcaaagatgaaatattaaagg

SEQ ID NO: 9243571 - DNA, 22 bp, Homo sapiens
tgcaaatttaatgaaactatgt

SEQ ID NO: 9243572 - DNA, 18 bp, Homo sapiens
tgcaaatggctgtttgat

SEQ ID NO: 9243573 - DNA, 22 bp, Homo sapiens
tgcaaaataatgaacgattttt

SEQ ID NO: 9243574 - DNA, 22 bp, Homo sapiens
tgcaaaaactgcaattgctttt

SEQ ID NO: 9243575 - DNA, 22 bp, Homo sapiens
tgatttttagctattctgaaga

SEQ ID NO: 9243576 - DNA, 22 bp, Homo sapiens
tgatttttagctattctgaaga

SEQ ID NO: 9243577 - DNA, 22 bp, Homo sapiens
tgatttttggatctgagctgca

SEQ ID NO: 9243578 - DNA, 22 bp, Homo sapiens
tgattttgaggtttcaggtctt

SEQ ID NO: 9243579 - DNA, 22 bp, Homo sapiens
tgattttgaggtttcaggtctt

SEQ ID NO: 9243580 - DNA, 22 bp, Homo sapiens
tgatttacagtagtgtctaaac

SEQ ID NO: 9243581 - DNA, 22 bp, Homo sapiens
tgatttaggaaacagctacagg

SEQ ID NO: 9243582 - DNA, 22 bp, Homo sapiens
tgatttatgcattatactgttg

SEQ ID NO: 9243583 - DNA, 22 bp, Homo sapiens
tgatttcaagccagggggcgtt

SEQ ID NO: 9243584 - DNA, 23 bp, Homo sapiens
tgatttccagtgagtcagtggga

SEQ ID NO: 9243585 - DNA, 22 bp, Homo sapiens
tgcaacattattaaactaagca

SEQ ID NO: 9243586 - DNA, 22 bp, Homo sapiens
tgcaagaaaggtggggccaggc

SEQ ID NO: 9243587 - DNA, 17 bp, Homo sapiens
tgcaagaagattaggaa

SEQ ID NO: 9243588 - DNA, 23 bp, Homo sapiens
tgcaagagttccaaactgttcaa

SEQ ID NO: 9243589 - DNA, 22 bp, Homo sapiens
tgcaagactcctcactttctct

SEQ ID NO: 9243590 - DNA, 21 bp, Homo sapiens
tgcaagaatcaggaagctgcc

SEQ ID NO: 9243591 - DNA, 22 bp, Homo sapiens
tgcaagatcacggtgttgagag

SEQ ID NO: 9243592 - DNA, 20 bp, Homo sapiens
tgcaagatgggtggggagaa

SEQ ID NO: 9243593 - DNA, 22 bp, Homo sapiens
tgcaagatcttgtctctgccac

SEQ ID NO: 9243594 - DNA, 19 bp, Homo sapiens
tgcaagctttttcttgtta

SEQ ID NO: 9243595 - DNA, 22 bp, Homo sapiens
tgcaaggaagggacagctgaga

SEQ ID NO: 9243596 - DNA, 22 bp, Homo sapiens
tgcaaggctgcctctgaggacc

SEQ ID NO: 9243597 - DNA, 22 bp, Homo sapiens
tgcaagggcttagggggctgtg

SEQ ID NO: 9243598 - DNA, 22 bp, Homo sapiens
tgcaagggcttagggggctgtg

SEQ ID NO: 9243599 - DNA, 22 bp, Homo sapiens
tgcaaggggtttatgcagatga

SEQ ID NO: 9243600 - DNA, 22 bp, Homo sapiens
tgcaagggtgtttgagctgccc

SEQ ID NO: 9243601 - DNA, 21 bp, Homo sapiens
tgcaatccagcctgggcgaca

SEQ ID NO: 9243602 - DNA, 21 bp, Homo sapiens
tgcaatccagcctgggcgaca

SEQ ID NO: 9243603 - DNA, 22 bp, Homo sapiens
tgcaattaatttacatgcttaa

SEQ ID NO: 9243604 - DNA, 21 bp, Homo sapiens
tgcaatgcattgacagcagca

SEQ ID NO: 9243605 - DNA, 22 bp, Homo sapiens
tgcaatgagaatatattaacca

SEQ ID NO: 9243606 - DNA, 22 bp, Homo sapiens
tgcaatttggcttccattttct

SEQ ID NO: 9243607 - DNA, 22 bp, Homo sapiens
tgcaatttcaggcatatattgt

SEQ ID NO: 9243608 - DNA, 22 bp, Homo sapiens
tgcaatttcaggcatatattgt

SEQ ID NO: 9243609 - DNA, 22 bp, Homo sapiens
tgcacacaagttggagaatgaa

SEQ ID NO: 9243610 - DNA, 22 bp, Homo sapiens
tgcacacaaatgtgaacgtgcc

SEQ ID NO: 9243611 - DNA, 17 bp, Homo sapiens
tgcacaagagacaatag

SEQ ID NO: 9243612 - DNA, 22 bp, Homo sapiens
tgcacaaatttgtgtatgctca

SEQ ID NO: 9243613 - DNA, 22 bp, Homo sapiens
tgcaattttaatacattagagg

SEQ ID NO: 9243614 - DNA, 22 bp, Homo sapiens
tgcacacactcgtgtatatgag

SEQ ID NO: 9243615 - DNA, 22 bp, Homo sapiens
tgcacacactctgcatatactt

SEQ ID NO: 9243616 - DNA, 22 bp, Homo sapiens
tgcacacactctgcatatactt

SEQ ID NO: 9243617 - DNA, 22 bp, Homo sapiens
tgcacacacatgaagtagcatg

SEQ ID NO: 9243618 - DNA, 22 bp, Homo sapiens
tgcacacacatgaagtagcatg

SEQ ID NO: 9243619 - DNA, 22 bp, Homo sapiens
tgcacacacgcggcacatctgt

SEQ ID NO: 9243620 - DNA, 21 bp, Homo sapiens
tgcacagggcccaggagagcc

SEQ ID NO: 9243621 - DNA, 21 bp, Homo sapiens
tgcacagggcccaggagagcc

SEQ ID NO: 9243622 - DNA, 22 bp, Homo sapiens
tgcacaggccttgaagggagag

SEQ ID NO: 9243623 - DNA, 22 bp, Homo sapiens
tgcacagctggctctccttttc

SEQ ID NO: 9243624 - DNA, 23 bp, Homo sapiens
tgcacaggacggccttataagta

SEQ ID NO: 9243625 - DNA, 22 bp, Homo sapiens
tgcacacagttctcaggaaaga

SEQ ID NO: 9243626 - DNA, 22 bp, Homo sapiens
tgcacagtgtaatgaatcagaa

SEQ ID NO: 9243627 - DNA, 22 bp, Homo sapiens
tgcaccagagcagggtgcccaa

SEQ ID NO: 9243628 - DNA, 22 bp, Homo sapiens
tgcaccagtttctcagagaatc

SEQ ID NO: 9243629 - DNA, 21 bp, Homo sapiens
tgcacctgttcactgcagttc

SEQ ID NO: 9243630 - DNA, 21 bp, Homo sapiens
tgcacctgtgccccatccttc

SEQ ID NO: 9243631 - DNA, 22 bp, Homo sapiens
tgcacctgagaggtctctgagg

SEQ ID NO: 9243632 - DNA, 22 bp, Homo sapiens
tgcagaaggaggaggaaatcca

SEQ ID NO: 9243633 - DNA, 22 bp, Homo sapiens
tgcagaaggcctgacattgcac

SEQ ID NO: 9243634 - DNA, 22 bp, Homo sapiens
tgcagaagtgagtcatgaggaa

SEQ ID NO: 9243635 - DNA, 22 bp, Homo sapiens
tgcagaagtattccaggcccca

SEQ ID NO: 9243636 - DNA, 22 bp, Homo sapiens
tgcagaagtgagtcatgaggaa

SEQ ID NO: 9243637 - DNA, 22 bp, Homo sapiens
tgcagaagcagagccggtggcc

SEQ ID NO: 9243638 - DNA, 22 bp, Homo sapiens
tgcagaagcagagagttgccaa

SEQ ID NO: 9243639 - DNA, 22 bp, Homo sapiens
tgcagaagctgcaggtcagtgg

SEQ ID NO: 9243640 - DNA, 22 bp, Homo sapiens
tgcagaagatggtctgagcacc

SEQ ID NO: 9243641 - DNA, 19 bp, Homo sapiens
tgcagaagacacagtggtg

SEQ ID NO: 9243642 - DNA, 19 bp, Homo sapiens
tgcagaagacacagtggtg

SEQ ID NO: 9243643 - DNA, 22 bp, Homo sapiens
tgcagaagaccttccagggctg

SEQ ID NO: 9243644 - DNA, 22 bp, Homo sapiens
tgcagaagacacaaggtaacgt

SEQ ID NO: 9243645 - DNA, 22 bp, Homo sapiens
tgcagaagaatgtaggcataag

SEQ ID NO: 9243646 - DNA, 22 bp, Homo sapiens
tgcagaagaatgagcttggagt

SEQ ID NO: 9243647 - DNA, 20 bp, Homo sapiens
tgcagaagaacgttctggtt

SEQ ID NO: 9243648 - DNA, 22 bp, Homo sapiens
tgcagaagaaaacagctgtgtg

SEQ ID NO: 9243649 - DNA, 22 bp, Homo sapiens
tgcagaacagggccatgtcacc

SEQ ID NO: 9243650 - DNA, 22 bp, Homo sapiens
tgcagaacagggccatgtcacc

SEQ ID NO: 9243651 - DNA, 22 bp, Homo sapiens
tgcagaaccagtcctcagaccc

SEQ ID NO: 9243652 - DNA, 22 bp, Homo sapiens
tgcagaaaccaattcaagtaag

SEQ ID NO: 9243653 - DNA, 22 bp, Homo sapiens
tgcagaaataactcatattgca

SEQ ID NO: 9243654 - DNA, 22 bp, Homo sapiens
tgcacgtgggctctctgctctt

SEQ ID NO: 9243655 - DNA, 22 bp, Homo sapiens
tgcacctttaaattcagcagta

SEQ ID NO: 9243656 - DNA, 22 bp, Homo sapiens
tgcaccttgtccatttttggcc

SEQ ID NO: 9243657 - DNA, 22 bp, Homo sapiens
tgcacgtgtgagcattcacatg

SEQ ID NO: 9243658 - DNA, 22 bp, Homo sapiens
tgcagaaacaagccatcattca

SEQ ID NO: 9243659 - DNA, 22 bp, Homo sapiens
tgcactactgtgatacacagcc

SEQ ID NO: 9243660 - DNA, 18 bp, Homo sapiens
tgcactagatgctggcag

SEQ ID NO: 9243661 - DNA, 18 bp, Homo sapiens
tgcactagatgctggcag

SEQ ID NO: 9243662 - DNA, 22 bp, Homo sapiens
tgcagagggagtgacggttcac

SEQ ID NO: 9243663 - DNA, 22 bp, Homo sapiens
tgcagagggaaaaggtgctcct

SEQ ID NO: 9243664 - DNA, 22 bp, Homo sapiens
tgcagagggacagccacagctc

SEQ ID NO: 9243665 - DNA, 22 bp, Homo sapiens
tgcagagggacagccacagctc

SEQ ID NO: 9243666 - DNA, 22 bp, Homo sapiens
tgcagagggacagccacagctc

SEQ ID NO: 9243667 - DNA, 22 bp, Homo sapiens
tgcagagtagctataccatttt

SEQ ID NO: 9243668 - DNA, 19 bp, Homo sapiens
tgcagagggtaggaaggcc

SEQ ID NO: 9243669 - DNA, 22 bp, Homo sapiens
tgcagagtggattctgtatacc

SEQ ID NO: 9243670 - DNA, 23 bp, Homo sapiens
tgcagagtgtcacttgaaaacca

SEQ ID NO: 9243671 - DNA, 22 bp, Homo sapiens
tgcagagttgctttgatagtcc

SEQ ID NO: 9243672 - DNA, 22 bp, Homo sapiens
tgcagcaccacacctggctaat

SEQ ID NO: 9243673 - DNA, 22 bp, Homo sapiens
tgcagattcaaatgaaatgcaa

SEQ ID NO: 9243674 - DNA, 22 bp, Homo sapiens
tgcagattcaaatgaaatgcaa

SEQ ID NO: 9243675 - DNA, 22 bp, Homo sapiens
tgcagattcaaatgaaatgcaa

SEQ ID NO: 9243676 - DNA, 22 bp, Homo sapiens
tgcagcaagcaagtatggttct

SEQ ID NO: 9243677 - DNA, 18 bp, Homo sapiens
tgcagcaagtgctaaata

SEQ ID NO: 9243678 - DNA, 23 bp, Homo sapiens
tgcagaggcatgatcactgctca

SEQ ID NO: 9243679 - DNA, 23 bp, Homo sapiens
tgcagaggcatgatcactgctca

SEQ ID NO: 9243680 - DNA, 22 bp, Homo sapiens
tgcagaggctggctcgccgggt

SEQ ID NO: 9243681 - DNA, 22 bp, Homo sapiens
tgcagaggagctggaaggctgg

SEQ ID NO: 9243682 - DNA, 22 bp, Homo sapiens
tgcagaggagctggaaggctgg

SEQ ID NO: 9243683 - DNA, 22 bp, Homo sapiens
tgcagaggagctggaaggctgg

SEQ ID NO: 9243684 - DNA, 22 bp, Homo sapiens
tgcagaggagtcagcctgggca

SEQ ID NO: 9243685 - DNA, 21 bp, Homo sapiens
tgcagaggcacaaacaagccc

SEQ ID NO: 9243686 - DNA, 22 bp, Homo sapiens
tgcagaggagtcagcctgggca

SEQ ID NO: 9243687 - DNA, 22 bp, Homo sapiens
tgcagaggagtcagcctgggca

SEQ ID NO: 9243688 - DNA, 22 bp, Homo sapiens
tgcagaggagtcagcctgggca

SEQ ID NO: 9243689 - DNA, 22 bp, Homo sapiens
tgcagacctcccatggctgcct

SEQ ID NO: 9243690 - DNA, 21 bp, Homo sapiens
tgcagagatatctgaagcaga

SEQ ID NO: 9243691 - DNA, 20 bp, Homo sapiens
tgcagagctggctggctcct

SEQ ID NO: 9243692 - DNA, 22 bp, Homo sapiens
tgcagagcagcaactgcgtgcg

SEQ ID NO: 9243693 - DNA, 22 bp, Homo sapiens
tgcagagcagcaactgcgtgcg

SEQ ID NO: 9243694 - DNA, 22 bp, Homo sapiens
tgcagagcttcattgcataggc

SEQ ID NO: 9243695 - DNA, 22 bp, Homo sapiens
tgcagagcttcattgcataggc

SEQ ID NO: 9243696 - DNA, 20 bp, Homo sapiens
tgcagagctggctggctcct

SEQ ID NO: 9243697 - DNA, 20 bp, Homo sapiens
tgcagagctggctggctcct

SEQ ID NO: 9243698 - DNA, 20 bp, Homo sapiens
tgcagagctggctggctcct

SEQ ID NO: 9243699 - DNA, 20 bp, Homo sapiens
tgcagagctggctggctcct

SEQ ID NO: 9243700 - DNA, 22 bp, Homo sapiens
tgcagaggagctggaaggctgg

SEQ ID NO: 9243701 - DNA, 21 bp, Homo sapiens
tgcagcagagtaagcagggga

SEQ ID NO: 9243702 - DNA, 22 bp, Homo sapiens
tgcagcagactgagtatgagaa

SEQ ID NO: 9243703 - DNA, 21 bp, Homo sapiens
tgcagcctctgcccagcagtg

SEQ ID NO: 9243704 - DNA, 22 bp, Homo sapiens
tgcagcctggtggtcactggag

SEQ ID NO: 9243705 - DNA, 22 bp, Homo sapiens
tgcagcccttccttcctctggg

SEQ ID NO: 9243706 - DNA, 22 bp, Homo sapiens
tgcagcctagacattctggtca

SEQ ID NO: 9243707 - DNA, 19 bp, Homo sapiens
tgcagccacgtgagagact

SEQ ID NO: 9243708 - DNA, 19 bp, Homo sapiens
tgcagccacgtgagagact

SEQ ID NO: 9243709 - DNA, 23 bp, Homo sapiens
tgcagccactcaggagctcagtg

SEQ ID NO: 9243710 - DNA, 22 bp, Homo sapiens
tgcagccaggaaatatttgctg

SEQ ID NO: 9243711 - DNA, 21 bp, Homo sapiens
tgcagccattcagccctatgc

SEQ ID NO: 9243712 - DNA, 22 bp, Homo sapiens
tgcagccattttctgccaatgc

SEQ ID NO: 9243713 - DNA, 22 bp, Homo sapiens
tgcagccatcgcagagtctgta

SEQ ID NO: 9243714 - DNA, 22 bp, Homo sapiens
tgcagccatcgcagagtctgta

SEQ ID NO: 9243715 - DNA, 22 bp, Homo sapiens
tgcagccatctttcttggagga

SEQ ID NO: 9243716 - DNA, 22 bp, Homo sapiens
tgcagctgatgatacccccatg

SEQ ID NO: 9243717 - DNA, 17 bp, Homo sapiens
tgcagctgctcccaggc

SEQ ID NO: 9243718 - DNA, 22 bp, Homo sapiens
tgcagctgagtcacccagccat

SEQ ID NO: 9243719 - DNA, 22 bp, Homo sapiens
tgcagctgaggccagctatgcc

SEQ ID NO: 9243720 - DNA, 22 bp, Homo sapiens
tgcagctgctggcccaggtgct

SEQ ID NO: 9243721 - DNA, 22 bp, Homo sapiens
tgcagctgcttgattcatcttg

SEQ ID NO: 9243722 - DNA, 22 bp, Homo sapiens
tgcagctgctggtggctgaaag

SEQ ID NO: 9243723 - DNA, 22 bp, Homo sapiens
tgcagctgctggcccaggtgct

SEQ ID NO: 9243724 - DNA, 20 bp, Homo sapiens
tgcagctggtttcacaggga

SEQ ID NO: 9243725 - DNA, 22 bp, Homo sapiens
tgcagctggtttagaactagat

SEQ ID NO: 9243726 - DNA, 22 bp, Homo sapiens
tgcagctggtttagaactagat

SEQ ID NO: 9243727 - DNA, 22 bp, Homo sapiens
tgcagctggtatcccatggatt

SEQ ID NO: 9243728 - DNA, 22 bp, Homo sapiens
tgcagctggtatcccatggatt

SEQ ID NO: 9243729 - DNA, 21 bp, Homo sapiens
tgcagctgacactggtatgcc

SEQ ID NO: 9243730 - DNA, 22 bp, Homo sapiens
tgcagctgacccactccagtcc

SEQ ID NO: 9243731 - DNA, 22 bp, Homo sapiens
tgcagctgaggccagctatgcc

SEQ ID NO: 9243732 - DNA, 22 bp, Homo sapiens
tgcagctgaacctagagtctgt

SEQ ID NO: 9243733 - DNA, 22 bp, Homo sapiens
tgcagctcaggattctcagggc

SEQ ID NO: 9243734 - DNA, 22 bp, Homo sapiens
tgcagctcattgctggggtctg

SEQ ID NO: 9243735 - DNA, 22 bp, Homo sapiens
tgcagctcattgctggggtctg

SEQ ID NO: 9243736 - DNA, 22 bp, Homo sapiens
tgcagctcctctggctgcctga

SEQ ID NO: 9243737 - DNA, 22 bp, Homo sapiens
tgcagcctttagaagttcagat

SEQ ID NO: 9243738 - DNA, 22 bp, Homo sapiens
tgcagccttggcaaccagggac

SEQ ID NO: 9243739 - DNA, 18 bp, Homo sapiens
tgcagcctgtagtcttgt

SEQ ID NO: 9243740 - DNA, 22 bp, Homo sapiens
tgcagccttgcctcctcccagc

SEQ ID NO: 9243741 - DNA, 22 bp, Homo sapiens
tgcagccttggcaaccagggac

SEQ ID NO: 9243742 - DNA, 22 bp, Homo sapiens
tgcaggagcaccagctcaccct

SEQ ID NO: 9243743 - DNA, 22 bp, Homo sapiens
tgcaggagcaccagctcaccct

SEQ ID NO: 9243744 - DNA, 22 bp, Homo sapiens
tgcaggagcagagatggctgga

SEQ ID NO: 9243745 - DNA, 22 bp, Homo sapiens
tgcaggagcagagatggctgga

SEQ ID NO: 9243746 - DNA, 22 bp, Homo sapiens
tgcaggagcccaggaatactat

SEQ ID NO: 9243747 - DNA, 22 bp, Homo sapiens
tgcaggagcccttgggctctgg

SEQ ID NO: 9243748 - DNA, 22 bp, Homo sapiens
tgcaggagagtgagtcagtagg

SEQ ID NO: 9243749 - DNA, 22 bp, Homo sapiens
tgcaggagataatggtgcttag

SEQ ID NO: 9243750 - DNA, 22 bp, Homo sapiens
tgcaggagagctggtctggccc

SEQ ID NO: 9243751 - DNA, 21 bp, Homo sapiens
tgcaggaaagtgctgcgaccc

SEQ ID NO: 9243752 - DNA, 21 bp, Homo sapiens
tgcaggaagtatggtgcctat

SEQ ID NO: 9243753 - DNA, 22 bp, Homo sapiens
tgcaggagaaagtacggagcgt

SEQ ID NO: 9243754 - DNA, 22 bp, Homo sapiens
tgcaggagacataatagggact

SEQ ID NO: 9243755 - DNA, 22 bp, Homo sapiens
tgcagctgttacggaccctgtc

SEQ ID NO: 9243756 - DNA, 22 bp, Homo sapiens
tgcagctgtaacagaggcctca

SEQ ID NO: 9243757 - DNA, 22 bp, Homo sapiens
tgcagctgtaacagaggcctca

SEQ ID NO: 9243758 - DNA, 22 bp, Homo sapiens
tgcagctgtaacagaggcctca

SEQ ID NO: 9243759 - DNA, 22 bp, Homo sapiens
tgcagcttctccaaatattaca

SEQ ID NO: 9243760 - DNA, 23 bp, Homo sapiens
tgcaggctaggaagagagccttc

SEQ ID NO: 9243761 - DNA, 21 bp, Homo sapiens
tgcaggctacttctgactcta

SEQ ID NO: 9243762 - DNA, 22 bp, Homo sapiens
tgcaggagttaagtgctctcct

SEQ ID NO: 9243763 - DNA, 21 bp, Homo sapiens
tgcaggagtgtaatgtgaccc

SEQ ID NO: 9243764 - DNA, 18 bp, Homo sapiens
tgcaggagtgaccccggc

SEQ ID NO: 9243765 - DNA, 21 bp, Homo sapiens
tgcaggagtctgtgagtcagg

SEQ ID NO: 9243766 - DNA, 22 bp, Homo sapiens
tgcaggagttcccctctgcctg

SEQ ID NO: 9243767 - DNA, 22 bp, Homo sapiens
tgcaggagctgctgtcctgctc

SEQ ID NO: 9243768 - DNA, 22 bp, Homo sapiens
tgcaggagccttggacttgaaa

SEQ ID NO: 9243769 - DNA, 19 bp, Homo sapiens
tgcaggaggactgagcaga

SEQ ID NO: 9243770 - DNA, 19 bp, Homo sapiens
tgcaggaggactgagcaga

SEQ ID NO: 9243771 - DNA, 22 bp, Homo sapiens
tgcaggagcttggctctgtccc

SEQ ID NO: 9243772 - DNA, 22 bp, Homo sapiens
tgcaggagctgtgcggtgaggg

SEQ ID NO: 9243773 - DNA, 22 bp, Homo sapiens
tgcaggagctgtgcggtgaggg

SEQ ID NO: 9243774 - DNA, 22 bp, Homo sapiens
tgcaggagtccaatcaggagac

SEQ ID NO: 9243775 - DNA, 21 bp, Homo sapiens
tgcaggagtctgtgagtcagg

SEQ ID NO: 9243776 - DNA, 22 bp, Homo sapiens
tgcaggaggattttgtggagct

SEQ ID NO: 9243777 - DNA, 22 bp, Homo sapiens
tgcaggaggccccatggaaccg

SEQ ID NO: 9243778 - DNA, 22 bp, Homo sapiens
tgcaggagggagggttacagtt

SEQ ID NO: 9243779 - DNA, 22 bp, Homo sapiens
tgcaggaggctttattcaggat

SEQ ID NO: 9243780 - DNA, 22 bp, Homo sapiens
tctataaaactcaagagcaatt

SEQ ID NO: 9243781 - DNA, 22 bp, Homo sapiens
tctataaaactcaagagcaatt

SEQ ID NO: 9243782 - DNA, 22 bp, Homo sapiens
tctataaaactcaagagcaatt

SEQ ID NO: 9243783 - DNA, 22 bp, Homo sapiens
tctataaaactcaagagcaatt

SEQ ID NO: 9243784 - DNA, 22 bp, Homo sapiens
tctataaaactcaagagcaatt

SEQ ID NO: 9243785 - DNA, 22 bp, Homo sapiens
tctataaagggccagatagtag

SEQ ID NO: 9243786 - DNA, 22 bp, Homo sapiens
tctagttttggtatgagatgca

SEQ ID NO: 9243787 - DNA, 19 bp, Homo sapiens
tctagttttgagagacttc

SEQ ID NO: 9243788 - DNA, 22 bp, Homo sapiens
tctagttttctcaaatgacttg

SEQ ID NO: 9243789 - DNA, 19 bp, Homo sapiens
tctagttttgagagacttc

SEQ ID NO: 9243790 - DNA, 22 bp, Homo sapiens
tctagttttagcttgagttgca

SEQ ID NO: 9243791 - DNA, 22 bp, Homo sapiens
tctagtttaagatctgttagtc

SEQ ID NO: 9243792 - DNA, 22 bp, Homo sapiens
tctagttaattcctttggtgtt

SEQ ID NO: 9243793 - DNA, 22 bp, Homo sapiens
tctagttctagatccctgagga

SEQ ID NO: 9243794 - DNA, 22 bp, Homo sapiens
tctagttagtggttgatactgt

SEQ ID NO: 9243795 - DNA, 22 bp, Homo sapiens
tctagttctagatccctgagga

SEQ ID NO: 9243796 - DNA, 22 bp, Homo sapiens
tctaggccgtaggatacagagc

SEQ ID NO: 9243797 - DNA, 22 bp, Homo sapiens
tctagggaggcaatagcaatgt

SEQ ID NO: 9243798 - DNA, 19 bp, Homo sapiens
tctagtcagtcagtcattc

SEQ ID NO: 9243799 - DNA, 22 bp, Homo sapiens
tctagtctcagccttcacctaa

SEQ ID NO: 9243800 - DNA, 22 bp, Homo sapiens
tctagtcattcatgctatgatt

SEQ ID NO: 9243801 - DNA, 22 bp, Homo sapiens
tctagtcatattttttcagtat

SEQ ID NO: 9243802 - DNA, 22 bp, Homo sapiens
tctataaagggccagatagtag

SEQ ID NO: 9243803 - DNA, 22 bp, Homo sapiens
tctataaagggccagatagtag

SEQ ID NO: 9243804 - DNA, 21 bp, Homo sapiens
tctatgcaagaccctagtcct

SEQ ID NO: 9243805 - DNA, 22 bp, Homo sapiens
tctatgtagtgccagctagtat

SEQ ID NO: 9243806 - DNA, 22 bp, Homo sapiens
tctatgtagtgccagctagtat

SEQ ID NO: 9243807 - DNA, 22 bp, Homo sapiens
tctatgtctccaccttcgcaga

SEQ ID NO: 9243808 - DNA, 22 bp, Homo sapiens
tctatgtcagcatctttctacc

SEQ ID NO: 9243809 - DNA, 22 bp, Homo sapiens
tctatgtcctttctcccattcc

SEQ ID NO: 9243810 - DNA, 22 bp, Homo sapiens
tctatgtcactctttggaaaga

SEQ ID NO: 9243811 - DNA, 22 bp, Homo sapiens
tctattactacatcagccaggt

SEQ ID NO: 9243812 - DNA, 22 bp, Homo sapiens
tctattagattattctcaagga

SEQ ID NO: 9243813 - DNA, 22 bp, Homo sapiens
tctatttcgcatataagttttg

SEQ ID NO: 9243814 - DNA, 22 bp, Homo sapiens
tctattcattcaatttagctct

SEQ ID NO: 9243815 - DNA, 22 bp, Homo sapiens
tctattcaggcagagtgcagca

SEQ ID NO: 9243816 - DNA, 22 bp, Homo sapiens
tctatttaccaaatgtagttcc

SEQ ID NO: 9243817 - DNA, 22 bp, Homo sapiens
tctatttacagaaagcagaatt

SEQ ID NO: 9243818 - DNA, 22 bp, Homo sapiens
tctcaaactaacaatgattata

SEQ ID NO: 9243819 - DNA, 18 bp, Homo sapiens
tctcaaaaataatggctt

SEQ ID NO: 9243820 - DNA, 23 bp, Homo sapiens
tctcaaatatgatctgggtcatc

SEQ ID NO: 9243821 - DNA, 22 bp, Homo sapiens
tctcaaatatttggagagagga

SEQ ID NO: 9243822 - DNA, 18 bp, Homo sapiens
tctcaaaaataatggctt

SEQ ID NO: 9243823 - DNA, 22 bp, Homo sapiens
tctatttttatagttgaagtgc

SEQ ID NO: 9243824 - DNA, 22 bp, Homo sapiens
tctattttcttgccaaaactgc

SEQ ID NO: 9243825 - DNA, 22 bp, Homo sapiens
tctcacacttctgtgttgcaca

SEQ ID NO: 9243826 - DNA, 22 bp, Homo sapiens
tctcacacttctgtgttgcaca

SEQ ID NO: 9243827 - DNA, 22 bp, Homo sapiens
tctcacagcaggggccaggtct

SEQ ID NO: 9243828 - DNA, 22 bp, Homo sapiens
tctcacactatttattctgctt

SEQ ID NO: 9243829 - DNA, 22 bp, Homo sapiens
tctcacactatttattctgctt

SEQ ID NO: 9243830 - DNA, 22 bp, Homo sapiens
tctcacactatttcaggtgact

SEQ ID NO: 9243831 - DNA, 22 bp, Homo sapiens
tctcacaccgtccctaaaccat

SEQ ID NO: 9243832 - DNA, 22 bp, Homo sapiens
tctcacactaatgctctatcag

SEQ ID NO: 9243833 - DNA, 22 bp, Homo sapiens
tctcacagcatcattgctcatg

SEQ ID NO: 9243834 - DNA, 19 bp, Homo sapiens
tctcacaagcaacattgtt

SEQ ID NO: 9243835 - DNA, 21 bp, Homo sapiens
tctcacaatatgatgccagat

SEQ ID NO: 9243836 - DNA, 22 bp, Homo sapiens
tctcacacaacatgttactttg

SEQ ID NO: 9243837 - DNA, 22 bp, Homo sapiens
tctcaaatgtaaagcatgattt

SEQ ID NO: 9243838 - DNA, 22 bp, Homo sapiens
tctcaaatggacaatattgtgg

SEQ ID NO: 9243839 - DNA, 20 bp, Homo sapiens
tctaggcaggcaggctcgtg

SEQ ID NO: 9243840 - DNA, 22 bp, Homo sapiens
tctaggaaagcctttcacaact

SEQ ID NO: 9243841 - DNA, 22 bp, Homo sapiens
tctagctttgagatcagtagcc

SEQ ID NO: 9243842 - DNA, 20 bp, Homo sapiens
tctagcttagtgcctgcctc

SEQ ID NO: 9243843 - DNA, 22 bp, Homo sapiens
tctagcttggcgtttgccttct

SEQ ID NO: 9243844 - DNA, 22 bp, Homo sapiens
tctagctctgcttatcatggct

SEQ ID NO: 9243845 - DNA, 22 bp, Homo sapiens
tctagctctgcttatcatggct

SEQ ID NO: 9243846 - DNA, 22 bp, Homo sapiens
tctagacctggcactgccctgt

SEQ ID NO: 9243847 - DNA, 22 bp, Homo sapiens
tctagagccaaagtcttggggg

SEQ ID NO: 9243848 - DNA, 17 bp, Homo sapiens
tctagagcactttgaga

SEQ ID NO: 9243849 - DNA, 22 bp, Homo sapiens
tctactgtggaggcaaatcctt

SEQ ID NO: 9243850 - DNA, 22 bp, Homo sapiens
tctactgcactggtgtctcatc

SEQ ID NO: 9243851 - DNA, 22 bp, Homo sapiens
tctaccctgcggtcttggggca

SEQ ID NO: 9243852 - DNA, 22 bp, Homo sapiens
tctaccagggtcacagaggccc

SEQ ID NO: 9243853 - DNA, 22 bp, Homo sapiens
tctaccctgcggtcttggggca

SEQ ID NO: 9243854 - DNA, 22 bp, Homo sapiens
tctacttttccctatacagttt

SEQ ID NO: 9243855 - DNA, 22 bp, Homo sapiens
tctagaaaaacaaagtatctga

SEQ ID NO: 9243856 - DNA, 22 bp, Homo sapiens
tctagaaaaacaaagtatctga

SEQ ID NO: 9243857 - DNA, 22 bp, Homo sapiens
tctagaaaaccaatattacatg

SEQ ID NO: 9243858 - DNA, 22 bp, Homo sapiens
tctagaaaaccaatattacatg

SEQ ID NO: 9243859 - DNA, 22 bp, Homo sapiens
tctagaaaaccaatattacatg

SEQ ID NO: 9243860 - DNA, 22 bp, Homo sapiens
tctacagagagtcatagactca

SEQ ID NO: 9243861 - DNA, 22 bp, Homo sapiens
tctacacaagtgagtggcacaa

SEQ ID NO: 9243862 - DNA, 22 bp, Homo sapiens
tctacacatttgtaaaggcatt

SEQ ID NO: 9243863 - DNA, 19 bp, Homo sapiens
tctacaaagtggcatcagg

SEQ ID NO: 9243864 - DNA, 19 bp, Homo sapiens
tctacaaagtggcatcagg

SEQ ID NO: 9243865 - DNA, 22 bp, Homo sapiens
tctacaaataaattactatgta

SEQ ID NO: 9243866 - DNA, 22 bp, Homo sapiens
tctacaatgagaaatgatcagt

SEQ ID NO: 9243867 - DNA, 22 bp, Homo sapiens
tctacaggtggggcctggcaat

SEQ ID NO: 9243868 - DNA, 22 bp, Homo sapiens
tctacagggtcagagtttcatg

SEQ ID NO: 9243869 - DNA, 22 bp, Homo sapiens
tctacagggtaaggggcttgcc

SEQ ID NO: 9243870 - DNA, 22 bp, Homo sapiens
tctacagccattttgagcagtg

SEQ ID NO: 9243871 - DNA, 22 bp, Homo sapiens
tctacagtcaagttatattgct

SEQ ID NO: 9243872 - DNA, 22 bp, Homo sapiens
tctacatgatgtaccatctaag

SEQ ID NO: 9243873 - DNA, 22 bp, Homo sapiens
tctacataaaaattcagaaggc

SEQ ID NO: 9243874 - DNA, 21 bp, Homo sapiens
tctacatatcaatatgtaatt

SEQ ID NO: 9243875 - DNA, 22 bp, Homo sapiens
tctacattccttttataatatc

SEQ ID NO: 9243876 - DNA, 22 bp, Homo sapiens
tctacattttcacaaggtctcc

SEQ ID NO: 9243877 - DNA, 22 bp, Homo sapiens
tctacattttaacaagatgccc

SEQ ID NO: 9243878 - DNA, 22 bp, Homo sapiens
tctaagaaagattaagaaattt

SEQ ID NO: 9243879 - DNA, 23 bp, Homo sapiens
tctacaaagctgtgtcaggaccc

SEQ ID NO: 9243880 - DNA, 23 bp, Homo sapiens
tctacaaagctgtgtcaggaccc

SEQ ID NO: 9243881 - DNA, 22 bp, Homo sapiens
tctacaaagccattcaggatct

SEQ ID NO: 9243882 - DNA, 22 bp, Homo sapiens
tctacaaagccattcaggatct

SEQ ID NO: 9243883 - DNA, 22 bp, Homo sapiens
tctaactaactacagtaagagg

SEQ ID NO: 9243884 - DNA, 22 bp, Homo sapiens
tctaacattgtttttcacagat

SEQ ID NO: 9243885 - DNA, 22 bp, Homo sapiens
tctaactaactacagtaagagg

SEQ ID NO: 9243886 - DNA, 22 bp, Homo sapiens
tctaactatacaaagaaaacat

SEQ ID NO: 9243887 - DNA, 22 bp, Homo sapiens
tctaactatacaaagaaaacat

SEQ ID NO: 9243888 - DNA, 22 bp, Homo sapiens
tccttggaggtgttcatctgcc

SEQ ID NO: 9243889 - DNA, 17 bp, Homo sapiens
tccttggcaaccagttc

SEQ ID NO: 9243890 - DNA, 21 bp, Homo sapiens
tccttgctattttcctcagct

SEQ ID NO: 9243891 - DNA, 23 bp, Homo sapiens
tccttgagtgtcccccaagagtc

SEQ ID NO: 9243892 - DNA, 22 bp, Homo sapiens
tccttctttgacaagtggcaga

SEQ ID NO: 9243893 - DNA, 22 bp, Homo sapiens
tccttgaaaatcttggtttaga

SEQ ID NO: 9243894 - DNA, 22 bp, Homo sapiens
tccttgaaaagaatgtctccat

SEQ ID NO: 9243895 - DNA, 22 bp, Homo sapiens
tccttgaaaggggctgcagggc

SEQ ID NO: 9243896 - DNA, 20 bp, Homo sapiens
tccttgaaagtggggtatat

SEQ ID NO: 9243897 - DNA, 22 bp, Homo sapiens
tccttgaagaatgattcttgga

SEQ ID NO: 9243898 - DNA, 22 bp, Homo sapiens
tccttgaacagagggcctgggt

SEQ ID NO: 9243899 - DNA, 22 bp, Homo sapiens
tccttgaagcaacgtgcagaca

SEQ ID NO: 9243900 - DNA, 22 bp, Homo sapiens
tccttgaagagtgggcggtcga

SEQ ID NO: 9243901 - DNA, 22 bp, Homo sapiens
tccttctttccccctagtcatt

SEQ ID NO: 9243902 - DNA, 22 bp, Homo sapiens
tccttgaatggacattacactg

SEQ ID NO: 9243903 - DNA, 22 bp, Homo sapiens
tccttgaattgtgccacttacc

SEQ ID NO: 9243904 - DNA, 22 bp, Homo sapiens
tccttgagagccactgtcttgg

SEQ ID NO: 9243905 - DNA, 22 bp, Homo sapiens
tccttgactgtgaggaactagc

SEQ ID NO: 9243906 - DNA, 22 bp, Homo sapiens
tccttgaagcttgtatctaata

SEQ ID NO: 9243907 - DNA, 22 bp, Homo sapiens
tccttgaagcttgtatctaata

SEQ ID NO: 9243908 - DNA, 22 bp, Homo sapiens
tccttgaatataataacagtag

SEQ ID NO: 9243909 - DNA, 22 bp, Homo sapiens
tccttgaatcctagcatcctat

SEQ ID NO: 9243910 - DNA, 22 bp, Homo sapiens
tccttgaatgaatgttctctcc

SEQ ID NO: 9243911 - DNA, 22 bp, Homo sapiens
tccttgaatgaagagaggtgac

SEQ ID NO: 9243912 - DNA, 22 bp, Homo sapiens
tccttgagccgtggccagggcc

SEQ ID NO: 9243913 - DNA, 22 bp, Homo sapiens
tccttgagaggacagagccata

SEQ ID NO: 9243914 - DNA, 22 bp, Homo sapiens
tccttgagcctcccagactcag

SEQ ID NO: 9243915 - DNA, 22 bp, Homo sapiens
tccttctgtagtccctgtccct

SEQ ID NO: 9243916 - DNA, 22 bp, Homo sapiens
tccttctgtagtccctgtccct

SEQ ID NO: 9243917 - DNA, 22 bp, Homo sapiens
tccttctgaaaaatgcacacga

SEQ ID NO: 9243918 - DNA, 20 bp, Homo sapiens
tccttctgaggtgaggagga

SEQ ID NO: 9243919 - DNA, 22 bp, Homo sapiens
tccttctatttgtttatgtggc

SEQ ID NO: 9243920 - DNA, 22 bp, Homo sapiens
tccttctaccagctggatacct

SEQ ID NO: 9243921 - DNA, 22 bp, Homo sapiens
tccttctacactgcctctgaga

SEQ ID NO: 9243922 - DNA, 22 bp, Homo sapiens
tccttctcctccttgagtgaca

SEQ ID NO: 9243923 - DNA, 22 bp, Homo sapiens
tccttctacactgcctctgaga

SEQ ID NO: 9243924 - DNA, 22 bp, Homo sapiens
tccttccttcctgaaattttag

SEQ ID NO: 9243925 - DNA, 22 bp, Homo sapiens
tccttcctggggtctctgctgc

SEQ ID NO: 9243926 - DNA, 22 bp, Homo sapiens
tccttcagggggccgcctgcac

SEQ ID NO: 9243927 - DNA, 19 bp, Homo sapiens
tccttcagtcagatctggg

SEQ ID NO: 9243928 - DNA, 22 bp, Homo sapiens
tccttcctggggtctctgctgc

SEQ ID NO: 9243929 - DNA, 22 bp, Homo sapiens
tccttcctggggtctctgctgc

SEQ ID NO: 9243930 - DNA, 22 bp, Homo sapiens
tccttcagggggccgcctgcac

SEQ ID NO: 9243931 - DNA, 17 bp, Homo sapiens
tccttcagggcctcaca

SEQ ID NO: 9243932 - DNA, 22 bp, Homo sapiens
tccttcaggcctcattctcata

SEQ ID NO: 9243933 - DNA, 22 bp, Homo sapiens
tccttcagccatgggctctcca

SEQ ID NO: 9243934 - DNA, 22 bp, Homo sapiens
tccttcagctactcagtttcca

SEQ ID NO: 9243935 - DNA, 22 bp, Homo sapiens
tccttcagcttgttagagtgac

SEQ ID NO: 9243936 - DNA, 22 bp, Homo sapiens
tccttcagcttgttagagtgac

SEQ ID NO: 9243937 - DNA, 22 bp, Homo sapiens
tccttcagctctctatttagat

SEQ ID NO: 9243938 - DNA, 22 bp, Homo sapiens
tccttcagctgctaggaaatga

SEQ ID NO: 9243939 - DNA, 20 bp, Homo sapiens
tccttcagacgacaagcaag

SEQ ID NO: 9243940 - DNA, 22 bp, Homo sapiens
tccttcagaggataaggaagaa

SEQ ID NO: 9243941 - DNA, 22 bp, Homo sapiens
tccttcagaggacggcagccag

SEQ ID NO: 9243942 - DNA, 22 bp, Homo sapiens
tccttcagattcctgcttctgg

SEQ ID NO: 9243943 - DNA, 22 bp, Homo sapiens
tccttcagccatgggctctcca

SEQ ID NO: 9243944 - DNA, 22 bp, Homo sapiens
tccttcaccttagccctcctag

SEQ ID NO: 9243945 - DNA, 22 bp, Homo sapiens
tccttcagaaaacctcagtctt

SEQ ID NO: 9243946 - DNA, 22 bp, Homo sapiens
tccttcactccctctgcatcca

SEQ ID NO: 9243947 - DNA, 23 bp, Homo sapiens
tccttcaagttaggaagtgaaca

SEQ ID NO: 9243948 - DNA, 18 bp, Homo sapiens
tccttcacagcaggaagg

SEQ ID NO: 9243949 - DNA, 22 bp, Homo sapiens
tccttcaaaagttgagagagcc

SEQ ID NO: 9243950 - DNA, 22 bp, Homo sapiens
tccttatatggcagacagcaga

SEQ ID NO: 9243951 - DNA, 22 bp, Homo sapiens
tccttatatggcagacagcaga

SEQ ID NO: 9243952 - DNA, 22 bp, Homo sapiens
tccttatatcttcagagaagca

SEQ ID NO: 9243953 - DNA, 22 bp, Homo sapiens
tccttatagttgtctttgaacc

SEQ ID NO: 9243954 - DNA, 22 bp, Homo sapiens
tccttatagcccaagtgatgga

SEQ ID NO: 9243955 - DNA, 22 bp, Homo sapiens
tccttatacctttgctccgctt

SEQ ID NO: 9243956 - DNA, 22 bp, Homo sapiens
tccttatagttgtctttgaacc

SEQ ID NO: 9243957 - DNA, 22 bp, Homo sapiens
tccttatatctatagttttgca

SEQ ID NO: 9243958 - DNA, 22 bp, Homo sapiens
tccttcaaagctcctagtgagc

SEQ ID NO: 9243959 - DNA, 21 bp, Homo sapiens
tccttatatttgaatacttta

SEQ ID NO: 9243960 - DNA, 22 bp, Homo sapiens
tccttagcttacaagtcttctg

SEQ ID NO: 9243961 - DNA, 22 bp, Homo sapiens
tccttagctgtgaaatgagaat

SEQ ID NO: 9243962 - DNA, 18 bp, Homo sapiens
tccttagctgagcttgtc

SEQ ID NO: 9243963 - DNA, 22 bp, Homo sapiens
tccttagccggagcagctcatc

SEQ ID NO: 9243964 - DNA, 22 bp, Homo sapiens
tccttagcccactaatacttat

SEQ ID NO: 9243965 - DNA, 22 bp, Homo sapiens
tccttagccagggcagctcaaa

SEQ ID NO: 9243966 - DNA, 22 bp, Homo sapiens
tccttagcaggcattcaggacc

SEQ ID NO: 9243967 - DNA, 22 bp, Homo sapiens
tccttataacaacaggagtgga

SEQ ID NO: 9243968 - DNA, 22 bp, Homo sapiens
tccttataaatgaggccctggg

SEQ ID NO: 9243969 - DNA, 22 bp, Homo sapiens
tccttaggtatttagcatgaat

SEQ ID NO: 9243970 - DNA, 22 bp, Homo sapiens
tccttaggcaatttgggagagt

SEQ ID NO: 9243971 - DNA, 22 bp, Homo sapiens
tccttacagttaaaatgggagt

SEQ ID NO: 9243972 - DNA, 22 bp, Homo sapiens
tccttagcaacactgttataat

SEQ ID NO: 9243973 - DNA, 22 bp, Homo sapiens
tccttaaatatttactgttaac

SEQ ID NO: 9243974 - DNA, 22 bp, Homo sapiens
tccttaaatgtgatctagattt

SEQ ID NO: 9243975 - DNA, 22 bp, Homo sapiens
tcctttttggtccaaggtgacc

SEQ ID NO: 9243976 - DNA, 22 bp, Homo sapiens
tcctttttatagttagagaaac

SEQ ID NO: 9243977 - DNA, 22 bp, Homo sapiens
tcctttttaagtcgttgtggta

SEQ ID NO: 9243978 - DNA, 22 bp, Homo sapiens
tcgaactcatagtcgtagctgt

SEQ ID NO: 9243979 - DNA, 22 bp, Homo sapiens
tcgaactcatagtcgtagctgt

SEQ ID NO: 9243980 - DNA, 22 bp, Homo sapiens
tcgaaaatgaagagtcaattaa

SEQ ID NO: 9243981 - DNA, 22 bp, Homo sapiens
tcgaatggcaaggaaagaggct

SEQ ID NO: 9243982 - DNA, 22 bp, Homo sapiens
tcgaaggttattgtctttacgt

SEQ ID NO: 9243983 - DNA, 22 bp, Homo sapiens
tcgataatatcttacatgtgct

SEQ ID NO: 9243984 - DNA, 22 bp, Homo sapiens
tcctttggttgtagacaggaat

SEQ ID NO: 9243985 - DNA, 22 bp, Homo sapiens
tcctttgcttctgtcattctcc

SEQ ID NO: 9243986 - DNA, 22 bp, Homo sapiens
tcctttgacttcttgcagtcca

SEQ ID NO: 9243987 - DNA, 22 bp, Homo sapiens
tccttttgctgggatcatcagg

SEQ ID NO: 9243988 - DNA, 22 bp, Homo sapiens
tccttgggaaacatcatgtaat

SEQ ID NO: 9243989 - DNA, 23 bp, Homo sapiens
tccttgggcctgcccagagtggt

SEQ ID NO: 9243990 - DNA, 23 bp, Homo sapiens
tccttgggcctgcccagagtggt

SEQ ID NO: 9243991 - DNA, 22 bp, Homo sapiens
tcctttccctttccatcctggc

SEQ ID NO: 9243992 - DNA, 22 bp, Homo sapiens
tcctttctccagctggcattgt

SEQ ID NO: 9243993 - DNA, 22 bp, Homo sapiens
tcctttctcccaggttagttgt

SEQ ID NO: 9243994 - DNA, 22 bp, Homo sapiens
tcctttcttcttctgcccatgg

SEQ ID NO: 9243995 - DNA, 19 bp, Homo sapiens
tcctttctgttcctgagat

SEQ ID NO: 9243996 - DNA, 19 bp, Homo sapiens
tcctttctgttcctgagat

SEQ ID NO: 9243997 - DNA, 19 bp, Homo sapiens
tcctttgaatatcagttga

SEQ ID NO: 9243998 - DNA, 18 bp, Homo sapiens
tcctttctccctcatctt

SEQ ID NO: 9243999 - DNA, 22 bp, Homo sapiens
tcctttctgtctttactctgga

SEQ ID NO: 9244000 - DNA, 22 bp, Homo sapiens
tcctttctgtgctgtcaggtcc

SEQ ID NO: 9244001 - DNA, 22 bp, Homo sapiens
tctaaagatgtttattgacata

SEQ ID NO: 9244002 - DNA, 22 bp, Homo sapiens
tctaaagatgtttattgacata

SEQ ID NO: 9244003 - DNA, 22 bp, Homo sapiens
tctaaagagagtgggtacatgt

SEQ ID NO: 9244004 - DNA, 22 bp, Homo sapiens
tctaaagagaaccttttctcat

SEQ ID NO: 9244005 - DNA, 22 bp, Homo sapiens
tctaaagatttggattcatttg

SEQ ID NO: 9244006 - DNA, 22 bp, Homo sapiens
tctaaacttcactttaagtgct

SEQ ID NO: 9244007 - DNA, 22 bp, Homo sapiens
tctaaaaaagtctgttcacttg

SEQ ID NO: 9244008 - DNA, 22 bp, Homo sapiens
tctaaaaaagtctgttcacttg

SEQ ID NO: 9244009 - DNA, 22 bp, Homo sapiens
tctaaaatgcagatctactggt

SEQ ID NO: 9244010 - DNA, 22 bp, Homo sapiens
tctaaaatgcagatctactggt

SEQ ID NO: 9244011 - DNA, 23 bp, Homo sapiens
tctaaaattcatcatttacgttc

SEQ ID NO: 9244012 - DNA, 22 bp, Homo sapiens
tcgcccaggctggaagtgcagt

SEQ ID NO: 9244013 - DNA, 22 bp, Homo sapiens
tcgcccaggctggaagtgcagt

SEQ ID NO: 9244014 - DNA, 22 bp, Homo sapiens
tcgtcatctgaaggctgtcaat

SEQ ID NO: 9244015 - DNA, 22 bp, Homo sapiens
tcgtctgtgaaattgggataag

SEQ ID NO: 9244016 - DNA, 22 bp, Homo sapiens
tcgccagggatgctgtaaggaa

SEQ ID NO: 9244017 - DNA, 22 bp, Homo sapiens
tcgcccaggctggaagtgcagt

SEQ ID NO: 9244018 - DNA, 22 bp, Homo sapiens
tcgcccaggatggagtgcagta

SEQ ID NO: 9244019 - DNA, 22 bp, Homo sapiens
tcgcaccattgcactccagcca

SEQ ID NO: 9244020 - DNA, 22 bp, Homo sapiens
tcgcaccattgcactccagcca

SEQ ID NO: 9244021 - DNA, 22 bp, Homo sapiens
tcgcaccattgcactccagcca

SEQ ID NO: 9244022 - DNA, 22 bp, Homo sapiens
tcgtgatctgtccacctcggcc

SEQ ID NO: 9244023 - DNA, 22 bp, Homo sapiens
tcgtgatctgtccacctcggcc

SEQ ID NO: 9244024 - DNA, 21 bp, Homo sapiens
tcgtgcagcagctgaggcttg

SEQ ID NO: 9244025 - DNA, 22 bp, Homo sapiens
tcgtggagaggccatgtggagg

SEQ ID NO: 9244026 - DNA, 19 bp, Homo sapiens
tcgtggggaggtgggcagc

SEQ ID NO: 9244027 - DNA, 22 bp, Homo sapiens
tcgttaaatgctaaaactgaca

SEQ ID NO: 9244028 - DNA, 22 bp, Homo sapiens
tcctgggatttgcccttttctc

SEQ ID NO: 9244029 - DNA, 22 bp, Homo sapiens
tcctgggattaaggtggtgatt

SEQ ID NO: 9244030 - DNA, 22 bp, Homo sapiens
tcctgggattaaggtggtgatt

SEQ ID NO: 9244031 - DNA, 22 bp, Homo sapiens
tcctgggattctgcatttctaa

SEQ ID NO: 9244032 - DNA, 22 bp, Homo sapiens
tcctgggattctgcatttctaa

SEQ ID NO: 9244033 - DNA, 22 bp, Homo sapiens
tcctgggcagaatgggatggct

SEQ ID NO: 9244034 - DNA, 22 bp, Homo sapiens
tcctgggcagcgggacgctcag

SEQ ID NO: 9244035 - DNA, 22 bp, Homo sapiens
tcctgggcagcctctctggaag

SEQ ID NO: 9244036 - DNA, 22 bp, Homo sapiens
tcctgggatcaagtgatcctcc

SEQ ID NO: 9244037 - DNA, 22 bp, Homo sapiens
tcctgggatcaagtgatcctcc

SEQ ID NO: 9244038 - DNA, 22 bp, Homo sapiens
tcctgggagtggccatgtaatg

SEQ ID NO: 9244039 - DNA, 22 bp, Homo sapiens
tcctgggagtggccatgtaatg

SEQ ID NO: 9244040 - DNA, 21 bp, Homo sapiens
tcctgggagtctgagatcctg

SEQ ID NO: 9244041 - DNA, 22 bp, Homo sapiens
tcctgggagtaattgagtcatg

SEQ ID NO: 9244042 - DNA, 22 bp, Homo sapiens
tcctgggagtaattgagtcatg

SEQ ID NO: 9244043 - DNA, 22 bp, Homo sapiens
tcctgggagtaattgagtcatg

SEQ ID NO: 9244044 - DNA, 22 bp, Homo sapiens
tcctggggagggttctggctcc

SEQ ID NO: 9244045 - DNA, 19 bp, Homo sapiens
tcctgggctgggccaggtc

SEQ ID NO: 9244046 - DNA, 22 bp, Homo sapiens
tcctgggctgtgtgccactctg

SEQ ID NO: 9244047 - DNA, 22 bp, Homo sapiens
tcctgggctgtgtgccactctg

SEQ ID NO: 9244048 - DNA, 22 bp, Homo sapiens
tcctgggcgattttctgaatat

SEQ ID NO: 9244049 - DNA, 22 bp, Homo sapiens
tcctgggctgcagggaagagca

SEQ ID NO: 9244050 - DNA, 19 bp, Homo sapiens
tcctgggcgttgactttgg

SEQ ID NO: 9244051 - DNA, 19 bp, Homo sapiens
tcctgggctgcgtcttgcc

SEQ ID NO: 9244052 - DNA, 22 bp, Homo sapiens
tcctgggccaagggctgtgagg

SEQ ID NO: 9244053 - DNA, 22 bp, Homo sapiens
tcctgggcccaggctgccaggg

SEQ ID NO: 9244054 - DNA, 22 bp, Homo sapiens
tcctgggcccaggctgccaggg

SEQ ID NO: 9244055 - DNA, 22 bp, Homo sapiens
tcctgggcccaggctgccaggg

SEQ ID NO: 9244056 - DNA, 22 bp, Homo sapiens
tcctgggcccaggctgccaggg

SEQ ID NO: 9244057 - DNA, 22 bp, Homo sapiens
tcctgggcctgtactccatccg

SEQ ID NO: 9244058 - DNA, 22 bp, Homo sapiens
tcctgggcctgtactccatccg

SEQ ID NO: 9244059 - DNA, 22 bp, Homo sapiens
tcctggctggaatttctcactc

SEQ ID NO: 9244060 - DNA, 22 bp, Homo sapiens
tcctggcttttcttggctcatc

SEQ ID NO: 9244061 - DNA, 21 bp, Homo sapiens
tcctggctttatgctacctct

SEQ ID NO: 9244062 - DNA, 22 bp, Homo sapiens
tcctgggaactcggaaagctct

SEQ ID NO: 9244063 - DNA, 18 bp, Homo sapiens
tcctgggaacttgctagc

SEQ ID NO: 9244064 - DNA, 22 bp, Homo sapiens
tcctgggaagagacctgagcat

SEQ ID NO: 9244065 - DNA, 22 bp, Homo sapiens
tcctgggaagagacctgagcat

SEQ ID NO: 9244066 - DNA, 21 bp, Homo sapiens
tcctgggaagcactggggtgg

SEQ ID NO: 9244067 - DNA, 22 bp, Homo sapiens
tcctgggaagtggctggctgag

SEQ ID NO: 9244068 - DNA, 22 bp, Homo sapiens
tcctgggaagttgcatcaccgt

SEQ ID NO: 9244069 - DNA, 22 bp, Homo sapiens
tcctgggaggctgtgcctggct

SEQ ID NO: 9244070 - DNA, 22 bp, Homo sapiens
tcctgggaggctgtgcctggct

SEQ ID NO: 9244071 - DNA, 22 bp, Homo sapiens
tcctgggaggaacatttaccta

SEQ ID NO: 9244072 - DNA, 22 bp, Homo sapiens
tcctgggaggaacatttaccta

SEQ ID NO: 9244073 - DNA, 22 bp, Homo sapiens
tcctgggaggcaggaccccttt

SEQ ID NO: 9244074 - DNA, 22 bp, Homo sapiens
tcctgggaccctgggtgcagag

SEQ ID NO: 9244075 - DNA, 22 bp, Homo sapiens
tcctgggactctgcctcaggct

SEQ ID NO: 9244076 - DNA, 22 bp, Homo sapiens
tcctgggactcaacttagaagg

SEQ ID NO: 9244077 - DNA, 22 bp, Homo sapiens
tcctggggctctttgatgtgat

SEQ ID NO: 9244078 - DNA, 22 bp, Homo sapiens
tcctggggctctgagcgagaca

SEQ ID NO: 9244079 - DNA, 22 bp, Homo sapiens
tcctggggctgcaaggcctgtc

SEQ ID NO: 9244080 - DNA, 21 bp, Homo sapiens
tcctggggggtaggtgagttt

SEQ ID NO: 9244081 - DNA, 22 bp, Homo sapiens
tcctggggctgcaaggcctgtc

SEQ ID NO: 9244082 - DNA, 20 bp, Homo sapiens
tcctggggtaagccatggtc

SEQ ID NO: 9244083 - DNA, 19 bp, Homo sapiens
tcctggggatgtggtcacc

SEQ ID NO: 9244084 - DNA, 19 bp, Homo sapiens
tcctggggatgtggtcacc

SEQ ID NO: 9244085 - DNA, 22 bp, Homo sapiens
tcctggggaggtcgaggctgag

SEQ ID NO: 9244086 - DNA, 16 bp, Homo sapiens
tcctggggatactgga

SEQ ID NO: 9244087 - DNA, 22 bp, Homo sapiens
tcctggggctcatgggatttgt

SEQ ID NO: 9244088 - DNA, 22 bp, Homo sapiens
tcctggggccaggcacctctgg

SEQ ID NO: 9244089 - DNA, 22 bp, Homo sapiens
tcctggggccagcactggtgga

SEQ ID NO: 9244090 - DNA, 22 bp, Homo sapiens
tcctggggttttggccgcagct

SEQ ID NO: 9244091 - DNA, 22 bp, Homo sapiens
tcctgggtaaacactgaccttt

SEQ ID NO: 9244092 - DNA, 22 bp, Homo sapiens
tcctgggtagagacctgatgaa

SEQ ID NO: 9244093 - DNA, 22 bp, Homo sapiens
tcctgggtagcctgtccaagat

SEQ ID NO: 9244094 - DNA, 22 bp, Homo sapiens
tcctggggtttagagggaagtg

SEQ ID NO: 9244095 - DNA, 22 bp, Homo sapiens
tcctggggtgtgttttgctgct

SEQ ID NO: 9244096 - DNA, 22 bp, Homo sapiens
tcctggggtcctgactgcttcc

SEQ ID NO: 9244097 - DNA, 20 bp, Homo sapiens
tcctggggtaagccatggtc

SEQ ID NO: 9244098 - DNA, 22 bp, Homo sapiens
tcctggtggcagattttaggtc

SEQ ID NO: 9244099 - DNA, 22 bp, Homo sapiens
tcctggtggctctttgggaagg

SEQ ID NO: 9244100 - DNA, 22 bp, Homo sapiens
tcctggtggctctttgggaagg

SEQ ID NO: 9244101 - DNA, 22 bp, Homo sapiens
tcctgggtgtgatattcataga

SEQ ID NO: 9244102 - DNA, 23 bp, Homo sapiens
tcctgggtttgaattctagtctt

SEQ ID NO: 9244103 - DNA, 22 bp, Homo sapiens
tcctgggtccatggcagccgaa

SEQ ID NO: 9244104 - DNA, 22 bp, Homo sapiens
tcctgggtcccgcacatctgtc

SEQ ID NO: 9244105 - DNA, 22 bp, Homo sapiens
tcctgggtctcttccttagttc

SEQ ID NO: 9244106 - DNA, 22 bp, Homo sapiens
tcctgggtggtggtaggagcag

SEQ ID NO: 9244107 - DNA, 22 bp, Homo sapiens
tcctgggtgaaagaacaggcag

SEQ ID NO: 9244108 - DNA, 22 bp, Homo sapiens
tcctggtggtctgtgcttcttc

SEQ ID NO: 9244109 - DNA, 22 bp, Homo sapiens
tcctggtggtctgtgcttcttc

SEQ ID NO: 9244110 - DNA, 22 bp, Homo sapiens
tcctggtgggacagaaaacctc

SEQ ID NO: 9244111 - DNA, 22 bp, Homo sapiens
tcctggtggctttccctgcctt

SEQ ID NO: 9244112 - DNA, 22 bp, Homo sapiens
tcctggtggtgccagctgcagg

SEQ ID NO: 9244113 - DNA, 22 bp, Homo sapiens
tcctggtggtgccggtgcccgg

SEQ ID NO: 9244114 - DNA, 22 bp, Homo sapiens
tcctggtgtaatggtaagcatg

SEQ ID NO: 9244115 - DNA, 22 bp, Homo sapiens
tcctggtggtttgaaaactgaa

SEQ ID NO: 9244116 - DNA, 22 bp, Homo sapiens
tcctggtgtaatggtaagcatg

SEQ ID NO: 9244117 - DNA, 22 bp, Homo sapiens
tcctggtgtcgcctggtcagtt

SEQ ID NO: 9244118 - DNA, 22 bp, Homo sapiens
tcctggtgtcctggtctgctag

SEQ ID NO: 9244119 - DNA, 22 bp, Homo sapiens
tcctggtgtcgcctggtcagtt

SEQ ID NO: 9244120 - DNA, 22 bp, Homo sapiens
tcctggtgttactaaattgaaa

SEQ ID NO: 9244121 - DNA, 22 bp, Homo sapiens
tcctggtgtttatgtcacatag

SEQ ID NO: 9244122 - DNA, 22 bp, Homo sapiens
tcctgtcctctgggtgccccat

SEQ ID NO: 9244123 - DNA, 22 bp, Homo sapiens
tcctgtctaaagacctgcaggc

SEQ ID NO: 9244124 - DNA, 22 bp, Homo sapiens
tcctgtctaaagacctgcaggc

SEQ ID NO: 9244125 - DNA, 22 bp, Homo sapiens
tcctgtctaaagacctgcaggc

SEQ ID NO: 9244126 - DNA, 22 bp, Homo sapiens
tcctgtcctgaggctccaggcc

SEQ ID NO: 9244127 - DNA, 22 bp, Homo sapiens
tcctgtagttgctaagtttgtt

SEQ ID NO: 9244128 - DNA, 22 bp, Homo sapiens
tcctgtcagtgaggcagatgaa

SEQ ID NO: 9244129 - DNA, 22 bp, Homo sapiens
tcctgtatcctgatacaataag

SEQ ID NO: 9244130 - DNA, 22 bp, Homo sapiens
tcctgtgggctctcggcctcca

SEQ ID NO: 9244131 - DNA, 22 bp, Homo sapiens
tcctgtggcgttatcatgtgat

SEQ ID NO: 9244132 - DNA, 17 bp, Homo sapiens
tcctgtgggtgcagcag

SEQ ID NO: 9244133 - DNA, 22 bp, Homo sapiens
tcctgtggtatgggagtgatgt

SEQ ID NO: 9244134 - DNA, 22 bp, Homo sapiens
tcctgtggtatgggagtgatgt

SEQ ID NO: 9244135 - DNA, 22 bp, Homo sapiens
tcctgtggagaggactggaggt

SEQ ID NO: 9244136 - DNA, 22 bp, Homo sapiens
tcctgtggaagacagtgttggg

SEQ ID NO: 9244137 - DNA, 22 bp, Homo sapiens
tcctgtctgctcacagagctgg

SEQ ID NO: 9244138 - DNA, 22 bp, Homo sapiens
tcctgtctcagtgtatttgcag

SEQ ID NO: 9244139 - DNA, 22 bp, Homo sapiens
tcctgtctgctcacagagctgg

SEQ ID NO: 9244140 - DNA, 22 bp, Homo sapiens
tcctgtctgctcacagagctgg

SEQ ID NO: 9244141 - DNA, 22 bp, Homo sapiens
tcctgtctcagtgtatttgcag

SEQ ID NO: 9244142 - DNA, 22 bp, Homo sapiens
tcctgtctaaagacctgcaggc

SEQ ID NO: 9244143 - DNA, 22 bp, Homo sapiens
tcctgtctgtctttggtccctt

SEQ ID NO: 9244144 - DNA, 22 bp, Homo sapiens
tcctgtctgctcacagagctgg

SEQ ID NO: 9244145 - DNA, 22 bp, Homo sapiens
tcctgtctgtctttggtccctt

SEQ ID NO: 9244146 - DNA, 22 bp, Homo sapiens
tcctgtcttaatgatctcgtgc

SEQ ID NO: 9244147 - DNA, 21 bp, Homo sapiens
tcctgtgaggacctgtcagtg

SEQ ID NO: 9244148 - DNA, 22 bp, Homo sapiens
tcctgtcttaatgatctcgtgc

SEQ ID NO: 9244149 - DNA, 22 bp, Homo sapiens
tcctggattctgccctgaaggc

SEQ ID NO: 9244150 - DNA, 22 bp, Homo sapiens
tcctggagtttgtggtgatatg

SEQ ID NO: 9244151 - DNA, 22 bp, Homo sapiens
tcctggagttgtgcagtgcaca

SEQ ID NO: 9244152 - DNA, 22 bp, Homo sapiens
tcctggccaagtagatgtggcg

SEQ ID NO: 9244153 - DNA, 21 bp, Homo sapiens
tcctggccagggcactaggca

SEQ ID NO: 9244154 - DNA, 22 bp, Homo sapiens
tcctggcccactatgccagcat

SEQ ID NO: 9244155 - DNA, 22 bp, Homo sapiens
tcctggccctgtggcctgcagt

SEQ ID NO: 9244156 - DNA, 22 bp, Homo sapiens
tcctggccgccgcgtggggccg

SEQ ID NO: 9244157 - DNA, 22 bp, Homo sapiens
tcctggccctgtggcctgcagt

SEQ ID NO: 9244158 - DNA, 17 bp, Homo sapiens
tcctggctctgccactg

SEQ ID NO: 9244159 - DNA, 22 bp, Homo sapiens
tcctggctctaagtcctgagtg

SEQ ID NO: 9244160 - DNA, 22 bp, Homo sapiens
tcctggctctaagtcctgagtg

SEQ ID NO: 9244161 - DNA, 20 bp, Homo sapiens
tcctggcctccctggggctc

SEQ ID NO: 9244162 - DNA, 22 bp, Homo sapiens
tcctggcctcacagtcctgggt

SEQ ID NO: 9244163 - DNA, 22 bp, Homo sapiens
taagaacagtgtctgtctcaca

SEQ ID NO: 9244164 - DNA, 22 bp, Homo sapiens
taagaacataaattcatacggg

SEQ ID NO: 9244165 - DNA, 23 bp, Homo sapiens
taagaacagacaagcatttacat

SEQ ID NO: 9244166 - DNA, 23 bp, Homo sapiens
taagaacagacaagcatttacat

SEQ ID NO: 9244167 - DNA, 18 bp, Homo sapiens
taagaaggtggctccagc

SEQ ID NO: 9244168 - DNA, 18 bp, Homo sapiens
taagaaggtggctccagc

SEQ ID NO: 9244169 - DNA, 18 bp, Homo sapiens
taagaaggtggctccagc

SEQ ID NO: 9244170 - DNA, 22 bp, Homo sapiens
taagaaggtagtttccaagtca

SEQ ID NO: 9244171 - DNA, 22 bp, Homo sapiens
taagaacttggcagcaagaaat

SEQ ID NO: 9244172 - DNA, 22 bp, Homo sapiens
taagaacattttcggaaagata

SEQ ID NO: 9244173 - DNA, 22 bp, Homo sapiens
taagaatattgggaatggatgg

SEQ ID NO: 9244174 - DNA, 22 bp, Homo sapiens
taagaatcagtagatatagatt

SEQ ID NO: 9244175 - DNA, 22 bp, Homo sapiens
taagaatagtccctagatgtgt

SEQ ID NO: 9244176 - DNA, 22 bp, Homo sapiens
taagaatagtccctagatgtgt

SEQ ID NO: 9244177 - DNA, 22 bp, Homo sapiens
tcctgctggattgtgtctggtg

SEQ ID NO: 9244178 - DNA, 22 bp, Homo sapiens
tcctgctgtttacctacaatgg

SEQ ID NO: 9244179 - DNA, 22 bp, Homo sapiens
tcctgctgtttacctacaatgg

SEQ ID NO: 9244180 - DNA, 22 bp, Homo sapiens
tcctgcttgaaactctgccttc

SEQ ID NO: 9244181 - DNA, 22 bp, Homo sapiens
tcctggaggcaaatgagcacat

SEQ ID NO: 9244182 - DNA, 22 bp, Homo sapiens
tcctggaggcaaatgaagactc

SEQ ID NO: 9244183 - DNA, 22 bp, Homo sapiens
tcctggaggcaaatgaagactc

SEQ ID NO: 9244184 - DNA, 22 bp, Homo sapiens
tcctggagggaggcggtgctac

SEQ ID NO: 9244185 - DNA, 22 bp, Homo sapiens
tcctggagggaggcggtgctac

SEQ ID NO: 9244186 - DNA, 22 bp, Homo sapiens
tcctggagtatttctgtggtgt

SEQ ID NO: 9244187 - DNA, 22 bp, Homo sapiens
tcctggagtatttctgtggtgt

SEQ ID NO: 9244188 - DNA, 22 bp, Homo sapiens
tcctggaggggacagcatgggc

SEQ ID NO: 9244189 - DNA, 22 bp, Homo sapiens
tcctggaggggacagcatgggc

SEQ ID NO: 9244190 - DNA, 22 bp, Homo sapiens
tcctggagggctcacaggcggc

SEQ ID NO: 9244191 - DNA, 22 bp, Homo sapiens
tcctggagaatggacaatgcac

SEQ ID NO: 9244192 - DNA, 22 bp, Homo sapiens
tcctggagaatcctgccacctg

SEQ ID NO: 9244193 - DNA, 22 bp, Homo sapiens
tcctggagagaggcctggaaga

SEQ ID NO: 9244194 - DNA, 22 bp, Homo sapiens
tcctggagataattgcagtgaa

SEQ ID NO: 9244195 - DNA, 22 bp, Homo sapiens
tcctggagagtgggcgagcaca

SEQ ID NO: 9244196 - DNA, 22 bp, Homo sapiens
tcctggaagtgcttggtgaggg

SEQ ID NO: 9244197 - DNA, 19 bp, Homo sapiens
tcctgctttctactctgct

SEQ ID NO: 9244198 - DNA, 22 bp, Homo sapiens
tcctggaacatggataaagaat

SEQ ID NO: 9244199 - DNA, 22 bp, Homo sapiens
tcctggaagatctctgtgagat

SEQ ID NO: 9244200 - DNA, 22 bp, Homo sapiens
tcctggagaagaggggcttgga

SEQ ID NO: 9244201 - DNA, 22 bp, Homo sapiens
tcctggagaaactcagagatct

SEQ ID NO: 9244202 - DNA, 22 bp, Homo sapiens
tctcagaaatactatgttgtca

SEQ ID NO: 9244203 - DNA, 22 bp, Homo sapiens
tctcagaaatgacaggaggtac

SEQ ID NO: 9244204 - DNA, 22 bp, Homo sapiens
tctcagaaatactatgttgtca

SEQ ID NO: 9244205 - DNA, 23 bp, Homo sapiens
tctcagaaaggagaagtaatttg

SEQ ID NO: 9244206 - DNA, 23 bp, Homo sapiens
tctcagaaaggagaagtaatttg

SEQ ID NO: 9244207 - DNA, 22 bp, Homo sapiens
tctcagaacacccttctatggt

SEQ ID NO: 9244208 - DNA, 22 bp, Homo sapiens
tctcagaacctcagtttgctct

SEQ ID NO: 9244209 - DNA, 22 bp, Homo sapiens
tctcagaactttatatgtatca

SEQ ID NO: 9244210 - DNA, 22 bp, Homo sapiens
tctcagaaggcaagggctgggg

SEQ ID NO: 9244211 - DNA, 22 bp, Homo sapiens
tctcagagagatgaaacttcca

SEQ ID NO: 9244212 - DNA, 22 bp, Homo sapiens
tctcacaggtgcacgtggctgt

SEQ ID NO: 9244213 - DNA, 22 bp, Homo sapiens
tctcacagtgagcctgaggtcg

SEQ ID NO: 9244214 - DNA, 19 bp, Homo sapiens
tctcacagtttccttgcct

SEQ ID NO: 9244215 - DNA, 22 bp, Homo sapiens
tctcagaaaagagcttcagaaa

SEQ ID NO: 9244216 - DNA, 22 bp, Homo sapiens
tctcagaaaagagcttcagaaa

SEQ ID NO: 9244217 - DNA, 22 bp, Homo sapiens
tctcagaaaaactttgagggta

SEQ ID NO: 9244218 - DNA, 22 bp, Homo sapiens
tctcagaaaaaggagaaactgg

SEQ ID NO: 9244219 - DNA, 22 bp, Homo sapiens
tctcactgggtcacagcagagg

SEQ ID NO: 9244220 - DNA, 22 bp, Homo sapiens
tctcactgatttgagaccaagg

SEQ ID NO: 9244221 - DNA, 22 bp, Homo sapiens
tctcactcatttcctaggtctt

SEQ ID NO: 9244222 - DNA, 22 bp, Homo sapiens
tctcactgggtataaatgagta

SEQ ID NO: 9244223 - DNA, 22 bp, Homo sapiens
tctcactgcaaatattatgtat

SEQ ID NO: 9244224 - DNA, 22 bp, Homo sapiens
tctcactgggtataaatgagta

SEQ ID NO: 9244225 - DNA, 22 bp, Homo sapiens
tctcagctgactgctttcctcg

SEQ ID NO: 9244226 - DNA, 22 bp, Homo sapiens
tctcagctgcctgccctgctcc

SEQ ID NO: 9244227 - DNA, 22 bp, Homo sapiens
tctcagcctcacctctatggag

SEQ ID NO: 9244228 - DNA, 20 bp, Homo sapiens
tctcaggccccctccttgct

SEQ ID NO: 9244229 - DNA, 22 bp, Homo sapiens
tctcagggccccaaaggctagt

SEQ ID NO: 9244230 - DNA, 22 bp, Homo sapiens
tctcagggcgcagtgaggcagt

SEQ ID NO: 9244231 - DNA, 22 bp, Homo sapiens
tctcagggcagcaaggaagcat

SEQ ID NO: 9244232 - DNA, 22 bp, Homo sapiens
tctcagggagttgaggctgcct

SEQ ID NO: 9244233 - DNA, 22 bp, Homo sapiens
tctcagggagttgaggctgcct

SEQ ID NO: 9244234 - DNA, 22 bp, Homo sapiens
tctcagagtgacaatgagaatt

SEQ ID NO: 9244235 - DNA, 22 bp, Homo sapiens
tctcagagggaaacatgagtga

SEQ ID NO: 9244236 - DNA, 22 bp, Homo sapiens
tctcagagtttagagctgagcc

SEQ ID NO: 9244237 - DNA, 22 bp, Homo sapiens
tctcagggctcagagctcaggc

SEQ ID NO: 9244238 - DNA, 22 bp, Homo sapiens
tctcagggcgcagtgaggcagt

SEQ ID NO: 9244239 - DNA, 22 bp, Homo sapiens
tctcaggtaaaagggtatctac

SEQ ID NO: 9244240 - DNA, 22 bp, Homo sapiens
tctcaggtaagcttctttgatg

SEQ ID NO: 9244241 - DNA, 22 bp, Homo sapiens
tctcaggtggcccccatgagtg

SEQ ID NO: 9244242 - DNA, 23 bp, Homo sapiens
tctcagggtggctgggcccatcc

SEQ ID NO: 9244243 - DNA, 22 bp, Homo sapiens
tctcagtgcagcttgacagaga

SEQ ID NO: 9244244 - DNA, 22 bp, Homo sapiens
tctcagtcagccttgatgtccc

SEQ ID NO: 9244245 - DNA, 22 bp, Homo sapiens
tctcatgatgcctatgcagggt

SEQ ID NO: 9244246 - DNA, 22 bp, Homo sapiens
tctcatctttaaatgaaaattt

SEQ ID NO: 9244247 - DNA, 22 bp, Homo sapiens
tctcatgaaaggtctctcctgg

SEQ ID NO: 9244248 - DNA, 22 bp, Homo sapiens
tctcatgaaaggtctctcctgg

SEQ ID NO: 9244249 - DNA, 22 bp, Homo sapiens
tctcatcttcatatctgaaaga

SEQ ID NO: 9244250 - DNA, 22 bp, Homo sapiens
tctcatcttcatatctgaaaga

SEQ ID NO: 9244251 - DNA, 22 bp, Homo sapiens
tctcatctcggatcagaagtga

SEQ ID NO: 9244252 - DNA, 22 bp, Homo sapiens
tctcatctgcgagctctgccag

SEQ ID NO: 9244253 - DNA, 22 bp, Homo sapiens
tctcatctagactctgcccttg

SEQ ID NO: 9244254 - DNA, 22 bp, Homo sapiens
tctcatctccattatagcatca

SEQ ID NO: 9244255 - DNA, 22 bp, Homo sapiens
tctcatctccattatagcatca

SEQ ID NO: 9244256 - DNA, 22 bp, Homo sapiens
tctcataattaggtaagtcaga

SEQ ID NO: 9244257 - DNA, 22 bp, Homo sapiens
tctcatgttttacctgtcctca

SEQ ID NO: 9244258 - DNA, 22 bp, Homo sapiens
tctcattcataccctacatgct

SEQ ID NO: 9244259 - DNA, 20 bp, Homo sapiens
tctcattatatccaagaggc

SEQ ID NO: 9244260 - DNA, 22 bp, Homo sapiens
tctcatgttttacctgtcctca

SEQ ID NO: 9244261 - DNA, 22 bp, Homo sapiens
tctcattcataccctacatgct

SEQ ID NO: 9244262 - DNA, 22 bp, Homo sapiens
tctcattcataccctacatgct

SEQ ID NO: 9244263 - DNA, 22 bp, Homo sapiens
tctcattcatccaaggatttat

SEQ ID NO: 9244264 - DNA, 22 bp, Homo sapiens
tctcattggtatatacatgtgt

SEQ ID NO: 9244265 - DNA, 22 bp, Homo sapiens
tctcatttacttccacaggctg

SEQ ID NO: 9244266 - DNA, 23 bp, Homo sapiens
tctcatttcccttgatctatctt

SEQ ID NO: 9244267 - DNA, 22 bp, Homo sapiens
tctcattttgagtcagacacta

SEQ ID NO: 9244268 - DNA, 22 bp, Homo sapiens
tctcattttgagtcagacacta

SEQ ID NO: 9244269 - DNA, 22 bp, Homo sapiens
tctcatttgtgtgcaattcaga

SEQ ID NO: 9244270 - DNA, 22 bp, Homo sapiens
tctcatttgtgtgcaattcaga

SEQ ID NO: 9244271 - DNA, 22 bp, Homo sapiens
tctcattggtatatacatgtgt

SEQ ID NO: 9244272 - DNA, 22 bp, Homo sapiens
tctcatttgcctcatctataaa

SEQ ID NO: 9244273 - DNA, 22 bp, Homo sapiens
tctcatttgcctcatctataaa

SEQ ID NO: 9244274 - DNA, 23 bp, Homo sapiens
tctcatttcccttgatctatctt

SEQ ID NO: 9244275 - DNA, 22 bp, Homo sapiens
tctcatttgcctcatctataaa

SEQ ID NO: 9244276 - DNA, 22 bp, Homo sapiens
tctcatttggctttgttttaaa

SEQ ID NO: 9244277 - DNA, 22 bp, Homo sapiens
tctccaaggagctcctgtgccg

SEQ ID NO: 9244278 - DNA, 22 bp, Homo sapiens
tctccaggaagccctccctgac

SEQ ID NO: 9244279 - DNA, 22 bp, Homo sapiens
tctccaggaagccctccctgac

SEQ ID NO: 9244280 - DNA, 17 bp, Homo sapiens
tctccaggacgagctca

SEQ ID NO: 9244281 - DNA, 22 bp, Homo sapiens
tctccaggactgagctccagcc

SEQ ID NO: 9244282 - DNA, 22 bp, Homo sapiens
tctccaggagaaatatgaagga

SEQ ID NO: 9244283 - DNA, 22 bp, Homo sapiens
tctccaggagcaagtcacccag

SEQ ID NO: 9244284 - DNA, 22 bp, Homo sapiens
tctccaggcactacctgggtaa

SEQ ID NO: 9244285 - DNA, 22 bp, Homo sapiens
tctccaggcactacctgggtaa

SEQ ID NO: 9244286 - DNA, 19 bp, Homo sapiens
tctccaggcaggtgagcga

SEQ ID NO: 9244287 - DNA, 19 bp, Homo sapiens
tctccaggcaggtgagcga

SEQ ID NO: 9244288 - DNA, 22 bp, Homo sapiens
tctccaggcacttggctgctac

SEQ ID NO: 9244289 - DNA, 19 bp, Homo sapiens
tctccaggcaggtgagcga

SEQ ID NO: 9244290 - DNA, 22 bp, Homo sapiens
tctcccaggtgggtgcctggag

SEQ ID NO: 9244291 - DNA, 22 bp, Homo sapiens
tctcccaggtgggtgcctggag

SEQ ID NO: 9244292 - DNA, 22 bp, Homo sapiens
tctcccaggctggagtgcagtg

SEQ ID NO: 9244293 - DNA, 22 bp, Homo sapiens
tctcccaggctggagtgcagtg

SEQ ID NO: 9244294 - DNA, 22 bp, Homo sapiens
tctcccagtggtgcagaaagca

SEQ ID NO: 9244295 - DNA, 22 bp, Homo sapiens
tctcccagtggtgcagaaagca

SEQ ID NO: 9244296 - DNA, 22 bp, Homo sapiens
tctcccagtggtgcagaaagca

SEQ ID NO: 9244297 - DNA, 22 bp, Homo sapiens
tctcccaggtgggtgcctggag

SEQ ID NO: 9244298 - DNA, 22 bp, Homo sapiens
tctcccaggtgggtgcctggag

SEQ ID NO: 9244299 - DNA, 22 bp, Homo sapiens
tctcccaggctgccctgtggac

SEQ ID NO: 9244300 - DNA, 22 bp, Homo sapiens
tctcccaggctgccctgtggac

SEQ ID NO: 9244301 - DNA, 22 bp, Homo sapiens
tctcccaggctgccctgtggac

SEQ ID NO: 9244302 - DNA, 20 bp, Homo sapiens
tctcccaggctcagggaaga

SEQ ID NO: 9244303 - DNA, 22 bp, Homo sapiens
tctcccagaggatcccagtgga

SEQ ID NO: 9244304 - DNA, 22 bp, Homo sapiens
tctcccaggcaggagtgcagtg

SEQ ID NO: 9244305 - DNA, 22 bp, Homo sapiens
tctcccaggcaggagtgcagtg

SEQ ID NO: 9244306 - DNA, 22 bp, Homo sapiens
tctccccaggggtatgggtatt

SEQ ID NO: 9244307 - DNA, 22 bp, Homo sapiens
tctcccccagtctctacagcag

SEQ ID NO: 9244308 - DNA, 23 bp, Homo sapiens
tctccctcatgcctaggcctggg

SEQ ID NO: 9244309 - DNA, 22 bp, Homo sapiens
tctccctcattcctgcttccat

SEQ ID NO: 9244310 - DNA, 22 bp, Homo sapiens
tctccccaaaggactcactctc

SEQ ID NO: 9244311 - DNA, 22 bp, Homo sapiens
tctccagggaggtagcccagtg

SEQ ID NO: 9244312 - DNA, 22 bp, Homo sapiens
tctccagggcagagaatagcaa

SEQ ID NO: 9244313 - DNA, 22 bp, Homo sapiens
tctccaggggcagggtctggag

SEQ ID NO: 9244314 - DNA, 22 bp, Homo sapiens
tctccagggtgagctaggccag

SEQ ID NO: 9244315 - DNA, 22 bp, Homo sapiens
tctccaggtaaatggcatcctg

SEQ ID NO: 9244316 - DNA, 22 bp, Homo sapiens
tctccagggtgagctaggccag

SEQ ID NO: 9244317 - DNA, 22 bp, Homo sapiens
tctccaggggctgctgtgccac

SEQ ID NO: 9244318 - DNA, 22 bp, Homo sapiens
tctccagggactgaggctggag

SEQ ID NO: 9244319 - DNA, 22 bp, Homo sapiens
tctccaggctttttgtgaattg

SEQ ID NO: 9244320 - DNA, 22 bp, Homo sapiens
tctccaggcttaatctcagctt

SEQ ID NO: 9244321 - DNA, 23 bp, Homo sapiens
tctccaggccttactccaggcct

SEQ ID NO: 9244322 - DNA, 22 bp, Homo sapiens
tctccaggcctttcccatctta

SEQ ID NO: 9244323 - DNA, 22 bp, Homo sapiens
tctcccactggccttgtatgat

SEQ ID NO: 9244324 - DNA, 22 bp, Homo sapiens
tctcccagaagtcctcagtaca

SEQ ID NO: 9244325 - DNA, 22 bp, Homo sapiens
tctcccagaggatcccagtgga

SEQ ID NO: 9244326 - DNA, 22 bp, Homo sapiens
tctcccagaggatcccagtgga

SEQ ID NO: 9244327 - DNA, 22 bp, Homo sapiens
tctcccactgcaagcccaggct

SEQ ID NO: 9244328 - DNA, 22 bp, Homo sapiens
tctccaggttcagtcgatggaa

SEQ ID NO: 9244329 - DNA, 22 bp, Homo sapiens
tctccaggtggggtcacctttt

SEQ ID NO: 9244330 - DNA, 22 bp, Homo sapiens
tctccaggtggcttgggcttct

SEQ ID NO: 9244331 - DNA, 22 bp, Homo sapiens
tctccaggtggcttgggcttct

SEQ ID NO: 9244332 - DNA, 22 bp, Homo sapiens
tctccaggtgctaagtgtgcct

SEQ ID NO: 9244333 - DNA, 22 bp, Homo sapiens
tctccaggtgagggtggttaga

SEQ ID NO: 9244334 - DNA, 22 bp, Homo sapiens
tctccaggtgactctgatgtat

SEQ ID NO: 9244335 - DNA, 22 bp, Homo sapiens
tctccaggtagatatgtcagga

SEQ ID NO: 9244336 - DNA, 22 bp, Homo sapiens
tctccaggtagatatgtcagga

SEQ ID NO: 9244337 - DNA, 22 bp, Homo sapiens
tctccaggtgaaacttgcaggg

SEQ ID NO: 9244338 - DNA, 22 bp, Homo sapiens
tctcctgaagaccatgtgcact

SEQ ID NO: 9244339 - DNA, 22 bp, Homo sapiens
tctcctgacatgtctggaggaa

SEQ ID NO: 9244340 - DNA, 22 bp, Homo sapiens
tctcctgatatctgcagaccta

SEQ ID NO: 9244341 - DNA, 22 bp, Homo sapiens
tctcctgatgatggtactggca

SEQ ID NO: 9244342 - DNA, 22 bp, Homo sapiens
tctcctctactgggtctgcaga

SEQ ID NO: 9244343 - DNA, 22 bp, Homo sapiens
tctcctctatttctgtatgtat

SEQ ID NO: 9244344 - DNA, 23 bp, Homo sapiens
tctcctcctagatacagtcatgg

SEQ ID NO: 9244345 - DNA, 23 bp, Homo sapiens
tctcctcctagatacagtcatgg

SEQ ID NO: 9244346 - DNA, 22 bp, Homo sapiens
tctcctctactgggtctgcaga

SEQ ID NO: 9244347 - DNA, 22 bp, Homo sapiens
tctcctcccaggctcttccagg

SEQ ID NO: 9244348 - DNA, 22 bp, Homo sapiens
tctcctaggctggagtgcagtg

SEQ ID NO: 9244349 - DNA, 22 bp, Homo sapiens
tctcctggagcccagatgctgg

SEQ ID NO: 9244350 - DNA, 22 bp, Homo sapiens
tctcctggagcaggaaggtggg

SEQ ID NO: 9244351 - DNA, 22 bp, Homo sapiens
tctcctggagcaggaaggtggg

SEQ ID NO: 9244352 - DNA, 22 bp, Homo sapiens
tctcctggagcccagatgctgg

SEQ ID NO: 9244353 - DNA, 22 bp, Homo sapiens
tctcctggatagatactatcca

SEQ ID NO: 9244354 - DNA, 22 bp, Homo sapiens
tctcctggatagatactatcca

SEQ ID NO: 9244355 - DNA, 22 bp, Homo sapiens
tctcctggcatttggttgagta

SEQ ID NO: 9244356 - DNA, 22 bp, Homo sapiens
tctcctggcatgtgggtcatct

SEQ ID NO: 9244357 - DNA, 22 bp, Homo sapiens
tctcctggcatttggttgagta

SEQ ID NO: 9244358 - DNA, 22 bp, Homo sapiens
tctcctggcatgtgggtcatct

SEQ ID NO: 9244359 - DNA, 22 bp, Homo sapiens
tctcctggatggaccttctctt

SEQ ID NO: 9244360 - DNA, 22 bp, Homo sapiens
tctcctgctcccaactgctgca

SEQ ID NO: 9244361 - DNA, 22 bp, Homo sapiens
tctcctgctcccaactgctgca

SEQ ID NO: 9244362 - DNA, 22 bp, Homo sapiens
tctcctgcttcaactgatggac

SEQ ID NO: 9244363 - DNA, 22 bp, Homo sapiens
tctcctgcttcaactgatggac

SEQ ID NO: 9244364 - DNA, 22 bp, Homo sapiens
tctcctggaagaataccacact

SEQ ID NO: 9244365 - DNA, 22 bp, Homo sapiens
tctcctggaagtgattcccctg

SEQ ID NO: 9244366 - DNA, 22 bp, Homo sapiens
tctcctgctcagaacagcctca

SEQ ID NO: 9244367 - DNA, 22 bp, Homo sapiens
tctcctgctcagaacagcctca

SEQ ID NO: 9244368 - DNA, 22 bp, Homo sapiens
tctcctgccactgcttcccatt

SEQ ID NO: 9244369 - DNA, 22 bp, Homo sapiens
tctcctgccactgcttcccatt

SEQ ID NO: 9244370 - DNA, 22 bp, Homo sapiens
tctcgctctgtcgcccaggctg

SEQ ID NO: 9244371 - DNA, 22 bp, Homo sapiens
tctcgctctgtcgcccaggctg

SEQ ID NO: 9244372 - DNA, 22 bp, Homo sapiens
tctcgctctgtcgcccaggctg

SEQ ID NO: 9244373 - DNA, 22 bp, Homo sapiens
tctcgctctgtcgcccaggctg

SEQ ID NO: 9244374 - DNA, 22 bp, Homo sapiens
tctcgctctgtcgcccaggctg

SEQ ID NO: 9244375 - DNA, 22 bp, Homo sapiens
tctcgctctgtcgcccaggctg

SEQ ID NO: 9244376 - DNA, 22 bp, Homo sapiens
tctctagtctcctttaacctga

SEQ ID NO: 9244377 - DNA, 22 bp, Homo sapiens
tctctagtctcctttaacctga

SEQ ID NO: 9244378 - DNA, 22 bp, Homo sapiens
tctcctttgaaagttaggactg

SEQ ID NO: 9244379 - DNA, 22 bp, Homo sapiens
tctcgctctgtcgcccaggctg

SEQ ID NO: 9244380 - DNA, 22 bp, Homo sapiens
tctcgatctcctgaccttgtga

SEQ ID NO: 9244381 - DNA, 22 bp, Homo sapiens
tctccttgctacccagtatgtc

SEQ ID NO: 9244382 - DNA, 22 bp, Homo sapiens
tctccttgctacccagtatgtc

SEQ ID NO: 9244383 - DNA, 22 bp, Homo sapiens
tctccttgacaggcaggcagac

SEQ ID NO: 9244384 - DNA, 22 bp, Homo sapiens
tctcctggtacccttcctagca

SEQ ID NO: 9244385 - DNA, 22 bp, Homo sapiens
tctcctggtacccttcctagca

SEQ ID NO: 9244386 - DNA, 22 bp, Homo sapiens
tctcctggtacccttcctagca

SEQ ID NO: 9244387 - DNA, 22 bp, Homo sapiens
tctcctgggtgctttatcagaa

SEQ ID NO: 9244388 - DNA, 22 bp, Homo sapiens
tctcctggtatgtatgcacctg

SEQ ID NO: 9244389 - DNA, 22 bp, Homo sapiens
tctcctgggtaaaagggttgat

SEQ ID NO: 9244390 - DNA, 22 bp, Homo sapiens
tctcctgggtaaaagggttgat

SEQ ID NO: 9244391 - DNA, 22 bp, Homo sapiens
tctcctgggcttggttgaagtt

SEQ ID NO: 9244392 - DNA, 22 bp, Homo sapiens
tctcctggccctgtcgccatct

SEQ ID NO: 9244393 - DNA, 18 bp, Homo sapiens
tctcctgggtaggggcct

SEQ ID NO: 9244394 - DNA, 18 bp, Homo sapiens
tctcctgggtaggggcct

SEQ ID NO: 9244395 - DNA, 21 bp, Homo sapiens
tctcctgggtccaacccatgc

SEQ ID NO: 9244396 - DNA, 18 bp, Homo sapiens
tctccttccaaatcttca

SEQ ID NO: 9244397 - DNA, 22 bp, Homo sapiens
tctccttcgaggcccagctccc

SEQ ID NO: 9244398 - DNA, 20 bp, Homo sapiens
tctcctggtctggtccgtgc

SEQ ID NO: 9244399 - DNA, 20 bp, Homo sapiens
tctcctggtctggtccgtgc

SEQ ID NO: 9244400 - DNA, 22 bp, Homo sapiens
tctcctggtcacctcagaagtc

SEQ ID NO: 9244401 - DNA, 22 bp, Homo sapiens
tctcctggtcacctcagaagtc

SEQ ID NO: 9244402 - DNA, 20 bp, Homo sapiens
tctcctggtgacagtaccca

SEQ ID NO: 9244403 - DNA, 20 bp, Homo sapiens
tctcctggtgacagtaccca

SEQ ID NO: 9244404 - DNA, 22 bp, Homo sapiens
tctcctggtttgttaaataatt

SEQ ID NO: 9244405 - DNA, 22 bp, Homo sapiens
tctctggctgatattcctctgc

SEQ ID NO: 9244406 - DNA, 22 bp, Homo sapiens
tctctggctcctgccgggtcca

SEQ ID NO: 9244407 - DNA, 22 bp, Homo sapiens
tctctggccctgttttctatct

SEQ ID NO: 9244408 - DNA, 19 bp, Homo sapiens
tctctggcatagactcaat

SEQ ID NO: 9244409 - DNA, 19 bp, Homo sapiens
tctctggcatagactcaat

SEQ ID NO: 9244410 - DNA, 22 bp, Homo sapiens
tctctggccccatggctgagct

SEQ ID NO: 9244411 - DNA, 22 bp, Homo sapiens
tctctggccccatggctgagct

SEQ ID NO: 9244412 - DNA, 22 bp, Homo sapiens
tctctggcagacacctccctga

SEQ ID NO: 9244413 - DNA, 22 bp, Homo sapiens
tctctggcagaggccctatccc

SEQ ID NO: 9244414 - DNA, 22 bp, Homo sapiens
tctctggcagggatatctggct

SEQ ID NO: 9244415 - DNA, 22 bp, Homo sapiens
tctctggcagggatatctggct

SEQ ID NO: 9244416 - DNA, 22 bp, Homo sapiens
tctctggagtataaccagggat

SEQ ID NO: 9244417 - DNA, 22 bp, Homo sapiens
tctctggagggctccaggcggg

SEQ ID NO: 9244418 - DNA, 21 bp, Homo sapiens
tctctggaattagaccatgtt

SEQ ID NO: 9244419 - DNA, 19 bp, Homo sapiens
tctctgcttctcttggcat

SEQ ID NO: 9244420 - DNA, 22 bp, Homo sapiens
tctctgcttggtgtatgtgagt

SEQ ID NO: 9244421 - DNA, 19 bp, Homo sapiens
tctctgccgatcagggccc

SEQ ID NO: 9244422 - DNA, 19 bp, Homo sapiens
tctctgccgatcagggccc

SEQ ID NO: 9244423 - DNA, 22 bp, Homo sapiens
tctctgctaagattgtgtctag

SEQ ID NO: 9244424 - DNA, 22 bp, Homo sapiens
tctctgctaagattgtgtctag

SEQ ID NO: 9244425 - DNA, 22 bp, Homo sapiens
tctctgctctgtgcctcagttt

SEQ ID NO: 9244426 - DNA, 22 bp, Homo sapiens
tctctgctcaggcaccagccct

SEQ ID NO: 9244427 - DNA, 22 bp, Homo sapiens
tctctgctctgtgcctcagttt

SEQ ID NO: 9244428 - DNA, 22 bp, Homo sapiens
tctctgctctgtgcctcagttt

SEQ ID NO: 9244429 - DNA, 22 bp, Homo sapiens
tctctgctctgtgcctcagttt

SEQ ID NO: 9244430 - DNA, 22 bp, Homo sapiens
tctctgctgagaagggctggca

SEQ ID NO: 9244431 - DNA, 19 bp, Homo sapiens
tctctgcttctcttggcat

SEQ ID NO: 9244432 - DNA, 19 bp, Homo sapiens
tctctgcttctcttggcat

SEQ ID NO: 9244433 - DNA, 22 bp, Homo sapiens
tctctgggtaaagttctctcat

SEQ ID NO: 9244434 - DNA, 22 bp, Homo sapiens
tctctggggatggacctgggag

SEQ ID NO: 9244435 - DNA, 22 bp, Homo sapiens
tctctggggcctttctacatca

SEQ ID NO: 9244436 - DNA, 22 bp, Homo sapiens
tctctgggggtagaactcaggc

SEQ ID NO: 9244437 - DNA, 22 bp, Homo sapiens
tctctgggtgatggcagggcac

SEQ ID NO: 9244438 - DNA, 22 bp, Homo sapiens
tctctgggttctcactcagcac

SEQ ID NO: 9244439 - DNA, 22 bp, Homo sapiens
tctctgggcctgttttctcatc

SEQ ID NO: 9244440 - DNA, 22 bp, Homo sapiens
tctctgggcctccctttccaag

SEQ ID NO: 9244441 - DNA, 22 bp, Homo sapiens
tctctgggcctccctttccaag

SEQ ID NO: 9244442 - DNA, 22 bp, Homo sapiens
tctctggggaaaaggctgatac

SEQ ID NO: 9244443 - DNA, 19 bp, Homo sapiens
tctctggggacactttcac

SEQ ID NO: 9244444 - DNA, 19 bp, Homo sapiens
tctctggggacactttcac

SEQ ID NO: 9244445 - DNA, 22 bp, Homo sapiens
tctctggggatgcttattcttg

SEQ ID NO: 9244446 - DNA, 22 bp, Homo sapiens
tctctgggcccagaccttcctt

SEQ ID NO: 9244447 - DNA, 22 bp, Homo sapiens
tctctgggcccagaccttcctt

SEQ ID NO: 9244448 - DNA, 21 bp, Homo sapiens
tctctgggccctcctgtgggg

SEQ ID NO: 9244449 - DNA, 21 bp, Homo sapiens
tctctgggccctcctgtgggg

SEQ ID NO: 9244450 - DNA, 19 bp, Homo sapiens
tctctggcttgtctgcctg

SEQ ID NO: 9244451 - DNA, 19 bp, Homo sapiens
tctctggcttgtctgcctg

SEQ ID NO: 9244452 - DNA, 22 bp, Homo sapiens
tctctggctggcaccccaggga

SEQ ID NO: 9244453 - DNA, 22 bp, Homo sapiens
tctctggctggcaccccaggga

SEQ ID NO: 9244454 - DNA, 22 bp, Homo sapiens
tctctgaccaagagaattggta

SEQ ID NO: 9244455 - DNA, 22 bp, Homo sapiens
tctctgactggcctttcacctg

SEQ ID NO: 9244456 - DNA, 22 bp, Homo sapiens
tctctgagaagttcctttgtga

SEQ ID NO: 9244457 - DNA, 22 bp, Homo sapiens
tctctgaattctgatgcaagtg

SEQ ID NO: 9244458 - DNA, 18 bp, Homo sapiens
tctctgaatattttatgt

SEQ ID NO: 9244459 - DNA, 22 bp, Homo sapiens
tctctgaattgtttaagttatt

SEQ ID NO: 9244460 - DNA, 22 bp, Homo sapiens
tctctgaattgtttaagttatt

SEQ ID NO: 9244461 - DNA, 22 bp, Homo sapiens
tctctgaagctgttgtagtctc

SEQ ID NO: 9244462 - DNA, 22 bp, Homo sapiens
tctctgaaggctgtgttgatgg

SEQ ID NO: 9244463 - DNA, 22 bp, Homo sapiens
tctctgaaggctgtgttgatgg

SEQ ID NO: 9244464 - DNA, 22 bp, Homo sapiens
tctctgaataatgctattcttt

SEQ ID NO: 9244465 - DNA, 22 bp, Homo sapiens
tctctgaaggggagctgtttaa

SEQ ID NO: 9244466 - DNA, 22 bp, Homo sapiens
tctctctgccaactcacagcca

SEQ ID NO: 9244467 - DNA, 22 bp, Homo sapiens
tctctctgccaactcacagcca

SEQ ID NO: 9244468 - DNA, 22 bp, Homo sapiens
tctctctttttaatcatgtaat

SEQ ID NO: 9244469 - DNA, 22 bp, Homo sapiens
tctctgaagaatcgatgattct

SEQ ID NO: 9244470 - DNA, 22 bp, Homo sapiens
tctctgaagaatcgatgattct

SEQ ID NO: 9244471 - DNA, 22 bp, Homo sapiens
tctctgaagagctcagactagt

SEQ ID NO: 9244472 - DNA, 22 bp, Homo sapiens
tctctgaagatatttattatta

SEQ ID NO: 9244473 - DNA, 22 bp, Homo sapiens
tctctgaagagtcagacataac

SEQ ID NO: 9244474 - DNA, 22 bp, Homo sapiens
tctctgaacttcctggaaaggc

SEQ ID NO: 9244475 - DNA, 22 bp, Homo sapiens
tctctctttttaatcatgtaat

SEQ ID NO: 9244476 - DNA, 22 bp, Homo sapiens
tctctgaggttgtttccagcac

SEQ ID NO: 9244477 - DNA, 22 bp, Homo sapiens
tctctgagtatcctgaactgcc

SEQ ID NO: 9244478 - DNA, 22 bp, Homo sapiens
tctctgagtaagtgacagttca

SEQ ID NO: 9244479 - DNA, 22 bp, Homo sapiens
tctctgagttctcctccagccc

SEQ ID NO: 9244480 - DNA, 22 bp, Homo sapiens
tctctgagctgcttcttgcata

SEQ ID NO: 9244481 - DNA, 22 bp, Homo sapiens
tctctgagcttaaggtgtttca

SEQ ID NO: 9244482 - DNA, 22 bp, Homo sapiens
tctctgagctgcttcttgcata

SEQ ID NO: 9244483 - DNA, 20 bp, Homo sapiens
tctctgagcttctcttgggg

SEQ ID NO: 9244484 - DNA, 22 bp, Homo sapiens
tctctgagggagatggcctgcc

SEQ ID NO: 9244485 - DNA, 22 bp, Homo sapiens
tctctgagcgcattcctccggc

SEQ ID NO: 9244486 - DNA, 22 bp, Homo sapiens
tctctgagctcaggagctgcag

SEQ ID NO: 9244487 - DNA, 22 bp, Homo sapiens
tctctgagcccctgcctctttc

SEQ ID NO: 9244488 - DNA, 22 bp, Homo sapiens
tctctgagcccaatgtagcaat

SEQ ID NO: 9244489 - DNA, 22 bp, Homo sapiens
tctctgagcccagtgtccccct

SEQ ID NO: 9244490 - DNA, 22 bp, Homo sapiens
tctctgagacagtagcctctgc

SEQ ID NO: 9244491 - DNA, 22 bp, Homo sapiens
tctctgagacagtagcctctgc

SEQ ID NO: 9244492 - DNA, 22 bp, Homo sapiens
tctctgagcatgccatattgct

SEQ ID NO: 9244493 - DNA, 22 bp, Homo sapiens
tctctgagatcagccactgact

SEQ ID NO: 9244494 - DNA, 22 bp, Homo sapiens
tctctccttatcattgtgttta

SEQ ID NO: 9244495 - DNA, 22 bp, Homo sapiens
tctctcctgtgttctgatgttt

SEQ ID NO: 9244496 - DNA, 22 bp, Homo sapiens
tctctccttatcattgtgttta

SEQ ID NO: 9244497 - DNA, 22 bp, Homo sapiens
tctctctaggcatctattttca

SEQ ID NO: 9244498 - DNA, 18 bp, Homo sapiens
tctctctgaagagttccc

SEQ ID NO: 9244499 - DNA, 22 bp, Homo sapiens
tctctctcctagtttttagtgg

SEQ ID NO: 9244500 - DNA, 18 bp, Homo sapiens
tctctctgaagagttccc

SEQ ID NO: 9244501 - DNA, 22 bp, Homo sapiens
tctctctgagttgagcaggagt

SEQ ID NO: 9244502 - DNA, 22 bp, Homo sapiens
tctctcctgtgttctgatgttt

SEQ ID NO: 9244503 - DNA, 22 bp, Homo sapiens
tctctcctgtgttctgatgttt

SEQ ID NO: 9244504 - DNA, 21 bp, Homo sapiens
tctctcctcaagctcgacccc

SEQ ID NO: 9244505 - DNA, 22 bp, Homo sapiens
tctctcctaatttcaggtgctt

SEQ ID NO: 9244506 - DNA, 22 bp, Homo sapiens
tctctcagaggaagaggcagtg

SEQ ID NO: 9244507 - DNA, 18 bp, Homo sapiens
tctctcagggaaacagaa

SEQ ID NO: 9244508 - DNA, 22 bp, Homo sapiens
tctctcaggctggagtgcagtg

SEQ ID NO: 9244509 - DNA, 22 bp, Homo sapiens
tctctcatagagaaaaatatat

SEQ ID NO: 9244510 - DNA, 22 bp, Homo sapiens
tctctcataagatgagtactta

SEQ ID NO: 9244511 - DNA, 22 bp, Homo sapiens
tctctcagtcagatgctaaaga

SEQ ID NO: 9244512 - DNA, 22 bp, Homo sapiens
tctctataggaatacttgaaca

SEQ ID NO: 9244513 - DNA, 22 bp, Homo sapiens
tctctatttgcctaggcttgtg

SEQ ID NO: 9244514 - DNA, 22 bp, Homo sapiens
tctctattaattgacaatggct

SEQ ID NO: 9244515 - DNA, 22 bp, Homo sapiens
tctctcactggtgcctctgttg

SEQ ID NO: 9244516 - DNA, 22 bp, Homo sapiens
tctctcagaaagcccatgtctg

SEQ ID NO: 9244517 - DNA, 22 bp, Homo sapiens
tctctcactggtgcctctgttg

SEQ ID NO: 9244518 - DNA, 22 bp, Homo sapiens
tctgaaatagaagtgtctttct

SEQ ID NO: 9244519 - DNA, 22 bp, Homo sapiens
tctgaaatactgcaggttctct

SEQ ID NO: 9244520 - DNA, 22 bp, Homo sapiens
tctgaaatagaagtgtctttct

SEQ ID NO: 9244521 - DNA, 22 bp, Homo sapiens
tctgaaataaatgcactgttag

SEQ ID NO: 9244522 - DNA, 22 bp, Homo sapiens
tctgaaataagggagaagggaa

SEQ ID NO: 9244523 - DNA, 22 bp, Homo sapiens
tctgaaatactgcaggttctct

SEQ ID NO: 9244524 - DNA, 22 bp, Homo sapiens
tctgaaatactgcaggttctct

SEQ ID NO: 9244525 - DNA, 22 bp, Homo sapiens
tctgaaataactgatgccagat

SEQ ID NO: 9244526 - DNA, 22 bp, Homo sapiens
tctgaaataagggagaagggaa

SEQ ID NO: 9244527 - DNA, 22 bp, Homo sapiens
tctgaaataactgatgccagat

SEQ ID NO: 9244528 - DNA, 22 bp, Homo sapiens
tctgaaataaatgcactgttag

SEQ ID NO: 9244529 - DNA, 22 bp, Homo sapiens
tctgaaataaatgcactgttag

SEQ ID NO: 9244530 - DNA, 18 bp, Homo sapiens
tctgaaagcaccggtgaa

SEQ ID NO: 9244531 - DNA, 22 bp, Homo sapiens
tctgaaagccctagtttgtaat

SEQ ID NO: 9244532 - DNA, 22 bp, Homo sapiens
tctgaaagccctagtttgtaat

SEQ ID NO: 9244533 - DNA, 22 bp, Homo sapiens
tctgaaagcattacagtttatt

SEQ ID NO: 9244534 - DNA, 22 bp, Homo sapiens
tctgaaagtatctggatctttt

SEQ ID NO: 9244535 - DNA, 22 bp, Homo sapiens
tctgaaataaatgcactgttag

SEQ ID NO: 9244536 - DNA, 22 bp, Homo sapiens
tctgaaagtctgaaacagtgtc

SEQ ID NO: 9244537 - DNA, 22 bp, Homo sapiens
tctgaaagctagaaaatgctct

SEQ ID NO: 9244538 - DNA, 22 bp, Homo sapiens
tctgaaaatgttgactttgttt

SEQ ID NO: 9244539 - DNA, 22 bp, Homo sapiens
tctgaaagaaagattttgtttc

SEQ ID NO: 9244540 - DNA, 22 bp, Homo sapiens
tctgaaagaaagattttgtttc

SEQ ID NO: 9244541 - DNA, 22 bp, Homo sapiens
tctgaaagaagggcagtctttt

SEQ ID NO: 9244542 - DNA, 22 bp, Homo sapiens
tctgaaagaagggcagtctttt

SEQ ID NO: 9244543 - DNA, 22 bp, Homo sapiens
tctgaaagagagtacatacagt

SEQ ID NO: 9244544 - DNA, 22 bp, Homo sapiens
tctgaaaactccatgagctcgt

SEQ ID NO: 9244545 - DNA, 22 bp, Homo sapiens
tctctttaaaaatagtgaaata

SEQ ID NO: 9244546 - DNA, 22 bp, Homo sapiens
tctctttaaaaatagtgaaata

SEQ ID NO: 9244547 - DNA, 22 bp, Homo sapiens
tctcttctttggggtgggctca

SEQ ID NO: 9244548 - DNA, 17 bp, Homo sapiens
tctcttgttcactgctg

SEQ ID NO: 9244549 - DNA, 22 bp, Homo sapiens
tctctttaaagactcagagatt

SEQ ID NO: 9244550 - DNA, 22 bp, Homo sapiens
tctctttctattgcaccatgct

SEQ ID NO: 9244551 - DNA, 18 bp, Homo sapiens
tctctttcctcagtggag

SEQ ID NO: 9244552 - DNA, 17 bp, Homo sapiens
tctctttccctttctgc

SEQ ID NO: 9244553 - DNA, 17 bp, Homo sapiens
tctctttccctttctgc

SEQ ID NO: 9244554 - DNA, 17 bp, Homo sapiens
tctctttccctttctgc

SEQ ID NO: 9244555 - DNA, 22 bp, Homo sapiens
tctctttctttgtatgtctatt

SEQ ID NO: 9244556 - DNA, 22 bp, Homo sapiens
tctctttctttgtatgtctatt

SEQ ID NO: 9244557 - DNA, 22 bp, Homo sapiens
tctctttctcaaaatgtaagca

SEQ ID NO: 9244558 - DNA, 22 bp, Homo sapiens
tctctttctcagatggtggaga

SEQ ID NO: 9244559 - DNA, 22 bp, Homo sapiens
tctgaaatgttctcttgttttg

SEQ ID NO: 9244560 - DNA, 22 bp, Homo sapiens
tctgaaattcacagttgagtca

SEQ ID NO: 9244561 - DNA, 22 bp, Homo sapiens
tctgaaattcacagttgagtca

SEQ ID NO: 9244562 - DNA, 22 bp, Homo sapiens
tctgaaatgttctcttgttttg

SEQ ID NO: 9244563 - DNA, 22 bp, Homo sapiens
tctgaaatgttctcttgttttg

SEQ ID NO: 9244564 - DNA, 22 bp, Homo sapiens
tctgaaattgttagtaaaaatg

SEQ ID NO: 9244565 - DNA, 22 bp, Homo sapiens
tctgaaattgttagtaaaaatg

SEQ ID NO: 9244566 - DNA, 22 bp, Homo sapiens
tctgaaattccttccagacttt

SEQ ID NO: 9244567 - DNA, 22 bp, Homo sapiens
tctgaaattccttccagacttt

SEQ ID NO: 9244568 - DNA, 22 bp, Homo sapiens
tctgaaattccttccagacttt

SEQ ID NO: 9244569 - DNA, 22 bp, Homo sapiens
tctgaaattttagttatagaaa

SEQ ID NO: 9244570 - DNA, 22 bp, Homo sapiens
tctgaaattttagttatagaaa

SEQ ID NO: 9244571 - DNA, 22 bp, Homo sapiens
tctgaaatggcagcgggaatga

SEQ ID NO: 9244572 - DNA, 22 bp, Homo sapiens
tctgaaatggcagcgggaatga

SEQ ID NO: 9244573 - DNA, 22 bp, Homo sapiens
tctgaaatgcaggcaatttgct

SEQ ID NO: 9244574 - DNA, 22 bp, Homo sapiens
tctgaaatgcaggcaatttgct

SEQ ID NO: 9244575 - DNA, 22 bp, Homo sapiens
tctgaaatggcgatggccgttg

SEQ ID NO: 9244576 - DNA, 22 bp, Homo sapiens
tctgaaatggcgatggccgttg

SEQ ID NO: 9244577 - DNA, 22 bp, Homo sapiens
tctgaaatggggctgaagcact

SEQ ID NO: 9244578 - DNA, 22 bp, Homo sapiens
tctgaaatggggctgaagcact

SEQ ID NO: 9244579 - DNA, 22 bp, Homo sapiens
tctgaaatgcaggcaatttgct

SEQ ID NO: 9244580 - DNA, 22 bp, Homo sapiens
tctgaaatgcaaatttgactga

SEQ ID NO: 9244581 - DNA, 22 bp, Homo sapiens
tctgaaatgcaaatttgactga

SEQ ID NO: 9244582 - DNA, 22 bp, Homo sapiens
tctgaaatgcaaatttgactga

SEQ ID NO: 9244583 - DNA, 22 bp, Homo sapiens
tctgaaataggaaagcaaatgg

SEQ ID NO: 9244584 - DNA, 22 bp, Homo sapiens
tctgaagaataggatgttgtgt

SEQ ID NO: 9244585 - DNA, 22 bp, Homo sapiens
tctgaagaataggatgttgtgt

SEQ ID NO: 9244586 - DNA, 22 bp, Homo sapiens
tctgaagaactgtctagagaac

SEQ ID NO: 9244587 - DNA, 22 bp, Homo sapiens
tctgaagaactgagtaaacatg

SEQ ID NO: 9244588 - DNA, 22 bp, Homo sapiens
tctgaagaactgtctagagaac

SEQ ID NO: 9244589 - DNA, 22 bp, Homo sapiens
tctgaagaactgagtaaacatg

SEQ ID NO: 9244590 - DNA, 22 bp, Homo sapiens
tctgaagaactgagtaaacatg

SEQ ID NO: 9244591 - DNA, 20 bp, Homo sapiens
tctgaagaaagacagggact

SEQ ID NO: 9244592 - DNA, 22 bp, Homo sapiens
tctgaacatcctacaacatttt

SEQ ID NO: 9244593 - DNA, 22 bp, Homo sapiens
tctgaacattttttgcagccta

SEQ ID NO: 9244594 - DNA, 22 bp, Homo sapiens
tctgaacatgatgtcatctgga

SEQ ID NO: 9244595 - DNA, 22 bp, Homo sapiens
tctgaacagcatggaatcattt

SEQ ID NO: 9244596 - DNA, 20 bp, Homo sapiens
tctgaacaaaatgtaatgtc

SEQ ID NO: 9244597 - DNA, 22 bp, Homo sapiens
tctgaaattttagttatagaaa

SEQ ID NO: 9244598 - DNA, 22 bp, Homo sapiens
tctgaacaagggcaccttccag

SEQ ID NO: 9244599 - DNA, 21 bp, Homo sapiens
tctgaacaacatacgaatctt

SEQ ID NO: 9244600 - DNA, 19 bp, Homo sapiens
tctgaacaatgcagttccc

SEQ ID NO: 9244601 - DNA, 22 bp, Homo sapiens
tctgaacactgagtgtcatcac

SEQ ID NO: 9244602 - DNA, 20 bp, Homo sapiens
tctgaacacaatatatcccc

SEQ ID NO: 9244603 - DNA, 22 bp, Homo sapiens
tctgaagacatatgatatggtg

SEQ ID NO: 9244604 - DNA, 19 bp, Homo sapiens
tctgaagaattagagagca

SEQ ID NO: 9244605 - DNA, 19 bp, Homo sapiens
tctgaagaattagagagca

SEQ ID NO: 9244606 - DNA, 19 bp, Homo sapiens
tctgaagaattagagagca

SEQ ID NO: 9244607 - DNA, 22 bp, Homo sapiens
tctgaagaggctcttgataaga

SEQ ID NO: 9244608 - DNA, 22 bp, Homo sapiens
tctgaagagtcatctttgggtg

SEQ ID NO: 9244609 - DNA, 22 bp, Homo sapiens
tctgaagattctttccactatt

SEQ ID NO: 9244610 - DNA, 22 bp, Homo sapiens
tctgaagattaccagctaaatg

SEQ ID NO: 9244611 - DNA, 22 bp, Homo sapiens
tctgaagattaccagctaaatg

SEQ ID NO: 9244612 - DNA, 23 bp, Homo sapiens
tctgaagatgctgtttccagtga

SEQ ID NO: 9244613 - DNA, 22 bp, Homo sapiens
tctgaagagtcttgcaagaaag

SEQ ID NO: 9244614 - DNA, 22 bp, Homo sapiens
tctgaagatatgagctttatga

SEQ ID NO: 9244615 - DNA, 22 bp, Homo sapiens
tctgaaggtctgagaaccagga

SEQ ID NO: 9244616 - DNA, 22 bp, Homo sapiens
tctgaagggctgagtggaggag

SEQ ID NO: 9244617 - DNA, 22 bp, Homo sapiens
tctgaaggtgctagagaaagct

SEQ ID NO: 9244618 - DNA, 22 bp, Homo sapiens
tctgaagctggaggaagctttg

SEQ ID NO: 9244619 - DNA, 22 bp, Homo sapiens
tctcttccagtaagagtcttta

SEQ ID NO: 9244620 - DNA, 20 bp, Homo sapiens
tctcttcaggaggtccatgt

SEQ ID NO: 9244621 - DNA, 22 bp, Homo sapiens
tctcttcacattcctggcaaac

SEQ ID NO: 9244622 - DNA, 22 bp, Homo sapiens
tctcttattttgcctttgacaa

SEQ ID NO: 9244623 - DNA, 22 bp, Homo sapiens
tctcttcacatgcttgctccaa

SEQ ID NO: 9244624 - DNA, 22 bp, Homo sapiens
tctcttcacatgcttgctccaa

SEQ ID NO: 9244625 - DNA, 22 bp, Homo sapiens
tctcttaggagaaattcataaa

SEQ ID NO: 9244626 - DNA, 22 bp, Homo sapiens
tctcttaatccggtgctttctg

SEQ ID NO: 9244627 - DNA, 23 bp, Homo sapiens
tctctgtgtgcctcagtttcttc

SEQ ID NO: 9244628 - DNA, 21 bp, Homo sapiens
tctctgtgtctttaagctgga

SEQ ID NO: 9244629 - DNA, 22 bp, Homo sapiens
tctcttctaacactagaaattc

SEQ ID NO: 9244630 - DNA, 22 bp, Homo sapiens
tctcttctaacactagaaattc

SEQ ID NO: 9244631 - DNA, 22 bp, Homo sapiens
tctcttccttgacctattgtaa

SEQ ID NO: 9244632 - DNA, 22 bp, Homo sapiens
tctcttccatgtttcagcccca

SEQ ID NO: 9244633 - DNA, 22 bp, Homo sapiens
tctcttccatgtttcagcccca

SEQ ID NO: 9244634 - DNA, 19 bp, Homo sapiens
tctcttctccctggtttta

SEQ ID NO: 9244635 - DNA, 22 bp, Homo sapiens
tctcttctatttgagactattt

SEQ ID NO: 9244636 - DNA, 22 bp, Homo sapiens
tctcttctagcttcttgtggtt

SEQ ID NO: 9244637 - DNA, 22 bp, Homo sapiens
tctcttctagcttcttgtggtt

SEQ ID NO: 9244638 - DNA, 22 bp, Homo sapiens
tctcttctaattagggtccatg

SEQ ID NO: 9244639 - DNA, 22 bp, Homo sapiens
tctcttctgaaacctgtcttta

SEQ ID NO: 9244640 - DNA, 22 bp, Homo sapiens
tctcttctgaaacctgtcttta

SEQ ID NO: 9244641 - DNA, 22 bp, Homo sapiens
tctcttctgacctagccttgga

SEQ ID NO: 9244642 - DNA, 22 bp, Homo sapiens
tctcttctgaaacctgtcttta

SEQ ID NO: 9244643 - DNA, 22 bp, Homo sapiens
tctcttcttgattttcactgga

SEQ ID NO: 9244644 - DNA, 22 bp, Homo sapiens
tctcttcttgattttcactgga

SEQ ID NO: 9244645 - DNA, 20 bp, Homo sapiens
tctcttctggggagataaaa

SEQ ID NO: 9244646 - DNA, 18 bp, Homo sapiens
tctcttcttggcagtcaa

SEQ ID NO: 9244647 - DNA, 22 bp, Homo sapiens
tctcttcttgtgttttcctgcc

SEQ ID NO: 9244648 - DNA, 22 bp, Homo sapiens
tctctgtctgagcctggcagac

SEQ ID NO: 9244649 - DNA, 22 bp, Homo sapiens
tctctgtccctaggagccttgc

SEQ ID NO: 9244650 - DNA, 22 bp, Homo sapiens
tctctgtcccctcagctggggt

SEQ ID NO: 9244651 - DNA, 22 bp, Homo sapiens
tctctgtctcccgtgtgtccgg

SEQ ID NO: 9244652 - DNA, 22 bp, Homo sapiens
tctctgggtttttgtcctgtac

SEQ ID NO: 9244653 - DNA, 23 bp, Homo sapiens
tctctggttaggggagattggtg

SEQ ID NO: 9244654 - DNA, 22 bp, Homo sapiens
tctctggtggctccatcagtag

SEQ ID NO: 9244655 - DNA, 22 bp, Homo sapiens
tctctggtcccacctggccatt

SEQ ID NO: 9244656 - DNA, 22 bp, Homo sapiens
tctctgtgagatgccttcctga

SEQ ID NO: 9244657 - DNA, 22 bp, Homo sapiens
tctctgtgacatttctgagcct

SEQ ID NO: 9244658 - DNA, 22 bp, Homo sapiens
tctctgtgaagctcccgttagg

SEQ ID NO: 9244659 - DNA, 22 bp, Homo sapiens
tctctgtgaatggcgtcacctg

SEQ ID NO: 9244660 - DNA, 22 bp, Homo sapiens
tctctgtgagatttgtattaag

SEQ ID NO: 9244661 - DNA, 22 bp, Homo sapiens
tctctgtgagatgccttcctga

SEQ ID NO: 9244662 - DNA, 22 bp, Homo sapiens
tctctgtgagatttgtattaag

SEQ ID NO: 9244663 - DNA, 22 bp, Homo sapiens
tctctgtgagccaggtcctagt

SEQ ID NO: 9244664 - DNA, 22 bp, Homo sapiens
tctctgtgagtggaaggcaccc

SEQ ID NO: 9244665 - DNA, 22 bp, Homo sapiens
tctctgtgcaggatgctgagtt

SEQ ID NO: 9244666 - DNA, 22 bp, Homo sapiens
tctctgtgcaggatgctgagtt

SEQ ID NO: 9244667 - DNA, 22 bp, Homo sapiens
tctctgtggtgggaggctgagt

SEQ ID NO: 9244668 - DNA, 22 bp, Homo sapiens
tctctgtggtatgtcatagcaa

SEQ ID NO: 9244669 - DNA, 22 bp, Homo sapiens
tctctgtgggtttcaccagcgc

SEQ ID NO: 9244670 - DNA, 22 bp, Homo sapiens
tctctgtgtctcatgttcctat

SEQ ID NO: 9244671 - DNA, 21 bp, Homo sapiens
tctctgtgtacagtctcaccc

SEQ ID NO: 9244672 - DNA, 22 bp, Homo sapiens
tctctgtgcccagtagttctct

SEQ ID NO: 9244673 - DNA, 22 bp, Homo sapiens
tctctgtggcaactacttagct

SEQ ID NO: 9244674 - DNA, 22 bp, Homo sapiens
tctctgtggagcagtgtgttca

SEQ ID NO: 9244675 - DNA, 22 bp, Homo sapiens
tctctgtggagcagtgtgttca

SEQ ID NO: 9244676 - DNA, 22 bp, Homo sapiens
tctctgtgggctttggacttga

SEQ ID NO: 9244677 - DNA, 21 bp, Homo sapiens
tctctgtggcctaccctctac

SEQ ID NO: 9244678 - DNA, 22 bp, Homo sapiens
tctctgtggcaagcatgctgct

SEQ ID NO: 9244679 - DNA, 22 bp, Homo sapiens
tcttgggcatgtgtttgatttc

SEQ ID NO: 9244680 - DNA, 22 bp, Homo sapiens
tcttgggattgccctgcagttc

SEQ ID NO: 9244681 - DNA, 19 bp, Homo sapiens
tcttggctttgtctactgt

SEQ ID NO: 9244682 - DNA, 22 bp, Homo sapiens
tcttggcttctgtatttcctgt

SEQ ID NO: 9244683 - DNA, 22 bp, Homo sapiens
tcttggctgtctttgaagttag

SEQ ID NO: 9244684 - DNA, 22 bp, Homo sapiens
tcttggctgtaccattgactag

SEQ ID NO: 9244685 - DNA, 21 bp, Homo sapiens
tcttggctctgccacttatta

SEQ ID NO: 9244686 - DNA, 22 bp, Homo sapiens
tcttggctgctgccaatttact

SEQ ID NO: 9244687 - DNA, 22 bp, Homo sapiens
tcttggctgctgccaatttact

SEQ ID NO: 9244688 - DNA, 22 bp, Homo sapiens
tcttggctctgccactaattag

SEQ ID NO: 9244689 - DNA, 22 bp, Homo sapiens
tctttacacaagacaagaataa

SEQ ID NO: 9244690 - DNA, 22 bp, Homo sapiens
tctttacacaagacaagaataa

SEQ ID NO: 9244691 - DNA, 22 bp, Homo sapiens
tctttacagtcctctgtcaatc

SEQ ID NO: 9244692 - DNA, 23 bp, Homo sapiens
tctttacatactgatgagttctc

SEQ ID NO: 9244693 - DNA, 22 bp, Homo sapiens
tctttacatcacaattgtatgg

SEQ ID NO: 9244694 - DNA, 22 bp, Homo sapiens
tctttacatcacaattgtatgg

SEQ ID NO: 9244695 - DNA, 22 bp, Homo sapiens
tctttacatcacaattgtatgg

SEQ ID NO: 9244696 - DNA, 22 bp, Homo sapiens
tctttactggaatggaactttc

SEQ ID NO: 9244697 - DNA, 23 bp, Homo sapiens
tctttagaagaacatcagaaatg

SEQ ID NO: 9244698 - DNA, 22 bp, Homo sapiens
tctttaattgtggaagagcagc

SEQ ID NO: 9244699 - DNA, 22 bp, Homo sapiens
tctttaatgtgattgtaattat

SEQ ID NO: 9244700 - DNA, 22 bp, Homo sapiens
tctttaatgtgattgtaattat

SEQ ID NO: 9244701 - DNA, 22 bp, Homo sapiens
tctttacaatctaagcatagtt

SEQ ID NO: 9244702 - DNA, 22 bp, Homo sapiens
tctttacaatctaagcatagtt

SEQ ID NO: 9244703 - DNA, 22 bp, Homo sapiens
tctttacaagtcacattttctg

SEQ ID NO: 9244704 - DNA, 22 bp, Homo sapiens
tctttaatatctgccccagagc

SEQ ID NO: 9244705 - DNA, 22 bp, Homo sapiens
tctttaatgtactttctttcac

SEQ ID NO: 9244706 - DNA, 22 bp, Homo sapiens
tctttaatgtactttctttcac

SEQ ID NO: 9244707 - DNA, 22 bp, Homo sapiens
tctttaatcataaccaagatgg

SEQ ID NO: 9244708 - DNA, 22 bp, Homo sapiens
tcttggaatctccatagagtga

SEQ ID NO: 9244709 - DNA, 22 bp, Homo sapiens
tcttggaacttattattgtaga

SEQ ID NO: 9244710 - DNA, 22 bp, Homo sapiens
tcttggaacttattattgtaga

SEQ ID NO: 9244711 - DNA, 22 bp, Homo sapiens
tcttggaagtagaacacagtct

SEQ ID NO: 9244712 - DNA, 22 bp, Homo sapiens
tcttggagactcttgtatattt

SEQ ID NO: 9244713 - DNA, 22 bp, Homo sapiens
tcttggccaggtgtggtgcctc

SEQ ID NO: 9244714 - DNA, 22 bp, Homo sapiens
tcttggccagatgcacttcctc

SEQ ID NO: 9244715 - DNA, 21 bp, Homo sapiens
tcttggcctaagttcactgaa

SEQ ID NO: 9244716 - DNA, 22 bp, Homo sapiens
tcttggccccacctgtgccagc

SEQ ID NO: 9244717 - DNA, 22 bp, Homo sapiens
tcttggctactttcctgtctgc

SEQ ID NO: 9244718 - DNA, 22 bp, Homo sapiens
tcttggctatccaagttatcca

SEQ ID NO: 9244719 - DNA, 22 bp, Homo sapiens
tcttggctatccaagttatcca

SEQ ID NO: 9244720 - DNA, 22 bp, Homo sapiens
tcttggctagtaccttcctgcc

SEQ ID NO: 9244721 - DNA, 22 bp, Homo sapiens
tcttggccactaccacctggag

SEQ ID NO: 9244722 - DNA, 22 bp, Homo sapiens
tcttggccactaccacctggag

SEQ ID NO: 9244723 - DNA, 22 bp, Homo sapiens
tcttgacattcaatcatgtata

SEQ ID NO: 9244724 - DNA, 22 bp, Homo sapiens
tcttgacattgttgttagcagg

SEQ ID NO: 9244725 - DNA, 20 bp, Homo sapiens
tcttgagaacaatttctggc

SEQ ID NO: 9244726 - DNA, 22 bp, Homo sapiens
tcttgagaaataattaaacatg

SEQ ID NO: 9244727 - DNA, 22 bp, Homo sapiens
tcttgaattgtactcccataag

SEQ ID NO: 9244728 - DNA, 22 bp, Homo sapiens
tcttgacaactatactacttac

SEQ ID NO: 9244729 - DNA, 22 bp, Homo sapiens
tcttgaaggggggcagtgttga

SEQ ID NO: 9244730 - DNA, 22 bp, Homo sapiens
tcttgaagtcttatggtttaaa

SEQ ID NO: 9244731 - DNA, 22 bp, Homo sapiens
tcttgaagtccttacatttgat

SEQ ID NO: 9244732 - DNA, 22 bp, Homo sapiens
tcttgaaagtatcttattttgt

SEQ ID NO: 9244733 - DNA, 22 bp, Homo sapiens
tcttgcttctgctcaaggggag

SEQ ID NO: 9244734 - DNA, 20 bp, Homo sapiens
tcttggaaaaagttcagaat

SEQ ID NO: 9244735 - DNA, 22 bp, Homo sapiens
tcttggaaccctatgtgatttc

SEQ ID NO: 9244736 - DNA, 22 bp, Homo sapiens
tcttgctaggagctatggaaga

SEQ ID NO: 9244737 - DNA, 22 bp, Homo sapiens
tcttgctagaatcatttggaga

SEQ ID NO: 9244738 - DNA, 22 bp, Homo sapiens
tcttgctaaagaccaacacatt

SEQ ID NO: 9244739 - DNA, 22 bp, Homo sapiens
tcttgctaaagaccaacacatt

SEQ ID NO: 9244740 - DNA, 22 bp, Homo sapiens
tcttgaggtcatcatctgaaac

SEQ ID NO: 9244741 - DNA, 22 bp, Homo sapiens
tcttgaggttattaagctgtta

SEQ ID NO: 9244742 - DNA, 19 bp, Homo sapiens
tcttgaggaaagtaaggca

SEQ ID NO: 9244743 - DNA, 22 bp, Homo sapiens
tcttgattggttgtatagctac

SEQ ID NO: 9244744 - DNA, 22 bp, Homo sapiens
tctttagagttaacaataatga

SEQ ID NO: 9244745 - DNA, 22 bp, Homo sapiens
tctttagctagaaatactctaa

SEQ ID NO: 9244746 - DNA, 20 bp, Homo sapiens
tctttagttcctggcccttt

SEQ ID NO: 9244747 - DNA, 22 bp, Homo sapiens
tctttagtgaccatctcattct

SEQ ID NO: 9244748 - DNA, 22 bp, Homo sapiens
tctttataaaagtcattatgtc

SEQ ID NO: 9244749 - DNA, 22 bp, Homo sapiens
tctttataaaagtcattatgtc

SEQ ID NO: 9244750 - DNA, 22 bp, Homo sapiens
tctttatacaaactgggaaaca

SEQ ID NO: 9244751 - DNA, 22 bp, Homo sapiens
tctttccatggccacacagtct

SEQ ID NO: 9244752 - DNA, 21 bp, Homo sapiens
tctttccaatattcatgtctc

SEQ ID NO: 9244753 - DNA, 19 bp, Homo sapiens
tctttcatttctagctctg

SEQ ID NO: 9244754 - DNA, 22 bp, Homo sapiens
tctttcagccacttacctgtct

SEQ ID NO: 9244755 - DNA, 22 bp, Homo sapiens
tctttcaatgtgaaaccatgta

SEQ ID NO: 9244756 - DNA, 22 bp, Homo sapiens
tctttcaatgtgaaaccatgta

SEQ ID NO: 9244757 - DNA, 22 bp, Homo sapiens
tctttattgctactggtttgtc

SEQ ID NO: 9244758 - DNA, 22 bp, Homo sapiens
tctttattgctactggtttgtc

SEQ ID NO: 9244759 - DNA, 22 bp, Homo sapiens
tctttcctaggtgatatgcaat

SEQ ID NO: 9244760 - DNA, 22 bp, Homo sapiens
tctttcctaggtgatatgcaat

SEQ ID NO: 9244761 - DNA, 22 bp, Homo sapiens
tctttcctactttattgtgaac

SEQ ID NO: 9244762 - DNA, 23 bp, Homo sapiens
tctttcctaatgaaacagtgaaa

SEQ ID NO: 9244763 - DNA, 22 bp, Homo sapiens
tctttcctactttattgtgaac

SEQ ID NO: 9244764 - DNA, 23 bp, Homo sapiens
tctttcctaatgaaacagtgaaa

SEQ ID NO: 9244765 - DNA, 17 bp, Homo sapiens
tctttcctgccatgctc

SEQ ID NO: 9244766 - DNA, 17 bp, Homo sapiens
tctttcctgccatgctc

SEQ ID NO: 9244767 - DNA, 21 bp, Homo sapiens
tctttcctgcccagttgccct

SEQ ID NO: 9244768 - DNA, 21 bp, Homo sapiens
tctttcctgcccagttgccct

SEQ ID NO: 9244769 - DNA, 22 bp, Homo sapiens
tctttcctctgagctcctgtag

SEQ ID NO: 9244770 - DNA, 23 bp, Homo sapiens
tctttcctcagcacacaccaaga

SEQ ID NO: 9244771 - DNA, 22 bp, Homo sapiens
tctttccttagaataattcttt

SEQ ID NO: 9244772 - DNA, 22 bp, Homo sapiens
tctttcggccatagcgatgatt

SEQ ID NO: 9244773 - DNA, 22 bp, Homo sapiens
tctttctacatcatttgcttct

SEQ ID NO: 9244774 - DNA, 22 bp, Homo sapiens
tctttcctgtaactgctgttca

SEQ ID NO: 9244775 - DNA, 21 bp, Homo sapiens
tctttcctgcccagttgccct

SEQ ID NO: 9244776 - DNA, 22 bp, Homo sapiens
tctttcctgtaactgctgttca

SEQ ID NO: 9244777 - DNA, 22 bp, Homo sapiens
tctttctctctaatcaagcaca

SEQ ID NO: 9244778 - DNA, 21 bp, Homo sapiens
tctttctgaaatctcagtctg

SEQ ID NO: 9244779 - DNA, 22 bp, Homo sapiens
tctttctgaatatttgacctca

SEQ ID NO: 9244780 - DNA, 22 bp, Homo sapiens
tctttctgaatatttgacctca

SEQ ID NO: 9244781 - DNA, 22 bp, Homo sapiens
tctttctgatgggaagggtcaa

SEQ ID NO: 9244782 - DNA, 22 bp, Homo sapiens
tctttctgcacttagtggggct

SEQ ID NO: 9244783 - DNA, 22 bp, Homo sapiens
tctttctggttatgtatagaga

SEQ ID NO: 9244784 - DNA, 22 bp, Homo sapiens
tctttctgcagcacaggggcag

SEQ ID NO: 9244785 - DNA, 22 bp, Homo sapiens
tctttctggtctcgccttattc

SEQ ID NO: 9244786 - DNA, 22 bp, Homo sapiens
tctttgaactctgtgtattaac

SEQ ID NO: 9244787 - DNA, 22 bp, Homo sapiens
tctttgaacttggctgatctct

SEQ ID NO: 9244788 - DNA, 22 bp, Homo sapiens
tctttcttaaataggtggattg

SEQ ID NO: 9244789 - DNA, 22 bp, Homo sapiens
tctttcttacaaagaaaacggt

SEQ ID NO: 9244790 - DNA, 22 bp, Homo sapiens
tctttctgtaagctccatggaa

SEQ ID NO: 9244791 - DNA, 22 bp, Homo sapiens
tctttctggttatgtatagaga

SEQ ID NO: 9244792 - DNA, 22 bp, Homo sapiens
tcttcctgaaaccctgttccag

SEQ ID NO: 9244793 - DNA, 22 bp, Homo sapiens
tcttcctgaaaccctgttccag

SEQ ID NO: 9244794 - DNA, 23 bp, Homo sapiens
tcttcctgaactatcaggcacat

SEQ ID NO: 9244795 - DNA, 21 bp, Homo sapiens
tcttcctgctccacactcccc

SEQ ID NO: 9244796 - DNA, 22 bp, Homo sapiens
tcttcctcttctgctgagaagt

SEQ ID NO: 9244797 - DNA, 22 bp, Homo sapiens
tcttcctctctaattgatcaga

SEQ ID NO: 9244798 - DNA, 22 bp, Homo sapiens
tcttcctccctacagagctcag

SEQ ID NO: 9244799 - DNA, 22 bp, Homo sapiens
tcttcctccctacagagctcag

SEQ ID NO: 9244800 - DNA, 22 bp, Homo sapiens
tcttccaggagggtgggcaaac

SEQ ID NO: 9244801 - DNA, 22 bp, Homo sapiens
tcttccaggagggcatttcttt

SEQ ID NO: 9244802 - DNA, 22 bp, Homo sapiens
tcttccaggagggcatttcttt

SEQ ID NO: 9244803 - DNA, 22 bp, Homo sapiens
tcttccttgccttgcttcatca

SEQ ID NO: 9244804 - DNA, 22 bp, Homo sapiens
tcttccttgccttgcttcatca

SEQ ID NO: 9244805 - DNA, 22 bp, Homo sapiens
tcttccttgctccttgtcactt

SEQ ID NO: 9244806 - DNA, 22 bp, Homo sapiens
tcttccttgtaagggctttaga

SEQ ID NO: 9244807 - DNA, 22 bp, Homo sapiens
tcttcctttcattcatgtgtta

SEQ ID NO: 9244808 - DNA, 22 bp, Homo sapiens
tcttcctttcattcatgtgtta

SEQ ID NO: 9244809 - DNA, 22 bp, Homo sapiens
tcttctagtaggccaagaagct

SEQ ID NO: 9244810 - DNA, 22 bp, Homo sapiens
tcttctatgaatcattggaaca

SEQ ID NO: 9244811 - DNA, 22 bp, Homo sapiens
tcttctatgaatcattggaaca

SEQ ID NO: 9244812 - DNA, 22 bp, Homo sapiens
tcttctatcctcagcccctgcc

SEQ ID NO: 9244813 - DNA, 22 bp, Homo sapiens
tcttccttttgtaccttctgaa

SEQ ID NO: 9244814 - DNA, 22 bp, Homo sapiens
tcttcgcttactgtgtaaggag

SEQ ID NO: 9244815 - DNA, 16 bp, Homo sapiens
tcttccttttgatttt

SEQ ID NO: 9244816 - DNA, 22 bp, Homo sapiens
tcttccttttgtaccttctgaa

SEQ ID NO: 9244817 - DNA, 22 bp, Homo sapiens
tcttcctgcttggtgtgtctgg

SEQ ID NO: 9244818 - DNA, 22 bp, Homo sapiens
tcttcctggcattgatgctgca

SEQ ID NO: 9244819 - DNA, 22 bp, Homo sapiens
tcttccttctttgatgacaagg

SEQ ID NO: 9244820 - DNA, 22 bp, Homo sapiens
tcttccttcgcccttgctgttt

SEQ ID NO: 9244821 - DNA, 22 bp, Homo sapiens
tcttctttgaatcatagtgacc

SEQ ID NO: 9244822 - DNA, 22 bp, Homo sapiens
tcttgaaagcatgagatggaca

SEQ ID NO: 9244823 - DNA, 22 bp, Homo sapiens
tcttgaaagcattttcttcatc

SEQ ID NO: 9244824 - DNA, 22 bp, Homo sapiens
tcttctgttttagattgcatac

SEQ ID NO: 9244825 - DNA, 20 bp, Homo sapiens
tcttctgttgccttgttctg

SEQ ID NO: 9244826 - DNA, 20 bp, Homo sapiens
tcttctgttgccttgttctg

SEQ ID NO: 9244827 - DNA, 20 bp, Homo sapiens
tcttctgttgccttgttctg

SEQ ID NO: 9244828 - DNA, 22 bp, Homo sapiens
tcttctgttttagattgcatac

SEQ ID NO: 9244829 - DNA, 22 bp, Homo sapiens
tcttcttcctccacagggccca

SEQ ID NO: 9244830 - DNA, 22 bp, Homo sapiens
tcttcttcctcatttatacata

SEQ ID NO: 9244831 - DNA, 22 bp, Homo sapiens
tcttcttcccatccctcaaatg

SEQ ID NO: 9244832 - DNA, 22 bp, Homo sapiens
tcttctcccatctccaggcagg

SEQ ID NO: 9244833 - DNA, 22 bp, Homo sapiens
tcttctccagttcatcctacca

SEQ ID NO: 9244834 - DNA, 22 bp, Homo sapiens
tcttctggatgagagcggaggc

SEQ ID NO: 9244835 - DNA, 22 bp, Homo sapiens
tcttctgtgagaattcaagcaa

SEQ ID NO: 9244836 - DNA, 22 bp, Homo sapiens
tcttctgtgagaattcaagcaa

SEQ ID NO: 9244837 - DNA, 22 bp, Homo sapiens
tcttctgtcctaagtcaaagca

SEQ ID NO: 9244838 - DNA, 22 bp, Homo sapiens
tcttctgtattgttaactcagg

SEQ ID NO: 9244839 - DNA, 22 bp, Homo sapiens
tcttctgtgatctatgtgtttt

SEQ ID NO: 9244840 - DNA, 22 bp, Homo sapiens
tcttctgtgatctatgtgtttt

SEQ ID NO: 9244841 - DNA, 22 bp, Homo sapiens
tcttctgtggctctcaccaccc

SEQ ID NO: 9244842 - DNA, 22 bp, Homo sapiens
tcttctgttaccacagcgatga

SEQ ID NO: 9244843 - DNA, 19 bp, Homo sapiens
tcttattgagcagctgagg

SEQ ID NO: 9244844 - DNA, 22 bp, Homo sapiens
tcttattggataaaaggaaacc

SEQ ID NO: 9244845 - DNA, 22 bp, Homo sapiens
tcttattgtttaaaagtacaca

SEQ ID NO: 9244846 - DNA, 22 bp, Homo sapiens
tcttattttttaatgacagaga

SEQ ID NO: 9244847 - DNA, 22 bp, Homo sapiens
tcttcaaagaattttagtaatt

SEQ ID NO: 9244848 - DNA, 22 bp, Homo sapiens
tcttcaaactgaaaatttagaa

SEQ ID NO: 9244849 - DNA, 22 bp, Homo sapiens
tcttcagattgcactgagcaag

SEQ ID NO: 9244850 - DNA, 22 bp, Homo sapiens
tcttcacaccgggcagcaggaa

SEQ ID NO: 9244851 - DNA, 22 bp, Homo sapiens
tcttcaagttccaaagtgcagg

SEQ ID NO: 9244852 - DNA, 22 bp, Homo sapiens
tcttcatgaatgaatctttgac

SEQ ID NO: 9244853 - DNA, 22 bp, Homo sapiens
tcttcatgccaaatgagttttg

SEQ ID NO: 9244854 - DNA, 22 bp, Homo sapiens
tcttcatgttgctgtagggaga

SEQ ID NO: 9244855 - DNA, 22 bp, Homo sapiens
tcttcaggttaacttgtctttt

SEQ ID NO: 9244856 - DNA, 22 bp, Homo sapiens
tcttcagcagagaattatgatg

SEQ ID NO: 9244857 - DNA, 22 bp, Homo sapiens
tcttcagcagggcctctctgag

SEQ ID NO: 9244858 - DNA, 22 bp, Homo sapiens
tcttcagttgtcatactgcctt

SEQ ID NO: 9244859 - DNA, 22 bp, Homo sapiens
tcttcagtatttggataacatt

SEQ ID NO: 9244860 - DNA, 22 bp, Homo sapiens
tcttcagtcaatccagatgttt

SEQ ID NO: 9244861 - DNA, 22 bp, Homo sapiens
tcttccaaatgcagctaaagct

SEQ ID NO: 9244862 - DNA, 22 bp, Homo sapiens
tcttccagaatgcattctcttt

SEQ ID NO: 9244863 - DNA, 22 bp, Homo sapiens
tctgggcttttccatgcctgtg

SEQ ID NO: 9244864 - DNA, 22 bp, Homo sapiens
tctgggctttgtaatgggaggt

SEQ ID NO: 9244865 - DNA, 22 bp, Homo sapiens
tctggggatgagtgatgtcgta

SEQ ID NO: 9244866 - DNA, 21 bp, Homo sapiens
tctgggggtgagcctagaaat

SEQ ID NO: 9244867 - DNA, 22 bp, Homo sapiens
tctgggggaggaggcatggccc

SEQ ID NO: 9244868 - DNA, 22 bp, Homo sapiens
tctgggctttacactgtgctta

SEQ ID NO: 9244869 - DNA, 22 bp, Homo sapiens
tctgggctttacactgtgctta

SEQ ID NO: 9244870 - DNA, 22 bp, Homo sapiens
tctgggctttaagaactctgtt

SEQ ID NO: 9244871 - DNA, 22 bp, Homo sapiens
tctgggcttggttagggctgtt

SEQ ID NO: 9244872 - DNA, 22 bp, Homo sapiens
tctgggcttggttagggctgtt

SEQ ID NO: 9244873 - DNA, 22 bp, Homo sapiens
tctgggcttgggtagaaatcac

SEQ ID NO: 9244874 - DNA, 22 bp, Homo sapiens
tctgggctgggcttaggaaccc

SEQ ID NO: 9244875 - DNA, 22 bp, Homo sapiens
tctgggctgggagcgtgtggac

SEQ ID NO: 9244876 - DNA, 22 bp, Homo sapiens
tctgggctgcttcagccttcgc

SEQ ID NO: 9244877 - DNA, 22 bp, Homo sapiens
tctgggctggtgctcatgaatt

SEQ ID NO: 9244878 - DNA, 22 bp, Homo sapiens
tctgggctggtgctcatgaatt

SEQ ID NO: 9244879 - DNA, 22 bp, Homo sapiens
tctgggctggtgctcatgaatt

SEQ ID NO: 9244880 - DNA, 22 bp, Homo sapiens
tctgggctgtctacaggttggc

SEQ ID NO: 9244881 - DNA, 18 bp, Homo sapiens
tctgggcttcccgaggct

SEQ ID NO: 9244882 - DNA, 18 bp, Homo sapiens
tctgggcttcccgaggct

SEQ ID NO: 9244883 - DNA, 22 bp, Homo sapiens
tctgggctgtggttccactccg

SEQ ID NO: 9244884 - DNA, 17 bp, Homo sapiens
tctgggcttcagtggtc

SEQ ID NO: 9244885 - DNA, 22 bp, Homo sapiens
tctgggtcggaagccccaggga

SEQ ID NO: 9244886 - DNA, 22 bp, Homo sapiens
tctgggtctatcccatgccttt

SEQ ID NO: 9244887 - DNA, 22 bp, Homo sapiens
tctgggtgaccctgggcaaggc

SEQ ID NO: 9244888 - DNA, 22 bp, Homo sapiens
tctgggtctggctgctggtgca

SEQ ID NO: 9244889 - DNA, 22 bp, Homo sapiens
tctgggtatgacctatttttcc

SEQ ID NO: 9244890 - DNA, 22 bp, Homo sapiens
tctgggtacttgcaagattttc

SEQ ID NO: 9244891 - DNA, 22 bp, Homo sapiens
tctggggttgagtctgggtcag

SEQ ID NO: 9244892 - DNA, 20 bp, Homo sapiens
tctggggtgaagcccaggaa

SEQ ID NO: 9244893 - DNA, 22 bp, Homo sapiens
tctggggtggagccctggagtc

SEQ ID NO: 9244894 - DNA, 22 bp, Homo sapiens
tctgtaaaacttctttgtaaat

SEQ ID NO: 9244895 - DNA, 22 bp, Homo sapiens
tctgtaaaacaatattgtattc

SEQ ID NO: 9244896 - DNA, 22 bp, Homo sapiens
tctgtaaaacaatattgtattc

SEQ ID NO: 9244897 - DNA, 22 bp, Homo sapiens
tctggtttcccagttcctccgt

SEQ ID NO: 9244898 - DNA, 22 bp, Homo sapiens
tctgggttcttgatgctacctt

SEQ ID NO: 9244899 - DNA, 22 bp, Homo sapiens
tctgggtgatgaaatgcactgt

SEQ ID NO: 9244900 - DNA, 22 bp, Homo sapiens
tctgggtgccctttgctctgtt

SEQ ID NO: 9244901 - DNA, 23 bp, Homo sapiens
tctgtacaattgagaagagaaca

SEQ ID NO: 9244902 - DNA, 20 bp, Homo sapiens
tctgtacactcatcttctgc

SEQ ID NO: 9244903 - DNA, 21 bp, Homo sapiens
tctgtacatcattgagtcccc

SEQ ID NO: 9244904 - DNA, 22 bp, Homo sapiens
tctgtacagtaccagatagtaa

SEQ ID NO: 9244905 - DNA, 22 bp, Homo sapiens
tctgtacagtaccagatagtaa

SEQ ID NO: 9244906 - DNA, 22 bp, Homo sapiens
tctgtacagtaccagatagtaa

SEQ ID NO: 9244907 - DNA, 22 bp, Homo sapiens
tctgtaaacaccatgttagagt

SEQ ID NO: 9244908 - DNA, 22 bp, Homo sapiens
tctgtaaagatgtttatacctt

SEQ ID NO: 9244909 - DNA, 22 bp, Homo sapiens
tctgtaatcaagatatttgaga

SEQ ID NO: 9244910 - DNA, 22 bp, Homo sapiens
tctgtaatcttccccagctcag

SEQ ID NO: 9244911 - DNA, 22 bp, Homo sapiens
tctgtcacccaggctggagtgc

SEQ ID NO: 9244912 - DNA, 22 bp, Homo sapiens
tctgtcacccaggctggagtgc

SEQ ID NO: 9244913 - DNA, 22 bp, Homo sapiens
tctgtcacccagagtgcagtgg

SEQ ID NO: 9244914 - DNA, 22 bp, Homo sapiens
tctgtcacccaggctggagtgc

SEQ ID NO: 9244915 - DNA, 22 bp, Homo sapiens
tctgtcaccattcagcttgaat

SEQ ID NO: 9244916 - DNA, 22 bp, Homo sapiens
tctgtattgattctgttaggca

SEQ ID NO: 9244917 - DNA, 22 bp, Homo sapiens
tctgtcacaatttgcttactct

SEQ ID NO: 9244918 - DNA, 22 bp, Homo sapiens
tctgtatatattaatgaaattc

SEQ ID NO: 9244919 - DNA, 22 bp, Homo sapiens
tctgtataaggacaaacattta

SEQ ID NO: 9244920 - DNA, 22 bp, Homo sapiens
tctgtacttcctttaaacttta

SEQ ID NO: 9244921 - DNA, 22 bp, Homo sapiens
tctgtagcaagtgagaggcatt

SEQ ID NO: 9244922 - DNA, 22 bp, Homo sapiens
tctgtacatttgtgttgtgaat

SEQ ID NO: 9244923 - DNA, 22 bp, Homo sapiens
tctgtccagaacgtacatcttg

SEQ ID NO: 9244924 - DNA, 22 bp, Homo sapiens
tctgtccagaggtcctggagac

SEQ ID NO: 9244925 - DNA, 18 bp, Homo sapiens
tctgtccaccctgtgctg

SEQ ID NO: 9244926 - DNA, 20 bp, Homo sapiens
tctgtccaccagcctcgcct

SEQ ID NO: 9244927 - DNA, 22 bp, Homo sapiens
tctgtcatctctaaaatagaaa

SEQ ID NO: 9244928 - DNA, 22 bp, Homo sapiens
tctgtcctccggagctcccagt

SEQ ID NO: 9244929 - DNA, 22 bp, Homo sapiens
tctgtcctccacactgtaagtt

SEQ ID NO: 9244930 - DNA, 22 bp, Homo sapiens
tctgtcctccggagctcccagt

SEQ ID NO: 9244931 - DNA, 22 bp, Homo sapiens
tctgtccattcagccatccatc

SEQ ID NO: 9244932 - DNA, 22 bp, Homo sapiens
tctgtccattcagaatggccct

SEQ ID NO: 9244933 - DNA, 22 bp, Homo sapiens
tctgtccatgcttttctctcac

SEQ ID NO: 9244934 - DNA, 22 bp, Homo sapiens
tctgtccaggcttactatatat

SEQ ID NO: 9244935 - DNA, 22 bp, Homo sapiens
tctgtccaggtcagcctacatt

SEQ ID NO: 9244936 - DNA, 22 bp, Homo sapiens
tctgtctgactaccatgaggca

SEQ ID NO: 9244937 - DNA, 23 bp, Homo sapiens
tctgtctgaataatttactcttt

SEQ ID NO: 9244938 - DNA, 22 bp, Homo sapiens
tctgtctctttgttctgtgagt

SEQ ID NO: 9244939 - DNA, 20 bp, Homo sapiens
tctgtctctgagctagactt

SEQ ID NO: 9244940 - DNA, 18 bp, Homo sapiens
tctgtctctgtccttgct

SEQ ID NO: 9244941 - DNA, 18 bp, Homo sapiens
tctgtctctgtccttgct

SEQ ID NO: 9244942 - DNA, 22 bp, Homo sapiens
tctgtctcctgccagtgcctct

SEQ ID NO: 9244943 - DNA, 22 bp, Homo sapiens
tctgtctcctgccagtgcctct

SEQ ID NO: 9244944 - DNA, 21 bp, Homo sapiens
tctgtctctccactgccctgc

SEQ ID NO: 9244945 - DNA, 22 bp, Homo sapiens
tctgtcctgtttcctcctgaca

SEQ ID NO: 9244946 - DNA, 22 bp, Homo sapiens
tctgtcctgtttcctcctgaca

SEQ ID NO: 9244947 - DNA, 22 bp, Homo sapiens
tctgtcctgtttcctcctgaca

SEQ ID NO: 9244948 - DNA, 22 bp, Homo sapiens
tctgtctcaagttcttgcactc

SEQ ID NO: 9244949 - DNA, 22 bp, Homo sapiens
tctgtctcaagttcttgcactc

SEQ ID NO: 9244950 - DNA, 22 bp, Homo sapiens
tctgtctcctctgaggtgccag

SEQ ID NO: 9244951 - DNA, 22 bp, Homo sapiens
tctgttgactcctagcagccat

SEQ ID NO: 9244952 - DNA, 22 bp, Homo sapiens
tctgttgcaatgtgcatggtga

SEQ ID NO: 9244953 - DNA, 22 bp, Homo sapiens
tctgttgcaatgtgcatggtga

SEQ ID NO: 9244954 - DNA, 22 bp, Homo sapiens
tctgttctttagcctgcttgag

SEQ ID NO: 9244955 - DNA, 22 bp, Homo sapiens
tctgttctttagcctgcttgag

SEQ ID NO: 9244956 - DNA, 22 bp, Homo sapiens
tctgttattctgctcagtatag

SEQ ID NO: 9244957 - DNA, 20 bp, Homo sapiens
tctgttattattacattgcc

SEQ ID NO: 9244958 - DNA, 22 bp, Homo sapiens
tctgttatggaagtttcctttt

SEQ ID NO: 9244959 - DNA, 22 bp, Homo sapiens
tctgttatggaagtttcctttt

SEQ ID NO: 9244960 - DNA, 22 bp, Homo sapiens
tctgttatgcataagcatcagt

SEQ ID NO: 9244961 - DNA, 22 bp, Homo sapiens
tctgttgcaatgtgcatggtga

SEQ ID NO: 9244962 - DNA, 22 bp, Homo sapiens
tctgttgctttcttcctgtgtg

SEQ ID NO: 9244963 - DNA, 22 bp, Homo sapiens
tctgttgcatatgctgctgggt

SEQ ID NO: 9244964 - DNA, 22 bp, Homo sapiens
tctgtttagatgctttatctgt

SEQ ID NO: 9244965 - DNA, 22 bp, Homo sapiens
tctgtgttgataattttggaga

SEQ ID NO: 9244966 - DNA, 22 bp, Homo sapiens
tctgtgtgttgtcaggaggatt

SEQ ID NO: 9244967 - DNA, 22 bp, Homo sapiens
tctgttatatgttttttctaaa

SEQ ID NO: 9244968 - DNA, 22 bp, Homo sapiens
tctgttataaatcacactgcat

SEQ ID NO: 9244969 - DNA, 22 bp, Homo sapiens
tctgttatacaacaagtaacag

SEQ ID NO: 9244970 - DNA, 22 bp, Homo sapiens
tctgttagctgtcaaagtgttt

SEQ ID NO: 9244971 - DNA, 22 bp, Homo sapiens
tctgttagagaggtagttcttg

SEQ ID NO: 9244972 - DNA, 22 bp, Homo sapiens
tctgttaacctggtcttggctt

SEQ ID NO: 9244973 - DNA, 22 bp, Homo sapiens
tctgtgtgtgcctgttaatatt

SEQ ID NO: 9244974 - DNA, 22 bp, Homo sapiens
tctgtgtgtgcctgttaatatt

SEQ ID NO: 9244975 - DNA, 22 bp, Homo sapiens
tctgtgtggtagtttcagtgaa

SEQ ID NO: 9244976 - DNA, 22 bp, Homo sapiens
tctgtgtggtagtttcagtgaa

SEQ ID NO: 9244977 - DNA, 22 bp, Homo sapiens
tctgtgtgggatagtttgagga

SEQ ID NO: 9244978 - DNA, 22 bp, Homo sapiens
tctgtgtgggatagtttgagga

SEQ ID NO: 9244979 - DNA, 22 bp, Homo sapiens
tctgtgtgccctaaagcctgct

SEQ ID NO: 9244980 - DNA, 22 bp, Homo sapiens
tctgtgtgaccataagccagct

SEQ ID NO: 9244981 - DNA, 20 bp, Homo sapiens
tctgtgtgccatcacctaac

SEQ ID NO: 9244982 - DNA, 22 bp, Homo sapiens
tctgtgtgatttcagggaagtc

SEQ ID NO: 9244983 - DNA, 22 bp, Homo sapiens
tcttaagcagagaagaagttga

SEQ ID NO: 9244984 - DNA, 22 bp, Homo sapiens
tcttaactgacagtttaatggg

SEQ ID NO: 9244985 - DNA, 22 bp, Homo sapiens
tcttagatgaataaaaagttat

SEQ ID NO: 9244986 - DNA, 22 bp, Homo sapiens
tcttaatgaaagtgaaatatca

SEQ ID NO: 9244987 - DNA, 22 bp, Homo sapiens
tcttaaatgactgataagagga

SEQ ID NO: 9244988 - DNA, 22 bp, Homo sapiens
tcttaacatattattttagcac

SEQ ID NO: 9244989 - DNA, 22 bp, Homo sapiens
tcttaaagcttacttcaattgt

SEQ ID NO: 9244990 - DNA, 22 bp, Homo sapiens
tcttaaatgactgataagagga

SEQ ID NO: 9244991 - DNA, 22 bp, Homo sapiens
tcttaaatgactgataagagga

SEQ ID NO: 9244992 - DNA, 22 bp, Homo sapiens
tcttagcaaatactacttagaa

SEQ ID NO: 9244993 - DNA, 22 bp, Homo sapiens
tcttagcacagctatataagtt

SEQ ID NO: 9244994 - DNA, 22 bp, Homo sapiens
tcttagttgtttgctgtctaac

SEQ ID NO: 9244995 - DNA, 22 bp, Homo sapiens
tcttaggtgtatgtcattaggg

SEQ ID NO: 9244996 - DNA, 22 bp, Homo sapiens
tcttagcatttcataacaactg

SEQ ID NO: 9244997 - DNA, 22 bp, Homo sapiens
tcttagcatttgttaataccca

SEQ ID NO: 9244998 - DNA, 22 bp, Homo sapiens
tcttataatctctattttaatg

SEQ ID NO: 9244999 - DNA, 22 bp, Homo sapiens
tcttataatgttgaagggttgg

SEQ ID NO: 9245000 - DNA, 21 bp, Homo sapiens
tcttatacagcaatagatctg

SEQ ID NO: 9245001 - DNA, 22 bp, Homo sapiens
tcttataatctctattttaatg

SEQ ID NO: 9245002 - DNA, 22 bp, Homo sapiens
tcttatatgcacatacattggg

SEQ ID NO: 9245003 - DNA, 22 bp, Homo sapiens
tcttatcttatacctaacagcc

SEQ ID NO: 9245004 - DNA, 22 bp, Homo sapiens
tcttatgaaaagcacttagaac

SEQ ID NO: 9245005 - DNA, 22 bp, Homo sapiens
tctgttttgtgtctctctggtg

SEQ ID NO: 9245006 - DNA, 22 bp, Homo sapiens
tctgttttgtaccagatacagc

SEQ ID NO: 9245007 - DNA, 22 bp, Homo sapiens
tcttaaagccaagcataaacca

SEQ ID NO: 9245008 - DNA, 22 bp, Homo sapiens
tcttaaaagtatgccaattgga

SEQ ID NO: 9245009 - DNA, 22 bp, Homo sapiens
tcttaaaccacacatgtgctct

SEQ ID NO: 9245010 - DNA, 17 bp, Homo sapiens
tctgtttctcctttctt

SEQ ID NO: 9245011 - DNA, 22 bp, Homo sapiens
tctgtttctataaagacaagag

SEQ ID NO: 9245012 - DNA, 22 bp, Homo sapiens
tctgtttctccaacattgtgag

SEQ ID NO: 9245013 - DNA, 22 bp, Homo sapiens
tctgtttattcaatttctatat

SEQ ID NO: 9245014 - DNA, 22 bp, Homo sapiens
tctgtttcctcttgtgtaaagt

SEQ ID NO: 9245015 - DNA, 22 bp, Homo sapiens
tctgtttcctcttgtgtaaagt

SEQ ID NO: 9245016 - DNA, 22 bp, Homo sapiens
tctgtttcctcttgtgtaaagt

SEQ ID NO: 9245017 - DNA, 22 bp, Homo sapiens
tctgttttgcataatgttcttt

SEQ ID NO: 9245018 - DNA, 22 bp, Homo sapiens
tctgttttctctgtattttgac

SEQ ID NO: 9245019 - DNA, 23 bp, Homo sapiens
tctgttttgcaacatgtgacaag

SEQ ID NO: 9245020 - DNA, 23 bp, Homo sapiens
tctgttttgcaacatgtgacaag

SEQ ID NO: 9245021 - DNA, 22 bp, Homo sapiens
tctgtttcttcttctgttatat

SEQ ID NO: 9245022 - DNA, 22 bp, Homo sapiens
tctgttttcatttgtcttgaga

SEQ ID NO: 9245023 - DNA, 22 bp, Homo sapiens
tctgttttcatttgtcttgaga

SEQ ID NO: 9245024 - DNA, 22 bp, Homo sapiens
tctgtgccaagcttatatctgt

SEQ ID NO: 9245025 - DNA, 22 bp, Homo sapiens
tctgtgcagtcagggctcagtc

SEQ ID NO: 9245026 - DNA, 23 bp, Homo sapiens
tctgtgccagtttccatgtctgt

SEQ ID NO: 9245027 - DNA, 22 bp, Homo sapiens
tctgtgccagcagcctcctgga

SEQ ID NO: 9245028 - DNA, 23 bp, Homo sapiens
tctgtgccagtttccatgtctgt

SEQ ID NO: 9245029 - DNA, 22 bp, Homo sapiens
tctgtgcctcatctggttcagg

SEQ ID NO: 9245030 - DNA, 21 bp, Homo sapiens
tctgtgcctcaaccctcatct

SEQ ID NO: 9245031 - DNA, 21 bp, Homo sapiens
tctgtgcctcaaccctcatct

SEQ ID NO: 9245032 - DNA, 22 bp, Homo sapiens
tctgtgaacatcacattgacag

SEQ ID NO: 9245033 - DNA, 22 bp, Homo sapiens
tctgtgaaatcacccaggttta

SEQ ID NO: 9245034 - DNA, 22 bp, Homo sapiens
tctgtgaaacagctctggcatg

SEQ ID NO: 9245035 - DNA, 22 bp, Homo sapiens
tctgtctgcttcacttgcattt

SEQ ID NO: 9245036 - DNA, 22 bp, Homo sapiens
tctgtctgctcatttacctcag

SEQ ID NO: 9245037 - DNA, 22 bp, Homo sapiens
tctgtctgcgcttgccctggtg

SEQ ID NO: 9245038 - DNA, 22 bp, Homo sapiens
tctgtctgccttgtgagggcac

SEQ ID NO: 9245039 - DNA, 22 bp, Homo sapiens
tctgtctgccccagcaagtcac

SEQ ID NO: 9245040 - DNA, 22 bp, Homo sapiens
tctgtctgcacctaagcacagt

SEQ ID NO: 9245041 - DNA, 22 bp, Homo sapiens
tctgtctgagtggtgttagagt

SEQ ID NO: 9245042 - DNA, 22 bp, Homo sapiens
tctgtctgaggagtttttgacc

SEQ ID NO: 9245043 - DNA, 22 bp, Homo sapiens
tctgtctgagggagtgacattt

SEQ ID NO: 9245044 - DNA, 22 bp, Homo sapiens
tctgtctgagggagtgacattt

SEQ ID NO: 9245045 - DNA, 22 bp, Homo sapiens
tctgtggagttgaggaaggttg

SEQ ID NO: 9245046 - DNA, 23 bp, Homo sapiens
tctgtggctccttcaggctgctg

SEQ ID NO: 9245047 - DNA, 22 bp, Homo sapiens
tctgtggctgtgctgggccaga

SEQ ID NO: 9245048 - DNA, 22 bp, Homo sapiens
tctgtggctgtctttccagagg

SEQ ID NO: 9245049 - DNA, 22 bp, Homo sapiens
tctgtggagtgacctgggcttt

SEQ ID NO: 9245050 - DNA, 22 bp, Homo sapiens
tctgtgctttccctgccttctt

SEQ ID NO: 9245051 - DNA, 19 bp, Homo sapiens
tctgtgctgggaggcagca

SEQ ID NO: 9245052 - DNA, 22 bp, Homo sapiens
tctgtgctggactgatttcata

SEQ ID NO: 9245053 - DNA, 22 bp, Homo sapiens
tctgtgctgccatcctgtggcc

SEQ ID NO: 9245054 - DNA, 22 bp, Homo sapiens
tctgtgctagaggagttggcca

SEQ ID NO: 9245055 - DNA, 22 bp, Homo sapiens
tctgtgctcattcagtcattca

SEQ ID NO: 9245056 - DNA, 22 bp, Homo sapiens
tctgtgctcattcagtcattca

SEQ ID NO: 9245057 - DNA, 22 bp, Homo sapiens
tctgtgtctgcagaagttcagc

SEQ ID NO: 9245058 - DNA, 22 bp, Homo sapiens
tctgtgtctgttacttcactgc

SEQ ID NO: 9245059 - DNA, 22 bp, Homo sapiens
tctgtgtcctgctagctgtctt

SEQ ID NO: 9245060 - DNA, 22 bp, Homo sapiens
tctgagaatggagctaaaaatc

SEQ ID NO: 9245061 - DNA, 22 bp, Homo sapiens
tctgagaataaaaattgcattt

SEQ ID NO: 9245062 - DNA, 22 bp, Homo sapiens
tctgagaagtcctgtatttcta

SEQ ID NO: 9245063 - DNA, 23 bp, Homo sapiens
tctgagaaggtttcagccagact

SEQ ID NO: 9245064 - DNA, 22 bp, Homo sapiens
tctgagaaggaagctctgtgta

SEQ ID NO: 9245065 - DNA, 22 bp, Homo sapiens
tctgagaagggtaggctccatt

SEQ ID NO: 9245066 - DNA, 22 bp, Homo sapiens
tctgagaagctagaggacaaag

SEQ ID NO: 9245067 - DNA, 22 bp, Homo sapiens
tctgagaactccgggttagatc

SEQ ID NO: 9245068 - DNA, 17 bp, Homo sapiens
tctgagaacttgaagca

SEQ ID NO: 9245069 - DNA, 17 bp, Homo sapiens
tctgagaaaggagaatc

SEQ ID NO: 9245070 - DNA, 22 bp, Homo sapiens
tctgagaaagtactgtatgttc

SEQ ID NO: 9245071 - DNA, 22 bp, Homo sapiens
tctgagaaatcagtggtgaata

SEQ ID NO: 9245072 - DNA, 22 bp, Homo sapiens
tctgagaaatcagtggtgaata

SEQ ID NO: 9245073 - DNA, 22 bp, Homo sapiens
tctgagaacatgctttgatcat

SEQ ID NO: 9245074 - DNA, 22 bp, Homo sapiens
tctgagaacatcatttcctaca

SEQ ID NO: 9245075 - DNA, 22 bp, Homo sapiens
tctgagaacataaattgacttc

SEQ ID NO: 9245076 - DNA, 22 bp, Homo sapiens
tctgaccacagacaacctgcta

SEQ ID NO: 9245077 - DNA, 22 bp, Homo sapiens
tctgaccacagacaacctgcta

SEQ ID NO: 9245078 - DNA, 23 bp, Homo sapiens
tctgaccatttgacaacatcctg

SEQ ID NO: 9245079 - DNA, 22 bp, Homo sapiens
tctgaccaggctggctcagggc

SEQ ID NO: 9245080 - DNA, 22 bp, Homo sapiens
tctgacttatttgtccttggtg

SEQ ID NO: 9245081 - DNA, 22 bp, Homo sapiens
tctgacttcctccacatctgtt

SEQ ID NO: 9245082 - DNA, 22 bp, Homo sapiens
tctgacttggcgctcttgtctt

SEQ ID NO: 9245083 - DNA, 22 bp, Homo sapiens
tctgacattagattaattggaa

SEQ ID NO: 9245084 - DNA, 22 bp, Homo sapiens
tctgacagggccaaacatgaca

SEQ ID NO: 9245085 - DNA, 22 bp, Homo sapiens
tctgacaggtcattttctatag

SEQ ID NO: 9245086 - DNA, 22 bp, Homo sapiens
tctgacaatgaacaatctatag

SEQ ID NO: 9245087 - DNA, 22 bp, Homo sapiens
tctgacaatgaacaatctatag

SEQ ID NO: 9245088 - DNA, 22 bp, Homo sapiens
tctgacaataactgagtttaac

SEQ ID NO: 9245089 - DNA, 22 bp, Homo sapiens
tctgacaatgaacaatctatag

SEQ ID NO: 9245090 - DNA, 22 bp, Homo sapiens
tctgacaagtcaagtcttgact

SEQ ID NO: 9245091 - DNA, 22 bp, Homo sapiens
tctgagctaatcctgttgccga

SEQ ID NO: 9245092 - DNA, 22 bp, Homo sapiens
tctgagccgtatggcttggcta

SEQ ID NO: 9245093 - DNA, 22 bp, Homo sapiens
tctgagctacgatgcctgtcac

SEQ ID NO: 9245094 - DNA, 22 bp, Homo sapiens
tctgagctaatcctgttgccga

SEQ ID NO: 9245095 - DNA, 22 bp, Homo sapiens
tctgagctccatgcaggaggct

SEQ ID NO: 9245096 - DNA, 22 bp, Homo sapiens
tctgagctctatctgtgggaat

SEQ ID NO: 9245097 - DNA, 22 bp, Homo sapiens
tctgagctccatgcaggaggct

SEQ ID NO: 9245098 - DNA, 21 bp, Homo sapiens
tctgagctgagtcctctaggt

SEQ ID NO: 9245099 - DNA, 21 bp, Homo sapiens
tctgagctgagtcctctaggt

SEQ ID NO: 9245100 - DNA, 22 bp, Homo sapiens
tctgagcttctgcatttccaac

SEQ ID NO: 9245101 - DNA, 23 bp, Homo sapiens
tctgagctgtcttttcagcagaa

SEQ ID NO: 9245102 - DNA, 23 bp, Homo sapiens
tctgagctgtcttttcagcagaa

SEQ ID NO: 9245103 - DNA, 22 bp, Homo sapiens
tctgagctgtgagttgcttagg

SEQ ID NO: 9245104 - DNA, 22 bp, Homo sapiens
tctgagctgggcacagaaggcg

SEQ ID NO: 9245105 - DNA, 22 bp, Homo sapiens
tctgagctggagcccatcacct

SEQ ID NO: 9245106 - DNA, 22 bp, Homo sapiens
tctgagctggagcccatcacct

SEQ ID NO: 9245107 - DNA, 22 bp, Homo sapiens
tctgagccagacaagacagcca

SEQ ID NO: 9245108 - DNA, 22 bp, Homo sapiens
tctgagccacctgccagtgctg

SEQ ID NO: 9245109 - DNA, 22 bp, Homo sapiens
tctgagccacctgagcccatgg

SEQ ID NO: 9245110 - DNA, 22 bp, Homo sapiens
tctgagccacctgagcccatgg

SEQ ID NO: 9245111 - DNA, 22 bp, Homo sapiens
tctgagccaatttctgtgtcca

SEQ ID NO: 9245112 - DNA, 22 bp, Homo sapiens
tctgagcatatgcagcacctgg

SEQ ID NO: 9245113 - DNA, 22 bp, Homo sapiens
tctgagcagggcagtgtccatg

SEQ ID NO: 9245114 - DNA, 20 bp, Homo sapiens
tctgagacttgtagtgtgga

SEQ ID NO: 9245115 - DNA, 22 bp, Homo sapiens
tctgagacactcttgtgatggg

SEQ ID NO: 9245116 - DNA, 22 bp, Homo sapiens
tctgagaatggtggatgtggtg

SEQ ID NO: 9245117 - DNA, 22 bp, Homo sapiens
tctgagacaggaagtggagggt

SEQ ID NO: 9245118 - DNA, 19 bp, Homo sapiens
tctgaggcttctccccttg

SEQ ID NO: 9245119 - DNA, 22 bp, Homo sapiens
tctgagggaatagctattgtag

SEQ ID NO: 9245120 - DNA, 19 bp, Homo sapiens
tctgaggcttctccccttg

SEQ ID NO: 9245121 - DNA, 22 bp, Homo sapiens
tctgaggctgtctctgggctcc

SEQ ID NO: 9245122 - DNA, 22 bp, Homo sapiens
tctgaggctgtctctgggctcc

SEQ ID NO: 9245123 - DNA, 22 bp, Homo sapiens
tctgaggcttcagactgtactg

SEQ ID NO: 9245124 - DNA, 22 bp, Homo sapiens
tctgaggcttcagactgtactg

SEQ ID NO: 9245125 - DNA, 22 bp, Homo sapiens
tctgaggctgcatctatgtgac

SEQ ID NO: 9245126 - DNA, 22 bp, Homo sapiens
tctgaggctatgttcaggctaa

SEQ ID NO: 9245127 - DNA, 20 bp, Homo sapiens
tctgaggctgagctctactt

SEQ ID NO: 9245128 - DNA, 20 bp, Homo sapiens
tctgaggctgagcccagcgt

SEQ ID NO: 9245129 - DNA, 22 bp, Homo sapiens
tctgaggctgcatctatgtgac

SEQ ID NO: 9245130 - DNA, 22 bp, Homo sapiens
tctgaggtaccagctggtttat

SEQ ID NO: 9245131 - DNA, 22 bp, Homo sapiens
tctgaggtaccagctggtttat

SEQ ID NO: 9245132 - DNA, 20 bp, Homo sapiens
tctgaggtatgatagggtct

SEQ ID NO: 9245133 - DNA, 22 bp, Homo sapiens
tctgaggtcacagatttcaaga

SEQ ID NO: 9245134 - DNA, 22 bp, Homo sapiens
tctgaggccctaccctgagcct

SEQ ID NO: 9245135 - DNA, 22 bp, Homo sapiens
tctgaggccctaccctgagcct

SEQ ID NO: 9245136 - DNA, 22 bp, Homo sapiens
tctgaggaattctgcagtgaga

SEQ ID NO: 9245137 - DNA, 22 bp, Homo sapiens
tctgaggaataagaaggaagtg

SEQ ID NO: 9245138 - DNA, 18 bp, Homo sapiens
tctgaggaatggaagagc

SEQ ID NO: 9245139 - DNA, 22 bp, Homo sapiens
tctgaggaaaagaggaggtagc

SEQ ID NO: 9245140 - DNA, 22 bp, Homo sapiens
tctgaggaaagagagtgggatg

SEQ ID NO: 9245141 - DNA, 22 bp, Homo sapiens
tctgaggaagcagcaggaagtg

SEQ ID NO: 9245142 - DNA, 22 bp, Homo sapiens
tctgaggccctgcaggcagtgt

SEQ ID NO: 9245143 - DNA, 22 bp, Homo sapiens
tctgaggccttcagcatgaatc

SEQ ID NO: 9245144 - DNA, 22 bp, Homo sapiens
tctgaggccttggcagctaagg

SEQ ID NO: 9245145 - DNA, 22 bp, Homo sapiens
tctgaggccttgggacagaagt

SEQ ID NO: 9245146 - DNA, 22 bp, Homo sapiens
tctgaggctaagagacagaggc

SEQ ID NO: 9245147 - DNA, 22 bp, Homo sapiens
tctgaggctaagagacagaggc

SEQ ID NO: 9245148 - DNA, 22 bp, Homo sapiens
tctgaggctaagagacagaggc

SEQ ID NO: 9245149 - DNA, 22 bp, Homo sapiens
tctgcaacattcctctccccac

SEQ ID NO: 9245150 - DNA, 22 bp, Homo sapiens
tctgcaagcgtcacatgattct

SEQ ID NO: 9245151 - DNA, 22 bp, Homo sapiens
tctgcaagatggtcttagaggt

SEQ ID NO: 9245152 - DNA, 22 bp, Homo sapiens
tctgcaaactggctcttactgc

SEQ ID NO: 9245153 - DNA, 22 bp, Homo sapiens
tctgcaaacttaagttgaaata

SEQ ID NO: 9245154 - DNA, 22 bp, Homo sapiens
tctgcaaacccccatctatcat

SEQ ID NO: 9245155 - DNA, 22 bp, Homo sapiens
tctgcaacagtgccctgtaaat

SEQ ID NO: 9245156 - DNA, 22 bp, Homo sapiens
tctgcaaaagtgttcataaaga

SEQ ID NO: 9245157 - DNA, 22 bp, Homo sapiens
tctgattccagtgaccctagga

SEQ ID NO: 9245158 - DNA, 22 bp, Homo sapiens
tctgattgatgcagaccatatt

SEQ ID NO: 9245159 - DNA, 22 bp, Homo sapiens
tctgattcattcatgtgcacca

SEQ ID NO: 9245160 - DNA, 22 bp, Homo sapiens
tctgattcattcatgtgcacca

SEQ ID NO: 9245161 - DNA, 22 bp, Homo sapiens
tctgattagagcattcttgagt

SEQ ID NO: 9245162 - DNA, 22 bp, Homo sapiens
tctgatgtgtttaagaaagaag

SEQ ID NO: 9245163 - DNA, 22 bp, Homo sapiens
tctgatgttgtgacatcacttc

SEQ ID NO: 9245164 - DNA, 23 bp, Homo sapiens
tctgatgttctcttatgctgtag

SEQ ID NO: 9245165 - DNA, 22 bp, Homo sapiens
tctgatgttgcttctgcagaac

SEQ ID NO: 9245166 - DNA, 21 bp, Homo sapiens
tctgatgtgtttaatggtggg

SEQ ID NO: 9245167 - DNA, 22 bp, Homo sapiens
tctgaggttaatcctgctgcat

SEQ ID NO: 9245168 - DNA, 22 bp, Homo sapiens
tctgaggttaatcctgctgcat

SEQ ID NO: 9245169 - DNA, 22 bp, Homo sapiens
tctgaggtgtcacaaggccagg

SEQ ID NO: 9245170 - DNA, 22 bp, Homo sapiens
tctgaggttactgctttgtaga

SEQ ID NO: 9245171 - DNA, 22 bp, Homo sapiens
tctgaggttattgtctgccatt

SEQ ID NO: 9245172 - DNA, 22 bp, Homo sapiens
tctgaggttactgctttgtaga

SEQ ID NO: 9245173 - DNA, 22 bp, Homo sapiens
tctgaggttattgtctgccatt

SEQ ID NO: 9245174 - DNA, 22 bp, Homo sapiens
tctgatgtaggcttttctggga

SEQ ID NO: 9245175 - DNA, 21 bp, Homo sapiens
tctgatggtagatgagatgtg

SEQ ID NO: 9245176 - DNA, 21 bp, Homo sapiens
tctgatggtagatgagatgtg

SEQ ID NO: 9245177 - DNA, 21 bp, Homo sapiens
tctgatggtagatgagatgtg

SEQ ID NO: 9245178 - DNA, 22 bp, Homo sapiens
tctgatgcaatgtaagtcttgg

SEQ ID NO: 9245179 - DNA, 21 bp, Homo sapiens
tctgatggtagatgagatgtg

SEQ ID NO: 9245180 - DNA, 22 bp, Homo sapiens
tctgaggtggacgatggagcct

SEQ ID NO: 9245181 - DNA, 23 bp, Homo sapiens
tctgaggtggctcttgctttgaa

SEQ ID NO: 9245182 - DNA, 23 bp, Homo sapiens
tctgaggtggctcttgctttgaa

SEQ ID NO: 9245183 - DNA, 22 bp, Homo sapiens
tctgaggtggggctggagcatt

SEQ ID NO: 9245184 - DNA, 22 bp, Homo sapiens
tctgaggtgtagctgggcttca

SEQ ID NO: 9245185 - DNA, 19 bp, Homo sapiens
tctgaggtggaactggggg

SEQ ID NO: 9245186 - DNA, 22 bp, Homo sapiens
tctgaggtggacgatggagcct

SEQ ID NO: 9245187 - DNA, 18 bp, Homo sapiens
tctgaggtggacgaggag

SEQ ID NO: 9245188 - DNA, 19 bp, Homo sapiens
tctgaggtggaactggggg

SEQ ID NO: 9245189 - DNA, 17 bp, Homo sapiens
tctgaggtgaggatgca

SEQ ID NO: 9245190 - DNA, 22 bp, Homo sapiens
tctgaggtctatgactttgctt

SEQ ID NO: 9245191 - DNA, 23 bp, Homo sapiens
tctgaggtccaccagtttgcaga

SEQ ID NO: 9245192 - DNA, 23 bp, Homo sapiens
tctgaggtccaccagtttgcaga

SEQ ID NO: 9245193 - DNA, 22 bp, Homo sapiens
tctgaggtcctactataagtgg

SEQ ID NO: 9245194 - DNA, 22 bp, Homo sapiens
tctgaggtctcatgacttgcat

SEQ ID NO: 9245195 - DNA, 22 bp, Homo sapiens
tctgaggtctatgactttgctt

SEQ ID NO: 9245196 - DNA, 22 bp, Homo sapiens
tctgaggtcctgtgatttctct

SEQ ID NO: 9245197 - DNA, 22 bp, Homo sapiens
tctgaggtcagtgctgcagtta

SEQ ID NO: 9245198 - DNA, 22 bp, Homo sapiens
tctgaggtcagtgctgcagtta

SEQ ID NO: 9245199 - DNA, 22 bp, Homo sapiens
tctgaggtcattccaaggacat

SEQ ID NO: 9245200 - DNA, 22 bp, Homo sapiens
tctgaggtcataaagcaacttt

SEQ ID NO: 9245201 - DNA, 22 bp, Homo sapiens
tctgaggtcattccaaggacat

SEQ ID NO: 9245202 - DNA, 22 bp, Homo sapiens
tctgcccacagtccaatagttg

SEQ ID NO: 9245203 - DNA, 22 bp, Homo sapiens
tctgcccacagcctcctgtcca

SEQ ID NO: 9245204 - DNA, 20 bp, Homo sapiens
tctgcccaccccggctccca

SEQ ID NO: 9245205 - DNA, 22 bp, Homo sapiens
tctgcccactgctctgctgccc

SEQ ID NO: 9245206 - DNA, 22 bp, Homo sapiens
tctgcccactgctctgctgccc

SEQ ID NO: 9245207 - DNA, 22 bp, Homo sapiens
tctgccctcattgctgcctgga

SEQ ID NO: 9245208 - DNA, 22 bp, Homo sapiens
tctgccctcattgctgcctgga

SEQ ID NO: 9245209 - DNA, 21 bp, Homo sapiens
tctgccctccaggagctcata

SEQ ID NO: 9245210 - DNA, 22 bp, Homo sapiens
tctgccctaattcagtgcttag

SEQ ID NO: 9245211 - DNA, 22 bp, Homo sapiens
tctgcccagtttgtgctcaggt

SEQ ID NO: 9245212 - DNA, 19 bp, Homo sapiens
tctgcccagttgtctgccc

SEQ ID NO: 9245213 - DNA, 22 bp, Homo sapiens
tctgcctgagggagctgaggaa

SEQ ID NO: 9245214 - DNA, 18 bp, Homo sapiens
tctgcctgcagggcatct

SEQ ID NO: 9245215 - DNA, 22 bp, Homo sapiens
tctgcctgagggagctgaggaa

SEQ ID NO: 9245216 - DNA, 22 bp, Homo sapiens
tctgcctgccagtctggtcctc

SEQ ID NO: 9245217 - DNA, 22 bp, Homo sapiens
tctgcctgccagtctggtcctc

SEQ ID NO: 9245218 - DNA, 22 bp, Homo sapiens
tctgcctgccagtctggtcctc

SEQ ID NO: 9245219 - DNA, 22 bp, Homo sapiens
tctgcctgccgagaacacctac

SEQ ID NO: 9245220 - DNA, 22 bp, Homo sapiens
tctgcctgcagtgtggcagggc

SEQ ID NO: 9245221 - DNA, 22 bp, Homo sapiens
tctgcctgcagtgtggcagggc

SEQ ID NO: 9245222 - DNA, 22 bp, Homo sapiens
tctgccctggggtcagcctcca

SEQ ID NO: 9245223 - DNA, 22 bp, Homo sapiens
tctgccctggggtcagcctcca

SEQ ID NO: 9245224 - DNA, 22 bp, Homo sapiens
tctgcccttggctctcttgttg

SEQ ID NO: 9245225 - DNA, 22 bp, Homo sapiens
tctgccctggggtcagcctcca

SEQ ID NO: 9245226 - DNA, 22 bp, Homo sapiens
tctgcccttggctctcttgttg

SEQ ID NO: 9245227 - DNA, 22 bp, Homo sapiens
tctgccgtgcgaggtcccacca

SEQ ID NO: 9245228 - DNA, 22 bp, Homo sapiens
tctgcctgagcagagggaggcc

SEQ ID NO: 9245229 - DNA, 22 bp, Homo sapiens
tctgcctgagcagagggaggcc

SEQ ID NO: 9245230 - DNA, 22 bp, Homo sapiens
tctgcctgagaagtggggtgcc

SEQ ID NO: 9245231 - DNA, 21 bp, Homo sapiens
tctgcctgagactttgctggt

SEQ ID NO: 9245232 - DNA, 22 bp, Homo sapiens
tctgctcagtgcttatctctaa

SEQ ID NO: 9245233 - DNA, 22 bp, Homo sapiens
tctgctcaggttacctagctag

SEQ ID NO: 9245234 - DNA, 22 bp, Homo sapiens
tctgctcaggttacctagctag

SEQ ID NO: 9245235 - DNA, 20 bp, Homo sapiens
tctgctcagccctcagtggc

SEQ ID NO: 9245236 - DNA, 22 bp, Homo sapiens
tctgccttcgctgctccctgaa

SEQ ID NO: 9245237 - DNA, 22 bp, Homo sapiens
tctgccttgaggtcctcagctc

SEQ ID NO: 9245238 - DNA, 22 bp, Homo sapiens
tctgcctgttgagcctaaggcc

SEQ ID NO: 9245239 - DNA, 22 bp, Homo sapiens
tctgcctgttgctagaatgtca

SEQ ID NO: 9245240 - DNA, 22 bp, Homo sapiens
tctgcctgttgagcctaaggcc

SEQ ID NO: 9245241 - DNA, 22 bp, Homo sapiens
tctgccttccccataatctgat

SEQ ID NO: 9245242 - DNA, 22 bp, Homo sapiens
tctgccttcgctgctccctgaa

SEQ ID NO: 9245243 - DNA, 22 bp, Homo sapiens
tctgcctgtgctgtgttttcat

SEQ ID NO: 9245244 - DNA, 22 bp, Homo sapiens
tctgcctgtggatacatgctct

SEQ ID NO: 9245245 - DNA, 22 bp, Homo sapiens
tctgcctgtggtggaggaagtt

SEQ ID NO: 9245246 - DNA, 22 bp, Homo sapiens
tctgcctgttcaagtcttctag

SEQ ID NO: 9245247 - DNA, 22 bp, Homo sapiens
tctgcctgttcaagtcttctag

SEQ ID NO: 9245248 - DNA, 22 bp, Homo sapiens
tctgcctgttcaagtcttctag

SEQ ID NO: 9245249 - DNA, 22 bp, Homo sapiens
tctgcctggctcatggcagtga

SEQ ID NO: 9245250 - DNA, 22 bp, Homo sapiens
tctgcctggctcatggcagtga

SEQ ID NO: 9245251 - DNA, 22 bp, Homo sapiens
tctgcctgggtgtggagcagag

SEQ ID NO: 9245252 - DNA, 22 bp, Homo sapiens
tctgcctgtacctcttttttgc

SEQ ID NO: 9245253 - DNA, 22 bp, Homo sapiens
tctgcctggcctggagggcaca

SEQ ID NO: 9245254 - DNA, 22 bp, Homo sapiens
tctgcctggcctggagggcaca

SEQ ID NO: 9245255 - DNA, 22 bp, Homo sapiens
tctgcctggattttggaaagct

SEQ ID NO: 9245256 - DNA, 22 bp, Homo sapiens
tctgcctggattttggaaagct

SEQ ID NO: 9245257 - DNA, 22 bp, Homo sapiens
tctgcctggattccattctcca

SEQ ID NO: 9245258 - DNA, 22 bp, Homo sapiens
tctgcctggatgatggcagggc

SEQ ID NO: 9245259 - DNA, 22 bp, Homo sapiens
tctgcctgcgctcacggggccg

SEQ ID NO: 9245260 - DNA, 22 bp, Homo sapiens
tctgcctgcggctgcaggtggc

SEQ ID NO: 9245261 - DNA, 22 bp, Homo sapiens
tctgcctgcggctgcaggtggc

SEQ ID NO: 9245262 - DNA, 22 bp, Homo sapiens
tctgcctgcggctgcaggtggc

SEQ ID NO: 9245263 - DNA, 22 bp, Homo sapiens
tctgcctgcggctgcaggtggc

SEQ ID NO: 9245264 - DNA, 22 bp, Homo sapiens
tctgcctgctaactcctgcacc

SEQ ID NO: 9245265 - DNA, 22 bp, Homo sapiens
tctgcctgctaactcctgcacc

SEQ ID NO: 9245266 - DNA, 22 bp, Homo sapiens
tctgcctggagagttcttctct

SEQ ID NO: 9245267 - DNA, 22 bp, Homo sapiens
tctgcctggatgatggcagggc

SEQ ID NO: 9245268 - DNA, 22 bp, Homo sapiens
tctgcctgcttcttcatagtct

SEQ ID NO: 9245269 - DNA, 22 bp, Homo sapiens
tctgccaggtggggagaggcca

SEQ ID NO: 9245270 - DNA, 22 bp, Homo sapiens
tctgccaggcctgcttccgggg

SEQ ID NO: 9245271 - DNA, 23 bp, Homo sapiens
tctgccagtgtgtgccaggagcc

SEQ ID NO: 9245272 - DNA, 23 bp, Homo sapiens
tctgccagtgtgtgccaggagcc

SEQ ID NO: 9245273 - DNA, 22 bp, Homo sapiens
tctgccagtttatagacaagcc

SEQ ID NO: 9245274 - DNA, 22 bp, Homo sapiens
tctgccagtttatagacaagcc

SEQ ID NO: 9245275 - DNA, 22 bp, Homo sapiens
tctgccatgctaacttcagtat

SEQ ID NO: 9245276 - DNA, 22 bp, Homo sapiens
tctgcaggtgggcccctagaat

SEQ ID NO: 9245277 - DNA, 22 bp, Homo sapiens
tctgcaggtcacgctccagcct

SEQ ID NO: 9245278 - DNA, 22 bp, Homo sapiens
tctgcaggtgggcccctagaat

SEQ ID NO: 9245279 - DNA, 22 bp, Homo sapiens
tctgcattattggaaagtcctt

SEQ ID NO: 9245280 - DNA, 21 bp, Homo sapiens
tctgcattttagcaagatctc

SEQ ID NO: 9245281 - DNA, 22 bp, Homo sapiens
tctgcatttttaacaagatccc

SEQ ID NO: 9245282 - DNA, 22 bp, Homo sapiens
tctgcatttttacaagatcccc

SEQ ID NO: 9245283 - DNA, 22 bp, Homo sapiens
tctgcagggcccttggctcctg

SEQ ID NO: 9245284 - DNA, 22 bp, Homo sapiens
tctgcagggtcccagcctcagc

SEQ ID NO: 9245285 - DNA, 22 bp, Homo sapiens
tctgcaggaggctggctgcagg

SEQ ID NO: 9245286 - DNA, 22 bp, Homo sapiens
tctgcaggagagtgccctagag

SEQ ID NO: 9245287 - DNA, 22 bp, Homo sapiens
tctgcaggagagtgccctagag

SEQ ID NO: 9245288 - DNA, 22 bp, Homo sapiens
tctgcagcttgcacaggcaggc

SEQ ID NO: 9245289 - DNA, 22 bp, Homo sapiens
tctgcagctttttggtggggtg

SEQ ID NO: 9245290 - DNA, 22 bp, Homo sapiens
tctgcagcttcttgccagagag

SEQ ID NO: 9245291 - DNA, 22 bp, Homo sapiens
tctgcagcgtgcaggctggtgc

SEQ ID NO: 9245292 - DNA, 22 bp, Homo sapiens
tctgcaagctaaggaagcatct

SEQ ID NO: 9245293 - DNA, 19 bp, Homo sapiens
tctgcaagtgtcagaggcg

SEQ ID NO: 9245294 - DNA, 22 bp, Homo sapiens
tctgcacataggtaggctggaa

SEQ ID NO: 9245295 - DNA, 22 bp, Homo sapiens
tctgcacatggcgctggtcctg

SEQ ID NO: 9245296 - DNA, 22 bp, Homo sapiens
tctgcagaaagtggctcagtgg

SEQ ID NO: 9245297 - DNA, 22 bp, Homo sapiens
tctgcagaagaattaaggacag

SEQ ID NO: 9245298 - DNA, 22 bp, Homo sapiens
tctgcagaactttatgagcaaa

SEQ ID NO: 9245299 - DNA, 22 bp, Homo sapiens
tctgcagaaactgtgactatgt

SEQ ID NO: 9245300 - DNA, 22 bp, Homo sapiens
tctgggcagcagcagctagtag

SEQ ID NO: 9245301 - DNA, 21 bp, Homo sapiens
tctgggcagcccagtcctgag

SEQ ID NO: 9245302 - DNA, 22 bp, Homo sapiens
tctgggcagcagcagctagtag

SEQ ID NO: 9245303 - DNA, 22 bp, Homo sapiens
tctgggcagagggtcttagtca

SEQ ID NO: 9245304 - DNA, 22 bp, Homo sapiens
tctgggcagaagcagtgcaaag

SEQ ID NO: 9245305 - DNA, 22 bp, Homo sapiens
tctgggcactgctgagcctgta

SEQ ID NO: 9245306 - DNA, 22 bp, Homo sapiens
tctgggcagagggtcttagtca

SEQ ID NO: 9245307 - DNA, 22 bp, Homo sapiens
tctgggcagcctcaggccaggg

SEQ ID NO: 9245308 - DNA, 20 bp, Homo sapiens
tctgggcagggcacatggaa

SEQ ID NO: 9245309 - DNA, 19 bp, Homo sapiens
tctgggcagggccagcacc

SEQ ID NO: 9245310 - DNA, 22 bp, Homo sapiens
tctgggcaatggatgcactcac

SEQ ID NO: 9245311 - DNA, 18 bp, Homo sapiens
tctgggcaatctcagtat

SEQ ID NO: 9245312 - DNA, 18 bp, Homo sapiens
tctgggcaatctcagtat

SEQ ID NO: 9245313 - DNA, 22 bp, Homo sapiens
tctgggcacacaccatgcccac

SEQ ID NO: 9245314 - DNA, 22 bp, Homo sapiens
tctgggcactgctgagcctgta

SEQ ID NO: 9245315 - DNA, 23 bp, Homo sapiens
tctgggcaccttgttgacatgat

SEQ ID NO: 9245316 - DNA, 22 bp, Homo sapiens
tctgggatgaagccagaaactt

SEQ ID NO: 9245317 - DNA, 22 bp, Homo sapiens
tctgggatagggccagaacatg

SEQ ID NO: 9245318 - DNA, 22 bp, Homo sapiens
tctgggataagaccacagattt

SEQ ID NO: 9245319 - DNA, 22 bp, Homo sapiens
tctgggattttatagacatgct

SEQ ID NO: 9245320 - DNA, 22 bp, Homo sapiens
tctgggatttttgacactgaag

SEQ ID NO: 9245321 - DNA, 22 bp, Homo sapiens
tctgggatgagatcagagacac

SEQ ID NO: 9245322 - DNA, 22 bp, Homo sapiens
tctgggatgcaaacagaatctg

SEQ ID NO: 9245323 - DNA, 22 bp, Homo sapiens
tctgggatgcaaacagaatctg

SEQ ID NO: 9245324 - DNA, 23 bp, Homo sapiens
tctgggctgagacttggaaggtc

SEQ ID NO: 9245325 - DNA, 23 bp, Homo sapiens
tctgggctgagctcgagtgtaga

SEQ ID NO: 9245326 - DNA, 22 bp, Homo sapiens
tctgggctgaaatgaaggcctt

SEQ ID NO: 9245327 - DNA, 22 bp, Homo sapiens
tctgggctgctatgaggcagag

SEQ ID NO: 9245328 - DNA, 22 bp, Homo sapiens
tctgggctgctgtgcagtgacc

SEQ ID NO: 9245329 - DNA, 22 bp, Homo sapiens
tctgggcatgtctgtgaacacg

SEQ ID NO: 9245330 - DNA, 22 bp, Homo sapiens
tctgggctcttagtgtaccctc

SEQ ID NO: 9245331 - DNA, 22 bp, Homo sapiens
tctgggctcttagtgtaccctc

SEQ ID NO: 9245332 - DNA, 22 bp, Homo sapiens
tctgggagagcacgtggctgac

SEQ ID NO: 9245333 - DNA, 22 bp, Homo sapiens
tctgggagagctgctgtcagag

SEQ ID NO: 9245334 - DNA, 22 bp, Homo sapiens
tctgggagagctgctgtcagag

SEQ ID NO: 9245335 - DNA, 22 bp, Homo sapiens
tctgggaatgaggcttgggcaa

SEQ ID NO: 9245336 - DNA, 19 bp, Homo sapiens
tctgggaatgatgccagca

SEQ ID NO: 9245337 - DNA, 22 bp, Homo sapiens
tctgggaataaaactagggact

SEQ ID NO: 9245338 - DNA, 22 bp, Homo sapiens
tctgggaatacacactgattta

SEQ ID NO: 9245339 - DNA, 22 bp, Homo sapiens
tctgggaagtcctctgtcatgc

SEQ ID NO: 9245340 - DNA, 22 bp, Homo sapiens
tctgggaagttggcagccagct

SEQ ID NO: 9245341 - DNA, 22 bp, Homo sapiens
tctgggagggagcctcagaatc

SEQ ID NO: 9245342 - DNA, 22 bp, Homo sapiens
tctgggaggtactgggaggtgt

SEQ ID NO: 9245343 - DNA, 22 bp, Homo sapiens
tctgggaggtcacattggtctt

SEQ ID NO: 9245344 - DNA, 22 bp, Homo sapiens
tctggctctcaacaaatattta

SEQ ID NO: 9245345 - DNA, 22 bp, Homo sapiens
tctggctgaagcttttgcagct

SEQ ID NO: 9245346 - DNA, 22 bp, Homo sapiens
tctggcccatgatcctgctaac

SEQ ID NO: 9245347 - DNA, 22 bp, Homo sapiens
tctggcccctggtctctggtgt

SEQ ID NO: 9245348 - DNA, 22 bp, Homo sapiens
tctggcccctggcagtcctgga

SEQ ID NO: 9245349 - DNA, 23 bp, Homo sapiens
tctggctccatccttggggatcc

SEQ ID NO: 9245350 - DNA, 22 bp, Homo sapiens
tctggctccacacctcactgca

SEQ ID NO: 9245351 - DNA, 22 bp, Homo sapiens
tctggctttcctggagcaagaa

SEQ ID NO: 9245352 - DNA, 22 bp, Homo sapiens
tctggctttcatttgtttaaag

SEQ ID NO: 9245353 - DNA, 21 bp, Homo sapiens
tctggctttcattccccttct

SEQ ID NO: 9245354 - DNA, 22 bp, Homo sapiens
tctggctgacatcctgtatgag

SEQ ID NO: 9245355 - DNA, 22 bp, Homo sapiens
tctggcttttattcagttggca

SEQ ID NO: 9245356 - DNA, 22 bp, Homo sapiens
tctgggaaagtaaatgtaaagg

SEQ ID NO: 9245357 - DNA, 22 bp, Homo sapiens
tctgggaaatggctacttgtca

SEQ ID NO: 9245358 - DNA, 22 bp, Homo sapiens
tctgggaacagcctggctgtgt

SEQ ID NO: 9245359 - DNA, 22 bp, Homo sapiens
tctgggaacatggcttggaatc

SEQ ID NO: 9245360 - DNA, 22 bp, Homo sapiens
tctgggaacactttgtgagctc

SEQ ID NO: 9245361 - DNA, 22 bp, Homo sapiens
tctgggaaatggctacttgtca

SEQ ID NO: 9245362 - DNA, 22 bp, Homo sapiens
tctgggaaatgggcagcttcgc

SEQ ID NO: 9245363 - DNA, 21 bp, Homo sapiens
tctgggaaattgggaaagaag

SEQ ID NO: 9245364 - DNA, 22 bp, Homo sapiens
tctgggaacacacgtcacttca

SEQ ID NO: 9245365 - DNA, 22 bp, Homo sapiens
tctgggaactctgtcatttccc

SEQ ID NO: 9245366 - DNA, 22 bp, Homo sapiens
tctgggaactatatctggtggt

SEQ ID NO: 9245367 - DNA, 22 bp, Homo sapiens
tctgggaactctgtcatttccc

SEQ ID NO: 9245368 - DNA, 22 bp, Homo sapiens
tctgggaactatatctggtggt

SEQ ID NO: 9245369 - DNA, 22 bp, Homo sapiens
tctgggaacgaaggctaatatg

SEQ ID NO: 9245370 - DNA, 22 bp, Homo sapiens
tctgggaaccagtgcggctggg

SEQ ID NO: 9245371 - DNA, 22 bp, Homo sapiens
tctgggaacgaaggctaatatg

SEQ ID NO: 9245372 - DNA, 22 bp, Homo sapiens
tctgggaaccattggtggggat

SEQ ID NO: 9245373 - DNA, 22 bp, Homo sapiens
tctgggaagcctgtatgcagaa

SEQ ID NO: 9245374 - DNA, 22 bp, Homo sapiens
tctgggaagcaaatatgtaaga

SEQ ID NO: 9245375 - DNA, 19 bp, Homo sapiens
tctgggaagccgggctcca

SEQ ID NO: 9245376 - DNA, 22 bp, Homo sapiens
tctgggaaggctctgcagatat

SEQ ID NO: 9245377 - DNA, 22 bp, Homo sapiens
tctggagggcccacatccacaa

SEQ ID NO: 9245378 - DNA, 22 bp, Homo sapiens
tctggagtgaatgaagtagtgt

SEQ ID NO: 9245379 - DNA, 22 bp, Homo sapiens
tctggagtggacccagagcact

SEQ ID NO: 9245380 - DNA, 22 bp, Homo sapiens
tctggagtgccctgctctgccc

SEQ ID NO: 9245381 - DNA, 22 bp, Homo sapiens
tctggagtccagatccatttgg

SEQ ID NO: 9245382 - DNA, 22 bp, Homo sapiens
tctggagtcctggaatcagcta

SEQ ID NO: 9245383 - DNA, 22 bp, Homo sapiens
tctggagtctggtggttatggt

SEQ ID NO: 9245384 - DNA, 22 bp, Homo sapiens
tctggagtctgagatctgagga

SEQ ID NO: 9245385 - DNA, 22 bp, Homo sapiens
tctggagtctaaagaaccaaaa

SEQ ID NO: 9245386 - DNA, 22 bp, Homo sapiens
tctggagtatgtccctggtgaa

SEQ ID NO: 9245387 - DNA, 22 bp, Homo sapiens
tctggagtagggtctgggaatt

SEQ ID NO: 9245388 - DNA, 21 bp, Homo sapiens
tctggagtcatctttaccata

SEQ ID NO: 9245389 - DNA, 22 bp, Homo sapiens
tctggagtatgtgtgaacggtg

SEQ ID NO: 9245390 - DNA, 22 bp, Homo sapiens
tctggagtaggacctgaaaata

SEQ ID NO: 9245391 - DNA, 20 bp, Homo sapiens
tctggagtagagcacaggca

SEQ ID NO: 9245392 - DNA, 22 bp, Homo sapiens
tctggagtaactctgtttctgg

SEQ ID NO: 9245393 - DNA, 22 bp, Homo sapiens
tctggagtaattacagtgactg

SEQ ID NO: 9245394 - DNA, 22 bp, Homo sapiens
tctggatgaaagggctatatat

SEQ ID NO: 9245395 - DNA, 22 bp, Homo sapiens
tctggatggtcagctcttcctg

SEQ ID NO: 9245396 - DNA, 22 bp, Homo sapiens
tctggagttactgctggctttg

SEQ ID NO: 9245397 - DNA, 22 bp, Homo sapiens
tctggagttagttataatggtt

SEQ ID NO: 9245398 - DNA, 22 bp, Homo sapiens
tctggagtgtttctaattactg

SEQ ID NO: 9245399 - DNA, 22 bp, Homo sapiens
tctggagtgtccagttctactc

SEQ ID NO: 9245400 - DNA, 22 bp, Homo sapiens
tctggagtgtgtgtattcagct

SEQ ID NO: 9245401 - DNA, 22 bp, Homo sapiens
tctggagtggagctgatcattt

SEQ ID NO: 9245402 - DNA, 22 bp, Homo sapiens
tctggagtggaggtgccttggg

SEQ ID NO: 9245403 - DNA, 22 bp, Homo sapiens
tctggagtggcagtcatctgaa

SEQ ID NO: 9245404 - DNA, 22 bp, Homo sapiens
tctggagtgggactttgcatct

SEQ ID NO: 9245405 - DNA, 22 bp, Homo sapiens
tctggagttgaagttcttcccc

SEQ ID NO: 9245406 - DNA, 22 bp, Homo sapiens
tctggagttgcatgttttggct

SEQ ID NO: 9245407 - DNA, 22 bp, Homo sapiens
tctggagttgtgcagtggacct

SEQ ID NO: 9245408 - DNA, 22 bp, Homo sapiens
tctggagtttgagcacttcaat

SEQ ID NO: 9245409 - DNA, 22 bp, Homo sapiens
tctggagttgagagtgtgcgag

SEQ ID NO: 9245410 - DNA, 22 bp, Homo sapiens
tctggagttcctgcaggctgtg

SEQ ID NO: 9245411 - DNA, 22 bp, Homo sapiens
tctggagttttttctgtctgtg

SEQ ID NO: 9245412 - DNA, 22 bp, Homo sapiens
tctggagtttgaggacaagctt

SEQ ID NO: 9245413 - DNA, 22 bp, Homo sapiens
tctggcccagcccctgaggtca

SEQ ID NO: 9245414 - DNA, 22 bp, Homo sapiens
tctggccatggcaagccgagtg

SEQ ID NO: 9245415 - DNA, 22 bp, Homo sapiens
tctggccactaataggtctcac

SEQ ID NO: 9245416 - DNA, 22 bp, Homo sapiens
tctggccagtgaaatgcagaat

SEQ ID NO: 9245417 - DNA, 22 bp, Homo sapiens
tctggccaggatggcaagacca

SEQ ID NO: 9245418 - DNA, 22 bp, Homo sapiens
tctggcagtgatttctgtgatc

SEQ ID NO: 9245419 - DNA, 22 bp, Homo sapiens
tctggccacccgaggcccctgc

SEQ ID NO: 9245420 - DNA, 22 bp, Homo sapiens
tctggccacccgaggcccctgc

SEQ ID NO: 9245421 - DNA, 22 bp, Homo sapiens
tctggccaacaaaaactaagtc

SEQ ID NO: 9245422 - DNA, 22 bp, Homo sapiens
tctggcatctgttttcatattt

SEQ ID NO: 9245423 - DNA, 22 bp, Homo sapiens
tctggcagggtgtgtatttaca

SEQ ID NO: 9245424 - DNA, 20 bp, Homo sapiens
tctggcaggtgaacgagctg

SEQ ID NO: 9245425 - DNA, 22 bp, Homo sapiens
tctggcaaaggcaaccacagtt

SEQ ID NO: 9245426 - DNA, 22 bp, Homo sapiens
tctggcactgggctgtgtgagc

SEQ ID NO: 9245427 - DNA, 22 bp, Homo sapiens
tctggcaccctgacttagtgtt

SEQ ID NO: 9245428 - DNA, 22 bp, Homo sapiens
tctggcacttgccagtttctat

SEQ ID NO: 9245429 - DNA, 22 bp, Homo sapiens
tctgctgctacagactctctag

SEQ ID NO: 9245430 - DNA, 22 bp, Homo sapiens
tctgctgaatggagccaacctc

SEQ ID NO: 9245431 - DNA, 22 bp, Homo sapiens
tctgctgacatttatgaataga

SEQ ID NO: 9245432 - DNA, 22 bp, Homo sapiens
tctgctgacatttatgaataga

SEQ ID NO: 9245433 - DNA, 22 bp, Homo sapiens
tctgctgacctttctctgacac

SEQ ID NO: 9245434 - DNA, 22 bp, Homo sapiens
tctgctgaatcagatagctaag

SEQ ID NO: 9245435 - DNA, 22 bp, Homo sapiens
tctgctgaacttgctgcccaga

SEQ ID NO: 9245436 - DNA, 22 bp, Homo sapiens
tctgctgagtcagacctctggg

SEQ ID NO: 9245437 - DNA, 22 bp, Homo sapiens
tctgctgaggtggttttagaga

SEQ ID NO: 9245438 - DNA, 22 bp, Homo sapiens
tctgctgaggccttcccactcc

SEQ ID NO: 9245439 - DNA, 22 bp, Homo sapiens
tctgctgagatgcccatggtta

SEQ ID NO: 9245440 - DNA, 22 bp, Homo sapiens
tctgctctccatacttccgcac

SEQ ID NO: 9245441 - DNA, 23 bp, Homo sapiens
tctgctctgaagttcggctgagc

SEQ ID NO: 9245442 - DNA, 23 bp, Homo sapiens
tctgctctgaagttcggctgagc

SEQ ID NO: 9245443 - DNA, 22 bp, Homo sapiens
tctgctctgagagggccatcag

SEQ ID NO: 9245444 - DNA, 22 bp, Homo sapiens
tctgctctagttgcttcctgcc

SEQ ID NO: 9245445 - DNA, 22 bp, Homo sapiens
tctgctctagttgcttcctgcc

SEQ ID NO: 9245446 - DNA, 17 bp, Homo sapiens
tctgctctgccaatcca

SEQ ID NO: 9245447 - DNA, 22 bp, Homo sapiens
tctgctctgggccagctattaa

SEQ ID NO: 9245448 - DNA, 22 bp, Homo sapiens
tctgctctgtactgcactggcc

SEQ ID NO: 9245449 - DNA, 22 bp, Homo sapiens
tctgctctgtactgcactggcc

SEQ ID NO: 9245450 - DNA, 22 bp, Homo sapiens
tctgctctgtggcttcagctaa

SEQ ID NO: 9245451 - DNA, 22 bp, Homo sapiens
tctgctctgtggcttcagctaa

SEQ ID NO: 9245452 - DNA, 22 bp, Homo sapiens
tctgctgtgattctactagtgt

SEQ ID NO: 9245453 - DNA, 22 bp, Homo sapiens
tctgctgtgaaaggtgaatatt

SEQ ID NO: 9245454 - DNA, 22 bp, Homo sapiens
tctgctgttcattcttttagct

SEQ ID NO: 9245455 - DNA, 22 bp, Homo sapiens
tctgctgtgtccctggtctcct

SEQ ID NO: 9245456 - DNA, 22 bp, Homo sapiens
tctgctgtaaccttcagaggta

SEQ ID NO: 9245457 - DNA, 22 bp, Homo sapiens
tctggaagttagaggaggaaag

SEQ ID NO: 9245458 - DNA, 22 bp, Homo sapiens
tctggaagtgatgttcatagtg

SEQ ID NO: 9245459 - DNA, 22 bp, Homo sapiens
tctggaataggtcctgagtatt

SEQ ID NO: 9245460 - DNA, 22 bp, Homo sapiens
tctggagaatctgtcagtgtgg

SEQ ID NO: 9245461 - DNA, 22 bp, Homo sapiens
tctggagaagcagtgagagtca

SEQ ID NO: 9245462 - DNA, 22 bp, Homo sapiens
tctggagaaagttgagtttgtg

SEQ ID NO: 9245463 - DNA, 22 bp, Homo sapiens
tctggagataagacagacagat

SEQ ID NO: 9245464 - DNA, 22 bp, Homo sapiens
tctggagaggggcctagaattt

SEQ ID NO: 9245465 - DNA, 22 bp, Homo sapiens
tctggagaggaggatgtggaca

SEQ ID NO: 9245466 - DNA, 22 bp, Homo sapiens
ttccaggaacaaactcacctta

SEQ ID NO: 9245467 - DNA, 22 bp, Homo sapiens
accagctgttaggcttggtgct

SEQ ID NO: 9245468 - DNA, 22 bp, Homo sapiens
accagctggtcacctgggcact

SEQ ID NO: 9245469 - DNA, 22 bp, Homo sapiens
accagctggtcacctgggcact

SEQ ID NO: 9245470 - DNA, 22 bp, Homo sapiens
accagctggcccatgagcacgt

SEQ ID NO: 9245471 - DNA, 22 bp, Homo sapiens
accagctgtgtcctggctgcag

SEQ ID NO: 9245472 - DNA, 22 bp, Homo sapiens
accagctgtgtcctggctgcag

SEQ ID NO: 9245473 - DNA, 22 bp, Homo sapiens
aaggtgtcactgggacaggaaa

SEQ ID NO: 9245474 - DNA, 22 bp, Homo sapiens
aagtaaaatgtttcctttatta

SEQ ID NO: 9245475 - DNA, 22 bp, Homo sapiens
aagtaaaatgtttcctttatta

SEQ ID NO: 9245476 - DNA, 22 bp, Homo sapiens
aagtaaaattcaatcttcactg

SEQ ID NO: 9245477 - DNA, 22 bp, Homo sapiens
aaggtttttttccagtatctct

SEQ ID NO: 9245478 - DNA, 22 bp, Homo sapiens
aagtaaaacacacagtccaccg

SEQ ID NO: 9245479 - DNA, 22 bp, Homo sapiens
aagggcagcctgactcacggtc

SEQ ID NO: 9245480 - DNA, 22 bp, Homo sapiens
aagggcagcctgactcacggtc

SEQ ID NO: 9245481 - DNA, 22 bp, Homo sapiens
aagggcagctgacagatgctta

SEQ ID NO: 9245482 - DNA, 22 bp, Homo sapiens
aagggcagagggaatcccacat

SEQ ID NO: 9245483 - DNA, 17 bp, Homo sapiens
accacctctcaccagca

SEQ ID NO: 9245484 - DNA, 22 bp, Homo sapiens
accacctcatcaagctggattg

SEQ ID NO: 9245485 - DNA, 17 bp, Homo sapiens
accacctctcaccagca

SEQ ID NO: 9245486 - DNA, 22 bp, Homo sapiens
accagcacggattagaatgctt

SEQ ID NO: 9245487 - DNA, 22 bp, Homo sapiens
accagcacttccagaggtcagg

SEQ ID NO: 9245488 - DNA, 22 bp, Homo sapiens
aagggcaggaaaagatggatgt

SEQ ID NO: 9245489 - DNA, 22 bp, Homo sapiens
aagggcagctgacagatgctta

SEQ ID NO: 9245490 - DNA, 22 bp, Homo sapiens
aagggcagctgacagatgctta

SEQ ID NO: 9245491 - DNA, 22 bp, Homo sapiens
accagctgccaagggctacact

SEQ ID NO: 9245492 - DNA, 23 bp, Homo sapiens
accagctgccctgaactttgtgc

SEQ ID NO: 9245493 - DNA, 22 bp, Homo sapiens
accagctgccttttcttagtag

SEQ ID NO: 9245494 - DNA, 22 bp, Homo sapiens
accaccaggggattttcagaac

SEQ ID NO: 9245495 - DNA, 22 bp, Homo sapiens
accacatttctgaatagcataa

SEQ ID NO: 9245496 - DNA, 22 bp, Homo sapiens
accacaggacccatgagtcagt

SEQ ID NO: 9245497 - DNA, 22 bp, Homo sapiens
accacaggaggatggctgctgg

SEQ ID NO: 9245498 - DNA, 22 bp, Homo sapiens
acattcttaacagttaaaaact

SEQ ID NO: 9245499 - DNA, 22 bp, Homo sapiens
acattcttaacagttaaaaact

SEQ ID NO: 9245500 - DNA, 22 bp, Homo sapiens
acattcttcagctttgtcaggc

SEQ ID NO: 9245501 - DNA, 22 bp, Homo sapiens
acattttgcccttatttgctga

SEQ ID NO: 9245502 - DNA, 22 bp, Homo sapiens
acattctgtttccccaaagaga

SEQ ID NO: 9245503 - DNA, 22 bp, Homo sapiens
acatacttatgctaaaaatata

SEQ ID NO: 9245504 - DNA, 22 bp, Homo sapiens
acatacttatgtgtatatgtgt

SEQ ID NO: 9245505 - DNA, 22 bp, Homo sapiens
acatggctcagtctcatgacag

SEQ ID NO: 9245506 - DNA, 23 bp, Homo sapiens
acatgggagggacatggaggctg

SEQ ID NO: 9245507 - DNA, 22 bp, Homo sapiens
acatgggatcaatgaggcaggc

SEQ ID NO: 9245508 - DNA, 22 bp, Homo sapiens
acataacactcttctctagtga

SEQ ID NO: 9245509 - DNA, 22 bp, Homo sapiens
acataacaatcataggacatag

SEQ ID NO: 9245510 - DNA, 22 bp, Homo sapiens
acataacaatcataggacatag

SEQ ID NO: 9245511 - DNA, 22 bp, Homo sapiens
acataacatgtcaatcacccga

SEQ ID NO: 9245512 - DNA, 22 bp, Homo sapiens
acataagtgcacaataaatatt

SEQ ID NO: 9245513 - DNA, 22 bp, Homo sapiens
acataatagcatttctaatttg

SEQ ID NO: 9245514 - DNA, 22 bp, Homo sapiens
acataatagcatttctaatttg

SEQ ID NO: 9245515 - DNA, 18 bp, Homo sapiens
acatacattctgtctgca

SEQ ID NO: 9245516 - DNA, 18 bp, Homo sapiens
acatacattctgtctgca

SEQ ID NO: 9245517 - DNA, 22 bp, Homo sapiens
acatactatgaatacatgtgtc

SEQ ID NO: 9245518 - DNA, 22 bp, Homo sapiens
acatactatgaatacatgtgtc

SEQ ID NO: 9245519 - DNA, 22 bp, Homo sapiens
acatacattgcctcattggtaa

SEQ ID NO: 9245520 - DNA, 22 bp, Homo sapiens
acataatgagctctttataaat

SEQ ID NO: 9245521 - DNA, 22 bp, Homo sapiens
acattacctggcatttgatctt

SEQ ID NO: 9245522 - DNA, 22 bp, Homo sapiens
aaggccaggcagggagctgtga

SEQ ID NO: 9245523 - DNA, 22 bp, Homo sapiens
aaggccaggcctagcacggagg

SEQ ID NO: 9245524 - DNA, 22 bp, Homo sapiens
aaggccaggccagatgacagtc

SEQ ID NO: 9245525 - DNA, 22 bp, Homo sapiens
aaggccagcgcagaccattgtc

SEQ ID NO: 9245526 - DNA, 22 bp, Homo sapiens
aaggccagcttgtagggctggt

SEQ ID NO: 9245527 - DNA, 22 bp, Homo sapiens
aaggccaggaaattatccctat

SEQ ID NO: 9245528 - DNA, 22 bp, Homo sapiens
acattagatgactctttctttc

SEQ ID NO: 9245529 - DNA, 21 bp, Homo sapiens
acattataattcatattccac

SEQ ID NO: 9245530 - DNA, 22 bp, Homo sapiens
acattatagctttgagtttgga

SEQ ID NO: 9245531 - DNA, 22 bp, Homo sapiens
acattatagttgctacagagta

SEQ ID NO: 9245532 - DNA, 22 bp, Homo sapiens
acattatgagcccactggtgaa

SEQ ID NO: 9245533 - DNA, 22 bp, Homo sapiens
acattatagttgctacagagta

SEQ ID NO: 9245534 - DNA, 22 bp, Homo sapiens
acattctgggtgatgttcttca

SEQ ID NO: 9245535 - DNA, 22 bp, Homo sapiens
acattctctccatgtcttcttt

SEQ ID NO: 9245536 - DNA, 22 bp, Homo sapiens
acattcaagatgcattcactta

SEQ ID NO: 9245537 - DNA, 22 bp, Homo sapiens
acagtgctggctacaaccctgg

SEQ ID NO: 9245538 - DNA, 22 bp, Homo sapiens
acagtgctgtcaaatatgtttt

SEQ ID NO: 9245539 - DNA, 22 bp, Homo sapiens
acagtgctgatctagactgacc

SEQ ID NO: 9245540 - DNA, 22 bp, Homo sapiens
acagtgctgaacgacatggaag

SEQ ID NO: 9245541 - DNA, 22 bp, Homo sapiens
acagtgctaatgatgccaagat

SEQ ID NO: 9245542 - DNA, 22 bp, Homo sapiens
acagtgctatcaatagctagaa

SEQ ID NO: 9245543 - DNA, 22 bp, Homo sapiens
acagtgctcatgtgacatggtg

SEQ ID NO: 9245544 - DNA, 20 bp, Homo sapiens
acagtgggtggggagcactg

SEQ ID NO: 9245545 - DNA, 20 bp, Homo sapiens
acagtgggtggggagcactg

SEQ ID NO: 9245546 - DNA, 22 bp, Homo sapiens
acagtgctgtctatctcactaa

SEQ ID NO: 9245547 - DNA, 18 bp, Homo sapiens
acagtgctgtcactgctt

SEQ ID NO: 9245548 - DNA, 18 bp, Homo sapiens
acagtgctgtcactgctt

SEQ ID NO: 9245549 - DNA, 20 bp, Homo sapiens
acagtgtaatattcacattc

SEQ ID NO: 9245550 - DNA, 22 bp, Homo sapiens
acagtgtaatatgggagtcagt

SEQ ID NO: 9245551 - DNA, 22 bp, Homo sapiens
acataacaatcataggacatag

SEQ ID NO: 9245552 - DNA, 22 bp, Homo sapiens
acagtttagaatgccacatagt

SEQ ID NO: 9245553 - DNA, 22 bp, Homo sapiens
acagtgtcatgtcgtgttcccc

SEQ ID NO: 9245554 - DNA, 22 bp, Homo sapiens
acagtgtccccagctctgtgag

SEQ ID NO: 9245555 - DNA, 22 bp, Homo sapiens
acagtgtatgatatttcacagt

SEQ ID NO: 9245556 - DNA, 22 bp, Homo sapiens
acagtgtataaaatcttaaaga

SEQ ID NO: 9245557 - DNA, 22 bp, Homo sapiens
acagtgtagtgtgatgtcaaaa

SEQ ID NO: 9245558 - DNA, 18 bp, Homo sapiens
acaggtgatatcttgaga

SEQ ID NO: 9245559 - DNA, 22 bp, Homo sapiens
acagtgctaaacacttcttgaa

SEQ ID NO: 9245560 - DNA, 22 bp, Homo sapiens
acagtctttctacattctgtgc

SEQ ID NO: 9245561 - DNA, 22 bp, Homo sapiens
acagtgcagtgtgatgagtatt

SEQ ID NO: 9245562 - DNA, 22 bp, Homo sapiens
acaggtctggtctgggtgggac

SEQ ID NO: 9245563 - DNA, 22 bp, Homo sapiens
acaggtgaagtattacactaag

SEQ ID NO: 9245564 - DNA, 22 bp, Homo sapiens
acaggtgacctgctcatatgaa

SEQ ID NO: 9245565 - DNA, 22 bp, Homo sapiens
acaggtgagggagctttgtgcc

SEQ ID NO: 9245566 - DNA, 22 bp, Homo sapiens
acaggtgacttgcattttcaca

SEQ ID NO: 9245567 - DNA, 22 bp, Homo sapiens
acaggtcaacgagagcaggcaa

SEQ ID NO: 9245568 - DNA, 22 bp, Homo sapiens
acaggtcagataaaggctggtg

SEQ ID NO: 9245569 - DNA, 23 bp, Homo sapiens
acagggcttatctgtcactcatc

SEQ ID NO: 9245570 - DNA, 23 bp, Homo sapiens
acagggcttatctgtcactcatc

SEQ ID NO: 9245571 - DNA, 21 bp, Homo sapiens
acaggctttagaaaatgactc

SEQ ID NO: 9245572 - DNA, 21 bp, Homo sapiens
acaggctttagaaaatgactc

SEQ ID NO: 9245573 - DNA, 22 bp, Homo sapiens
acaggctttattattggttagt

SEQ ID NO: 9245574 - DNA, 22 bp, Homo sapiens
acaggcttttttagaatgacat

SEQ ID NO: 9245575 - DNA, 23 bp, Homo sapiens
acagggaaaagtcatcagtgtga

SEQ ID NO: 9245576 - DNA, 22 bp, Homo sapiens
acaggcttctcacagaaaaggg

SEQ ID NO: 9245577 - DNA, 22 bp, Homo sapiens
acaggcttgcactagggtggca

SEQ ID NO: 9245578 - DNA, 22 bp, Homo sapiens
acaggctgatagaccataaata

SEQ ID NO: 9245579 - DNA, 22 bp, Homo sapiens
acaggctgccacttgcatccaa

SEQ ID NO: 9245580 - DNA, 22 bp, Homo sapiens
acaggctgatagaccataaata

SEQ ID NO: 9245581 - DNA, 22 bp, Homo sapiens
acaggctgccacttgcatccaa

SEQ ID NO: 9245582 - DNA, 22 bp, Homo sapiens
acaggctgccacttgcatccaa

SEQ ID NO: 9245583 - DNA, 22 bp, Homo sapiens
acaggctgttggggtccagggt

SEQ ID NO: 9245584 - DNA, 22 bp, Homo sapiens
acaggcttacaggctgcaagta

SEQ ID NO: 9245585 - DNA, 22 bp, Homo sapiens
acaggctgacttcctgccatgt

SEQ ID NO: 9245586 - DNA, 22 bp, Homo sapiens
acaggctgacttcctgccatgt

SEQ ID NO: 9245587 - DNA, 22 bp, Homo sapiens
acaggctgaggatgattgcatc

SEQ ID NO: 9245588 - DNA, 22 bp, Homo sapiens
acaggctgaggatgattgcatc

SEQ ID NO: 9245589 - DNA, 22 bp, Homo sapiens
acaggctgagcgtccatcttca

SEQ ID NO: 9245590 - DNA, 22 bp, Homo sapiens
acaggctgacttcctgccatgt

SEQ ID NO: 9245591 - DNA, 22 bp, Homo sapiens
acaggctgacttcctgccatgt

SEQ ID NO: 9245592 - DNA, 22 bp, Homo sapiens
acaggctgacttcctgccatgt

SEQ ID NO: 9245593 - DNA, 22 bp, Homo sapiens
acaggctgaaagttaagttctg

SEQ ID NO: 9245594 - DNA, 22 bp, Homo sapiens
acagctggagtgttggtgaggt

SEQ ID NO: 9245595 - DNA, 22 bp, Homo sapiens
acagctggagtgttggtgaggt

SEQ ID NO: 9245596 - DNA, 22 bp, Homo sapiens
acagctggagtgttggtgaggt

SEQ ID NO: 9245597 - DNA, 22 bp, Homo sapiens
acagatgaggaagagtcagcca

SEQ ID NO: 9245598 - DNA, 22 bp, Homo sapiens
acagatgagagacaatgtgcta

SEQ ID NO: 9245599 - DNA, 20 bp, Homo sapiens
acagatgaggaaaatgaagt

SEQ ID NO: 9245600 - DNA, 22 bp, Homo sapiens
acagctttttactaatagattg

SEQ ID NO: 9245601 - DNA, 22 bp, Homo sapiens
acagctttttactaatagattg

SEQ ID NO: 9245602 - DNA, 22 bp, Homo sapiens
acagcttttgaaaaattactgg

SEQ ID NO: 9245603 - DNA, 22 bp, Homo sapiens
acagcttttgaaaaattactgg

SEQ ID NO: 9245604 - DNA, 22 bp, Homo sapiens
acagcttttcaattctgctgag

SEQ ID NO: 9245605 - DNA, 22 bp, Homo sapiens
acaggaaatgaaatggtatcta

SEQ ID NO: 9245606 - DNA, 22 bp, Homo sapiens
acaggaaccaggcaggtcgatt

SEQ ID NO: 9245607 - DNA, 22 bp, Homo sapiens
acaggaacagcttgatggcatc

SEQ ID NO: 9245608 - DNA, 22 bp, Homo sapiens
acaggaaattggcatatcagtt

SEQ ID NO: 9245609 - DNA, 21 bp, Homo sapiens
acaggagaccgcctggcagtc

SEQ ID NO: 9245610 - DNA, 22 bp, Homo sapiens
acaggagaccctgctggttctg

SEQ ID NO: 9245611 - DNA, 21 bp, Homo sapiens
acaggagaccgcctggcagtc

SEQ ID NO: 9245612 - DNA, 22 bp, Homo sapiens
acaggagcccaggatgggcgga

SEQ ID NO: 9245613 - DNA, 22 bp, Homo sapiens
acaggaggagcagctgtgtgcc

SEQ ID NO: 9245614 - DNA, 22 bp, Homo sapiens
acaggagccaaacacatgccag

SEQ ID NO: 9245615 - DNA, 20 bp, Homo sapiens
acaggagatctgaggaaagg

SEQ ID NO: 9245616 - DNA, 20 bp, Homo sapiens
acaggagatctgaggaaagg

SEQ ID NO: 9245617 - DNA, 19 bp, Homo sapiens
acaggcagaattgggtgtg

SEQ ID NO: 9245618 - DNA, 22 bp, Homo sapiens
acaggcagagaactcagccaga

SEQ ID NO: 9245619 - DNA, 22 bp, Homo sapiens
acaggcagagaactcagccaga

SEQ ID NO: 9245620 - DNA, 22 bp, Homo sapiens
acaggcagagaactcagccaga

SEQ ID NO: 9245621 - DNA, 22 bp, Homo sapiens
acaggccagaggtggggcagcc

SEQ ID NO: 9245622 - DNA, 22 bp, Homo sapiens
aatcttcattttgacaagattc

SEQ ID NO: 9245623 - DNA, 22 bp, Homo sapiens
aatcttcatgtcctctctaatt

SEQ ID NO: 9245624 - DNA, 22 bp, Homo sapiens
aatcttctttcttaacagtaca

SEQ ID NO: 9245625 - DNA, 22 bp, Homo sapiens
aatcttgagggactcatgaggt

SEQ ID NO: 9245626 - DNA, 22 bp, Homo sapiens
aatcttaaagaatattctacca

SEQ ID NO: 9245627 - DNA, 22 bp, Homo sapiens
aatcttacttatgatttttcgg

SEQ ID NO: 9245628 - DNA, 22 bp, Homo sapiens
aatcttaaagaatattctacca

SEQ ID NO: 9245629 - DNA, 22 bp, Homo sapiens
aatcttacaccgaatttaaact

SEQ ID NO: 9245630 - DNA, 22 bp, Homo sapiens
aatcttaagctgaattctctcc

SEQ ID NO: 9245631 - DNA, 22 bp, Homo sapiens
aatcttaggtttggcttcatct

SEQ ID NO: 9245632 - DNA, 22 bp, Homo sapiens
aatcttcacagaaaaatgtctg

SEQ ID NO: 9245633 - DNA, 22 bp, Homo sapiens
aatcttcaacagaatggtagga

SEQ ID NO: 9245634 - DNA, 22 bp, Homo sapiens
aatcttcactcattcagagttg

SEQ ID NO: 9245635 - DNA, 22 bp, Homo sapiens
aatcttcactcttaactgtgca

SEQ ID NO: 9245636 - DNA, 22 bp, Homo sapiens
aatcttcataaaaatctagtag

SEQ ID NO: 9245637 - DNA, 17 bp, Homo sapiens
aatctgtttacagtcag

SEQ ID NO: 9245638 - DNA, 22 bp, Homo sapiens
aatctgtattgttaacaagtaa

SEQ ID NO: 9245639 - DNA, 22 bp, Homo sapiens
aatcttaaagaatattctacca

SEQ ID NO: 9245640 - DNA, 22 bp, Homo sapiens
aatctgttttctgcctctatga

SEQ ID NO: 9245641 - DNA, 22 bp, Homo sapiens
aatcttaagctgaattctctcc

SEQ ID NO: 9245642 - DNA, 22 bp, Homo sapiens
aatctgtttccatgttttattg

SEQ ID NO: 9245643 - DNA, 22 bp, Homo sapiens
aatctgtttgatgcttgtgata

SEQ ID NO: 9245644 - DNA, 22 bp, Homo sapiens
agaaactaagtcataactcttt

SEQ ID NO: 9245645 - DNA, 22 bp, Homo sapiens
agaaactatcctgagtagcaaa

SEQ ID NO: 9245646 - DNA, 22 bp, Homo sapiens
agaaactaaagccaagggctct

SEQ ID NO: 9245647 - DNA, 22 bp, Homo sapiens
agaaacctgtgtgctgtgatga

SEQ ID NO: 9245648 - DNA, 22 bp, Homo sapiens
agaaaactggagcctggggttg

SEQ ID NO: 9245649 - DNA, 22 bp, Homo sapiens
aatattcatttgcagaagaagt

SEQ ID NO: 9245650 - DNA, 22 bp, Homo sapiens
aatattcaagttattctttctt

SEQ ID NO: 9245651 - DNA, 22 bp, Homo sapiens
aatattcaagttattctttctt

SEQ ID NO: 9245652 - DNA, 22 bp, Homo sapiens
agaaaataatttcttggctggt

SEQ ID NO: 9245653 - DNA, 22 bp, Homo sapiens
agaaaactgggaggagagcttc

SEQ ID NO: 9245654 - DNA, 22 bp, Homo sapiens
agaaaataatttcttggctggt

SEQ ID NO: 9245655 - DNA, 22 bp, Homo sapiens
agaaaatattcattgagaggct

SEQ ID NO: 9245656 - DNA, 22 bp, Homo sapiens
agaaaatattcattgagaggct

SEQ ID NO: 9245657 - DNA, 22 bp, Homo sapiens
agaaaattactccagagacaag

SEQ ID NO: 9245658 - DNA, 22 bp, Homo sapiens
agaaaccagggcttaccagtgc

SEQ ID NO: 9245659 - DNA, 22 bp, Homo sapiens
agaaaccatctttatatatctg

SEQ ID NO: 9245660 - DNA, 22 bp, Homo sapiens
agaaacctccatttattcactc

SEQ ID NO: 9245661 - DNA, 23 bp, Homo sapiens
agaaaccactgaagagatccagt

SEQ ID NO: 9245662 - DNA, 23 bp, Homo sapiens
agaaaccactgaagagatccagt

SEQ ID NO: 9245663 - DNA, 22 bp, Homo sapiens
aatatgttccacttaaagctgg

SEQ ID NO: 9245664 - DNA, 22 bp, Homo sapiens
aatatgttcaaaatagatcact

SEQ ID NO: 9245665 - DNA, 22 bp, Homo sapiens
aatatgttcaaaatagatcact

SEQ ID NO: 9245666 - DNA, 22 bp, Homo sapiens
aatatgtgggtgctaatcaaaa

SEQ ID NO: 9245667 - DNA, 22 bp, Homo sapiens
aatatgttcaaaatagatcact

SEQ ID NO: 9245668 - DNA, 22 bp, Homo sapiens
aatattaatagaaggggttcta

SEQ ID NO: 9245669 - DNA, 22 bp, Homo sapiens
aatattatcaaaagctttttca

SEQ ID NO: 9245670 - DNA, 22 bp, Homo sapiens
aatatgagtttgcctttcctgc

SEQ ID NO: 9245671 - DNA, 22 bp, Homo sapiens
aatatgatccttaaccttcatg

SEQ ID NO: 9245672 - DNA, 22 bp, Homo sapiens
aatacttttgaactgaaaggca

SEQ ID NO: 9245673 - DNA, 22 bp, Homo sapiens
aatactttcctatataaggtgc

SEQ ID NO: 9245674 - DNA, 22 bp, Homo sapiens
aatactttgccaagttcgaaga

SEQ ID NO: 9245675 - DNA, 22 bp, Homo sapiens
aatactgtgggatgcagtagga

SEQ ID NO: 9245676 - DNA, 22 bp, Homo sapiens
aatacttatgtgacctcatttt

SEQ ID NO: 9245677 - DNA, 22 bp, Homo sapiens
aatacttgaatttcatgtcagg

SEQ ID NO: 9245678 - DNA, 22 bp, Homo sapiens
aatacttgtgaattcaaagtct

SEQ ID NO: 9245679 - DNA, 22 bp, Homo sapiens
aatactttcctatataaggtgc

SEQ ID NO: 9245680 - DNA, 22 bp, Homo sapiens
aatactgtctttcacagatatt

SEQ ID NO: 9245681 - DNA, 22 bp, Homo sapiens
actgtgctttctctggaggcat

SEQ ID NO: 9245682 - DNA, 22 bp, Homo sapiens
actgtgctggcaatgactcagg

SEQ ID NO: 9245683 - DNA, 22 bp, Homo sapiens
actgtggcgtcaggaagaaatt

SEQ ID NO: 9245684 - DNA, 22 bp, Homo sapiens
aataacagggttgatttgcaat

SEQ ID NO: 9245685 - DNA, 22 bp, Homo sapiens
aataactgcacttgttgaatgc

SEQ ID NO: 9245686 - DNA, 21 bp, Homo sapiens
aataaccactaatatagtggc

SEQ ID NO: 9245687 - DNA, 22 bp, Homo sapiens
aataacagtgccatgaaattga

SEQ ID NO: 9245688 - DNA, 22 bp, Homo sapiens
aataactggcacatatcacata

SEQ ID NO: 9245689 - DNA, 22 bp, Homo sapiens
actgtctgctggcccctggtta

SEQ ID NO: 9245690 - DNA, 19 bp, Homo sapiens
actgtgctcgggaaccact

SEQ ID NO: 9245691 - DNA, 22 bp, Homo sapiens
actgtctgccctgagatgccag

SEQ ID NO: 9245692 - DNA, 18 bp, Homo sapiens
actgtctgccagattggg

SEQ ID NO: 9245693 - DNA, 22 bp, Homo sapiens
actgtctgcacccgaggaggcc

SEQ ID NO: 9245694 - DNA, 22 bp, Homo sapiens
acttagcaatttgattaaaaga

SEQ ID NO: 9245695 - DNA, 22 bp, Homo sapiens
aatagaaaggaggggctcttgt

SEQ ID NO: 9245696 - DNA, 22 bp, Homo sapiens
actgttgaagtgccagcttgat

SEQ ID NO: 9245697 - DNA, 22 bp, Homo sapiens
actgttggcttctggtagtgac

SEQ ID NO: 9245698 - DNA, 22 bp, Homo sapiens
acttagcattatgtaattacta

SEQ ID NO: 9245699 - DNA, 22 bp, Homo sapiens
acttagcagtttagaatatgtc

SEQ ID NO: 9245700 - DNA, 22 bp, Homo sapiens
acttagcaggtactttcatatt

SEQ ID NO: 9245701 - DNA, 22 bp, Homo sapiens
acttataagagtgctatgggga

SEQ ID NO: 9245702 - DNA, 22 bp, Homo sapiens
acttccaggaggtgtcactgaa

SEQ ID NO: 9245703 - DNA, 22 bp, Homo sapiens
acttccagctgccctgtgtgct

SEQ ID NO: 9245704 - DNA, 22 bp, Homo sapiens
acttatttcatggatcataatg

SEQ ID NO: 9245705 - DNA, 22 bp, Homo sapiens
acttatttcatggatcataatg

SEQ ID NO: 9245706 - DNA, 22 bp, Homo sapiens
acttatttattcattcagctca

SEQ ID NO: 9245707 - DNA, 22 bp, Homo sapiens
acttcctgaatggggctaatta

SEQ ID NO: 9245708 - DNA, 22 bp, Homo sapiens
acttcctgaatggggctaatta

SEQ ID NO: 9245709 - DNA, 22 bp, Homo sapiens
acttcctgacttctgggttgga

SEQ ID NO: 9245710 - DNA, 22 bp, Homo sapiens
acttccctgtgggcaggtagtg

SEQ ID NO: 9245711 - DNA, 21 bp, Homo sapiens
acttcccaggacctactcaga

SEQ ID NO: 9245712 - DNA, 18 bp, Homo sapiens
acttcccagatgagggga

SEQ ID NO: 9245713 - DNA, 22 bp, Homo sapiens
acttcccaggtggtgtggagtt

SEQ ID NO: 9245714 - DNA, 23 bp, Homo sapiens
acttccagttataggaactcttc

SEQ ID NO: 9245715 - DNA, 22 bp, Homo sapiens
acttccagtgtctgctgctagc

SEQ ID NO: 9245716 - DNA, 22 bp, Homo sapiens
acttccaggttccacccaagac

SEQ ID NO: 9245717 - DNA, 23 bp, Homo sapiens
acttccagttgcttcagcatatg

SEQ ID NO: 9245718 - DNA, 22 bp, Homo sapiens
acttcccacaccctgttttctc

SEQ ID NO: 9245719 - DNA, 22 bp, Homo sapiens
aatatgaattattgttacaagt

SEQ ID NO: 9245720 - DNA, 22 bp, Homo sapiens
aatatcttggcccaactccaga

SEQ ID NO: 9245721 - DNA, 22 bp, Homo sapiens
aatatgaattattgttacaagt

SEQ ID NO: 9245722 - DNA, 22 bp, Homo sapiens
aatatcttctaaggatagaact

SEQ ID NO: 9245723 - DNA, 19 bp, Homo sapiens
acttcctgcccgctccttt

SEQ ID NO: 9245724 - DNA, 22 bp, Homo sapiens
aatatcagctctgtcacttact

SEQ ID NO: 9245725 - DNA, 22 bp, Homo sapiens
aatatcttctaaggatagaact

SEQ ID NO: 9245726 - DNA, 22 bp, Homo sapiens
aatatcttctaaggatagaact

SEQ ID NO: 9245727 - DNA, 22 bp, Homo sapiens
aatatcttctaaggatagaact

SEQ ID NO: 9245728 - DNA, 22 bp, Homo sapiens
acctttatatatcaacttctcc

SEQ ID NO: 9245729 - DNA, 22 bp, Homo sapiens
acctttatatgaaagatgacat

SEQ ID NO: 9245730 - DNA, 22 bp, Homo sapiens
aagtgaagaaatacatgagaat

SEQ ID NO: 9245731 - DNA, 22 bp, Homo sapiens
aagtctcttttcttcctgtatt

SEQ ID NO: 9245732 - DNA, 22 bp, Homo sapiens
aagtctctttgggtactttatt

SEQ ID NO: 9245733 - DNA, 22 bp, Homo sapiens
aagtgactatttgagtacatca

SEQ ID NO: 9245734 - DNA, 22 bp, Homo sapiens
aagtgacctcatggtttctcct

SEQ ID NO: 9245735 - DNA, 22 bp, Homo sapiens
aagtgaatttcattccaattct

SEQ ID NO: 9245736 - DNA, 22 bp, Homo sapiens
aagtgatgctacgactttgaca

SEQ ID NO: 9245737 - DNA, 22 bp, Homo sapiens
aagtgatgctacgactttgaca

SEQ ID NO: 9245738 - DNA, 18 bp, Homo sapiens
aagtgactggcaggccaa

SEQ ID NO: 9245739 - DNA, 22 bp, Homo sapiens
accttgaaagctggttgttagg

SEQ ID NO: 9245740 - DNA, 22 bp, Homo sapiens
accttgaacacaagaattattg

SEQ ID NO: 9245741 - DNA, 22 bp, Homo sapiens
accttctgaccagttatcttga

SEQ ID NO: 9245742 - DNA, 22 bp, Homo sapiens
accttctggtctgcctgacagc

SEQ ID NO: 9245743 - DNA, 20 bp, Homo sapiens
acctggggttgcctgtgctc

SEQ ID NO: 9245744 - DNA, 22 bp, Homo sapiens
acctgggcattttggatgatta

SEQ ID NO: 9245745 - DNA, 22 bp, Homo sapiens
acctgggcattttggatgatta

SEQ ID NO: 9245746 - DNA, 22 bp, Homo sapiens
accttctgaccagttatcttga

SEQ ID NO: 9245747 - DNA, 22 bp, Homo sapiens
accttctgaccagttatcttga

SEQ ID NO: 9245748 - DNA, 22 bp, Homo sapiens
accttgggcaacctgctcctgc

SEQ ID NO: 9245749 - DNA, 20 bp, Homo sapiens
accttgaacccgccagccat

SEQ ID NO: 9245750 - DNA, 22 bp, Homo sapiens
accttgaacccagcttgctgca

SEQ ID NO: 9245751 - DNA, 22 bp, Homo sapiens
accttgaaggcagaggacacct

SEQ ID NO: 9245752 - DNA, 22 bp, Homo sapiens
acctgggaaagccgtggaaagg

SEQ ID NO: 9245753 - DNA, 22 bp, Homo sapiens
acctgggaaaaggagtggccat

SEQ ID NO: 9245754 - DNA, 22 bp, Homo sapiens
acctgggaggcagaggttgcag

SEQ ID NO: 9245755 - DNA, 22 bp, Homo sapiens
acctgggaggcggaggttgcag

SEQ ID NO: 9245756 - DNA, 22 bp, Homo sapiens
aagtaaaattcaatcttcactg

SEQ ID NO: 9245757 - DNA, 22 bp, Homo sapiens
aagtaaatatctgtttatagca

SEQ ID NO: 9245758 - DNA, 22 bp, Homo sapiens
aagtaaatgttggagctcaaat

SEQ ID NO: 9245759 - DNA, 21 bp, Homo sapiens
aagtaaatcagagaaataacc

SEQ ID NO: 9245760 - DNA, 22 bp, Homo sapiens
aagtaaatatctgtttatagca

SEQ ID NO: 9245761 - DNA, 21 bp, Homo sapiens
aagtaaatcagagaaataacc

SEQ ID NO: 9245762 - DNA, 18 bp, Homo sapiens
aagtaacagaagagcaca

SEQ ID NO: 9245763 - DNA, 18 bp, Homo sapiens
acctgcctgttcttctct

SEQ ID NO: 9245764 - DNA, 22 bp, Homo sapiens
acctgcctctaagcagcaggtg

SEQ ID NO: 9245765 - DNA, 18 bp, Homo sapiens
acctgcctgttcttctct

SEQ ID NO: 9245766 - DNA, 22 bp, Homo sapiens
aataaagaatggatgagatcgt

SEQ ID NO: 9245767 - DNA, 22 bp, Homo sapiens
aataaacttccactgtgttttt

SEQ ID NO: 9245768 - DNA, 22 bp, Homo sapiens
aataaacttccactgtgttttt

SEQ ID NO: 9245769 - DNA, 22 bp, Homo sapiens
aataaaatggtcagttttctca

SEQ ID NO: 9245770 - DNA, 22 bp, Homo sapiens
actgagaagattctcactctta

SEQ ID NO: 9245771 - DNA, 22 bp, Homo sapiens
actgagaacttgccaaggactg

SEQ ID NO: 9245772 - DNA, 22 bp, Homo sapiens
actgagaactcaagagaaaagg

SEQ ID NO: 9245773 - DNA, 22 bp, Homo sapiens
actgagaacttggggacagagg

SEQ ID NO: 9245774 - DNA, 22 bp, Homo sapiens
actgagaacttggggacagagg

SEQ ID NO: 9245775 - DNA, 22 bp, Homo sapiens
actgagaagattctcactctta

SEQ ID NO: 9245776 - DNA, 22 bp, Homo sapiens
actgactcttgttaacttcagc

SEQ ID NO: 9245777 - DNA, 22 bp, Homo sapiens
actgagaaagaccacatggaga

SEQ ID NO: 9245778 - DNA, 22 bp, Homo sapiens
aagttttattggctatagcact

SEQ ID NO: 9245779 - DNA, 21 bp, Homo sapiens
aagttttatgttgccatttgt

SEQ ID NO: 9245780 - DNA, 22 bp, Homo sapiens
aataaagtagcgtttaaggtgc

SEQ ID NO: 9245781 - DNA, 22 bp, Homo sapiens
aataaagtgtattctttgtcat

SEQ ID NO: 9245782 - DNA, 22 bp, Homo sapiens
aataaagacaaacaggggagcc

SEQ ID NO: 9245783 - DNA, 22 bp, Homo sapiens
aataaagacaaacaggggagcc

SEQ ID NO: 9245784 - DNA, 22 bp, Homo sapiens
aataaagaatggatgagatcgt

SEQ ID NO: 9245785 - DNA, 22 bp, Homo sapiens
aataaagcatgaggcatttatc

SEQ ID NO: 9245786 - DNA, 22 bp, Homo sapiens
aataacagagtcttcaagatag

SEQ ID NO: 9245787 - DNA, 22 bp, Homo sapiens
aataacagagtcttcaagatag

SEQ ID NO: 9245788 - DNA, 22 bp, Homo sapiens
aataacagattttcaagctgtg

SEQ ID NO: 9245789 - DNA, 22 bp, Homo sapiens
aataaatgtttgttggatgttt

SEQ ID NO: 9245790 - DNA, 22 bp, Homo sapiens
aataaatgtttgttggatgttt

SEQ ID NO: 9245791 - DNA, 22 bp, Homo sapiens
aataaatgaacaaagcaggttg

SEQ ID NO: 9245792 - DNA, 22 bp, Homo sapiens
aataaatgaacaaagcaggttg

SEQ ID NO: 9245793 - DNA, 22 bp, Homo sapiens
aataaatgtttgttggatgttt

SEQ ID NO: 9245794 - DNA, 22 bp, Homo sapiens
aataaatgttaagattgtctca

SEQ ID NO: 9245795 - DNA, 22 bp, Homo sapiens
aataaatgttaagattgtctca

SEQ ID NO: 9245796 - DNA, 22 bp, Homo sapiens
aataaatgttaagattgtctca

SEQ ID NO: 9245797 - DNA, 22 bp, Homo sapiens
aagttttactgaggacacatgt

SEQ ID NO: 9245798 - DNA, 22 bp, Homo sapiens
aagttttaacaagtacttacta

SEQ ID NO: 9245799 - DNA, 22 bp, Homo sapiens
aagtttgttttagtctaatgat

SEQ ID NO: 9245800 - DNA, 22 bp, Homo sapiens
aagttttaacaagtacttacta

SEQ ID NO: 9245801 - DNA, 22 bp, Homo sapiens
aagtttgtctcatttgatcttc

SEQ ID NO: 9245802 - DNA, 22 bp, Homo sapiens
aagtggccctaggccaagggga

SEQ ID NO: 9245803 - DNA, 22 bp, Homo sapiens
aagtttggtccttctaagaaga

SEQ ID NO: 9245804 - DNA, 22 bp, Homo sapiens
actcagtacatctggagttggc

SEQ ID NO: 9245805 - DNA, 22 bp, Homo sapiens
aagtggcacgctttttggagtt

SEQ ID NO: 9245806 - DNA, 22 bp, Homo sapiens
aagtggagtccctacaaccagc

SEQ ID NO: 9245807 - DNA, 22 bp, Homo sapiens
aagtggaggccgagttcacgca

SEQ ID NO: 9245808 - DNA, 21 bp, Homo sapiens
acagacagggccagtgtcccc

SEQ ID NO: 9245809 - DNA, 21 bp, Homo sapiens
acagacagggccagtgtcccc

SEQ ID NO: 9245810 - DNA, 22 bp, Homo sapiens
acagacagtatggtggggctga

SEQ ID NO: 9245811 - DNA, 22 bp, Homo sapiens
acagacagtatggtggggctga

SEQ ID NO: 9245812 - DNA, 22 bp, Homo sapiens
acagacagtaaatagtgtggct

SEQ ID NO: 9245813 - DNA, 22 bp, Homo sapiens
acagacagtaaatagtgtggct

SEQ ID NO: 9245814 - DNA, 22 bp, Homo sapiens
acagacagtatggtggggctga

SEQ ID NO: 9245815 - DNA, 22 bp, Homo sapiens
acagacatctatccatttaatt

SEQ ID NO: 9245816 - DNA, 22 bp, Homo sapiens
acagacatctatccatttaatt

SEQ ID NO: 9245817 - DNA, 22 bp, Homo sapiens
acagacatcatcaacatcttcc

SEQ ID NO: 9245818 - DNA, 22 bp, Homo sapiens
acagacatcatcaacatcttcc

SEQ ID NO: 9245819 - DNA, 22 bp, Homo sapiens
agcccaggtggagtgtgtgggg

SEQ ID NO: 9245820 - DNA, 22 bp, Homo sapiens
acagacagggcacctgcctcct

SEQ ID NO: 9245821 - DNA, 22 bp, Homo sapiens
agcccaggtctggcccagcctg

SEQ ID NO: 9245822 - DNA, 22 bp, Homo sapiens
acagaacaggctgagaaaaaca

SEQ ID NO: 9245823 - DNA, 22 bp, Homo sapiens
acagaacaggctgagaaaaaca

SEQ ID NO: 9245824 - DNA, 22 bp, Homo sapiens
acagaacatattgcttctctca

SEQ ID NO: 9245825 - DNA, 22 bp, Homo sapiens
acagaacaggctgagaaaaaca

SEQ ID NO: 9245826 - DNA, 22 bp, Homo sapiens
acagaacatattgcttctctca

SEQ ID NO: 9245827 - DNA, 22 bp, Homo sapiens
acagaacaggctgagaaaaaca

SEQ ID NO: 9245828 - DNA, 22 bp, Homo sapiens
acagaacagagggttttagaat

SEQ ID NO: 9245829 - DNA, 22 bp, Homo sapiens
acagaacatggatttttgaagt

SEQ ID NO: 9245830 - DNA, 22 bp, Homo sapiens
acagaacatggatttttgaagt

SEQ ID NO: 9245831 - DNA, 22 bp, Homo sapiens
agcccagggctaataggaacca

SEQ ID NO: 9245832 - DNA, 22 bp, Homo sapiens
agcatctgttaagtgccttcaa

SEQ ID NO: 9245833 - DNA, 22 bp, Homo sapiens
agcatctggtgagggcctagtt

SEQ ID NO: 9245834 - DNA, 22 bp, Homo sapiens
agcatcccatgactctggagga

SEQ ID NO: 9245835 - DNA, 22 bp, Homo sapiens
agcatctgcataatgccttccc

SEQ ID NO: 9245836 - DNA, 21 bp, Homo sapiens
agcatctgaggcagtttccta

SEQ ID NO: 9245837 - DNA, 22 bp, Homo sapiens
agcattccacactgaagtctgc

SEQ ID NO: 9245838 - DNA, 22 bp, Homo sapiens
agcattccacactgaagtctgc

SEQ ID NO: 9245839 - DNA, 22 bp, Homo sapiens
agcattccacactgaagtctgc

SEQ ID NO: 9245840 - DNA, 20 bp, Homo sapiens
agcattcattcagcaagcct

SEQ ID NO: 9245841 - DNA, 20 bp, Homo sapiens
agccaggctcaagctccccc

SEQ ID NO: 9245842 - DNA, 22 bp, Homo sapiens
agccaggctcaaggcctgctcc

SEQ ID NO: 9245843 - DNA, 22 bp, Homo sapiens
acagaacaagacctgcttattg

SEQ ID NO: 9245844 - DNA, 22 bp, Homo sapiens
acagaacaagacctgcttattg

SEQ ID NO: 9245845 - DNA, 20 bp, Homo sapiens
agccaggctcaagctccccc

SEQ ID NO: 9245846 - DNA, 22 bp, Homo sapiens
agccaggcgggtctttgctcct

SEQ ID NO: 9245847 - DNA, 22 bp, Homo sapiens
agccaggctaaatgagccatga

SEQ ID NO: 9245848 - DNA, 22 bp, Homo sapiens
agccaggcgggtctttgctcct

SEQ ID NO: 9245849 - DNA, 22 bp, Homo sapiens
agccaggctactccttgctgac

SEQ ID NO: 9245850 - DNA, 22 bp, Homo sapiens
agccaggaatgcatgctctgct

SEQ ID NO: 9245851 - DNA, 22 bp, Homo sapiens
agccaggcggggcaggtttcct

SEQ ID NO: 9245852 - DNA, 22 bp, Homo sapiens
agccaggcgcagtggcttatgc

SEQ ID NO: 9245853 - DNA, 22 bp, Homo sapiens
agcatttaatcctacatagatc

SEQ ID NO: 9245854 - DNA, 22 bp, Homo sapiens
agcattggtggccagagtgcct

SEQ ID NO: 9245855 - DNA, 22 bp, Homo sapiens
agccctggggctggtcttggaa

SEQ ID NO: 9245856 - DNA, 22 bp, Homo sapiens
agccctggtagcctgctgccat

SEQ ID NO: 9245857 - DNA, 22 bp, Homo sapiens
agccctggggtgcagaaccatg

SEQ ID NO: 9245858 - DNA, 22 bp, Homo sapiens
agccctggggctggtgcttacc

SEQ ID NO: 9245859 - DNA, 22 bp, Homo sapiens
agcctggcggtcgtcggtcagg

SEQ ID NO: 9245860 - DNA, 22 bp, Homo sapiens
agcctggcctgggcaggcacat

SEQ ID NO: 9245861 - DNA, 22 bp, Homo sapiens
agcctggcctgggcaggcacat

SEQ ID NO: 9245862 - DNA, 22 bp, Homo sapiens
agcctggccctgctgaactctg

SEQ ID NO: 9245863 - DNA, 22 bp, Homo sapiens
agcctggccactcagggcctga

SEQ ID NO: 9245864 - DNA, 22 bp, Homo sapiens
agcctgtggatccctgcactgg

SEQ ID NO: 9245865 - DNA, 22 bp, Homo sapiens
agcctgtggatccctgcactgg

SEQ ID NO: 9245866 - DNA, 22 bp, Homo sapiens
agcctgtggaaactgggtgcag

SEQ ID NO: 9245867 - DNA, 22 bp, Homo sapiens
agcctgtgagggatgctgcagt

SEQ ID NO: 9245868 - DNA, 22 bp, Homo sapiens
agcctgtgtcctcatctgcagc

SEQ ID NO: 9245869 - DNA, 22 bp, Homo sapiens
agcctgtgtgaagccctcagag

SEQ ID NO: 9245870 - DNA, 22 bp, Homo sapiens
agccttaaatgctagattcata

SEQ ID NO: 9245871 - DNA, 22 bp, Homo sapiens
agcctgtctgtctccaaagctg

SEQ ID NO: 9245872 - DNA, 22 bp, Homo sapiens
agcctgtgaaatctctgccact

SEQ ID NO: 9245873 - DNA, 22 bp, Homo sapiens
agcctggctgtaacctcatggt

SEQ ID NO: 9245874 - DNA, 22 bp, Homo sapiens
agctcaggctctgcagggacta

SEQ ID NO: 9245875 - DNA, 22 bp, Homo sapiens
agctcagggcgatctgtctcgg

SEQ ID NO: 9245876 - DNA, 22 bp, Homo sapiens
agctcagggcgatctgtctcgg

SEQ ID NO: 9245877 - DNA, 22 bp, Homo sapiens
agctcaggccggagctacaggc

SEQ ID NO: 9245878 - DNA, 22 bp, Homo sapiens
agctcaggccggagctacaggc

SEQ ID NO: 9245879 - DNA, 22 bp, Homo sapiens
agctcaagctacacacagagtc

SEQ ID NO: 9245880 - DNA, 22 bp, Homo sapiens
agctcaggtcattccagggatg

SEQ ID NO: 9245881 - DNA, 23 bp, Homo sapiens
agctccagggaacaggcagtagg

SEQ ID NO: 9245882 - DNA, 23 bp, Homo sapiens
agctccagggaacaggcagtagg

SEQ ID NO: 9245883 - DNA, 22 bp, Homo sapiens
agctccactccctgcctgtttc

SEQ ID NO: 9245884 - DNA, 23 bp, Homo sapiens
agctccaggtgattgtaatgtgt

SEQ ID NO: 9245885 - DNA, 21 bp, Homo sapiens
agcagcagcagtggggcttct

SEQ ID NO: 9245886 - DNA, 21 bp, Homo sapiens
agcagaacagtcgagcactgc

SEQ ID NO: 9245887 - DNA, 22 bp, Homo sapiens
agcagaacattttcagggctgt

SEQ ID NO: 9245888 - DNA, 22 bp, Homo sapiens
agcagaaccacagcactgttga

SEQ ID NO: 9245889 - DNA, 22 bp, Homo sapiens
agcagcaactgctagagtggca

SEQ ID NO: 9245890 - DNA, 22 bp, Homo sapiens
agcagcagattatggtctacat

SEQ ID NO: 9245891 - DNA, 22 bp, Homo sapiens
agcagcagattcagcaggaatg

SEQ ID NO: 9245892 - DNA, 22 bp, Homo sapiens
acacacttcagatgtaatttgt

SEQ ID NO: 9245893 - DNA, 22 bp, Homo sapiens
acacacttttgctaaaaattgt

SEQ ID NO: 9245894 - DNA, 22 bp, Homo sapiens
acacactggcccccagtactga

SEQ ID NO: 9245895 - DNA, 22 bp, Homo sapiens
acacactgtaaggactatcact

SEQ ID NO: 9245896 - DNA, 22 bp, Homo sapiens
agcagcagttgctgacgttcta

SEQ ID NO: 9245897 - DNA, 23 bp, Homo sapiens
acacagaagaagacccaaggaag

SEQ ID NO: 9245898 - DNA, 23 bp, Homo sapiens
acacagaagaagacccaaggaag

SEQ ID NO: 9245899 - DNA, 22 bp, Homo sapiens
acacagaacctcatagcctctc

SEQ ID NO: 9245900 - DNA, 22 bp, Homo sapiens
agcagccagagtctgaacatta

SEQ ID NO: 9245901 - DNA, 22 bp, Homo sapiens
agcagccaggaatctgcagagc

SEQ ID NO: 9245902 - DNA, 22 bp, Homo sapiens
agcagccaggaatctgcagagc

SEQ ID NO: 9245903 - DNA, 22 bp, Homo sapiens
agatttctgtcaccttctatgc

SEQ ID NO: 9245904 - DNA, 22 bp, Homo sapiens
agatttctgtcaccttctatgc

SEQ ID NO: 9245905 - DNA, 22 bp, Homo sapiens
agatttctctttccctggctga

SEQ ID NO: 9245906 - DNA, 22 bp, Homo sapiens
agattcagaaaattctctgttc

SEQ ID NO: 9245907 - DNA, 22 bp, Homo sapiens
agatttgaaacttgcttcataa

SEQ ID NO: 9245908 - DNA, 22 bp, Homo sapiens
agatttctgtggtcatgtaatg

SEQ ID NO: 9245909 - DNA, 22 bp, Homo sapiens
agatttgatatcatgcaacaaa

SEQ ID NO: 9245910 - DNA, 22 bp, Homo sapiens
agatttgataaaagtagcagtt

SEQ ID NO: 9245911 - DNA, 22 bp, Homo sapiens
agattttagtgtagaggacttg

SEQ ID NO: 9245912 - DNA, 22 bp, Homo sapiens
agattttagtgtagaggacttg

SEQ ID NO: 9245913 - DNA, 18 bp, Homo sapiens
agattttgagaaatacaa

SEQ ID NO: 9245914 - DNA, 22 bp, Homo sapiens
agattttagtttggggaggtgc

SEQ ID NO: 9245915 - DNA, 22 bp, Homo sapiens
agattttatagataatttccca

SEQ ID NO: 9245916 - DNA, 22 bp, Homo sapiens
acacacatggtattgttcagaa

SEQ ID NO: 9245917 - DNA, 22 bp, Homo sapiens
acacacagaaggaagccccact

SEQ ID NO: 9245918 - DNA, 22 bp, Homo sapiens
acacactggcaggagctataaa

SEQ ID NO: 9245919 - DNA, 21 bp, Homo sapiens
acacactgagttttccactgt

SEQ ID NO: 9245920 - DNA, 21 bp, Homo sapiens
acacactgagttttccactgt

SEQ ID NO: 9245921 - DNA, 21 bp, Homo sapiens
acacactacacattcctagtt

SEQ ID NO: 9245922 - DNA, 22 bp, Homo sapiens
acacactcaattgcataagcac

SEQ ID NO: 9245923 - DNA, 22 bp, Homo sapiens
acacaccatgatttatttaccc

SEQ ID NO: 9245924 - DNA, 22 bp, Homo sapiens
acacactgagtgccataggacc

SEQ ID NO: 9245925 - DNA, 22 bp, Homo sapiens
agcactttgagcagatgaagga

SEQ ID NO: 9245926 - DNA, 22 bp, Homo sapiens
agcactttcctggcaaatgtgg

SEQ ID NO: 9245927 - DNA, 22 bp, Homo sapiens
agcagaaaattggaaatgacaa

SEQ ID NO: 9245928 - DNA, 22 bp, Homo sapiens
agcagaaaattggaaatgacaa

SEQ ID NO: 9245929 - DNA, 22 bp, Homo sapiens
agcagttatattactctcaggt

SEQ ID NO: 9245930 - DNA, 22 bp, Homo sapiens
agcaggtgagcacagccaggct

SEQ ID NO: 9245931 - DNA, 20 bp, Homo sapiens
agcaggtgacggggcctgct

SEQ ID NO: 9245932 - DNA, 20 bp, Homo sapiens
agcaggtgacggggcctgct

SEQ ID NO: 9245933 - DNA, 22 bp, Homo sapiens
agcatccagaaaactctcagaa

SEQ ID NO: 9245934 - DNA, 22 bp, Homo sapiens
agcatccaactttgattagaga

SEQ ID NO: 9245935 - DNA, 22 bp, Homo sapiens
agcatcagcctctgtcctggag

SEQ ID NO: 9245936 - DNA, 22 bp, Homo sapiens
agcatccagcatcctatagaaa

SEQ ID NO: 9245937 - DNA, 22 bp, Homo sapiens
agcatccagcatcctatagaaa

SEQ ID NO: 9245938 - DNA, 22 bp, Homo sapiens
agcagggctttgtctctgtgaa

SEQ ID NO: 9245939 - DNA, 21 bp, Homo sapiens
agcaggtgaacctccagtaca

SEQ ID NO: 9245940 - DNA, 22 bp, Homo sapiens
agcaggtgaattcctggatgtg

SEQ ID NO: 9245941 - DNA, 22 bp, Homo sapiens
agcaggtgacccaagcaggctg

SEQ ID NO: 9245942 - DNA, 22 bp, Homo sapiens
agcaggtgacccaagcaggctg

SEQ ID NO: 9245943 - DNA, 22 bp, Homo sapiens
agcaggtgacagggctgtggtg

SEQ ID NO: 9245944 - DNA, 22 bp, Homo sapiens
agcagggctttgcagacttggg

SEQ ID NO: 9245945 - DNA, 22 bp, Homo sapiens
agcagggcttgccgcttgtcct

SEQ ID NO: 9245946 - DNA, 22 bp, Homo sapiens
agcagggcttctgtgcctgtgc

SEQ ID NO: 9245947 - DNA, 19 bp, Homo sapiens
agcaggcaggtggcccagg

SEQ ID NO: 9245948 - DNA, 22 bp, Homo sapiens
agcaggcatagagtagcactca

SEQ ID NO: 9245949 - DNA, 22 bp, Homo sapiens
agcaggcatagagtagcactca

SEQ ID NO: 9245950 - DNA, 23 bp, Homo sapiens
agcaggcatctgtggcacaaggc

SEQ ID NO: 9245951 - DNA, 19 bp, Homo sapiens
agcaggccacagggccagc

SEQ ID NO: 9245952 - DNA, 19 bp, Homo sapiens
agcagccatcgaccatgga

SEQ ID NO: 9245953 - DNA, 22 bp, Homo sapiens
agcagccatagatagcatgcaa

SEQ ID NO: 9245954 - DNA, 22 bp, Homo sapiens
agcagccatagatagcatgcaa

SEQ ID NO: 9245955 - DNA, 22 bp, Homo sapiens
agcagctgaccagtgagtcctg

SEQ ID NO: 9245956 - DNA, 17 bp, Homo sapiens
agcagctgaagcagcca

SEQ ID NO: 9245957 - DNA, 17 bp, Homo sapiens
agcagctgaagcagcca

SEQ ID NO: 9245958 - DNA, 22 bp, Homo sapiens
agcagctcgggctacagagggg

SEQ ID NO: 9245959 - DNA, 22 bp, Homo sapiens
agcagctctggcactgtagcat

SEQ ID NO: 9245960 - DNA, 22 bp, Homo sapiens
agcaggagggttttgtagagtc

SEQ ID NO: 9245961 - DNA, 21 bp, Homo sapiens
agcaggaggcagtcacagctc

SEQ ID NO: 9245962 - DNA, 22 bp, Homo sapiens
agcaggagggttttgtagagtc

SEQ ID NO: 9245963 - DNA, 22 bp, Homo sapiens
agcaggagtgtcccctggctgt

SEQ ID NO: 9245964 - DNA, 22 bp, Homo sapiens
agcaggagtgtcccctggctgt

SEQ ID NO: 9245965 - DNA, 22 bp, Homo sapiens
agcagctgagatggtaagattc

SEQ ID NO: 9245966 - DNA, 22 bp, Homo sapiens
agcagctgagccccagctgtga

SEQ ID NO: 9245967 - DNA, 22 bp, Homo sapiens
agcaggaacgagttcatgggga

SEQ ID NO: 9245968 - DNA, 22 bp, Homo sapiens
agcaggagcccttatcaccagg

SEQ ID NO: 9245969 - DNA, 22 bp, Homo sapiens
agcaggagctgtgggaagatgg

SEQ ID NO: 9245970 - DNA, 22 bp, Homo sapiens
agcaggagctgtgggaagatgg

SEQ ID NO: 9245971 - DNA, 22 bp, Homo sapiens
agcaggaggagagcctggcggt

SEQ ID NO: 9245972 - DNA, 22 bp, Homo sapiens
agaattttatctaaagggagta

SEQ ID NO: 9245973 - DNA, 22 bp, Homo sapiens
agaatttgagtgctttctgtgt

SEQ ID NO: 9245974 - DNA, 22 bp, Homo sapiens
agaatttgtaaaagataagaca

SEQ ID NO: 9245975 - DNA, 22 bp, Homo sapiens
agaatttggtagttatttttgg

SEQ ID NO: 9245976 - DNA, 23 bp, Homo sapiens
agaatttctaactctagctctgt

SEQ ID NO: 9245977 - DNA, 22 bp, Homo sapiens
aatgtaaacagcaagagaaggg

SEQ ID NO: 9245978 - DNA, 22 bp, Homo sapiens
aatgtacactgaaagcctatca

SEQ ID NO: 9245979 - DNA, 23 bp, Homo sapiens
agacaaaagcctcagtcttaggc

SEQ ID NO: 9245980 - DNA, 22 bp, Homo sapiens
aatgtaaacagcaagagaaggg

SEQ ID NO: 9245981 - DNA, 22 bp, Homo sapiens
aatgtagatgagatattttttg

SEQ ID NO: 9245982 - DNA, 22 bp, Homo sapiens
aatgtagatgagatattttttg

SEQ ID NO: 9245983 - DNA, 22 bp, Homo sapiens
aatgtataaagtgttaataact

SEQ ID NO: 9245984 - DNA, 22 bp, Homo sapiens
aatgtataaagtgttaataact

SEQ ID NO: 9245985 - DNA, 22 bp, Homo sapiens
aatgtataaagtgttaataact

SEQ ID NO: 9245986 - DNA, 22 bp, Homo sapiens
aatgtataaagtgttaataact

SEQ ID NO: 9245987 - DNA, 22 bp, Homo sapiens
agaatttaggcttgtctgctgt

SEQ ID NO: 9245988 - DNA, 22 bp, Homo sapiens
agaatttagctccttggtcata

SEQ ID NO: 9245989 - DNA, 22 bp, Homo sapiens
agaatttaggatgcatgtgaat

SEQ ID NO: 9245990 - DNA, 22 bp, Homo sapiens
agaatcttcggtaactggaaga

SEQ ID NO: 9245991 - DNA, 22 bp, Homo sapiens
agaattgtaagcaatttgatta

SEQ ID NO: 9245992 - DNA, 22 bp, Homo sapiens
agaatcctgatgaaaaggagag

SEQ ID NO: 9245993 - DNA, 19 bp, Homo sapiens
agaatctaaattatttctg

SEQ ID NO: 9245994 - DNA, 20 bp, Homo sapiens
agaatctgacccagagagac

SEQ ID NO: 9245995 - DNA, 20 bp, Homo sapiens
agaatctgacccagagagac

SEQ ID NO: 9245996 - DNA, 22 bp, Homo sapiens
agaatctgcattttaacaagcc

SEQ ID NO: 9245997 - DNA, 22 bp, Homo sapiens
agaatctgcattttaacaagct

SEQ ID NO: 9245998 - DNA, 22 bp, Homo sapiens
agaatctgcattttaacaagat

SEQ ID NO: 9245999 - DNA, 22 bp, Homo sapiens
agaatctgctttttaacaagat

SEQ ID NO: 9246000 - DNA, 22 bp, Homo sapiens
agaatctggtagaaccaaggat

SEQ ID NO: 9246001 - DNA, 22 bp, Homo sapiens
agaataaaatagtctgaagatg

SEQ ID NO: 9246002 - DNA, 22 bp, Homo sapiens
agaataaaatagtctgaagatg

SEQ ID NO: 9246003 - DNA, 22 bp, Homo sapiens
aatggagaccctaaggaagagg

SEQ ID NO: 9246004 - DNA, 22 bp, Homo sapiens
agaagttttgggaaatactgat

SEQ ID NO: 9246005 - DNA, 22 bp, Homo sapiens
agaataaatcaaatgtcctgag

SEQ ID NO: 9246006 - DNA, 22 bp, Homo sapiens
agaataaatcaaatgtcctgag

SEQ ID NO: 9246007 - DNA, 22 bp, Homo sapiens
agaataaactgctttagggcag

SEQ ID NO: 9246008 - DNA, 22 bp, Homo sapiens
agaataaatgctacctatcaca

SEQ ID NO: 9246009 - DNA, 22 bp, Homo sapiens
agaataaatgctacctatcaca

SEQ ID NO: 9246010 - DNA, 22 bp, Homo sapiens
agaataaatgctacctatcaca

SEQ ID NO: 9246011 - DNA, 22 bp, Homo sapiens
agaataagcctgacgaaaccta

SEQ ID NO: 9246012 - DNA, 22 bp, Homo sapiens
agaataaatgttggacttagga

SEQ ID NO: 9246013 - DNA, 22 bp, Homo sapiens
agaataaatgttggacttagga

SEQ ID NO: 9246014 - DNA, 19 bp, Homo sapiens
agaatcatcttgaagtgat

SEQ ID NO: 9246015 - DNA, 22 bp, Homo sapiens
aatgctttgactatatctataa

SEQ ID NO: 9246016 - DNA, 22 bp, Homo sapiens
aatgctttgagggaagatgaaa

SEQ ID NO: 9246017 - DNA, 22 bp, Homo sapiens
aatgctttgattgattaaaaca

SEQ ID NO: 9246018 - DNA, 23 bp, Homo sapiens
aatgctggaaattcaggcatgat

SEQ ID NO: 9246019 - DNA, 22 bp, Homo sapiens
aatgcttttacgacatgtacct

SEQ ID NO: 9246020 - DNA, 22 bp, Homo sapiens
aatgcttttgctgtcattgctt

SEQ ID NO: 9246021 - DNA, 21 bp, Homo sapiens
aatggaagtttaaaggtatcc

SEQ ID NO: 9246022 - DNA, 18 bp, Homo sapiens
aatggaaggggtgctgtt

SEQ ID NO: 9246023 - DNA, 22 bp, Homo sapiens
aatggacaaacttgggaagtat

SEQ ID NO: 9246024 - DNA, 21 bp, Homo sapiens
agactgccatctttgggccac

SEQ ID NO: 9246025 - DNA, 22 bp, Homo sapiens
agactggaagcctgccaagcaa

SEQ ID NO: 9246026 - DNA, 22 bp, Homo sapiens
agactgagactggggaaagaca

SEQ ID NO: 9246027 - DNA, 23 bp, Homo sapiens
agactgaggctgccagggtcaga

SEQ ID NO: 9246028 - DNA, 23 bp, Homo sapiens
agactgaggctgccagggtcaga

SEQ ID NO: 9246029 - DNA, 22 bp, Homo sapiens
agactgaaacaatctgcaggca

SEQ ID NO: 9246030 - DNA, 22 bp, Homo sapiens
agagaaactgatgtcctttgaa

SEQ ID NO: 9246031 - DNA, 18 bp, Homo sapiens
agagaaagaccaaagcat

SEQ ID NO: 9246032 - DNA, 22 bp, Homo sapiens
agagaaacccttcagtgttttg

SEQ ID NO: 9246033 - DNA, 22 bp, Homo sapiens
agagaaacaggtcagctgggag

SEQ ID NO: 9246034 - DNA, 22 bp, Homo sapiens
agagaaacccttcagtgttttg

SEQ ID NO: 9246035 - DNA, 23 bp, Homo sapiens
agactggggcataagaagatggc

SEQ ID NO: 9246036 - DNA, 23 bp, Homo sapiens
agactggggcataagaagatggc

SEQ ID NO: 9246037 - DNA, 22 bp, Homo sapiens
agactgggccatttccccagct

SEQ ID NO: 9246038 - DNA, 22 bp, Homo sapiens
agacactgccacttctgttccc

SEQ ID NO: 9246039 - DNA, 22 bp, Homo sapiens
agacactgccacttctgttccc

SEQ ID NO: 9246040 - DNA, 22 bp, Homo sapiens
agacactgatgttcagctcaat

SEQ ID NO: 9246041 - DNA, 19 bp, Homo sapiens
agacactggatggaaaatg

SEQ ID NO: 9246042 - DNA, 22 bp, Homo sapiens
agacactgcggaggtcgggtgg

SEQ ID NO: 9246043 - DNA, 22 bp, Homo sapiens
agacactgatgttcagctcaat

SEQ ID NO: 9246044 - DNA, 17 bp, Homo sapiens
agacactgagccaagta

SEQ ID NO: 9246045 - DNA, 22 bp, Homo sapiens
agacactgagcattttcctagc

SEQ ID NO: 9246046 - DNA, 21 bp, Homo sapiens
aatgtataacagagcccatca

SEQ ID NO: 9246047 - DNA, 22 bp, Homo sapiens
aatgtataaccataggaaattt

SEQ ID NO: 9246048 - DNA, 22 bp, Homo sapiens
aatgtataaccataggaaattt

SEQ ID NO: 9246049 - DNA, 22 bp, Homo sapiens
aatgtataaccataggaaattt

SEQ ID NO: 9246050 - DNA, 22 bp, Homo sapiens
agacactgaatgtttggtggtc

SEQ ID NO: 9246051 - DNA, 22 bp, Homo sapiens
agacactgaatcagagggacat

SEQ ID NO: 9246052 - DNA, 22 bp, Homo sapiens
agacactgaaatgtattgaaga

SEQ ID NO: 9246053 - DNA, 22 bp, Homo sapiens
agacactgaaatgtattgaaga

SEQ ID NO: 9246054 - DNA, 22 bp, Homo sapiens
agacactggtgaagaaatcagg

SEQ ID NO: 9246055 - DNA, 22 bp, Homo sapiens
agacactggcactggggaagcc

SEQ ID NO: 9246056 - DNA, 21 bp, Homo sapiens
agacctcttcccttcatgcac

SEQ ID NO: 9246057 - DNA, 22 bp, Homo sapiens
agacctctggatagatgtgagg

SEQ ID NO: 9246058 - DNA, 22 bp, Homo sapiens
aattcacaattatgttgggaga

SEQ ID NO: 9246059 - DNA, 23 bp, Homo sapiens
agagagagtttgtgtcaggtacc

SEQ ID NO: 9246060 - DNA, 22 bp, Homo sapiens
agagatatgagtagttgtgaca

SEQ ID NO: 9246061 - DNA, 22 bp, Homo sapiens
agagaaagtaaagattctacct

SEQ ID NO: 9246062 - DNA, 22 bp, Homo sapiens
agagacagggttttgccatgtt

SEQ ID NO: 9246063 - DNA, 22 bp, Homo sapiens
agagacagggttttgccatgtt

SEQ ID NO: 9246064 - DNA, 22 bp, Homo sapiens
agagagagaaatgaaatgtgct

SEQ ID NO: 9246065 - DNA, 22 bp, Homo sapiens
agagtgaaaagctagagcagta

SEQ ID NO: 9246066 - DNA, 22 bp, Homo sapiens
agagtcttccaggcagcctgag

SEQ ID NO: 9246067 - DNA, 22 bp, Homo sapiens
agagtgaaggttgacacttcac

SEQ ID NO: 9246068 - DNA, 22 bp, Homo sapiens
agatataataatttacaagtgt

SEQ ID NO: 9246069 - DNA, 22 bp, Homo sapiens
agagtacattcagagctaccta

SEQ ID NO: 9246070 - DNA, 22 bp, Homo sapiens
agagtaatttctgctgaaaagg

SEQ ID NO: 9246071 - DNA, 21 bp, Homo sapiens
agagtctgcatttctgacaag

SEQ ID NO: 9246072 - DNA, 21 bp, Homo sapiens
agagtctgcatttctgacaag

SEQ ID NO: 9246073 - DNA, 22 bp, Homo sapiens
agagtctggtgcatgataagca

SEQ ID NO: 9246074 - DNA, 22 bp, Homo sapiens
agagtctgggcactgggaatgc

SEQ ID NO: 9246075 - DNA, 22 bp, Homo sapiens
agaggttcagagaaggcgatct

SEQ ID NO: 9246076 - DNA, 20 bp, Homo sapiens
agaggttcagtctggagaag

SEQ ID NO: 9246077 - DNA, 22 bp, Homo sapiens
agaggttgggtctgaggtgaga

SEQ ID NO: 9246078 - DNA, 20 bp, Homo sapiens
agagtaactggcacataggg

SEQ ID NO: 9246079 - DNA, 22 bp, Homo sapiens
agaggtttcttaggggcttcct

SEQ ID NO: 9246080 - DNA, 22 bp, Homo sapiens
agaggtgtggccaggactcaag

SEQ ID NO: 9246081 - DNA, 22 bp, Homo sapiens
agaggtggagctcttggcatca

SEQ ID NO: 9246082 - DNA, 22 bp, Homo sapiens
agaggtggccatgggcgctgga

SEQ ID NO: 9246083 - DNA, 22 bp, Homo sapiens
agatccagttaatagcttcatt

SEQ ID NO: 9246084 - DNA, 21 bp, Homo sapiens
agatccctgaggagagcatcc

SEQ ID NO: 9246085 - DNA, 22 bp, Homo sapiens
agatccttaatttaatcacatc

SEQ ID NO: 9246086 - DNA, 21 bp, Homo sapiens
agatcctgtggctgagaagta

SEQ ID NO: 9246087 - DNA, 22 bp, Homo sapiens
agatcggctttgcagacctcat

SEQ ID NO: 9246088 - DNA, 22 bp, Homo sapiens
agatatgactagaagctcattt

SEQ ID NO: 9246089 - DNA, 22 bp, Homo sapiens
agatatagttgttgagaagaac

SEQ ID NO: 9246090 - DNA, 22 bp, Homo sapiens
agatatatttaaggtaataagt

SEQ ID NO: 9246091 - DNA, 21 bp, Homo sapiens
agattacaggtgtgatccacc

SEQ ID NO: 9246092 - DNA, 22 bp, Homo sapiens
agattacagaagaataagtaga

SEQ ID NO: 9246093 - DNA, 22 bp, Homo sapiens
agattacaacatgggacgcata

SEQ ID NO: 9246094 - DNA, 22 bp, Homo sapiens
agattacagcatgggaatggga

SEQ ID NO: 9246095 - DNA, 21 bp, Homo sapiens
agattcaggacagcagtcact

SEQ ID NO: 9246096 - DNA, 22 bp, Homo sapiens
agattatgctggctgctacaag

SEQ ID NO: 9246097 - DNA, 20 bp, Homo sapiens
agattattcctaagatttct

SEQ ID NO: 9246098 - DNA, 22 bp, Homo sapiens
agatgggtaattgatggcagta

SEQ ID NO: 9246099 - DNA, 22 bp, Homo sapiens
agatgggtaattgatggcagta

SEQ ID NO: 9246100 - DNA, 22 bp, Homo sapiens
agatgggtctcccttagcacct

SEQ ID NO: 9246101 - DNA, 22 bp, Homo sapiens
agatgggtgccttctttcttta

SEQ ID NO: 9246102 - DNA, 22 bp, Homo sapiens
agatgggttgagaacacatgct

SEQ ID NO: 9246103 - DNA, 22 bp, Homo sapiens
agatcttatgatgcacagggca

SEQ ID NO: 9246104 - DNA, 20 bp, Homo sapiens
agatctgcctgcaccctctc

SEQ ID NO: 9246105 - DNA, 22 bp, Homo sapiens
agattaactctcagaaaagagg

SEQ ID NO: 9246106 - DNA, 20 bp, Homo sapiens
agatgggttaaagctatggg

SEQ ID NO: 9246107 - DNA, 16 bp, Homo sapiens
agatgggtgggtcact

SEQ ID NO: 9246108 - DNA, 22 bp, Homo sapiens
aattcacagttctgcaccttac

SEQ ID NO: 9246109 - DNA, 22 bp, Homo sapiens
aattcacaggaggtatttgtcc

SEQ ID NO: 9246110 - DNA, 22 bp, Homo sapiens
aattcacagcatttgcccatct

SEQ ID NO: 9246111 - DNA, 22 bp, Homo sapiens
aattcacttgtgcacgctatgg

SEQ ID NO: 9246112 - DNA, 22 bp, Homo sapiens
aattcacatccgaccaggtcaa

SEQ ID NO: 9246113 - DNA, 18 bp, Homo sapiens
agagcagcggcatcacac

SEQ ID NO: 9246114 - DNA, 22 bp, Homo sapiens
aattcactgttccttctgcttt

SEQ ID NO: 9246115 - DNA, 22 bp, Homo sapiens
aattcatactctatattgcttt

SEQ ID NO: 9246116 - DNA, 22 bp, Homo sapiens
agaggccaagccagactgtgca

SEQ ID NO: 9246117 - DNA, 23 bp, Homo sapiens
agaggccaacttcttgcccctcc

SEQ ID NO: 9246118 - DNA, 23 bp, Homo sapiens
agaggccaacttcttgcccctcc

SEQ ID NO: 9246119 - DNA, 22 bp, Homo sapiens
agaggccaaagaatctacaaga

SEQ ID NO: 9246120 - DNA, 22 bp, Homo sapiens
agaggccaaagaatctacaaga

SEQ ID NO: 9246121 - DNA, 21 bp, Homo sapiens
agaggcaggcattaagtacac

SEQ ID NO: 9246122 - DNA, 22 bp, Homo sapiens
agaggcagtatacaatccgagc

SEQ ID NO: 9246123 - DNA, 21 bp, Homo sapiens
agaggcaggcattaagtacac

SEQ ID NO: 9246124 - DNA, 22 bp, Homo sapiens
agagcagctggggcagagacca

SEQ ID NO: 9246125 - DNA, 22 bp, Homo sapiens
agaggcaacatggggaacagat

SEQ ID NO: 9246126 - DNA, 22 bp, Homo sapiens
agagcaggcataaagctttgaa

SEQ ID NO: 9246127 - DNA, 21 bp, Homo sapiens
agaggccaagtcatcatttcc

SEQ ID NO: 9246128 - DNA, 21 bp, Homo sapiens
agaggccaagtcatcatttcc

SEQ ID NO: 9246129 - DNA, 21 bp, Homo sapiens
agaggccaagtcatcatttcc

SEQ ID NO: 9246130 - DNA, 22 bp, Homo sapiens
agaggccaatagtaggtggcat

SEQ ID NO: 9246131 - DNA, 22 bp, Homo sapiens
agaggccaatagtaggtggcat

SEQ ID NO: 9246132 - DNA, 22 bp, Homo sapiens
agaggccacaccagcctcccgt

SEQ ID NO: 9246133 - DNA, 22 bp, Homo sapiens
agaggccaatagtaggtggcat

SEQ ID NO: 9246134 - DNA, 22 bp, Homo sapiens
aatttattcccgtctctgggct

SEQ ID NO: 9246135 - DNA, 22 bp, Homo sapiens
aatttattcccgtctctgggct

SEQ ID NO: 9246136 - DNA, 22 bp, Homo sapiens
aatttattatatcctaggggaa

SEQ ID NO: 9246137 - DNA, 22 bp, Homo sapiens
aatttattatatcctaggggaa

SEQ ID NO: 9246138 - DNA, 22 bp, Homo sapiens
aatttatttcctgccagtacac

SEQ ID NO: 9246139 - DNA, 22 bp, Homo sapiens
aatttatttcctgccagtacac

SEQ ID NO: 9246140 - DNA, 22 bp, Homo sapiens
aatttatttcctgccagtacac

SEQ ID NO: 9246141 - DNA, 22 bp, Homo sapiens
aatttcaaagctcactggcata

SEQ ID NO: 9246142 - DNA, 21 bp, Homo sapiens
aattttgaaggaagattaagg

SEQ ID NO: 9246143 - DNA, 17 bp, Homo sapiens
agagggctcaaggcatc

SEQ ID NO: 9246144 - DNA, 22 bp, Homo sapiens
agagggctggacgcaggttgga

SEQ ID NO: 9246145 - DNA, 22 bp, Homo sapiens
agagggctgctgcacagtgctc

SEQ ID NO: 9246146 - DNA, 22 bp, Homo sapiens
agagggccataggtgcatagtt

SEQ ID NO: 9246147 - DNA, 22 bp, Homo sapiens
agagggcccatgttgggctgct

SEQ ID NO: 9246148 - DNA, 22 bp, Homo sapiens
agagggcataaaatagagcacg

SEQ ID NO: 9246149 - DNA, 22 bp, Homo sapiens
agagggcccatgttgggctgct

SEQ ID NO: 9246150 - DNA, 23 bp, Homo sapiens
aaagatgtgagtattcatatggc

SEQ ID NO: 9246151 - DNA, 22 bp, Homo sapiens
aaagcaataggttaggtcaaga

SEQ ID NO: 9246152 - DNA, 22 bp, Homo sapiens
aaagcaataggttaggtcaaga

SEQ ID NO: 9246153 - DNA, 22 bp, Homo sapiens
aaagcaataggttaggtcaaga

SEQ ID NO: 9246154 - DNA, 22 bp, Homo sapiens
aaagatgtcagtttgaaataac

SEQ ID NO: 9246155 - DNA, 22 bp, Homo sapiens
aaagcaatgcccgttcattatc

SEQ ID NO: 9246156 - DNA, 22 bp, Homo sapiens
aaagcaatgcccgttcattatc

SEQ ID NO: 9246157 - DNA, 22 bp, Homo sapiens
aaagcaatgcccgttcattatc

SEQ ID NO: 9246158 - DNA, 22 bp, Homo sapiens
aaagcaatgcttgtggaatgta

SEQ ID NO: 9246159 - DNA, 22 bp, Homo sapiens
aaagcaatgcccgttcattatc

SEQ ID NO: 9246160 - DNA, 22 bp, Homo sapiens
aaagcaatctagttccaattct

SEQ ID NO: 9246161 - DNA, 22 bp, Homo sapiens
aaagcaatgatggtagacacgt

SEQ ID NO: 9246162 - DNA, 22 bp, Homo sapiens
aaagcaatgatggtagacacgt

SEQ ID NO: 9246163 - DNA, 22 bp, Homo sapiens
aaagcaatgatggtagacacgt

SEQ ID NO: 9246164 - DNA, 22 bp, Homo sapiens
aaagcaatgatggtagacacgt

SEQ ID NO: 9246165 - DNA, 22 bp, Homo sapiens
aaagcaatagtaatggtaatag

SEQ ID NO: 9246166 - DNA, 22 bp, Homo sapiens
aaagcaatagtaatggtaatag

SEQ ID NO: 9246167 - DNA, 22 bp, Homo sapiens
aaagcaatagtaatggtaatag

SEQ ID NO: 9246168 - DNA, 22 bp, Homo sapiens
aaagcaatcagattcagatgtc

SEQ ID NO: 9246169 - DNA, 22 bp, Homo sapiens
aaagcaatcagattcagatgtc

SEQ ID NO: 9246170 - DNA, 22 bp, Homo sapiens
aaagcaatcagattcagatgtc

SEQ ID NO: 9246171 - DNA, 22 bp, Homo sapiens
aaagcaatcagattcagatgtc

SEQ ID NO: 9246172 - DNA, 22 bp, Homo sapiens
aaagcaatctagttccaattct

SEQ ID NO: 9246173 - DNA, 22 bp, Homo sapiens
aaagcaatctagttccaattct

SEQ ID NO: 9246174 - DNA, 22 bp, Homo sapiens
aaagcaatgcttgtggaatgta

SEQ ID NO: 9246175 - DNA, 22 bp, Homo sapiens
aaagcaatgcttgtggaatgta

SEQ ID NO: 9246176 - DNA, 22 bp, Homo sapiens
aaagcaatggatgagaatctgt

SEQ ID NO: 9246177 - DNA, 22 bp, Homo sapiens
aaagcaatggatgagaatctgt

SEQ ID NO: 9246178 - DNA, 22 bp, Homo sapiens
aaaggaggaatggagagatgct

SEQ ID NO: 9246179 - DNA, 22 bp, Homo sapiens
aaaggaggaatggagagatgct

SEQ ID NO: 9246180 - DNA, 22 bp, Homo sapiens
aaaggccttgagctgggtgcca

SEQ ID NO: 9246181 - DNA, 22 bp, Homo sapiens
aaacactgatggatatttttcc

SEQ ID NO: 9246182 - DNA, 22 bp, Homo sapiens
aaaggccacactgctctttctc

SEQ ID NO: 9246183 - DNA, 22 bp, Homo sapiens
aaacatcataggcatgcatgat

SEQ ID NO: 9246184 - DNA, 22 bp, Homo sapiens
aaacatcataggcatgcatgat

SEQ ID NO: 9246185 - DNA, 22 bp, Homo sapiens
aaacatagataatagatagatg

SEQ ID NO: 9246186 - DNA, 22 bp, Homo sapiens
aaacatcaccattttacctaat

SEQ ID NO: 9246187 - DNA, 20 bp, Homo sapiens
aaacatagtggataccacag

SEQ ID NO: 9246188 - DNA, 20 bp, Homo sapiens
aaacatagtggataccacag

SEQ ID NO: 9246189 - DNA, 22 bp, Homo sapiens
aaacagttttctcatttagtgt

SEQ ID NO: 9246190 - DNA, 22 bp, Homo sapiens
aaacactgtctctggtattgaa

SEQ ID NO: 9246191 - DNA, 22 bp, Homo sapiens
aaacactgcagggtttacttga

SEQ ID NO: 9246192 - DNA, 22 bp, Homo sapiens
aaacactggcaatttcatgcac

SEQ ID NO: 9246193 - DNA, 22 bp, Homo sapiens
aaacactggcaatttcatgcac

SEQ ID NO: 9246194 - DNA, 22 bp, Homo sapiens
aaacactggtatgatgtatagt

SEQ ID NO: 9246195 - DNA, 22 bp, Homo sapiens
aaacactggtatgatgtatagt

SEQ ID NO: 9246196 - DNA, 22 bp, Homo sapiens
aaacactggtatgatgtatagt

SEQ ID NO: 9246197 - DNA, 20 bp, Homo sapiens
aaacgagccatcattctggt

SEQ ID NO: 9246198 - DNA, 22 bp, Homo sapiens
aaatagaattggaagcagagtt

SEQ ID NO: 9246199 - DNA, 22 bp, Homo sapiens
aaatagaattaactagctactg

SEQ ID NO: 9246200 - DNA, 22 bp, Homo sapiens
aaatagaattaactagctactg

SEQ ID NO: 9246201 - DNA, 22 bp, Homo sapiens
aaatagaattggaagcagagtt

SEQ ID NO: 9246202 - DNA, 22 bp, Homo sapiens
aaatagaattggaagcagagtt

SEQ ID NO: 9246203 - DNA, 22 bp, Homo sapiens
aaatagaaaccaacaaggtcag

SEQ ID NO: 9246204 - DNA, 22 bp, Homo sapiens
aaatactgttgaatgaagtaag

SEQ ID NO: 9246205 - DNA, 22 bp, Homo sapiens
aaatactgttttattccatgat

SEQ ID NO: 9246206 - DNA, 22 bp, Homo sapiens
aaatatgtaaccaaggtgaagt

SEQ ID NO: 9246207 - DNA, 23 bp, Homo sapiens
aaactacaacgccaggcactgag

SEQ ID NO: 9246208 - DNA, 22 bp, Homo sapiens
aaactacactttgggaccagca

SEQ ID NO: 9246209 - DNA, 20 bp, Homo sapiens
aaactaaaggtgtttggttt

SEQ ID NO: 9246210 - DNA, 19 bp, Homo sapiens
aaactaaggggaaatgttt

SEQ ID NO: 9246211 - DNA, 19 bp, Homo sapiens
aaactaaggggaaatgttt

SEQ ID NO: 9246212 - DNA, 22 bp, Homo sapiens
aaatataatttctgcctcaata

SEQ ID NO: 9246213 - DNA, 22 bp, Homo sapiens
aaactacatctcatggatgagg

SEQ ID NO: 9246214 - DNA, 23 bp, Homo sapiens
aaactacatttatagtttttctc

SEQ ID NO: 9246215 - DNA, 22 bp, Homo sapiens
aaatattattgcttaaggggag

SEQ ID NO: 9246216 - DNA, 22 bp, Homo sapiens
aaatattagggagaacagggac

SEQ ID NO: 9246217 - DNA, 22 bp, Homo sapiens
aaatatgttttccagttgtcat

SEQ ID NO: 9246218 - DNA, 22 bp, Homo sapiens
aaatcagttggaacacaagcag

SEQ ID NO: 9246219 - DNA, 22 bp, Homo sapiens
aaatgcagctgggcatgagagg

SEQ ID NO: 9246220 - DNA, 22 bp, Homo sapiens
aaatcatctctgcatccttagc

SEQ ID NO: 9246221 - DNA, 22 bp, Homo sapiens
aaatgctgagtgtttagagatc

SEQ ID NO: 9246222 - DNA, 22 bp, Homo sapiens
aaatggcatagaggtgaaggta

SEQ ID NO: 9246223 - DNA, 22 bp, Homo sapiens
aaatggcatagaggtgaaggta

SEQ ID NO: 9246224 - DNA, 23 bp, Homo sapiens
aaatggccaaggttaaaaataca

SEQ ID NO: 9246225 - DNA, 22 bp, Homo sapiens
aaatggcattcagcaacctttc

SEQ ID NO: 9246226 - DNA, 22 bp, Homo sapiens
aaatggcagtgtcataaggctc

SEQ ID NO: 9246227 - DNA, 22 bp, Homo sapiens
aaatggcagtgtcataaggctc

SEQ ID NO: 9246228 - DNA, 22 bp, Homo sapiens
aaatggcagtagaaaagaatcc

SEQ ID NO: 9246229 - DNA, 22 bp, Homo sapiens
aaatgctctccaaaatgaaagt

SEQ ID NO: 9246230 - DNA, 22 bp, Homo sapiens
aaatgctctctaatgtaataca

SEQ ID NO: 9246231 - DNA, 22 bp, Homo sapiens
aaatgctacacaggaattctca

SEQ ID NO: 9246232 - DNA, 22 bp, Homo sapiens
aaaaagatagcattgtgctcct

SEQ ID NO: 9246233 - DNA, 22 bp, Homo sapiens
aaaaagatgtcctgaagtttag

SEQ ID NO: 9246234 - DNA, 19 bp, Homo sapiens
aaaaagaggctataatatt

SEQ ID NO: 9246235 - DNA, 22 bp, Homo sapiens
aaaaagacttccaactcaggag

SEQ ID NO: 9246236 - DNA, 22 bp, Homo sapiens
aaaaagagaaatgctctagtcc

SEQ ID NO: 9246237 - DNA, 21 bp, Homo sapiens
aaaaatgaagttgttcaggaa

SEQ ID NO: 9246238 - DNA, 22 bp, Homo sapiens
aaaaatgaaacggctggttggc

SEQ ID NO: 9246239 - DNA, 22 bp, Homo sapiens
aaaaatgaattcttcagtggca

SEQ ID NO: 9246240 - DNA, 22 bp, Homo sapiens
aaaaagacttccaactcaggag

SEQ ID NO: 9246241 - DNA, 22 bp, Homo sapiens
aaaaagacagaggatgaggcag

SEQ ID NO: 9246242 - DNA, 22 bp, Homo sapiens
aaaaatgaattcttcagtggca

SEQ ID NO: 9246243 - DNA, 22 bp, Homo sapiens
aaaaatgtgaccacagggtgtt

SEQ ID NO: 9246244 - DNA, 19 bp, Homo sapiens
aaaagtctattcaattaca

SEQ ID NO: 9246245 - DNA, 22 bp, Homo sapiens
aaacaaatagtgcatgggaatt

SEQ ID NO: 9246246 - DNA, 22 bp, Homo sapiens
aaacaaatttcaagctgtgaca

SEQ ID NO: 9246247 - DNA, 22 bp, Homo sapiens
aaacaacaatccaatgggagct

SEQ ID NO: 9246248 - DNA, 22 bp, Homo sapiens
aaacaaagccagggaagttatg

SEQ ID NO: 9246249 - DNA, 22 bp, Homo sapiens
aaacaaacataggtttgaaagt

SEQ ID NO: 9246250 - DNA, 22 bp, Homo sapiens
aaacaaacataggtttgaaagt

SEQ ID NO: 9246251 - DNA, 22 bp, Homo sapiens
aaacaaagcatcttgctatgca

SEQ ID NO: 9246252 - DNA, 22 bp, Homo sapiens
aaacaaagcatcttgctatgca

SEQ ID NO: 9246253 - DNA, 22 bp, Homo sapiens
aaacaactcggcaactgctttt

SEQ ID NO: 9246254 - DNA, 22 bp, Homo sapiens
aaacaacatggtgggtgtgtag

SEQ ID NO: 9246255 - DNA, 22 bp, Homo sapiens
aaacacaatgtttctttgttct

SEQ ID NO: 9246256 - DNA, 22 bp, Homo sapiens
aaacacacctttggaactgtga

SEQ ID NO: 9246257 - DNA, 22 bp, Homo sapiens
aaacacacagaaatgaatgagg

SEQ ID NO: 9246258 - DNA, 19 bp, Homo sapiens
aaacacagatttcttacca

SEQ ID NO: 9246259 - DNA, 22 bp, Homo sapiens
aaaatagattctaggatgtctt

SEQ ID NO: 9246260 - DNA, 22 bp, Homo sapiens
aaaatagattctaggatgtctt

SEQ ID NO: 9246261 - DNA, 22 bp, Homo sapiens
aaaatagataatgccagggtca

SEQ ID NO: 9246262 - DNA, 22 bp, Homo sapiens
aaaatagataatgccagggtca

SEQ ID NO: 9246263 - DNA, 22 bp, Homo sapiens
aaaagtctgctttctattatca

SEQ ID NO: 9246264 - DNA, 22 bp, Homo sapiens
aaaagtcttggggaaggccagg

SEQ ID NO: 9246265 - DNA, 22 bp, Homo sapiens
aaaagtctgctttctattatca

SEQ ID NO: 9246266 - DNA, 22 bp, Homo sapiens
aaaatagctatggaatgtcact

SEQ ID NO: 9246267 - DNA, 22 bp, Homo sapiens
aaaatagctatggaatgtcact

SEQ ID NO: 9246268 - DNA, 22 bp, Homo sapiens
aaaattcatggcttgggaaaag

SEQ ID NO: 9246269 - DNA, 22 bp, Homo sapiens
aaaatagcctcacataattgct

SEQ ID NO: 9246270 - DNA, 22 bp, Homo sapiens
aaaatagcctcacataattgct

SEQ ID NO: 9246271 - DNA, 22 bp, Homo sapiens
aaacatgagcatttctgtttaa

SEQ ID NO: 9246272 - DNA, 22 bp, Homo sapiens
aaacatgagcatctcttcaagc

SEQ ID NO: 9246273 - DNA, 22 bp, Homo sapiens
aaacatgagcatctcttcaagc

SEQ ID NO: 9246274 - DNA, 22 bp, Homo sapiens
aaacatttttcttcatcatcct

SEQ ID NO: 9246275 - DNA, 22 bp, Homo sapiens
aaacatttttcttcatcatcct

SEQ ID NO: 9246276 - DNA, 22 bp, Homo sapiens
aaaccaaccctggctggcctag

SEQ ID NO: 9246277 - DNA, 22 bp, Homo sapiens
aaaccacagttcagtgcttttg

SEQ ID NO: 9246278 - DNA, 22 bp, Homo sapiens
aaaccatggagtaagttcacat

SEQ ID NO: 9246279 - DNA, 22 bp, Homo sapiens
aaaccatcagataattcatact

SEQ ID NO: 9246280 - DNA, 22 bp, Homo sapiens
aaactgtaaacacagcagtaca

SEQ ID NO: 9246281 - DNA, 22 bp, Homo sapiens
aaacatcttctcttgattcttt

SEQ ID NO: 9246282 - DNA, 22 bp, Homo sapiens
aaacatgaatagatattaaaca

SEQ ID NO: 9246283 - DNA, 22 bp, Homo sapiens
aaacatgagcatctcttcaagc

SEQ ID NO: 9246284 - DNA, 22 bp, Homo sapiens
aaacatgagcacttgcttcata

SEQ ID NO: 9246285 - DNA, 22 bp, Homo sapiens
aaacatgagcacttgcttcata

SEQ ID NO: 9246286 - DNA, 19 bp, Homo sapiens
aaacacagatttcttacca

SEQ ID NO: 9246287 - DNA, 19 bp, Homo sapiens
aaacacagatttcttacca

SEQ ID NO: 9246288 - DNA, 22 bp, Homo sapiens
aaacacagatttctttgtccca

SEQ ID NO: 9246289 - DNA, 22 bp, Homo sapiens
aaacacagcatgtccttgggga

SEQ ID NO: 9246290 - DNA, 20 bp, Homo sapiens
aaacacagcctctctttaca

SEQ ID NO: 9246291 - DNA, 22 bp, Homo sapiens
aaacacagggatatatattcca

SEQ ID NO: 9246292 - DNA, 22 bp, Homo sapiens
aaacagtcctctttatttagtc

SEQ ID NO: 9246293 - DNA, 22 bp, Homo sapiens
aaacacagggatatatattcca

SEQ ID NO: 9246294 - DNA, 22 bp, Homo sapiens
aaacagtctgatgccatctgcc

SEQ ID NO: 9246295 - DNA, 22 bp, Homo sapiens
aaagatgatctacaagttcatt

SEQ ID NO: 9246296 - DNA, 22 bp, Homo sapiens
aaagatgatctacaagttcatt

SEQ ID NO: 9246297 - DNA, 22 bp, Homo sapiens
aaagagctttagaaatctcaga

SEQ ID NO: 9246298 - DNA, 22 bp, Homo sapiens
aaagatcattctctggtccaga

SEQ ID NO: 9246299 - DNA, 22 bp, Homo sapiens
aaagatcattctctggtccaga

SEQ ID NO: 9246300 - DNA, 19 bp, Homo sapiens
aaagatctgggattgagac

SEQ ID NO: 9246301 - DNA, 22 bp, Homo sapiens
aaagatctccccttcaaagagt

SEQ ID NO: 9246302 - DNA, 22 bp, Homo sapiens
aaagaagatggagacctgacta

SEQ ID NO: 9246303 - DNA, 22 bp, Homo sapiens
aaagaagacagacatttctttc

SEQ ID NO: 9246304 - DNA, 22 bp, Homo sapiens
aaagaagacagacatttctttc

SEQ ID NO: 9246305 - DNA, 22 bp, Homo sapiens
aaagaaggacctggaggaggat

SEQ ID NO: 9246306 - DNA, 22 bp, Homo sapiens
aaagaagctgtggctctgggag

SEQ ID NO: 9246307 - DNA, 22 bp, Homo sapiens
aaagaagggacagactgcctct

SEQ ID NO: 9246308 - DNA, 18 bp, Homo sapiens
aaagaaggattggagagc

SEQ ID NO: 9246309 - DNA, 18 bp, Homo sapiens
aaagaaggattggagagc

SEQ ID NO: 9246310 - DNA, 22 bp, Homo sapiens
aaactttaagacagtcctcaag

SEQ ID NO: 9246311 - DNA, 19 bp, Homo sapiens
aaagaactttgggctaggc

SEQ ID NO: 9246312 - DNA, 22 bp, Homo sapiens
aaactttaggaaggaatttaca

SEQ ID NO: 9246313 - DNA, 23 bp, Homo sapiens
aaacttgctatggctgaaatcat

SEQ ID NO: 9246314 - DNA, 22 bp, Homo sapiens
aaacttgatttagaactaaggc

SEQ ID NO: 9246315 - DNA, 23 bp, Homo sapiens
aaacttgctatggctgaaatcat

SEQ ID NO: 9246316 - DNA, 22 bp, Homo sapiens
aaacttgcgtcatgtcatgaaa

SEQ ID NO: 9246317 - DNA, 22 bp, Homo sapiens
aaacttgaggcaatgaaggtgt

SEQ ID NO: 9246318 - DNA, 22 bp, Homo sapiens
aaacttgagccaagggcttggg

SEQ ID NO: 9246319 - DNA, 22 bp, Homo sapiens
aaacttgaacccagctcaggct

SEQ ID NO: 9246320 - DNA, 22 bp, Homo sapiens
aacattcaagttctggtttatg

SEQ ID NO: 9246321 - DNA, 22 bp, Homo sapiens
aacattcacctctacctccttc

SEQ ID NO: 9246322 - DNA, 22 bp, Homo sapiens
aacattcaaaacccagttcagt

SEQ ID NO: 9246323 - DNA, 22 bp, Homo sapiens
aacatgcaatgtctgaaaatcc

SEQ ID NO: 9246324 - DNA, 22 bp, Homo sapiens
aacatttccggccttttgttct

SEQ ID NO: 9246325 - DNA, 22 bp, Homo sapiens
aacattctatgtgcattcagaa

SEQ ID NO: 9246326 - DNA, 22 bp, Homo sapiens
aacatttcataacttgactttt

SEQ ID NO: 9246327 - DNA, 22 bp, Homo sapiens
aacattctactgtactgcattg

SEQ ID NO: 9246328 - DNA, 22 bp, Homo sapiens
aacattcagctgggtggagcag

SEQ ID NO: 9246329 - DNA, 22 bp, Homo sapiens
aacagtattggttgaactcaag

SEQ ID NO: 9246330 - DNA, 22 bp, Homo sapiens
aacagtatctacgggaactatt

SEQ ID NO: 9246331 - DNA, 22 bp, Homo sapiens
aacagtatcttttatcagaaat

SEQ ID NO: 9246332 - DNA, 22 bp, Homo sapiens
aacagtcttacagaagtagcca

SEQ ID NO: 9246333 - DNA, 22 bp, Homo sapiens
aacaggaaaacagcacaatagc

SEQ ID NO: 9246334 - DNA, 22 bp, Homo sapiens
aacaggaaacaagttgttagga

SEQ ID NO: 9246335 - DNA, 22 bp, Homo sapiens
aacaggaaatacttatgaggta

SEQ ID NO: 9246336 - DNA, 22 bp, Homo sapiens
aacagtactggacaaggagtca

SEQ ID NO: 9246337 - DNA, 22 bp, Homo sapiens
aacagtaggcatcacataatga

SEQ ID NO: 9246338 - DNA, 22 bp, Homo sapiens
aacagtaggtgtaaccaaacaa

SEQ ID NO: 9246339 - DNA, 22 bp, Homo sapiens
aactcactttgtggcttctgaa

SEQ ID NO: 9246340 - DNA, 22 bp, Homo sapiens
aactgaggccaagtgaggaaag

SEQ ID NO: 9246341 - DNA, 22 bp, Homo sapiens
aactgatttcaagttcagtttc

SEQ ID NO: 9246342 - DNA, 22 bp, Homo sapiens
aacatttgcagaggaaagctat

SEQ ID NO: 9246343 - DNA, 22 bp, Homo sapiens
aactaatacattaatacatgtg

SEQ ID NO: 9246344 - DNA, 22 bp, Homo sapiens
aactcacacaagtattgcctgc

SEQ ID NO: 9246345 - DNA, 22 bp, Homo sapiens
aactcacagctgtttggattag

SEQ ID NO: 9246346 - DNA, 21 bp, Homo sapiens
aactatggaggaaataagtcc

SEQ ID NO: 9246347 - DNA, 22 bp, Homo sapiens
aactatggtattctgatgtttc

SEQ ID NO: 9246348 - DNA, 22 bp, Homo sapiens
aaagcactatagccaaatagcc

SEQ ID NO: 9246349 - DNA, 22 bp, Homo sapiens
aaagcacattacaagctcagtc

SEQ ID NO: 9246350 - DNA, 22 bp, Homo sapiens
aaagcacatagtagaaggattt

SEQ ID NO: 9246351 - DNA, 22 bp, Homo sapiens
aaagcaattgtggtttttgtca

SEQ ID NO: 9246352 - DNA, 22 bp, Homo sapiens
aaagcaatttaatggaccatga

SEQ ID NO: 9246353 - DNA, 22 bp, Homo sapiens
aaagcaatttaatggaccatga

SEQ ID NO: 9246354 - DNA, 22 bp, Homo sapiens
aaagcaattgtggtttttgtca

SEQ ID NO: 9246355 - DNA, 22 bp, Homo sapiens
aaagcaatttaatggaccatga

SEQ ID NO: 9246356 - DNA, 22 bp, Homo sapiens
aacaaattagttgcaagactgg

SEQ ID NO: 9246357 - DNA, 22 bp, Homo sapiens
aacaaatgtgttttgtaattaa

SEQ ID NO: 9246358 - DNA, 22 bp, Homo sapiens
aacaacagctgctaaagagttg

SEQ ID NO: 9246359 - DNA, 22 bp, Homo sapiens
aaagcaatgtctctgcctggtt

SEQ ID NO: 9246360 - DNA, 22 bp, Homo sapiens
aaagcaatgtctctgcctggtt

SEQ ID NO: 9246361 - DNA, 22 bp, Homo sapiens
aaagcaattacaaaagggataa

SEQ ID NO: 9246362 - DNA, 22 bp, Homo sapiens
aaagcaatgggtctaaggtaaa

SEQ ID NO: 9246363 - DNA, 22 bp, Homo sapiens
aaagcaatgtctctgcctggtt

SEQ ID NO: 9246364 - DNA, 22 bp, Homo sapiens
aaagcaatgggtctaaggtaaa

SEQ ID NO: 9246365 - DNA, 22 bp, Homo sapiens
aaagcaattacaaaagggataa

SEQ ID NO: 9246366 - DNA, 22 bp, Homo sapiens
aaagcaattacaaaagggataa

SEQ ID NO: 9246367 - DNA, 22 bp, Homo sapiens
aaagcaattgtggtttttgcca

SEQ ID NO: 9246368 - DNA, 22 bp, Homo sapiens
aaagcaattgtggtttttgcca

SEQ ID NO: 9246369 - DNA, 22 bp, Homo sapiens
aaagcaattgtggtttttgtca

SEQ ID NO: 9246370 - DNA, 22 bp, Homo sapiens
aaagcaattgtggtttttgcca

SEQ ID NO: 9246371 - DNA, 22 bp, Homo sapiens
aaagcaatggcacatgatggta

SEQ ID NO: 9246372 - DNA, 22 bp, Homo sapiens
aaagcaatggcacatgatggta

SEQ ID NO: 9246373 - DNA, 22 bp, Homo sapiens
aaagcaatgggtctaaggtaaa

SEQ ID NO: 9246374 - DNA, 22 bp, Homo sapiens
aaagcaatgggtctaaggtaaa

SEQ ID NO: 9246375 - DNA, 22 bp, Homo sapiens
aaagcaatagagggtaagactg

SEQ ID NO: 9246376 - DNA, 22 bp, Homo sapiens
aaagcaatagagggtaagactg

SEQ ID NO: 9246377 - DNA, 22 bp, Homo sapiens
aaagcaatagagggtaagactg

SEQ ID NO: 9246378 - DNA, 22 bp, Homo sapiens
aaatggtgaagtgtaatttagc

SEQ ID NO: 9246379 - DNA, 22 bp, Homo sapiens
aaagcaagtctctacaaagtac

SEQ ID NO: 9246380 - DNA, 22 bp, Homo sapiens
aaagcaagtctctacaaagtac

SEQ ID NO: 9246381 - DNA, 22 bp, Homo sapiens
aaatggtaatgtctttctgttt

SEQ ID NO: 9246382 - DNA, 22 bp, Homo sapiens
aaatggtaggttttcttaagaa

SEQ ID NO: 9246383 - DNA, 22 bp, Homo sapiens
aaatggtatgaaaagagatttc

SEQ ID NO: 9246384 - DNA, 22 bp, Homo sapiens
aaatggtagtagcattccatat

SEQ ID NO: 9246385 - DNA, 22 bp, Homo sapiens
aaatggtataatgtcatgtatt

SEQ ID NO: 9246386 - DNA, 22 bp, Homo sapiens
aaatgggcctggaaagaggatg

SEQ ID NO: 9246387 - DNA, 22 bp, Homo sapiens
aaatgggcctggaaagaggatg

SEQ ID NO: 9246388 - DNA, 20 bp, Homo sapiens
aaatggcctcagataagcag

SEQ ID NO: 9246389 - DNA, 22 bp, Homo sapiens
aaatggctgactaaattaaatt

SEQ ID NO: 9246390 - DNA, 22 bp, Homo sapiens
aacacaaagaagctgcaggatc

SEQ ID NO: 9246391 - DNA, 22 bp, Homo sapiens
aacaattatcatatacattgca

SEQ ID NO: 9246392 - DNA, 22 bp, Homo sapiens
aacaattatcatatacattgca

SEQ ID NO: 9246393 - DNA, 22 bp, Homo sapiens
aacaagaagggaaggcatgatt

SEQ ID NO: 9246394 - DNA, 22 bp, Homo sapiens
aacaagaagagagggacgtaat

SEQ ID NO: 9246395 - DNA, 22 bp, Homo sapiens
aacaagaacacctacagttcta

SEQ ID NO: 9246396 - DNA, 22 bp, Homo sapiens
aacaagaacacctacagttcta

SEQ ID NO: 9246397 - DNA, 22 bp, Homo sapiens
aacaagaataagtggtttctgg

SEQ ID NO: 9246398 - DNA, 22 bp, Homo sapiens
aacaagaataagtggtttctgg

SEQ ID NO: 9246399 - DNA, 22 bp, Homo sapiens
aacagctttgagcagttctgta

SEQ ID NO: 9246400 - DNA, 22 bp, Homo sapiens
aacagcttgctgcaccttaata

SEQ ID NO: 9246401 - DNA, 22 bp, Homo sapiens
aacagctttagaggataatagt

SEQ ID NO: 9246402 - DNA, 23 bp, Homo sapiens
aacacattgctaattacattcaa

SEQ ID NO: 9246403 - DNA, 22 bp, Homo sapiens
aacagctttgcttctggagaca

SEQ ID NO: 9246404 - DNA, 22 bp, Homo sapiens
aacagctttgcttctggagaca

SEQ ID NO: 9246405 - DNA, 22 bp, Homo sapiens
aacagctttgtatacagtaact

SEQ ID NO: 9246406 - DNA, 22 bp, Homo sapiens
aacagctttgtgctcagatttg

SEQ ID NO: 9246407 - DNA, 22 bp, Homo sapiens
aacagcttttttggtcagcatt

SEQ ID NO: 9246408 - DNA, 22 bp, Homo sapiens
aacacatatttatatatgcaca

SEQ ID NO: 9246409 - DNA, 22 bp, Homo sapiens
aacacatgggtgtttattgtac

SEQ ID NO: 9246410 - DNA, 22 bp, Homo sapiens
aacacatgggtgtttattgtac

SEQ ID NO: 9246411 - DNA, 22 bp, Homo sapiens
aagaaagtgctttgtaaattat

SEQ ID NO: 9246412 - DNA, 22 bp, Homo sapiens
aagaaagtgctttgtaaattat

SEQ ID NO: 9246413 - DNA, 22 bp, Homo sapiens
aagaatgtgggtggatatgatg

SEQ ID NO: 9246414 - DNA, 22 bp, Homo sapiens
aagaatgtggcatttatttata

SEQ ID NO: 9246415 - DNA, 22 bp, Homo sapiens
aagaatgtgggtggatatgatg

SEQ ID NO: 9246416 - DNA, 22 bp, Homo sapiens
aagaatgtcgttggtattttaa

SEQ ID NO: 9246417 - DNA, 22 bp, Homo sapiens
aagaatgagctcaaagatctta

SEQ ID NO: 9246418 - DNA, 22 bp, Homo sapiens
aagaatgagctcaaagatctta

SEQ ID NO: 9246419 - DNA, 22 bp, Homo sapiens
aagaatgattacaaagcaacga

SEQ ID NO: 9246420 - DNA, 22 bp, Homo sapiens
aactttgttttattcactgctg

SEQ ID NO: 9246421 - DNA, 22 bp, Homo sapiens
aactttcttgtgacatttgggg

SEQ ID NO: 9246422 - DNA, 22 bp, Homo sapiens
aagaaagctgaatattctgtgt

SEQ ID NO: 9246423 - DNA, 22 bp, Homo sapiens
aacttttcattgaatcatgtca

SEQ ID NO: 9246424 - DNA, 22 bp, Homo sapiens
aacttttcataagggcaaattt

SEQ ID NO: 9246425 - DNA, 23 bp, Homo sapiens
aacttttagagtttaacagtgtt

SEQ ID NO: 9246426 - DNA, 22 bp, Homo sapiens
aagaatgttagtttctgataca

SEQ ID NO: 9246427 - DNA, 22 bp, Homo sapiens
aagacactaagctttcaggata

SEQ ID NO: 9246428 - DNA, 22 bp, Homo sapiens
aagacactaagctttcaggata

SEQ ID NO: 9246429 - DNA, 22 bp, Homo sapiens
aagaattatctgaaagctgtgt

SEQ ID NO: 9246430 - DNA, 22 bp, Homo sapiens
aagacactgatactctgtgatt

SEQ ID NO: 9246431 - DNA, 22 bp, Homo sapiens
aagacactgggggctgcagcca

SEQ ID NO: 9246432 - DNA, 22 bp, Homo sapiens
aagacactcattatcactggtt

SEQ ID NO: 9246433 - DNA, 22 bp, Homo sapiens
aagacactcattatcactggtt

SEQ ID NO: 9246434 - DNA, 22 bp, Homo sapiens
aagacactgatactctgtgatt

SEQ ID NO: 9246435 - DNA, 22 bp, Homo sapiens
aagacactttctaaatagaagt

SEQ ID NO: 9246436 - DNA, 22 bp, Homo sapiens
aagacactgggttaggcacgtg

SEQ ID NO: 9246437 - DNA, 22 bp, Homo sapiens
aagacactgggttaggcacgtg

SEQ ID NO: 9246438 - DNA, 22 bp, Homo sapiens
aagacactttctaaatagaagt

SEQ ID NO: 9246439 - DNA, 17 bp, Homo sapiens
aagacagaagccatgag

SEQ ID NO: 9246440 - DNA, 22 bp, Homo sapiens
aagacagaccacgtgacagggc

SEQ ID NO: 9246441 - DNA, 22 bp, Homo sapiens
aagacagaccacgtgacagggc

SEQ ID NO: 9246442 - DNA, 22 bp, Homo sapiens
aagacagagactctgcaacagg

SEQ ID NO: 9246443 - DNA, 22 bp, Homo sapiens
aagagagagttcctaggcaaaa

SEQ ID NO: 9246444 - DNA, 22 bp, Homo sapiens
aagagcagtgttttactcagct

SEQ ID NO: 9246445 - DNA, 20 bp, Homo sapiens
aagagcatagtacaggaaga

SEQ ID NO: 9246446 - DNA, 22 bp, Homo sapiens
aagagcatttggtgagatttga

SEQ ID NO: 9246447 - DNA, 22 bp, Homo sapiens
aagagccagctagtgaagaggc

SEQ ID NO: 9246448 - DNA, 22 bp, Homo sapiens
aagagccagtgggaaagtcttg

SEQ ID NO: 9246449 - DNA, 22 bp, Homo sapiens
aagagcatattaatagtggaga

SEQ ID NO: 9246450 - DNA, 22 bp, Homo sapiens
aagagcatctatttcacagtgg

SEQ ID NO: 9246451 - DNA, 22 bp, Homo sapiens
aagaggaagtctccatggagag

SEQ ID NO: 9246452 - DNA, 22 bp, Homo sapiens
aagaggagaaaggctggctttg

SEQ ID NO: 9246453 - DNA, 22 bp, Homo sapiens
aagaggacttgtgaagatgtac

SEQ ID NO: 9246454 - DNA, 22 bp, Homo sapiens
aagaggaagtctccatggagag

SEQ ID NO: 9246455 - DNA, 22 bp, Homo sapiens
aagcacctgcagttgacaaaaa

SEQ ID NO: 9246456 - DNA, 22 bp, Homo sapiens
aaatatgactagaatgccaggt

SEQ ID NO: 9246457 - DNA, 22 bp, Homo sapiens
aaatatgaatgataagagttat

SEQ ID NO: 9246458 - DNA, 22 bp, Homo sapiens
aaatatcctcagggcagaggtg

SEQ ID NO: 9246459 - DNA, 22 bp, Homo sapiens
aaatatgaatgataagagttat

SEQ ID NO: 9246460 - DNA, 22 bp, Homo sapiens
aagcaactgccttcaatattta

SEQ ID NO: 9246461 - DNA, 22 bp, Homo sapiens
aagcaactgttgaattggacta

SEQ ID NO: 9246462 - DNA, 22 bp, Homo sapiens
aaatatcatttataacttttaa

SEQ ID NO: 9246463 - DNA, 22 bp, Homo sapiens
aaatatcatttataacttttaa

SEQ ID NO: 9246464 - DNA, 22 bp, Homo sapiens
aaatatcatttataacttttaa

SEQ ID NO: 9246465 - DNA, 22 bp, Homo sapiens
aaatatcatttataacttttaa

SEQ ID NO: 9246466 - DNA, 22 bp, Homo sapiens
aaatatcatttataacttttaa

SEQ ID NO: 9246467 - DNA, 22 bp, Homo sapiens
aaatatcattctggtgcacaga

SEQ ID NO: 9246468 - DNA, 22 bp, Homo sapiens
aagaggagacttcagcaacttg

SEQ ID NO: 9246469 - DNA, 22 bp, Homo sapiens
aagaggagacttcagcaacttg

SEQ ID NO: 9246470 - DNA, 22 bp, Homo sapiens
aagaggaggacggttcccagaa

SEQ ID NO: 9246471 - DNA, 18 bp, Homo sapiens
aagaggaggaaacccagg

SEQ ID NO: 9246472 - DNA, 18 bp, Homo sapiens
aagaggaggagcaggttg

SEQ ID NO: 9246473 - DNA, 18 bp, Homo sapiens
aagaggaggagcaggttg

SEQ ID NO: 9246474 - DNA, 18 bp, Homo sapiens
aagaggaggagcaggttg

SEQ ID NO: 9246475 - DNA, 22 bp, Homo sapiens
aagcaaagagtttagtgggtga

SEQ ID NO: 9246476 - DNA, 22 bp, Homo sapiens
aagcaaagagataaccttttgg

SEQ ID NO: 9246477 - DNA, 22 bp, Homo sapiens
aagcaaaggaaagctgactttt

SEQ ID NO: 9246478 - DNA, 22 bp, Homo sapiens
aagcaaaggcaggagcttgtga

SEQ ID NO: 9246479 - DNA, 22 bp, Homo sapiens
aagcaaaggcaggagcttgtga

SEQ ID NO: 9246480 - DNA, 22 bp, Homo sapiens
aagcaaagtgaattttgccaag

SEQ ID NO: 9246481 - DNA, 22 bp, Homo sapiens
aagcaaagtgctttgcctccag

SEQ ID NO: 9246482 - DNA, 22 bp, Homo sapiens
aagcaaatgtgggtgcagaatt

SEQ ID NO: 9246483 - DNA, 23 bp, Homo sapiens
aagcatggttcacagttagtact

SEQ ID NO: 9246484 - DNA, 22 bp, Homo sapiens
aagcagcataattgctatttta

SEQ ID NO: 9246485 - DNA, 22 bp, Homo sapiens
aagccactgagatttcactgca

SEQ ID NO: 9246486 - DNA, 22 bp, Homo sapiens
aagccactcacaataactgtcc

SEQ ID NO: 9246487 - DNA, 22 bp, Homo sapiens
aagccactgagatttcactgca

SEQ ID NO: 9246488 - DNA, 22 bp, Homo sapiens
aagccactatggtgattctcaa

SEQ ID NO: 9246489 - DNA, 22 bp, Homo sapiens
aagccacagatcgttctgtcac

SEQ ID NO: 9246490 - DNA, 18 bp, Homo sapiens
aagccagagaccactgcc

SEQ ID NO: 9246491 - DNA, 22 bp, Homo sapiens
aagccactttcagctgtctcag

SEQ ID NO: 9246492 - DNA, 22 bp, Homo sapiens
aagccactttcagctgtctcag

SEQ ID NO: 9246493 - DNA, 22 bp, Homo sapiens
aagccagatcaaagtgtccagg

SEQ ID NO: 9246494 - DNA, 22 bp, Homo sapiens
aagccagatagaagaactcatt

SEQ ID NO: 9246495 - DNA, 22 bp, Homo sapiens
aagccagatagaagaactcatt

SEQ ID NO: 9246496 - DNA, 22 bp, Homo sapiens
aagcactgtacaaatgtcactt

SEQ ID NO: 9246497 - DNA, 22 bp, Homo sapiens
aagcactgtgcctcatatctga

SEQ ID NO: 9246498 - DNA, 22 bp, Homo sapiens
aagcacttagaagagtgcctgc

SEQ ID NO: 9246499 - DNA, 22 bp, Homo sapiens
aagcactgaggaaaaatttgat

SEQ ID NO: 9246500 - DNA, 22 bp, Homo sapiens
aagcactgggaggaggctgaga

SEQ ID NO: 9246501 - DNA, 22 bp, Homo sapiens
aagcactgagcacagtggctga

SEQ ID NO: 9246502 - DNA, 22 bp, Homo sapiens
aagcactaggtcacacaagtta

SEQ ID NO: 9246503 - DNA, 22 bp, Homo sapiens
aagcagaaaaactgagctccaa

SEQ ID NO: 9246504 - DNA, 22 bp, Homo sapiens
aagcagaaagaacaactgagtg

SEQ ID NO: 9246505 - DNA, 22 bp, Homo sapiens
aagcagattggggatttccatg

SEQ ID NO: 9246506 - DNA, 22 bp, Homo sapiens
aagcagcaacaaactggataaa

SEQ ID NO: 9246507 - DNA, 22 bp, Homo sapiens
aagcagatgcagctaataaagc

SEQ ID NO: 9246508 - DNA, 22 bp, Homo sapiens
aagcagatgggactccaaggca

SEQ ID NO: 9246509 - DNA, 22 bp, Homo sapiens
aagcagatgggactccaaggca

SEQ ID NO: 9246510 - DNA, 22 bp, Homo sapiens
aagcagatgcgttggagcagtt

SEQ ID NO: 9246511 - DNA, 22 bp, Homo sapiens
aagcagatgccaagatttacca

SEQ ID NO: 9246512 - DNA, 22 bp, Homo sapiens
aattcaaattacaatagttgtt

SEQ ID NO: 9246513 - DNA, 22 bp, Homo sapiens
aattcaaagactagaattttgc

SEQ ID NO: 9246514 - DNA, 22 bp, Homo sapiens
aattcaaagactagaattttgc

SEQ ID NO: 9246515 - DNA, 22 bp, Homo sapiens
aattcaaagactagaattttgc

SEQ ID NO: 9246516 - DNA, 22 bp, Homo sapiens
aattcaatctaagaaatgatca

SEQ ID NO: 9246517 - DNA, 22 bp, Homo sapiens
aattcaatctaagaaatgatca

SEQ ID NO: 9246518 - DNA, 22 bp, Homo sapiens
aattcaacagtcagttatctca

SEQ ID NO: 9246519 - DNA, 22 bp, Homo sapiens
aattcaatctaagaaatgatca

SEQ ID NO: 9246520 - DNA, 22 bp, Homo sapiens
aattagcagcatattctgcgat

SEQ ID NO: 9246521 - DNA, 22 bp, Homo sapiens
aattagagaagcttcttccatt

SEQ ID NO: 9246522 - DNA, 22 bp, Homo sapiens
aattagctaattaattgtagcc

SEQ ID NO: 9246523 - DNA, 22 bp, Homo sapiens
aattagcatttcccatataaat

SEQ ID NO: 9246524 - DNA, 22 bp, Homo sapiens
aattagaagctgttagcaaaat

SEQ ID NO: 9246525 - DNA, 22 bp, Homo sapiens
aattagaagctgttagcaaaat

SEQ ID NO: 9246526 - DNA, 22 bp, Homo sapiens
aattagaagctgttagcaaaat

SEQ ID NO: 9246527 - DNA, 22 bp, Homo sapiens
aattagaagctgttagcaaaat

SEQ ID NO: 9246528 - DNA, 22 bp, Homo sapiens
aattagaagggagttattgata

SEQ ID NO: 9246529 - DNA, 22 bp, Homo sapiens
aattagaatcttatttggggaa

SEQ ID NO: 9246530 - DNA, 22 bp, Homo sapiens
aattagaagggagttattgata

SEQ ID NO: 9246531 - DNA, 22 bp, Homo sapiens
aagacaaaggggtccttggatg

SEQ ID NO: 9246532 - DNA, 22 bp, Homo sapiens
aagaatttaaactaaccatatg

SEQ ID NO: 9246533 - DNA, 22 bp, Homo sapiens
aagaattttccagcatgtcagt

SEQ ID NO: 9246534 - DNA, 22 bp, Homo sapiens
aagacaagcatcaaatcaggca

SEQ ID NO: 9246535 - DNA, 22 bp, Homo sapiens
aagacaatcctggacagtcagc

SEQ ID NO: 9246536 - DNA, 22 bp, Homo sapiens
aagacaatattgctgtgaacgt

SEQ ID NO: 9246537 - DNA, 22 bp, Homo sapiens
aagaattggtttcctctgtcat

SEQ ID NO: 9246538 - DNA, 22 bp, Homo sapiens
aagaattattgcaatactagat

SEQ ID NO: 9246539 - DNA, 22 bp, Homo sapiens
aagaattattgcaatactagat

SEQ ID NO: 9246540 - DNA, 22 bp, Homo sapiens
aagaattcactggtagagtcaa

SEQ ID NO: 9246541 - DNA, 22 bp, Homo sapiens
acaagaaccaaagaaggatatt

SEQ ID NO: 9246542 - DNA, 22 bp, Homo sapiens
acaagaaccaaagaaggatatt

SEQ ID NO: 9246543 - DNA, 22 bp, Homo sapiens
acaagaagtcacatctaggagt

SEQ ID NO: 9246544 - DNA, 22 bp, Homo sapiens
acaagaagagcatttgcagggt

SEQ ID NO: 9246545 - DNA, 22 bp, Homo sapiens
acaagaaaggtaggattcaggt

SEQ ID NO: 9246546 - DNA, 22 bp, Homo sapiens
acaactttgtagcaattccacg

SEQ ID NO: 9246547 - DNA, 22 bp, Homo sapiens
acaagaataaggataagagatt

SEQ ID NO: 9246548 - DNA, 22 bp, Homo sapiens
acaagaataaggataagagatt

SEQ ID NO: 9246549 - DNA, 22 bp, Homo sapiens
aagacattgcatgataatgctg

SEQ ID NO: 9246550 - DNA, 22 bp, Homo sapiens
aagacattggcattgactgtaa

SEQ ID NO: 9246551 - DNA, 22 bp, Homo sapiens
aagacattggacaatccagagg

SEQ ID NO: 9246552 - DNA, 22 bp, Homo sapiens
aagacattgctgcttttaattg

SEQ ID NO: 9246553 - DNA, 22 bp, Homo sapiens
aagacattgtcattttataatt

SEQ ID NO: 9246554 - DNA, 22 bp, Homo sapiens
acaactgtcagtaaagaatatt

SEQ ID NO: 9246555 - DNA, 22 bp, Homo sapiens
acaactgtcagtaaagaatatt

SEQ ID NO: 9246556 - DNA, 22 bp, Homo sapiens
acaactgttggaggaacacagg

SEQ ID NO: 9246557 - DNA, 22 bp, Homo sapiens
aagacaatgtttctgatagata

SEQ ID NO: 9246558 - DNA, 22 bp, Homo sapiens
aagacaatctaaggggaatggt

SEQ ID NO: 9246559 - DNA, 22 bp, Homo sapiens
aatgtcttttcccttactttcc

SEQ ID NO: 9246560 - DNA, 22 bp, Homo sapiens
aatgtcttttgatacaagttac

SEQ ID NO: 9246561 - DNA, 21 bp, Homo sapiens
aatgtctttgtccatgctctg

SEQ ID NO: 9246562 - DNA, 22 bp, Homo sapiens
aatgtgttttcactgaagattc

SEQ ID NO: 9246563 - DNA, 22 bp, Homo sapiens
aatgttaaaaccttcagtgctt

SEQ ID NO: 9246564 - DNA, 22 bp, Homo sapiens
aatgttaaaaccttcagtgctt

SEQ ID NO: 9246565 - DNA, 22 bp, Homo sapiens
aatgtgaaaccgcacagaataa

SEQ ID NO: 9246566 - DNA, 22 bp, Homo sapiens
aatgttacgatcaacaacacat

SEQ ID NO: 9246567 - DNA, 22 bp, Homo sapiens
aatgttacaggacctaagatga

SEQ ID NO: 9246568 - DNA, 22 bp, Homo sapiens
aatgttacataacccattgtcc

SEQ ID NO: 9246569 - DNA, 22 bp, Homo sapiens
aatgttagattcctccacctag

SEQ ID NO: 9246570 - DNA, 22 bp, Homo sapiens
aatgttaatgtgtttgcttatg

SEQ ID NO: 9246571 - DNA, 22 bp, Homo sapiens
aatgttacacaggtataatcag

SEQ ID NO: 9246572 - DNA, 22 bp, Homo sapiens
aatgttaatttactgtcttcat

SEQ ID NO: 9246573 - DNA, 22 bp, Homo sapiens
aatgttaattcacagccaaata

SEQ ID NO: 9246574 - DNA, 22 bp, Homo sapiens
aatgttaatttactgtcttcat

SEQ ID NO: 9246575 - DNA, 22 bp, Homo sapiens
aatgttaatgtgtttgcttatg

SEQ ID NO: 9246576 - DNA, 22 bp, Homo sapiens
aatgttaatgtgtttgcttatg

SEQ ID NO: 9246577 - DNA, 22 bp, Homo sapiens
aatgttaagtttagattataac

SEQ ID NO: 9246578 - DNA, 22 bp, Homo sapiens
aatgttaagtttagattataac

SEQ ID NO: 9246579 - DNA, 22 bp, Homo sapiens
aatgttttttggtctgatgaat

SEQ ID NO: 9246580 - DNA, 22 bp, Homo sapiens
aattacttaagagaaactttga

SEQ ID NO: 9246581 - DNA, 22 bp, Homo sapiens
aattagaaccagaagccatatt

SEQ ID NO: 9246582 - DNA, 22 bp, Homo sapiens
aatgttttgtatgcctctgagc

SEQ ID NO: 9246583 - DNA, 22 bp, Homo sapiens
aactttctccagtgccaactat

SEQ ID NO: 9246584 - DNA, 22 bp, Homo sapiens
aactttcaggcaatgaatattt

SEQ ID NO: 9246585 - DNA, 22 bp, Homo sapiens
aactttattgttaggggctaaa

SEQ ID NO: 9246586 - DNA, 22 bp, Homo sapiens
aactttatcggaacaggtactc

SEQ ID NO: 9246587 - DNA, 22 bp, Homo sapiens
aactttattgttaggggctaaa

SEQ ID NO: 9246588 - DNA, 22 bp, Homo sapiens
aactttattgttaggggctaaa

SEQ ID NO: 9246589 - DNA, 22 bp, Homo sapiens
aatgtcaaaataattgatttgt

SEQ ID NO: 9246590 - DNA, 22 bp, Homo sapiens
aatgtattttgggagtttcttt

SEQ ID NO: 9246591 - DNA, 22 bp, Homo sapiens
aatgtatttgatgtattagcct

SEQ ID NO: 9246592 - DNA, 20 bp, Homo sapiens
aatgtcttgagacatttcag

SEQ ID NO: 9246593 - DNA, 22 bp, Homo sapiens
aatgtctttaaagtgcaataga

SEQ ID NO: 9246594 - DNA, 22 bp, Homo sapiens
aatgtacaataagacaaagagg

SEQ ID NO: 9246595 - DNA, 22 bp, Homo sapiens
aatgtattctgggaaaatgtta

SEQ ID NO: 9246596 - DNA, 22 bp, Homo sapiens
aatgtattctgggaaaatgtta

SEQ ID NO: 9246597 - DNA, 22 bp, Homo sapiens
aatgtattctgggaaaatgtta

SEQ ID NO: 9246598 - DNA, 22 bp, Homo sapiens
aactcttaaaattttggcttgc

SEQ ID NO: 9246599 - DNA, 22 bp, Homo sapiens
aactctttgtggacattaaatt

SEQ ID NO: 9246600 - DNA, 22 bp, Homo sapiens
aactctttggtctcaggaaagg

SEQ ID NO: 9246601 - DNA, 20 bp, Homo sapiens
aactcctagcctcaagtgat

SEQ ID NO: 9246602 - DNA, 20 bp, Homo sapiens
aactcctagcctcaagtgat

SEQ ID NO: 9246603 - DNA, 22 bp, Homo sapiens
aactcctatgacccactgaact

SEQ ID NO: 9246604 - DNA, 22 bp, Homo sapiens
aactctatttaccctactaaac

SEQ ID NO: 9246605 - DNA, 22 bp, Homo sapiens
aactctatttaccctactaaac

SEQ ID NO: 9246606 - DNA, 22 bp, Homo sapiens
acagatctacattgtctgaccc

SEQ ID NO: 9246607 - DNA, 22 bp, Homo sapiens
acagatgaaacccagctagttg

SEQ ID NO: 9246608 - DNA, 22 bp, Homo sapiens
aagcacatttggaaaacatgga

SEQ ID NO: 9246609 - DNA, 22 bp, Homo sapiens
acagagtcattcactgatgaag

SEQ ID NO: 9246610 - DNA, 20 bp, Homo sapiens
aagcacatttctacaataat

SEQ ID NO: 9246611 - DNA, 20 bp, Homo sapiens
aagcacatttctacaataat

SEQ ID NO: 9246612 - DNA, 22 bp, Homo sapiens
aagcacattgtacatttgtgct

SEQ ID NO: 9246613 - DNA, 22 bp, Homo sapiens
aagcacatttggaaaacatgga

SEQ ID NO: 9246614 - DNA, 22 bp, Homo sapiens
aagcacattgtacatttgtgct

SEQ ID NO: 9246615 - DNA, 22 bp, Homo sapiens
aagcacattgtacatttgtgct

SEQ ID NO: 9246616 - DNA, 22 bp, Homo sapiens
aagcacattgcctggcacatag

SEQ ID NO: 9246617 - DNA, 22 bp, Homo sapiens
aagcacattgcctggcacatag

SEQ ID NO: 9246618 - DNA, 22 bp, Homo sapiens
aagcacattaaggaacattgaa

SEQ ID NO: 9246619 - DNA, 22 bp, Homo sapiens
aagcacattaaggaacattgaa

SEQ ID NO: 9246620 - DNA, 22 bp, Homo sapiens
aagcacatgaaaatgtgaagct

SEQ ID NO: 9246621 - DNA, 22 bp, Homo sapiens
aagcacatgagctattcatgct

SEQ ID NO: 9246622 - DNA, 22 bp, Homo sapiens
aagcacatgagctattcatgct

SEQ ID NO: 9246623 - DNA, 22 bp, Homo sapiens
aagcacatctcaaacttcatct

SEQ ID NO: 9246624 - DNA, 22 bp, Homo sapiens
aagcacatctcaaacttcatct

SEQ ID NO: 9246625 - DNA, 22 bp, Homo sapiens
aagcacatctcctgtgcagaac

SEQ ID NO: 9246626 - DNA, 22 bp, Homo sapiens
aagcacatctcctgtgcagaac

SEQ ID NO: 9246627 - DNA, 22 bp, Homo sapiens
aagcacatcatgttgttcagac

SEQ ID NO: 9246628 - DNA, 22 bp, Homo sapiens
acagaggaaggctgagctgccc

SEQ ID NO: 9246629 - DNA, 18 bp, Homo sapiens
acagaggcagacatgtat

SEQ ID NO: 9246630 - DNA, 22 bp, Homo sapiens
aagcacatacataataaagtcc

SEQ ID NO: 9246631 - DNA, 22 bp, Homo sapiens
aagcacatacataataaagtcc

SEQ ID NO: 9246632 - DNA, 22 bp, Homo sapiens
acagaggaagcatatagcacaa

SEQ ID NO: 9246633 - DNA, 22 bp, Homo sapiens
acagagcttcccagcctgagca

SEQ ID NO: 9246634 - DNA, 22 bp, Homo sapiens
acagagcttaattcaggagctt

SEQ ID NO: 9246635 - DNA, 22 bp, Homo sapiens
acagagcttaggatgactccca

SEQ ID NO: 9246636 - DNA, 22 bp, Homo sapiens
acagagctgtacatgtgccatg

SEQ ID NO: 9246637 - DNA, 22 bp, Homo sapiens
acagagcacatagattggagtt

SEQ ID NO: 9246638 - DNA, 22 bp, Homo sapiens
acagagcacatagattggagtt

SEQ ID NO: 9246639 - DNA, 22 bp, Homo sapiens
aagcaaagacagtttgagtgga

SEQ ID NO: 9246640 - DNA, 22 bp, Homo sapiens
aagatttttttccacagactca

SEQ ID NO: 9246641 - DNA, 22 bp, Homo sapiens
aagcaaaaggttacacttctgg

SEQ ID NO: 9246642 - DNA, 22 bp, Homo sapiens
aagcaaaacgtgctctaggagg

SEQ ID NO: 9246643 - DNA, 22 bp, Homo sapiens
aagattttcagctaatggtgca

SEQ ID NO: 9246644 - DNA, 22 bp, Homo sapiens
aagattttcagtgcctaaaaca

SEQ ID NO: 9246645 - DNA, 22 bp, Homo sapiens
aagattttcagctaatggtgca

SEQ ID NO: 9246646 - DNA, 22 bp, Homo sapiens
aagattttctcaactgtatttg

SEQ ID NO: 9246647 - DNA, 22 bp, Homo sapiens
acagaagagcacatttagtatg

SEQ ID NO: 9246648 - DNA, 22 bp, Homo sapiens
acagaagataactgggaccaga

SEQ ID NO: 9246649 - DNA, 22 bp, Homo sapiens
acagaagcaaaagcaggatctt

SEQ ID NO: 9246650 - DNA, 22 bp, Homo sapiens
acagaagcagccgtcacagata

SEQ ID NO: 9246651 - DNA, 22 bp, Homo sapiens
aagatacttcacttgccgaaat

SEQ ID NO: 9246652 - DNA, 22 bp, Homo sapiens
aagatacttcacttgccgaaat

SEQ ID NO: 9246653 - DNA, 22 bp, Homo sapiens
aagatactgatgatgtaggcta

SEQ ID NO: 9246654 - DNA, 20 bp, Homo sapiens
aagatactccagaaattaaa

SEQ ID NO: 9246655 - DNA, 22 bp, Homo sapiens
aagatacatcattcaggagtga

SEQ ID NO: 9246656 - DNA, 22 bp, Homo sapiens
aagatacattttcttcagagaa

SEQ ID NO: 9246657 - DNA, 22 bp, Homo sapiens
aagagtggagctggaaagtggg

SEQ ID NO: 9246658 - DNA, 20 bp, Homo sapiens
aagagtctttactgagctaa

SEQ ID NO: 9246659 - DNA, 22 bp, Homo sapiens
aagagtttaccagtgctgcttc

SEQ ID NO: 9246660 - DNA, 22 bp, Homo sapiens
aagagttagctcaataacttga

SEQ ID NO: 9246661 - DNA, 22 bp, Homo sapiens
aagagttaagcaacagatacca

SEQ ID NO: 9246662 - DNA, 22 bp, Homo sapiens
aagagttaaatgaatgagtggg

SEQ ID NO: 9246663 - DNA, 22 bp, Homo sapiens
aagagttagctcaataacttga

SEQ ID NO: 9246664 - DNA, 22 bp, Homo sapiens
aagagttatagttggtatgtgg

SEQ ID NO: 9246665 - DNA, 22 bp, Homo sapiens
aagagttatataatgtgtagtt

SEQ ID NO: 9246666 - DNA, 22 bp, Homo sapiens
aagaggttgtctgtgatgagtt

SEQ ID NO: 9246667 - DNA, 22 bp, Homo sapiens
aagaggttgtctgtgatgagtt

SEQ ID NO: 9246668 - DNA, 22 bp, Homo sapiens
aagaggtttaactgactcacag

SEQ ID NO: 9246669 - DNA, 22 bp, Homo sapiens
aagaggtttcatgattttctta

SEQ ID NO: 9246670 - DNA, 22 bp, Homo sapiens
aagaggtttcatgattttctta

SEQ ID NO: 9246671 - DNA, 22 bp, Homo sapiens
aagagtaaatgtctaattagga

SEQ ID NO: 9246672 - DNA, 22 bp, Homo sapiens
aagagtctattggaactagaca

SEQ ID NO: 9246673 - DNA, 22 bp, Homo sapiens
aagagtatagctttaggattga

SEQ ID NO: 9246674 - DNA, 22 bp, Homo sapiens
aagagtatagctttaggattga

SEQ ID NO: 9246675 - DNA, 22 bp, Homo sapiens
aagagtatttggtatagaacac

SEQ ID NO: 9246676 - DNA, 22 bp, Homo sapiens
acacctttgtgaagtgatgatg

SEQ ID NO: 9246677 - DNA, 22 bp, Homo sapiens
acacctttgccccaagtcatag

SEQ ID NO: 9246678 - DNA, 22 bp, Homo sapiens
acacccaggctggcgtgcagtg

SEQ ID NO: 9246679 - DNA, 22 bp, Homo sapiens
acacccaggctggcgtgcagtg

SEQ ID NO: 9246680 - DNA, 22 bp, Homo sapiens
aagagtttatgatataacatgt

SEQ ID NO: 9246681 - DNA, 22 bp, Homo sapiens
acacggcactttaggaaggggc

SEQ ID NO: 9246682 - DNA, 22 bp, Homo sapiens
acacggcactttaggaaggggc

SEQ ID NO: 9246683 - DNA, 22 bp, Homo sapiens
acactaaggttggagtcacagt

SEQ ID NO: 9246684 - DNA, 22 bp, Homo sapiens
acactaatcttttatttggttt

SEQ ID NO: 9246685 - DNA, 22 bp, Homo sapiens
acactagagagcaggcattccc

SEQ ID NO: 9246686 - DNA, 22 bp, Homo sapiens
acacacagagtttatacaggca

SEQ ID NO: 9246687 - DNA, 20 bp, Homo sapiens
acacacagagacatgcgcat

SEQ ID NO: 9246688 - DNA, 20 bp, Homo sapiens
acacacagagacatgcgcat

SEQ ID NO: 9246689 - DNA, 22 bp, Homo sapiens
acacacagcgcctaccatgtgc

SEQ ID NO: 9246690 - DNA, 22 bp, Homo sapiens
acacacagcgcctaccatgtgc

SEQ ID NO: 9246691 - DNA, 22 bp, Homo sapiens
acacacaggtaaaggagcctgg

SEQ ID NO: 9246692 - DNA, 22 bp, Homo sapiens
acacacagcgcctaccatgtgc

SEQ ID NO: 9246693 - DNA, 22 bp, Homo sapiens
aagaggtagcagtcacaaaaga

SEQ ID NO: 9246694 - DNA, 22 bp, Homo sapiens
aagaggctttcagtgaacttgt

SEQ ID NO: 9246695 - DNA, 22 bp, Homo sapiens
acacacaggtaaaggagcctgg

SEQ ID NO: 9246696 - DNA, 22 bp, Homo sapiens
acacacatgcatgcttgccatt

SEQ ID NO: 9246697 - DNA, 22 bp, Homo sapiens
aagaggtggaacagcaattcgt

SEQ ID NO: 9246698 - DNA, 22 bp, Homo sapiens
aagaggttattgttcccagctt

SEQ ID NO: 9246699 - DNA, 22 bp, Homo sapiens
aagaggttctaatttaactatc

SEQ ID NO: 9246700 - DNA, 20 bp, Homo sapiens
aagaggtgataacaggtgag

SEQ ID NO: 9246701 - DNA, 22 bp, Homo sapiens
aagaggagtagatgtggttggt

SEQ ID NO: 9246702 - DNA, 22 bp, Homo sapiens
aagaggagtagatgtggttggt

SEQ ID NO: 9246703 - DNA, 22 bp, Homo sapiens
aagaggagtagatgtggttggt

SEQ ID NO: 9246704 - DNA, 22 bp, Homo sapiens
aagaggagggcagattcaaggc

SEQ ID NO: 9246705 - DNA, 22 bp, Homo sapiens
aagacatttatgaaaagtgctg

SEQ ID NO: 9246706 - DNA, 22 bp, Homo sapiens
aagacattttagagatagggaa

SEQ ID NO: 9246707 - DNA, 22 bp, Homo sapiens
aagaccagggtgggtacgttcc

SEQ ID NO: 9246708 - DNA, 22 bp, Homo sapiens
aagaggaggattgatgtgggag

SEQ ID NO: 9246709 - DNA, 23 bp, Homo sapiens
aagaggaggccctgctcccgtcc

SEQ ID NO: 9246710 - DNA, 21 bp, Homo sapiens
aagaggaagcattatggcata

SEQ ID NO: 9246711 - DNA, 22 bp, Homo sapiens
aagaggaggattgatgtgggag

SEQ ID NO: 9246712 - DNA, 22 bp, Homo sapiens
aagttctttcatatcttaatta

SEQ ID NO: 9246713 - DNA, 22 bp, Homo sapiens
aagttcttagacaagcttgtgg

SEQ ID NO: 9246714 - DNA, 22 bp, Homo sapiens
aagttgaatcagtaacacagtt

SEQ ID NO: 9246715 - DNA, 22 bp, Homo sapiens
aagttgagatgtcataggagac

SEQ ID NO: 9246716 - DNA, 22 bp, Homo sapiens
aagttgatagcatgttaagctc

SEQ ID NO: 9246717 - DNA, 22 bp, Homo sapiens
aacactggtttggcattagatg

SEQ ID NO: 9246718 - DNA, 22 bp, Homo sapiens
aacactggtttggcattagatg

SEQ ID NO: 9246719 - DNA, 22 bp, Homo sapiens
aacactggttctgactacacag

SEQ ID NO: 9246720 - DNA, 22 bp, Homo sapiens
aacactgggataggtgatagac

SEQ ID NO: 9246721 - DNA, 17 bp, Homo sapiens
aacactgggtgagcctc

SEQ ID NO: 9246722 - DNA, 22 bp, Homo sapiens
aacactgtaacagcatcatttt

SEQ ID NO: 9246723 - DNA, 22 bp, Homo sapiens
aacactgtaacagcatcatttt

SEQ ID NO: 9246724 - DNA, 22 bp, Homo sapiens
aacactgtaacagcatcatttt

SEQ ID NO: 9246725 - DNA, 19 bp, Homo sapiens
aagttctcagagttcaaag

SEQ ID NO: 9246726 - DNA, 22 bp, Homo sapiens
aagttctatagtctttctacta

SEQ ID NO: 9246727 - DNA, 20 bp, Homo sapiens
aagttacattgtattgtacc

SEQ ID NO: 9246728 - DNA, 22 bp, Homo sapiens
aacactgtactggaagatggac

SEQ ID NO: 9246729 - DNA, 22 bp, Homo sapiens
aacactgagtatcagagttggg

SEQ ID NO: 9246730 - DNA, 22 bp, Homo sapiens
aacactgctgctgggttctgtg

SEQ ID NO: 9246731 - DNA, 22 bp, Homo sapiens
aacactggacaggaggctaggt

SEQ ID NO: 9246732 - DNA, 22 bp, Homo sapiens
aacactggaagggacatcaagt

SEQ ID NO: 9246733 - DNA, 22 bp, Homo sapiens
aacactgagggaaaagagatag

SEQ ID NO: 9246734 - DNA, 22 bp, Homo sapiens
aagtatttcagcggttctttgt

SEQ ID NO: 9246735 - DNA, 22 bp, Homo sapiens
aagtatttcagcggttctttgt

SEQ ID NO: 9246736 - DNA, 22 bp, Homo sapiens
aataaacaaatctttcctgtgg

SEQ ID NO: 9246737 - DNA, 22 bp, Homo sapiens
aataaacaaatctttcctgtgg

SEQ ID NO: 9246738 - DNA, 22 bp, Homo sapiens
aataaacaaatccttccttccc

SEQ ID NO: 9246739 - DNA, 22 bp, Homo sapiens
aataaacaaatccttccttccc

SEQ ID NO: 9246740 - DNA, 22 bp, Homo sapiens
aataaacaaaggacaaggaggt

SEQ ID NO: 9246741 - DNA, 20 bp, Homo sapiens
aataaactactgagagatgt

SEQ ID NO: 9246742 - DNA, 20 bp, Homo sapiens
aataaactactgagagatgt

SEQ ID NO: 9246743 - DNA, 22 bp, Homo sapiens
aataaactgctcaattgcatca

SEQ ID NO: 9246744 - DNA, 18 bp, Homo sapiens
aacagtttccagattctc

SEQ ID NO: 9246745 - DNA, 18 bp, Homo sapiens
aacagtttccagattctc

SEQ ID NO: 9246746 - DNA, 22 bp, Homo sapiens
aacagtttcctgactcctatga

SEQ ID NO: 9246747 - DNA, 22 bp, Homo sapiens
aacagtttcctgactcctatga

SEQ ID NO: 9246748 - DNA, 22 bp, Homo sapiens
aacagtttatgtaaatgtccag

SEQ ID NO: 9246749 - DNA, 22 bp, Homo sapiens
aacagtttgctttaagaggcac

SEQ ID NO: 9246750 - DNA, 22 bp, Homo sapiens
aacagtttgcctgaaatgtatt

SEQ ID NO: 9246751 - DNA, 22 bp, Homo sapiens
aacagtttgagctttgaatttc

SEQ ID NO: 9246752 - DNA, 22 bp, Homo sapiens
aacagtttctatgttagtggtt

SEQ ID NO: 9246753 - DNA, 22 bp, Homo sapiens
aataaaatggtcagttttctca

SEQ ID NO: 9246754 - DNA, 22 bp, Homo sapiens
aataaaatggtcagttttctca

SEQ ID NO: 9246755 - DNA, 22 bp, Homo sapiens
aataaaatggtcagttttctca

SEQ ID NO: 9246756 - DNA, 22 bp, Homo sapiens
aataaaatggtcagttttctca

SEQ ID NO: 9246757 - DNA, 22 bp, Homo sapiens
aagtttgacagaagtttctaat

SEQ ID NO: 9246758 - DNA, 20 bp, Homo sapiens
aagtttgccccaggaaattg

SEQ ID NO: 9246759 - DNA, 20 bp, Homo sapiens
aagttgcagagagttgtctt

SEQ ID NO: 9246760 - DNA, 22 bp, Homo sapiens
aagtttctgggcaagacaaggc

SEQ ID NO: 9246761 - DNA, 22 bp, Homo sapiens
aagtttctggaccttacctgct

SEQ ID NO: 9246762 - DNA, 22 bp, Homo sapiens
aagtttgacagaagtttctaat

SEQ ID NO: 9246763 - DNA, 22 bp, Homo sapiens
aagtttctgttcgctttaataa

SEQ ID NO: 9246764 - DNA, 20 bp, Homo sapiens
aagtttctggtttatatctt

SEQ ID NO: 9246765 - DNA, 22 bp, Homo sapiens
aagtttctgttcatatctctga

SEQ ID NO: 9246766 - DNA, 22 bp, Homo sapiens
aacattaagatggcggaacagt

SEQ ID NO: 9246767 - DNA, 22 bp, Homo sapiens
aacattcttcaaatatcactct

SEQ ID NO: 9246768 - DNA, 22 bp, Homo sapiens
aacattcttcaaatatcactct

SEQ ID NO: 9246769 - DNA, 22 bp, Homo sapiens
aacattctttagctcttcctgc

SEQ ID NO: 9246770 - DNA, 22 bp, Homo sapiens
aacagtttgtggatagcttgta

SEQ ID NO: 9246771 - DNA, 22 bp, Homo sapiens
aacagtttgggtaggtatgtag

SEQ ID NO: 9246772 - DNA, 22 bp, Homo sapiens
aacatgttgctttaataatatt

SEQ ID NO: 9246773 - DNA, 22 bp, Homo sapiens
aacattgaacttggcacaccca

SEQ ID NO: 9246774 - DNA, 20 bp, Homo sapiens
aacattgaaagtctagaaga

SEQ ID NO: 9246775 - DNA, 20 bp, Homo sapiens
aacattgaaagtctagaaga

SEQ ID NO: 9246776 - DNA, 22 bp, Homo sapiens
aacattctttagctcttcctgc

SEQ ID NO: 9246777 - DNA, 22 bp, Homo sapiens
aacattgagttctacttccatt

SEQ ID NO: 9246778 - DNA, 22 bp, Homo sapiens
aacattgattgcatctgttcac

SEQ ID NO: 9246779 - DNA, 22 bp, Homo sapiens
aacattgccatggttaatttta

SEQ ID NO: 9246780 - DNA, 21 bp, Homo sapiens
aacattgattcatttggctat

SEQ ID NO: 9246781 - DNA, 22 bp, Homo sapiens
aacatttacaaatccttctgca

SEQ ID NO: 9246782 - DNA, 22 bp, Homo sapiens
aacatttattctaattctggga

SEQ ID NO: 9246783 - DNA, 22 bp, Homo sapiens
aacatttatggtagtcattgca

SEQ ID NO: 9246784 - DNA, 22 bp, Homo sapiens
aacatttatatgggttcatgaa

SEQ ID NO: 9246785 - DNA, 22 bp, Homo sapiens
aacatttattgagcacctactg

SEQ ID NO: 9246786 - DNA, 22 bp, Homo sapiens
aatcacatgcagggcctccacc

SEQ ID NO: 9246787 - DNA, 22 bp, Homo sapiens
aatatttgttagtgttttaatg

SEQ ID NO: 9246788 - DNA, 22 bp, Homo sapiens
aatatttgaacagtcactgagt

SEQ ID NO: 9246789 - DNA, 22 bp, Homo sapiens
aatcacatgtgggtcttgtagc

SEQ ID NO: 9246790 - DNA, 22 bp, Homo sapiens
aatcacattaagccctgttcag

SEQ ID NO: 9246791 - DNA, 22 bp, Homo sapiens
aatcacattagtgaaacactga

SEQ ID NO: 9246792 - DNA, 22 bp, Homo sapiens
aatcacattgaatctgctacct

SEQ ID NO: 9246793 - DNA, 22 bp, Homo sapiens
aatcacattagtgaaacactga

SEQ ID NO: 9246794 - DNA, 23 bp, Homo sapiens
aatcacttccctccaaatggatt

SEQ ID NO: 9246795 - DNA, 22 bp, Homo sapiens
aatcacatttacattgctaatt

SEQ ID NO: 9246796 - DNA, 22 bp, Homo sapiens
aatcacatttgcccccatattc

SEQ ID NO: 9246797 - DNA, 22 bp, Homo sapiens
aatcagaaaattcagtggaatt

SEQ ID NO: 9246798 - DNA, 22 bp, Homo sapiens
aaccagctaacatgtggaatga

SEQ ID NO: 9246799 - DNA, 22 bp, Homo sapiens
aaccagctccagcctccattca

SEQ ID NO: 9246800 - DNA, 22 bp, Homo sapiens
aaccagctaaactttgctcgaa

SEQ ID NO: 9246801 - DNA, 20 bp, Homo sapiens
aatcactttgtacaggaagc

SEQ ID NO: 9246802 - DNA, 22 bp, Homo sapiens
aatcactttgcactcttatttg

SEQ ID NO: 9246803 - DNA, 22 bp, Homo sapiens
aatcacttttctctaatgtagc

SEQ ID NO: 9246804 - DNA, 22 bp, Homo sapiens
aatcagaaaattcagtggaatt

SEQ ID NO: 9246805 - DNA, 22 bp, Homo sapiens
aaccagctgagaatgcttctgc

SEQ ID NO: 9246806 - DNA, 17 bp, Homo sapiens
aaccagctgtcccctcc

SEQ ID NO: 9246807 - DNA, 22 bp, Homo sapiens
aaccagctttgatacgcattat

SEQ ID NO: 9246808 - DNA, 22 bp, Homo sapiens
aaccagctttgatacgcattat

SEQ ID NO: 9246809 - DNA, 22 bp, Homo sapiens
aaccagctgagaatgcttctgc

SEQ ID NO: 9246810 - DNA, 22 bp, Homo sapiens
aaccagctccagcctccattca

SEQ ID NO: 9246811 - DNA, 22 bp, Homo sapiens
aaccagctcctcaccccattgt

SEQ ID NO: 9246812 - DNA, 22 bp, Homo sapiens
aaccagctctgcaaaatgtcat

SEQ ID NO: 9246813 - DNA, 22 bp, Homo sapiens
aactccaggcagggaggccact

SEQ ID NO: 9246814 - DNA, 22 bp, Homo sapiens
aactccatggttctcagattct

SEQ ID NO: 9246815 - DNA, 20 bp, Homo sapiens
aactcctagcctcaagtgat

SEQ ID NO: 9246816 - DNA, 20 bp, Homo sapiens
aactcctagcctcaagtgat

SEQ ID NO: 9246817 - DNA, 22 bp, Homo sapiens
aactcagttacatattagaata

SEQ ID NO: 9246818 - DNA, 22 bp, Homo sapiens
aactcagttacatattagaata

SEQ ID NO: 9246819 - DNA, 22 bp, Homo sapiens
aaccagtgaaacaccaggcaag

SEQ ID NO: 9246820 - DNA, 22 bp, Homo sapiens
aaccagtactttacacagctct

SEQ ID NO: 9246821 - DNA, 22 bp, Homo sapiens
aagctttgggcagaagaggatt

SEQ ID NO: 9246822 - DNA, 22 bp, Homo sapiens
aagctttgtccaaggccatgca

SEQ ID NO: 9246823 - DNA, 22 bp, Homo sapiens
aagctttgttcttcacagagtg

SEQ ID NO: 9246824 - DNA, 21 bp, Homo sapiens
aaggaaaagcttggtctctga

SEQ ID NO: 9246825 - DNA, 22 bp, Homo sapiens
aagctttggaagggcagggttg

SEQ ID NO: 9246826 - DNA, 22 bp, Homo sapiens
aagctttggagaggcgggcagg

SEQ ID NO: 9246827 - DNA, 22 bp, Homo sapiens
aagctttgcaatgcttcattat

SEQ ID NO: 9246828 - DNA, 22 bp, Homo sapiens
aagctttgataattggattact

SEQ ID NO: 9246829 - DNA, 22 bp, Homo sapiens
aagctttgcaccggtggctgga

SEQ ID NO: 9246830 - DNA, 22 bp, Homo sapiens
aagctttgactactgcctcttg

SEQ ID NO: 9246831 - DNA, 22 bp, Homo sapiens
aagctgggacttagcgcagata

SEQ ID NO: 9246832 - DNA, 22 bp, Homo sapiens
aagctgggacttagcgcagata

SEQ ID NO: 9246833 - DNA, 22 bp, Homo sapiens
aagctgggagggagcccagagt

SEQ ID NO: 9246834 - DNA, 20 bp, Homo sapiens
aagctgggtaggagaggagc

SEQ ID NO: 9246835 - DNA, 22 bp, Homo sapiens
aagctggggactcagaccccat

SEQ ID NO: 9246836 - DNA, 20 bp, Homo sapiens
aagctgggtaggagaggagc

SEQ ID NO: 9246837 - DNA, 22 bp, Homo sapiens
aagctgtcaatgtatctagtct

SEQ ID NO: 9246838 - DNA, 18 bp, Homo sapiens
aagctgggaaggagacag

SEQ ID NO: 9246839 - DNA, 18 bp, Homo sapiens
aagctgggaaggagacag

SEQ ID NO: 9246840 - DNA, 18 bp, Homo sapiens
aagctgggaaggagacag

SEQ ID NO: 9246841 - DNA, 22 bp, Homo sapiens
aagctggcaattatcaaaactg

SEQ ID NO: 9246842 - DNA, 22 bp, Homo sapiens
aagccatttgttgtccttcagg

SEQ ID NO: 9246843 - DNA, 22 bp, Homo sapiens
aagccagtgtttttgagagttg

SEQ ID NO: 9246844 - DNA, 22 bp, Homo sapiens
aagccagtaagtttttgtcatt

SEQ ID NO: 9246845 - DNA, 22 bp, Homo sapiens
aagccagccagtgccagtctta

SEQ ID NO: 9246846 - DNA, 22 bp, Homo sapiens
aagccagatttcactcttaatt

SEQ ID NO: 9246847 - DNA, 22 bp, Homo sapiens
aagccagcattttcccattcct

SEQ ID NO: 9246848 - DNA, 22 bp, Homo sapiens
aagccagtcctctactgggcac

SEQ ID NO: 9246849 - DNA, 22 bp, Homo sapiens
aagccagtgtccagaatgggca

SEQ ID NO: 9246850 - DNA, 21 bp, Homo sapiens
aaggacgaggttttgattaca

SEQ ID NO: 9246851 - DNA, 22 bp, Homo sapiens
aaggacctgattttgagcatct

SEQ ID NO: 9246852 - DNA, 22 bp, Homo sapiens
aaggacctatattgtcagagga

SEQ ID NO: 9246853 - DNA, 22 bp, Homo sapiens
aaggagaaatggtagatgtgca

SEQ ID NO: 9246854 - DNA, 22 bp, Homo sapiens
aaggagaaatggtagatgtgca

SEQ ID NO: 9246855 - DNA, 22 bp, Homo sapiens
aaggagaaatggtagatgtgca

SEQ ID NO: 9246856 - DNA, 22 bp, Homo sapiens
aaggagaaatggtagatgtgca

SEQ ID NO: 9246857 - DNA, 22 bp, Homo sapiens
aaattgcattgagctgcttatt

SEQ ID NO: 9246858 - DNA, 22 bp, Homo sapiens
aaatttaaaaagcagcattgca

SEQ ID NO: 9246859 - DNA, 22 bp, Homo sapiens
aaatttaagaagtgtgtgcgtg

SEQ ID NO: 9246860 - DNA, 22 bp, Homo sapiens
aaatttaaggaggtgctcactt

SEQ ID NO: 9246861 - DNA, 22 bp, Homo sapiens
aaattgtggcgtctgtaagagt

SEQ ID NO: 9246862 - DNA, 22 bp, Homo sapiens
aaattgcattgagctgcttatt

SEQ ID NO: 9246863 - DNA, 22 bp, Homo sapiens
aaattgttgatctacagtaagg

SEQ ID NO: 9246864 - DNA, 22 bp, Homo sapiens
aaattagtgcaccaggttgaag

SEQ ID NO: 9246865 - DNA, 22 bp, Homo sapiens
aaattataggtgccaccttgga

SEQ ID NO: 9246866 - DNA, 22 bp, Homo sapiens
aaattagtacattgcaaagtcc

SEQ ID NO: 9246867 - DNA, 22 bp, Homo sapiens
aaattaactatcacttttgtga

SEQ ID NO: 9246868 - DNA, 22 bp, Homo sapiens
aaattattacaagctagttggc

SEQ ID NO: 9246869 - DNA, 22 bp, Homo sapiens
aaattattaaacagtgggatgc

SEQ ID NO: 9246870 - DNA, 21 bp, Homo sapiens
aagggagataggaatcaggcc

SEQ ID NO: 9246871 - DNA, 22 bp, Homo sapiens
aagggagaggagggtcttgttg

SEQ ID NO: 9246872 - DNA, 21 bp, Homo sapiens
aagggagataggaatcaggcc

SEQ ID NO: 9246873 - DNA, 22 bp, Homo sapiens
aagggaggaggatttattgtac

SEQ ID NO: 9246874 - DNA, 22 bp, Homo sapiens
aagggctggagactgggtcttc

SEQ ID NO: 9246875 - DNA, 22 bp, Homo sapiens
aagggctggagactgggtcttc

SEQ ID NO: 9246876 - DNA, 22 bp, Homo sapiens
aaggggaagtagcaccagaggt

SEQ ID NO: 9246877 - DNA, 22 bp, Homo sapiens
aaggggaatagagtgggttgtg

SEQ ID NO: 9246878 - DNA, 22 bp, Homo sapiens
aaggggagttagtgataaaacc

SEQ ID NO: 9246879 - DNA, 22 bp, Homo sapiens
aaggggagatgtcatgggccct

SEQ ID NO: 9246880 - DNA, 22 bp, Homo sapiens
aaggggaagtagcaccagaggt

SEQ ID NO: 9246881 - DNA, 22 bp, Homo sapiens
aaggggaagtagcaccagaggt

SEQ ID NO: 9246882 - DNA, 22 bp, Homo sapiens
aaggggaatagagtgggttgtg

SEQ ID NO: 9246883 - DNA, 22 bp, Homo sapiens
aaggggcctcacagatgggctt

SEQ ID NO: 9246884 - DNA, 22 bp, Homo sapiens
aaggggctcttgtcaggcgcag

SEQ ID NO: 9246885 - DNA, 22 bp, Homo sapiens
aaggggctcttgtcaggcgcag

SEQ ID NO: 9246886 - DNA, 22 bp, Homo sapiens
aacaataattgcggttctctat

SEQ ID NO: 9246887 - DNA, 22 bp, Homo sapiens
aacaataggagtgatgcagtat

SEQ ID NO: 9246888 - DNA, 17 bp, Homo sapiens
aacaataggatgtgtat

SEQ ID NO: 9246889 - DNA, 22 bp, Homo sapiens
aacaataggctatatgctaggc

SEQ ID NO: 9246890 - DNA, 22 bp, Homo sapiens
aacaatcaagtttctaaatgac

SEQ ID NO: 9246891 - DNA, 22 bp, Homo sapiens
aacaatgaccacacaatgtact

SEQ ID NO: 9246892 - DNA, 22 bp, Homo sapiens
aacaatctgttcgatagaaaat

SEQ ID NO: 9246893 - DNA, 22 bp, Homo sapiens
aacaatgaggatctgttctgag

SEQ ID NO: 9246894 - DNA, 22 bp, Homo sapiens
aacaatcaagtttctaaatgac

SEQ ID NO: 9246895 - DNA, 22 bp, Homo sapiens
aagtacagaaatagcaggtgca

SEQ ID NO: 9246896 - DNA, 22 bp, Homo sapiens
aagtatgacatttaagacaatt

SEQ ID NO: 9246897 - DNA, 22 bp, Homo sapiens
aagtatgtgatacatgttaatt

SEQ ID NO: 9246898 - DNA, 22 bp, Homo sapiens
aacaatgcactatcgtaagtgg

SEQ ID NO: 9246899 - DNA, 22 bp, Homo sapiens
aacaatgcagttaatgggaaga

SEQ ID NO: 9246900 - DNA, 22 bp, Homo sapiens
aacaatgccaacagcatgctgg

SEQ ID NO: 9246901 - DNA, 22 bp, Homo sapiens
aacaatgatatagggattggca

SEQ ID NO: 9246902 - DNA, 22 bp, Homo sapiens
aacaatgctgaactgaggaaag

SEQ ID NO: 9246903 - DNA, 22 bp, Homo sapiens
aacaatgcctgatgacctcctg

SEQ ID NO: 9246904 - DNA, 22 bp, Homo sapiens
aacaatgccacattaagtgtat

SEQ ID NO: 9246905 - DNA, 16 bp, Homo sapiens
aacaatgccaatccag

SEQ ID NO: 9246906 - DNA, 22 bp, Homo sapiens
aacaaggcacaagctggctgtt

SEQ ID NO: 9246907 - DNA, 22 bp, Homo sapiens
aacaagatgttttgatatatgt

SEQ ID NO: 9246908 - DNA, 22 bp, Homo sapiens
aacaagatgggagaaggacctc

SEQ ID NO: 9246909 - DNA, 22 bp, Homo sapiens
aacaagatagatatcacttagg

SEQ ID NO: 9246910 - DNA, 22 bp, Homo sapiens
aacaagatagatatcacttagg

SEQ ID NO: 9246911 - DNA, 22 bp, Homo sapiens
aacaagatagagctcttgcctt

SEQ ID NO: 9246912 - DNA, 22 bp, Homo sapiens
aacaagtctttggttttggcta

SEQ ID NO: 9246913 - DNA, 22 bp, Homo sapiens
aacaagtgtattaatggaaata

SEQ ID NO: 9246914 - DNA, 22 bp, Homo sapiens
aacaataactagacatgccatg

SEQ ID NO: 9246915 - DNA, 22 bp, Homo sapiens
aacaataactagacatgccatg

SEQ ID NO: 9246916 - DNA, 22 bp, Homo sapiens
aagggagacagttgtgtgagga

SEQ ID NO: 9246917 - DNA, 22 bp, Homo sapiens
aagggagacagttgtgtgagga

SEQ ID NO: 9246918 - DNA, 22 bp, Homo sapiens
aagggagacccaccgtcctgga

SEQ ID NO: 9246919 - DNA, 22 bp, Homo sapiens
aacaataattgcggttctctat

SEQ ID NO: 9246920 - DNA, 22 bp, Homo sapiens
aacaataactagacatgccatg

SEQ ID NO: 9246921 - DNA, 22 bp, Homo sapiens
aagggagacagttgtgtgagga

SEQ ID NO: 9246922 - DNA, 22 bp, Homo sapiens
aagggagacagttgtgtgagga

SEQ ID NO: 9246923 - DNA, 22 bp, Homo sapiens
aaatttctaagcagccacttcc

SEQ ID NO: 9246924 - DNA, 22 bp, Homo sapiens
aaggccaaagacacctacacag

SEQ ID NO: 9246925 - DNA, 22 bp, Homo sapiens
aaggccaaagttttcaggctaa

SEQ ID NO: 9246926 - DNA, 22 bp, Homo sapiens
aaggccaactaggatgagctag

SEQ ID NO: 9246927 - DNA, 22 bp, Homo sapiens
aaggcattggactagtatcaga

SEQ ID NO: 9246928 - DNA, 20 bp, Homo sapiens
aaatttaggaaattttacgc

SEQ ID NO: 9246929 - DNA, 22 bp, Homo sapiens
aaatttcaagcaaagtagctat

SEQ ID NO: 9246930 - DNA, 22 bp, Homo sapiens
aaatttcaagcaaagtagctat

SEQ ID NO: 9246931 - DNA, 22 bp, Homo sapiens
aaatttcagttacctttacgtt

SEQ ID NO: 9246932 - DNA, 22 bp, Homo sapiens
aaatttcagttggaatgagctc

SEQ ID NO: 9246933 - DNA, 22 bp, Homo sapiens
aaggccacgtctccttccagag

SEQ ID NO: 9246934 - DNA, 22 bp, Homo sapiens
aaggccactgaagaaatcacaa

SEQ ID NO: 9246935 - DNA, 22 bp, Homo sapiens
aaggccaccaccagcgaggggg

SEQ ID NO: 9246936 - DNA, 22 bp, Homo sapiens
aaggccacagagcctcagagag

SEQ ID NO: 9246937 - DNA, 22 bp, Homo sapiens
aaggccacacttgctggccagc

SEQ ID NO: 9246938 - DNA, 22 bp, Homo sapiens
aaggccacacttgctggccagc

SEQ ID NO: 9246939 - DNA, 22 bp, Homo sapiens
aaggccacacttgctggccagc

SEQ ID NO: 9246940 - DNA, 22 bp, Homo sapiens
aaggccactttaccttaaatcc

SEQ ID NO: 9246941 - DNA, 22 bp, Homo sapiens
aaggccactgaagaaatcacaa

SEQ ID NO: 9246942 - DNA, 22 bp, Homo sapiens
aacaaatgtgttttgtaattaa

SEQ ID NO: 9246943 - DNA, 22 bp, Homo sapiens
aacaaatgtgtggcagtgtggg

SEQ ID NO: 9246944 - DNA, 22 bp, Homo sapiens
aaggccagacaggaccacatct

SEQ ID NO: 9246945 - DNA, 22 bp, Homo sapiens
agctcctgtggcagctcttctg

SEQ ID NO: 9246946 - DNA, 22 bp, Homo sapiens
agctctgtgaagccagcagttc

SEQ ID NO: 9246947 - DNA, 20 bp, Homo sapiens
agctcttaagaagaagatga

SEQ ID NO: 9246948 - DNA, 22 bp, Homo sapiens
agctcttcctgcacctgtggct

SEQ ID NO: 9246949 - DNA, 20 bp, Homo sapiens
agctcttaagaagaagatga

SEQ ID NO: 9246950 - DNA, 22 bp, Homo sapiens
agctcttatctctaagcacagc

SEQ ID NO: 9246951 - DNA, 18 bp, Homo sapiens
agctcctggtctcaggga

SEQ ID NO: 9246952 - DNA, 22 bp, Homo sapiens
agctcctgtagtacatattatt

SEQ ID NO: 9246953 - DNA, 19 bp, Homo sapiens
agctcctgggctctgggcc

SEQ ID NO: 9246954 - DNA, 19 bp, Homo sapiens
agctcctgggctctgggcc

SEQ ID NO: 9246955 - DNA, 22 bp, Homo sapiens
agctcctgggccaagcccatgc

SEQ ID NO: 9246956 - DNA, 22 bp, Homo sapiens
agctcctgggcacctctttcac

SEQ ID NO: 9246957 - DNA, 22 bp, Homo sapiens
agctcctggcaaggtcatggtg

SEQ ID NO: 9246958 - DNA, 22 bp, Homo sapiens
agctcctggcaaggtcatggtg

SEQ ID NO: 9246959 - DNA, 22 bp, Homo sapiens
agctaggaaattgaggctgaga

SEQ ID NO: 9246960 - DNA, 22 bp, Homo sapiens
agctaggacaggtagagatggg

SEQ ID NO: 9246961 - DNA, 20 bp, Homo sapiens
agctaggagaaagcatggag

SEQ ID NO: 9246962 - DNA, 20 bp, Homo sapiens
agctaggagaaagcatggag

SEQ ID NO: 9246963 - DNA, 19 bp, Homo sapiens
agctcaggcccatcgtccc

SEQ ID NO: 9246964 - DNA, 22 bp, Homo sapiens
agctccagaaaggtacacacag

SEQ ID NO: 9246965 - DNA, 23 bp, Homo sapiens
agctccagaacatagcacaggaa

SEQ ID NO: 9246966 - DNA, 23 bp, Homo sapiens
agctccagaacatagcacaggaa

SEQ ID NO: 9246967 - DNA, 22 bp, Homo sapiens
agctccagaagcctgcaaggta

SEQ ID NO: 9246968 - DNA, 22 bp, Homo sapiens
agctccagagtctgaactattc

SEQ ID NO: 9246969 - DNA, 22 bp, Homo sapiens
agctccagagccacatccatca

SEQ ID NO: 9246970 - DNA, 22 bp, Homo sapiens
agctccagaggcagtgatgaag

SEQ ID NO: 9246971 - DNA, 22 bp, Homo sapiens
agctccagccgctgatgggttt

SEQ ID NO: 9246972 - DNA, 22 bp, Homo sapiens
agctccagcctcttctggaggt

SEQ ID NO: 9246973 - DNA, 22 bp, Homo sapiens
agctccagattaattgtaggag

SEQ ID NO: 9246974 - DNA, 22 bp, Homo sapiens
agctccaggataagacaggtgc

SEQ ID NO: 9246975 - DNA, 22 bp, Homo sapiens
agctccaggataagacaggtgc

SEQ ID NO: 9246976 - DNA, 19 bp, Homo sapiens
agctccaggcctggatgct

SEQ ID NO: 9246977 - DNA, 19 bp, Homo sapiens
agctccaggcctggatgct

SEQ ID NO: 9246978 - DNA, 22 bp, Homo sapiens
agctccaggcagcattaataaa

SEQ ID NO: 9246979 - DNA, 22 bp, Homo sapiens
agctccaggatctgaaagttcg

SEQ ID NO: 9246980 - DNA, 22 bp, Homo sapiens
agctccagcggatggtcttata

SEQ ID NO: 9246981 - DNA, 23 bp, Homo sapiens
agctccagctgacgtgggcagcc

SEQ ID NO: 9246982 - DNA, 23 bp, Homo sapiens
agctccagctgacgtgggcagcc

SEQ ID NO: 9246983 - DNA, 23 bp, Homo sapiens
agctccagctgacgtgggcagcc

SEQ ID NO: 9246984 - DNA, 22 bp, Homo sapiens
agctccagcctcttctggaggt

SEQ ID NO: 9246985 - DNA, 22 bp, Homo sapiens
agctccagcctcttctggaggt

SEQ ID NO: 9246986 - DNA, 22 bp, Homo sapiens
agctccagcggatggtcttata

SEQ ID NO: 9246987 - DNA, 23 bp, Homo sapiens
agctccagctgacgtgggcagcc

SEQ ID NO: 9246988 - DNA, 22 bp, Homo sapiens
agctcctgattctcagagatag

SEQ ID NO: 9246989 - DNA, 22 bp, Homo sapiens
agctccagggaaagagtggatc

SEQ ID NO: 9246990 - DNA, 19 bp, Homo sapiens
agctcctgattgtgcctcg

SEQ ID NO: 9246991 - DNA, 21 bp, Homo sapiens
agctccaggctcctggggttc

SEQ ID NO: 9246992 - DNA, 21 bp, Homo sapiens
agctccaggctcctggggttc

SEQ ID NO: 9246993 - DNA, 22 bp, Homo sapiens
agctcctggaggtgcgcactcg

SEQ ID NO: 9246994 - DNA, 22 bp, Homo sapiens
agctcctgcttgacagaagagg

SEQ ID NO: 9246995 - DNA, 22 bp, Homo sapiens
agctcctgcttgacagaagagg

SEQ ID NO: 9246996 - DNA, 22 bp, Homo sapiens
cagcaactcctatattgaaagc

SEQ ID NO: 9246997 - DNA, 20 bp, Homo sapiens
cagcaactttggactgagtt

SEQ ID NO: 9246998 - DNA, 22 bp, Homo sapiens
cagcaacttaggcagaacatct

SEQ ID NO: 9246999 - DNA, 22 bp, Homo sapiens
cagcaacatatatgaaactgtg

SEQ ID NO: 9247000 - DNA, 22 bp, Homo sapiens
cagcaacatgtggtagtgtagg

SEQ ID NO: 9247001 - DNA, 22 bp, Homo sapiens
cagcaacatatatgaaactgtg

SEQ ID NO: 9247002 - DNA, 21 bp, Homo sapiens
cagcaaatcattgggcagact

SEQ ID NO: 9247003 - DNA, 20 bp, Homo sapiens
cagatgggacgtggaggagt

SEQ ID NO: 9247004 - DNA, 22 bp, Homo sapiens
cagatggggcaaggccatctgt

SEQ ID NO: 9247005 - DNA, 20 bp, Homo sapiens
cagatgggacgtggaggagt

SEQ ID NO: 9247006 - DNA, 22 bp, Homo sapiens
cagatgtacatgaagggcaatg

SEQ ID NO: 9247007 - DNA, 22 bp, Homo sapiens
cagatggggcaaggccatctgt

SEQ ID NO: 9247008 - DNA, 22 bp, Homo sapiens
agcctgggcaacagagcaaaac

SEQ ID NO: 9247009 - DNA, 22 bp, Homo sapiens
agcctgggaatttagagttcgg

SEQ ID NO: 9247010 - DNA, 22 bp, Homo sapiens
agcctgggagacactaagttgt

SEQ ID NO: 9247011 - DNA, 21 bp, Homo sapiens
agcctgggaggcggaggttgc

SEQ ID NO: 9247012 - DNA, 22 bp, Homo sapiens
cagcaagaaaattcacatgctc

SEQ ID NO: 9247013 - DNA, 19 bp, Homo sapiens
agcctggctttgctctgct

SEQ ID NO: 9247014 - DNA, 17 bp, Homo sapiens
agcctgggaaggagtga

SEQ ID NO: 9247015 - DNA, 20 bp, Homo sapiens
agcctggggaattccacccc

SEQ ID NO: 9247016 - DNA, 22 bp, Homo sapiens
agcctgggcatgggacgggagg

SEQ ID NO: 9247017 - DNA, 22 bp, Homo sapiens
agcctgggcctggcttcccgcc

SEQ ID NO: 9247018 - DNA, 18 bp, Homo sapiens
agcctgggctctgcctgg

SEQ ID NO: 9247019 - DNA, 21 bp, Homo sapiens
agcctgggtatcctttgagga

SEQ ID NO: 9247020 - DNA, 22 bp, Homo sapiens
agcctggtgatatcagtggttt

SEQ ID NO: 9247021 - DNA, 22 bp, Homo sapiens
agcctggtgtggggctgcagag

SEQ ID NO: 9247022 - DNA, 22 bp, Homo sapiens
agctaagacttagtgacttagt

SEQ ID NO: 9247023 - DNA, 23 bp, Homo sapiens
agctaacagatcgacaaagtata

SEQ ID NO: 9247024 - DNA, 20 bp, Homo sapiens
agcggcagcttcctgcttcg

SEQ ID NO: 9247025 - DNA, 22 bp, Homo sapiens
agctacagtggacaagtgaact

SEQ ID NO: 9247026 - DNA, 22 bp, Homo sapiens
agctacatgaaattgctgatat

SEQ ID NO: 9247027 - DNA, 22 bp, Homo sapiens
agctagaatgttccttttcatt

SEQ ID NO: 9247028 - DNA, 22 bp, Homo sapiens
agctactggagaacacaaaacc

SEQ ID NO: 9247029 - DNA, 19 bp, Homo sapiens
agctaagacaagggacatc

SEQ ID NO: 9247030 - DNA, 22 bp, Homo sapiens
agctaaggaactctgtaacacc

SEQ ID NO: 9247031 - DNA, 22 bp, Homo sapiens
agctaaggacagttgatttaga

SEQ ID NO: 9247032 - DNA, 22 bp, Homo sapiens
agctaaggatgactagtacttc

SEQ ID NO: 9247033 - DNA, 19 bp, Homo sapiens
agctaatggaagtttactg

SEQ ID NO: 9247034 - DNA, 22 bp, Homo sapiens
agctaattagaaatagattatt

SEQ ID NO: 9247035 - DNA, 22 bp, Homo sapiens
agctacaacttttccatgagca

SEQ ID NO: 9247036 - DNA, 22 bp, Homo sapiens
agctacacccctttacagtcct

SEQ ID NO: 9247037 - DNA, 22 bp, Homo sapiens
agcccagtgggccgaggcgggg

SEQ ID NO: 9247038 - DNA, 22 bp, Homo sapiens
agcccaggttgaggctgcagtg

SEQ ID NO: 9247039 - DNA, 22 bp, Homo sapiens
agcccaggttgaggctgcagtg

SEQ ID NO: 9247040 - DNA, 22 bp, Homo sapiens
agcccaggttgaggctgcagtg

SEQ ID NO: 9247041 - DNA, 22 bp, Homo sapiens
agcccaggttgaggctgcagtg

SEQ ID NO: 9247042 - DNA, 22 bp, Homo sapiens
agcccatggtgtactctgtggc

SEQ ID NO: 9247043 - DNA, 22 bp, Homo sapiens
agcccatggtgtactctgtggc

SEQ ID NO: 9247044 - DNA, 22 bp, Homo sapiens
agccccacactctctctgagaa

SEQ ID NO: 9247045 - DNA, 20 bp, Homo sapiens
agccccacccttgtcctggc

SEQ ID NO: 9247046 - DNA, 22 bp, Homo sapiens
agccccacactctctctgagaa

SEQ ID NO: 9247047 - DNA, 22 bp, Homo sapiens
agccccagcccctctctcacaa

SEQ ID NO: 9247048 - DNA, 22 bp, Homo sapiens
agccccaggcccggacgcctct

SEQ ID NO: 9247049 - DNA, 22 bp, Homo sapiens
agccccaggatgggccgcagga

SEQ ID NO: 9247050 - DNA, 22 bp, Homo sapiens
agccccagtaagggagggcctg

SEQ ID NO: 9247051 - DNA, 22 bp, Homo sapiens
agccccagtccgctgcgggcgg

SEQ ID NO: 9247052 - DNA, 22 bp, Homo sapiens
agccagtttaagcaggaggggt

SEQ ID NO: 9247053 - DNA, 22 bp, Homo sapiens
agccagtttccagatattaact

SEQ ID NO: 9247054 - DNA, 23 bp, Homo sapiens
agccagttgtagccacagaactc

SEQ ID NO: 9247055 - DNA, 22 bp, Homo sapiens
agccagttggctatgaggagga

SEQ ID NO: 9247056 - DNA, 22 bp, Homo sapiens
agcccaggttgaggctgcagtg

SEQ ID NO: 9247057 - DNA, 22 bp, Homo sapiens
agcccaggttgaggctgcagtg

SEQ ID NO: 9247058 - DNA, 22 bp, Homo sapiens
agccagtgttaagtgactggtt

SEQ ID NO: 9247059 - DNA, 22 bp, Homo sapiens
agccagtgggattagagcctct

SEQ ID NO: 9247060 - DNA, 18 bp, Homo sapiens
cagagctcctggatgcag

SEQ ID NO: 9247061 - DNA, 22 bp, Homo sapiens
agcccccaaaagtgcttatgat

SEQ ID NO: 9247062 - DNA, 22 bp, Homo sapiens
agcccccaaaagtgcttatgat

SEQ ID NO: 9247063 - DNA, 22 bp, Homo sapiens
agcccccaaaagtgcttatgat

SEQ ID NO: 9247064 - DNA, 17 bp, Homo sapiens
agcccccactcccaagt

SEQ ID NO: 9247065 - DNA, 22 bp, Homo sapiens
agcccccacgtttcctgggtcc

SEQ ID NO: 9247066 - DNA, 22 bp, Homo sapiens
agccctgggaggccagcttgta

SEQ ID NO: 9247067 - DNA, 22 bp, Homo sapiens
agccctgggcacctgtgagggg

SEQ ID NO: 9247068 - DNA, 22 bp, Homo sapiens
agccctggctcccagcagcgct

SEQ ID NO: 9247069 - DNA, 22 bp, Homo sapiens
agccctggcccggctgtgcttt

SEQ ID NO: 9247070 - DNA, 22 bp, Homo sapiens
agccctggcccggctgtgcttt

SEQ ID NO: 9247071 - DNA, 22 bp, Homo sapiens
agccctgggctgtagataagca

SEQ ID NO: 9247072 - DNA, 22 bp, Homo sapiens
cagatgaagatcatagaatagt

SEQ ID NO: 9247073 - DNA, 22 bp, Homo sapiens
cagatggctgccttcttgctgt

SEQ ID NO: 9247074 - DNA, 22 bp, Homo sapiens
cagatggctgccaagatgggct

SEQ ID NO: 9247075 - DNA, 22 bp, Homo sapiens
agccagccgggggaccacagtg

SEQ ID NO: 9247076 - DNA, 22 bp, Homo sapiens
agccagctaccggggctcctgg

SEQ ID NO: 9247077 - DNA, 22 bp, Homo sapiens
agccagctaagggaagcatgat

SEQ ID NO: 9247078 - DNA, 22 bp, Homo sapiens
agccagctaagggaagcatgat

SEQ ID NO: 9247079 - DNA, 22 bp, Homo sapiens
agccagcatgaagacagaggcc

SEQ ID NO: 9247080 - DNA, 22 bp, Homo sapiens
agccagcaggtgagtgcagcct

SEQ ID NO: 9247081 - DNA, 22 bp, Homo sapiens
agccagcaggtgagtgcagcct

SEQ ID NO: 9247082 - DNA, 22 bp, Homo sapiens
agccagcaggtgcagaattcca

SEQ ID NO: 9247083 - DNA, 22 bp, Homo sapiens
agccagcaggtgcagaattcca

SEQ ID NO: 9247084 - DNA, 22 bp, Homo sapiens
agccagcagggcttagaggaca

SEQ ID NO: 9247085 - DNA, 22 bp, Homo sapiens
agccagcaggtgagtgcagcct

SEQ ID NO: 9247086 - DNA, 22 bp, Homo sapiens
agccagcagggcttagaggaca

SEQ ID NO: 9247087 - DNA, 23 bp, Homo sapiens
agccagatttctttgcagggcag

SEQ ID NO: 9247088 - DNA, 22 bp, Homo sapiens
agccagcacggcgccatggagt

SEQ ID NO: 9247089 - DNA, 22 bp, Homo sapiens
agccagcacggcgccatggagt

SEQ ID NO: 9247090 - DNA, 22 bp, Homo sapiens
agccagagagtgttggagatgt

SEQ ID NO: 9247091 - DNA, 22 bp, Homo sapiens
agccagagagtgttggagatgt

SEQ ID NO: 9247092 - DNA, 22 bp, Homo sapiens
agccagagagtgttggagatgt

SEQ ID NO: 9247093 - DNA, 19 bp, Homo sapiens
agccagagtggcccagggg

SEQ ID NO: 9247094 - DNA, 19 bp, Homo sapiens
agccagagtggcccagggg

SEQ ID NO: 9247095 - DNA, 22 bp, Homo sapiens
cactttctgtgtatcttccatt

SEQ ID NO: 9247096 - DNA, 22 bp, Homo sapiens
cactttctcatgaatttggccc

SEQ ID NO: 9247097 - DNA, 22 bp, Homo sapiens
cactttattataaatttgagag

SEQ ID NO: 9247098 - DNA, 19 bp, Homo sapiens
cactttatttctgttttgt

SEQ ID NO: 9247099 - DNA, 22 bp, Homo sapiens
cactttatatgcattacctcat

SEQ ID NO: 9247100 - DNA, 22 bp, Homo sapiens
cactttataaaattggtgtgag

SEQ ID NO: 9247101 - DNA, 22 bp, Homo sapiens
cactttatgggaagcaaaaatt

SEQ ID NO: 9247102 - DNA, 22 bp, Homo sapiens
cactttatattctaagacggcc

SEQ ID NO: 9247103 - DNA, 19 bp, Homo sapiens
cagagccttcagtgactcc

SEQ ID NO: 9247104 - DNA, 22 bp, Homo sapiens
cagagccttcctagcagactct

SEQ ID NO: 9247105 - DNA, 22 bp, Homo sapiens
cagagccttcctagcagactct

SEQ ID NO: 9247106 - DNA, 22 bp, Homo sapiens
cagagctcagagctgccaggca

SEQ ID NO: 9247107 - DNA, 22 bp, Homo sapiens
cagagcccagggcctacgtccc

SEQ ID NO: 9247108 - DNA, 22 bp, Homo sapiens
cagagcctggcgatgtcatgga

SEQ ID NO: 9247109 - DNA, 21 bp, Homo sapiens
cagagcctgtgttgacagttg

SEQ ID NO: 9247110 - DNA, 22 bp, Homo sapiens
agccaggccttttctcaaggtt

SEQ ID NO: 9247111 - DNA, 22 bp, Homo sapiens
agccaggccagctgtcttgagt

SEQ ID NO: 9247112 - DNA, 20 bp, Homo sapiens
agccaggcctcaagttaagt

SEQ ID NO: 9247113 - DNA, 22 bp, Homo sapiens
agccaggccagctgtcttgagt

SEQ ID NO: 9247114 - DNA, 22 bp, Homo sapiens
agccaggccttagggagaggca

SEQ ID NO: 9247115 - DNA, 22 bp, Homo sapiens
cagagacattaagtgccatgat

SEQ ID NO: 9247116 - DNA, 22 bp, Homo sapiens
agccaggccagactcacaccct

SEQ ID NO: 9247117 - DNA, 22 bp, Homo sapiens
agccaggccagactcacaccct

SEQ ID NO: 9247118 - DNA, 17 bp, Homo sapiens
agccaggcatatgaagt

SEQ ID NO: 9247119 - DNA, 22 bp, Homo sapiens
agccaggcagggctctcgctct

SEQ ID NO: 9247120 - DNA, 22 bp, Homo sapiens
agcactgggaacgcatggggcc

SEQ ID NO: 9247121 - DNA, 22 bp, Homo sapiens
agcactagctttaagcattctg

SEQ ID NO: 9247122 - DNA, 22 bp, Homo sapiens
agcactagcctgttttgctgtg

SEQ ID NO: 9247123 - DNA, 22 bp, Homo sapiens
agcactagcctgttttgctgtg

SEQ ID NO: 9247124 - DNA, 20 bp, Homo sapiens
agcactaggtgtggcaggtg

SEQ ID NO: 9247125 - DNA, 22 bp, Homo sapiens
agcactgattttgttgcactta

SEQ ID NO: 9247126 - DNA, 22 bp, Homo sapiens
agcactgatttaaactggattt

SEQ ID NO: 9247127 - DNA, 22 bp, Homo sapiens
agcactagagccaaaatttggg

SEQ ID NO: 9247128 - DNA, 17 bp, Homo sapiens
agcactaaaatgcttcc

SEQ ID NO: 9247129 - DNA, 22 bp, Homo sapiens
agcactagacatgtaagtgagc

SEQ ID NO: 9247130 - DNA, 21 bp, Homo sapiens
agcaccttcaattctattgtc

SEQ ID NO: 9247131 - DNA, 22 bp, Homo sapiens
agcaccttgctcttggccttcc

SEQ ID NO: 9247132 - DNA, 22 bp, Homo sapiens
agcacctgttgcacttcataat

SEQ ID NO: 9247133 - DNA, 22 bp, Homo sapiens
caaaggcagttactgaatgaag

SEQ ID NO: 9247134 - DNA, 20 bp, Homo sapiens
agcaccagtgggggcagccc

SEQ ID NO: 9247135 - DNA, 18 bp, Homo sapiens
agcaccagtcactaacag

SEQ ID NO: 9247136 - DNA, 21 bp, Homo sapiens
agcagaggcagaatgtatgca

SEQ ID NO: 9247137 - DNA, 21 bp, Homo sapiens
agcagaggcagaatgtatgca

SEQ ID NO: 9247138 - DNA, 21 bp, Homo sapiens
agcagaggctgcctggtgact

SEQ ID NO: 9247139 - DNA, 21 bp, Homo sapiens
agcagaggcagaatgtatgca

SEQ ID NO: 9247140 - DNA, 22 bp, Homo sapiens
agcagagctgggatcctgggtc

SEQ ID NO: 9247141 - DNA, 22 bp, Homo sapiens
agcagaggacagttcttaggaa

SEQ ID NO: 9247142 - DNA, 22 bp, Homo sapiens
agcagaggaggatttagttagg

SEQ ID NO: 9247143 - DNA, 22 bp, Homo sapiens
agcagagcggggcctccggaag

SEQ ID NO: 9247144 - DNA, 22 bp, Homo sapiens
agcagagcggggcctccggaag

SEQ ID NO: 9247145 - DNA, 22 bp, Homo sapiens
agcagagctattcttgtgcaat

SEQ ID NO: 9247146 - DNA, 22 bp, Homo sapiens
agcagagctgcagtggcctgct

SEQ ID NO: 9247147 - DNA, 22 bp, Homo sapiens
agcagagaccatatagcccaga

SEQ ID NO: 9247148 - DNA, 22 bp, Homo sapiens
agcactgtgatttataacattt

SEQ ID NO: 9247149 - DNA, 22 bp, Homo sapiens
agcagagacctggttttgttga

SEQ ID NO: 9247150 - DNA, 20 bp, Homo sapiens
agcagagtgcccatcccgga

SEQ ID NO: 9247151 - DNA, 22 bp, Homo sapiens
agcagagtcttcaagggcaggc

SEQ ID NO: 9247152 - DNA, 20 bp, Homo sapiens
agcagagtgcccatcccgga

SEQ ID NO: 9247153 - DNA, 22 bp, Homo sapiens
agcagaggtttgttggaaacct

SEQ ID NO: 9247154 - DNA, 22 bp, Homo sapiens
agcagagtctgtgtgcacttta

SEQ ID NO: 9247155 - DNA, 22 bp, Homo sapiens
agcagaggtgtttattatggga

SEQ ID NO: 9247156 - DNA, 21 bp, Homo sapiens
agcagaggggacatgtttgat

SEQ ID NO: 9247157 - DNA, 21 bp, Homo sapiens
agcagaggggacatgtttgat

SEQ ID NO: 9247158 - DNA, 22 bp, Homo sapiens
caataatatcctgtgctgtttg

SEQ ID NO: 9247159 - DNA, 20 bp, Homo sapiens
agcagagtgcccatcccgga

SEQ ID NO: 9247160 - DNA, 19 bp, Homo sapiens
caagtgaagcctgggatgg

SEQ ID NO: 9247161 - DNA, 22 bp, Homo sapiens
caataatttacattggatacca

SEQ ID NO: 9247162 - DNA, 22 bp, Homo sapiens
cacagagattagaattagacta

SEQ ID NO: 9247163 - DNA, 22 bp, Homo sapiens
cacagagatggtctggcaggtg

SEQ ID NO: 9247164 - DNA, 17 bp, Homo sapiens
agcagctggcacaggag

SEQ ID NO: 9247165 - DNA, 21 bp, Homo sapiens
agcagctgggcaacatggagg

SEQ ID NO: 9247166 - DNA, 19 bp, Homo sapiens
agcagctggaggtggagtg

SEQ ID NO: 9247167 - DNA, 19 bp, Homo sapiens
agcagctggaggtggagtg

SEQ ID NO: 9247168 - DNA, 22 bp, Homo sapiens
agcagcctttgatcatctggga

SEQ ID NO: 9247169 - DNA, 22 bp, Homo sapiens
agcagcctttgatcatctggga

SEQ ID NO: 9247170 - DNA, 22 bp, Homo sapiens
agcagctatttcttccagagag

SEQ ID NO: 9247171 - DNA, 22 bp, Homo sapiens
agcagctcaaagcctgcaagga

SEQ ID NO: 9247172 - DNA, 22 bp, Homo sapiens
agcagctcaacagtgtctctat

SEQ ID NO: 9247173 - DNA, 22 bp, Homo sapiens
agcagctcatggagtaggcact

SEQ ID NO: 9247174 - DNA, 22 bp, Homo sapiens
cacagagatggccagggcacat

SEQ ID NO: 9247175 - DNA, 22 bp, Homo sapiens
cacagagatggccagggcacat

SEQ ID NO: 9247176 - DNA, 22 bp, Homo sapiens
cacagagatcggaacagaagta

SEQ ID NO: 9247177 - DNA, 21 bp, Homo sapiens
cacagagatattggtgagcct

SEQ ID NO: 9247178 - DNA, 21 bp, Homo sapiens
cacagagatattggtgagcct

SEQ ID NO: 9247179 - DNA, 22 bp, Homo sapiens
cacagagaggcttgtctccaag

SEQ ID NO: 9247180 - DNA, 22 bp, Homo sapiens
agcagccctagggattgctgtt

SEQ ID NO: 9247181 - DNA, 22 bp, Homo sapiens
agcagcccagttgtactgagtg

SEQ ID NO: 9247182 - DNA, 21 bp, Homo sapiens
agcagcagatctggtgagggc

SEQ ID NO: 9247183 - DNA, 22 bp, Homo sapiens
agcagccagagaatgatgcagt

SEQ ID NO: 9247184 - DNA, 22 bp, Homo sapiens
agcagcctggacttggatgtgg

SEQ ID NO: 9247185 - DNA, 22 bp, Homo sapiens
agcagcctggacttggatgtgg

SEQ ID NO: 9247186 - DNA, 22 bp, Homo sapiens
agcagcctctgtagaggtctcc

SEQ ID NO: 9247187 - DNA, 22 bp, Homo sapiens
agcagcctggtctctcgccaat

SEQ ID NO: 9247188 - DNA, 22 bp, Homo sapiens
agcagccttgcaggggtcgcac

SEQ ID NO: 9247189 - DNA, 22 bp, Homo sapiens
agcagccttgtgactccggggt

SEQ ID NO: 9247190 - DNA, 22 bp, Homo sapiens
agcagcctattcttctcttgga

SEQ ID NO: 9247191 - DNA, 22 bp, Homo sapiens
agcagcagatcaaacaggcttg

SEQ ID NO: 9247192 - DNA, 22 bp, Homo sapiens
agcagcagatccaaaaaatgtg

SEQ ID NO: 9247193 - DNA, 16 bp, Homo sapiens
caatacatggcatttc

SEQ ID NO: 9247194 - DNA, 22 bp, Homo sapiens
caatacaattaccagttaatca

SEQ ID NO: 9247195 - DNA, 22 bp, Homo sapiens
agcagtaagacttttttctgtg

SEQ ID NO: 9247196 - DNA, 22 bp, Homo sapiens
agcagtaagcaactgagcttgc

SEQ ID NO: 9247197 - DNA, 22 bp, Homo sapiens
agcaggttaccattgatttcct

SEQ ID NO: 9247198 - DNA, 22 bp, Homo sapiens
agcagggctggggcacgagcca

SEQ ID NO: 9247199 - DNA, 22 bp, Homo sapiens
agcaggtgtcggcgagggtctt

SEQ ID NO: 9247200 - DNA, 22 bp, Homo sapiens
agcaggtgttggctgggccatc

SEQ ID NO: 9247201 - DNA, 18 bp, Homo sapiens
agcaggtgtgcagaatgt

SEQ ID NO: 9247202 - DNA, 22 bp, Homo sapiens
agcagtggacctcagtgctatt

SEQ ID NO: 9247203 - DNA, 22 bp, Homo sapiens
agcagtggacctcagtgctatt

SEQ ID NO: 9247204 - DNA, 22 bp, Homo sapiens
agcagtgatgcatgacagccta

SEQ ID NO: 9247205 - DNA, 22 bp, Homo sapiens
agcagtgagtgggaggaccatg

SEQ ID NO: 9247206 - DNA, 22 bp, Homo sapiens
agcagtgagtaacacagaccag

SEQ ID NO: 9247207 - DNA, 22 bp, Homo sapiens
agcagtggcatacattttgagt

SEQ ID NO: 9247208 - DNA, 22 bp, Homo sapiens
agcagtggagcgagatgtttaa

SEQ ID NO: 9247209 - DNA, 22 bp, Homo sapiens
agcatataggaaatgttgaatc

SEQ ID NO: 9247210 - DNA, 22 bp, Homo sapiens
agcagtggcctggggctctgtg

SEQ ID NO: 9247211 - DNA, 22 bp, Homo sapiens
agcatgaaagcataggacagtc

SEQ ID NO: 9247212 - DNA, 22 bp, Homo sapiens
agcatcaacaatgaacataaat

SEQ ID NO: 9247213 - DNA, 22 bp, Homo sapiens
agcatgaaagcataggacagtc

SEQ ID NO: 9247214 - DNA, 22 bp, Homo sapiens
agcatgaaaggcgtgccaactt

SEQ ID NO: 9247215 - DNA, 22 bp, Homo sapiens
agcatgaagacttcagagctag

SEQ ID NO: 9247216 - DNA, 22 bp, Homo sapiens
agcatgaagacttcagagctag

SEQ ID NO: 9247217 - DNA, 19 bp, Homo sapiens
cactgtggtccttcactgc

SEQ ID NO: 9247218 - DNA, 22 bp, Homo sapiens
cactgtgtcagtttggttagac

SEQ ID NO: 9247219 - DNA, 22 bp, Homo sapiens
cactgtgtaagaagatgggctt

SEQ ID NO: 9247220 - DNA, 22 bp, Homo sapiens
agcattaataagaaatggctcc

SEQ ID NO: 9247221 - DNA, 22 bp, Homo sapiens
cactggtgacttctgagctgga

SEQ ID NO: 9247222 - DNA, 18 bp, Homo sapiens
agcattaggaggttatca

SEQ ID NO: 9247223 - DNA, 23 bp, Homo sapiens
agcattagagatgccagccctgt

SEQ ID NO: 9247224 - DNA, 22 bp, Homo sapiens
cactgttttattccaacatagg

SEQ ID NO: 9247225 - DNA, 22 bp, Homo sapiens
cactgtttttatgtaatcagtg

SEQ ID NO: 9247226 - DNA, 22 bp, Homo sapiens
cactttactatctataaaataa

SEQ ID NO: 9247227 - DNA, 22 bp, Homo sapiens
cactttactatctataaaataa

SEQ ID NO: 9247228 - DNA, 22 bp, Homo sapiens
cactttacccttgttactcatg

SEQ ID NO: 9247229 - DNA, 22 bp, Homo sapiens
cacttaaagtcttagcttacag

SEQ ID NO: 9247230 - DNA, 22 bp, Homo sapiens
cacttaaaactcctggaattgt

SEQ ID NO: 9247231 - DNA, 22 bp, Homo sapiens
cacttaaagtcttagcttacag

SEQ ID NO: 9247232 - DNA, 22 bp, Homo sapiens
cactgttcatcaaaactgctct

SEQ ID NO: 9247233 - DNA, 22 bp, Homo sapiens
cactgttgaagatacttcctct

SEQ ID NO: 9247234 - DNA, 22 bp, Homo sapiens
cactgttattactactatacat

SEQ ID NO: 9247235 - DNA, 22 bp, Homo sapiens
agcatgttgggatgagaaggaa

SEQ ID NO: 9247236 - DNA, 22 bp, Homo sapiens
agcattaagagagactgaactg

SEQ ID NO: 9247237 - DNA, 22 bp, Homo sapiens
agcattaagcctggctcagagg

SEQ ID NO: 9247238 - DNA, 22 bp, Homo sapiens
agcatgtgtggagaaatatttt

SEQ ID NO: 9247239 - DNA, 22 bp, Homo sapiens
agcatggggctccgcaatgaac

SEQ ID NO: 9247240 - DNA, 22 bp, Homo sapiens
agcatgtaaagctcttagcacc

SEQ ID NO: 9247241 - DNA, 22 bp, Homo sapiens
agcatggggctccgcaatgaac

SEQ ID NO: 9247242 - DNA, 22 bp, Homo sapiens
agcatggggcaatgcatgtgct

SEQ ID NO: 9247243 - DNA, 22 bp, Homo sapiens
agcatgctgggtcatttttgcc

SEQ ID NO: 9247244 - DNA, 22 bp, Homo sapiens
agcatgctggtgttcatggcag

SEQ ID NO: 9247245 - DNA, 22 bp, Homo sapiens
agcatgctggttacgtgtagca

SEQ ID NO: 9247246 - DNA, 22 bp, Homo sapiens
agcatgcttggcatttgtcaga

SEQ ID NO: 9247247 - DNA, 23 bp, Homo sapiens
agcatggaataggaaagaggcag

SEQ ID NO: 9247248 - DNA, 19 bp, Homo sapiens
agcatggaagctggtgcca

SEQ ID NO: 9247249 - DNA, 22 bp, Homo sapiens
caccagagttgtccaaatgatt

SEQ ID NO: 9247250 - DNA, 22 bp, Homo sapiens
caccagagtgagtggactgtcg

SEQ ID NO: 9247251 - DNA, 22 bp, Homo sapiens
caccagcaccagctctgtgcct

SEQ ID NO: 9247252 - DNA, 22 bp, Homo sapiens
caccagctaattaaaacagcag

SEQ ID NO: 9247253 - DNA, 22 bp, Homo sapiens
caccagctacagactactgtgt

SEQ ID NO: 9247254 - DNA, 22 bp, Homo sapiens
caccagctacagactactgtgt

SEQ ID NO: 9247255 - DNA, 22 bp, Homo sapiens
caccagctaattaaaacagcag

SEQ ID NO: 9247256 - DNA, 22 bp, Homo sapiens
agcagggctctgtggagggtgg

SEQ ID NO: 9247257 - DNA, 22 bp, Homo sapiens
agcagggctgcagtgtgtcttt

SEQ ID NO: 9247258 - DNA, 22 bp, Homo sapiens
cacatttaatcctttataagta

SEQ ID NO: 9247259 - DNA, 22 bp, Homo sapiens
agcagggcagtgatcagaaagg

SEQ ID NO: 9247260 - DNA, 22 bp, Homo sapiens
agcagggcaggtaaggatcaga

SEQ ID NO: 9247261 - DNA, 22 bp, Homo sapiens
agcagggcaaagtcaggctaac

SEQ ID NO: 9247262 - DNA, 17 bp, Homo sapiens
agcagggagtcaaggga

SEQ ID NO: 9247263 - DNA, 22 bp, Homo sapiens
cacagcagaacttaatttcaaa

SEQ ID NO: 9247264 - DNA, 22 bp, Homo sapiens
cacagcagaaatatgaaggcag

SEQ ID NO: 9247265 - DNA, 22 bp, Homo sapiens
cacagcagaaagtgtaggagga

SEQ ID NO: 9247266 - DNA, 22 bp, Homo sapiens
cacagcagagggagccattgaa

SEQ ID NO: 9247267 - DNA, 22 bp, Homo sapiens
cacagcagacagggaggcggct

SEQ ID NO: 9247268 - DNA, 22 bp, Homo sapiens
cacagcaagagctaaatgacca

SEQ ID NO: 9247269 - DNA, 20 bp, Homo sapiens
agcaggaatgatgctttcat

SEQ ID NO: 9247270 - DNA, 22 bp, Homo sapiens
agcaggaaggtctgtgtgagtc

SEQ ID NO: 9247271 - DNA, 22 bp, Homo sapiens
agcaggaagtagtctgtaagca

SEQ ID NO: 9247272 - DNA, 22 bp, Homo sapiens
agcaggaaggtctgtgtgagtc

SEQ ID NO: 9247273 - DNA, 21 bp, Homo sapiens
agcagctgggcaacatggagg

SEQ ID NO: 9247274 - DNA, 22 bp, Homo sapiens
agcaggaaggctttgggggttc

SEQ ID NO: 9247275 - DNA, 22 bp, Homo sapiens
agcaggaactcagggagttctc

SEQ ID NO: 9247276 - DNA, 22 bp, Homo sapiens
agaggaggtccttttctgatgt

SEQ ID NO: 9247277 - DNA, 22 bp, Homo sapiens
agagctgggaccgtctggaagt

SEQ ID NO: 9247278 - DNA, 21 bp, Homo sapiens
agagctgggacttgcctgaga

SEQ ID NO: 9247279 - DNA, 22 bp, Homo sapiens
agagctgggaccgtctggaagt

SEQ ID NO: 9247280 - DNA, 22 bp, Homo sapiens
agagctggctgtgggtgacttt

SEQ ID NO: 9247281 - DNA, 22 bp, Homo sapiens
attacagaaagcaatattgagt

SEQ ID NO: 9247282 - DNA, 22 bp, Homo sapiens
agaggcacccgcgcgcggccat

SEQ ID NO: 9247283 - DNA, 22 bp, Homo sapiens
agaggccaggcagcccaaggtg

SEQ ID NO: 9247284 - DNA, 22 bp, Homo sapiens
agaggccaggcagcccaaggtg

SEQ ID NO: 9247285 - DNA, 22 bp, Homo sapiens
agaggccagctagcgggccatc

SEQ ID NO: 9247286 - DNA, 22 bp, Homo sapiens
agaggccaggctgcagagggat

SEQ ID NO: 9247287 - DNA, 22 bp, Homo sapiens
agaggccaggctgcagagggat

SEQ ID NO: 9247288 - DNA, 22 bp, Homo sapiens
agaggctccttcactctggcac

SEQ ID NO: 9247289 - DNA, 22 bp, Homo sapiens
agaggctgcacttgctcatgat

SEQ ID NO: 9247290 - DNA, 22 bp, Homo sapiens
agaggctgcacttgctcatgat

SEQ ID NO: 9247291 - DNA, 22 bp, Homo sapiens
agaggctgcacttgctcatgat

SEQ ID NO: 9247292 - DNA, 22 bp, Homo sapiens
agaggctggattgagcatagac

SEQ ID NO: 9247293 - DNA, 22 bp, Homo sapiens
agaggctggattgagcatagac

SEQ ID NO: 9247294 - DNA, 22 bp, Homo sapiens
agaggctgggaagggtccccgg

SEQ ID NO: 9247295 - DNA, 22 bp, Homo sapiens
agaggctggattgagcatagac

SEQ ID NO: 9247296 - DNA, 22 bp, Homo sapiens
agaggctgcaggctggaaatca

SEQ ID NO: 9247297 - DNA, 23 bp, Homo sapiens
agaggctgcagggtattgagaat

SEQ ID NO: 9247298 - DNA, 18 bp, Homo sapiens
agaggctggacaggggat

SEQ ID NO: 9247299 - DNA, 23 bp, Homo sapiens
agaggccagcctttggagacacc

SEQ ID NO: 9247300 - DNA, 23 bp, Homo sapiens
agaggccagcctttggagacacc

SEQ ID NO: 9247301 - DNA, 23 bp, Homo sapiens
agaggccagcctttggagacacc

SEQ ID NO: 9247302 - DNA, 22 bp, Homo sapiens
agaggccagcagtgcctatctg

SEQ ID NO: 9247303 - DNA, 22 bp, Homo sapiens
agaggccagcccaggccaccga

SEQ ID NO: 9247304 - DNA, 22 bp, Homo sapiens
agaggccagcactgcagggaag

SEQ ID NO: 9247305 - DNA, 22 bp, Homo sapiens
agaggccagcactgcagggaag

SEQ ID NO: 9247306 - DNA, 22 bp, Homo sapiens
agaggccagcactgcagggaag

SEQ ID NO: 9247307 - DNA, 22 bp, Homo sapiens
agaggccagatcatcatagatg

SEQ ID NO: 9247308 - DNA, 22 bp, Homo sapiens
agaggccagcaaccacagtaaa

SEQ ID NO: 9247309 - DNA, 22 bp, Homo sapiens
agaggccagaaagtatgccacc

SEQ ID NO: 9247310 - DNA, 22 bp, Homo sapiens
agaggccagaaggcgcaccccg

SEQ ID NO: 9247311 - DNA, 22 bp, Homo sapiens
agaggccactttgcctgtgatg

SEQ ID NO: 9247312 - DNA, 22 bp, Homo sapiens
agaggccaccttctcttgagaa

SEQ ID NO: 9247313 - DNA, 22 bp, Homo sapiens
agaggccaccagaggtggtgcc

SEQ ID NO: 9247314 - DNA, 22 bp, Homo sapiens
agaggccaccagaggtggtgcc

SEQ ID NO: 9247315 - DNA, 16 bp, Homo sapiens
agaggccacagacaga

SEQ ID NO: 9247316 - DNA, 22 bp, Homo sapiens
agaggccaccactgtcagggac

SEQ ID NO: 9247317 - DNA, 22 bp, Homo sapiens
agagtgcaaccgaaacaagcag

SEQ ID NO: 9247318 - DNA, 20 bp, Homo sapiens
agagtgagactccatctcag

SEQ ID NO: 9247319 - DNA, 22 bp, Homo sapiens
agagtgagggggcactgagacg

SEQ ID NO: 9247320 - DNA, 22 bp, Homo sapiens
agagtgagggggcactgagacg

SEQ ID NO: 9247321 - DNA, 22 bp, Homo sapiens
agagtgcttagtagtgacatgg

SEQ ID NO: 9247322 - DNA, 22 bp, Homo sapiens
agagtgcttaaagctggctttg

SEQ ID NO: 9247323 - DNA, 22 bp, Homo sapiens
agagtctgaggcagctgcagcc

SEQ ID NO: 9247324 - DNA, 19 bp, Homo sapiens
agagtattgaatttgccct

SEQ ID NO: 9247325 - DNA, 22 bp, Homo sapiens
agagtatgcatctattgtacct

SEQ ID NO: 9247326 - DNA, 22 bp, Homo sapiens
agagtactgcctcagttatgaa

SEQ ID NO: 9247327 - DNA, 22 bp, Homo sapiens
agagtactgcctcagttatgaa

SEQ ID NO: 9247328 - DNA, 22 bp, Homo sapiens
agagtactgcctcagttatgaa

SEQ ID NO: 9247329 - DNA, 22 bp, Homo sapiens
agagtcagactaagccatggtg

SEQ ID NO: 9247330 - DNA, 22 bp, Homo sapiens
agaggctgggtacgggccacct

SEQ ID NO: 9247331 - DNA, 22 bp, Homo sapiens
agaggctgggcaggacccacag

SEQ ID NO: 9247332 - DNA, 22 bp, Homo sapiens
agaggctgggaagggtccccgg

SEQ ID NO: 9247333 - DNA, 19 bp, Homo sapiens
agaggctgtcacctgtagc

SEQ ID NO: 9247334 - DNA, 22 bp, Homo sapiens
agaggctgtcccttgctattcc

SEQ ID NO: 9247335 - DNA, 16 bp, Homo sapiens
agaggctgtaatggaa

SEQ ID NO: 9247336 - DNA, 19 bp, Homo sapiens
agaggctgtcacctgtagc

SEQ ID NO: 9247337 - DNA, 22 bp, Homo sapiens
agagggctgggatgtgctgtgt

SEQ ID NO: 9247338 - DNA, 22 bp, Homo sapiens
agaggctgtctcatattttgta

SEQ ID NO: 9247339 - DNA, 22 bp, Homo sapiens
agagggcttccctaggagtgag

SEQ ID NO: 9247340 - DNA, 22 bp, Homo sapiens
agaggggaaggatgtgatgtga

SEQ ID NO: 9247341 - DNA, 22 bp, Homo sapiens
agaggggaggcgaaccagagtc

SEQ ID NO: 9247342 - DNA, 22 bp, Homo sapiens
agaggggaggcgaaccagagtc

SEQ ID NO: 9247343 - DNA, 22 bp, Homo sapiens
agaggggcaagtaaagagtctt

SEQ ID NO: 9247344 - DNA, 22 bp, Homo sapiens
agaggggagtcctaatctgatt

SEQ ID NO: 9247345 - DNA, 18 bp, Homo sapiens
agaggggaggtaagtctg

SEQ ID NO: 9247346 - DNA, 22 bp, Homo sapiens
agaggggctcaagcagtggtct

SEQ ID NO: 9247347 - DNA, 22 bp, Homo sapiens
agaggggctcaagcagtggtct

SEQ ID NO: 9247348 - DNA, 22 bp, Homo sapiens
agaggggcccggttctccgtct

SEQ ID NO: 9247349 - DNA, 22 bp, Homo sapiens
agaggggcagggtctccggatt

SEQ ID NO: 9247350 - DNA, 22 bp, Homo sapiens
agatggagtggagatgagtaaa

SEQ ID NO: 9247351 - DNA, 22 bp, Homo sapiens
agatggagttagtaccagagtc

SEQ ID NO: 9247352 - DNA, 17 bp, Homo sapiens
agatggcaggaggcaga

SEQ ID NO: 9247353 - DNA, 17 bp, Homo sapiens
agatggcaggaggcaga

SEQ ID NO: 9247354 - DNA, 17 bp, Homo sapiens
agatggcaggaggcaga

SEQ ID NO: 9247355 - DNA, 22 bp, Homo sapiens
agatggcagcagaacaaacagg

SEQ ID NO: 9247356 - DNA, 17 bp, Homo sapiens
agatggcaggaggcaga

SEQ ID NO: 9247357 - DNA, 22 bp, Homo sapiens
agatggcaggggtacctggaag

SEQ ID NO: 9247358 - DNA, 22 bp, Homo sapiens
agatggccccaggtgcccaggg

SEQ ID NO: 9247359 - DNA, 22 bp, Homo sapiens
agatggctccagtgtccagagg

SEQ ID NO: 9247360 - DNA, 22 bp, Homo sapiens
agatggctgattaactccatgg

SEQ ID NO: 9247361 - DNA, 22 bp, Homo sapiens
agatggctgatggcaggagcca

SEQ ID NO: 9247362 - DNA, 22 bp, Homo sapiens
attttaaccctcttatatatac

SEQ ID NO: 9247363 - DNA, 22 bp, Homo sapiens
agatggctgggagctctgtttg

SEQ ID NO: 9247364 - DNA, 22 bp, Homo sapiens
agatcactttgatgctacctgg

SEQ ID NO: 9247365 - DNA, 22 bp, Homo sapiens
agatcagtaagaggaagaatgg

SEQ ID NO: 9247366 - DNA, 22 bp, Homo sapiens
agatcagttagatagcttgatg

SEQ ID NO: 9247367 - DNA, 22 bp, Homo sapiens
agatcatatgaaaaatttcaag

SEQ ID NO: 9247368 - DNA, 22 bp, Homo sapiens
agatgattatgatagcactgtt

SEQ ID NO: 9247369 - DNA, 22 bp, Homo sapiens
agatgattatgatagcactgtt

SEQ ID NO: 9247370 - DNA, 22 bp, Homo sapiens
agatccagatccttcctggttg

SEQ ID NO: 9247371 - DNA, 21 bp, Homo sapiens
agatcattcttctgagcactt

SEQ ID NO: 9247372 - DNA, 22 bp, Homo sapiens
agatcatatgcagtaatgaact

SEQ ID NO: 9247373 - DNA, 17 bp, Homo sapiens
agatgctggccacatgt

SEQ ID NO: 9247374 - DNA, 22 bp, Homo sapiens
agatgctggatggaaaatgatc

SEQ ID NO: 9247375 - DNA, 22 bp, Homo sapiens
agatgctgtcacacacactgtt

SEQ ID NO: 9247376 - DNA, 22 bp, Homo sapiens
agatgctgtgaggaagctagga

SEQ ID NO: 9247377 - DNA, 22 bp, Homo sapiens
agatgctgtgaggaagctagga

SEQ ID NO: 9247378 - DNA, 22 bp, Homo sapiens
agatgcttaagttttcagtgta

SEQ ID NO: 9247379 - DNA, 22 bp, Homo sapiens
agatgcttcagtgtttaattta

SEQ ID NO: 9247380 - DNA, 22 bp, Homo sapiens
agatgctttcctgatatttatg

SEQ ID NO: 9247381 - DNA, 22 bp, Homo sapiens
agatgctgtgtctgttcccttg

SEQ ID NO: 9247382 - DNA, 21 bp, Homo sapiens
agatgctgtgctccaggagca

SEQ ID NO: 9247383 - DNA, 22 bp, Homo sapiens
agatggaaaatatagacagaga

SEQ ID NO: 9247384 - DNA, 22 bp, Homo sapiens
agatgctttcctgatatttatg

SEQ ID NO: 9247385 - DNA, 22 bp, Homo sapiens
agatgcttcagtgtttaattta

SEQ ID NO: 9247386 - DNA, 22 bp, Homo sapiens
agatcacagtggcaactccctt

SEQ ID NO: 9247387 - DNA, 22 bp, Homo sapiens
agatcacagtggcaactccctt

SEQ ID NO: 9247388 - DNA, 22 bp, Homo sapiens
agatcactggttacttaatgaa

SEQ ID NO: 9247389 - DNA, 22 bp, Homo sapiens
agatcaaagccatgagagattt

SEQ ID NO: 9247390 - DNA, 22 bp, Homo sapiens
agatcaaggtgtcagcaggctt

SEQ ID NO: 9247391 - DNA, 22 bp, Homo sapiens
agatcaagcactgtgcaaaaat

SEQ ID NO: 9247392 - DNA, 22 bp, Homo sapiens
agatcaaggacatgaagaggct

SEQ ID NO: 9247393 - DNA, 22 bp, Homo sapiens
agatataataatttacaagtgt

SEQ ID NO: 9247394 - DNA, 22 bp, Homo sapiens
agatattctgcctaacaggttt

SEQ ID NO: 9247395 - DNA, 22 bp, Homo sapiens
agatattctagaacctagtaga

SEQ ID NO: 9247396 - DNA, 22 bp, Homo sapiens
agatattcaaccaaacactaat

SEQ ID NO: 9247397 - DNA, 22 bp, Homo sapiens
agatatttaaatcagacaaaga

SEQ ID NO: 9247398 - DNA, 22 bp, Homo sapiens
agatatttaaatcagacaaaga

SEQ ID NO: 9247399 - DNA, 22 bp, Homo sapiens
agatatttgtatcttgctattg

SEQ ID NO: 9247400 - DNA, 22 bp, Homo sapiens
attgggatgccggctgataaga

SEQ ID NO: 9247401 - DNA, 22 bp, Homo sapiens
attggctttcttttgtgaaaat

SEQ ID NO: 9247402 - DNA, 22 bp, Homo sapiens
attggtagttttgtatttctct

SEQ ID NO: 9247403 - DNA, 22 bp, Homo sapiens
attggtaaaattcttcccattt

SEQ ID NO: 9247404 - DNA, 22 bp, Homo sapiens
attggtaagcaagatggcaata

SEQ ID NO: 9247405 - DNA, 22 bp, Homo sapiens
agagtggagagaaacaactctg

SEQ ID NO: 9247406 - DNA, 22 bp, Homo sapiens
agagtgctttattagatgtagc

SEQ ID NO: 9247407 - DNA, 22 bp, Homo sapiens
attggcttagttggcaattgtt

SEQ ID NO: 9247408 - DNA, 22 bp, Homo sapiens
attggccatttgcatgtattat

SEQ ID NO: 9247409 - DNA, 22 bp, Homo sapiens
attggccagacttatccttcag

SEQ ID NO: 9247410 - DNA, 22 bp, Homo sapiens
attttcagaacattcattcact

SEQ ID NO: 9247411 - DNA, 22 bp, Homo sapiens
attttcaccctgaatatattga

SEQ ID NO: 9247412 - DNA, 22 bp, Homo sapiens
attttcaccctgaatatattga

SEQ ID NO: 9247413 - DNA, 22 bp, Homo sapiens
attttcaagggagaggcctctg

SEQ ID NO: 9247414 - DNA, 22 bp, Homo sapiens
attttcaagggagaggcctctg

SEQ ID NO: 9247415 - DNA, 22 bp, Homo sapiens
attttcaccctgaatatattga

SEQ ID NO: 9247416 - DNA, 22 bp, Homo sapiens
agatgtggcctttgggagatta

SEQ ID NO: 9247417 - DNA, 22 bp, Homo sapiens
agatgtggccggctagggagag

SEQ ID NO: 9247418 - DNA, 22 bp, Homo sapiens
agatgtggctgcacccaccgct

SEQ ID NO: 9247419 - DNA, 22 bp, Homo sapiens
agatgtggccggctagggagag

SEQ ID NO: 9247420 - DNA, 22 bp, Homo sapiens
agatgtggatcctagggtagaa

SEQ ID NO: 9247421 - DNA, 22 bp, Homo sapiens
agatgtggatcctagggtagaa

SEQ ID NO: 9247422 - DNA, 22 bp, Homo sapiens
agatgtggatcctagggtagaa

SEQ ID NO: 9247423 - DNA, 22 bp, Homo sapiens
attttatctgcttactttcagg

SEQ ID NO: 9247424 - DNA, 22 bp, Homo sapiens
attttatccccactggattaca

SEQ ID NO: 9247425 - DNA, 22 bp, Homo sapiens
attttagttttagcatccatgc

SEQ ID NO: 9247426 - DNA, 22 bp, Homo sapiens
attttcaaaacatctgctgtgt

SEQ ID NO: 9247427 - DNA, 22 bp, Homo sapiens
attttcaaaacatctgctgtgt

SEQ ID NO: 9247428 - DNA, 22 bp, Homo sapiens
attttatctgcttactttcagg

SEQ ID NO: 9247429 - DNA, 22 bp, Homo sapiens
attttatgacacgattcttcca

SEQ ID NO: 9247430 - DNA, 22 bp, Homo sapiens
attttagtacctcaagtatcca

SEQ ID NO: 9247431 - DNA, 22 bp, Homo sapiens
attttagcagttctctaatttc

SEQ ID NO: 9247432 - DNA, 22 bp, Homo sapiens
attttagcaaatgcaagatgga

SEQ ID NO: 9247433 - DNA, 22 bp, Homo sapiens
attttaaccctcttatatatac

SEQ ID NO: 9247434 - DNA, 22 bp, Homo sapiens
agcaacagccctgaggttcatg

SEQ ID NO: 9247435 - DNA, 22 bp, Homo sapiens
agcaaattcagaagcagaatgg

SEQ ID NO: 9247436 - DNA, 19 bp, Homo sapiens
agcaacaccgtttatttcc

SEQ ID NO: 9247437 - DNA, 22 bp, Homo sapiens
agatgtgtttctagttcctgca

SEQ ID NO: 9247438 - DNA, 22 bp, Homo sapiens
agatgtggtagttgaagggaag

SEQ ID NO: 9247439 - DNA, 22 bp, Homo sapiens
agatgtgggtgtcaggcagtga

SEQ ID NO: 9247440 - DNA, 22 bp, Homo sapiens
agatgtgggtgtcaggcagtga

SEQ ID NO: 9247441 - DNA, 22 bp, Homo sapiens
agatgtgggcaatggaatggag

SEQ ID NO: 9247442 - DNA, 22 bp, Homo sapiens
agatgtgggcaatggaatggag

SEQ ID NO: 9247443 - DNA, 22 bp, Homo sapiens
agatgtgggtgtcaggcagtga

SEQ ID NO: 9247444 - DNA, 22 bp, Homo sapiens
agcaaagctatctctatggaga

SEQ ID NO: 9247445 - DNA, 22 bp, Homo sapiens
agatgtgtttctagttcctgca

SEQ ID NO: 9247446 - DNA, 22 bp, Homo sapiens
agcaacagggggatggccactg

SEQ ID NO: 9247447 - DNA, 22 bp, Homo sapiens
agcaacaggaccatggagccca

SEQ ID NO: 9247448 - DNA, 19 bp, Homo sapiens
agcaacctgtcagagatgc

SEQ ID NO: 9247449 - DNA, 22 bp, Homo sapiens
agcaacatttttcaattaacat

SEQ ID NO: 9247450 - DNA, 21 bp, Homo sapiens
agcaagaatcaggaaggctct

SEQ ID NO: 9247451 - DNA, 20 bp, Homo sapiens
agcaagagtaaggacagcga

SEQ ID NO: 9247452 - DNA, 20 bp, Homo sapiens
agcaagagtaaggacagcga

SEQ ID NO: 9247453 - DNA, 22 bp, Homo sapiens
agcaacttctacagatatagca

SEQ ID NO: 9247454 - DNA, 22 bp, Homo sapiens
caaaggcaggtgctgaatattc

SEQ ID NO: 9247455 - DNA, 22 bp, Homo sapiens
caaagcaagggctgaagactcc

SEQ ID NO: 9247456 - DNA, 22 bp, Homo sapiens
caaagcaaggctcagtttgaac

SEQ ID NO: 9247457 - DNA, 22 bp, Homo sapiens
caaagcaaggctcagtttgaac

SEQ ID NO: 9247458 - DNA, 22 bp, Homo sapiens
caaagatatgacatggaaaatg

SEQ ID NO: 9247459 - DNA, 22 bp, Homo sapiens
caaagatatgacatggaaaatg

SEQ ID NO: 9247460 - DNA, 22 bp, Homo sapiens
caaaccagtaggaagtctatta

SEQ ID NO: 9247461 - DNA, 22 bp, Homo sapiens
caaagagttttttcatataatg

SEQ ID NO: 9247462 - DNA, 22 bp, Homo sapiens
caaagagttttttcatataatg

SEQ ID NO: 9247463 - DNA, 22 bp, Homo sapiens
agaatattcatctgtattctta

SEQ ID NO: 9247464 - DNA, 22 bp, Homo sapiens
agaatatagttaccaaattctg

SEQ ID NO: 9247465 - DNA, 22 bp, Homo sapiens
atgaagttccagtatatgcagt

SEQ ID NO: 9247466 - DNA, 22 bp, Homo sapiens
atgaagttctagtgagaaatgc

SEQ ID NO: 9247467 - DNA, 22 bp, Homo sapiens
atgaagggtgtccctgtgagca

SEQ ID NO: 9247468 - DNA, 22 bp, Homo sapiens
atgaagtctagcaagcattgaa

SEQ ID NO: 9247469 - DNA, 22 bp, Homo sapiens
atgaagtctctttttcatgaga

SEQ ID NO: 9247470 - DNA, 22 bp, Homo sapiens
atgaaggatggctggctgccct

SEQ ID NO: 9247471 - DNA, 22 bp, Homo sapiens
atgaaggatggctggctgccct

SEQ ID NO: 9247472 - DNA, 22 bp, Homo sapiens
atgaaggatagggcaaaatttt

SEQ ID NO: 9247473 - DNA, 22 bp, Homo sapiens
atgaaggacaacaggggagcag

SEQ ID NO: 9247474 - DNA, 22 bp, Homo sapiens
atgaaggacaacaggggagcag

SEQ ID NO: 9247475 - DNA, 22 bp, Homo sapiens
atctgcctgcagtggaggtggg

SEQ ID NO: 9247476 - DNA, 22 bp, Homo sapiens
atctgcctggctccaggtgagc

SEQ ID NO: 9247477 - DNA, 20 bp, Homo sapiens
atctgctgagaatgaaaggc

SEQ ID NO: 9247478 - DNA, 22 bp, Homo sapiens
atctgcttgaaacttcttatac

SEQ ID NO: 9247479 - DNA, 22 bp, Homo sapiens
atctgcttgaatgagcaacagg

SEQ ID NO: 9247480 - DNA, 22 bp, Homo sapiens
atgaacaatgactacatattga

SEQ ID NO: 9247481 - DNA, 22 bp, Homo sapiens
atctgcttcctgggctccatga

SEQ ID NO: 9247482 - DNA, 22 bp, Homo sapiens
atgaagcattacaggatgacag

SEQ ID NO: 9247483 - DNA, 19 bp, Homo sapiens
atgaagcattgtttttgta

SEQ ID NO: 9247484 - DNA, 22 bp, Homo sapiens
atgaagcagttaaggtgcatga

SEQ ID NO: 9247485 - DNA, 22 bp, Homo sapiens
atgaagcagttaaggtgcatga

SEQ ID NO: 9247486 - DNA, 22 bp, Homo sapiens
atgaagcatctcacaatctagt

SEQ ID NO: 9247487 - DNA, 22 bp, Homo sapiens
agacaacaccaaatgctagtgt

SEQ ID NO: 9247488 - DNA, 22 bp, Homo sapiens
agacaactagaaaactagacag

SEQ ID NO: 9247489 - DNA, 22 bp, Homo sapiens
agacaacatctagtttggtgga

SEQ ID NO: 9247490 - DNA, 22 bp, Homo sapiens
agacaagtaggaatggttgaag

SEQ ID NO: 9247491 - DNA, 22 bp, Homo sapiens
agacaagtgtggtgagagcagt

SEQ ID NO: 9247492 - DNA, 21 bp, Homo sapiens
agacagaacaactgctctcca

SEQ ID NO: 9247493 - DNA, 21 bp, Homo sapiens
agacagaacaactgctctcca

SEQ ID NO: 9247494 - DNA, 22 bp, Homo sapiens
agacactgtgtacagaaaaaga

SEQ ID NO: 9247495 - DNA, 22 bp, Homo sapiens
agacactgttctcacatgcttg

SEQ ID NO: 9247496 - DNA, 22 bp, Homo sapiens
atgaggcccaggaatctgtatt

SEQ ID NO: 9247497 - DNA, 22 bp, Homo sapiens
atgaggccatggctgtcactaa

SEQ ID NO: 9247498 - DNA, 22 bp, Homo sapiens
atgaggcccaaacattacaaat

SEQ ID NO: 9247499 - DNA, 22 bp, Homo sapiens
atgaggcctatcttggcagagg

SEQ ID NO: 9247500 - DNA, 22 bp, Homo sapiens
atgaggcctttcttcacccttt

SEQ ID NO: 9247501 - DNA, 22 bp, Homo sapiens
atgagggaggcaaggagatgct

SEQ ID NO: 9247502 - DNA, 22 bp, Homo sapiens
atgagggaggcaaggagatgct

SEQ ID NO: 9247503 - DNA, 22 bp, Homo sapiens
atgaggccagggtgccatgaaa

SEQ ID NO: 9247504 - DNA, 22 bp, Homo sapiens
atgaggccagggtgccatgaaa

SEQ ID NO: 9247505 - DNA, 20 bp, Homo sapiens
atgaggccagcagggctcag

SEQ ID NO: 9247506 - DNA, 22 bp, Homo sapiens
atgaggccagaccactctgcat

SEQ ID NO: 9247507 - DNA, 22 bp, Homo sapiens
agaatattgaaagttcttgaca

SEQ ID NO: 9247508 - DNA, 22 bp, Homo sapiens
agaatcaactgaaaattggtga

SEQ ID NO: 9247509 - DNA, 22 bp, Homo sapiens
agaatattgaaagttcttgaca

SEQ ID NO: 9247510 - DNA, 22 bp, Homo sapiens
agaatattgaaagttcttgaca

SEQ ID NO: 9247511 - DNA, 22 bp, Homo sapiens
agaatcaaagagaaatactttg

SEQ ID NO: 9247512 - DNA, 22 bp, Homo sapiens
agacctggtttatcaccagcat

SEQ ID NO: 9247513 - DNA, 22 bp, Homo sapiens
agacctggtttatcaccagcat

SEQ ID NO: 9247514 - DNA, 22 bp, Homo sapiens
agacctggtgatagctgtccta

SEQ ID NO: 9247515 - DNA, 22 bp, Homo sapiens
agacctgggttcgagtcctaac

SEQ ID NO: 9247516 - DNA, 22 bp, Homo sapiens
agacctgggtgccctgtgcttt

SEQ ID NO: 9247517 - DNA, 22 bp, Homo sapiens
agacctgggtgccctgtgcttt

SEQ ID NO: 9247518 - DNA, 22 bp, Homo sapiens
agacctgggtgccctgtgcttt

SEQ ID NO: 9247519 - DNA, 22 bp, Homo sapiens
agacctggagtggggcctcagg

SEQ ID NO: 9247520 - DNA, 22 bp, Homo sapiens
agacctggatgtgagggaagta

SEQ ID NO: 9247521 - DNA, 22 bp, Homo sapiens
atgccaagtacaggcactgctc

SEQ ID NO: 9247522 - DNA, 22 bp, Homo sapiens
agacctggaagttcaagagaaa

SEQ ID NO: 9247523 - DNA, 22 bp, Homo sapiens
agacctggagacctgagtggta

SEQ ID NO: 9247524 - DNA, 22 bp, Homo sapiens
agacccaggattggggctgccg

SEQ ID NO: 9247525 - DNA, 22 bp, Homo sapiens
atgcctgtaattccagcatttt

SEQ ID NO: 9247526 - DNA, 22 bp, Homo sapiens
atgcctgtaatcccagtgcttt

SEQ ID NO: 9247527 - DNA, 22 bp, Homo sapiens
agactggggttctggcaaggag

SEQ ID NO: 9247528 - DNA, 22 bp, Homo sapiens
agactctgcatttctaataagc

SEQ ID NO: 9247529 - DNA, 22 bp, Homo sapiens
atgcctttgccacagattagga

SEQ ID NO: 9247530 - DNA, 22 bp, Homo sapiens
atgcgagtgatgcagagtggct

SEQ ID NO: 9247531 - DNA, 22 bp, Homo sapiens
atgatacatcttcatgtcagtg

SEQ ID NO: 9247532 - DNA, 22 bp, Homo sapiens
atgatatacttcctagaacagt

SEQ ID NO: 9247533 - DNA, 20 bp, Homo sapiens
atgatagtcagaaaactagc

SEQ ID NO: 9247534 - DNA, 22 bp, Homo sapiens
atgatatacttcctagaacagt

SEQ ID NO: 9247535 - DNA, 22 bp, Homo sapiens
atgatactctaggtgatttaca

SEQ ID NO: 9247536 - DNA, 22 bp, Homo sapiens
atgatacatttacctatggtct

SEQ ID NO: 9247537 - DNA, 22 bp, Homo sapiens
atgcagggttctgggctagaga

SEQ ID NO: 9247538 - DNA, 22 bp, Homo sapiens
atgcaggtatattttattaaag

SEQ ID NO: 9247539 - DNA, 22 bp, Homo sapiens
atgcatatggcttgagggaata

SEQ ID NO: 9247540 - DNA, 22 bp, Homo sapiens
atgcatatgtacccatgttctg

SEQ ID NO: 9247541 - DNA, 22 bp, Homo sapiens
atgcatatgtacccatgttctg

SEQ ID NO: 9247542 - DNA, 22 bp, Homo sapiens
atgcatttttgagtatgaatga

SEQ ID NO: 9247543 - DNA, 22 bp, Homo sapiens
atgcatttgtaaaatataatcg

SEQ ID NO: 9247544 - DNA, 22 bp, Homo sapiens
atgcatattttctgttggtgac

SEQ ID NO: 9247545 - DNA, 22 bp, Homo sapiens
atgcatattttctactatatcg

SEQ ID NO: 9247546 - DNA, 22 bp, Homo sapiens
atgcatttttgagtatgaatga

SEQ ID NO: 9247547 - DNA, 21 bp, Homo sapiens
atgcatattttaagttgtgtc

SEQ ID NO: 9247548 - DNA, 18 bp, Homo sapiens
atgcatattttaagttgt

SEQ ID NO: 9247549 - DNA, 21 bp, Homo sapiens
atgcatattttaagttgtgtc

SEQ ID NO: 9247550 - DNA, 22 bp, Homo sapiens
atgcatattttctactatatcg

SEQ ID NO: 9247551 - DNA, 22 bp, Homo sapiens
atgcatattttctactatatcg

SEQ ID NO: 9247552 - DNA, 22 bp, Homo sapiens
atgcatatttcttgggcttacc

SEQ ID NO: 9247553 - DNA, 22 bp, Homo sapiens
atgcatatttcttggagcacct

SEQ ID NO: 9247554 - DNA, 22 bp, Homo sapiens
atgcatattgtcatttagtcct

SEQ ID NO: 9247555 - DNA, 22 bp, Homo sapiens
atgcatatttcatgaatctttg

SEQ ID NO: 9247556 - DNA, 22 bp, Homo sapiens
atgcatattgtcatttagtcct

SEQ ID NO: 9247557 - DNA, 22 bp, Homo sapiens
atgcatatgtgtgcacacgtgt

SEQ ID NO: 9247558 - DNA, 22 bp, Homo sapiens
atgcatatgtacttgcatatgt

SEQ ID NO: 9247559 - DNA, 22 bp, Homo sapiens
atgcatatgtacttgcatatgt

SEQ ID NO: 9247560 - DNA, 22 bp, Homo sapiens
atgcatatgtacccatgttctg

SEQ ID NO: 9247561 - DNA, 22 bp, Homo sapiens
atgcatattcttagcccctcct

SEQ ID NO: 9247562 - DNA, 22 bp, Homo sapiens
atgcatattgattatagattca

SEQ ID NO: 9247563 - DNA, 22 bp, Homo sapiens
atgcatattggattagcagcca

SEQ ID NO: 9247564 - DNA, 22 bp, Homo sapiens
agactttataaatcttaatttc

SEQ ID NO: 9247565 - DNA, 22 bp, Homo sapiens
agactttataaatcttaatttc

SEQ ID NO: 9247566 - DNA, 22 bp, Homo sapiens
agactttagatacgtcttcttc

SEQ ID NO: 9247567 - DNA, 22 bp, Homo sapiens
agactttatagtttttggctat

SEQ ID NO: 9247568 - DNA, 22 bp, Homo sapiens
agactttatccctgtttttctc

SEQ ID NO: 9247569 - DNA, 22 bp, Homo sapiens
agactgtactttctgcagctct

SEQ ID NO: 9247570 - DNA, 22 bp, Homo sapiens
agacttaatagaagcatgacat

SEQ ID NO: 9247571 - DNA, 22 bp, Homo sapiens
agacttaggtgagatgtttgta

SEQ ID NO: 9247572 - DNA, 19 bp, Homo sapiens
agacttttgtaagttgaga

SEQ ID NO: 9247573 - DNA, 22 bp, Homo sapiens
agagaaaactcattgaggtgtc

SEQ ID NO: 9247574 - DNA, 22 bp, Homo sapiens
agagaaaactcattgaggtgtc

SEQ ID NO: 9247575 - DNA, 23 bp, Homo sapiens
agagaaaaatatctgggcacatt

SEQ ID NO: 9247576 - DNA, 22 bp, Homo sapiens
agagaaaagagttcaggctttg

SEQ ID NO: 9247577 - DNA, 22 bp, Homo sapiens
agagaaaagagttcaggctttg

SEQ ID NO: 9247578 - DNA, 19 bp, Homo sapiens
agagaaggatcctatggtt

SEQ ID NO: 9247579 - DNA, 22 bp, Homo sapiens
agagaaaagagttcaggctttg

SEQ ID NO: 9247580 - DNA, 22 bp, Homo sapiens
agagaatacaaagaagatatgt

SEQ ID NO: 9247581 - DNA, 22 bp, Homo sapiens
agagaagggtgtagcctgggcc

SEQ ID NO: 9247582 - DNA, 22 bp, Homo sapiens
agagaaggtcactaaggaccca

SEQ ID NO: 9247583 - DNA, 22 bp, Homo sapiens
agagaagggtgtagcctgggcc

SEQ ID NO: 9247584 - DNA, 22 bp, Homo sapiens
agagagctgtcctgggacaccc

SEQ ID NO: 9247585 - DNA, 22 bp, Homo sapiens
agagagctgactttggagtcag

SEQ ID NO: 9247586 - DNA, 22 bp, Homo sapiens
agagagctctggctgggtgacc

SEQ ID NO: 9247587 - DNA, 22 bp, Homo sapiens
agagagctctgatgggaggtga

SEQ ID NO: 9247588 - DNA, 22 bp, Homo sapiens
agagagctctggctgggtgacc

SEQ ID NO: 9247589 - DNA, 22 bp, Homo sapiens
agagagcccgggccagggcaca

SEQ ID NO: 9247590 - DNA, 22 bp, Homo sapiens
agagagctgtcctgggacaccc

SEQ ID NO: 9247591 - DNA, 22 bp, Homo sapiens
agagaggcgagttacctgtgct

SEQ ID NO: 9247592 - DNA, 22 bp, Homo sapiens
agagagggaatatttggggtat

SEQ ID NO: 9247593 - DNA, 21 bp, Homo sapiens
agagagggagatgaaacatcc

SEQ ID NO: 9247594 - DNA, 21 bp, Homo sapiens
agagagggagatgaaacatcc

SEQ ID NO: 9247595 - DNA, 22 bp, Homo sapiens
agagagggcatagaaaaaggga

SEQ ID NO: 9247596 - DNA, 22 bp, Homo sapiens
agagagggaatatttggggtat

SEQ ID NO: 9247597 - DNA, 20 bp, Homo sapiens
agagaattccctttggagat

SEQ ID NO: 9247598 - DNA, 22 bp, Homo sapiens
agagaattttaaaagccttgaa

SEQ ID NO: 9247599 - DNA, 22 bp, Homo sapiens
agagacaatgccaatgcacacg

SEQ ID NO: 9247600 - DNA, 22 bp, Homo sapiens
agagacaatgccaatgcacacg

SEQ ID NO: 9247601 - DNA, 21 bp, Homo sapiens
agagagaaggccatatggtcc

SEQ ID NO: 9247602 - DNA, 22 bp, Homo sapiens
agagagcatggcacagaggggt

SEQ ID NO: 9247603 - DNA, 21 bp, Homo sapiens
agagacagagaaagtaacatt

SEQ ID NO: 9247604 - DNA, 21 bp, Homo sapiens
agagacagagaaagtaacatt

SEQ ID NO: 9247605 - DNA, 22 bp, Homo sapiens
agagacagacacatcgggctgc

SEQ ID NO: 9247606 - DNA, 22 bp, Homo sapiens
agagccctgacggggacagatg

SEQ ID NO: 9247607 - DNA, 22 bp, Homo sapiens
agagccctctcattggcttatt

SEQ ID NO: 9247608 - DNA, 22 bp, Homo sapiens
agagccctgcagttcttcagga

SEQ ID NO: 9247609 - DNA, 22 bp, Homo sapiens
agagcctctgtcatggagagaa

SEQ ID NO: 9247610 - DNA, 22 bp, Homo sapiens
agagcctgaggatgtcccagct

SEQ ID NO: 9247611 - DNA, 23 bp, Homo sapiens
agagcctgaaagacttctggcac

SEQ ID NO: 9247612 - DNA, 21 bp, Homo sapiens
agagcctgagatcttccagca

SEQ ID NO: 9247613 - DNA, 21 bp, Homo sapiens
agagcctgagatcttccagca

SEQ ID NO: 9247614 - DNA, 22 bp, Homo sapiens
agagctctttgatttgcttctc

SEQ ID NO: 9247615 - DNA, 22 bp, Homo sapiens
agagctgaaaaagctgacccgg

SEQ ID NO: 9247616 - DNA, 17 bp, Homo sapiens
agagctcttcactgtga

SEQ ID NO: 9247617 - DNA, 22 bp, Homo sapiens
agagcctgcagctgtgaagaaa

SEQ ID NO: 9247618 - DNA, 22 bp, Homo sapiens
agagcctgaggccctgagaggg

SEQ ID NO: 9247619 - DNA, 22 bp, Homo sapiens
agagcctgaggccaggaaaatg

SEQ ID NO: 9247620 - DNA, 22 bp, Homo sapiens
agagcctgaggccctgagaggg

SEQ ID NO: 9247621 - DNA, 22 bp, Homo sapiens
agagctggacgtctgagcccta

SEQ ID NO: 9247622 - DNA, 22 bp, Homo sapiens
agagctggacgtctgagcccta

SEQ ID NO: 9247623 - DNA, 22 bp, Homo sapiens
agagctggaatcagacctcagg

SEQ ID NO: 9247624 - DNA, 22 bp, Homo sapiens
agagctggatggtcaagatggc

SEQ ID NO: 9247625 - DNA, 22 bp, Homo sapiens
agagctggagatgcaggtttcg

SEQ ID NO: 9247626 - DNA, 22 bp, Homo sapiens
agagctggagatgcaggtttcg

SEQ ID NO: 9247627 - DNA, 22 bp, Homo sapiens
agagctggatggtcaagatggc

SEQ ID NO: 9247628 - DNA, 22 bp, Homo sapiens
agagctggatggtcaagatggc

SEQ ID NO: 9247629 - DNA, 22 bp, Homo sapiens
agagctggatggtcaagatggc

SEQ ID NO: 9247630 - DNA, 21 bp, Homo sapiens
agagctggcctgccaggccct

SEQ ID NO: 9247631 - DNA, 22 bp, Homo sapiens
agagctggccagggatcactct

SEQ ID NO: 9247632 - DNA, 21 bp, Homo sapiens
agagctggcctgccaggccct

SEQ ID NO: 9247633 - DNA, 22 bp, Homo sapiens
agagctggcagcagcttctcct

SEQ ID NO: 9247634 - DNA, 22 bp, Homo sapiens
agagctggccagggatcactct

SEQ ID NO: 9247635 - DNA, 22 bp, Homo sapiens
agagctggctgtgggtgacttt

SEQ ID NO: 9247636 - DNA, 22 bp, Homo sapiens
agagctggctggtagccctgat

SEQ ID NO: 9247637 - DNA, 22 bp, Homo sapiens
agagctggctggtagccctgat

SEQ ID NO: 9247638 - DNA, 22 bp, Homo sapiens
agagcagagtggctgtagcttg

SEQ ID NO: 9247639 - DNA, 22 bp, Homo sapiens
agagcagagtggctgtagcttg

SEQ ID NO: 9247640 - DNA, 22 bp, Homo sapiens
agagcagaggcatggccgtggg

SEQ ID NO: 9247641 - DNA, 22 bp, Homo sapiens
agagcagagggctctgggacaa

SEQ ID NO: 9247642 - DNA, 22 bp, Homo sapiens
agagcagagggctctgggacaa

SEQ ID NO: 9247643 - DNA, 22 bp, Homo sapiens
agagcagacatccttgtcttgt

SEQ ID NO: 9247644 - DNA, 22 bp, Homo sapiens
agagattgtgctactcacccaa

SEQ ID NO: 9247645 - DNA, 22 bp, Homo sapiens
agagattggggatgaatctttc

SEQ ID NO: 9247646 - DNA, 22 bp, Homo sapiens
agagcacagccaccatttacaa

SEQ ID NO: 9247647 - DNA, 22 bp, Homo sapiens
agagcacagccaccatttacaa

SEQ ID NO: 9247648 - DNA, 22 bp, Homo sapiens
agagattgctagctggctttaa

SEQ ID NO: 9247649 - DNA, 22 bp, Homo sapiens
agagaggtttgctggaagattc

SEQ ID NO: 9247650 - DNA, 22 bp, Homo sapiens
agagcacaggtgctggagccca

SEQ ID NO: 9247651 - DNA, 21 bp, Homo sapiens
agagcacaggtggacaatgct

SEQ ID NO: 9247652 - DNA, 22 bp, Homo sapiens
agagcacagtgcaggatccccg

SEQ ID NO: 9247653 - DNA, 22 bp, Homo sapiens
agagccaggccaggccggggca

SEQ ID NO: 9247654 - DNA, 22 bp, Homo sapiens
agagcccctggtggagtgagaa

SEQ ID NO: 9247655 - DNA, 22 bp, Homo sapiens
agagcccctggtggagtgagaa

SEQ ID NO: 9247656 - DNA, 22 bp, Homo sapiens
agagcccctgggtcacacagcc

SEQ ID NO: 9247657 - DNA, 22 bp, Homo sapiens
agagcagatggccagggggcct

SEQ ID NO: 9247658 - DNA, 22 bp, Homo sapiens
agagcagatggagctggaagag

SEQ ID NO: 9247659 - DNA, 22 bp, Homo sapiens
agagcagcacgttgtccccaca

SEQ ID NO: 9247660 - DNA, 22 bp, Homo sapiens
agagcagatggccagggggcct

SEQ ID NO: 9247661 - DNA, 22 bp, Homo sapiens
agagcagatttcaaatattggc

SEQ ID NO: 9247662 - DNA, 22 bp, Homo sapiens
acttccagcacctcaagcggaa

SEQ ID NO: 9247663 - DNA, 22 bp, Homo sapiens
acttccagcccctgtcagcaaa

SEQ ID NO: 9247664 - DNA, 19 bp, Homo sapiens
ataaataaaaagtgggaga

SEQ ID NO: 9247665 - DNA, 19 bp, Homo sapiens
ataaataaaaagtgggaga

SEQ ID NO: 9247666 - DNA, 22 bp, Homo sapiens
ataaagtggaagtgttaaaggg

SEQ ID NO: 9247667 - DNA, 19 bp, Homo sapiens
ataaataaaaagtgggaga

SEQ ID NO: 9247668 - DNA, 21 bp, Homo sapiens
ataaagttttacaggaatgca

SEQ ID NO: 9247669 - DNA, 22 bp, Homo sapiens
acttcctgtgttggtcttgctg

SEQ ID NO: 9247670 - DNA, 22 bp, Homo sapiens
acttcctgggcatgcagagtcc

SEQ ID NO: 9247671 - DNA, 22 bp, Homo sapiens
acttcctgtaaatagaattcca

SEQ ID NO: 9247672 - DNA, 22 bp, Homo sapiens
acttccttttgggaaactgttt

SEQ ID NO: 9247673 - DNA, 22 bp, Homo sapiens
acttccttttcaaccatacagc

SEQ ID NO: 9247674 - DNA, 22 bp, Homo sapiens
acttccttttgggaaactgttt

SEQ ID NO: 9247675 - DNA, 22 bp, Homo sapiens
acttccttgtcaggtgcatcat

SEQ ID NO: 9247676 - DNA, 18 bp, Homo sapiens
acttctcatttctctgca

SEQ ID NO: 9247677 - DNA, 22 bp, Homo sapiens
acttctaagctcaaattggtat

SEQ ID NO: 9247678 - DNA, 22 bp, Homo sapiens
acttaaaaagaatcttttcacg

SEQ ID NO: 9247679 - DNA, 22 bp, Homo sapiens
acttaaagtagttttactgtgg

SEQ ID NO: 9247680 - DNA, 22 bp, Homo sapiens
acttaaaaccagacagcgtcat

SEQ ID NO: 9247681 - DNA, 22 bp, Homo sapiens
acttaaagaggctacttttggt

SEQ ID NO: 9247682 - DNA, 22 bp, Homo sapiens
ataaagtagctttcagtgccaa

SEQ ID NO: 9247683 - DNA, 22 bp, Homo sapiens
ataaagtagctttcagtgccaa

SEQ ID NO: 9247684 - DNA, 22 bp, Homo sapiens
actgttttgtgccttagtttcc

SEQ ID NO: 9247685 - DNA, 22 bp, Homo sapiens
agtttctaccggtacattcagg

SEQ ID NO: 9247686 - DNA, 22 bp, Homo sapiens
agttttaaatgatggtggtggt

SEQ ID NO: 9247687 - DNA, 21 bp, Homo sapiens
actgggctagcctgacttctg

SEQ ID NO: 9247688 - DNA, 22 bp, Homo sapiens
actgggccttgccatggcagcc

SEQ ID NO: 9247689 - DNA, 22 bp, Homo sapiens
agttttatgcagtgttctgata

SEQ ID NO: 9247690 - DNA, 22 bp, Homo sapiens
agttttatgcagtgttctgata

SEQ ID NO: 9247691 - DNA, 22 bp, Homo sapiens
agttttatggctcaacctaata

SEQ ID NO: 9247692 - DNA, 22 bp, Homo sapiens
agttttatgcagtgttctgata

SEQ ID NO: 9247693 - DNA, 21 bp, Homo sapiens
agttttatattataagctaaa

SEQ ID NO: 9247694 - DNA, 22 bp, Homo sapiens
agttttatctgtaagctgttca

SEQ ID NO: 9247695 - DNA, 22 bp, Homo sapiens
agttttataaaggcacctcagt

SEQ ID NO: 9247696 - DNA, 22 bp, Homo sapiens
agttttatatcttccattggtt

SEQ ID NO: 9247697 - DNA, 21 bp, Homo sapiens
agttttatattataagctaaa

SEQ ID NO: 9247698 - DNA, 22 bp, Homo sapiens
actgttatttgtaatccattat

SEQ ID NO: 9247699 - DNA, 22 bp, Homo sapiens
agtttttgagaatttactatgt

SEQ ID NO: 9247700 - DNA, 22 bp, Homo sapiens
ataaaaactgacccatcctttg

SEQ ID NO: 9247701 - DNA, 22 bp, Homo sapiens
agtttttctgctggtctcacta

SEQ ID NO: 9247702 - DNA, 22 bp, Homo sapiens
agtttttcctgattttacagaa

SEQ ID NO: 9247703 - DNA, 21 bp, Homo sapiens
agtttttactcttaactgtgg

SEQ ID NO: 9247704 - DNA, 21 bp, Homo sapiens
agtttttactcttaactgtgg

SEQ ID NO: 9247705 - DNA, 18 bp, Homo sapiens
agtttttaggaagaaatg

SEQ ID NO: 9247706 - DNA, 22 bp, Homo sapiens
agtttttccgtggctacgataa

SEQ ID NO: 9247707 - DNA, 23 bp, Homo sapiens
agtttttaatggtcatagctgag

SEQ ID NO: 9247708 - DNA, 22 bp, Homo sapiens
agttttatgtagacaattcatt

SEQ ID NO: 9247709 - DNA, 22 bp, Homo sapiens
agttttatgtagacaattcatt

SEQ ID NO: 9247710 - DNA, 22 bp, Homo sapiens
agttttatgttcacagaaggat

SEQ ID NO: 9247711 - DNA, 22 bp, Homo sapiens
actttaaaactgatcatcagag

SEQ ID NO: 9247712 - DNA, 22 bp, Homo sapiens
acttggttgatgtcataaggtt

SEQ ID NO: 9247713 - DNA, 22 bp, Homo sapiens
atacaaaatatatactggagac

SEQ ID NO: 9247714 - DNA, 22 bp, Homo sapiens
atacaaaatatatactggagac

SEQ ID NO: 9247715 - DNA, 22 bp, Homo sapiens
acttctcttcataggtggcaat

SEQ ID NO: 9247716 - DNA, 22 bp, Homo sapiens
acttctcttcataggtggcaat

SEQ ID NO: 9247717 - DNA, 22 bp, Homo sapiens
atacaaaaattagccgggagta

SEQ ID NO: 9247718 - DNA, 22 bp, Homo sapiens
atacatatccacaggagataaa

SEQ ID NO: 9247719 - DNA, 22 bp, Homo sapiens
atacatatccacaggagataaa

SEQ ID NO: 9247720 - DNA, 22 bp, Homo sapiens
atacatcacctatatattcaca

SEQ ID NO: 9247721 - DNA, 22 bp, Homo sapiens
atacatatgaatgatttggctc

SEQ ID NO: 9247722 - DNA, 22 bp, Homo sapiens
atacatatgaatgatttggctc

SEQ ID NO: 9247723 - DNA, 22 bp, Homo sapiens
atacatcaatttcttagttatc

SEQ ID NO: 9247724 - DNA, 22 bp, Homo sapiens
atacatcaaggatgatggtgta

SEQ ID NO: 9247725 - DNA, 22 bp, Homo sapiens
actttacaatatcctgtgactt

SEQ ID NO: 9247726 - DNA, 21 bp, Homo sapiens
actttacaatttacatagtga

SEQ ID NO: 9247727 - DNA, 22 bp, Homo sapiens
actttaaagcagaatggctatg

SEQ ID NO: 9247728 - DNA, 21 bp, Homo sapiens
actttaatatacatgaggagg

SEQ ID NO: 9247729 - DNA, 22 bp, Homo sapiens
atacatcatttatggaataagg

SEQ ID NO: 9247730 - DNA, 22 bp, Homo sapiens
atacatcatttcccatcaatcg

SEQ ID NO: 9247731 - DNA, 22 bp, Homo sapiens
atacatcatttatgatgtgtgt

SEQ ID NO: 9247732 - DNA, 22 bp, Homo sapiens
atacatcatttcccatcaatcg

SEQ ID NO: 9247733 - DNA, 22 bp, Homo sapiens
atacatcatgctccatatattt

SEQ ID NO: 9247734 - DNA, 22 bp, Homo sapiens
atacatcatgctccatatattt

SEQ ID NO: 9247735 - DNA, 22 bp, Homo sapiens
atacatctagagtcataaaaac

SEQ ID NO: 9247736 - DNA, 20 bp, Homo sapiens
actttctcggtttctcacct

SEQ ID NO: 9247737 - DNA, 22 bp, Homo sapiens
actttctgccttacaggagtcc

SEQ ID NO: 9247738 - DNA, 22 bp, Homo sapiens
actttctgcagtgttggaaatg

SEQ ID NO: 9247739 - DNA, 22 bp, Homo sapiens
actttgcaaataaactctctaa

SEQ ID NO: 9247740 - DNA, 22 bp, Homo sapiens
acttttcaaatgggaaactcag

SEQ ID NO: 9247741 - DNA, 22 bp, Homo sapiens
actttgtgcccaacagaaagaa

SEQ ID NO: 9247742 - DNA, 20 bp, Homo sapiens
atagatatcatctttagaag

SEQ ID NO: 9247743 - DNA, 20 bp, Homo sapiens
atagatatcatctttagaag

SEQ ID NO: 9247744 - DNA, 22 bp, Homo sapiens
atagatattagcaaaattttat

SEQ ID NO: 9247745 - DNA, 20 bp, Homo sapiens
atagatatcatctttagaag

SEQ ID NO: 9247746 - DNA, 22 bp, Homo sapiens
atagagtgatgtaaggtatgtg

SEQ ID NO: 9247747 - DNA, 22 bp, Homo sapiens
atagagtgatgtaaggtatgtg

SEQ ID NO: 9247748 - DNA, 22 bp, Homo sapiens
atagatacattaggtaacttgt

SEQ ID NO: 9247749 - DNA, 22 bp, Homo sapiens
actttggaataagctatataac

SEQ ID NO: 9247750 - DNA, 21 bp, Homo sapiens
atcccagcacccaggagtgca

SEQ ID NO: 9247751 - DNA, 22 bp, Homo sapiens
atcccagatggaggctggtcac

SEQ ID NO: 9247752 - DNA, 22 bp, Homo sapiens
atcccagatagtgaccctcagg

SEQ ID NO: 9247753 - DNA, 22 bp, Homo sapiens
atcccagatggaggctggtcac

SEQ ID NO: 9247754 - DNA, 22 bp, Homo sapiens
atcccagatagtgaccctcagg

SEQ ID NO: 9247755 - DNA, 19 bp, Homo sapiens
atcccaaggagctgggact

SEQ ID NO: 9247756 - DNA, 22 bp, Homo sapiens
atcccacacccctacaacatat

SEQ ID NO: 9247757 - DNA, 22 bp, Homo sapiens
atcccagagaataatgatcagg

SEQ ID NO: 9247758 - DNA, 22 bp, Homo sapiens
atccagctttgtctggtcttcg

SEQ ID NO: 9247759 - DNA, 22 bp, Homo sapiens
atccaggaaggatggcattgag

SEQ ID NO: 9247760 - DNA, 22 bp, Homo sapiens
atccagctttgtctggtcttcg

SEQ ID NO: 9247761 - DNA, 22 bp, Homo sapiens
agaaatctgactgctgtgcaca

SEQ ID NO: 9247762 - DNA, 20 bp, Homo sapiens
atccaggatgttgatttgaa

SEQ ID NO: 9247763 - DNA, 22 bp, Homo sapiens
agaaatctattatttcagagtt

SEQ ID NO: 9247764 - DNA, 22 bp, Homo sapiens
atctcagggctggagccctgga

SEQ ID NO: 9247765 - DNA, 22 bp, Homo sapiens
atctctggcccctggggtccga

SEQ ID NO: 9247766 - DNA, 22 bp, Homo sapiens
atctctggcaatgcagcatcgt

SEQ ID NO: 9247767 - DNA, 22 bp, Homo sapiens
agaacatctgaagatacaaagt

SEQ ID NO: 9247768 - DNA, 22 bp, Homo sapiens
agaacattaatgcgaggtatta

SEQ ID NO: 9247769 - DNA, 22 bp, Homo sapiens
agaacatttgtcaaaaagccaa

SEQ ID NO: 9247770 - DNA, 22 bp, Homo sapiens
agaacatttgtcgatcaatttg

SEQ ID NO: 9247771 - DNA, 22 bp, Homo sapiens
agaacatttgtcgatcaatttg

SEQ ID NO: 9247772 - DNA, 22 bp, Homo sapiens
atctctggttgttttgctccca

SEQ ID NO: 9247773 - DNA, 22 bp, Homo sapiens
atctctgggtccatagaagaga

SEQ ID NO: 9247774 - DNA, 22 bp, Homo sapiens
atctctggtccaaatgttacct

SEQ ID NO: 9247775 - DNA, 22 bp, Homo sapiens
atctctggccttccttttccaa

SEQ ID NO: 9247776 - DNA, 22 bp, Homo sapiens
atctctgggctttgagtttgtt

SEQ ID NO: 9247777 - DNA, 22 bp, Homo sapiens
atctctgtaattacatgatatt

SEQ ID NO: 9247778 - DNA, 22 bp, Homo sapiens
atctctgtaattacatgatatt

SEQ ID NO: 9247779 - DNA, 22 bp, Homo sapiens
agaagccacaggcctcgtctgg

SEQ ID NO: 9247780 - DNA, 22 bp, Homo sapiens
agaagccaattctgtgtgagtc

SEQ ID NO: 9247781 - DNA, 22 bp, Homo sapiens
agaagccaatccttgtctctct

SEQ ID NO: 9247782 - DNA, 22 bp, Homo sapiens
agaagccaattctgtgtgagtc

SEQ ID NO: 9247783 - DNA, 22 bp, Homo sapiens
agaagccaatccttgtctctct

SEQ ID NO: 9247784 - DNA, 22 bp, Homo sapiens
agaagccaacagggcaggagag

SEQ ID NO: 9247785 - DNA, 22 bp, Homo sapiens
atctctttgatggctcctgtga

SEQ ID NO: 9247786 - DNA, 22 bp, Homo sapiens
atctctttgatggctcctgtga

SEQ ID NO: 9247787 - DNA, 20 bp, Homo sapiens
agaagccaagtgacatgttt

SEQ ID NO: 9247788 - DNA, 22 bp, Homo sapiens
agaagccaatcagctctctgct

SEQ ID NO: 9247789 - DNA, 20 bp, Homo sapiens
agaaggcaggagacaaaagg

SEQ ID NO: 9247790 - DNA, 22 bp, Homo sapiens
atctgccaatgccatgagaaga

SEQ ID NO: 9247791 - DNA, 22 bp, Homo sapiens
agaaggcactcacactggcacg

SEQ ID NO: 9247792 - DNA, 22 bp, Homo sapiens
agaaggcagatgggacggagca

SEQ ID NO: 9247793 - DNA, 22 bp, Homo sapiens
agaaggagtgtacaggtcatgc

SEQ ID NO: 9247794 - DNA, 22 bp, Homo sapiens
agaaggcaccgtggccaatatt

SEQ ID NO: 9247795 - DNA, 22 bp, Homo sapiens
agaaggagtgtacaggtcatgc

SEQ ID NO: 9247796 - DNA, 19 bp, Homo sapiens
agaagctgtgaaatgaagg

SEQ ID NO: 9247797 - DNA, 19 bp, Homo sapiens
agaagctgtgaaatgaagg

SEQ ID NO: 9247798 - DNA, 23 bp, Homo sapiens
acttttcaattagctatgcttaa

SEQ ID NO: 9247799 - DNA, 22 bp, Homo sapiens
acttttctgcagatgatctctt

SEQ ID NO: 9247800 - DNA, 22 bp, Homo sapiens
actttttacagggtgtatacca

SEQ ID NO: 9247801 - DNA, 22 bp, Homo sapiens
actttttgctggtctcttccat

SEQ ID NO: 9247802 - DNA, 22 bp, Homo sapiens
actttttagtttcctcaaacat

SEQ ID NO: 9247803 - DNA, 22 bp, Homo sapiens
actttttagtttcctcaaacat

SEQ ID NO: 9247804 - DNA, 21 bp, Homo sapiens
agaaaaacacgatataagccc

SEQ ID NO: 9247805 - DNA, 21 bp, Homo sapiens
agaaaaacacgatataagccc

SEQ ID NO: 9247806 - DNA, 22 bp, Homo sapiens
atatttctccaaatgttttcaa

SEQ ID NO: 9247807 - DNA, 22 bp, Homo sapiens
agaaaaagtcaaggaattggac

SEQ ID NO: 9247808 - DNA, 22 bp, Homo sapiens
atattttggggtgatgtgcatc

SEQ ID NO: 9247809 - DNA, 21 bp, Homo sapiens
agaaaaaccagcatgttttca

SEQ ID NO: 9247810 - DNA, 22 bp, Homo sapiens
agaaaaagtcaaggaattggac

SEQ ID NO: 9247811 - DNA, 22 bp, Homo sapiens
atattttggtagctctcaatga

SEQ ID NO: 9247812 - DNA, 22 bp, Homo sapiens
atatttttccatgtgggactct

SEQ ID NO: 9247813 - DNA, 21 bp, Homo sapiens
atatttttgtttggactgtca

SEQ ID NO: 9247814 - DNA, 22 bp, Homo sapiens
atcaaaaccttgacttttaatg

SEQ ID NO: 9247815 - DNA, 22 bp, Homo sapiens
atcaaaaccttgacttttaatg

SEQ ID NO: 9247816 - DNA, 22 bp, Homo sapiens
agaaagcatctccattgtaggt

SEQ ID NO: 9247817 - DNA, 22 bp, Homo sapiens
agaaagcatctccattgtaggt

SEQ ID NO: 9247818 - DNA, 22 bp, Homo sapiens
agaaagcagcatttatgatctc

SEQ ID NO: 9247819 - DNA, 22 bp, Homo sapiens
agaaagcagtcccttccgaccg

SEQ ID NO: 9247820 - DNA, 22 bp, Homo sapiens
agaaagcccaggagaacagatt

SEQ ID NO: 9247821 - DNA, 22 bp, Homo sapiens
agaaagcccacccagaagatgt

SEQ ID NO: 9247822 - DNA, 22 bp, Homo sapiens
atcagcaatctcgtgtattagg

SEQ ID NO: 9247823 - DNA, 22 bp, Homo sapiens
agaaagcactctgtcttttacc

SEQ ID NO: 9247824 - DNA, 22 bp, Homo sapiens
agaaagcactctgtcttttacc

SEQ ID NO: 9247825 - DNA, 22 bp, Homo sapiens
agaaagcaccctgcactttctg

SEQ ID NO: 9247826 - DNA, 22 bp, Homo sapiens
agaaagcacagcgggtccattt

SEQ ID NO: 9247827 - DNA, 22 bp, Homo sapiens
atcaaaatgctccagtgatggt

SEQ ID NO: 9247828 - DNA, 20 bp, Homo sapiens
atcaaaatcctattgaggtt

SEQ ID NO: 9247829 - DNA, 17 bp, Homo sapiens
atcagtagcatatcaga

SEQ ID NO: 9247830 - DNA, 22 bp, Homo sapiens
atcagtgcttcatagccctggt

SEQ ID NO: 9247831 - DNA, 22 bp, Homo sapiens
atcagttatttttaagctataa

SEQ ID NO: 9247832 - DNA, 22 bp, Homo sapiens
atcagttatttttaagctataa

SEQ ID NO: 9247833 - DNA, 22 bp, Homo sapiens
agaaatcaggaacagtaaggag

SEQ ID NO: 9247834 - DNA, 22 bp, Homo sapiens
agaaatcatgtcttatttctat

SEQ ID NO: 9247835 - DNA, 22 bp, Homo sapiens
agaaatcatgtcttatttctat

SEQ ID NO: 9247836 - DNA, 22 bp, Homo sapiens
actgggcctgtacagagaaaac

SEQ ID NO: 9247837 - DNA, 22 bp, Homo sapiens
actgggcctggattggcgtgtc

SEQ ID NO: 9247838 - DNA, 22 bp, Homo sapiens
actgggccggtgcagagtagtt

SEQ ID NO: 9247839 - DNA, 22 bp, Homo sapiens
actgggccagatcagagcaact

SEQ ID NO: 9247840 - DNA, 22 bp, Homo sapiens
actgggcatcccatggcagagc

SEQ ID NO: 9247841 - DNA, 22 bp, Homo sapiens
actgggcattttgaacgttctt

SEQ ID NO: 9247842 - DNA, 22 bp, Homo sapiens
actgggcatgatgagtcaccta

SEQ ID NO: 9247843 - DNA, 22 bp, Homo sapiens
actggcttgaagtagattcaaa

SEQ ID NO: 9247844 - DNA, 22 bp, Homo sapiens
actggcttcagggggaaagtcc

SEQ ID NO: 9247845 - DNA, 22 bp, Homo sapiens
agtgtctcagccccaactagag

SEQ ID NO: 9247846 - DNA, 22 bp, Homo sapiens
actgggaggcaaagagcaagga

SEQ ID NO: 9247847 - DNA, 22 bp, Homo sapiens
actgggcagggaaggagaccga

SEQ ID NO: 9247848 - DNA, 22 bp, Homo sapiens
actgggcagcagctcgagccgc

SEQ ID NO: 9247849 - DNA, 22 bp, Homo sapiens
actgggcagggaaggagaccga

SEQ ID NO: 9247850 - DNA, 20 bp, Homo sapiens
actgggcatacctgtcctgt

SEQ ID NO: 9247851 - DNA, 21 bp, Homo sapiens
agtgtccttgatcttgccttg

SEQ ID NO: 9247852 - DNA, 22 bp, Homo sapiens
agtgtcctgtgtcccagactgt

SEQ ID NO: 9247853 - DNA, 21 bp, Homo sapiens
actggccaccactggcagggg

SEQ ID NO: 9247854 - DNA, 22 bp, Homo sapiens
actgcctgcctctgattctgca

SEQ ID NO: 9247855 - DNA, 22 bp, Homo sapiens
actgcctgcatccttagggtag

SEQ ID NO: 9247856 - DNA, 22 bp, Homo sapiens
actgcctgccttccaggtactg

SEQ ID NO: 9247857 - DNA, 23 bp, Homo sapiens
actgcctgctactatgcccacgg

SEQ ID NO: 9247858 - DNA, 19 bp, Homo sapiens
actgcctgcaggtgttggg

SEQ ID NO: 9247859 - DNA, 19 bp, Homo sapiens
actgcctgaggctcacagg

SEQ ID NO: 9247860 - DNA, 22 bp, Homo sapiens
actgcctggcagaggtttgcaa

SEQ ID NO: 9247861 - DNA, 22 bp, Homo sapiens
actgcctgctcctggctccaca

SEQ ID NO: 9247862 - DNA, 22 bp, Homo sapiens
actgcctggcctggcctcactg

SEQ ID NO: 9247863 - DNA, 22 bp, Homo sapiens
actgccagaggaggtatctgaa

SEQ ID NO: 9247864 - DNA, 23 bp, Homo sapiens
actgccagattgaaggtttctta

SEQ ID NO: 9247865 - DNA, 22 bp, Homo sapiens
actgccacctggtggtcctgga

SEQ ID NO: 9247866 - DNA, 22 bp, Homo sapiens
actgccacgttccaggcttagc

SEQ ID NO: 9247867 - DNA, 22 bp, Homo sapiens
actgccaatggtagtttgatgg

SEQ ID NO: 9247868 - DNA, 22 bp, Homo sapiens
actgcccagtgattggtggtta

SEQ ID NO: 9247869 - DNA, 22 bp, Homo sapiens
actgcccagaagagatgaaagt

SEQ ID NO: 9247870 - DNA, 22 bp, Homo sapiens
actgcccttgtcctggcacacc

SEQ ID NO: 9247871 - DNA, 22 bp, Homo sapiens
actgccctgtaactgccaggta

SEQ ID NO: 9247872 - DNA, 22 bp, Homo sapiens
actgcctcttggtgctgagaga

SEQ ID NO: 9247873 - DNA, 22 bp, Homo sapiens
actgcctcttggtgctgagaga

SEQ ID NO: 9247874 - DNA, 22 bp, Homo sapiens
actgagagcgtgtacaaactta

SEQ ID NO: 9247875 - DNA, 22 bp, Homo sapiens
actgagagcgtgtacaaactta

SEQ ID NO: 9247876 - DNA, 22 bp, Homo sapiens
actgagaggtgatagtgacatt

SEQ ID NO: 9247877 - DNA, 19 bp, Homo sapiens
agtgaactccatatcaggt

SEQ ID NO: 9247878 - DNA, 22 bp, Homo sapiens
agtgaagaggaagtggggcaca

SEQ ID NO: 9247879 - DNA, 22 bp, Homo sapiens
agtgaagaggaagtggggcaca

SEQ ID NO: 9247880 - DNA, 22 bp, Homo sapiens
agtgaacaaaggtagtgagcat

SEQ ID NO: 9247881 - DNA, 22 bp, Homo sapiens
agtgaacaaaggtagtgagcat

SEQ ID NO: 9247882 - DNA, 23 bp, Homo sapiens
actgagccagggcctgggtcagc

SEQ ID NO: 9247883 - DNA, 22 bp, Homo sapiens
actgagcataaatatgtgtcca

SEQ ID NO: 9247884 - DNA, 22 bp, Homo sapiens
agtgaaatttgtttagataggt

SEQ ID NO: 9247885 - DNA, 22 bp, Homo sapiens
agtgaaatttgtttagataggt

SEQ ID NO: 9247886 - DNA, 22 bp, Homo sapiens
actctgcctttcagcagatgaa

SEQ ID NO: 9247887 - DNA, 22 bp, Homo sapiens
actctgccccgagttctgggaa

SEQ ID NO: 9247888 - DNA, 22 bp, Homo sapiens
actctgccatcccaggtgctgt

SEQ ID NO: 9247889 - DNA, 21 bp, Homo sapiens
actctgaaaattaatagttat

SEQ ID NO: 9247890 - DNA, 22 bp, Homo sapiens
actctgaaccagagatcatacc

SEQ ID NO: 9247891 - DNA, 22 bp, Homo sapiens
actctgaaccagagatcatacc

SEQ ID NO: 9247892 - DNA, 22 bp, Homo sapiens
actctgaaccagagatcatacc

SEQ ID NO: 9247893 - DNA, 22 bp, Homo sapiens
actctgaattaattgctctcaa

SEQ ID NO: 9247894 - DNA, 22 bp, Homo sapiens
actctgagcatcccaagtctta

SEQ ID NO: 9247895 - DNA, 19 bp, Homo sapiens
actctgaggctgagacaag

SEQ ID NO: 9247896 - DNA, 22 bp, Homo sapiens
actctgaggagtgactagaggt

SEQ ID NO: 9247897 - DNA, 22 bp, Homo sapiens
actgcactccagcctgggtgat

SEQ ID NO: 9247898 - DNA, 22 bp, Homo sapiens
actgcaccttgcggtcctgtgg

SEQ ID NO: 9247899 - DNA, 20 bp, Homo sapiens
agtgaatagagacattgccc

SEQ ID NO: 9247900 - DNA, 20 bp, Homo sapiens
agtgaatagagacattgccc

SEQ ID NO: 9247901 - DNA, 22 bp, Homo sapiens
agtgaagctaacctgctgattt

SEQ ID NO: 9247902 - DNA, 22 bp, Homo sapiens
agtgaagcccatttttagctgt

SEQ ID NO: 9247903 - DNA, 22 bp, Homo sapiens
agtgaagccccgatgcgttttg

SEQ ID NO: 9247904 - DNA, 21 bp, Homo sapiens
agtgaagagtgaaacacatgg

SEQ ID NO: 9247905 - DNA, 22 bp, Homo sapiens
agtgctccctagagttgtgcaa

SEQ ID NO: 9247906 - DNA, 22 bp, Homo sapiens
actgcacttcaccctgggtgac

SEQ ID NO: 9247907 - DNA, 22 bp, Homo sapiens
agtgctctctccccagtgctac

SEQ ID NO: 9247908 - DNA, 22 bp, Homo sapiens
agtgctctgatctccttgggtt

SEQ ID NO: 9247909 - DNA, 22 bp, Homo sapiens
agtgctctgggtccactccaga

SEQ ID NO: 9247910 - DNA, 22 bp, Homo sapiens
agtgctctaacagtcaaaaaag

SEQ ID NO: 9247911 - DNA, 22 bp, Homo sapiens
agtgctcctttcattgctgccc

SEQ ID NO: 9247912 - DNA, 22 bp, Homo sapiens
actgcagcctagggaccacagt

SEQ ID NO: 9247913 - DNA, 22 bp, Homo sapiens
actactgaatattagttctgaa

SEQ ID NO: 9247914 - DNA, 22 bp, Homo sapiens
actacagtgtgataagaggggc

SEQ ID NO: 9247915 - DNA, 22 bp, Homo sapiens
aggtgactggtttatctggcag

SEQ ID NO: 9247916 - DNA, 22 bp, Homo sapiens
actaaatatttgagaggtgtag

SEQ ID NO: 9247917 - DNA, 22 bp, Homo sapiens
aggtgagaaaacgagggttgca

SEQ ID NO: 9247918 - DNA, 22 bp, Homo sapiens
actacagtccctcatatgttgg

SEQ ID NO: 9247919 - DNA, 22 bp, Homo sapiens
actacagtaagggaggcagcat

SEQ ID NO: 9247920 - DNA, 22 bp, Homo sapiens
actaaatatttgagaggtgtag

SEQ ID NO: 9247921 - DNA, 23 bp, Homo sapiens
actacagatactcctgctgtttg

SEQ ID NO: 9247922 - DNA, 22 bp, Homo sapiens
aggtgggcactccgctcgaggt

SEQ ID NO: 9247923 - DNA, 21 bp, Homo sapiens
aggtgggcaggtggagtggcc

SEQ ID NO: 9247924 - DNA, 22 bp, Homo sapiens
aggtgggcactccgctcgaggt

SEQ ID NO: 9247925 - DNA, 22 bp, Homo sapiens
aggtgggcaccaggcttgtggt

SEQ ID NO: 9247926 - DNA, 22 bp, Homo sapiens
actagaaagtttccagagttat

SEQ ID NO: 9247927 - DNA, 23 bp, Homo sapiens
actagaaaatgactttctccctg

SEQ ID NO: 9247928 - DNA, 22 bp, Homo sapiens
actagaaaattcctagaaacta

SEQ ID NO: 9247929 - DNA, 22 bp, Homo sapiens
aggtgacatcccggcagcagag

SEQ ID NO: 9247930 - DNA, 22 bp, Homo sapiens
aggtgacaggacaggagctggt

SEQ ID NO: 9247931 - DNA, 22 bp, Homo sapiens
aggtgaatgctcacattctaat

SEQ ID NO: 9247932 - DNA, 22 bp, Homo sapiens
aggtgacaggacaggagctggt

SEQ ID NO: 9247933 - DNA, 22 bp, Homo sapiens
aggtgaagttgaggaggcagaa

SEQ ID NO: 9247934 - DNA, 22 bp, Homo sapiens
accttttttcagaactctaaag

SEQ ID NO: 9247935 - DNA, 22 bp, Homo sapiens
acctttttgttctgttctcagc

SEQ ID NO: 9247936 - DNA, 21 bp, Homo sapiens
acctttgggtgtttataatag

SEQ ID NO: 9247937 - DNA, 22 bp, Homo sapiens
aggtccacagttcagctgccca

SEQ ID NO: 9247938 - DNA, 22 bp, Homo sapiens
aggtcaagagtaaatttgggta

SEQ ID NO: 9247939 - DNA, 22 bp, Homo sapiens
aggtcaagagtaaatttgggta

SEQ ID NO: 9247940 - DNA, 22 bp, Homo sapiens
aggtatttatgagagcacatat

SEQ ID NO: 9247941 - DNA, 22 bp, Homo sapiens
aggtattttatagataagtaaa

SEQ ID NO: 9247942 - DNA, 22 bp, Homo sapiens
accctttagaaggcatctcagt

SEQ ID NO: 9247943 - DNA, 19 bp, Homo sapiens
aggtagctcagactcaaag

SEQ ID NO: 9247944 - DNA, 22 bp, Homo sapiens
aggtaggagttgatggatgttc

SEQ ID NO: 9247945 - DNA, 22 bp, Homo sapiens
aggtaggaaagtctccttgtat

SEQ ID NO: 9247946 - DNA, 22 bp, Homo sapiens
aggtaggaaagtctccttgtat

SEQ ID NO: 9247947 - DNA, 20 bp, Homo sapiens
acctttcaaatgattcagca

SEQ ID NO: 9247948 - DNA, 22 bp, Homo sapiens
acctttcaaagtggctatcact

SEQ ID NO: 9247949 - DNA, 22 bp, Homo sapiens
acctttcattaaagtctgtagt

SEQ ID NO: 9247950 - DNA, 22 bp, Homo sapiens
acctttcacggtatcagacatc

SEQ ID NO: 9247951 - DNA, 22 bp, Homo sapiens
acctttgacgctatttaatttg

SEQ ID NO: 9247952 - DNA, 22 bp, Homo sapiens
acctttcgtcctggttcctccg

SEQ ID NO: 9247953 - DNA, 19 bp, Homo sapiens
acctttgagaagaaatgtc

SEQ ID NO: 9247954 - DNA, 20 bp, Homo sapiens
aggtccactgaggctgcctc

SEQ ID NO: 9247955 - DNA, 20 bp, Homo sapiens
aggtccactgaggctgcctc

SEQ ID NO: 9247956 - DNA, 22 bp, Homo sapiens
aggtccaggttccgtttctgcg

SEQ ID NO: 9247957 - DNA, 23 bp, Homo sapiens
agtacattcgaaaaattctgtga

SEQ ID NO: 9247958 - DNA, 22 bp, Homo sapiens
agtacatttattaatggtaaaa

SEQ ID NO: 9247959 - DNA, 22 bp, Homo sapiens
agtaccattactcacttatttt

SEQ ID NO: 9247960 - DNA, 22 bp, Homo sapiens
agtaccattatccagtaaagga

SEQ ID NO: 9247961 - DNA, 22 bp, Homo sapiens
agtaccatgcttcctgactggt

SEQ ID NO: 9247962 - DNA, 23 bp, Homo sapiens
agtacatttgacccaaataagct

SEQ ID NO: 9247963 - DNA, 22 bp, Homo sapiens
aggtggggaaaccagcgatccc

SEQ ID NO: 9247964 - DNA, 22 bp, Homo sapiens
aggtggggaaaccagcgatccc

SEQ ID NO: 9247965 - DNA, 22 bp, Homo sapiens
agtaataatagctgtaaagtgc

SEQ ID NO: 9247966 - DNA, 22 bp, Homo sapiens
aggtggggaaaccagcgatccc

SEQ ID NO: 9247967 - DNA, 22 bp, Homo sapiens
aggtgggcggattcatgaggtc

SEQ ID NO: 9247968 - DNA, 22 bp, Homo sapiens
aggtgggcggattcatgaggtc

SEQ ID NO: 9247969 - DNA, 22 bp, Homo sapiens
aggtgggcccagtgggctccag

SEQ ID NO: 9247970 - DNA, 22 bp, Homo sapiens
aggtgggcatagctagaatatt

SEQ ID NO: 9247971 - DNA, 21 bp, Homo sapiens
aggtgggcaggtggagtggcc

SEQ ID NO: 9247972 - DNA, 22 bp, Homo sapiens
aggtgggcggattcatgaggtc

SEQ ID NO: 9247973 - DNA, 22 bp, Homo sapiens
aggtgggcggatcacaaggtca

SEQ ID NO: 9247974 - DNA, 22 bp, Homo sapiens
agtagtggcttcctggagtgct

SEQ ID NO: 9247975 - DNA, 22 bp, Homo sapiens
agtagtggggccagggtttgaa

SEQ ID NO: 9247976 - DNA, 22 bp, Homo sapiens
agtagaaagttgcaggaggaat

SEQ ID NO: 9247977 - DNA, 22 bp, Homo sapiens
agtagaaagaaggcactgggcc

SEQ ID NO: 9247978 - DNA, 20 bp, Homo sapiens
agtaccttttgtatgttacc

SEQ ID NO: 9247979 - DNA, 22 bp, Homo sapiens
agtactttacttcttacagttt

SEQ ID NO: 9247980 - DNA, 22 bp, Homo sapiens
agtacttagaaagttaatataa

SEQ ID NO: 9247981 - DNA, 22 bp, Homo sapiens
agtactttgcactttgctcaga

SEQ ID NO: 9247982 - DNA, 22 bp, Homo sapiens
agtatacatagagatggctgtt

SEQ ID NO: 9247983 - DNA, 22 bp, Homo sapiens
agtataaagtggttttcagcac

SEQ ID NO: 9247984 - DNA, 22 bp, Homo sapiens
agtataatgaaatgtgtcagta

SEQ ID NO: 9247985 - DNA, 22 bp, Homo sapiens
agtataattagatatcaaaagt

SEQ ID NO: 9247986 - DNA, 22 bp, Homo sapiens
agtataatttacatttggtatt

SEQ ID NO: 9247987 - DNA, 22 bp, Homo sapiens
agtagtttgggcagtgacagat

SEQ ID NO: 9247988 - DNA, 22 bp, Homo sapiens
agtcacttccagacacctgcct

SEQ ID NO: 9247989 - DNA, 22 bp, Homo sapiens
agtcacttccagacacctgcct

SEQ ID NO: 9247990 - DNA, 22 bp, Homo sapiens
agtcactgggctgcttcctata

SEQ ID NO: 9247991 - DNA, 22 bp, Homo sapiens
agtcactggttctgtaattaat

SEQ ID NO: 9247992 - DNA, 22 bp, Homo sapiens
actctccttttgatcttcagaa

SEQ ID NO: 9247993 - DNA, 22 bp, Homo sapiens
actctctcacagcttggctgat

SEQ ID NO: 9247994 - DNA, 22 bp, Homo sapiens
actctctcacagcttggctgat

SEQ ID NO: 9247995 - DNA, 22 bp, Homo sapiens
actctctcacacacgcctatat

SEQ ID NO: 9247996 - DNA, 22 bp, Homo sapiens
actctccttttgatcttcagaa

SEQ ID NO: 9247997 - DNA, 22 bp, Homo sapiens
actctctgggcatgccccacca

SEQ ID NO: 9247998 - DNA, 22 bp, Homo sapiens
actctctgagctaccaggtgag

SEQ ID NO: 9247999 - DNA, 22 bp, Homo sapiens
actctctggtgtagaaagacct

SEQ ID NO: 9248000 - DNA, 22 bp, Homo sapiens
actctctggtgtagaaagacct

SEQ ID NO: 9248001 - DNA, 22 bp, Homo sapiens
actctctgtgatggaggccagc

SEQ ID NO: 9248002 - DNA, 22 bp, Homo sapiens
actctcttgggggagagcagag

SEQ ID NO: 9248003 - DNA, 22 bp, Homo sapiens
actctctgtgatggaggccagc

SEQ ID NO: 9248004 - DNA, 22 bp, Homo sapiens
actctctgtctaaatgcagttt

SEQ ID NO: 9248005 - DNA, 22 bp, Homo sapiens
actcccttgtgaactcattctt

SEQ ID NO: 9248006 - DNA, 22 bp, Homo sapiens
actcctcagccagcatcaggga

SEQ ID NO: 9248007 - DNA, 21 bp, Homo sapiens
actccctgcataagtgattta

SEQ ID NO: 9248008 - DNA, 22 bp, Homo sapiens
actcctgggtgctgaccagcgt

SEQ ID NO: 9248009 - DNA, 22 bp, Homo sapiens
agtcaccatctgtggcagcctg

SEQ ID NO: 9248010 - DNA, 22 bp, Homo sapiens
agtcaccctccaactctccact

SEQ ID NO: 9248011 - DNA, 22 bp, Homo sapiens
agtcaccttgaaatgtcttgaa

SEQ ID NO: 9248012 - DNA, 22 bp, Homo sapiens
actcctggggatccattccttt

SEQ ID NO: 9248013 - DNA, 20 bp, Homo sapiens
accccagcccctctatctga

SEQ ID NO: 9248014 - DNA, 22 bp, Homo sapiens
accccagccctgcttctgggag

SEQ ID NO: 9248015 - DNA, 22 bp, Homo sapiens
accccagaggcggaggctgcag

SEQ ID NO: 9248016 - DNA, 22 bp, Homo sapiens
acccatgtgctcttttgtaccc

SEQ ID NO: 9248017 - DNA, 22 bp, Homo sapiens
accctgggacctggaggtggat

SEQ ID NO: 9248018 - DNA, 22 bp, Homo sapiens
accctgggtatttcccaaactt

SEQ ID NO: 9248019 - DNA, 22 bp, Homo sapiens
accctgggtcatatacagtgtg

SEQ ID NO: 9248020 - DNA, 22 bp, Homo sapiens
accctgggttcccgcagcacca

SEQ ID NO: 9248021 - DNA, 22 bp, Homo sapiens
accctgggtgagaggcaaacag

SEQ ID NO: 9248022 - DNA, 22 bp, Homo sapiens
acccacagccgctgtgcgtccc

SEQ ID NO: 9248023 - DNA, 22 bp, Homo sapiens
agggcctgagctctcctccagt

SEQ ID NO: 9248024 - DNA, 22 bp, Homo sapiens
acccacgaagatgagcggcatg

SEQ ID NO: 9248025 - DNA, 22 bp, Homo sapiens
acccacgaagatgagcggcatg

SEQ ID NO: 9248026 - DNA, 22 bp, Homo sapiens
acccagagaactgtgccttgag

SEQ ID NO: 9248027 - DNA, 22 bp, Homo sapiens
agggcctgagaccgtggcttga

SEQ ID NO: 9248028 - DNA, 22 bp, Homo sapiens
agggcctgagaccgtggcttga

SEQ ID NO: 9248029 - DNA, 22 bp, Homo sapiens
agggcctgacacccttgccagc

SEQ ID NO: 9248030 - DNA, 22 bp, Homo sapiens
agggcctgagaccgtggcttga

SEQ ID NO: 9248031 - DNA, 22 bp, Homo sapiens
acccagagcacagatgcaacgt

SEQ ID NO: 9248032 - DNA, 22 bp, Homo sapiens
acccagggaccccgctgacgcc

SEQ ID NO: 9248033 - DNA, 22 bp, Homo sapiens
acccagggtagaacctcagagc

SEQ ID NO: 9248034 - DNA, 22 bp, Homo sapiens
acccagggagtgctcctgttct

SEQ ID NO: 9248035 - DNA, 22 bp, Homo sapiens
acccagggtagagtgcagtggc

SEQ ID NO: 9248036 - DNA, 22 bp, Homo sapiens
acccagggtagagtgcagtggc

SEQ ID NO: 9248037 - DNA, 22 bp, Homo sapiens
acccagggtagagtgcagtggc

SEQ ID NO: 9248038 - DNA, 22 bp, Homo sapiens
acccagggtcaccccgtagggt

SEQ ID NO: 9248039 - DNA, 22 bp, Homo sapiens
acccagggtagagtgcagtggc

SEQ ID NO: 9248040 - DNA, 22 bp, Homo sapiens
acccaggtggctctgacggggg

SEQ ID NO: 9248041 - DNA, 22 bp, Homo sapiens
acccagtcatcctggtgtgaga

SEQ ID NO: 9248042 - DNA, 22 bp, Homo sapiens
acccagggtttgagctctgcag

SEQ ID NO: 9248043 - DNA, 22 bp, Homo sapiens
acccagggtttgagctctgcag

SEQ ID NO: 9248044 - DNA, 22 bp, Homo sapiens
acccagtgacatcctttacctg

SEQ ID NO: 9248045 - DNA, 22 bp, Homo sapiens
acccagtctggagtgcagtgac

SEQ ID NO: 9248046 - DNA, 18 bp, Homo sapiens
acccagtttgaaggaaag

SEQ ID NO: 9248047 - DNA, 22 bp, Homo sapiens
acccagggttcctgggtcccag

SEQ ID NO: 9248048 - DNA, 22 bp, Homo sapiens
acccagggtcaccccgtagggt

SEQ ID NO: 9248049 - DNA, 22 bp, Homo sapiens
acccagggttcctgggtcccag

SEQ ID NO: 9248050 - DNA, 19 bp, Homo sapiens
acccagggttgatgtccag

SEQ ID NO: 9248051 - DNA, 19 bp, Homo sapiens
acccagggttgatgtccag

SEQ ID NO: 9248052 - DNA, 22 bp, Homo sapiens
acccagggtttgagctctgcag

SEQ ID NO: 9248053 - DNA, 19 bp, Homo sapiens
acccagggttgatgtccag

SEQ ID NO: 9248054 - DNA, 18 bp, Homo sapiens
accaggaagcttcttgtc

SEQ ID NO: 9248055 - DNA, 19 bp, Homo sapiens
accaggaacttccctaggc

SEQ ID NO: 9248056 - DNA, 19 bp, Homo sapiens
accaggagacagtgagctt

SEQ ID NO: 9248057 - DNA, 20 bp, Homo sapiens
accaggagatggaggcaggg

SEQ ID NO: 9248058 - DNA, 22 bp, Homo sapiens
accaggactttgtattcagctt

SEQ ID NO: 9248059 - DNA, 22 bp, Homo sapiens
accaggactttgtattcagctt

SEQ ID NO: 9248060 - DNA, 22 bp, Homo sapiens
accaggaggcctggagcacaaa

SEQ ID NO: 9248061 - DNA, 22 bp, Homo sapiens
accaggagccatagagtcaggc

SEQ ID NO: 9248062 - DNA, 20 bp, Homo sapiens
accaggagatggaggcaggg

SEQ ID NO: 9248063 - DNA, 22 bp, Homo sapiens
accaggagccacaggaggagcc

SEQ ID NO: 9248064 - DNA, 22 bp, Homo sapiens
accaggagccacaggaggagcc

SEQ ID NO: 9248065 - DNA, 23 bp, Homo sapiens
accaggagccaagatctccctgg

SEQ ID NO: 9248066 - DNA, 22 bp, Homo sapiens
accaggagccacaggaggagcc

SEQ ID NO: 9248067 - DNA, 23 bp, Homo sapiens
accaacaagcctctggagagtgg

SEQ ID NO: 9248068 - DNA, 22 bp, Homo sapiens
accaacttgcagccaaatttga

SEQ ID NO: 9248069 - DNA, 22 bp, Homo sapiens
accaagcacaaagatgagtaaa

SEQ ID NO: 9248070 - DNA, 22 bp, Homo sapiens
accagctctttcttttcactat

SEQ ID NO: 9248071 - DNA, 22 bp, Homo sapiens
accagctctttcttttcactat

SEQ ID NO: 9248072 - DNA, 22 bp, Homo sapiens
accagctcttctgctctagttg

SEQ ID NO: 9248073 - DNA, 22 bp, Homo sapiens
accatacattaaatgactttca

SEQ ID NO: 9248074 - DNA, 22 bp, Homo sapiens
accagtgcttcctgctggagct

SEQ ID NO: 9248075 - DNA, 20 bp, Homo sapiens
accaggtggctgatgacacc

SEQ ID NO: 9248076 - DNA, 22 bp, Homo sapiens
accagtccgcggagctccgggg

SEQ ID NO: 9248077 - DNA, 22 bp, Homo sapiens
accaggagtaacagtgagtggt

SEQ ID NO: 9248078 - DNA, 22 bp, Homo sapiens
accaggagggaccctggtggcc

SEQ ID NO: 9248079 - DNA, 22 bp, Homo sapiens
accaggagggaccctggtggcc

SEQ ID NO: 9248080 - DNA, 22 bp, Homo sapiens
accaggagtagaatatctgtga

SEQ ID NO: 9248081 - DNA, 22 bp, Homo sapiens
accaggagtctagcctagtcaa

SEQ ID NO: 9248082 - DNA, 22 bp, Homo sapiens
accaggagttgggggtgggacc

SEQ ID NO: 9248083 - DNA, 22 bp, Homo sapiens
accaggctgtgaagtgagacta

SEQ ID NO: 9248084 - DNA, 22 bp, Homo sapiens
accagggcagccgaggtgtgtc

SEQ ID NO: 9248085 - DNA, 22 bp, Homo sapiens
accaggctgtgaagtgagacta

SEQ ID NO: 9248086 - DNA, 22 bp, Homo sapiens
accagggcacattccggccaga

SEQ ID NO: 9248087 - DNA, 22 bp, Homo sapiens
accagggcggcttgaggaggca

SEQ ID NO: 9248088 - DNA, 22 bp, Homo sapiens
accagggcggcttgaggaggca

SEQ ID NO: 9248089 - DNA, 22 bp, Homo sapiens
accagggcggcttgaggaggca

SEQ ID NO: 9248090 - DNA, 22 bp, Homo sapiens
accagggcccgggagagctctc

SEQ ID NO: 9248091 - DNA, 22 bp, Homo sapiens
accagggttgagtcagctgcgt

SEQ ID NO: 9248092 - DNA, 22 bp, Homo sapiens
accaggggtgtcaacagcattt

SEQ ID NO: 9248093 - DNA, 22 bp, Homo sapiens
accagggctgggataggtcagg

SEQ ID NO: 9248094 - DNA, 22 bp, Homo sapiens
accagggcttacagcagtagct

SEQ ID NO: 9248095 - DNA, 22 bp, Homo sapiens
aggcatggggctgcagtcaggt

SEQ ID NO: 9248096 - DNA, 22 bp, Homo sapiens
aggcatggggctgcagtcaggt

SEQ ID NO: 9248097 - DNA, 22 bp, Homo sapiens
aggcatggctttaggcaggcgt

SEQ ID NO: 9248098 - DNA, 22 bp, Homo sapiens
acatacatgggattaaaaaatt

SEQ ID NO: 9248099 - DNA, 22 bp, Homo sapiens
acatacatggtgctttcttggt

SEQ ID NO: 9248100 - DNA, 22 bp, Homo sapiens
acatacatgggattaaaaaatt

SEQ ID NO: 9248101 - DNA, 22 bp, Homo sapiens
acatacatggtgctttcttggt

SEQ ID NO: 9248102 - DNA, 22 bp, Homo sapiens
acatacatgggattaaaaaatt

SEQ ID NO: 9248103 - DNA, 22 bp, Homo sapiens
acatacatggattcatggattc

SEQ ID NO: 9248104 - DNA, 22 bp, Homo sapiens
aggcatggctttaggcaggcgt

SEQ ID NO: 9248105 - DNA, 22 bp, Homo sapiens
aggcatggcatggggcagatgt

SEQ ID NO: 9248106 - DNA, 20 bp, Homo sapiens
aggcagttagaaggagatga

SEQ ID NO: 9248107 - DNA, 22 bp, Homo sapiens
acatacatggtgctttcttggt

SEQ ID NO: 9248108 - DNA, 22 bp, Homo sapiens
acatacatggttctcagccctt

SEQ ID NO: 9248109 - DNA, 22 bp, Homo sapiens
acatacatgtaaaggaaattat

SEQ ID NO: 9248110 - DNA, 22 bp, Homo sapiens
acatacatgtaaaggaaattat

SEQ ID NO: 9248111 - DNA, 22 bp, Homo sapiens
aggccacacaactcttagagat

SEQ ID NO: 9248112 - DNA, 18 bp, Homo sapiens
aggccacactccagaaca

SEQ ID NO: 9248113 - DNA, 22 bp, Homo sapiens
aggccacagagagtgcatgtgc

SEQ ID NO: 9248114 - DNA, 22 bp, Homo sapiens
aggccacagagagtgcatgtgc

SEQ ID NO: 9248115 - DNA, 22 bp, Homo sapiens
aggccacagatactgtgaagta

SEQ ID NO: 9248116 - DNA, 22 bp, Homo sapiens
aggcatgtatatgtgcacatgt

SEQ ID NO: 9248117 - DNA, 22 bp, Homo sapiens
aggccacaagaactaccccatc

SEQ ID NO: 9248118 - DNA, 22 bp, Homo sapiens
aggccacaggcaccctgtgttc

SEQ ID NO: 9248119 - DNA, 22 bp, Homo sapiens
aggccacaggattgcacagcat

SEQ ID NO: 9248120 - DNA, 22 bp, Homo sapiens
aggccacaggtggaagccagag

SEQ ID NO: 9248121 - DNA, 22 bp, Homo sapiens
aggccacaggtggaagccagag

SEQ ID NO: 9248122 - DNA, 22 bp, Homo sapiens
aggccacaggattgcacagcat

SEQ ID NO: 9248123 - DNA, 22 bp, Homo sapiens
aggccacaggcaccctgtgttc

SEQ ID NO: 9248124 - DNA, 22 bp, Homo sapiens
aggccacaggcaccctgtgttc

SEQ ID NO: 9248125 - DNA, 22 bp, Homo sapiens
aggccacagcctgggaggtgac

SEQ ID NO: 9248126 - DNA, 22 bp, Homo sapiens
aggccacagcctgggaggtgac

SEQ ID NO: 9248127 - DNA, 22 bp, Homo sapiens
aggcccagcttgaagtgggaag

SEQ ID NO: 9248128 - DNA, 21 bp, Homo sapiens
aggcccagctttcctcttgct

SEQ ID NO: 9248129 - DNA, 22 bp, Homo sapiens
aggccagggtcccacactcgca

SEQ ID NO: 9248130 - DNA, 22 bp, Homo sapiens
aggccagggtcccacactcgca

SEQ ID NO: 9248131 - DNA, 22 bp, Homo sapiens
acatgaaacctgagtctaactc

SEQ ID NO: 9248132 - DNA, 22 bp, Homo sapiens
aggccctgagcatccgagggca

SEQ ID NO: 9248133 - DNA, 22 bp, Homo sapiens
aggcccagggctgctctctgaa

SEQ ID NO: 9248134 - DNA, 18 bp, Homo sapiens
aggccagccctgctactg

SEQ ID NO: 9248135 - DNA, 22 bp, Homo sapiens
acatctttttggaaacggctga

SEQ ID NO: 9248136 - DNA, 22 bp, Homo sapiens
acatcttttttctctaattgtg

SEQ ID NO: 9248137 - DNA, 22 bp, Homo sapiens
acatctttgtttcttagtgtat

SEQ ID NO: 9248138 - DNA, 22 bp, Homo sapiens
acatctttgctcttatagagct

SEQ ID NO: 9248139 - DNA, 22 bp, Homo sapiens
acatgaaaagactatctgatta

SEQ ID NO: 9248140 - DNA, 22 bp, Homo sapiens
acatgaaaactggttccttcag

SEQ ID NO: 9248141 - DNA, 22 bp, Homo sapiens
acattctttgagttttgttaaa

SEQ ID NO: 9248142 - DNA, 22 bp, Homo sapiens
acattcttgaagtgaagtttat

SEQ ID NO: 9248143 - DNA, 22 bp, Homo sapiens
acattctatgaagataatttta

SEQ ID NO: 9248144 - DNA, 22 bp, Homo sapiens
acattctagatatgttatattt

SEQ ID NO: 9248145 - DNA, 22 bp, Homo sapiens
acattctagatatgttatattt

SEQ ID NO: 9248146 - DNA, 22 bp, Homo sapiens
acattctagatatgttatattt

SEQ ID NO: 9248147 - DNA, 22 bp, Homo sapiens
acattctagatatgttatattt

SEQ ID NO: 9248148 - DNA, 22 bp, Homo sapiens
acattctagaagtctttgcaat

SEQ ID NO: 9248149 - DNA, 22 bp, Homo sapiens
acattctaacattgtacagata

SEQ ID NO: 9248150 - DNA, 22 bp, Homo sapiens
acattctaaagcatgctcagga

SEQ ID NO: 9248151 - DNA, 22 bp, Homo sapiens
acattcctttcttgagcacagt

SEQ ID NO: 9248152 - DNA, 22 bp, Homo sapiens
acattcctgccataaatttttt

SEQ ID NO: 9248153 - DNA, 22 bp, Homo sapiens
acattcctgaggaaatacattc

SEQ ID NO: 9248154 - DNA, 22 bp, Homo sapiens
acattcctgaggaaatacattc

SEQ ID NO: 9248155 - DNA, 22 bp, Homo sapiens
acattcctgcctccccggagat

SEQ ID NO: 9248156 - DNA, 22 bp, Homo sapiens
acattcctgccataaatttttt

SEQ ID NO: 9248157 - DNA, 22 bp, Homo sapiens
acattcctcagtgccagttgag

SEQ ID NO: 9248158 - DNA, 22 bp, Homo sapiens
acattcctcagtgccagttgag

SEQ ID NO: 9248159 - DNA, 22 bp, Homo sapiens
acattcctacctgctcgggtgt

SEQ ID NO: 9248160 - DNA, 22 bp, Homo sapiens
acattcctgaatgggcacattt

SEQ ID NO: 9248161 - DNA, 22 bp, Homo sapiens
acattcctgaatgggcacattt

SEQ ID NO: 9248162 - DNA, 22 bp, Homo sapiens
acattcccttggcttgaagcag

SEQ ID NO: 9248163 - DNA, 22 bp, Homo sapiens
acattcattgagcaacaacaat

SEQ ID NO: 9248164 - DNA, 22 bp, Homo sapiens
aggccctgcaggaagcaggatg

SEQ ID NO: 9248165 - DNA, 22 bp, Homo sapiens
aggccctgcaggaagcaggatg

SEQ ID NO: 9248166 - DNA, 22 bp, Homo sapiens
aggccctgcaggagtggggaca

SEQ ID NO: 9248167 - DNA, 22 bp, Homo sapiens
aggccctgcattgtactgaggg

SEQ ID NO: 9248168 - DNA, 20 bp, Homo sapiens
aggccctgccagggacggag

SEQ ID NO: 9248169 - DNA, 22 bp, Homo sapiens
acattcatgcaccttcctatcc

SEQ ID NO: 9248170 - DNA, 22 bp, Homo sapiens
acattcatgggttttacattat

SEQ ID NO: 9248171 - DNA, 22 bp, Homo sapiens
acattcactatgtccaaactct

SEQ ID NO: 9248172 - DNA, 22 bp, Homo sapiens
acattcatgtcccacttctagc

SEQ ID NO: 9248173 - DNA, 22 bp, Homo sapiens
acattcatgtcccacttctagc

SEQ ID NO: 9248174 - DNA, 22 bp, Homo sapiens
acattcattccaggtcagtcag

SEQ ID NO: 9248175 - DNA, 22 bp, Homo sapiens
acattcattccaggtcagtcag

SEQ ID NO: 9248176 - DNA, 22 bp, Homo sapiens
acattcaaggccttctgacaca

SEQ ID NO: 9248177 - DNA, 22 bp, Homo sapiens
acattcacgctctcaaagctga

SEQ ID NO: 9248178 - DNA, 21 bp, Homo sapiens
acattcacaggatattatcat

SEQ ID NO: 9248179 - DNA, 22 bp, Homo sapiens
acattgaattcaaaattactga

SEQ ID NO: 9248180 - DNA, 22 bp, Homo sapiens
aggctccacggtcactggctct

SEQ ID NO: 9248181 - DNA, 23 bp, Homo sapiens
aggctccactccctgggatgtgg

SEQ ID NO: 9248182 - DNA, 22 bp, Homo sapiens
acattgacttggatgggtagca

SEQ ID NO: 9248183 - DNA, 22 bp, Homo sapiens
aggctccagcagccagaggaag

SEQ ID NO: 9248184 - DNA, 22 bp, Homo sapiens
aggctccagccaatgggtctgt

SEQ ID NO: 9248185 - DNA, 22 bp, Homo sapiens
aggctgtgcaattagggtaaga

SEQ ID NO: 9248186 - DNA, 22 bp, Homo sapiens
aggctccagcccaaggctgcag

SEQ ID NO: 9248187 - DNA, 22 bp, Homo sapiens
aggcttcagcagccctctcttg

SEQ ID NO: 9248188 - DNA, 22 bp, Homo sapiens
aggcttcaggaagtctcctggg

SEQ ID NO: 9248189 - DNA, 18 bp, Homo sapiens
aggcttcccaggcaggcc

SEQ ID NO: 9248190 - DNA, 19 bp, Homo sapiens
aggcttcaggccacatgct

SEQ ID NO: 9248191 - DNA, 19 bp, Homo sapiens
aggcttcaggccacatgct

SEQ ID NO: 9248192 - DNA, 22 bp, Homo sapiens
aggcttcagttgtaccttcttg

SEQ ID NO: 9248193 - DNA, 22 bp, Homo sapiens
aggcttcattacagtggttcaa

SEQ ID NO: 9248194 - DNA, 22 bp, Homo sapiens
agctgcagccctcctgcatggc

SEQ ID NO: 9248195 - DNA, 22 bp, Homo sapiens
agctgcagccgcagctgtggcc

SEQ ID NO: 9248196 - DNA, 23 bp, Homo sapiens
acagccagttcacctctccttgg

SEQ ID NO: 9248197 - DNA, 23 bp, Homo sapiens
acagccagttcacctctccttgg

SEQ ID NO: 9248198 - DNA, 22 bp, Homo sapiens
acagccagtgactggacaagct

SEQ ID NO: 9248199 - DNA, 22 bp, Homo sapiens
acagccagtgactgcagaccct

SEQ ID NO: 9248200 - DNA, 22 bp, Homo sapiens
acagccagtgactggacaagct

SEQ ID NO: 9248201 - DNA, 22 bp, Homo sapiens
agctgcaggcccatgctcagtc

SEQ ID NO: 9248202 - DNA, 22 bp, Homo sapiens
agctgctcaggagagccaggtc

SEQ ID NO: 9248203 - DNA, 22 bp, Homo sapiens
agctgctgggatacagtagtga

SEQ ID NO: 9248204 - DNA, 22 bp, Homo sapiens
agctgcaggagtcgcctaggat

SEQ ID NO: 9248205 - DNA, 22 bp, Homo sapiens
agctgcagcttcctagtccagc

SEQ ID NO: 9248206 - DNA, 22 bp, Homo sapiens
agctgcaggaagtagaagcgga

SEQ ID NO: 9248207 - DNA, 22 bp, Homo sapiens
agctgcagctgttttctgagtg

SEQ ID NO: 9248208 - DNA, 22 bp, Homo sapiens
agctccagttacttacctagag

SEQ ID NO: 9248209 - DNA, 22 bp, Homo sapiens
acagccagggtctcaggaggcg

SEQ ID NO: 9248210 - DNA, 22 bp, Homo sapiens
acagccaggtaaaggcatggca

SEQ ID NO: 9248211 - DNA, 22 bp, Homo sapiens
acagccagtaatctacccctgt

SEQ ID NO: 9248212 - DNA, 22 bp, Homo sapiens
acagccagtcatctcagcaggg

SEQ ID NO: 9248213 - DNA, 22 bp, Homo sapiens
acagccagtcatctcagcaggg

SEQ ID NO: 9248214 - DNA, 22 bp, Homo sapiens
agctccaggtgcaagtcatggt

SEQ ID NO: 9248215 - DNA, 20 bp, Homo sapiens
agctccagtgctgacgcttc

SEQ ID NO: 9248216 - DNA, 22 bp, Homo sapiens
agctccagttacttacctagag

SEQ ID NO: 9248217 - DNA, 22 bp, Homo sapiens
acagccagaggtggtcctgggt

SEQ ID NO: 9248218 - DNA, 22 bp, Homo sapiens
agctcccaattgacttgaacta

SEQ ID NO: 9248219 - DNA, 22 bp, Homo sapiens
agctggccttcggtgtcactgg

SEQ ID NO: 9248220 - DNA, 22 bp, Homo sapiens
agctggccttagtgagcacctg

SEQ ID NO: 9248221 - DNA, 22 bp, Homo sapiens
agctggccttagtgagcacctg

SEQ ID NO: 9248222 - DNA, 22 bp, Homo sapiens
agctggcctgttagagctgagt

SEQ ID NO: 9248223 - DNA, 22 bp, Homo sapiens
agctggctatgccctgtgaacc

SEQ ID NO: 9248224 - DNA, 21 bp, Homo sapiens
agctggctctctctggagaga

SEQ ID NO: 9248225 - DNA, 21 bp, Homo sapiens
agctggctctctctggagaga

SEQ ID NO: 9248226 - DNA, 22 bp, Homo sapiens
acagcctgacttttgttgtcac

SEQ ID NO: 9248227 - DNA, 22 bp, Homo sapiens
acagcctgacttttgttgtcac

SEQ ID NO: 9248228 - DNA, 22 bp, Homo sapiens
acagcctgagagtggagctggc

SEQ ID NO: 9248229 - DNA, 22 bp, Homo sapiens
acagcctgagagtggagctggc

SEQ ID NO: 9248230 - DNA, 22 bp, Homo sapiens
acagcctgatttatggagcagt

SEQ ID NO: 9248231 - DNA, 20 bp, Homo sapiens
agctggcctgtcctaggcct

SEQ ID NO: 9248232 - DNA, 22 bp, Homo sapiens
agctgcttagagtcctcaggat

SEQ ID NO: 9248233 - DNA, 22 bp, Homo sapiens
agctgctgtttggtgagtcttg

SEQ ID NO: 9248234 - DNA, 22 bp, Homo sapiens
agctgctgtggggctcggcctg

SEQ ID NO: 9248235 - DNA, 21 bp, Homo sapiens
agctgctgtggccagaatcca

SEQ ID NO: 9248236 - DNA, 22 bp, Homo sapiens
agctgctggggagggcagacac

SEQ ID NO: 9248237 - DNA, 22 bp, Homo sapiens
agctgctgtcctaggcactgta

SEQ ID NO: 9248238 - DNA, 22 bp, Homo sapiens
agctgcttataagatttgggag

SEQ ID NO: 9248239 - DNA, 22 bp, Homo sapiens
agctgcttcctctttgatgtca

SEQ ID NO: 9248240 - DNA, 21 bp, Homo sapiens
agctgcttcacctggacaaca

SEQ ID NO: 9248241 - DNA, 22 bp, Homo sapiens
agctgcttcaaaatgggctcct

SEQ ID NO: 9248242 - DNA, 22 bp, Homo sapiens
agctgcttgttgaaatccaaac

SEQ ID NO: 9248243 - DNA, 22 bp, Homo sapiens
agctgcttgggaaccatcaatt

SEQ ID NO: 9248244 - DNA, 22 bp, Homo sapiens
agctgcttgggaaccatcaatt

SEQ ID NO: 9248245 - DNA, 21 bp, Homo sapiens
acagcctccatctcctgggct

SEQ ID NO: 9248246 - DNA, 22 bp, Homo sapiens
acagcccgtgtcatcagctgct

SEQ ID NO: 9248247 - DNA, 22 bp, Homo sapiens
acagcccgttctctggcacaca

SEQ ID NO: 9248248 - DNA, 22 bp, Homo sapiens
acagccccccgctcagtttcca

SEQ ID NO: 9248249 - DNA, 23 bp, Homo sapiens
acagccccatgcaggtgtgtttg

SEQ ID NO: 9248250 - DNA, 22 bp, Homo sapiens
acagccccagcgcggcggggtc

SEQ ID NO: 9248251 - DNA, 22 bp, Homo sapiens
agctgtggggaggaggctagca

SEQ ID NO: 9248252 - DNA, 22 bp, Homo sapiens
agctgtggggaggaggctagca

SEQ ID NO: 9248253 - DNA, 22 bp, Homo sapiens
agctgtgggcctgggagagctg

SEQ ID NO: 9248254 - DNA, 22 bp, Homo sapiens
agctgtgggcctgggagagctg

SEQ ID NO: 9248255 - DNA, 22 bp, Homo sapiens
agctgtggggcaggcagcgagg

SEQ ID NO: 9248256 - DNA, 22 bp, Homo sapiens
agctgtgtaagtcatgtaggtg

SEQ ID NO: 9248257 - DNA, 22 bp, Homo sapiens
agctgtgtaagtcatgtaggtg

SEQ ID NO: 9248258 - DNA, 22 bp, Homo sapiens
agctgtggttctgggcagcgac

SEQ ID NO: 9248259 - DNA, 22 bp, Homo sapiens
agctgtggttagatagagtcct

SEQ ID NO: 9248260 - DNA, 22 bp, Homo sapiens
agctgtggttctgggcagcgac

SEQ ID NO: 9248261 - DNA, 22 bp, Homo sapiens
agcttaggaggatgatgaacat

SEQ ID NO: 9248262 - DNA, 22 bp, Homo sapiens
agcttcagatttatctttctgt

SEQ ID NO: 9248263 - DNA, 22 bp, Homo sapiens
agcttcaaagctaggaagatct

SEQ ID NO: 9248264 - DNA, 22 bp, Homo sapiens
agcttcaggaacaggcagcctg

SEQ ID NO: 9248265 - DNA, 22 bp, Homo sapiens
agcttcagggacttgtggcaga

SEQ ID NO: 9248266 - DNA, 20 bp, Homo sapiens
agcttcaggctcaagagaac

SEQ ID NO: 9248267 - DNA, 22 bp, Homo sapiens
agcttcagcttgcagctgtgat

SEQ ID NO: 9248268 - DNA, 22 bp, Homo sapiens
agcttcagcttgcagctgtgat

SEQ ID NO: 9248269 - DNA, 20 bp, Homo sapiens
agcttcagccctaggattgc

SEQ ID NO: 9248270 - DNA, 22 bp, Homo sapiens
agctgtgggatttgggtgtgcc

SEQ ID NO: 9248271 - DNA, 22 bp, Homo sapiens
agctgtgggatttgggtgtgcc

SEQ ID NO: 9248272 - DNA, 22 bp, Homo sapiens
agctgtgggcctgggagagctg

SEQ ID NO: 9248273 - DNA, 22 bp, Homo sapiens
agctgtgggcctgggagagctg

SEQ ID NO: 9248274 - DNA, 22 bp, Homo sapiens
agctgtggccagatgtgagcgg

SEQ ID NO: 9248275 - DNA, 22 bp, Homo sapiens
agctggttagcaatctaagtga

SEQ ID NO: 9248276 - DNA, 21 bp, Homo sapiens
agctgtggcgaggggaacatg

SEQ ID NO: 9248277 - DNA, 22 bp, Homo sapiens
agctgggcaaaatgtgaggttg

SEQ ID NO: 9248278 - DNA, 22 bp, Homo sapiens
agctgggcaaaatgtgaggttg

SEQ ID NO: 9248279 - DNA, 22 bp, Homo sapiens
agctgggatgataacctcagtc

SEQ ID NO: 9248280 - DNA, 22 bp, Homo sapiens
agctgggatgataacctcagtc

SEQ ID NO: 9248281 - DNA, 22 bp, Homo sapiens
agctgggaggctcctctgtgac

SEQ ID NO: 9248282 - DNA, 22 bp, Homo sapiens
agctgggaggctcctctgtgac

SEQ ID NO: 9248283 - DNA, 22 bp, Homo sapiens
agctgggaggtgggcagtgaga

SEQ ID NO: 9248284 - DNA, 22 bp, Homo sapiens
agctgggagcagagccacagcc

SEQ ID NO: 9248285 - DNA, 22 bp, Homo sapiens
agctgggagctgaaggctgatt

SEQ ID NO: 9248286 - DNA, 22 bp, Homo sapiens
agctttggttgaggggagtgtg

SEQ ID NO: 9248287 - DNA, 22 bp, Homo sapiens
agctttggttgaggggagtgtg

SEQ ID NO: 9248288 - DNA, 23 bp, Homo sapiens
agctttgtgaaagcagacatggg

SEQ ID NO: 9248289 - DNA, 22 bp, Homo sapiens
agctttgtttgctcacccgccg

SEQ ID NO: 9248290 - DNA, 22 bp, Homo sapiens
agctttgtttcacatacacctt

SEQ ID NO: 9248291 - DNA, 22 bp, Homo sapiens
agctttgtggctttgcaagact

SEQ ID NO: 9248292 - DNA, 22 bp, Homo sapiens
agctttgtgactttgagctagt

SEQ ID NO: 9248293 - DNA, 22 bp, Homo sapiens
agcttcatggaacctgaggcta

SEQ ID NO: 9248294 - DNA, 17 bp, Homo sapiens
agcttcagttgcaaaac

SEQ ID NO: 9248295 - DNA, 22 bp, Homo sapiens
agcttcataattccttgactca

SEQ ID NO: 9248296 - DNA, 22 bp, Homo sapiens
agcttcagttttctattgttaa

SEQ ID NO: 9248297 - DNA, 22 bp, Homo sapiens
agcttcagtgtcaggcccgtgg

SEQ ID NO: 9248298 - DNA, 22 bp, Homo sapiens
agcttcaggtggtcttgtttct

SEQ ID NO: 9248299 - DNA, 22 bp, Homo sapiens
aggaaaaacctgttaatggtag

SEQ ID NO: 9248300 - DNA, 22 bp, Homo sapiens
aggaaaaaagtctgtgattata

SEQ ID NO: 9248301 - DNA, 22 bp, Homo sapiens
aggaaaaagagttgctgccttc

SEQ ID NO: 9248302 - DNA, 22 bp, Homo sapiens
agcttttacataatgatcttga

SEQ ID NO: 9248303 - DNA, 22 bp, Homo sapiens
agcttttattggctgtcatttg

SEQ ID NO: 9248304 - DNA, 22 bp, Homo sapiens
aggaaactcaaagtgtcaggta

SEQ ID NO: 9248305 - DNA, 22 bp, Homo sapiens
aggaaactaattagtagaataa

SEQ ID NO: 9248306 - DNA, 22 bp, Homo sapiens
aggaaactcccctacatctcaa

SEQ ID NO: 9248307 - DNA, 22 bp, Homo sapiens
aggaaactaattagtagaataa

SEQ ID NO: 9248308 - DNA, 22 bp, Homo sapiens
aggaaactaacttatctttata

SEQ ID NO: 9248309 - DNA, 22 bp, Homo sapiens
aggaaactttcttttgcttcat

SEQ ID NO: 9248310 - DNA, 22 bp, Homo sapiens
aggaaacttcagagttttggtc

SEQ ID NO: 9248311 - DNA, 22 bp, Homo sapiens
aggaaacttcagagttttggtc

SEQ ID NO: 9248312 - DNA, 22 bp, Homo sapiens
aggaaactgatgttttttacaa

SEQ ID NO: 9248313 - DNA, 22 bp, Homo sapiens
aggaaactgggtatggttatac

SEQ ID NO: 9248314 - DNA, 22 bp, Homo sapiens
aggaaactgggcctcaggttag

SEQ ID NO: 9248315 - DNA, 22 bp, Homo sapiens
aggaagccatggtggacgtcta

SEQ ID NO: 9248316 - DNA, 22 bp, Homo sapiens
aggaagccatggtggacgtcta

SEQ ID NO: 9248317 - DNA, 18 bp, Homo sapiens
aggaagcaggaggaaggc

SEQ ID NO: 9248318 - DNA, 20 bp, Homo sapiens
aggaagccaaaggctgtctt

SEQ ID NO: 9248319 - DNA, 22 bp, Homo sapiens
aggaagagcattcacatggtag

SEQ ID NO: 9248320 - DNA, 22 bp, Homo sapiens
aggaaagaaaggaggtgcattt

SEQ ID NO: 9248321 - DNA, 18 bp, Homo sapiens
aggaaagaaaggcaggtg

SEQ ID NO: 9248322 - DNA, 18 bp, Homo sapiens
aggaaagaaaggcaggtg

SEQ ID NO: 9248323 - DNA, 22 bp, Homo sapiens
aggagggaataagaaagagtca

SEQ ID NO: 9248324 - DNA, 22 bp, Homo sapiens
aggaggccgatttcagaggtcg

SEQ ID NO: 9248325 - DNA, 20 bp, Homo sapiens
aggagggacctggattggcg

SEQ ID NO: 9248326 - DNA, 20 bp, Homo sapiens
aggagggacctggattggcg

SEQ ID NO: 9248327 - DNA, 22 bp, Homo sapiens
aggagggagatgcccatcctgg

SEQ ID NO: 9248328 - DNA, 21 bp, Homo sapiens
aggaggggtctttcccactga

SEQ ID NO: 9248329 - DNA, 21 bp, Homo sapiens
aggattttgttgaagtttctg

SEQ ID NO: 9248330 - DNA, 22 bp, Homo sapiens
aggcaaaagaatgtcataaatg

SEQ ID NO: 9248331 - DNA, 22 bp, Homo sapiens
aggcaaattattgtatgcagtt

SEQ ID NO: 9248332 - DNA, 22 bp, Homo sapiens
aggagggtacaatgggtggaaa

SEQ ID NO: 9248333 - DNA, 22 bp, Homo sapiens
aggaggggttctcgggtgctga

SEQ ID NO: 9248334 - DNA, 21 bp, Homo sapiens
aggaggggtctttcccactga

SEQ ID NO: 9248335 - DNA, 21 bp, Homo sapiens
aggaggggtctttcccactga

SEQ ID NO: 9248336 - DNA, 22 bp, Homo sapiens
aggcacagaatggcattcagtg

SEQ ID NO: 9248337 - DNA, 22 bp, Homo sapiens
aggcacagatttggggaaagca

SEQ ID NO: 9248338 - DNA, 18 bp, Homo sapiens
aggcacagagcatacata

SEQ ID NO: 9248339 - DNA, 22 bp, Homo sapiens
aggcacagatttggggaaagca

SEQ ID NO: 9248340 - DNA, 23 bp, Homo sapiens
acatacataagcaccacattttg

SEQ ID NO: 9248341 - DNA, 23 bp, Homo sapiens
acatacataagcaccacattttg

SEQ ID NO: 9248342 - DNA, 23 bp, Homo sapiens
acatacataagcaccacattttg

SEQ ID NO: 9248343 - DNA, 22 bp, Homo sapiens
acatacacaagcgtacatgaac

SEQ ID NO: 9248344 - DNA, 22 bp, Homo sapiens
acatacacatgaatatattttt

SEQ ID NO: 9248345 - DNA, 23 bp, Homo sapiens
acatacatggagataaagtgatg

SEQ ID NO: 9248346 - DNA, 23 bp, Homo sapiens
acatacatggagataaagtgatg

SEQ ID NO: 9248347 - DNA, 22 bp, Homo sapiens
acatacatcaagtatcacaaga

SEQ ID NO: 9248348 - DNA, 22 bp, Homo sapiens
acatacatcaagtatcacaaga

SEQ ID NO: 9248349 - DNA, 22 bp, Homo sapiens
acatacatcaagtatcacaaga

SEQ ID NO: 9248350 - DNA, 22 bp, Homo sapiens
acatacatcaagtatcacaaga

SEQ ID NO: 9248351 - DNA, 22 bp, Homo sapiens
acatacatatgtttaaatgcat

SEQ ID NO: 9248352 - DNA, 22 bp, Homo sapiens
acatacatcaagtatcacaaga

SEQ ID NO: 9248353 - DNA, 22 bp, Homo sapiens
acatacatatgtttaaatgcat

SEQ ID NO: 9248354 - DNA, 22 bp, Homo sapiens
acatacatatgacaactttcct

SEQ ID NO: 9248355 - DNA, 22 bp, Homo sapiens
acatacatatgacaactttcct

SEQ ID NO: 9248356 - DNA, 21 bp, Homo sapiens
acatacataccttaccacctt

SEQ ID NO: 9248357 - DNA, 21 bp, Homo sapiens
acatacataccttaccacctt

SEQ ID NO: 9248358 - DNA, 22 bp, Homo sapiens
aggagctgcatggatacctggt

SEQ ID NO: 9248359 - DNA, 22 bp, Homo sapiens
aggagctgcagattctgccttg

SEQ ID NO: 9248360 - DNA, 22 bp, Homo sapiens
aggagctgcttaaatggttggt

SEQ ID NO: 9248361 - DNA, 22 bp, Homo sapiens
aggagctgctttggtgcggttt

SEQ ID NO: 9248362 - DNA, 22 bp, Homo sapiens
aggagctggagtccaggcaagt

SEQ ID NO: 9248363 - DNA, 22 bp, Homo sapiens
aggagcccagcctgggctcgga

SEQ ID NO: 9248364 - DNA, 23 bp, Homo sapiens
aggagcccaaggagaggtaactt

SEQ ID NO: 9248365 - DNA, 22 bp, Homo sapiens
aggagcagaccgtagtcctgca

SEQ ID NO: 9248366 - DNA, 22 bp, Homo sapiens
acagggtggggatggtgagctt

SEQ ID NO: 9248367 - DNA, 22 bp, Homo sapiens
acagggtggggatggtgagctt

SEQ ID NO: 9248368 - DNA, 22 bp, Homo sapiens
acagggtgactttgtgacagat

SEQ ID NO: 9248369 - DNA, 22 bp, Homo sapiens
acagggtgactttgtgacagat

SEQ ID NO: 9248370 - DNA, 22 bp, Homo sapiens
acagggtgactttgtgacagat

SEQ ID NO: 9248371 - DNA, 22 bp, Homo sapiens
acagggtgactttgtgacagat

SEQ ID NO: 9248372 - DNA, 22 bp, Homo sapiens
acaggggctccgaaggtgaggg

SEQ ID NO: 9248373 - DNA, 22 bp, Homo sapiens
acagggtgaatgtgacattatc

SEQ ID NO: 9248374 - DNA, 22 bp, Homo sapiens
aggagccattgcaggatggcag

SEQ ID NO: 9248375 - DNA, 22 bp, Homo sapiens
aggagcagaccgtagtcctgca

SEQ ID NO: 9248376 - DNA, 23 bp, Homo sapiens
aggagccatgagttggatatgtt

SEQ ID NO: 9248377 - DNA, 22 bp, Homo sapiens
aggaaggagggcagatattaag

SEQ ID NO: 9248378 - DNA, 22 bp, Homo sapiens
aggaaggctgatcactgcttgt

SEQ ID NO: 9248379 - DNA, 22 bp, Homo sapiens
aggaagcgtgggtctggctgga

SEQ ID NO: 9248380 - DNA, 17 bp, Homo sapiens
aggaagcgagctggcct

SEQ ID NO: 9248381 - DNA, 22 bp, Homo sapiens
aggaagcctggggctgccctcg

SEQ ID NO: 9248382 - DNA, 22 bp, Homo sapiens
aggaagcctggcattaaaaagc

SEQ ID NO: 9248383 - DNA, 22 bp, Homo sapiens
aggaagcctgcaggtgactgct

SEQ ID NO: 9248384 - DNA, 22 bp, Homo sapiens
aggaagcccaagtctcatcttc

SEQ ID NO: 9248385 - DNA, 22 bp, Homo sapiens
aggaagcccttgtcatttctgt

SEQ ID NO: 9248386 - DNA, 22 bp, Homo sapiens
aggagacccagaatgttgctgt

SEQ ID NO: 9248387 - DNA, 22 bp, Homo sapiens
aggagacccaatgccagaaaga

SEQ ID NO: 9248388 - DNA, 22 bp, Homo sapiens
aggagaccttcaccacttccac

SEQ ID NO: 9248389 - DNA, 21 bp, Homo sapiens
aggagaccggcttgtttgtgc

SEQ ID NO: 9248390 - DNA, 22 bp, Homo sapiens
aggagactcagagacctggccg

SEQ ID NO: 9248391 - DNA, 22 bp, Homo sapiens
aggagaccttttgagtgtgaga

SEQ ID NO: 9248392 - DNA, 22 bp, Homo sapiens
acaggggctccgaaggtgaggg

SEQ ID NO: 9248393 - DNA, 22 bp, Homo sapiens
aggagacatctaactgtaggtt

SEQ ID NO: 9248394 - DNA, 22 bp, Homo sapiens
aggagacatctaactgtaggtt

SEQ ID NO: 9248395 - DNA, 20 bp, Homo sapiens
aggagaccaagccaagtgga

SEQ ID NO: 9248396 - DNA, 22 bp, Homo sapiens
aggagacatggaatagtgaggc

SEQ ID NO: 9248397 - DNA, 22 bp, Homo sapiens
aggagacatactataggaatat

SEQ ID NO: 9248398 - DNA, 22 bp, Homo sapiens
aggagacatactataggaatat

SEQ ID NO: 9248399 - DNA, 22 bp, Homo sapiens
aggagacataactatgatgaga

SEQ ID NO: 9248400 - DNA, 22 bp, Homo sapiens
aggagacataactatgatgaga

SEQ ID NO: 9248401 - DNA, 23 bp, Homo sapiens
aggagacagggaagtgcctggct

SEQ ID NO: 9248402 - DNA, 23 bp, Homo sapiens
aggagacagggaagtgcctggct

SEQ ID NO: 9248403 - DNA, 23 bp, Homo sapiens
aggagacagggaagtgcctggct

SEQ ID NO: 9248404 - DNA, 23 bp, Homo sapiens
aggagacagggaagtgcctggct

SEQ ID NO: 9248405 - DNA, 22 bp, Homo sapiens
aggagacagccaggggcctgag

SEQ ID NO: 9248406 - DNA, 22 bp, Homo sapiens
aggaagggatacataggatagt

SEQ ID NO: 9248407 - DNA, 17 bp, Homo sapiens
aggaagggcaagtttct

SEQ ID NO: 9248408 - DNA, 20 bp, Homo sapiens
aggacttgtttgggcagagt

SEQ ID NO: 9248409 - DNA, 22 bp, Homo sapiens
aggcagcttctgattagcagcg

SEQ ID NO: 9248410 - DNA, 22 bp, Homo sapiens
aggcagcttaagccctggccca

SEQ ID NO: 9248411 - DNA, 20 bp, Homo sapiens
aggcagctggccaggcaggt

SEQ ID NO: 9248412 - DNA, 22 bp, Homo sapiens
aggcagcgtagcaaggctagta

SEQ ID NO: 9248413 - DNA, 19 bp, Homo sapiens
aggcagaggcttggctagc

SEQ ID NO: 9248414 - DNA, 22 bp, Homo sapiens
aggcagctggcaaattctagag

SEQ ID NO: 9248415 - DNA, 22 bp, Homo sapiens
aggcagctggcagcacccaggg

SEQ ID NO: 9248416 - DNA, 22 bp, Homo sapiens
aggcagaggagaatgatcttcc

SEQ ID NO: 9248417 - DNA, 19 bp, Homo sapiens
aggcagaggcttggctagc

SEQ ID NO: 9248418 - DNA, 22 bp, Homo sapiens
aggcagaggagaatgatcttcc

SEQ ID NO: 9248419 - DNA, 22 bp, Homo sapiens
aggcagaggaagggtggatttg

SEQ ID NO: 9248420 - DNA, 22 bp, Homo sapiens
aggcagagctgggttttgaaat

SEQ ID NO: 9248421 - DNA, 22 bp, Homo sapiens
aggcagaggaagggtggatttg

SEQ ID NO: 9248422 - DNA, 22 bp, Homo sapiens
aggcagagctgatgttctgtga

SEQ ID NO: 9248423 - DNA, 22 bp, Homo sapiens
aggcagagctgatgttctgtga

SEQ ID NO: 9248424 - DNA, 22 bp, Homo sapiens
aggcagagctaggaagaattgt

SEQ ID NO: 9248425 - DNA, 20 bp, Homo sapiens
aggcagagcgcacttttaga

SEQ ID NO: 9248426 - DNA, 22 bp, Homo sapiens
aggcagagctaggaagaattgt

SEQ ID NO: 9248427 - DNA, 23 bp, Homo sapiens
aggcagagccaaggtcaaaaccc

SEQ ID NO: 9248428 - DNA, 22 bp, Homo sapiens
aggcaggccctgggccatcccg

SEQ ID NO: 9248429 - DNA, 22 bp, Homo sapiens
aggcaggccgtgtccctcctca

SEQ ID NO: 9248430 - DNA, 18 bp, Homo sapiens
aggcaggcggatcacaag

SEQ ID NO: 9248431 - DNA, 22 bp, Homo sapiens
aggcaggctgctatggagtaga

SEQ ID NO: 9248432 - DNA, 22 bp, Homo sapiens
aggcaggctcaggcccatgctt

SEQ ID NO: 9248433 - DNA, 21 bp, Homo sapiens
aggcaggattcaaacacagag

SEQ ID NO: 9248434 - DNA, 22 bp, Homo sapiens
ccaaagaaacccaagctcaggg

SEQ ID NO: 9248435 - DNA, 21 bp, Homo sapiens
ccaaagaactgccatttgtca

SEQ ID NO: 9248436 - DNA, 22 bp, Homo sapiens
ccaaagagagacctttcttctc

SEQ ID NO: 9248437 - DNA, 22 bp, Homo sapiens
ccaaagagctagaattataggc

SEQ ID NO: 9248438 - DNA, 22 bp, Homo sapiens
aggcaggcccctgagaatagac

SEQ ID NO: 9248439 - DNA, 22 bp, Homo sapiens
ccaaaatgtttgaatgcatgtg

SEQ ID NO: 9248440 - DNA, 22 bp, Homo sapiens
ccaaaccatccatctccaggct

SEQ ID NO: 9248441 - DNA, 22 bp, Homo sapiens
ccaaagaaacccaagctcaggg

SEQ ID NO: 9248442 - DNA, 20 bp, Homo sapiens
aggcacagttcctagttggg

SEQ ID NO: 9248443 - DNA, 22 bp, Homo sapiens
aggcacagtggccctgtttggg

SEQ ID NO: 9248444 - DNA, 19 bp, Homo sapiens
aggcacaggttgtctggac

SEQ ID NO: 9248445 - DNA, 22 bp, Homo sapiens
aggcactgaagaactctttttg

SEQ ID NO: 9248446 - DNA, 22 bp, Homo sapiens
aggcactgaagaactctttttg

SEQ ID NO: 9248447 - DNA, 22 bp, Homo sapiens
aggcactgaagtggtaaatgta

SEQ ID NO: 9248448 - DNA, 22 bp, Homo sapiens
aggcactgaaggaagcttgcgc

SEQ ID NO: 9248449 - DNA, 22 bp, Homo sapiens
aggcactgaaggaagcttgcgc

SEQ ID NO: 9248450 - DNA, 22 bp, Homo sapiens
aggcactgaatatccagtaaaa

SEQ ID NO: 9248451 - DNA, 22 bp, Homo sapiens
aggcactgaagtggtaaatgta

SEQ ID NO: 9248452 - DNA, 22 bp, Homo sapiens
aggcactgaagtggtaaatgta

SEQ ID NO: 9248453 - DNA, 23 bp, Homo sapiens
aggcactgaatgtgtcagtgagt

SEQ ID NO: 9248454 - DNA, 22 bp, Homo sapiens
aggcactgacagattctgtgtc

SEQ ID NO: 9248455 - DNA, 22 bp, Homo sapiens
aggcactgacctgcttccttga

SEQ ID NO: 9248456 - DNA, 22 bp, Homo sapiens
aggcactgacagattctgtgtc

SEQ ID NO: 9248457 - DNA, 22 bp, Homo sapiens
aggcactgacaattctggactg

SEQ ID NO: 9248458 - DNA, 23 bp, Homo sapiens
aggcactgaatgtgtcagtgagt

SEQ ID NO: 9248459 - DNA, 22 bp, Homo sapiens
aggcactgactcaagggagcca

SEQ ID NO: 9248460 - DNA, 22 bp, Homo sapiens
aggcactgactcaagggagcca

SEQ ID NO: 9248461 - DNA, 22 bp, Homo sapiens
aggcactgagaggctgtgttgc

SEQ ID NO: 9248462 - DNA, 22 bp, Homo sapiens
aggcactgattctcagagttac

SEQ ID NO: 9248463 - DNA, 22 bp, Homo sapiens
aggcagagagcagtggccgtct

SEQ ID NO: 9248464 - DNA, 16 bp, Homo sapiens
aggcagagatttaccc

SEQ ID NO: 9248465 - DNA, 22 bp, Homo sapiens
aggcagagagcagtggccgtct

SEQ ID NO: 9248466 - DNA, 22 bp, Homo sapiens
aggcactgcagattacaggcgc

SEQ ID NO: 9248467 - DNA, 22 bp, Homo sapiens
aggcactgattctgttttccat

SEQ ID NO: 9248468 - DNA, 22 bp, Homo sapiens
aggcacaggtggacttcacagt

SEQ ID NO: 9248469 - DNA, 22 bp, Homo sapiens
aggcacaggtggacttcacagt

SEQ ID NO: 9248470 - DNA, 22 bp, Homo sapiens
aggcacagggatgcggagccag

SEQ ID NO: 9248471 - DNA, 23 bp, Homo sapiens
catgtgtgacagtatcactgttt

SEQ ID NO: 9248472 - DNA, 22 bp, Homo sapiens
catgtccttctcattgcctcat

SEQ ID NO: 9248473 - DNA, 22 bp, Homo sapiens
aggatgactggaacccaagtga

SEQ ID NO: 9248474 - DNA, 22 bp, Homo sapiens
catgtgtgaatcttgtgatcat

SEQ ID NO: 9248475 - DNA, 22 bp, Homo sapiens
aggataaatgatctagattttc

SEQ ID NO: 9248476 - DNA, 22 bp, Homo sapiens
aggagtttggggattagtcagg

SEQ ID NO: 9248477 - DNA, 22 bp, Homo sapiens
aggagtttatccgagggcataa

SEQ ID NO: 9248478 - DNA, 21 bp, Homo sapiens
aggagttgctgtggcctggtt

SEQ ID NO: 9248479 - DNA, 18 bp, Homo sapiens
aggatattaagagtacag

SEQ ID NO: 9248480 - DNA, 22 bp, Homo sapiens
aggatatttgcttaagatagct

SEQ ID NO: 9248481 - DNA, 22 bp, Homo sapiens
aggatctgtgagtgctgcagac

SEQ ID NO: 9248482 - DNA, 22 bp, Homo sapiens
aggatcatgtggtcattcctga

SEQ ID NO: 9248483 - DNA, 22 bp, Homo sapiens
aggatcatataagctccagcta

SEQ ID NO: 9248484 - DNA, 22 bp, Homo sapiens
aggatcctccttagaaaagacc

SEQ ID NO: 9248485 - DNA, 22 bp, Homo sapiens
aggagctgggcccaaggatgct

SEQ ID NO: 9248486 - DNA, 22 bp, Homo sapiens
aggagctgggctgctgctggga

SEQ ID NO: 9248487 - DNA, 22 bp, Homo sapiens
aggagctgggctgctgctggga

SEQ ID NO: 9248488 - DNA, 22 bp, Homo sapiens
aggagctgggctgctgctggga

SEQ ID NO: 9248489 - DNA, 22 bp, Homo sapiens
aggagctgggctgctgctggga

SEQ ID NO: 9248490 - DNA, 22 bp, Homo sapiens
aggagctggccactaggatgca

SEQ ID NO: 9248491 - DNA, 23 bp, Homo sapiens
cagtggagactcatgcttcctta

SEQ ID NO: 9248492 - DNA, 22 bp, Homo sapiens
cagtggagagacttttactctt

SEQ ID NO: 9248493 - DNA, 22 bp, Homo sapiens
cagtggaatatataggggattt

SEQ ID NO: 9248494 - DNA, 22 bp, Homo sapiens
cagtggaagctggctgtgaaga

SEQ ID NO: 9248495 - DNA, 22 bp, Homo sapiens
aggagcagcttctgaaccatgt

SEQ ID NO: 9248496 - DNA, 22 bp, Homo sapiens
aggagcagcccactcctgtcct

SEQ ID NO: 9248497 - DNA, 22 bp, Homo sapiens
aggagcagcccactcctgtcct

SEQ ID NO: 9248498 - DNA, 22 bp, Homo sapiens
aggagatggagctcagtgggca

SEQ ID NO: 9248499 - DNA, 22 bp, Homo sapiens
aggagcagattggtaagatcat

SEQ ID NO: 9248500 - DNA, 22 bp, Homo sapiens
cagtggaaactatgctgctgga

SEQ ID NO: 9248501 - DNA, 22 bp, Homo sapiens
cagtggaaatcagagtgagagt

SEQ ID NO: 9248502 - DNA, 22 bp, Homo sapiens
cagtggaaactatgctgctgga

SEQ ID NO: 9248503 - DNA, 22 bp, Homo sapiens
cagtgcttttttaccttccaac

SEQ ID NO: 9248504 - DNA, 20 bp, Homo sapiens
cagtgcttcctcctttcttt

SEQ ID NO: 9248505 - DNA, 22 bp, Homo sapiens
aggagccacctaggagctgttt

SEQ ID NO: 9248506 - DNA, 22 bp, Homo sapiens
aggagccaaattttagactctg

SEQ ID NO: 9248507 - DNA, 23 bp, Homo sapiens
cagtgcagggcaactcagactcc

SEQ ID NO: 9248508 - DNA, 23 bp, Homo sapiens
cagtgcagggcaactcagactcc

SEQ ID NO: 9248509 - DNA, 22 bp, Homo sapiens
cagtgcaggcttgtggccgcag

SEQ ID NO: 9248510 - DNA, 23 bp, Homo sapiens
cagtgcagggcaactcagactcc

SEQ ID NO: 9248511 - DNA, 22 bp, Homo sapiens
cagtgcagctgccccgctggta

SEQ ID NO: 9248512 - DNA, 22 bp, Homo sapiens
cagtgcagctgccccgctggta

SEQ ID NO: 9248513 - DNA, 22 bp, Homo sapiens
cagtgcaggctgggggccctgc

SEQ ID NO: 9248514 - DNA, 22 bp, Homo sapiens
cagtgcaggaagtgagatgcct

SEQ ID NO: 9248515 - DNA, 22 bp, Homo sapiens
cagtgcaggaagtgagatgcct

SEQ ID NO: 9248516 - DNA, 22 bp, Homo sapiens
cagtgagggcattcagtgctgg

SEQ ID NO: 9248517 - DNA, 22 bp, Homo sapiens
cagtgagggcattcagtgctgg

SEQ ID NO: 9248518 - DNA, 22 bp, Homo sapiens
cagtgcagccaaggacaggcac

SEQ ID NO: 9248519 - DNA, 22 bp, Homo sapiens
cagtgagggaagatctcagcac

SEQ ID NO: 9248520 - DNA, 22 bp, Homo sapiens
cagtgaggctctgctgagcggt

SEQ ID NO: 9248521 - DNA, 17 bp, Homo sapiens
cagtgaggcctttcctc

SEQ ID NO: 9248522 - DNA, 21 bp, Homo sapiens
cagtgaggccctcctgttccc

SEQ ID NO: 9248523 - DNA, 22 bp, Homo sapiens
cagtgaggctctgctgagcggt

SEQ ID NO: 9248524 - DNA, 22 bp, Homo sapiens
cagtgaggctctgctgagcggt

SEQ ID NO: 9248525 - DNA, 22 bp, Homo sapiens
aggaatttggggttacatgatg

SEQ ID NO: 9248526 - DNA, 22 bp, Homo sapiens
aggaatttggaatttttcctgt

SEQ ID NO: 9248527 - DNA, 22 bp, Homo sapiens
aggaattcaagaccagctgggc

SEQ ID NO: 9248528 - DNA, 22 bp, Homo sapiens
aggaattgagatcctaggtttt

SEQ ID NO: 9248529 - DNA, 22 bp, Homo sapiens
aggacaaaggaccagatctgga

SEQ ID NO: 9248530 - DNA, 22 bp, Homo sapiens
cagtctgaacactgggctactc

SEQ ID NO: 9248531 - DNA, 22 bp, Homo sapiens
cagtctgatgttcgcaggtgaa

SEQ ID NO: 9248532 - DNA, 18 bp, Homo sapiens
cagtgaggatgaagggtt

SEQ ID NO: 9248533 - DNA, 22 bp, Homo sapiens
cagtgaggagtccagggcagag

SEQ ID NO: 9248534 - DNA, 22 bp, Homo sapiens
cagtgaggagtccagggcagag

SEQ ID NO: 9248535 - DNA, 22 bp, Homo sapiens
cagttataggagccattgtata

SEQ ID NO: 9248536 - DNA, 22 bp, Homo sapiens
cagttattatgaggtcattagg

SEQ ID NO: 9248537 - DNA, 22 bp, Homo sapiens
cagttattttgaggattaaatg

SEQ ID NO: 9248538 - DNA, 22 bp, Homo sapiens
cagttcatccccatgttttcaa

SEQ ID NO: 9248539 - DNA, 21 bp, Homo sapiens
cagttctcttagatttccagt

SEQ ID NO: 9248540 - DNA, 22 bp, Homo sapiens
cagttctctgtgcctcgctggg

SEQ ID NO: 9248541 - DNA, 22 bp, Homo sapiens
cagttctacttggatgtctgca

SEQ ID NO: 9248542 - DNA, 22 bp, Homo sapiens
cagttcctcaaaggttaaatgt

SEQ ID NO: 9248543 - DNA, 19 bp, Homo sapiens
catatttttgggctggcat

SEQ ID NO: 9248544 - DNA, 22 bp, Homo sapiens
catattttagttgctgaacagc

SEQ ID NO: 9248545 - DNA, 22 bp, Homo sapiens
catcactacaaatttaagaaat

SEQ ID NO: 9248546 - DNA, 22 bp, Homo sapiens
aggaggctggttcaggccatat

SEQ ID NO: 9248547 - DNA, 22 bp, Homo sapiens
aggaggctgcaaccctgaggcc

SEQ ID NO: 9248548 - DNA, 22 bp, Homo sapiens
aggaggctgcaaccctgaggcc

SEQ ID NO: 9248549 - DNA, 22 bp, Homo sapiens
aggaggctgcaaccctgaggcc

SEQ ID NO: 9248550 - DNA, 23 bp, Homo sapiens
catcagaggttgccactccctgg

SEQ ID NO: 9248551 - DNA, 22 bp, Homo sapiens
catcagaggtacttaatgaatg

SEQ ID NO: 9248552 - DNA, 22 bp, Homo sapiens
catcagaacgtgagctccttgt

SEQ ID NO: 9248553 - DNA, 22 bp, Homo sapiens
catcagaatagctctgtggata

SEQ ID NO: 9248554 - DNA, 22 bp, Homo sapiens
catcagaagatggctctggaaa

SEQ ID NO: 9248555 - DNA, 22 bp, Homo sapiens
catcacttttaaaggtgatcga

SEQ ID NO: 9248556 - DNA, 20 bp, Homo sapiens
catcagaaatcctgacccac

SEQ ID NO: 9248557 - DNA, 22 bp, Homo sapiens
catcactgaaccccaactttct

SEQ ID NO: 9248558 - DNA, 22 bp, Homo sapiens
catcactgtcaccatctttcct

SEQ ID NO: 9248559 - DNA, 22 bp, Homo sapiens
aggaggtgagcggtcatgtggt

SEQ ID NO: 9248560 - DNA, 22 bp, Homo sapiens
catcatgccccgctacagtgca

SEQ ID NO: 9248561 - DNA, 22 bp, Homo sapiens
aggaggtgagcggtcatgtggt

SEQ ID NO: 9248562 - DNA, 22 bp, Homo sapiens
aggaggtgagcggtcatgtggt

SEQ ID NO: 9248563 - DNA, 22 bp, Homo sapiens
aggaggtgacagcctgcatctg

SEQ ID NO: 9248564 - DNA, 22 bp, Homo sapiens
aggaggtgacagcctgcatctg

SEQ ID NO: 9248565 - DNA, 22 bp, Homo sapiens
aggagggtggggtctgcctgtc

SEQ ID NO: 9248566 - DNA, 22 bp, Homo sapiens
aggaggggcaatgatagtctgg

SEQ ID NO: 9248567 - DNA, 22 bp, Homo sapiens
aggaggggcatagaaatgtaat

SEQ ID NO: 9248568 - DNA, 22 bp, Homo sapiens
aggaggctggttcaggccatat

SEQ ID NO: 9248569 - DNA, 22 bp, Homo sapiens
aggagtggtgcaggacctgcca

SEQ ID NO: 9248570 - DNA, 22 bp, Homo sapiens
aggagtggtgcaggacctgcca

SEQ ID NO: 9248571 - DNA, 22 bp, Homo sapiens
aggagtggaattactgggttct

SEQ ID NO: 9248572 - DNA, 22 bp, Homo sapiens
aggagtatctaataatctgaga

SEQ ID NO: 9248573 - DNA, 22 bp, Homo sapiens
aggagtgggggcgagaagttaa

SEQ ID NO: 9248574 - DNA, 22 bp, Homo sapiens
catcattttattaaccaagaaa

SEQ ID NO: 9248575 - DNA, 23 bp, Homo sapiens
catcattgttatgggtgctacta

SEQ ID NO: 9248576 - DNA, 19 bp, Homo sapiens
catcattatcagttcactg

SEQ ID NO: 9248577 - DNA, 22 bp, Homo sapiens
catcattaccttgtaaccaata

SEQ ID NO: 9248578 - DNA, 22 bp, Homo sapiens
catcattaccatcattagtagt

SEQ ID NO: 9248579 - DNA, 22 bp, Homo sapiens
catcattttattaaccaagaaa

SEQ ID NO: 9248580 - DNA, 22 bp, Homo sapiens
catcatttgtttgcatgcagga

SEQ ID NO: 9248581 - DNA, 22 bp, Homo sapiens
agctggagatcatgctgatact

SEQ ID NO: 9248582 - DNA, 22 bp, Homo sapiens
agctggagagtttccaggaagg

SEQ ID NO: 9248583 - DNA, 22 bp, Homo sapiens
agctggagaatgtggatgatcc

SEQ ID NO: 9248584 - DNA, 22 bp, Homo sapiens
agctggagatcatgctgatact

SEQ ID NO: 9248585 - DNA, 22 bp, Homo sapiens
agctggagatgcccagcaccgg

SEQ ID NO: 9248586 - DNA, 22 bp, Homo sapiens
agctggagaaacctgggagggt

SEQ ID NO: 9248587 - DNA, 20 bp, Homo sapiens
agctggagaagggcccttcc

SEQ ID NO: 9248588 - DNA, 22 bp, Homo sapiens
agctggagaataggaattagtg

SEQ ID NO: 9248589 - DNA, 22 bp, Homo sapiens
agctggagcttcaagcaggtaa

SEQ ID NO: 9248590 - DNA, 22 bp, Homo sapiens
agctggagccagtgtgaggctt

SEQ ID NO: 9248591 - DNA, 22 bp, Homo sapiens
agctggagccagtgtgaggctt

SEQ ID NO: 9248592 - DNA, 22 bp, Homo sapiens
agctggagcttcaagcaggtaa

SEQ ID NO: 9248593 - DNA, 19 bp, Homo sapiens
agctggagattggagggca

SEQ ID NO: 9248594 - DNA, 22 bp, Homo sapiens
agctggagatgcccagcaccgg

SEQ ID NO: 9248595 - DNA, 22 bp, Homo sapiens
agctgggactcaactgtctggg

SEQ ID NO: 9248596 - DNA, 22 bp, Homo sapiens
agctggaggagtttctcctagc

SEQ ID NO: 9248597 - DNA, 22 bp, Homo sapiens
agctgggcagactgcagtggtt

SEQ ID NO: 9248598 - DNA, 22 bp, Homo sapiens
agctgggcaccccgctgcgtct

SEQ ID NO: 9248599 - DNA, 21 bp, Homo sapiens
agctgggcctcagcctgcagt

SEQ ID NO: 9248600 - DNA, 22 bp, Homo sapiens
agctgggcagactgcagtggtt

SEQ ID NO: 9248601 - DNA, 22 bp, Homo sapiens
agctgggcctgagctggaagct

SEQ ID NO: 9248602 - DNA, 22 bp, Homo sapiens
agctgggcctgagctggaagct

SEQ ID NO: 9248603 - DNA, 22 bp, Homo sapiens
agctgggcctgatttgcagggg

SEQ ID NO: 9248604 - DNA, 22 bp, Homo sapiens
agctgggcgcagtggctggtga

SEQ ID NO: 9248605 - DNA, 21 bp, Homo sapiens
agctgggcctcagcctgcagt

SEQ ID NO: 9248606 - DNA, 21 bp, Homo sapiens
agctgggcctcagcctgcagt

SEQ ID NO: 9248607 - DNA, 21 bp, Homo sapiens
agctgggcctcagcctgcagt

SEQ ID NO: 9248608 - DNA, 22 bp, Homo sapiens
agctgggcctgagctggaagct

SEQ ID NO: 9248609 - DNA, 22 bp, Homo sapiens
agctgggctgatgactcatgtt

SEQ ID NO: 9248610 - DNA, 22 bp, Homo sapiens
agctgggctccaagagggatct

SEQ ID NO: 9248611 - DNA, 22 bp, Homo sapiens
agctgggcgcagtggctggtga

SEQ ID NO: 9248612 - DNA, 22 bp, Homo sapiens
agctgggcgcagtggctggtga

SEQ ID NO: 9248613 - DNA, 22 bp, Homo sapiens
agctgggcctgatttgcagggg

SEQ ID NO: 9248614 - DNA, 22 bp, Homo sapiens
agctgggtgtgtatcagataaa

SEQ ID NO: 9248615 - DNA, 22 bp, Homo sapiens
agctggtatttgttagggagtt

SEQ ID NO: 9248616 - DNA, 22 bp, Homo sapiens
agctggtcagagtggggataga

SEQ ID NO: 9248617 - DNA, 20 bp, Homo sapiens
agctggtccccaagcctctc

SEQ ID NO: 9248618 - DNA, 22 bp, Homo sapiens
agctggtatgaacaggatagga

SEQ ID NO: 9248619 - DNA, 22 bp, Homo sapiens
agctggtaagtggcagagattc

SEQ ID NO: 9248620 - DNA, 18 bp, Homo sapiens
agctggtgaaatccagta

SEQ ID NO: 9248621 - DNA, 22 bp, Homo sapiens
agctggtctgctgcatggagtg

SEQ ID NO: 9248622 - DNA, 20 bp, Homo sapiens
agctggtgaattaaagactg

SEQ ID NO: 9248623 - DNA, 18 bp, Homo sapiens
agctggtgaaatccagta

SEQ ID NO: 9248624 - DNA, 22 bp, Homo sapiens
agctggtgaacctgaggcacag

SEQ ID NO: 9248625 - DNA, 22 bp, Homo sapiens
agctggtgctcaggggcatgga

SEQ ID NO: 9248626 - DNA, 22 bp, Homo sapiens
agctggtgctcaggggcatgga

SEQ ID NO: 9248627 - DNA, 22 bp, Homo sapiens
agctggtgatgtggtccctcac

SEQ ID NO: 9248628 - DNA, 22 bp, Homo sapiens
agctggtgagggttgaggggta

SEQ ID NO: 9248629 - DNA, 22 bp, Homo sapiens
agctggtgagggttgaggggta

SEQ ID NO: 9248630 - DNA, 22 bp, Homo sapiens
caggcagagtcagattagactt

SEQ ID NO: 9248631 - DNA, 20 bp, Homo sapiens
caggcagaggatgctgacca

SEQ ID NO: 9248632 - DNA, 22 bp, Homo sapiens
caggcagagtgagaagcccttg

SEQ ID NO: 9248633 - DNA, 23 bp, Homo sapiens
agctgggtggcctgcgtgaagct

SEQ ID NO: 9248634 - DNA, 21 bp, Homo sapiens
agctgcctccacttctgaggc

SEQ ID NO: 9248635 - DNA, 22 bp, Homo sapiens
agctgcctcagcaacacagacc

SEQ ID NO: 9248636 - DNA, 22 bp, Homo sapiens
agctgccctgtggggagggttg

SEQ ID NO: 9248637 - DNA, 22 bp, Homo sapiens
agctgcccttaataggcattca

SEQ ID NO: 9248638 - DNA, 22 bp, Homo sapiens
agctgccctgggtcttgctgct

SEQ ID NO: 9248639 - DNA, 22 bp, Homo sapiens
agctgccctttatgatgctgaa

SEQ ID NO: 9248640 - DNA, 20 bp, Homo sapiens
agctgcccttttcacatgtt

SEQ ID NO: 9248641 - DNA, 22 bp, Homo sapiens
agctgcccttctcttgcccttg

SEQ ID NO: 9248642 - DNA, 22 bp, Homo sapiens
agctgccactgagggtgcacag

SEQ ID NO: 9248643 - DNA, 20 bp, Homo sapiens
agctgcccctgggcactgcc

SEQ ID NO: 9248644 - DNA, 22 bp, Homo sapiens
agctgcccctcattttcaccac

SEQ ID NO: 9248645 - DNA, 22 bp, Homo sapiens
agctgcccccagggctgtgctt

SEQ ID NO: 9248646 - DNA, 22 bp, Homo sapiens
agctgccctggcggagctgctc

SEQ ID NO: 9248647 - DNA, 22 bp, Homo sapiens
agctgccctgggctggagatgg

SEQ ID NO: 9248648 - DNA, 18 bp, Homo sapiens
agctgccctgggctggag

SEQ ID NO: 9248649 - DNA, 18 bp, Homo sapiens
agctgcttttggcttaaa

SEQ ID NO: 9248650 - DNA, 22 bp, Homo sapiens
agctgcttttattaggacaatg

SEQ ID NO: 9248651 - DNA, 21 bp, Homo sapiens
agctgctttcagctcctagag

SEQ ID NO: 9248652 - DNA, 22 bp, Homo sapiens
agctgctttgccaatgcgttcc

SEQ ID NO: 9248653 - DNA, 22 bp, Homo sapiens
agctgcctgcttatgagctcca

SEQ ID NO: 9248654 - DNA, 17 bp, Homo sapiens
caggaaaatatgagtga

SEQ ID NO: 9248655 - DNA, 22 bp, Homo sapiens
agctgaagaaatgggaagcatt

SEQ ID NO: 9248656 - DNA, 22 bp, Homo sapiens
caggaaatatctcaacacttta

SEQ ID NO: 9248657 - DNA, 22 bp, Homo sapiens
caggaaatcactctgattttgg

SEQ ID NO: 9248658 - DNA, 22 bp, Homo sapiens
agctgaaattcacaaggatcca

SEQ ID NO: 9248659 - DNA, 22 bp, Homo sapiens
agctgaaagtgctttgaggact

SEQ ID NO: 9248660 - DNA, 17 bp, Homo sapiens
agctgaaattgctgaag

SEQ ID NO: 9248661 - DNA, 22 bp, Homo sapiens
agctgaagaaatgggaagcatt

SEQ ID NO: 9248662 - DNA, 22 bp, Homo sapiens
caggaagaagggtggtgagtcc

SEQ ID NO: 9248663 - DNA, 22 bp, Homo sapiens
caggaagaccagggctgtggct

SEQ ID NO: 9248664 - DNA, 22 bp, Homo sapiens
caggaagaagggtggtgagtcc

SEQ ID NO: 9248665 - DNA, 22 bp, Homo sapiens
caggaagaaagaggtgaggtgt

SEQ ID NO: 9248666 - DNA, 22 bp, Homo sapiens
caggaacctgtgcgtagggatg

SEQ ID NO: 9248667 - DNA, 22 bp, Homo sapiens
caggaacctaaagagacattac

SEQ ID NO: 9248668 - DNA, 22 bp, Homo sapiens
agcttctctcagggtatctttc

SEQ ID NO: 9248669 - DNA, 22 bp, Homo sapiens
agcttctccctttcctattggt

SEQ ID NO: 9248670 - DNA, 22 bp, Homo sapiens
agcttctgcccgtgtttgctct

SEQ ID NO: 9248671 - DNA, 17 bp, Homo sapiens
agcttctgccctttctt

SEQ ID NO: 9248672 - DNA, 22 bp, Homo sapiens
agcttctgcatcttttcttccc

SEQ ID NO: 9248673 - DNA, 22 bp, Homo sapiens
agcttctgcccgtgtttgctct

SEQ ID NO: 9248674 - DNA, 22 bp, Homo sapiens
agcttctgcatcttttcttccc

SEQ ID NO: 9248675 - DNA, 22 bp, Homo sapiens
agcttctggaaggcaaggcttg

SEQ ID NO: 9248676 - DNA, 22 bp, Homo sapiens
agcttctgttcatcttccaggc

SEQ ID NO: 9248677 - DNA, 20 bp, Homo sapiens
agcttctgctgcctttcggc

SEQ ID NO: 9248678 - DNA, 22 bp, Homo sapiens
agcttctgcccgtgtttgctct

SEQ ID NO: 9248679 - DNA, 22 bp, Homo sapiens
agctttcaggataatgaaaaag

SEQ ID NO: 9248680 - DNA, 22 bp, Homo sapiens
agctttcacgatttggaacagg

SEQ ID NO: 9248681 - DNA, 22 bp, Homo sapiens
agctttatatttaatgaattct

SEQ ID NO: 9248682 - DNA, 22 bp, Homo sapiens
caggcttgagggcaggcccagt

SEQ ID NO: 9248683 - DNA, 22 bp, Homo sapiens
caggcttgattattcagacaat

SEQ ID NO: 9248684 - DNA, 22 bp, Homo sapiens
agcttctcaggagtctgaggca

SEQ ID NO: 9248685 - DNA, 22 bp, Homo sapiens
caggcttgctgctagagcactt

SEQ ID NO: 9248686 - DNA, 22 bp, Homo sapiens
caggcttcatgaattatgcacc

SEQ ID NO: 9248687 - DNA, 22 bp, Homo sapiens
caggctgtggatcaggagcctt

SEQ ID NO: 9248688 - DNA, 22 bp, Homo sapiens
caggctgtgaaactgagatgcg

SEQ ID NO: 9248689 - DNA, 22 bp, Homo sapiens
caggctgtgttcctggaacccc

SEQ ID NO: 9248690 - DNA, 22 bp, Homo sapiens
caggctgtgggagtcaggaccc

SEQ ID NO: 9248691 - DNA, 22 bp, Homo sapiens
caggctgtgggagtcaggaccc

SEQ ID NO: 9248692 - DNA, 22 bp, Homo sapiens
caggctggagttacctttaggg

SEQ ID NO: 9248693 - DNA, 22 bp, Homo sapiens
agctggtgctgaagctcttgag

SEQ ID NO: 9248694 - DNA, 22 bp, Homo sapiens
caggctggagttcagtggtgtg

SEQ ID NO: 9248695 - DNA, 22 bp, Homo sapiens
caggctgtgaaactgagatgcg

SEQ ID NO: 9248696 - DNA, 22 bp, Homo sapiens
agctggtgctcggggagctggc

SEQ ID NO: 9248697 - DNA, 22 bp, Homo sapiens
agctggtgctcggggagctggc

SEQ ID NO: 9248698 - DNA, 22 bp, Homo sapiens
agctggtgctgaagctcttgag

SEQ ID NO: 9248699 - DNA, 22 bp, Homo sapiens
agctttctcttctttagaaagt

SEQ ID NO: 9248700 - DNA, 22 bp, Homo sapiens
cagggacccgcacaggtagcat

SEQ ID NO: 9248701 - DNA, 22 bp, Homo sapiens
agctttgggccactggctggat

SEQ ID NO: 9248702 - DNA, 22 bp, Homo sapiens
agctttgggggtaggtatagag

SEQ ID NO: 9248703 - DNA, 20 bp, Homo sapiens
aggaaaagggtggtggtaga

SEQ ID NO: 9248704 - DNA, 22 bp, Homo sapiens
aggaaaacacagtattgatgga

SEQ ID NO: 9248705 - DNA, 20 bp, Homo sapiens
aggaaaagggtggtggtaga

SEQ ID NO: 9248706 - DNA, 22 bp, Homo sapiens
aggaaacaacttggcatgagcc

SEQ ID NO: 9248707 - DNA, 22 bp, Homo sapiens
aggaaaattatcatgagagcca

SEQ ID NO: 9248708 - DNA, 22 bp, Homo sapiens
aggaaacagagtgaagcttggg

SEQ ID NO: 9248709 - DNA, 22 bp, Homo sapiens
aggaaaatgaaacagcaactgt

SEQ ID NO: 9248710 - DNA, 22 bp, Homo sapiens
aggaaaatcgagtctggaggca

SEQ ID NO: 9248711 - DNA, 22 bp, Homo sapiens
aggaaaagtgtgaagtatggag

SEQ ID NO: 9248712 - DNA, 22 bp, Homo sapiens
cagggtggtaccagcatctagt

SEQ ID NO: 9248713 - DNA, 22 bp, Homo sapiens
cagggtggggctggctatcaaa

SEQ ID NO: 9248714 - DNA, 22 bp, Homo sapiens
cagggtggggctggctatcaaa

SEQ ID NO: 9248715 - DNA, 22 bp, Homo sapiens
cagggtggggctggctatcaaa

SEQ ID NO: 9248716 - DNA, 22 bp, Homo sapiens
cagggttcagtgggccctcttg

SEQ ID NO: 9248717 - DNA, 22 bp, Homo sapiens
cagggtggtgaatagctatagt

SEQ ID NO: 9248718 - DNA, 22 bp, Homo sapiens
cagggtggtaccagcatctagt

SEQ ID NO: 9248719 - DNA, 22 bp, Homo sapiens
cagggtggtgaatagctatagt

SEQ ID NO: 9248720 - DNA, 22 bp, Homo sapiens
cagggtggtgaatagctatagt

SEQ ID NO: 9248721 - DNA, 22 bp, Homo sapiens
cagggtggtaccagcatctagt

SEQ ID NO: 9248722 - DNA, 22 bp, Homo sapiens
cagggtggtaccagcatctagt

SEQ ID NO: 9248723 - DNA, 22 bp, Homo sapiens
cagggtggtaccagcatctagt

SEQ ID NO: 9248724 - DNA, 17 bp, Homo sapiens
aggaaacattttctttc

SEQ ID NO: 9248725 - DNA, 17 bp, Homo sapiens
aggaaacattttctttc

SEQ ID NO: 9248726 - DNA, 22 bp, Homo sapiens
aggaaacattgatattgggaaa

SEQ ID NO: 9248727 - DNA, 22 bp, Homo sapiens
aggaaacatgaatctgccttga

SEQ ID NO: 9248728 - DNA, 22 bp, Homo sapiens
aggaaacatgaatctgccttga

SEQ ID NO: 9248729 - DNA, 22 bp, Homo sapiens
aggaaacagttggtaatgcata

SEQ ID NO: 9248730 - DNA, 22 bp, Homo sapiens
aggaaacatccttatctattct

SEQ ID NO: 9248731 - DNA, 22 bp, Homo sapiens
aggaaacatccttatctattct

SEQ ID NO: 9248732 - DNA, 22 bp, Homo sapiens
aggaagagtgttacctatgggt

SEQ ID NO: 9248733 - DNA, 22 bp, Homo sapiens
aggaaggactgcagcatttggt

SEQ ID NO: 9248734 - DNA, 22 bp, Homo sapiens
aggaagcaaaaggcagggtcta

SEQ ID NO: 9248735 - DNA, 22 bp, Homo sapiens
aggaagaggtagctgtcaaggg

SEQ ID NO: 9248736 - DNA, 22 bp, Homo sapiens
cagggttgcatgcatctgtggg

SEQ ID NO: 9248737 - DNA, 22 bp, Homo sapiens
cagggttgattccttctgaggg

SEQ ID NO: 9248738 - DNA, 22 bp, Homo sapiens
cagggttggtttctcctcaggc

SEQ ID NO: 9248739 - DNA, 22 bp, Homo sapiens
cagggtttcaccatgttagcag

SEQ ID NO: 9248740 - DNA, 22 bp, Homo sapiens
cagggtttcaccatgttagcag

SEQ ID NO: 9248741 - DNA, 22 bp, Homo sapiens
caggtcccgttccccagagatt

SEQ ID NO: 9248742 - DNA, 22 bp, Homo sapiens
caggtcctcacgcctcaccctt

SEQ ID NO: 9248743 - DNA, 22 bp, Homo sapiens
caggtcctcgggggaggccggc

SEQ ID NO: 9248744 - DNA, 22 bp, Homo sapiens
aggaatgaactcgagtgatctg

SEQ ID NO: 9248745 - DNA, 22 bp, Homo sapiens
aggaatgacagatgtccgcacc

SEQ ID NO: 9248746 - DNA, 22 bp, Homo sapiens
caggtcctggcatcaggcaggt

SEQ ID NO: 9248747 - DNA, 22 bp, Homo sapiens
aggaatgtttagaatgtcagaa

SEQ ID NO: 9248748 - DNA, 22 bp, Homo sapiens
aggaatgttaaagattaagagc

SEQ ID NO: 9248749 - DNA, 21 bp, Homo sapiens
aggaatgtgtatatatacaat

SEQ ID NO: 9248750 - DNA, 23 bp, Homo sapiens
aggaatgtgcccacccatctcct

SEQ ID NO: 9248751 - DNA, 22 bp, Homo sapiens
aggaatgtggcaatcttcaagt

SEQ ID NO: 9248752 - DNA, 22 bp, Homo sapiens
aggaatgtcgtcataaacatga

SEQ ID NO: 9248753 - DNA, 22 bp, Homo sapiens
aggaatgtcgtcataaacatga

SEQ ID NO: 9248754 - DNA, 22 bp, Homo sapiens
aggaatgtgaccactagactct

SEQ ID NO: 9248755 - DNA, 22 bp, Homo sapiens
caggtcccctcccctaccaggc

SEQ ID NO: 9248756 - DNA, 17 bp, Homo sapiens
caggtcccagggtctct

SEQ ID NO: 9248757 - DNA, 22 bp, Homo sapiens
aggaagggttctttgtgaaaga

SEQ ID NO: 9248758 - DNA, 22 bp, Homo sapiens
aggaagggttctttgtgaaaga

SEQ ID NO: 9248759 - DNA, 22 bp, Homo sapiens
aggaagggtggatagtaacgtg

SEQ ID NO: 9248760 - DNA, 22 bp, Homo sapiens
aggaaggggagaagttaaagct

SEQ ID NO: 9248761 - DNA, 22 bp, Homo sapiens
aggaagggtgtcatgagccctt

SEQ ID NO: 9248762 - DNA, 22 bp, Homo sapiens
aggaagggtgtcatgagccctt

SEQ ID NO: 9248763 - DNA, 22 bp, Homo sapiens
aggaagggttctttgtgaaaga

SEQ ID NO: 9248764 - DNA, 22 bp, Homo sapiens
ccaggtctcgggtctgctcgtg

SEQ ID NO: 9248765 - DNA, 22 bp, Homo sapiens
ccaggtctggaaccaccagggc

SEQ ID NO: 9248766 - DNA, 22 bp, Homo sapiens
ccaggtctggaaccaccagggc

SEQ ID NO: 9248767 - DNA, 22 bp, Homo sapiens
aggctgaggcaggtggatcacc

SEQ ID NO: 9248768 - DNA, 22 bp, Homo sapiens
aggctgaggcaggtggatcacc

SEQ ID NO: 9248769 - DNA, 22 bp, Homo sapiens
aggctgaggcaggtggatcacc

SEQ ID NO: 9248770 - DNA, 22 bp, Homo sapiens
aggctgaggcaggtggatcacc

SEQ ID NO: 9248771 - DNA, 22 bp, Homo sapiens
aggctgaggcaggtggatcacc

SEQ ID NO: 9248772 - DNA, 22 bp, Homo sapiens
aggctgaggcaagaggatcact

SEQ ID NO: 9248773 - DNA, 22 bp, Homo sapiens
aggctgaggcaggtggatcacc

SEQ ID NO: 9248774 - DNA, 22 bp, Homo sapiens
aggctgaggcaagaggatcact

SEQ ID NO: 9248775 - DNA, 22 bp, Homo sapiens
aggctgaggcaagaggatcact

SEQ ID NO: 9248776 - DNA, 22 bp, Homo sapiens
aggctgaggcaagaggatcact

SEQ ID NO: 9248777 - DNA, 22 bp, Homo sapiens
aggctgaggcaagaggatcact

SEQ ID NO: 9248778 - DNA, 22 bp, Homo sapiens
aggctgaggatcgtactttcca

SEQ ID NO: 9248779 - DNA, 22 bp, Homo sapiens
aggctgaggatcgtactttcca

SEQ ID NO: 9248780 - DNA, 22 bp, Homo sapiens
aggctgaggcaagaggatcact

SEQ ID NO: 9248781 - DNA, 22 bp, Homo sapiens
ccagggctggtggctgcagagg

SEQ ID NO: 9248782 - DNA, 22 bp, Homo sapiens
ccagggctggtgggagatgctg

SEQ ID NO: 9248783 - DNA, 22 bp, Homo sapiens
ccagggctggtgggagatgctg

SEQ ID NO: 9248784 - DNA, 22 bp, Homo sapiens
ccagggctggtggctgcagagg

SEQ ID NO: 9248785 - DNA, 22 bp, Homo sapiens
ccagggctggtggctgcagagg

SEQ ID NO: 9248786 - DNA, 22 bp, Homo sapiens
ccagggctggtggctgcagagg

SEQ ID NO: 9248787 - DNA, 22 bp, Homo sapiens
ccagggctgggtttgtcggtgt

SEQ ID NO: 9248788 - DNA, 22 bp, Homo sapiens
ccagggctggtgggagatgctg

SEQ ID NO: 9248789 - DNA, 22 bp, Homo sapiens
ccagggctggtgggagatgctg

SEQ ID NO: 9248790 - DNA, 22 bp, Homo sapiens
aggctgagctgacctggtttgg

SEQ ID NO: 9248791 - DNA, 22 bp, Homo sapiens
aggctgaggatccctgtgttct

SEQ ID NO: 9248792 - DNA, 22 bp, Homo sapiens
aggctgagctgacctggtttgg

SEQ ID NO: 9248793 - DNA, 22 bp, Homo sapiens
aggctgaggatcgtactttcca

SEQ ID NO: 9248794 - DNA, 22 bp, Homo sapiens
aggctgaggatcgtactttcca

SEQ ID NO: 9248795 - DNA, 22 bp, Homo sapiens
aggctgaggatcgtactttcca

SEQ ID NO: 9248796 - DNA, 22 bp, Homo sapiens
aggctgaggatccctgtgttct

SEQ ID NO: 9248797 - DNA, 22 bp, Homo sapiens
ccagggctcaggctcccagtgg

SEQ ID NO: 9248798 - DNA, 22 bp, Homo sapiens
ccagggctcaggctcccagtgg

SEQ ID NO: 9248799 - DNA, 19 bp, Homo sapiens
ccagggctccaagctgagt

SEQ ID NO: 9248800 - DNA, 22 bp, Homo sapiens
ccagggctccattgctcatcct

SEQ ID NO: 9248801 - DNA, 22 bp, Homo sapiens
ccagggctccattgctcatcct

SEQ ID NO: 9248802 - DNA, 20 bp, Homo sapiens
ccagggctggctcctgggat

SEQ ID NO: 9248803 - DNA, 20 bp, Homo sapiens
ccagggctggctcctgggat

SEQ ID NO: 9248804 - DNA, 23 bp, Homo sapiens
ccagggctacgggcaccgtcctg

SEQ ID NO: 9248805 - DNA, 22 bp, Homo sapiens
ccagggcctgccacttagcaag

SEQ ID NO: 9248806 - DNA, 22 bp, Homo sapiens
ccaggctgtaaacaccttcaaa

SEQ ID NO: 9248807 - DNA, 22 bp, Homo sapiens
ccagggcagcgcccctccacgc

SEQ ID NO: 9248808 - DNA, 22 bp, Homo sapiens
ccagggcaggagaaagactcac

SEQ ID NO: 9248809 - DNA, 22 bp, Homo sapiens
ccaggctggagtatagtggcgc

SEQ ID NO: 9248810 - DNA, 22 bp, Homo sapiens
ccaggctggagtatagtggcgc

SEQ ID NO: 9248811 - DNA, 22 bp, Homo sapiens
ccaggctggaatcaatattctg

SEQ ID NO: 9248812 - DNA, 22 bp, Homo sapiens
ccaggctgctttattactctgt

SEQ ID NO: 9248813 - DNA, 22 bp, Homo sapiens
ccaggctgctttattactctgt

SEQ ID NO: 9248814 - DNA, 22 bp, Homo sapiens
ccaggctggaatcaatattctg

SEQ ID NO: 9248815 - DNA, 22 bp, Homo sapiens
ccaggctgcttagccttatctt

SEQ ID NO: 9248816 - DNA, 22 bp, Homo sapiens
ccaggctgcttagccttatctt

SEQ ID NO: 9248817 - DNA, 22 bp, Homo sapiens
ccaggctgcttagccttatctt

SEQ ID NO: 9248818 - DNA, 22 bp, Homo sapiens
ccaggctgggctacaagttgag

SEQ ID NO: 9248819 - DNA, 22 bp, Homo sapiens
ccaggctgggctacaagttgag

SEQ ID NO: 9248820 - DNA, 22 bp, Homo sapiens
ccaggctgggctacaagttgag

SEQ ID NO: 9248821 - DNA, 22 bp, Homo sapiens
ccaggctggtctgaatttctag

SEQ ID NO: 9248822 - DNA, 22 bp, Homo sapiens
ccaggctggtctgaatttctag

SEQ ID NO: 9248823 - DNA, 15 bp, Homo sapiens
ccaggctgggtgagc

SEQ ID NO: 9248824 - DNA, 22 bp, Homo sapiens
ccaggctgggctacaagttgag

SEQ ID NO: 9248825 - DNA, 22 bp, Homo sapiens
ccaggctgggcggggaacctgg

SEQ ID NO: 9248826 - DNA, 22 bp, Homo sapiens
ccaggctgggcggggaacctgg

SEQ ID NO: 9248827 - DNA, 21 bp, Homo sapiens
ccaggctgggagggcagttcc

SEQ ID NO: 9248828 - DNA, 21 bp, Homo sapiens
ccaggctgggagggcagttcc

SEQ ID NO: 9248829 - DNA, 22 bp, Homo sapiens
aggctaagtgggtgtcagggcc

SEQ ID NO: 9248830 - DNA, 22 bp, Homo sapiens
aggctaaggtgggaggatcgct

SEQ ID NO: 9248831 - DNA, 22 bp, Homo sapiens
aggctaagggatgactggagtg

SEQ ID NO: 9248832 - DNA, 22 bp, Homo sapiens
aggctaaggagtgtgatgctca

SEQ ID NO: 9248833 - DNA, 19 bp, Homo sapiens
aggctaaagagtcttgcgt

SEQ ID NO: 9248834 - DNA, 22 bp, Homo sapiens
aggctaagatgtggtctgagca

SEQ ID NO: 9248835 - DNA, 22 bp, Homo sapiens
aggcgtggttgaggcgagcata

SEQ ID NO: 9248836 - DNA, 22 bp, Homo sapiens
ccaggctctgcgctggacatgg

SEQ ID NO: 9248837 - DNA, 22 bp, Homo sapiens
ccaggctctgcgctggacatgg

SEQ ID NO: 9248838 - DNA, 22 bp, Homo sapiens
ccaggctgctgttggtgtccgc

SEQ ID NO: 9248839 - DNA, 22 bp, Homo sapiens
ccaggctgctgttggtgtccgc

SEQ ID NO: 9248840 - DNA, 22 bp, Homo sapiens
ccaggctgctgttggtgtccgc

SEQ ID NO: 9248841 - DNA, 22 bp, Homo sapiens
aggctagactttggcgaagcac

SEQ ID NO: 9248842 - DNA, 22 bp, Homo sapiens
aggctggccctactggctgcct

SEQ ID NO: 9248843 - DNA, 22 bp, Homo sapiens
aggctggccctactggctgcct

SEQ ID NO: 9248844 - DNA, 22 bp, Homo sapiens
aggctggcgacatctggcgggc

SEQ ID NO: 9248845 - DNA, 22 bp, Homo sapiens
ccatttcattgcctgtaaagtg

SEQ ID NO: 9248846 - DNA, 22 bp, Homo sapiens
ccatttagtaaggaagaacagc

SEQ ID NO: 9248847 - DNA, 22 bp, Homo sapiens
aggctggcggtgactgctctga

SEQ ID NO: 9248848 - DNA, 22 bp, Homo sapiens
ccatttaacacagagttttcca

SEQ ID NO: 9248849 - DNA, 22 bp, Homo sapiens
aggctggctggcaggggacaca

SEQ ID NO: 9248850 - DNA, 22 bp, Homo sapiens
ccatttgtggtttatttgctct

SEQ ID NO: 9248851 - DNA, 22 bp, Homo sapiens
aggctggggaattgaatttgct

SEQ ID NO: 9248852 - DNA, 22 bp, Homo sapiens
aggctggggaattgaatttgct

SEQ ID NO: 9248853 - DNA, 22 bp, Homo sapiens
aggctgggtacctgtcatatgc

SEQ ID NO: 9248854 - DNA, 22 bp, Homo sapiens
aggctggaaagggaccagagtg

SEQ ID NO: 9248855 - DNA, 19 bp, Homo sapiens
aggctggagacaccaggcc

SEQ ID NO: 9248856 - DNA, 19 bp, Homo sapiens
aggctggagacaccaggcc

SEQ ID NO: 9248857 - DNA, 22 bp, Homo sapiens
aggctgctctgcgaagtcagct

SEQ ID NO: 9248858 - DNA, 22 bp, Homo sapiens
aggctgcttcttgtccttggca

SEQ ID NO: 9248859 - DNA, 22 bp, Homo sapiens
ccaggtctttgactaatatgct

SEQ ID NO: 9248860 - DNA, 22 bp, Homo sapiens
ccaggtctttggccttggcact

SEQ ID NO: 9248861 - DNA, 22 bp, Homo sapiens
ccaggtctggaaccaccagggc

SEQ ID NO: 9248862 - DNA, 22 bp, Homo sapiens
ccaggtcttcactttactgaag

SEQ ID NO: 9248863 - DNA, 22 bp, Homo sapiens
ccaggtcttcactttactgaag

SEQ ID NO: 9248864 - DNA, 22 bp, Homo sapiens
ccaggtctgtcttcttagctca

SEQ ID NO: 9248865 - DNA, 22 bp, Homo sapiens
aggctggagacccgccaagaaa

SEQ ID NO: 9248866 - DNA, 22 bp, Homo sapiens
aggctggagacccgccaagaaa

SEQ ID NO: 9248867 - DNA, 22 bp, Homo sapiens
aggctggagacccgccaagaaa

SEQ ID NO: 9248868 - DNA, 22 bp, Homo sapiens
aggctggagagtgcagtggcgt

SEQ ID NO: 9248869 - DNA, 22 bp, Homo sapiens
aggctggagagtgcagtggcgt

SEQ ID NO: 9248870 - DNA, 22 bp, Homo sapiens
aggctggagtacagtggctatt

SEQ ID NO: 9248871 - DNA, 22 bp, Homo sapiens
aggctggagcaagggggcatat

SEQ ID NO: 9248872 - DNA, 22 bp, Homo sapiens
aggctggagagtgcagtggcgt

SEQ ID NO: 9248873 - DNA, 22 bp, Homo sapiens
aggctggagcaagggggcatat

SEQ ID NO: 9248874 - DNA, 22 bp, Homo sapiens
aggctggagcaagggggcatat

SEQ ID NO: 9248875 - DNA, 22 bp, Homo sapiens
aggctggagtacagtggctatt

SEQ ID NO: 9248876 - DNA, 22 bp, Homo sapiens
aggctggagtacagtggctatt

SEQ ID NO: 9248877 - DNA, 22 bp, Homo sapiens
aggctggagtgcaatggcgtga

SEQ ID NO: 9248878 - DNA, 22 bp, Homo sapiens
aggctggagtgtagcagtgcag

SEQ ID NO: 9248879 - DNA, 22 bp, Homo sapiens
aggctggagtgctggagtgctg

SEQ ID NO: 9248880 - DNA, 22 bp, Homo sapiens
aggcctggcctttatgttcaag

SEQ ID NO: 9248881 - DNA, 22 bp, Homo sapiens
aggcctggcctttatgttcaag

SEQ ID NO: 9248882 - DNA, 22 bp, Homo sapiens
aggcctggcctttatgttcaag

SEQ ID NO: 9248883 - DNA, 22 bp, Homo sapiens
aggcctggctttggtttgctga

SEQ ID NO: 9248884 - DNA, 22 bp, Homo sapiens
aggcctggctttggtttgctga

SEQ ID NO: 9248885 - DNA, 22 bp, Homo sapiens
aggcctggcctttatgttcaag

SEQ ID NO: 9248886 - DNA, 22 bp, Homo sapiens
aggcctggcctgggcggcattg

SEQ ID NO: 9248887 - DNA, 22 bp, Homo sapiens
aggcctggcctgggcggcattg

SEQ ID NO: 9248888 - DNA, 22 bp, Homo sapiens
aggcctggccccagttgctagg

SEQ ID NO: 9248889 - DNA, 22 bp, Homo sapiens
aggcctggccccagttgctagg

SEQ ID NO: 9248890 - DNA, 22 bp, Homo sapiens
aggcctggcatgagacctgaga

SEQ ID NO: 9248891 - DNA, 22 bp, Homo sapiens
aggcctggccccagttgctagg

SEQ ID NO: 9248892 - DNA, 22 bp, Homo sapiens
aggcctgggacgggagccgtga

SEQ ID NO: 9248893 - DNA, 18 bp, Homo sapiens
aggcctgggaagctgagg

SEQ ID NO: 9248894 - DNA, 18 bp, Homo sapiens
aggcctgggaagctgagg

SEQ ID NO: 9248895 - DNA, 22 bp, Homo sapiens
aggcggtggccaaggagcggga

SEQ ID NO: 9248896 - DNA, 22 bp, Homo sapiens
aggcggtgtgctttgcagagca

SEQ ID NO: 9248897 - DNA, 22 bp, Homo sapiens
aggcgtgggaggatctgaggcc

SEQ ID NO: 9248898 - DNA, 22 bp, Homo sapiens
aggcggtgctgtggacagtgac

SEQ ID NO: 9248899 - DNA, 22 bp, Homo sapiens
aggcgctgtgcttggggctgga

SEQ ID NO: 9248900 - DNA, 22 bp, Homo sapiens
aggcggctggtgtcctgcaggt

SEQ ID NO: 9248901 - DNA, 22 bp, Homo sapiens
aggcgctgtgcttggggctgga

SEQ ID NO: 9248902 - DNA, 22 bp, Homo sapiens
aggcgctgcatgtgaaggagtt

SEQ ID NO: 9248903 - DNA, 22 bp, Homo sapiens
aggcgctgcgctggggccagaa

SEQ ID NO: 9248904 - DNA, 22 bp, Homo sapiens
aggcgctgcatgtgaaggagtt

SEQ ID NO: 9248905 - DNA, 22 bp, Homo sapiens
aggcctggtgtgccggatgcag

SEQ ID NO: 9248906 - DNA, 22 bp, Homo sapiens
ccaggacaagccagagggacag

SEQ ID NO: 9248907 - DNA, 22 bp, Homo sapiens
aggcctctgggtctcctctgac

SEQ ID NO: 9248908 - DNA, 22 bp, Homo sapiens
aggcctgctgtcttgaggccaa

SEQ ID NO: 9248909 - DNA, 22 bp, Homo sapiens
ccagctggcaggagagtcaggg

SEQ ID NO: 9248910 - DNA, 22 bp, Homo sapiens
ccagctggcaggagagtcaggg

SEQ ID NO: 9248911 - DNA, 22 bp, Homo sapiens
ccagctggagctcgcagatagg

SEQ ID NO: 9248912 - DNA, 22 bp, Homo sapiens
ccagctggagctcgcagatagg

SEQ ID NO: 9248913 - DNA, 22 bp, Homo sapiens
ccagctggaagagtgcagaact

SEQ ID NO: 9248914 - DNA, 22 bp, Homo sapiens
ccagctgagaagtgtaaagtga

SEQ ID NO: 9248915 - DNA, 22 bp, Homo sapiens
ccagctggaacggcagcccagc

SEQ ID NO: 9248916 - DNA, 22 bp, Homo sapiens
ccagctgacgatgcctggtctc

SEQ ID NO: 9248917 - DNA, 22 bp, Homo sapiens
ccagctcttttggctgagtgag

SEQ ID NO: 9248918 - DNA, 22 bp, Homo sapiens
ccagcaggagatgcctgtgtct

SEQ ID NO: 9248919 - DNA, 22 bp, Homo sapiens
ccagcaggagatgcctgtgtct

SEQ ID NO: 9248920 - DNA, 23 bp, Homo sapiens
ccagctccgtgagcctcgggctc

SEQ ID NO: 9248921 - DNA, 21 bp, Homo sapiens
ccagctctgcctccagttggt

SEQ ID NO: 9248922 - DNA, 21 bp, Homo sapiens
ccagctctgcctccagttggt

SEQ ID NO: 9248923 - DNA, 21 bp, Homo sapiens
ccagctctgcctccagttggt

SEQ ID NO: 9248924 - DNA, 21 bp, Homo sapiens
ccagctctgcctccagttggt

SEQ ID NO: 9248925 - DNA, 22 bp, Homo sapiens
ccagctcttttggctgagtgag

SEQ ID NO: 9248926 - DNA, 22 bp, Homo sapiens
ccagctcttttggctgagtgag

SEQ ID NO: 9248927 - DNA, 22 bp, Homo sapiens
ccagctcttggtgcacttacat

SEQ ID NO: 9248928 - DNA, 22 bp, Homo sapiens
ccagctcttggtgcacttacat

SEQ ID NO: 9248929 - DNA, 22 bp, Homo sapiens
ccagctcttttggctgagtgag

SEQ ID NO: 9248930 - DNA, 22 bp, Homo sapiens
ccagctcttggtgcacttacat

SEQ ID NO: 9248931 - DNA, 22 bp, Homo sapiens
ccagctctgtaagctgtgaaat

SEQ ID NO: 9248932 - DNA, 22 bp, Homo sapiens
ccagctctggcttcttgctggg

SEQ ID NO: 9248933 - DNA, 22 bp, Homo sapiens
ccagctctgtaagctgtgaaat

SEQ ID NO: 9248934 - DNA, 22 bp, Homo sapiens
ccagctcttggtgcacttacat

SEQ ID NO: 9248935 - DNA, 22 bp, Homo sapiens
ccagctctgcttgcccagtcag

SEQ ID NO: 9248936 - DNA, 22 bp, Homo sapiens
ccagctctgcttgcccagtcag

SEQ ID NO: 9248937 - DNA, 21 bp, Homo sapiens
ccagctctgcctccagttggt

SEQ ID NO: 9248938 - DNA, 22 bp, Homo sapiens
ccagctctggcttcttgctggg

SEQ ID NO: 9248939 - DNA, 22 bp, Homo sapiens
ccagctctggcttcttgctggg

SEQ ID NO: 9248940 - DNA, 22 bp, Homo sapiens
ccagctctgcttgcccagtcag

SEQ ID NO: 9248941 - DNA, 22 bp, Homo sapiens
ccagctctgcttgcccagtcag

SEQ ID NO: 9248942 - DNA, 22 bp, Homo sapiens
ccagctctggcttcttgctggg

SEQ ID NO: 9248943 - DNA, 22 bp, Homo sapiens
aggccacagtcagtgggtgctg

SEQ ID NO: 9248944 - DNA, 22 bp, Homo sapiens
aggccacagttgaggccagcaa

SEQ ID NO: 9248945 - DNA, 22 bp, Homo sapiens
aggccacagtactttgcagacc

SEQ ID NO: 9248946 - DNA, 22 bp, Homo sapiens
aggccacagtactttgcagacc

SEQ ID NO: 9248947 - DNA, 22 bp, Homo sapiens
aggccacagtcagtgggtgctg

SEQ ID NO: 9248948 - DNA, 22 bp, Homo sapiens
ccagactggggctccttgaggg

SEQ ID NO: 9248949 - DNA, 22 bp, Homo sapiens
ccagactgtggagttcctggtg

SEQ ID NO: 9248950 - DNA, 22 bp, Homo sapiens
ccagaagaccggggagtcaggg

SEQ ID NO: 9248951 - DNA, 22 bp, Homo sapiens
ccagacagttccttgaggttca

SEQ ID NO: 9248952 - DNA, 22 bp, Homo sapiens
ccagaccctccattcaagctcc

SEQ ID NO: 9248953 - DNA, 22 bp, Homo sapiens
ccagaccaccctggccatgcac

SEQ ID NO: 9248954 - DNA, 21 bp, Homo sapiens
ccagactggcctatgtggtag

SEQ ID NO: 9248955 - DNA, 22 bp, Homo sapiens
ccactgggggctgctcccaggt

SEQ ID NO: 9248956 - DNA, 22 bp, Homo sapiens
ccactgggggctgcaggcactc

SEQ ID NO: 9248957 - DNA, 22 bp, Homo sapiens
ccactgggggctgcaggcactc

SEQ ID NO: 9248958 - DNA, 18 bp, Homo sapiens
aggcaggctggagtgact

SEQ ID NO: 9248959 - DNA, 22 bp, Homo sapiens
ccagaaagactttttaggtacg

SEQ ID NO: 9248960 - DNA, 22 bp, Homo sapiens
ccagaaaatatggctaaggtga

SEQ ID NO: 9248961 - DNA, 22 bp, Homo sapiens
ccagaaacagatgacaagccct

SEQ ID NO: 9248962 - DNA, 22 bp, Homo sapiens
ccagaacacagtggaagaatat

SEQ ID NO: 9248963 - DNA, 23 bp, Homo sapiens
aggcccaactctgtgagggctgc

SEQ ID NO: 9248964 - DNA, 19 bp, Homo sapiens
ccagcagctttgattctct

SEQ ID NO: 9248965 - DNA, 22 bp, Homo sapiens
aggcccaaaagaaaccactggg

SEQ ID NO: 9248966 - DNA, 22 bp, Homo sapiens
aggccaggttcctcaatcttga

SEQ ID NO: 9248967 - DNA, 22 bp, Homo sapiens
aggccaggtggtcatgcttgct

SEQ ID NO: 9248968 - DNA, 22 bp, Homo sapiens
aggccaggttcctcaatcttga

SEQ ID NO: 9248969 - DNA, 22 bp, Homo sapiens
aggccaggtggtcatgcttgct

SEQ ID NO: 9248970 - DNA, 22 bp, Homo sapiens
aggccagtgcctttccagggct

SEQ ID NO: 9248971 - DNA, 22 bp, Homo sapiens
aggccagtgcagctggaacaga

SEQ ID NO: 9248972 - DNA, 22 bp, Homo sapiens
aggccagtgtggctggagcaca

SEQ ID NO: 9248973 - DNA, 22 bp, Homo sapiens
aggccagaaatgtcagggagtg

SEQ ID NO: 9248974 - DNA, 22 bp, Homo sapiens
ccagagcctggcatctgcataa

SEQ ID NO: 9248975 - DNA, 22 bp, Homo sapiens
ccagagcctggcatctgcataa

SEQ ID NO: 9248976 - DNA, 21 bp, Homo sapiens
ccagagcctgctgagccccct

SEQ ID NO: 9248977 - DNA, 22 bp, Homo sapiens
aggccacagttgaggccagcaa

SEQ ID NO: 9248978 - DNA, 22 bp, Homo sapiens
aggccacagttgaggccagcaa

SEQ ID NO: 9248979 - DNA, 22 bp, Homo sapiens
aggccacatagcttgcatgtag

SEQ ID NO: 9248980 - DNA, 22 bp, Homo sapiens
aggccacatagcttgcatgtag

SEQ ID NO: 9248981 - DNA, 22 bp, Homo sapiens
ccagagctccagggctacagaa

SEQ ID NO: 9248982 - DNA, 22 bp, Homo sapiens
ccagagctccagggctacagaa

SEQ ID NO: 9248983 - DNA, 22 bp, Homo sapiens
ccagagctgaggagatgggctt

SEQ ID NO: 9248984 - DNA, 22 bp, Homo sapiens
ccagagctaaacacacaggctg

SEQ ID NO: 9248985 - DNA, 17 bp, Homo sapiens
ccagagctactgagact

SEQ ID NO: 9248986 - DNA, 22 bp, Homo sapiens
ccagagctccagggctacagaa

SEQ ID NO: 9248987 - DNA, 23 bp, Homo sapiens
ccctgcccattgagcaggacgtc

SEQ ID NO: 9248988 - DNA, 22 bp, Homo sapiens
ccctgccctggagacacttaaa

SEQ ID NO: 9248989 - DNA, 22 bp, Homo sapiens
ccctgccccaggcggcttcact

SEQ ID NO: 9248990 - DNA, 22 bp, Homo sapiens
ccctgcccaccacatgctggga

SEQ ID NO: 9248991 - DNA, 22 bp, Homo sapiens
ccctgcccatcggggcggcctg

SEQ ID NO: 9248992 - DNA, 22 bp, Homo sapiens
ccctgctgtcaggtgctgggag

SEQ ID NO: 9248993 - DNA, 22 bp, Homo sapiens
ccctgccctgggcagaagtggg

SEQ ID NO: 9248994 - DNA, 22 bp, Homo sapiens
ccctcccaggagtggccagaga

SEQ ID NO: 9248995 - DNA, 22 bp, Homo sapiens
ccctcccaggagtggccagaga

SEQ ID NO: 9248996 - DNA, 22 bp, Homo sapiens
ccctcccagatgggcttgaggt

SEQ ID NO: 9248997 - DNA, 22 bp, Homo sapiens
ccctcccagatgggcttgaggt

SEQ ID NO: 9248998 - DNA, 22 bp, Homo sapiens
ccctcccagatgggcttgaggt

SEQ ID NO: 9248999 - DNA, 22 bp, Homo sapiens
ccctgccaatcccgtctctctg

SEQ ID NO: 9249000 - DNA, 22 bp, Homo sapiens
ccctgccaatcccgtctctctg

SEQ ID NO: 9249001 - DNA, 23 bp, Homo sapiens
ccctgcatctgtccctcaccagt

SEQ ID NO: 9249002 - DNA, 22 bp, Homo sapiens
ccctgccagatgtgcttcagtt

SEQ ID NO: 9249003 - DNA, 17 bp, Homo sapiens
ccctgccaccaggaagc

SEQ ID NO: 9249004 - DNA, 18 bp, Homo sapiens
ccctgccagctcccagca

SEQ ID NO: 9249005 - DNA, 22 bp, Homo sapiens
ccctcccaagcactctgacata

SEQ ID NO: 9249006 - DNA, 22 bp, Homo sapiens
ccctcccaagcactctgacata

SEQ ID NO: 9249007 - DNA, 22 bp, Homo sapiens
ccctcccaagcactctgacata

SEQ ID NO: 9249008 - DNA, 22 bp, Homo sapiens
ccctcccaagcactctgacata

SEQ ID NO: 9249009 - DNA, 20 bp, Homo sapiens
ccctcccagatgcttcccaa

SEQ ID NO: 9249010 - DNA, 20 bp, Homo sapiens
ccctcccagatgcttcccaa

SEQ ID NO: 9249011 - DNA, 20 bp, Homo sapiens
ccctcccagatgcttcccaa

SEQ ID NO: 9249012 - DNA, 22 bp, Homo sapiens
ccctccattaaaacagacctat

SEQ ID NO: 9249013 - DNA, 22 bp, Homo sapiens
ccctcagctccaccctcagcag

SEQ ID NO: 9249014 - DNA, 22 bp, Homo sapiens
ccctccatgagtgtgctgctgg

SEQ ID NO: 9249015 - DNA, 22 bp, Homo sapiens
ccctcagctccaccctcagcag

SEQ ID NO: 9249016 - DNA, 22 bp, Homo sapiens
ccctcagctccaccctcagcag

SEQ ID NO: 9249017 - DNA, 22 bp, Homo sapiens
cccattcatcctcgcttccttc

SEQ ID NO: 9249018 - DNA, 22 bp, Homo sapiens
ccccagaaggggacagagggta

SEQ ID NO: 9249019 - DNA, 22 bp, Homo sapiens
ccccagaaggggacagagggta

SEQ ID NO: 9249020 - DNA, 22 bp, Homo sapiens
ccccagaagtttgcacaagaga

SEQ ID NO: 9249021 - DNA, 22 bp, Homo sapiens
ccccagagaaagtcagcagcat

SEQ ID NO: 9249022 - DNA, 22 bp, Homo sapiens
cccatgagattctgaatttggc

SEQ ID NO: 9249023 - DNA, 17 bp, Homo sapiens
ccctcactcctgccggg

SEQ ID NO: 9249024 - DNA, 22 bp, Homo sapiens
ccctcactctgcctcctggggt

SEQ ID NO: 9249025 - DNA, 22 bp, Homo sapiens
ccccagcactctgactcttacc

SEQ ID NO: 9249026 - DNA, 22 bp, Homo sapiens
ccccttccacagtgcttcctaa

SEQ ID NO: 9249027 - DNA, 22 bp, Homo sapiens
cccaggagatggaggttgcagt

SEQ ID NO: 9249028 - DNA, 22 bp, Homo sapiens
cccaggagatggaggttgcagt

SEQ ID NO: 9249029 - DNA, 22 bp, Homo sapiens
cccaggagatgcactccattgg

SEQ ID NO: 9249030 - DNA, 22 bp, Homo sapiens
cccaggagatgcactccattgg

SEQ ID NO: 9249031 - DNA, 22 bp, Homo sapiens
cccaggagatctggatctcgtc

SEQ ID NO: 9249032 - DNA, 19 bp, Homo sapiens
cccaggagcagtattgatg

SEQ ID NO: 9249033 - DNA, 19 bp, Homo sapiens
cccaggagcagtattgatg

SEQ ID NO: 9249034 - DNA, 23 bp, Homo sapiens
cccaggagcctgagtcctctctg

SEQ ID NO: 9249035 - DNA, 22 bp, Homo sapiens
cccaggagccatctgtcttggc

SEQ ID NO: 9249036 - DNA, 22 bp, Homo sapiens
cccaggagatggtgcgtggtct

SEQ ID NO: 9249037 - DNA, 22 bp, Homo sapiens
cccaggagatggaggttgcagt

SEQ ID NO: 9249038 - DNA, 22 bp, Homo sapiens
cccaggagatggaggttgcagt

SEQ ID NO: 9249039 - DNA, 22 bp, Homo sapiens
cccaggaggtagaggttgcagt

SEQ ID NO: 9249040 - DNA, 22 bp, Homo sapiens
cccaggagcttctctctgcctc

SEQ ID NO: 9249041 - DNA, 22 bp, Homo sapiens
cccaggagcttctctctgcctc

SEQ ID NO: 9249042 - DNA, 22 bp, Homo sapiens
cccaggaggtagaggttgcagt

SEQ ID NO: 9249043 - DNA, 22 bp, Homo sapiens
cccaggaggtagaggttgcagt

SEQ ID NO: 9249044 - DNA, 22 bp, Homo sapiens
cccaggaggtagaggttgcagt

SEQ ID NO: 9249045 - DNA, 22 bp, Homo sapiens
cccaggaggtcaaggctgcagt

SEQ ID NO: 9249046 - DNA, 23 bp, Homo sapiens
cccaggagcctgagtcctctctg

SEQ ID NO: 9249047 - DNA, 23 bp, Homo sapiens
cccaggagcctgagtcctctctg

SEQ ID NO: 9249048 - DNA, 20 bp, Homo sapiens
cccaggagctgtgccccatc

SEQ ID NO: 9249049 - DNA, 20 bp, Homo sapiens
cccaggagctgtgccccatc

SEQ ID NO: 9249050 - DNA, 20 bp, Homo sapiens
cccaggagctgtgccccatc

SEQ ID NO: 9249051 - DNA, 20 bp, Homo sapiens
cccaggagctgtgccccatc

SEQ ID NO: 9249052 - DNA, 22 bp, Homo sapiens
aggctgtgaactctatgctgaa

SEQ ID NO: 9249053 - DNA, 22 bp, Homo sapiens
aggctgtctgaccccagagccc

SEQ ID NO: 9249054 - DNA, 22 bp, Homo sapiens
aggctgtctcagcctgcttgca

SEQ ID NO: 9249055 - DNA, 22 bp, Homo sapiens
aggctgtcctctcttgctcagt

SEQ ID NO: 9249056 - DNA, 21 bp, Homo sapiens
aggctgtcctttgccagccct

SEQ ID NO: 9249057 - DNA, 21 bp, Homo sapiens
aggctgtcctttgccagccct

SEQ ID NO: 9249058 - DNA, 22 bp, Homo sapiens
aggctggtgcctgcagtgaatc

SEQ ID NO: 9249059 - DNA, 22 bp, Homo sapiens
aggctggtgcttcctagggcag

SEQ ID NO: 9249060 - DNA, 22 bp, Homo sapiens
aggctggtgcttcctagggcag

SEQ ID NO: 9249061 - DNA, 22 bp, Homo sapiens
aggctgtcatctttgcaggcag

SEQ ID NO: 9249062 - DNA, 22 bp, Homo sapiens
aggctgtagtgcatgtgctatg

SEQ ID NO: 9249063 - DNA, 22 bp, Homo sapiens
aggctggtgtgtcctgaagcct

SEQ ID NO: 9249064 - DNA, 22 bp, Homo sapiens
aggctggtagtatttagtcaca

SEQ ID NO: 9249065 - DNA, 22 bp, Homo sapiens
aggctggtctatacggagacga

SEQ ID NO: 9249066 - DNA, 22 bp, Homo sapiens
aggctggtgattagaagcagcc

SEQ ID NO: 9249067 - DNA, 22 bp, Homo sapiens
aggctggtctgttggcattttt

SEQ ID NO: 9249068 - DNA, 22 bp, Homo sapiens
cccaggaggtcgaagctgcagt

SEQ ID NO: 9249069 - DNA, 22 bp, Homo sapiens
cccaggaggtcgaagctgcagt

SEQ ID NO: 9249070 - DNA, 22 bp, Homo sapiens
cccaggaggtcgaagctgcagt

SEQ ID NO: 9249071 - DNA, 22 bp, Homo sapiens
cccaggaggtcgaagctgcagt

SEQ ID NO: 9249072 - DNA, 22 bp, Homo sapiens
cccaggctgagttagaggtgtc

SEQ ID NO: 9249073 - DNA, 23 bp, Homo sapiens
cccaggctacaaattatgctctg

SEQ ID NO: 9249074 - DNA, 22 bp, Homo sapiens
cccaggaggtggagcttgcagt

SEQ ID NO: 9249075 - DNA, 22 bp, Homo sapiens
cccaggaggtcaaggctgcagt

SEQ ID NO: 9249076 - DNA, 22 bp, Homo sapiens
cccaggaggtcaaggctgcagt

SEQ ID NO: 9249077 - DNA, 22 bp, Homo sapiens
cccaggaggtcaaggctgcagt

SEQ ID NO: 9249078 - DNA, 22 bp, Homo sapiens
cccaggaggtcgaagctgcagt

SEQ ID NO: 9249079 - DNA, 22 bp, Homo sapiens
cccaggaggtcgaagctgcagt

SEQ ID NO: 9249080 - DNA, 22 bp, Homo sapiens
cccaggctgcatgagtccatgg

SEQ ID NO: 9249081 - DNA, 22 bp, Homo sapiens
cccaggctgatgttcagcgggt

SEQ ID NO: 9249082 - DNA, 22 bp, Homo sapiens
cccaggctgatgttcagcgggt

SEQ ID NO: 9249083 - DNA, 22 bp, Homo sapiens
cccaggctgatgttcagcgggt

SEQ ID NO: 9249084 - DNA, 22 bp, Homo sapiens
cccaggctgcgtatccacaata

SEQ ID NO: 9249085 - DNA, 22 bp, Homo sapiens
cccaggctgccacgattactgc

SEQ ID NO: 9249086 - DNA, 22 bp, Homo sapiens
cccaggctgcatgagtccatgg

SEQ ID NO: 9249087 - DNA, 22 bp, Homo sapiens
cccaggctgccacgattactgc

SEQ ID NO: 9249088 - DNA, 22 bp, Homo sapiens
cccaggctgatgttcagcgggt

SEQ ID NO: 9249089 - DNA, 22 bp, Homo sapiens
cccaggctgatgttcagcgggt

SEQ ID NO: 9249090 - DNA, 22 bp, Homo sapiens
cccaggctgatgggatgggcca

SEQ ID NO: 9249091 - DNA, 22 bp, Homo sapiens
cccaggctgatgggatgggcca

SEQ ID NO: 9249092 - DNA, 22 bp, Homo sapiens
cccaggctgatgggatgggcca

SEQ ID NO: 9249093 - DNA, 22 bp, Homo sapiens
cccaggctgatgggatgggcca

SEQ ID NO: 9249094 - DNA, 22 bp, Homo sapiens
cccatctcagtcgtgctaaggg

SEQ ID NO: 9249095 - DNA, 22 bp, Homo sapiens
cccaggcttttctcttgcccca

SEQ ID NO: 9249096 - DNA, 22 bp, Homo sapiens
cccagtacctctgttccctgct

SEQ ID NO: 9249097 - DNA, 22 bp, Homo sapiens
cccaggcttttctcttgcccca

SEQ ID NO: 9249098 - DNA, 22 bp, Homo sapiens
cccaggcttttaagttagacag

SEQ ID NO: 9249099 - DNA, 22 bp, Homo sapiens
cccaggcttttaagttagacag

SEQ ID NO: 9249100 - DNA, 22 bp, Homo sapiens
cccaggctgtgcaaacttcaaa

SEQ ID NO: 9249101 - DNA, 22 bp, Homo sapiens
cccaggctgtgcaaacttcaaa

SEQ ID NO: 9249102 - DNA, 22 bp, Homo sapiens
cccaggcttcccaatcagaagg

SEQ ID NO: 9249103 - DNA, 22 bp, Homo sapiens
cccaggcttcccaatcagaagg

SEQ ID NO: 9249104 - DNA, 18 bp, Homo sapiens
cccaggctttgtgggtct

SEQ ID NO: 9249105 - DNA, 18 bp, Homo sapiens
cccaggctttgtgggtct

SEQ ID NO: 9249106 - DNA, 18 bp, Homo sapiens
cccaggctttgtgggtct

SEQ ID NO: 9249107 - DNA, 18 bp, Homo sapiens
cccaggctttgtgggtct

SEQ ID NO: 9249108 - DNA, 22 bp, Homo sapiens
cccaggcttttaagttagacag

SEQ ID NO: 9249109 - DNA, 22 bp, Homo sapiens
cccaggctgtctgtcctttgct

SEQ ID NO: 9249110 - DNA, 22 bp, Homo sapiens
cccaggctgtctgtcctttgct

SEQ ID NO: 9249111 - DNA, 22 bp, Homo sapiens
cccaggctggtcctgaactcct

SEQ ID NO: 9249112 - DNA, 22 bp, Homo sapiens
cccaggctgcgtatccacaata

SEQ ID NO: 9249113 - DNA, 22 bp, Homo sapiens
cccaggctgcgtatccacaata

SEQ ID NO: 9249114 - DNA, 22 bp, Homo sapiens
agggcgaggagacggaggcaca

SEQ ID NO: 9249115 - DNA, 22 bp, Homo sapiens
agggcgacaatggagagcgttt

SEQ ID NO: 9249116 - DNA, 22 bp, Homo sapiens
agggcgcctgctgtggccaccg

SEQ ID NO: 9249117 - DNA, 22 bp, Homo sapiens
agggcgaggagacggaggcaca

SEQ ID NO: 9249118 - DNA, 22 bp, Homo sapiens
agggcgtggtggtgctggagca

SEQ ID NO: 9249119 - DNA, 19 bp, Homo sapiens
agggcggggcccaggcaca

SEQ ID NO: 9249120 - DNA, 22 bp, Homo sapiens
cctcaggatacaggagccacag

SEQ ID NO: 9249121 - DNA, 22 bp, Homo sapiens
cctcaggatacaggagccacag

SEQ ID NO: 9249122 - DNA, 22 bp, Homo sapiens
cctcaggcaggaaactgtcccg

SEQ ID NO: 9249123 - DNA, 22 bp, Homo sapiens
cctcaggcaagtcacttaacat

SEQ ID NO: 9249124 - DNA, 22 bp, Homo sapiens
cctcaggccctgtccctgcgcc

SEQ ID NO: 9249125 - DNA, 22 bp, Homo sapiens
agggctggagccacagctggga

SEQ ID NO: 9249126 - DNA, 22 bp, Homo sapiens
agggctggagccacagctggga

SEQ ID NO: 9249127 - DNA, 22 bp, Homo sapiens
agggctggagccacagctggga

SEQ ID NO: 9249128 - DNA, 22 bp, Homo sapiens
agggctggagccacagctggga

SEQ ID NO: 9249129 - DNA, 22 bp, Homo sapiens
agggctggagggtactagttta

SEQ ID NO: 9249130 - DNA, 22 bp, Homo sapiens
agggctggcaagggattgaaat

SEQ ID NO: 9249131 - DNA, 22 bp, Homo sapiens
agggctggcaagggattgaaat

SEQ ID NO: 9249132 - DNA, 22 bp, Homo sapiens
agggctggagggtactagttta

SEQ ID NO: 9249133 - DNA, 22 bp, Homo sapiens
agggctggagggtactagttta

SEQ ID NO: 9249134 - DNA, 22 bp, Homo sapiens
agggctggcaagggattgaaat

SEQ ID NO: 9249135 - DNA, 22 bp, Homo sapiens
agggctggcatctctaatgctg

SEQ ID NO: 9249136 - DNA, 22 bp, Homo sapiens
agggctaggaatggaactggag

SEQ ID NO: 9249137 - DNA, 22 bp, Homo sapiens
agggctgctttgctaaatatgg

SEQ ID NO: 9249138 - DNA, 22 bp, Homo sapiens
agggctgcttacctggaatggc

SEQ ID NO: 9249139 - DNA, 22 bp, Homo sapiens
agggctggagccacagctggga

SEQ ID NO: 9249140 - DNA, 22 bp, Homo sapiens
agggctggagccacagctggga

SEQ ID NO: 9249141 - DNA, 22 bp, Homo sapiens
agggcctgcatcaggagcttgg

SEQ ID NO: 9249142 - DNA, 22 bp, Homo sapiens
agggcctgcatcaggagcttgg

SEQ ID NO: 9249143 - DNA, 19 bp, Homo sapiens
agggcctgcagctcaagct

SEQ ID NO: 9249144 - DNA, 19 bp, Homo sapiens
agggcctgcagctcaagct

SEQ ID NO: 9249145 - DNA, 22 bp, Homo sapiens
agggcctgaggctgacggggag

SEQ ID NO: 9249146 - DNA, 19 bp, Homo sapiens
agggcctgcagctcaagct

SEQ ID NO: 9249147 - DNA, 22 bp, Homo sapiens
agggcctgaggctgacggggag

SEQ ID NO: 9249148 - DNA, 22 bp, Homo sapiens
agggcctgagctggctgacctc

SEQ ID NO: 9249149 - DNA, 22 bp, Homo sapiens
ccctgctttgcacccaggctgg

SEQ ID NO: 9249150 - DNA, 22 bp, Homo sapiens
ccctgctttcaaccttctagct

SEQ ID NO: 9249151 - DNA, 22 bp, Homo sapiens
ccctgcttccgctgttttctca

SEQ ID NO: 9249152 - DNA, 22 bp, Homo sapiens
agggcctggaactgtgggcagg

SEQ ID NO: 9249153 - DNA, 22 bp, Homo sapiens
agggcctggaactggagaccac

SEQ ID NO: 9249154 - DNA, 22 bp, Homo sapiens
agggcctggaactggagaccac

SEQ ID NO: 9249155 - DNA, 22 bp, Homo sapiens
agggcctggaactggagaccac

SEQ ID NO: 9249156 - DNA, 20 bp, Homo sapiens
agggcctgctctgtggtgtc

SEQ ID NO: 9249157 - DNA, 22 bp, Homo sapiens
agggcctgctctatcactctca

SEQ ID NO: 9249158 - DNA, 22 bp, Homo sapiens
cctcagcttgatttctgcagag

SEQ ID NO: 9249159 - DNA, 20 bp, Homo sapiens
agggcctggagtacagcagg

SEQ ID NO: 9249160 - DNA, 22 bp, Homo sapiens
agggcctggcgcgtggccgccg

SEQ ID NO: 9249161 - DNA, 23 bp, Homo sapiens
agggcctggcgtggagtgtgtgc

SEQ ID NO: 9249162 - DNA, 22 bp, Homo sapiens
agggtagggtaaatgatgcatc

SEQ ID NO: 9249163 - DNA, 22 bp, Homo sapiens
cctgaggtggctgcagcactgc

SEQ ID NO: 9249164 - DNA, 22 bp, Homo sapiens
cctgaggtctagagtcagggtg

SEQ ID NO: 9249165 - DNA, 22 bp, Homo sapiens
agggtcaccagttcataggcac

SEQ ID NO: 9249166 - DNA, 22 bp, Homo sapiens
agggtataaagagcaagcagaa

SEQ ID NO: 9249167 - DNA, 22 bp, Homo sapiens
agggtaggaactgagtggaagg

SEQ ID NO: 9249168 - DNA, 22 bp, Homo sapiens
agggtagggcccggagacagac

SEQ ID NO: 9249169 - DNA, 22 bp, Homo sapiens
agggtagggcccggagacagac

SEQ ID NO: 9249170 - DNA, 22 bp, Homo sapiens
agggtagggcccggagacagac

SEQ ID NO: 9249171 - DNA, 22 bp, Homo sapiens
agggtagggccgtagggccatg

SEQ ID NO: 9249172 - DNA, 22 bp, Homo sapiens
agggtagggccgtagggccatg

SEQ ID NO: 9249173 - DNA, 22 bp, Homo sapiens
aggggtgaaggcccgataggag

SEQ ID NO: 9249174 - DNA, 22 bp, Homo sapiens
aggggtgaaggcccgataggag

SEQ ID NO: 9249175 - DNA, 22 bp, Homo sapiens
agggtaggaactgagtggaagg

SEQ ID NO: 9249176 - DNA, 22 bp, Homo sapiens
cctgagagcattccacactgaa

SEQ ID NO: 9249177 - DNA, 22 bp, Homo sapiens
cctgagaggccctctcactgtc

SEQ ID NO: 9249178 - DNA, 22 bp, Homo sapiens
cctgagagtaggtgtctcttta

SEQ ID NO: 9249179 - DNA, 22 bp, Homo sapiens
cctgagaggccctctcactgtc

SEQ ID NO: 9249180 - DNA, 22 bp, Homo sapiens
cctgaagagtgaatgtggcagt

SEQ ID NO: 9249181 - DNA, 22 bp, Homo sapiens
cctgaagagcactctagagttg

SEQ ID NO: 9249182 - DNA, 22 bp, Homo sapiens
cctgaagagcactctagagttg

SEQ ID NO: 9249183 - DNA, 22 bp, Homo sapiens
cctgaagatgctgtggcctggt

SEQ ID NO: 9249184 - DNA, 22 bp, Homo sapiens
cctgaagatccattatagacac

SEQ ID NO: 9249185 - DNA, 20 bp, Homo sapiens
cctgaagagtttctctttct

SEQ ID NO: 9249186 - DNA, 22 bp, Homo sapiens
cctgaaatttgaagacctgaat

SEQ ID NO: 9249187 - DNA, 22 bp, Homo sapiens
cctgaaatccatagtttacact

SEQ ID NO: 9249188 - DNA, 22 bp, Homo sapiens
cctgaaatgactccagctgagt

SEQ ID NO: 9249189 - DNA, 21 bp, Homo sapiens
cctgaaattctcactagctta

SEQ ID NO: 9249190 - DNA, 22 bp, Homo sapiens
cctgaaatgagttctgctcact

SEQ ID NO: 9249191 - DNA, 22 bp, Homo sapiens
aggggatggagctggaaggcag

SEQ ID NO: 9249192 - DNA, 22 bp, Homo sapiens
aggggatgcctgaggatctgta

SEQ ID NO: 9249193 - DNA, 22 bp, Homo sapiens
aggggcactagaatgggagact

SEQ ID NO: 9249194 - DNA, 22 bp, Homo sapiens
aggggatggagctggaaggcag

SEQ ID NO: 9249195 - DNA, 22 bp, Homo sapiens
aggggatggagctggaaggcag

SEQ ID NO: 9249196 - DNA, 22 bp, Homo sapiens
aggggcagcctcacaatcctct

SEQ ID NO: 9249197 - DNA, 22 bp, Homo sapiens
cctgaaacagtccttgccctca

SEQ ID NO: 9249198 - DNA, 22 bp, Homo sapiens
cctgaaaatcaaggtagtttgg

SEQ ID NO: 9249199 - DNA, 19 bp, Homo sapiens
aggggcactgtctctagag

SEQ ID NO: 9249200 - DNA, 22 bp, Homo sapiens
aggggcacttctcaggctgtgg

SEQ ID NO: 9249201 - DNA, 23 bp, Homo sapiens
aggggcagcaagttttggtgtta

SEQ ID NO: 9249202 - DNA, 23 bp, Homo sapiens
aggggcagcaagttttggtgtta

SEQ ID NO: 9249203 - DNA, 23 bp, Homo sapiens
aggggcagcaagttttggtgtta

SEQ ID NO: 9249204 - DNA, 22 bp, Homo sapiens
aggggaggtgtccccaaatctc

SEQ ID NO: 9249205 - DNA, 22 bp, Homo sapiens
aggggaggtgtccccaaatctc

SEQ ID NO: 9249206 - DNA, 22 bp, Homo sapiens
aggggatgcctagtggagtctc

SEQ ID NO: 9249207 - DNA, 22 bp, Homo sapiens
aggggaggagcttttcttgcct

SEQ ID NO: 9249208 - DNA, 22 bp, Homo sapiens
aggggaggagcttttcttgcct

SEQ ID NO: 9249209 - DNA, 22 bp, Homo sapiens
aggggaggcagcgataaacctg

SEQ ID NO: 9249210 - DNA, 22 bp, Homo sapiens
aggggaggcagcgataaacctg

SEQ ID NO: 9249211 - DNA, 22 bp, Homo sapiens
aggggaggcagcgataaacctg

SEQ ID NO: 9249212 - DNA, 22 bp, Homo sapiens
agggctggctaggtgcgttccc

SEQ ID NO: 9249213 - DNA, 22 bp, Homo sapiens
agggctggctaggtgcgttccc

SEQ ID NO: 9249214 - DNA, 22 bp, Homo sapiens
agggctggctccgttaccttga

SEQ ID NO: 9249215 - DNA, 22 bp, Homo sapiens
agggctggctccgttaccttga

SEQ ID NO: 9249216 - DNA, 22 bp, Homo sapiens
agggctggcatctctaatgctg

SEQ ID NO: 9249217 - DNA, 22 bp, Homo sapiens
agggctggcatctctaatgctg

SEQ ID NO: 9249218 - DNA, 22 bp, Homo sapiens
agggctggccacatgatttggt

SEQ ID NO: 9249219 - DNA, 22 bp, Homo sapiens
agggctggccacatgatttggt

SEQ ID NO: 9249220 - DNA, 22 bp, Homo sapiens
agggctggctaggtgcgttccc

SEQ ID NO: 9249221 - DNA, 22 bp, Homo sapiens
ataaaagaagttttggtacttg

SEQ ID NO: 9249222 - DNA, 22 bp, Homo sapiens
ataaaagaagttttggtacttg

SEQ ID NO: 9249223 - DNA, 22 bp, Homo sapiens
ctgcaggctcgaagacacggat

SEQ ID NO: 9249224 - DNA, 22 bp, Homo sapiens
ataaaacttgggtatgatccct

SEQ ID NO: 9249225 - DNA, 22 bp, Homo sapiens
ataaaacttattagaattgtgt

SEQ ID NO: 9249226 - DNA, 22 bp, Homo sapiens
ataaaaatgagggcggtagcta

SEQ ID NO: 9249227 - DNA, 22 bp, Homo sapiens
ataaaaaggacagatgtggtct

SEQ ID NO: 9249228 - DNA, 22 bp, Homo sapiens
ataaaaatgagggcggtagcta

SEQ ID NO: 9249229 - DNA, 17 bp, Homo sapiens
agttttgatataatggc

SEQ ID NO: 9249230 - DNA, 22 bp, Homo sapiens
agttcttattgaatagaaatca

SEQ ID NO: 9249231 - DNA, 22 bp, Homo sapiens
agttctagaagacttttccatt

SEQ ID NO: 9249232 - DNA, 22 bp, Homo sapiens
agttctaattgcgttttcttgc

SEQ ID NO: 9249233 - DNA, 22 bp, Homo sapiens
agttctattgggtaggttctgt

SEQ ID NO: 9249234 - DNA, 23 bp, Homo sapiens
agttctcaaaaccagcttgacaa

SEQ ID NO: 9249235 - DNA, 22 bp, Homo sapiens
agttctcaagacaattacctgt

SEQ ID NO: 9249236 - DNA, 22 bp, Homo sapiens
agttctatttctaacatgttat

SEQ ID NO: 9249237 - DNA, 22 bp, Homo sapiens
agttctataattaaaatgaagg

SEQ ID NO: 9249238 - DNA, 23 bp, Homo sapiens
agttctcattcatcacggcctat

SEQ ID NO: 9249239 - DNA, 22 bp, Homo sapiens
agttctctatgaagtctattgt

SEQ ID NO: 9249240 - DNA, 22 bp, Homo sapiens
agttctcgagcgtccctgtttc

SEQ ID NO: 9249241 - DNA, 22 bp, Homo sapiens
agttctcaggtcagctgagtct

SEQ ID NO: 9249242 - DNA, 22 bp, Homo sapiens
agttctcagcttagtatgctgt

SEQ ID NO: 9249243 - DNA, 22 bp, Homo sapiens
agttctctggctcctttccaga

SEQ ID NO: 9249244 - DNA, 22 bp, Homo sapiens
agttctcttggaagttatgtga

SEQ ID NO: 9249245 - DNA, 22 bp, Homo sapiens
agttctctttagctcatatggt

SEQ ID NO: 9249246 - DNA, 22 bp, Homo sapiens
agttctctttagctcatatggt

SEQ ID NO: 9249247 - DNA, 22 bp, Homo sapiens
agttctgataaaggaggaagat

SEQ ID NO: 9249248 - DNA, 22 bp, Homo sapiens
ataaagctatttttaattctgt

SEQ ID NO: 9249249 - DNA, 22 bp, Homo sapiens
ataaagctattcctctcttttt

SEQ ID NO: 9249250 - DNA, 22 bp, Homo sapiens
ataaagcatctagtctgtcact

SEQ ID NO: 9249251 - DNA, 22 bp, Homo sapiens
ataaagcaagcataccattaag

SEQ ID NO: 9249252 - DNA, 22 bp, Homo sapiens
ataaagcaaataggactattgc

SEQ ID NO: 9249253 - DNA, 22 bp, Homo sapiens
ataaagcaagcataccattaag

SEQ ID NO: 9249254 - DNA, 22 bp, Homo sapiens
ataaagcaggtccccagacact

SEQ ID NO: 9249255 - DNA, 22 bp, Homo sapiens
ataaagcaaataggactattgc

SEQ ID NO: 9249256 - DNA, 22 bp, Homo sapiens
ataaagatttttaggcatttct

SEQ ID NO: 9249257 - DNA, 22 bp, Homo sapiens
ataaagaggatgtatttacagc

SEQ ID NO: 9249258 - DNA, 22 bp, Homo sapiens
ataaacttgagtctcagagtat

SEQ ID NO: 9249259 - DNA, 21 bp, Homo sapiens
ataaagacaaacactatttgg

SEQ ID NO: 9249260 - DNA, 22 bp, Homo sapiens
ataaagaccagtatcttatgtt

SEQ ID NO: 9249261 - DNA, 22 bp, Homo sapiens
ataaagacatgcttacttgccc

SEQ ID NO: 9249262 - DNA, 22 bp, Homo sapiens
ataaacttgagtctcagagtat

SEQ ID NO: 9249263 - DNA, 22 bp, Homo sapiens
ataaacatctgtttctcttctg

SEQ ID NO: 9249264 - DNA, 22 bp, Homo sapiens
ataaacatctgtttctcttctg

SEQ ID NO: 9249265 - DNA, 22 bp, Homo sapiens
ataaaatctttatgtgctctgc

SEQ ID NO: 9249266 - DNA, 22 bp, Homo sapiens
ataaaatcagagttggattgga

SEQ ID NO: 9249267 - DNA, 22 bp, Homo sapiens
ataaaatcaactggctccagtt

SEQ ID NO: 9249268 - DNA, 22 bp, Homo sapiens
ctgcagggaccacaagcaggtt

SEQ ID NO: 9249269 - DNA, 22 bp, Homo sapiens
ctgcagggaccacaagcaggtt

SEQ ID NO: 9249270 - DNA, 22 bp, Homo sapiens
ctgcagggagaggggacagcct

SEQ ID NO: 9249271 - DNA, 22 bp, Homo sapiens
ctgcagggacccaagtctttgg

SEQ ID NO: 9249272 - DNA, 22 bp, Homo sapiens
ctgcagggaactgaggcccaga

SEQ ID NO: 9249273 - DNA, 22 bp, Homo sapiens
ctgcagggaccacaagcaggtt

SEQ ID NO: 9249274 - DNA, 22 bp, Homo sapiens
ctgcaggcttccagggctgtgg

SEQ ID NO: 9249275 - DNA, 22 bp, Homo sapiens
ctgcaggctgagcgcctgccgg

SEQ ID NO: 9249276 - DNA, 22 bp, Homo sapiens
ctgcaggctgagcgcctgccgg

SEQ ID NO: 9249277 - DNA, 22 bp, Homo sapiens
ctgctcacgccaccgttcatca

SEQ ID NO: 9249278 - DNA, 22 bp, Homo sapiens
ctgctagcccgccggccagcga

SEQ ID NO: 9249279 - DNA, 22 bp, Homo sapiens
ctgctagcccaggatgcaggga

SEQ ID NO: 9249280 - DNA, 22 bp, Homo sapiens
ctgctagaatttctggaaaaga

SEQ ID NO: 9249281 - DNA, 22 bp, Homo sapiens
ctgctcagcggaaggaagagcg

SEQ ID NO: 9249282 - DNA, 19 bp, Homo sapiens
ctgctcagagcagctccag

SEQ ID NO: 9249283 - DNA, 22 bp, Homo sapiens
ctgctgccattagggcacagac

SEQ ID NO: 9249284 - DNA, 22 bp, Homo sapiens
ctgctgggcagaggctgcatga

SEQ ID NO: 9249285 - DNA, 22 bp, Homo sapiens
ctgctgggcctggtctctgagg

SEQ ID NO: 9249286 - DNA, 22 bp, Homo sapiens
ctgctgggcagaggctgcatga

SEQ ID NO: 9249287 - DNA, 22 bp, Homo sapiens
ctgctgggcctggtctctgagg

SEQ ID NO: 9249288 - DNA, 22 bp, Homo sapiens
ctgctgggctcctcatgtgact

SEQ ID NO: 9249289 - DNA, 22 bp, Homo sapiens
ctgctgggctcctcatgtgact

SEQ ID NO: 9249290 - DNA, 22 bp, Homo sapiens
ctgctgggctcctcatgtgact

SEQ ID NO: 9249291 - DNA, 22 bp, Homo sapiens
ctgctgggctcctcatgtgact

SEQ ID NO: 9249292 - DNA, 22 bp, Homo sapiens
ctgctgggggacacaggtccgg

SEQ ID NO: 9249293 - DNA, 22 bp, Homo sapiens
ctgctggggaggcgcctcgacg

SEQ ID NO: 9249294 - DNA, 22 bp, Homo sapiens
ctgctgggctcctcatgtgact

SEQ ID NO: 9249295 - DNA, 22 bp, Homo sapiens
ctgctgggctcctcatgtgact

SEQ ID NO: 9249296 - DNA, 22 bp, Homo sapiens
ctgctggggaggcgcctcgacg

SEQ ID NO: 9249297 - DNA, 22 bp, Homo sapiens
ctgcctggaaggagcaagggga

SEQ ID NO: 9249298 - DNA, 22 bp, Homo sapiens
ctgcctggggcatcagtcaagg

SEQ ID NO: 9249299 - DNA, 22 bp, Homo sapiens
ctgcctgggttcaagtcctgtt

SEQ ID NO: 9249300 - DNA, 22 bp, Homo sapiens
ctgcctgggttcaagtcctgtt

SEQ ID NO: 9249301 - DNA, 22 bp, Homo sapiens
ctgcctgtattgtctgcttggg

SEQ ID NO: 9249302 - DNA, 22 bp, Homo sapiens
ctgcctgtgcatgcagtcagaa

SEQ ID NO: 9249303 - DNA, 22 bp, Homo sapiens
ctgcctgtgatttttctctagt

SEQ ID NO: 9249304 - DNA, 22 bp, Homo sapiens
ctgctaaacctctctgagagct

SEQ ID NO: 9249305 - DNA, 22 bp, Homo sapiens
ctgctaaacctctctgagagct

SEQ ID NO: 9249306 - DNA, 22 bp, Homo sapiens
ctgcctgtgccaccgcctcatt

SEQ ID NO: 9249307 - DNA, 22 bp, Homo sapiens
ctgcctgtgccaatgctccttt

SEQ ID NO: 9249308 - DNA, 22 bp, Homo sapiens
ctgcctgtgccaatgctccttt

SEQ ID NO: 9249309 - DNA, 20 bp, Homo sapiens
atacacatattcttgcaact

SEQ ID NO: 9249310 - DNA, 22 bp, Homo sapiens
atacacatgcacacatgtgtgt

SEQ ID NO: 9249311 - DNA, 22 bp, Homo sapiens
atacacatgcacacatgtgtgt

SEQ ID NO: 9249312 - DNA, 22 bp, Homo sapiens
atacacatatcaggtgtataca

SEQ ID NO: 9249313 - DNA, 22 bp, Homo sapiens
atacacatatgtgtgtatatgt

SEQ ID NO: 9249314 - DNA, 22 bp, Homo sapiens
atacacatatgtgtgtatatgt

SEQ ID NO: 9249315 - DNA, 20 bp, Homo sapiens
atacacatattcttgcaact

SEQ ID NO: 9249316 - DNA, 22 bp, Homo sapiens
atacacatatgtgtgtatatgt

SEQ ID NO: 9249317 - DNA, 19 bp, Homo sapiens
atacacatacgtaaactga

SEQ ID NO: 9249318 - DNA, 22 bp, Homo sapiens
atacacatatcaggtgtataca

SEQ ID NO: 9249319 - DNA, 22 bp, Homo sapiens
atacacaggtgctaggtcaata

SEQ ID NO: 9249320 - DNA, 21 bp, Homo sapiens
atacacatacacataaatgtg

SEQ ID NO: 9249321 - DNA, 21 bp, Homo sapiens
atacacatacacataaatgtg

SEQ ID NO: 9249322 - DNA, 22 bp, Homo sapiens
ctgctgtgtcagagtccagggg

SEQ ID NO: 9249323 - DNA, 22 bp, Homo sapiens
ctgctggggtcagagcactggg

SEQ ID NO: 9249324 - DNA, 22 bp, Homo sapiens
ctgctgggggacacaggtccgg

SEQ ID NO: 9249325 - DNA, 22 bp, Homo sapiens
ctgctggggtcagagcactggg

SEQ ID NO: 9249326 - DNA, 22 bp, Homo sapiens
ctgctggggtcagagcactggg

SEQ ID NO: 9249327 - DNA, 22 bp, Homo sapiens
ctgctgtgcctcttttcacgtg

SEQ ID NO: 9249328 - DNA, 22 bp, Homo sapiens
ctggctctttcctagctaggct

SEQ ID NO: 9249329 - DNA, 19 bp, Homo sapiens
ctggctcttgggtggagga

SEQ ID NO: 9249330 - DNA, 22 bp, Homo sapiens
ctggctgacaccttgatagcag

SEQ ID NO: 9249331 - DNA, 22 bp, Homo sapiens
ctggctgaatcctagtctcata

SEQ ID NO: 9249332 - DNA, 22 bp, Homo sapiens
atataaagtgtttagaaagctg

SEQ ID NO: 9249333 - DNA, 23 bp, Homo sapiens
atataaacaccagatagattgta

SEQ ID NO: 9249334 - DNA, 22 bp, Homo sapiens
atataaagaagtggaaaatgag

SEQ ID NO: 9249335 - DNA, 22 bp, Homo sapiens
atataaagagcttagtatagtg

SEQ ID NO: 9249336 - DNA, 22 bp, Homo sapiens
atagttttctatgcactgttat

SEQ ID NO: 9249337 - DNA, 22 bp, Homo sapiens
atagttttatagatattgtgta

SEQ ID NO: 9249338 - DNA, 22 bp, Homo sapiens
ctggcctttcgtgagagctggg

SEQ ID NO: 9249339 - DNA, 22 bp, Homo sapiens
ctggcctttagccccagtgtct

SEQ ID NO: 9249340 - DNA, 22 bp, Homo sapiens
ctggccttgttcctccccaagt

SEQ ID NO: 9249341 - DNA, 22 bp, Homo sapiens
ctggccttcagactcggactga

SEQ ID NO: 9249342 - DNA, 19 bp, Homo sapiens
ctggcctgtgtcctgtgct

SEQ ID NO: 9249343 - DNA, 22 bp, Homo sapiens
ctggcctgtgggctgtctccgg

SEQ ID NO: 9249344 - DNA, 22 bp, Homo sapiens
atagtttccattgctgaccaaa

SEQ ID NO: 9249345 - DNA, 22 bp, Homo sapiens
atagtttaccttccagatggct

SEQ ID NO: 9249346 - DNA, 22 bp, Homo sapiens
atagtttaccttccagatggct

SEQ ID NO: 9249347 - DNA, 22 bp, Homo sapiens
atagtttgctttaatacaactg

SEQ ID NO: 9249348 - DNA, 22 bp, Homo sapiens
ctggctcacaggtgagatgcat

SEQ ID NO: 9249349 - DNA, 22 bp, Homo sapiens
ctggctcaatttgtactgctgt

SEQ ID NO: 9249350 - DNA, 22 bp, Homo sapiens
ctggctcaatttgtactgctgt

SEQ ID NO: 9249351 - DNA, 22 bp, Homo sapiens
ctggctcaataaatattagctg

SEQ ID NO: 9249352 - DNA, 22 bp, Homo sapiens
ctggctcaataaatattagctg

SEQ ID NO: 9249353 - DNA, 22 bp, Homo sapiens
ctggctaaagagcaagaagatg

SEQ ID NO: 9249354 - DNA, 19 bp, Homo sapiens
ctggctgcaatgccagggt

SEQ ID NO: 9249355 - DNA, 22 bp, Homo sapiens
atataatacaacctgctaagtg

SEQ ID NO: 9249356 - DNA, 22 bp, Homo sapiens
atatacacatgtgtatacattt

SEQ ID NO: 9249357 - DNA, 22 bp, Homo sapiens
ctggctgaggtcaccagtagct

SEQ ID NO: 9249358 - DNA, 22 bp, Homo sapiens
ctggctgagttactccactgag

SEQ ID NO: 9249359 - DNA, 22 bp, Homo sapiens
ctggctgaggcagagcctgggg

SEQ ID NO: 9249360 - DNA, 22 bp, Homo sapiens
atatacaggtggtatgtgtaaa

SEQ ID NO: 9249361 - DNA, 22 bp, Homo sapiens
atatacagtatgtactgtggtt

SEQ ID NO: 9249362 - DNA, 22 bp, Homo sapiens
atatacctgaagttggtaatta

SEQ ID NO: 9249363 - DNA, 22 bp, Homo sapiens
atatacctgaagttggtaatta

SEQ ID NO: 9249364 - DNA, 22 bp, Homo sapiens
atatacctcattctttgagtgc

SEQ ID NO: 9249365 - DNA, 22 bp, Homo sapiens
atatactgtagtggtttagagc

SEQ ID NO: 9249366 - DNA, 22 bp, Homo sapiens
atatacagttttacagggtttc

SEQ ID NO: 9249367 - DNA, 22 bp, Homo sapiens
ctgggagaggaacctcgagggt

SEQ ID NO: 9249368 - DNA, 22 bp, Homo sapiens
atatacttggagactatcattg

SEQ ID NO: 9249369 - DNA, 22 bp, Homo sapiens
atatacttggagactatcattg

SEQ ID NO: 9249370 - DNA, 22 bp, Homo sapiens
atatacttggagactatcattg

SEQ ID NO: 9249371 - DNA, 22 bp, Homo sapiens
ctgggagaggaacctcgagggt

SEQ ID NO: 9249372 - DNA, 22 bp, Homo sapiens
ctgggagaggaacctcgagggt

SEQ ID NO: 9249373 - DNA, 22 bp, Homo sapiens
ctggcacataattagtgatcct

SEQ ID NO: 9249374 - DNA, 22 bp, Homo sapiens
ctggcacagttaacatatgcta

SEQ ID NO: 9249375 - DNA, 22 bp, Homo sapiens
ctggcacaggatccgagacctt

SEQ ID NO: 9249376 - DNA, 22 bp, Homo sapiens
ctggcacagccactgcaggcag

SEQ ID NO: 9249377 - DNA, 22 bp, Homo sapiens
atacatgcgccatgttggtgtg

SEQ ID NO: 9249378 - DNA, 22 bp, Homo sapiens
atacatgatgggtgtatagttt

SEQ ID NO: 9249379 - DNA, 22 bp, Homo sapiens
atacatgtaactgcattgtaat

SEQ ID NO: 9249380 - DNA, 22 bp, Homo sapiens
atacatgtcatcatatgtttgt

SEQ ID NO: 9249381 - DNA, 22 bp, Homo sapiens
atacatgtgccatgttggtgta

SEQ ID NO: 9249382 - DNA, 22 bp, Homo sapiens
atacatgtgctatgttggtgta

SEQ ID NO: 9249383 - DNA, 22 bp, Homo sapiens
atacatgtgccgcgttggtgtg

SEQ ID NO: 9249384 - DNA, 22 bp, Homo sapiens
ctggcagcttagcactctggtt

SEQ ID NO: 9249385 - DNA, 22 bp, Homo sapiens
ctggcagcttattagaaatgca

SEQ ID NO: 9249386 - DNA, 22 bp, Homo sapiens
ctggcagcttagcactctggtt

SEQ ID NO: 9249387 - DNA, 22 bp, Homo sapiens
ctggcacacagtaggcaccaat

SEQ ID NO: 9249388 - DNA, 22 bp, Homo sapiens
ctggcacagagacagaaggatt

SEQ ID NO: 9249389 - DNA, 22 bp, Homo sapiens
ctggcaagtactgggccagctc

SEQ ID NO: 9249390 - DNA, 22 bp, Homo sapiens
ctggcacaactccacctcagcg

SEQ ID NO: 9249391 - DNA, 22 bp, Homo sapiens
atacacatgtgtatgtgcatgc

SEQ ID NO: 9249392 - DNA, 22 bp, Homo sapiens
ctggcagtattaagagaagtga

SEQ ID NO: 9249393 - DNA, 22 bp, Homo sapiens
ctggccactggaggtggcaccc

SEQ ID NO: 9249394 - DNA, 22 bp, Homo sapiens
ctggccctatgagcctcctgat

SEQ ID NO: 9249395 - DNA, 22 bp, Homo sapiens
ctggccagactacacatgtgtg

SEQ ID NO: 9249396 - DNA, 22 bp, Homo sapiens
ctggccagactacacatgtgtg

SEQ ID NO: 9249397 - DNA, 22 bp, Homo sapiens
ctggccagactacacatgtgtg

SEQ ID NO: 9249398 - DNA, 22 bp, Homo sapiens
ctggccagaagcacctttggcg

SEQ ID NO: 9249399 - DNA, 20 bp, Homo sapiens
ctggccagaacgcctacaca

SEQ ID NO: 9249400 - DNA, 22 bp, Homo sapiens
ctggcctcatagccaagctgtg

SEQ ID NO: 9249401 - DNA, 22 bp, Homo sapiens
ctggcctcatagccaagctgtg

SEQ ID NO: 9249402 - DNA, 22 bp, Homo sapiens
ctggcctcagagggtcatggtg

SEQ ID NO: 9249403 - DNA, 22 bp, Homo sapiens
ctggcctcagagggtcatggtg

SEQ ID NO: 9249404 - DNA, 22 bp, Homo sapiens
ctggcctcacctcagacttact

SEQ ID NO: 9249405 - DNA, 22 bp, Homo sapiens
ctggcctcacagaggctaagcc

SEQ ID NO: 9249406 - DNA, 22 bp, Homo sapiens
cttaaggaaaagtctcttttaa

SEQ ID NO: 9249407 - DNA, 22 bp, Homo sapiens
cttaagagtctttctgtgttta

SEQ ID NO: 9249408 - DNA, 22 bp, Homo sapiens
cttaagacaggctcaaagatta

SEQ ID NO: 9249409 - DNA, 22 bp, Homo sapiens
cttaacatcctgcatttttctt

SEQ ID NO: 9249410 - DNA, 22 bp, Homo sapiens
cttaacatcctgcatttttctt

SEQ ID NO: 9249411 - DNA, 22 bp, Homo sapiens
atcatacagcctttgttagtgt

SEQ ID NO: 9249412 - DNA, 22 bp, Homo sapiens
atcatacagcctttgttagtgt

SEQ ID NO: 9249413 - DNA, 22 bp, Homo sapiens
ctgtttctccacactcttccca

SEQ ID NO: 9249414 - DNA, 22 bp, Homo sapiens
atcatcatcaacaagaaacatt

SEQ ID NO: 9249415 - DNA, 23 bp, Homo sapiens
atccatgtgagaatagactagca

SEQ ID NO: 9249416 - DNA, 22 bp, Homo sapiens
atccatgattgcccagaggtgt

SEQ ID NO: 9249417 - DNA, 23 bp, Homo sapiens
atccatgcttaagtaatcatttg

SEQ ID NO: 9249418 - DNA, 22 bp, Homo sapiens
atccatttctatcttgctgagg

SEQ ID NO: 9249419 - DNA, 22 bp, Homo sapiens
cttagatgaagtcacagaaccc

SEQ ID NO: 9249420 - DNA, 21 bp, Homo sapiens
atccatccatcttggcctaac

SEQ ID NO: 9249421 - DNA, 21 bp, Homo sapiens
atccatccatcttggcctaac

SEQ ID NO: 9249422 - DNA, 20 bp, Homo sapiens
atccatcatgtccatgactt

SEQ ID NO: 9249423 - DNA, 22 bp, Homo sapiens
cttaatctcacctgcaaagtcc

SEQ ID NO: 9249424 - DNA, 22 bp, Homo sapiens
cttatcttacttccccttcatg

SEQ ID NO: 9249425 - DNA, 22 bp, Homo sapiens
cttatggaagaaacctcagaga

SEQ ID NO: 9249426 - DNA, 22 bp, Homo sapiens
cttatgctgagaatgaaagaat

SEQ ID NO: 9249427 - DNA, 19 bp, Homo sapiens
cttatgcagctgagcttgg

SEQ ID NO: 9249428 - DNA, 22 bp, Homo sapiens
cttattaatggaatcctaatga

SEQ ID NO: 9249429 - DNA, 22 bp, Homo sapiens
cttattataaaatcctgtttga

SEQ ID NO: 9249430 - DNA, 22 bp, Homo sapiens
cttattatggcatgtaagtggg

SEQ ID NO: 9249431 - DNA, 22 bp, Homo sapiens
cttattataaaatcctgtttga

SEQ ID NO: 9249432 - DNA, 19 bp, Homo sapiens
cttattagagtgagagctt

SEQ ID NO: 9249433 - DNA, 22 bp, Homo sapiens
cttattcagcacttgctctgta

SEQ ID NO: 9249434 - DNA, 22 bp, Homo sapiens
cttattcagatacagactcttg

SEQ ID NO: 9249435 - DNA, 22 bp, Homo sapiens
cttattcagaaggagaaatgga

SEQ ID NO: 9249436 - DNA, 22 bp, Homo sapiens
cttcaacttccctagatgtcat

SEQ ID NO: 9249437 - DNA, 22 bp, Homo sapiens
cttcctctcaataagatgagaa

SEQ ID NO: 9249438 - DNA, 22 bp, Homo sapiens
cttcctctatgttcaggtagaa

SEQ ID NO: 9249439 - DNA, 22 bp, Homo sapiens
cttcctctatgttcaggtagaa

SEQ ID NO: 9249440 - DNA, 22 bp, Homo sapiens
cttcctctcttgcccataagag

SEQ ID NO: 9249441 - DNA, 22 bp, Homo sapiens
cttccttctgaagcatagaagc

SEQ ID NO: 9249442 - DNA, 22 bp, Homo sapiens
cttccttccttccccgaaatgc

SEQ ID NO: 9249443 - DNA, 19 bp, Homo sapiens
cttccttgctccccatgtg

SEQ ID NO: 9249444 - DNA, 22 bp, Homo sapiens
cttccttgctgtctgctccagg

SEQ ID NO: 9249445 - DNA, 22 bp, Homo sapiens
cttccttgctgtctgctccagg

SEQ ID NO: 9249446 - DNA, 22 bp, Homo sapiens
cttccttgcggcccctgcctag

SEQ ID NO: 9249447 - DNA, 22 bp, Homo sapiens
cttccttgcggcccctgcctag

SEQ ID NO: 9249448 - DNA, 22 bp, Homo sapiens
cttcaagtcgccaaatgctgaa

SEQ ID NO: 9249449 - DNA, 22 bp, Homo sapiens
cttcaagatccatagatattgc

SEQ ID NO: 9249450 - DNA, 22 bp, Homo sapiens
cttcaagatatttctagaatca

SEQ ID NO: 9249451 - DNA, 22 bp, Homo sapiens
cttcacaaaatatttcattata

SEQ ID NO: 9249452 - DNA, 22 bp, Homo sapiens
cttctgagggcctttgcttcca

SEQ ID NO: 9249453 - DNA, 22 bp, Homo sapiens
cttctgaggcagctattcagtt

SEQ ID NO: 9249454 - DNA, 22 bp, Homo sapiens
cttctgaggactctaaagagga

SEQ ID NO: 9249455 - DNA, 22 bp, Homo sapiens
cttctgagcagacctcctgggg

SEQ ID NO: 9249456 - DNA, 22 bp, Homo sapiens
cttctgagatgttgttttacag

SEQ ID NO: 9249457 - DNA, 22 bp, Homo sapiens
cttctgagatgttgttttacag

SEQ ID NO: 9249458 - DNA, 22 bp, Homo sapiens
cttctgagatgttgttttacag

SEQ ID NO: 9249459 - DNA, 22 bp, Homo sapiens
cttctgcaggccctgtctgacc

SEQ ID NO: 9249460 - DNA, 19 bp, Homo sapiens
cttctgcagggtgacagtg

SEQ ID NO: 9249461 - DNA, 22 bp, Homo sapiens
cttctgattagcaagtttgtat

SEQ ID NO: 9249462 - DNA, 22 bp, Homo sapiens
cttctgatctggattcctaact

SEQ ID NO: 9249463 - DNA, 22 bp, Homo sapiens
cttctgtgctaaatgcaaaacc

SEQ ID NO: 9249464 - DNA, 22 bp, Homo sapiens
cttctgtgcttcacagttgcca

SEQ ID NO: 9249465 - DNA, 22 bp, Homo sapiens
cttctgtgcaattgtggaggag

SEQ ID NO: 9249466 - DNA, 22 bp, Homo sapiens
cttctgcccctgtagcctgagt

SEQ ID NO: 9249467 - DNA, 22 bp, Homo sapiens
cttctgcccctgtagcctgagt

SEQ ID NO: 9249468 - DNA, 22 bp, Homo sapiens
cttctgtgttaaatgagtcttt

SEQ ID NO: 9249469 - DNA, 22 bp, Homo sapiens
cttctgttactgttagctgaag

SEQ ID NO: 9249470 - DNA, 23 bp, Homo sapiens
atctctctggtggtcacagtcag

SEQ ID NO: 9249471 - DNA, 23 bp, Homo sapiens
atctctctggtggtcacagtcag

SEQ ID NO: 9249472 - DNA, 22 bp, Homo sapiens
atctctaatttaaaaagtaaca

SEQ ID NO: 9249473 - DNA, 22 bp, Homo sapiens
atctctccttatgaagcattat

SEQ ID NO: 9249474 - DNA, 22 bp, Homo sapiens
atctctatctttattgaaatct

SEQ ID NO: 9249475 - DNA, 22 bp, Homo sapiens
cttctccttatatgtcccgttc

SEQ ID NO: 9249476 - DNA, 22 bp, Homo sapiens
atctctgatttacagcatctct

SEQ ID NO: 9249477 - DNA, 22 bp, Homo sapiens
cttctgagatgttgttttacag

SEQ ID NO: 9249478 - DNA, 22 bp, Homo sapiens
cttctgagatgttgttttacag

SEQ ID NO: 9249479 - DNA, 22 bp, Homo sapiens
cttccttgtggtccttctcatt

SEQ ID NO: 9249480 - DNA, 22 bp, Homo sapiens
cttccttggcttctggggtgtg

SEQ ID NO: 9249481 - DNA, 22 bp, Homo sapiens
cttccttgtggtccttctcatt

SEQ ID NO: 9249482 - DNA, 22 bp, Homo sapiens
atctccccgagcttacctcctg

SEQ ID NO: 9249483 - DNA, 22 bp, Homo sapiens
cttcctttcagaggaaggcctg

SEQ ID NO: 9249484 - DNA, 23 bp, Homo sapiens
atctcctgagaacccacagtggt

SEQ ID NO: 9249485 - DNA, 22 bp, Homo sapiens
atctccgccatcgcgaacgcct

SEQ ID NO: 9249486 - DNA, 19 bp, Homo sapiens
atctcctttcttcaagctt

SEQ ID NO: 9249487 - DNA, 19 bp, Homo sapiens
atctcctttcttcaagctt

SEQ ID NO: 9249488 - DNA, 22 bp, Homo sapiens
atctggttcttcttaggcatca

SEQ ID NO: 9249489 - DNA, 22 bp, Homo sapiens
cttctgttactgttagctgaag

SEQ ID NO: 9249490 - DNA, 22 bp, Homo sapiens
cttcttaaatatttggctgact

SEQ ID NO: 9249491 - DNA, 22 bp, Homo sapiens
atctgtaattttgaatgcaaat

SEQ ID NO: 9249492 - DNA, 22 bp, Homo sapiens
atctgtactaattaattaatgt

SEQ ID NO: 9249493 - DNA, 22 bp, Homo sapiens
atctgtcaggagcaaggactac

SEQ ID NO: 9249494 - DNA, 22 bp, Homo sapiens
atctgtaacatcagtagcagaa

SEQ ID NO: 9249495 - DNA, 22 bp, Homo sapiens
atctgtaaatgcaaatgtagct

SEQ ID NO: 9249496 - DNA, 22 bp, Homo sapiens
atctggttcttcttaggcatca

SEQ ID NO: 9249497 - DNA, 22 bp, Homo sapiens
atctggttttggctgtgtccct

SEQ ID NO: 9249498 - DNA, 22 bp, Homo sapiens
atctgtaaagataatcatatgt

SEQ ID NO: 9249499 - DNA, 22 bp, Homo sapiens
atctgtcttttattcatgagct

SEQ ID NO: 9249500 - DNA, 22 bp, Homo sapiens
atctgtcttccaccacacatcc

SEQ ID NO: 9249501 - DNA, 22 bp, Homo sapiens
atctgtcttccaccacacatcc

SEQ ID NO: 9249502 - DNA, 22 bp, Homo sapiens
atctgtcttccaccacacatcc

SEQ ID NO: 9249503 - DNA, 22 bp, Homo sapiens
atctgtcttgccttgcatattt

SEQ ID NO: 9249504 - DNA, 22 bp, Homo sapiens
atctgtcttgccttgcatattt

SEQ ID NO: 9249505 - DNA, 22 bp, Homo sapiens
atctgtctatgatatagtctgt

SEQ ID NO: 9249506 - DNA, 22 bp, Homo sapiens
atctgtcctgtgacagtgggag

SEQ ID NO: 9249507 - DNA, 22 bp, Homo sapiens
atctgttatttacccatctctg

SEQ ID NO: 9249508 - DNA, 22 bp, Homo sapiens
atctgttcccctatgctctcta

SEQ ID NO: 9249509 - DNA, 22 bp, Homo sapiens
atcacagcacacctgacatgta

SEQ ID NO: 9249510 - DNA, 22 bp, Homo sapiens
ctgtaaatatgaagaatatatg

SEQ ID NO: 9249511 - DNA, 22 bp, Homo sapiens
ctgtaaataatgacagttgact

SEQ ID NO: 9249512 - DNA, 22 bp, Homo sapiens
atcacagattgtgaataactat

SEQ ID NO: 9249513 - DNA, 22 bp, Homo sapiens
atcacaaaggtctcagagcaca

SEQ ID NO: 9249514 - DNA, 22 bp, Homo sapiens
atcacaatcttcaaatcgattc

SEQ ID NO: 9249515 - DNA, 22 bp, Homo sapiens
atcacactggacattggatact

SEQ ID NO: 9249516 - DNA, 22 bp, Homo sapiens
atcaagaattgggagctattga

SEQ ID NO: 9249517 - DNA, 22 bp, Homo sapiens
atcaagaattgggagctattga

SEQ ID NO: 9249518 - DNA, 22 bp, Homo sapiens
atcacaaagggttttctctgag

SEQ ID NO: 9249519 - DNA, 22 bp, Homo sapiens
atcagcaggtgctggtggagac

SEQ ID NO: 9249520 - DNA, 22 bp, Homo sapiens
atcagcacaacgtacagagaaa

SEQ ID NO: 9249521 - DNA, 22 bp, Homo sapiens
atcagctcattttgatggaaat

SEQ ID NO: 9249522 - DNA, 22 bp, Homo sapiens
atcagctgaaaaacaggcagca

SEQ ID NO: 9249523 - DNA, 22 bp, Homo sapiens
ctgtaatcccagctactcggga

SEQ ID NO: 9249524 - DNA, 22 bp, Homo sapiens
ctgtaatcccagctacctggga

SEQ ID NO: 9249525 - DNA, 22 bp, Homo sapiens
ctgtctcctcctttgttcttaa

SEQ ID NO: 9249526 - DNA, 22 bp, Homo sapiens
ctgtctcctcctttgttcttaa

SEQ ID NO: 9249527 - DNA, 23 bp, Homo sapiens
ctgtctcctgggctaggtggaat

SEQ ID NO: 9249528 - DNA, 22 bp, Homo sapiens
ctgtctcctccactgcatggga

SEQ ID NO: 9249529 - DNA, 22 bp, Homo sapiens
ctgtctccgccctcttggtagg

SEQ ID NO: 9249530 - DNA, 22 bp, Homo sapiens
atcaggtgatgctctggttccc

SEQ ID NO: 9249531 - DNA, 22 bp, Homo sapiens
ctgtctctctaggacactgggg

SEQ ID NO: 9249532 - DNA, 22 bp, Homo sapiens
ctgtctctctaggacactgggg

SEQ ID NO: 9249533 - DNA, 22 bp, Homo sapiens
ctgtctctgataagctcgaggg

SEQ ID NO: 9249534 - DNA, 22 bp, Homo sapiens
ctgtcgcctggtcctctctgga

SEQ ID NO: 9249535 - DNA, 22 bp, Homo sapiens
ctgtctccagggcaggtgcagg

SEQ ID NO: 9249536 - DNA, 22 bp, Homo sapiens
ctgtctccagggcaggtgcagg

SEQ ID NO: 9249537 - DNA, 22 bp, Homo sapiens
ctgtctcaagactgcaggcact

SEQ ID NO: 9249538 - DNA, 22 bp, Homo sapiens
ctgtctcagcaggaagtcatca

SEQ ID NO: 9249539 - DNA, 19 bp, Homo sapiens
ctgtccttggctgcactgt

SEQ ID NO: 9249540 - DNA, 22 bp, Homo sapiens
atcagcttttctcatcagaaat

SEQ ID NO: 9249541 - DNA, 22 bp, Homo sapiens
atcagtttgtatatgaaacact

SEQ ID NO: 9249542 - DNA, 22 bp, Homo sapiens
atcagtttgtatatgaaacact

SEQ ID NO: 9249543 - DNA, 22 bp, Homo sapiens
atcataaaattgcaccatttct

SEQ ID NO: 9249544 - DNA, 22 bp, Homo sapiens
atcataaaattgcaccatttct

SEQ ID NO: 9249545 - DNA, 22 bp, Homo sapiens
atcataaaccactttgtaatct

SEQ ID NO: 9249546 - DNA, 22 bp, Homo sapiens
atcataaaccactttgtaatct

SEQ ID NO: 9249547 - DNA, 22 bp, Homo sapiens
atcataaaccactttgtaatct

SEQ ID NO: 9249548 - DNA, 22 bp, Homo sapiens
atcataaaccactttgtaatct

SEQ ID NO: 9249549 - DNA, 22 bp, Homo sapiens
atcataaagtgctatctgattg

SEQ ID NO: 9249550 - DNA, 22 bp, Homo sapiens
ctgggggcaagcagacagctgt

SEQ ID NO: 9249551 - DNA, 22 bp, Homo sapiens
ctgggggcaagcagacagctgt

SEQ ID NO: 9249552 - DNA, 19 bp, Homo sapiens
ctggggctttggtactgcc

SEQ ID NO: 9249553 - DNA, 19 bp, Homo sapiens
ctggggctttggtactgcc

SEQ ID NO: 9249554 - DNA, 19 bp, Homo sapiens
ctggggctttggtactgcc

SEQ ID NO: 9249555 - DNA, 19 bp, Homo sapiens
ctggggctttggtactgcc

SEQ ID NO: 9249556 - DNA, 22 bp, Homo sapiens
ctggggcatctgacagataaat

SEQ ID NO: 9249557 - DNA, 22 bp, Homo sapiens
ctggggctgtaggaggacttat

SEQ ID NO: 9249558 - DNA, 22 bp, Homo sapiens
ctggggctgtaggaggacttat

SEQ ID NO: 9249559 - DNA, 23 bp, Homo sapiens
ctggggctttcaaatctgggcag

SEQ ID NO: 9249560 - DNA, 23 bp, Homo sapiens
ctggggctttcaaatctgggcag

SEQ ID NO: 9249561 - DNA, 22 bp, Homo sapiens
ctggggcttcaatgcttcggtg

SEQ ID NO: 9249562 - DNA, 22 bp, Homo sapiens
ctggggcttcaatgcttcggtg

SEQ ID NO: 9249563 - DNA, 22 bp, Homo sapiens
ctggggctgtgggagacaaggc

SEQ ID NO: 9249564 - DNA, 22 bp, Homo sapiens
ctgggagcttgttaggaatgca

SEQ ID NO: 9249565 - DNA, 22 bp, Homo sapiens
ctgggaggacaacttggagctc

SEQ ID NO: 9249566 - DNA, 22 bp, Homo sapiens
ctgggaggacaacttggagctc

SEQ ID NO: 9249567 - DNA, 22 bp, Homo sapiens
ctgggaggacaacttggagctc

SEQ ID NO: 9249568 - DNA, 22 bp, Homo sapiens
ctgggaggattcattgaggtga

SEQ ID NO: 9249569 - DNA, 22 bp, Homo sapiens
ctgggaggatacacaagatcag

SEQ ID NO: 9249570 - DNA, 22 bp, Homo sapiens
ctgggaggattcattgaggtga

SEQ ID NO: 9249571 - DNA, 22 bp, Homo sapiens
ctgggaggtggaggttgcattg

SEQ ID NO: 9249572 - DNA, 19 bp, Homo sapiens
ctgggaggtgttcagagaa

SEQ ID NO: 9249573 - DNA, 22 bp, Homo sapiens
ctgggaggtggaggttgcattg

SEQ ID NO: 9249574 - DNA, 22 bp, Homo sapiens
ctgggaggtgcagcaaaaatca

SEQ ID NO: 9249575 - DNA, 22 bp, Homo sapiens
ctgggaggtgaacagaaaaact

SEQ ID NO: 9249576 - DNA, 22 bp, Homo sapiens
ctgggaggtgaacagaaaaact

SEQ ID NO: 9249577 - DNA, 20 bp, Homo sapiens
ctgggaggtcttccaaatca

SEQ ID NO: 9249578 - DNA, 22 bp, Homo sapiens
ctgggaggggtagccaatccta

SEQ ID NO: 9249579 - DNA, 22 bp, Homo sapiens
ctgggaggggtagccaatccta

SEQ ID NO: 9249580 - DNA, 22 bp, Homo sapiens
ctgggaggcggaggttgtagtg

SEQ ID NO: 9249581 - DNA, 22 bp, Homo sapiens
ctgggaggcggaggttgtagtg

SEQ ID NO: 9249582 - DNA, 22 bp, Homo sapiens
ctgggtggcagagcctgcagtg

SEQ ID NO: 9249583 - DNA, 22 bp, Homo sapiens
ctgggtggcgtctggggccagt

SEQ ID NO: 9249584 - DNA, 22 bp, Homo sapiens
ctgggtggcagagcctgcagtg

SEQ ID NO: 9249585 - DNA, 20 bp, Homo sapiens
ctgggtggcaagcaaggggg

SEQ ID NO: 9249586 - DNA, 22 bp, Homo sapiens
ctgggtggcagagcctgcagtg

SEQ ID NO: 9249587 - DNA, 22 bp, Homo sapiens
ctgggtggatcgcagccccagg

SEQ ID NO: 9249588 - DNA, 20 bp, Homo sapiens
ctgggtggcaagcaaggggg

SEQ ID NO: 9249589 - DNA, 22 bp, Homo sapiens
ctgggtggatcgcagccccagg

SEQ ID NO: 9249590 - DNA, 18 bp, Homo sapiens
ctgggtctccaggctgcc

SEQ ID NO: 9249591 - DNA, 22 bp, Homo sapiens
atattcacactgtttagttaca

SEQ ID NO: 9249592 - DNA, 22 bp, Homo sapiens
atattcactgagcataaagcca

SEQ ID NO: 9249593 - DNA, 22 bp, Homo sapiens
atattattctagtaacagtgat

SEQ ID NO: 9249594 - DNA, 22 bp, Homo sapiens
atattattctagtaacagtgat

SEQ ID NO: 9249595 - DNA, 22 bp, Homo sapiens
atattcaaattacatttactaa

SEQ ID NO: 9249596 - DNA, 18 bp, Homo sapiens
atattcaagaagacagag

SEQ ID NO: 9249597 - DNA, 18 bp, Homo sapiens
ctggtcagggcaatgggc

SEQ ID NO: 9249598 - DNA, 22 bp, Homo sapiens
ctggtcagggctctttgggagc

SEQ ID NO: 9249599 - DNA, 22 bp, Homo sapiens
ctggtcaggaaggtggggacag

SEQ ID NO: 9249600 - DNA, 22 bp, Homo sapiens
ctggtcaggggatggggctcag

SEQ ID NO: 9249601 - DNA, 22 bp, Homo sapiens
ctgggtggctgtccagccagcc

SEQ ID NO: 9249602 - DNA, 22 bp, Homo sapiens
ctgggtggcgtctggggccagt

SEQ ID NO: 9249603 - DNA, 22 bp, Homo sapiens
ctgggtggctgtccagccagcc

SEQ ID NO: 9249604 - DNA, 22 bp, Homo sapiens
ctgggtggctgtccagccagcc

SEQ ID NO: 9249605 - DNA, 22 bp, Homo sapiens
ctggtccattctctccctgaag

SEQ ID NO: 9249606 - DNA, 22 bp, Homo sapiens
ctggtccagtggatgctgaggg

SEQ ID NO: 9249607 - DNA, 22 bp, Homo sapiens
ctggtcctaaagccctactcca

SEQ ID NO: 9249608 - DNA, 22 bp, Homo sapiens
atcaagaacttattttggaaat

SEQ ID NO: 9249609 - DNA, 22 bp, Homo sapiens
atcaagaatgttcattcttcta

SEQ ID NO: 9249610 - DNA, 22 bp, Homo sapiens
agtgccaggagcaaggagctcc

SEQ ID NO: 9249611 - DNA, 20 bp, Homo sapiens
agtgccagggcaggtgagag

SEQ ID NO: 9249612 - DNA, 22 bp, Homo sapiens
agtgccctggcccagctggacc

SEQ ID NO: 9249613 - DNA, 22 bp, Homo sapiens
agtgcccacctctcttcagcta

SEQ ID NO: 9249614 - DNA, 22 bp, Homo sapiens
agtgcctggaccccatgacata

SEQ ID NO: 9249615 - DNA, 22 bp, Homo sapiens
agtgctgggtactgttcccatt

SEQ ID NO: 9249616 - DNA, 22 bp, Homo sapiens
agtgctaatgtgcaatatagag

SEQ ID NO: 9249617 - DNA, 22 bp, Homo sapiens
agtgctaaaggatcacagggtc

SEQ ID NO: 9249618 - DNA, 22 bp, Homo sapiens
agtgccttgtgtgtgggcagcc

SEQ ID NO: 9249619 - DNA, 22 bp, Homo sapiens
agtgccttgtgtgtgggcagcc

SEQ ID NO: 9249620 - DNA, 22 bp, Homo sapiens
agtgccttgggtattttgagta

SEQ ID NO: 9249621 - DNA, 22 bp, Homo sapiens
agtgccttggctgtgatgggga

SEQ ID NO: 9249622 - DNA, 19 bp, Homo sapiens
agtgccttgctctctaggt

SEQ ID NO: 9249623 - DNA, 22 bp, Homo sapiens
agtgcagggggaaagggtgtct

SEQ ID NO: 9249624 - DNA, 22 bp, Homo sapiens
agtgatgtgggagagtatagct

SEQ ID NO: 9249625 - DNA, 22 bp, Homo sapiens
agtgcagggggaaagggtgtct

SEQ ID NO: 9249626 - DNA, 22 bp, Homo sapiens
agtggcaatgtagagagtgatc

SEQ ID NO: 9249627 - DNA, 22 bp, Homo sapiens
agtggcagtggggcagggccct

SEQ ID NO: 9249628 - DNA, 22 bp, Homo sapiens
agtggcagggctggctgctgca

SEQ ID NO: 9249629 - DNA, 22 bp, Homo sapiens
agtggcagtttgggagctacag

SEQ ID NO: 9249630 - DNA, 22 bp, Homo sapiens
agtggcattttaatggatgtca

SEQ ID NO: 9249631 - DNA, 22 bp, Homo sapiens
agtggagcttttcctatcagag

SEQ ID NO: 9249632 - DNA, 22 bp, Homo sapiens
agtggaggttacagctgtacat

SEQ ID NO: 9249633 - DNA, 22 bp, Homo sapiens
agtggaggcactaattggattt

SEQ ID NO: 9249634 - DNA, 22 bp, Homo sapiens
agtggaccagaagactgaagct

SEQ ID NO: 9249635 - DNA, 22 bp, Homo sapiens
agtggagaagaggatggtctcc

SEQ ID NO: 9249636 - DNA, 22 bp, Homo sapiens
agtggagaatatgcagaaagcc

SEQ ID NO: 9249637 - DNA, 22 bp, Homo sapiens
agtggagacaggacagtcgata

SEQ ID NO: 9249638 - DNA, 22 bp, Homo sapiens
agtgctttgtggagaatttgta

SEQ ID NO: 9249639 - DNA, 18 bp, Homo sapiens
agtggaaaacaaatacac

SEQ ID NO: 9249640 - DNA, 22 bp, Homo sapiens
agtggaaggtcaggggacagtg

SEQ ID NO: 9249641 - DNA, 22 bp, Homo sapiens
agtctagtaggatctctgggct

SEQ ID NO: 9249642 - DNA, 22 bp, Homo sapiens
agtctagtaggatctctgggct

SEQ ID NO: 9249643 - DNA, 20 bp, Homo sapiens
ctcacagtcaatgcagaggt

SEQ ID NO: 9249644 - DNA, 22 bp, Homo sapiens
agtctttatacagaaatatatg

SEQ ID NO: 9249645 - DNA, 18 bp, Homo sapiens
agtcttctgatccatttt

SEQ ID NO: 9249646 - DNA, 22 bp, Homo sapiens
agtcttctgctctgtcactaac

SEQ ID NO: 9249647 - DNA, 19 bp, Homo sapiens
agtctttgcctggggcctt

SEQ ID NO: 9249648 - DNA, 22 bp, Homo sapiens
ctcacatgatggcctttttcat

SEQ ID NO: 9249649 - DNA, 22 bp, Homo sapiens
ctcacagtttcacagtgtagat

SEQ ID NO: 9249650 - DNA, 22 bp, Homo sapiens
ctcacagttttctgtagtccaa

SEQ ID NO: 9249651 - DNA, 23 bp, Homo sapiens
ctcaccaagcgccgccgctgtgt

SEQ ID NO: 9249652 - DNA, 22 bp, Homo sapiens
agtgaggctaataggcaatggt

SEQ ID NO: 9249653 - DNA, 22 bp, Homo sapiens
agtgagggactagtgctgggga

SEQ ID NO: 9249654 - DNA, 22 bp, Homo sapiens
agtgaaattgctgtaagaggaa

SEQ ID NO: 9249655 - DNA, 21 bp, Homo sapiens
agtgaaattgcatcagaggga

SEQ ID NO: 9249656 - DNA, 22 bp, Homo sapiens
agtgaaatcctggtcaacaggt

SEQ ID NO: 9249657 - DNA, 22 bp, Homo sapiens
agtgaaatgatagtgtaaatac

SEQ ID NO: 9249658 - DNA, 22 bp, Homo sapiens
agtgaaattcctggtctttgtt

SEQ ID NO: 9249659 - DNA, 22 bp, Homo sapiens
agtgaaatgattctgagcaaga

SEQ ID NO: 9249660 - DNA, 22 bp, Homo sapiens
agtgaaaggttgagaatattct

SEQ ID NO: 9249661 - DNA, 22 bp, Homo sapiens
agtgaaaggaaaaactgatatt

SEQ ID NO: 9249662 - DNA, 22 bp, Homo sapiens
agtgaaatagcatttatgaagc

SEQ ID NO: 9249663 - DNA, 22 bp, Homo sapiens
agtgaaatactgtcgtttttag

SEQ ID NO: 9249664 - DNA, 22 bp, Homo sapiens
agtgaaatatgcccattgctgt

SEQ ID NO: 9249665 - DNA, 22 bp, Homo sapiens
agtgaaatcaggttttgactgc

SEQ ID NO: 9249666 - DNA, 22 bp, Homo sapiens
agtgaaatcaggttttgactgc

SEQ ID NO: 9249667 - DNA, 22 bp, Homo sapiens
agtgaaaacactagttcttgcc

SEQ ID NO: 9249668 - DNA, 22 bp, Homo sapiens
agtgaaaacactagttcttgcc

SEQ ID NO: 9249669 - DNA, 22 bp, Homo sapiens
agtgaaaacctaatcatgcagt

SEQ ID NO: 9249670 - DNA, 22 bp, Homo sapiens
agtgaaaacctaatcatgcagt

SEQ ID NO: 9249671 - DNA, 22 bp, Homo sapiens
agtgaaaagatgcatttctctg

SEQ ID NO: 9249672 - DNA, 22 bp, Homo sapiens
agtgaggggcagctgagtgggc

SEQ ID NO: 9249673 - DNA, 22 bp, Homo sapiens
agtgaggggattcaggcaaggt

SEQ ID NO: 9249674 - DNA, 22 bp, Homo sapiens
agtgaggggcagctgagtgggc

SEQ ID NO: 9249675 - DNA, 22 bp, Homo sapiens
agtgagggatgaagaactgcgg

SEQ ID NO: 9249676 - DNA, 22 bp, Homo sapiens
agtgagggactagtgctgggga

SEQ ID NO: 9249677 - DNA, 22 bp, Homo sapiens
agtgatggtgagtgagaagctc

SEQ ID NO: 9249678 - DNA, 22 bp, Homo sapiens
agtgatggggccctgcactgat

SEQ ID NO: 9249679 - DNA, 22 bp, Homo sapiens
agtgatggcatatatagatgtg

SEQ ID NO: 9249680 - DNA, 22 bp, Homo sapiens
agtgatggcatcgggtccagca

SEQ ID NO: 9249681 - DNA, 22 bp, Homo sapiens
agtgatggagcttcctctgcta

SEQ ID NO: 9249682 - DNA, 22 bp, Homo sapiens
agtgatgccacacaatgctttg

SEQ ID NO: 9249683 - DNA, 22 bp, Homo sapiens
agtgataggacatatggatttt

SEQ ID NO: 9249684 - DNA, 22 bp, Homo sapiens
agtgataatgtggtaattattt

SEQ ID NO: 9249685 - DNA, 18 bp, Homo sapiens
agtgagttgttgaaagaa

SEQ ID NO: 9249686 - DNA, 22 bp, Homo sapiens
agtgagttgaacattgataatg

SEQ ID NO: 9249687 - DNA, 22 bp, Homo sapiens
ctctggagttcttcaagctact

SEQ ID NO: 9249688 - DNA, 22 bp, Homo sapiens
ctctggagtgtctggccagggt

SEQ ID NO: 9249689 - DNA, 22 bp, Homo sapiens
agtggtcctgcaaacccgtgtg

SEQ ID NO: 9249690 - DNA, 19 bp, Homo sapiens
agtggtagatgagcaggag

SEQ ID NO: 9249691 - DNA, 22 bp, Homo sapiens
agtgggtggcgcagaggaggaa

SEQ ID NO: 9249692 - DNA, 22 bp, Homo sapiens
agtgggtgtagtcttcctcctg

SEQ ID NO: 9249693 - DNA, 22 bp, Homo sapiens
agtggccagtgctgctctgggg

SEQ ID NO: 9249694 - DNA, 22 bp, Homo sapiens
agtggctagatcatgagtgagc

SEQ ID NO: 9249695 - DNA, 22 bp, Homo sapiens
agtggctatgcatgactggaat

SEQ ID NO: 9249696 - DNA, 22 bp, Homo sapiens
agtggcctggagccccgcctgg

SEQ ID NO: 9249697 - DNA, 22 bp, Homo sapiens
agtggcctggagccccgcctgg

SEQ ID NO: 9249698 - DNA, 22 bp, Homo sapiens
agtggctctccaagaagtcaca

SEQ ID NO: 9249699 - DNA, 22 bp, Homo sapiens
agtgggtaggcctctggtgcct

SEQ ID NO: 9249700 - DNA, 22 bp, Homo sapiens
agtgggtactgggcaggcagag

SEQ ID NO: 9249701 - DNA, 22 bp, Homo sapiens
agtgggtactgggcaggcagag

SEQ ID NO: 9249702 - DNA, 22 bp, Homo sapiens
agtgtctttgtctctcaagcac

SEQ ID NO: 9249703 - DNA, 22 bp, Homo sapiens
agtgtctttgacacattcaaag

SEQ ID NO: 9249704 - DNA, 22 bp, Homo sapiens
agtgtcccctccaagggcctgg

SEQ ID NO: 9249705 - DNA, 22 bp, Homo sapiens
agtgtcccctacagaggcattc

SEQ ID NO: 9249706 - DNA, 22 bp, Homo sapiens
agtgtccaactcagcttgtcaa

SEQ ID NO: 9249707 - DNA, 22 bp, Homo sapiens
agtgtgagcctacaggccaaag

SEQ ID NO: 9249708 - DNA, 22 bp, Homo sapiens
agtgtgagtaattcagggaggg

SEQ ID NO: 9249709 - DNA, 22 bp, Homo sapiens
agtgtgagtaattcagggaggg

SEQ ID NO: 9249710 - DNA, 23 bp, Homo sapiens
agtgtgacttttttgactgtcac

SEQ ID NO: 9249711 - DNA, 19 bp, Homo sapiens
agtgtgagactccatctca

SEQ ID NO: 9249712 - DNA, 22 bp, Homo sapiens
agtgtctttgtctctcaagcac

SEQ ID NO: 9249713 - DNA, 22 bp, Homo sapiens
agtgtcacaaacctgccttgta

SEQ ID NO: 9249714 - DNA, 22 bp, Homo sapiens
agtgtacaaaatgatagataaa

SEQ ID NO: 9249715 - DNA, 22 bp, Homo sapiens
agtgtacaaaatgatagataaa

SEQ ID NO: 9249716 - DNA, 22 bp, Homo sapiens
agtgtacaaaatgatagataaa

SEQ ID NO: 9249717 - DNA, 22 bp, Homo sapiens
agtgtacaaaatgatagataaa

SEQ ID NO: 9249718 - DNA, 21 bp, Homo sapiens
ctctggagtttgaaggctggg

SEQ ID NO: 9249719 - DNA, 22 bp, Homo sapiens
agtgtcaaattaaataatctgg

SEQ ID NO: 9249720 - DNA, 19 bp, Homo sapiens
agtgtatttttttctgtag

SEQ ID NO: 9249721 - DNA, 22 bp, Homo sapiens
agtgttttattagaacacagcc

SEQ ID NO: 9249722 - DNA, 22 bp, Homo sapiens
agtgttttattagaacacagcc

SEQ ID NO: 9249723 - DNA, 22 bp, Homo sapiens
agtgtttggggtgattgtaacc

SEQ ID NO: 9249724 - DNA, 22 bp, Homo sapiens
agtgtttggggtgattgtaacc

SEQ ID NO: 9249725 - DNA, 20 bp, Homo sapiens
agtgtttgctcacagtctcc

SEQ ID NO: 9249726 - DNA, 22 bp, Homo sapiens
agtgtttgggggccttgtaaca

SEQ ID NO: 9249727 - DNA, 22 bp, Homo sapiens
agtgtttctggcaaatgaaagt

SEQ ID NO: 9249728 - DNA, 22 bp, Homo sapiens
agtgtttctggaatcagtgttt

SEQ ID NO: 9249729 - DNA, 22 bp, Homo sapiens
agtgtttctcagaagggcctat

SEQ ID NO: 9249730 - DNA, 22 bp, Homo sapiens
agtgtttctggcaaatgaaagt

SEQ ID NO: 9249731 - DNA, 22 bp, Homo sapiens
agtgtttctgtgccccagtgtt

SEQ ID NO: 9249732 - DNA, 17 bp, Homo sapiens
agtgtttccttatcatt

SEQ ID NO: 9249733 - DNA, 20 bp, Homo sapiens
agtgtttctcaacatggggc

SEQ ID NO: 9249734 - DNA, 22 bp, Homo sapiens
agtgtttctaagtagatgtgaa

SEQ ID NO: 9249735 - DNA, 22 bp, Homo sapiens
agtgtttcacagcactttttct

SEQ ID NO: 9249736 - DNA, 22 bp, Homo sapiens
agtgtttcaatcctaggggttg

SEQ ID NO: 9249737 - DNA, 22 bp, Homo sapiens
agtgtttcaccgtatgttctca

SEQ ID NO: 9249738 - DNA, 19 bp, Homo sapiens
agtgtttcatgtgctttta

SEQ ID NO: 9249739 - DNA, 19 bp, Homo sapiens
agtgtttcatgtgctttta

SEQ ID NO: 9249740 - DNA, 22 bp, Homo sapiens
agtgtttcaccgtatgttctca

SEQ ID NO: 9249741 - DNA, 22 bp, Homo sapiens
agtgtttcccagtaggatgaaa

SEQ ID NO: 9249742 - DNA, 22 bp, Homo sapiens
agtgtttcctgagtgttatcat

SEQ ID NO: 9249743 - DNA, 22 bp, Homo sapiens
agtgtgggcccccaggttagcc

SEQ ID NO: 9249744 - DNA, 22 bp, Homo sapiens
agtgtgggggctttggtgtcac

SEQ ID NO: 9249745 - DNA, 22 bp, Homo sapiens
agtgtgggccacgcagctgagc

SEQ ID NO: 9249746 - DNA, 22 bp, Homo sapiens
agtgtttcaagaagcaggaagt

SEQ ID NO: 9249747 - DNA, 18 bp, Homo sapiens
agtgtttatttaggtgaa

SEQ ID NO: 9249748 - DNA, 22 bp, Homo sapiens
agtgtttcaagtgatgctttgg

SEQ ID NO: 9249749 - DNA, 22 bp, Homo sapiens
agtgtttcaagtgatgctttgg

SEQ ID NO: 9249750 - DNA, 22 bp, Homo sapiens
agtgtttcaagtgatgctttgg

SEQ ID NO: 9249751 - DNA, 19 bp, Homo sapiens
agtgttctgagtactcctc

SEQ ID NO: 9249752 - DNA, 18 bp, Homo sapiens
agtgttctcgttttataa

SEQ ID NO: 9249753 - DNA, 20 bp, Homo sapiens
agtgtgcatttagagtctgc

SEQ ID NO: 9249754 - DNA, 22 bp, Homo sapiens
agtgtgcatttgcagaagaccc

SEQ ID NO: 9249755 - DNA, 22 bp, Homo sapiens
agtgtgagttacaaagtgtgaa

SEQ ID NO: 9249756 - DNA, 22 bp, Homo sapiens
agtgtggagccactgagtggct

SEQ ID NO: 9249757 - DNA, 22 bp, Homo sapiens
agtgtggagccactgagtggct

SEQ ID NO: 9249758 - DNA, 22 bp, Homo sapiens
agtgtggattggctggagctat

SEQ ID NO: 9249759 - DNA, 22 bp, Homo sapiens
agtgtggattggctggagctat

SEQ ID NO: 9249760 - DNA, 22 bp, Homo sapiens
agtgtggagcatcgagggcaga

SEQ ID NO: 9249761 - DNA, 22 bp, Homo sapiens
agtgtggagcatcgagggcaga

SEQ ID NO: 9249762 - DNA, 22 bp, Homo sapiens
ctgagccagggccacacatgga

SEQ ID NO: 9249763 - DNA, 22 bp, Homo sapiens
ctgagctaggagttaggaagct

SEQ ID NO: 9249764 - DNA, 22 bp, Homo sapiens
ctgagctcaagcgatcctccca

SEQ ID NO: 9249765 - DNA, 22 bp, Homo sapiens
ctgagctcaagcgatcctccca

SEQ ID NO: 9249766 - DNA, 22 bp, Homo sapiens
ctgagctctaatgtcagccttg

SEQ ID NO: 9249767 - DNA, 22 bp, Homo sapiens
ctgagctcacgccattctcctt

SEQ ID NO: 9249768 - DNA, 22 bp, Homo sapiens
ctgagccagctggcatgtgcta

SEQ ID NO: 9249769 - DNA, 22 bp, Homo sapiens
ctgagccagctggcatgtgcta

SEQ ID NO: 9249770 - DNA, 22 bp, Homo sapiens
ctgagccagggccacacatgga

SEQ ID NO: 9249771 - DNA, 22 bp, Homo sapiens
ctgagccagggccacacatgga

SEQ ID NO: 9249772 - DNA, 22 bp, Homo sapiens
ctgagccagctggcatgtgcta

SEQ ID NO: 9249773 - DNA, 22 bp, Homo sapiens
ctgagccagctggcatgtgcta

SEQ ID NO: 9249774 - DNA, 22 bp, Homo sapiens
ctgagccagcgggctcactttt

SEQ ID NO: 9249775 - DNA, 22 bp, Homo sapiens
ctgagccagcgggctcactttt

SEQ ID NO: 9249776 - DNA, 22 bp, Homo sapiens
ctgagccaaggggacagtgaca

SEQ ID NO: 9249777 - DNA, 22 bp, Homo sapiens
ctgagccaaggggacagtgaca

SEQ ID NO: 9249778 - DNA, 22 bp, Homo sapiens
ctgagccagcgggctcactttt

SEQ ID NO: 9249779 - DNA, 22 bp, Homo sapiens
ctgagccactgcttgttcagtg

SEQ ID NO: 9249780 - DNA, 22 bp, Homo sapiens
ctgagccagagggagtcgggtc

SEQ ID NO: 9249781 - DNA, 22 bp, Homo sapiens
ctgagccaaggggacagtgaca

SEQ ID NO: 9249782 - DNA, 22 bp, Homo sapiens
agttaactaaactgtgagtaaa

SEQ ID NO: 9249783 - DNA, 22 bp, Homo sapiens
agttccagtgtgagagaacatg

SEQ ID NO: 9249784 - DNA, 22 bp, Homo sapiens
agttccagtgtgagagaacatg

SEQ ID NO: 9249785 - DNA, 22 bp, Homo sapiens
agttcccaggtgatgctgatgt

SEQ ID NO: 9249786 - DNA, 23 bp, Homo sapiens
agttcataatttcttatttgtgt

SEQ ID NO: 9249787 - DNA, 23 bp, Homo sapiens
agttccagaaaaatgctcaagca

SEQ ID NO: 9249788 - DNA, 22 bp, Homo sapiens
ctgagctgcggcaggcacctgg

SEQ ID NO: 9249789 - DNA, 22 bp, Homo sapiens
ctgagctgctcccgctgcagcg

SEQ ID NO: 9249790 - DNA, 22 bp, Homo sapiens
ctgagctgcagtcctggctctg

SEQ ID NO: 9249791 - DNA, 22 bp, Homo sapiens
ctgagctgcagtcctggctctg

SEQ ID NO: 9249792 - DNA, 20 bp, Homo sapiens
ctgagctgagctccatgggt

SEQ ID NO: 9249793 - DNA, 22 bp, Homo sapiens
cctgtgggagcccaggcagata

SEQ ID NO: 9249794 - DNA, 22 bp, Homo sapiens
cctgtgggagggagcggctgga

SEQ ID NO: 9249795 - DNA, 22 bp, Homo sapiens
cctgtgggaggttctgtgagtc

SEQ ID NO: 9249796 - DNA, 22 bp, Homo sapiens
aggtggcaaggggcgcctctct

SEQ ID NO: 9249797 - DNA, 22 bp, Homo sapiens
cctgtgggtcacatgggtgact

SEQ ID NO: 9249798 - DNA, 22 bp, Homo sapiens
cctgtgggcttgagtgtagggt

SEQ ID NO: 9249799 - DNA, 22 bp, Homo sapiens
aggtggcagaggactcctcctg

SEQ ID NO: 9249800 - DNA, 22 bp, Homo sapiens
aggtggcagagtgacaggctga

SEQ ID NO: 9249801 - DNA, 22 bp, Homo sapiens
ccttccagagttcagtctgccc

SEQ ID NO: 9249802 - DNA, 22 bp, Homo sapiens
ccttccagaggcgtgacaccct

SEQ ID NO: 9249803 - DNA, 22 bp, Homo sapiens
ccttccaagtgctgctttttcc

SEQ ID NO: 9249804 - DNA, 22 bp, Homo sapiens
ccttccaggagtctctgcaggt

SEQ ID NO: 9249805 - DNA, 22 bp, Homo sapiens
ccttccagccccatctcatcgt

SEQ ID NO: 9249806 - DNA, 22 bp, Homo sapiens
cctgtttggtacaatctgccaa

SEQ ID NO: 9249807 - DNA, 22 bp, Homo sapiens
aggtggcagatgggggtgctcg

SEQ ID NO: 9249808 - DNA, 22 bp, Homo sapiens
cctgtgggagcccaggcagata

SEQ ID NO: 9249809 - DNA, 22 bp, Homo sapiens
aggtgcagctggtggagtctgg

SEQ ID NO: 9249810 - DNA, 22 bp, Homo sapiens
aggtgcaggagctgtgcaggga

SEQ ID NO: 9249811 - DNA, 22 bp, Homo sapiens
aggtgcagctggtggagtctgg

SEQ ID NO: 9249812 - DNA, 22 bp, Homo sapiens
aggtgcagctgacaccatgtgg

SEQ ID NO: 9249813 - DNA, 18 bp, Homo sapiens
aggtgcagcctctgaggc

SEQ ID NO: 9249814 - DNA, 22 bp, Homo sapiens
aggtgcagctggtggagtctgg

SEQ ID NO: 9249815 - DNA, 22 bp, Homo sapiens
aggtgcagcatgagtccaacgg

SEQ ID NO: 9249816 - DNA, 22 bp, Homo sapiens
aggtgcagcatgagtccaacgg

SEQ ID NO: 9249817 - DNA, 22 bp, Homo sapiens
cctgggtccaccctgtgaagta

SEQ ID NO: 9249818 - DNA, 17 bp, Homo sapiens
aggtgcagaggcagagc

SEQ ID NO: 9249819 - DNA, 17 bp, Homo sapiens
aggtgcagaggcagagc

SEQ ID NO: 9249820 - DNA, 22 bp, Homo sapiens
cctgggtcactcaggcaggcgg

SEQ ID NO: 9249821 - DNA, 22 bp, Homo sapiens
cctggggtatataggtgaatat

SEQ ID NO: 9249822 - DNA, 22 bp, Homo sapiens
cctgggtagactttgaagcatt

SEQ ID NO: 9249823 - DNA, 22 bp, Homo sapiens
aggtcctgatgatctctgagag

SEQ ID NO: 9249824 - DNA, 22 bp, Homo sapiens
aggtcctggactgctcttgtta

SEQ ID NO: 9249825 - DNA, 23 bp, Homo sapiens
aggtcctggacatatgtgcatca

SEQ ID NO: 9249826 - DNA, 22 bp, Homo sapiens
aggtcctgggagttctagtgtg

SEQ ID NO: 9249827 - DNA, 20 bp, Homo sapiens
aggtcctggttctctgggat

SEQ ID NO: 9249828 - DNA, 22 bp, Homo sapiens
cctgggctttgagggcaggatg

SEQ ID NO: 9249829 - DNA, 22 bp, Homo sapiens
cctggggctccagagcagcgga

SEQ ID NO: 9249830 - DNA, 20 bp, Homo sapiens
cctggggtacactggcatgt

SEQ ID NO: 9249831 - DNA, 22 bp, Homo sapiens
aggtcaggaggcctctgccatt

SEQ ID NO: 9249832 - DNA, 22 bp, Homo sapiens
aggtcagctgctgataggcagc

SEQ ID NO: 9249833 - DNA, 22 bp, Homo sapiens
aggtcagatgggagatgggatg

SEQ ID NO: 9249834 - DNA, 22 bp, Homo sapiens
aggtcagacagggtgtctttct

SEQ ID NO: 9249835 - DNA, 22 bp, Homo sapiens
aggtcagaaaaggagagcattg

SEQ ID NO: 9249836 - DNA, 22 bp, Homo sapiens
aggtcacgtcctgtgatgtcat

SEQ ID NO: 9249837 - DNA, 22 bp, Homo sapiens
aggtcacagggttgaagtactt

SEQ ID NO: 9249838 - DNA, 22 bp, Homo sapiens
aggtcaccatggcatgctccac

SEQ ID NO: 9249839 - DNA, 22 bp, Homo sapiens
aggtcacccgtttgactatcca

SEQ ID NO: 9249840 - DNA, 22 bp, Homo sapiens
aggtcacccgtttgactatcca

SEQ ID NO: 9249841 - DNA, 22 bp, Homo sapiens
aggtcaggtatcagcaggtatt

SEQ ID NO: 9249842 - DNA, 22 bp, Homo sapiens
aggtcaggtatcagcaggtatt

SEQ ID NO: 9249843 - DNA, 22 bp, Homo sapiens
cctgggaggctgaggctgcagt

SEQ ID NO: 9249844 - DNA, 22 bp, Homo sapiens
cctgggaggctgaggctgcagt

SEQ ID NO: 9249845 - DNA, 22 bp, Homo sapiens
cctgggaggctgtgggtctgct

SEQ ID NO: 9249846 - DNA, 22 bp, Homo sapiens
cctgggaggctgaggctgcagt

SEQ ID NO: 9249847 - DNA, 22 bp, Homo sapiens
cctgggagggcaagtgctgatg

SEQ ID NO: 9249848 - DNA, 22 bp, Homo sapiens
cctgggaggctgtgggtctgct

SEQ ID NO: 9249849 - DNA, 22 bp, Homo sapiens
cctgggaggctgtgggtctgct

SEQ ID NO: 9249850 - DNA, 22 bp, Homo sapiens
cctgggaggctgtttccagcct

SEQ ID NO: 9249851 - DNA, 22 bp, Homo sapiens
cctgggaggctgtgggtctgct

SEQ ID NO: 9249852 - DNA, 22 bp, Homo sapiens
cctgggaggctgtgggtctgct

SEQ ID NO: 9249853 - DNA, 22 bp, Homo sapiens
aggtaaggctgtaagctaagcc

SEQ ID NO: 9249854 - DNA, 22 bp, Homo sapiens
aggtaaggggctcccaagtacc

SEQ ID NO: 9249855 - DNA, 22 bp, Homo sapiens
aggtaaagacagtgaaagaggg

SEQ ID NO: 9249856 - DNA, 22 bp, Homo sapiens
aggtaaatgtcagagcctttaa

SEQ ID NO: 9249857 - DNA, 22 bp, Homo sapiens
aggtcacacaactgtcagaggc

SEQ ID NO: 9249858 - DNA, 22 bp, Homo sapiens
aggtcacacttggatcatagaa

SEQ ID NO: 9249859 - DNA, 22 bp, Homo sapiens
aggtcacaggctttgaaatcaa

SEQ ID NO: 9249860 - DNA, 22 bp, Homo sapiens
aggtcacagctttctcgtgagg

SEQ ID NO: 9249861 - DNA, 22 bp, Homo sapiens
aggtacagatgaaagtctagtt

SEQ ID NO: 9249862 - DNA, 22 bp, Homo sapiens
aggtacagatgaaagtctagtt

SEQ ID NO: 9249863 - DNA, 22 bp, Homo sapiens
cctgagtagctggaattaaagg

SEQ ID NO: 9249864 - DNA, 22 bp, Homo sapiens
agggtgggctagactcttcccc

SEQ ID NO: 9249865 - DNA, 22 bp, Homo sapiens
cctgaggtttttggatagttgt

SEQ ID NO: 9249866 - DNA, 22 bp, Homo sapiens
cctgaggtttttggatagttgt

SEQ ID NO: 9249867 - DNA, 21 bp, Homo sapiens
cctgaggtttctggcctctgt

SEQ ID NO: 9249868 - DNA, 22 bp, Homo sapiens
cctgagtagctggaattaaagg

SEQ ID NO: 9249869 - DNA, 22 bp, Homo sapiens
cctgagtagctggaattaaagg

SEQ ID NO: 9249870 - DNA, 22 bp, Homo sapiens
cctgagtaacatggtgagaacc

SEQ ID NO: 9249871 - DNA, 22 bp, Homo sapiens
cctgaggttgaagtataaattg

SEQ ID NO: 9249872 - DNA, 19 bp, Homo sapiens
cctgaggtggggtggaagg

SEQ ID NO: 9249873 - DNA, 22 bp, Homo sapiens
cctgaggttatccatctacctg

SEQ ID NO: 9249874 - DNA, 18 bp, Homo sapiens
cctgaggtgggaggaagg

SEQ ID NO: 9249875 - DNA, 18 bp, Homo sapiens
cctgaggtgggaggaagg

SEQ ID NO: 9249876 - DNA, 19 bp, Homo sapiens
cctgaggtggggtggaagg

SEQ ID NO: 9249877 - DNA, 19 bp, Homo sapiens
cctgaggtggggtggaagg

SEQ ID NO: 9249878 - DNA, 22 bp, Homo sapiens
cctgaggtggctgcagcactgc

SEQ ID NO: 9249879 - DNA, 22 bp, Homo sapiens
cctgaggtctagagtcagggtg

SEQ ID NO: 9249880 - DNA, 22 bp, Homo sapiens
cctgaggtggctgcagcactgc

SEQ ID NO: 9249881 - DNA, 18 bp, Homo sapiens
cctgaggtgggaggaagg

SEQ ID NO: 9249882 - DNA, 19 bp, Homo sapiens
cctgaggtggggtggaagg

SEQ ID NO: 9249883 - DNA, 18 bp, Homo sapiens
cctgaggtgggaggaagg

SEQ ID NO: 9249884 - DNA, 22 bp, Homo sapiens
agggttctgccagtgtcttgag

SEQ ID NO: 9249885 - DNA, 22 bp, Homo sapiens
agggttttcatttctgagcatt

SEQ ID NO: 9249886 - DNA, 23 bp, Homo sapiens
agggttgtgtgcttcatgatcat

SEQ ID NO: 9249887 - DNA, 22 bp, Homo sapiens
aggtaaaatagatagtatttct

SEQ ID NO: 9249888 - DNA, 20 bp, Homo sapiens
agtcacaggcctggaacatg

SEQ ID NO: 9249889 - DNA, 22 bp, Homo sapiens
agtcacagggggcccctgcaac

SEQ ID NO: 9249890 - DNA, 19 bp, Homo sapiens
agtcacagggaagaggaac

SEQ ID NO: 9249891 - DNA, 22 bp, Homo sapiens
agtcacagggggcccctgcaac

SEQ ID NO: 9249892 - DNA, 22 bp, Homo sapiens
agtcacagaaacccaggtgtgg

SEQ ID NO: 9249893 - DNA, 22 bp, Homo sapiens
agtcacagaaacccaggtgtgg

SEQ ID NO: 9249894 - DNA, 22 bp, Homo sapiens
agtcacatgagcactaattagg

SEQ ID NO: 9249895 - DNA, 22 bp, Homo sapiens
agtcacaggttcttgggattag

SEQ ID NO: 9249896 - DNA, 20 bp, Homo sapiens
agtcacagtatcagtcttag

SEQ ID NO: 9249897 - DNA, 22 bp, Homo sapiens
agtcacagttctgctgtctgag

SEQ ID NO: 9249898 - DNA, 22 bp, Homo sapiens
ctaggaggcgggggctgcagta

SEQ ID NO: 9249899 - DNA, 22 bp, Homo sapiens
ctaggcactcacgtggctttag

SEQ ID NO: 9249900 - DNA, 22 bp, Homo sapiens
ctaggcacttgtaaggccgctc

SEQ ID NO: 9249901 - DNA, 22 bp, Homo sapiens
ctaggaaatgaatacagtacac

SEQ ID NO: 9249902 - DNA, 22 bp, Homo sapiens
ctaggaaatttaaaatatgatt

SEQ ID NO: 9249903 - DNA, 22 bp, Homo sapiens
ctaggaagagaaggaattcccc

SEQ ID NO: 9249904 - DNA, 22 bp, Homo sapiens
ctaggaacagttcaacagttta

SEQ ID NO: 9249905 - DNA, 22 bp, Homo sapiens
ctaggaaagacacagagagttt

SEQ ID NO: 9249906 - DNA, 22 bp, Homo sapiens
ctagcttcaagtcctggctgtg

SEQ ID NO: 9249907 - DNA, 22 bp, Homo sapiens
ctagctttttatgacaatcttg

SEQ ID NO: 9249908 - DNA, 22 bp, Homo sapiens
ctagctttgtccattgtcttgc

SEQ ID NO: 9249909 - DNA, 19 bp, Homo sapiens
ctagcttgtcatttgtgtg

SEQ ID NO: 9249910 - DNA, 22 bp, Homo sapiens
ctagagaaaaagcttaggtacg

SEQ ID NO: 9249911 - DNA, 22 bp, Homo sapiens
agtcacatgcattttcttcaat

SEQ ID NO: 9249912 - DNA, 22 bp, Homo sapiens
ctagaattgcattctatgaata

SEQ ID NO: 9249913 - DNA, 23 bp, Homo sapiens
ctagaattttgctaaaagactag

SEQ ID NO: 9249914 - DNA, 22 bp, Homo sapiens
ctagaattttaattgggtatat

SEQ ID NO: 9249915 - DNA, 19 bp, Homo sapiens
ctattgcacatagctgaag

SEQ ID NO: 9249916 - DNA, 22 bp, Homo sapiens
ctattgcatcctccacctcgat

SEQ ID NO: 9249917 - DNA, 22 bp, Homo sapiens
ctattgcatttgcatcttcatc

SEQ ID NO: 9249918 - DNA, 22 bp, Homo sapiens
ctattgaattaactattaaagt

SEQ ID NO: 9249919 - DNA, 22 bp, Homo sapiens
ctattgaattaactattaaagt

SEQ ID NO: 9249920 - DNA, 22 bp, Homo sapiens
ctattgaatagcccaaatcatt

SEQ ID NO: 9249921 - DNA, 22 bp, Homo sapiens
ctattgaatagcccaaatcatt

SEQ ID NO: 9249922 - DNA, 22 bp, Homo sapiens
ctattgaaagtgtacaattcaa

SEQ ID NO: 9249923 - DNA, 22 bp, Homo sapiens
ctattgaaagtgtacaattcaa

SEQ ID NO: 9249924 - DNA, 22 bp, Homo sapiens
agtcctgggtccagcaggtcct

SEQ ID NO: 9249925 - DNA, 22 bp, Homo sapiens
ctattgtagtaagggaaagcca

SEQ ID NO: 9249926 - DNA, 22 bp, Homo sapiens
ctatgaccccagcatgaataag

SEQ ID NO: 9249927 - DNA, 22 bp, Homo sapiens
ctatgaccccagcatgaataag

SEQ ID NO: 9249928 - DNA, 22 bp, Homo sapiens
ctattctagattacagtataaa

SEQ ID NO: 9249929 - DNA, 22 bp, Homo sapiens
agtcagcagtgaaagcacagcc

SEQ ID NO: 9249930 - DNA, 22 bp, Homo sapiens
agtcagcagcctggccaggaga

SEQ ID NO: 9249931 - DNA, 22 bp, Homo sapiens
agtcagcagcctggccaggaga

SEQ ID NO: 9249932 - DNA, 22 bp, Homo sapiens
agtcaggaagctggagctgggg

SEQ ID NO: 9249933 - DNA, 22 bp, Homo sapiens
agtcaggagctgctgcattgta

SEQ ID NO: 9249934 - DNA, 22 bp, Homo sapiens
agtcaggagatattttgatatg

SEQ ID NO: 9249935 - DNA, 22 bp, Homo sapiens
agtcaggacacagcatgaacat

SEQ ID NO: 9249936 - DNA, 22 bp, Homo sapiens
agtcaggagctgctgcattgta

SEQ ID NO: 9249937 - DNA, 22 bp, Homo sapiens
agtcaggatatgccttgtgggc

SEQ ID NO: 9249938 - DNA, 22 bp, Homo sapiens
agtcaggagctgctgcattgta

SEQ ID NO: 9249939 - DNA, 22 bp, Homo sapiens
ctagtctctggaggtcagggct

SEQ ID NO: 9249940 - DNA, 22 bp, Homo sapiens
ctagtctgtgtgggaccagggc

SEQ ID NO: 9249941 - DNA, 22 bp, Homo sapiens
ctagtgaaatttgcaagtaatt

SEQ ID NO: 9249942 - DNA, 22 bp, Homo sapiens
ctatattctggaatgtccattt

SEQ ID NO: 9249943 - DNA, 22 bp, Homo sapiens
ctatatttcttggctttaaaca

SEQ ID NO: 9249944 - DNA, 22 bp, Homo sapiens
ctatcaaacagccattaatata

SEQ ID NO: 9249945 - DNA, 22 bp, Homo sapiens
agtaaatttctgcatgtgtact

SEQ ID NO: 9249946 - DNA, 18 bp, Homo sapiens
agtaaatgttaaatattg

SEQ ID NO: 9249947 - DNA, 18 bp, Homo sapiens
agtaaatgttaaatattg

SEQ ID NO: 9249948 - DNA, 22 bp, Homo sapiens
agtaaatggcccagggttatca

SEQ ID NO: 9249949 - DNA, 22 bp, Homo sapiens
agtaaatgaaagcaattttaga

SEQ ID NO: 9249950 - DNA, 22 bp, Homo sapiens
agtaaataacagagaaaatggg

SEQ ID NO: 9249951 - DNA, 22 bp, Homo sapiens
agtaaataacagagaaaatggg

SEQ ID NO: 9249952 - DNA, 22 bp, Homo sapiens
agtaaataacagagaaaatggg

SEQ ID NO: 9249953 - DNA, 22 bp, Homo sapiens
agtaaataacagagaaaatggg

SEQ ID NO: 9249954 - DNA, 22 bp, Homo sapiens
agtaaagtaccaaagtgtgagt

SEQ ID NO: 9249955 - DNA, 22 bp, Homo sapiens
agtaaagcggtgtcacagaatg

SEQ ID NO: 9249956 - DNA, 18 bp, Homo sapiens
agtaaagcttattacatg

SEQ ID NO: 9249957 - DNA, 22 bp, Homo sapiens
agtaaacatttcagatttattt

SEQ ID NO: 9249958 - DNA, 22 bp, Homo sapiens
agtaaacatagaatgttcttcc

SEQ ID NO: 9249959 - DNA, 22 bp, Homo sapiens
agtaaacataatttacctgtag

SEQ ID NO: 9249960 - DNA, 22 bp, Homo sapiens
agtaaacagtttcttagaagaa

SEQ ID NO: 9249961 - DNA, 22 bp, Homo sapiens
agtaaagcattgtcttcagagt

SEQ ID NO: 9249962 - DNA, 22 bp, Homo sapiens
agtaaagcagagttgcagtaca

SEQ ID NO: 9249963 - DNA, 22 bp, Homo sapiens
ccttccagtatgttaagatggt

SEQ ID NO: 9249964 - DNA, 22 bp, Homo sapiens
ccttccaggtgcaggcaagcct

SEQ ID NO: 9249965 - DNA, 22 bp, Homo sapiens
ccttctcccctctgcagggtgt

SEQ ID NO: 9249966 - DNA, 22 bp, Homo sapiens
ccttccagtgactaaggaggaa

SEQ ID NO: 9249967 - DNA, 22 bp, Homo sapiens
agtaaacagtatctttagtgtc

SEQ ID NO: 9249968 - DNA, 22 bp, Homo sapiens
agtaaaaatatgcttgtggcta

SEQ ID NO: 9249969 - DNA, 22 bp, Homo sapiens
ccttctctactcctgatgcatg

SEQ ID NO: 9249970 - DNA, 22 bp, Homo sapiens
ccttctcctgccttgggttcat

SEQ ID NO: 9249971 - DNA, 22 bp, Homo sapiens
agtaacagaaggcctgacttaa

SEQ ID NO: 9249972 - DNA, 22 bp, Homo sapiens
agtaacagagcatgggttcaga

SEQ ID NO: 9249973 - DNA, 22 bp, Homo sapiens
agtaacagaaggcctgacttaa

SEQ ID NO: 9249974 - DNA, 22 bp, Homo sapiens
agtacatacttcaaatgtactt

SEQ ID NO: 9249975 - DNA, 22 bp, Homo sapiens
agtaacaagtgccaacgttaga

SEQ ID NO: 9249976 - DNA, 22 bp, Homo sapiens
agtaacactattttcatatgta

SEQ ID NO: 9249977 - DNA, 22 bp, Homo sapiens
agtaacacttggaatgatagca

SEQ ID NO: 9249978 - DNA, 22 bp, Homo sapiens
agtagacagacagaacacagcc

SEQ ID NO: 9249979 - DNA, 22 bp, Homo sapiens
agtagaaatgtagtgtagagaa

SEQ ID NO: 9249980 - DNA, 19 bp, Homo sapiens
agtagcagaaagtgcagtg

SEQ ID NO: 9249981 - DNA, 22 bp, Homo sapiens
agtagggagaccggaggccgcc

SEQ ID NO: 9249982 - DNA, 20 bp, Homo sapiens
agtaggggaatgcaagagca

SEQ ID NO: 9249983 - DNA, 20 bp, Homo sapiens
agtagcagtgtgacattgac

SEQ ID NO: 9249984 - DNA, 22 bp, Homo sapiens
agtaggaggcgggagcatgaag

SEQ ID NO: 9249985 - DNA, 22 bp, Homo sapiens
agtaggatgctttatatgaaag

SEQ ID NO: 9249986 - DNA, 18 bp, Homo sapiens
agtaggcactgtggggtt

SEQ ID NO: 9249987 - DNA, 22 bp, Homo sapiens
agtaggataagagcctgtccaa

SEQ ID NO: 9249988 - DNA, 22 bp, Homo sapiens
agtaggaggcgggagcatgaag

SEQ ID NO: 9249989 - DNA, 23 bp, Homo sapiens
gccctccctcccaggtgggtgtt

SEQ ID NO: 9249990 - DNA, 22 bp, Homo sapiens
gccctcctggcaggcagtgatg

SEQ ID NO: 9249991 - DNA, 22 bp, Homo sapiens
gccctgagttgagccttccaaa

SEQ ID NO: 9249992 - DNA, 22 bp, Homo sapiens
gccctcccctctgggtggtgag

SEQ ID NO: 9249993 - DNA, 22 bp, Homo sapiens
gccctcccctctgggtggtgag

SEQ ID NO: 9249994 - DNA, 22 bp, Homo sapiens
gccctccatggtgatccaggcc

SEQ ID NO: 9249995 - DNA, 23 bp, Homo sapiens
gccctccctcccaggtgggtgtt

SEQ ID NO: 9249996 - DNA, 22 bp, Homo sapiens
gccctccctacagcctatttct

SEQ ID NO: 9249997 - DNA, 22 bp, Homo sapiens
gccctccctacagcctatttct

SEQ ID NO: 9249998 - DNA, 22 bp, Homo sapiens
gccctgcctgccggtgtgggtc

SEQ ID NO: 9249999 - DNA, 23 bp, Homo sapiens
gccctgcccttagcacactcaca

SEQ ID NO: 9250000 - DNA, 22 bp, Homo sapiens
gccctgccctgttgaaactaga

SEQ ID NO: 9250001 - DNA, 19 bp, Homo sapiens
gccctgcaggaggtggggc

SEQ ID NO: 9250002 - DNA, 22 bp, Homo sapiens
gccctgccctgagccgtagacc

SEQ ID NO: 9250003 - DNA, 22 bp, Homo sapiens
gccctgccctctcggcactcgc

SEQ ID NO: 9250004 - DNA, 22 bp, Homo sapiens
gcccaggagttcaaggctgcag

SEQ ID NO: 9250005 - DNA, 22 bp, Homo sapiens
gcccaggagttcaaggctgcag

SEQ ID NO: 9250006 - DNA, 22 bp, Homo sapiens
gcccaggaggttgggctgtgca

SEQ ID NO: 9250007 - DNA, 22 bp, Homo sapiens
gcccaggagttcaaggctgcag

SEQ ID NO: 9250008 - DNA, 22 bp, Homo sapiens
gcccaggaggttgggctgtgca

SEQ ID NO: 9250009 - DNA, 22 bp, Homo sapiens
gcccaggaggtggaggtgcagt

SEQ ID NO: 9250010 - DNA, 22 bp, Homo sapiens
gcccaggaggtggaggtgcagt

SEQ ID NO: 9250011 - DNA, 22 bp, Homo sapiens
gcccagcccctgggtggacgtg

SEQ ID NO: 9250012 - DNA, 22 bp, Homo sapiens
gcccaggaggtcaagtagctat

SEQ ID NO: 9250013 - DNA, 22 bp, Homo sapiens
gcccaggaggtcaagtagctat

SEQ ID NO: 9250014 - DNA, 22 bp, Homo sapiens
gccccctctttggagccagcca

SEQ ID NO: 9250015 - DNA, 22 bp, Homo sapiens
gcccaggagttgaagggctgac

SEQ ID NO: 9250016 - DNA, 22 bp, Homo sapiens
gcccaggagttgaagggctgac

SEQ ID NO: 9250017 - DNA, 21 bp, Homo sapiens
gccccctggactcctcatcca

SEQ ID NO: 9250018 - DNA, 22 bp, Homo sapiens
gcccccttgacctaatcacctt

SEQ ID NO: 9250019 - DNA, 22 bp, Homo sapiens
gcccaggagttcaagtctagtg

SEQ ID NO: 9250020 - DNA, 22 bp, Homo sapiens
gcccaggagttcaagtctagtg

SEQ ID NO: 9250021 - DNA, 22 bp, Homo sapiens
gccctccaccagagcccttctc

SEQ ID NO: 9250022 - DNA, 22 bp, Homo sapiens
gccctccaccagagcccttctc

SEQ ID NO: 9250023 - DNA, 22 bp, Homo sapiens
gccctccaccagagcccttctc

SEQ ID NO: 9250024 - DNA, 22 bp, Homo sapiens
gccctccatgagacacagtgta

SEQ ID NO: 9250025 - DNA, 22 bp, Homo sapiens
gccctccatgagacacagtgta

SEQ ID NO: 9250026 - DNA, 22 bp, Homo sapiens
gccctccacctggtctctctgg

SEQ ID NO: 9250027 - DNA, 22 bp, Homo sapiens
gcccagcaggggatggcagctc

SEQ ID NO: 9250028 - DNA, 22 bp, Homo sapiens
gcccagcaggacagagtggttt

SEQ ID NO: 9250029 - DNA, 22 bp, Homo sapiens
gcccagcaggacagagtggttt

SEQ ID NO: 9250030 - DNA, 22 bp, Homo sapiens
gcccagccagagctgtgtgatg

SEQ ID NO: 9250031 - DNA, 18 bp, Homo sapiens
gccagaggtactactgat

SEQ ID NO: 9250032 - DNA, 18 bp, Homo sapiens
gccagaggtactactgat

SEQ ID NO: 9250033 - DNA, 22 bp, Homo sapiens
gccagaggtatcaaagatagta

SEQ ID NO: 9250034 - DNA, 22 bp, Homo sapiens
gccagaggttcaacaactgtct

SEQ ID NO: 9250035 - DNA, 22 bp, Homo sapiens
gcccactccagcttctcccaca

SEQ ID NO: 9250036 - DNA, 20 bp, Homo sapiens
gcccactctaatccactgtc

SEQ ID NO: 9250037 - DNA, 22 bp, Homo sapiens
gccagaggggctcgaaggcgcg

SEQ ID NO: 9250038 - DNA, 22 bp, Homo sapiens
gccagaggggctcgaaggcgcg

SEQ ID NO: 9250039 - DNA, 18 bp, Homo sapiens
gccagagggcccaaggtc

SEQ ID NO: 9250040 - DNA, 18 bp, Homo sapiens
gccagagggcccaaggtc

SEQ ID NO: 9250041 - DNA, 22 bp, Homo sapiens
atttacagtgtgcctactatat

SEQ ID NO: 9250042 - DNA, 22 bp, Homo sapiens
atttacagtgtgcctactatat

SEQ ID NO: 9250043 - DNA, 22 bp, Homo sapiens
atttacagaccctcccactaag

SEQ ID NO: 9250044 - DNA, 22 bp, Homo sapiens
atttacagtttagcatttcaag

SEQ ID NO: 9250045 - DNA, 22 bp, Homo sapiens
atttacagtttagcatttcaag

SEQ ID NO: 9250046 - DNA, 22 bp, Homo sapiens
atttacattccatggtggttac

SEQ ID NO: 9250047 - DNA, 22 bp, Homo sapiens
atttacataatagactttaggt

SEQ ID NO: 9250048 - DNA, 18 bp, Homo sapiens
gccagagggaagcaggtg

SEQ ID NO: 9250049 - DNA, 18 bp, Homo sapiens
gccagagggaagcaggtg

SEQ ID NO: 9250050 - DNA, 18 bp, Homo sapiens
gccagagggaagcaggtg

SEQ ID NO: 9250051 - DNA, 18 bp, Homo sapiens
atttacccagcaacgtgg

SEQ ID NO: 9250052 - DNA, 18 bp, Homo sapiens
gccagagggaagcaggtg

SEQ ID NO: 9250053 - DNA, 22 bp, Homo sapiens
atttacatttatttgagaaggt

SEQ ID NO: 9250054 - DNA, 22 bp, Homo sapiens
attttaaggcttatttaaaggc

SEQ ID NO: 9250055 - DNA, 22 bp, Homo sapiens
attttaataagatccatttggt

SEQ ID NO: 9250056 - DNA, 22 bp, Homo sapiens
attttaataagattcccaagta

SEQ ID NO: 9250057 - DNA, 23 bp, Homo sapiens
attttaaccttgactaacatgca

SEQ ID NO: 9250058 - DNA, 22 bp, Homo sapiens
attttaaggcttatttaaaggc

SEQ ID NO: 9250059 - DNA, 22 bp, Homo sapiens
atttgcctgtaagacaaggcct

SEQ ID NO: 9250060 - DNA, 22 bp, Homo sapiens
atttgcatttagaaagatcact

SEQ ID NO: 9250061 - DNA, 22 bp, Homo sapiens
atttgcctttcgaatcaacagg

SEQ ID NO: 9250062 - DNA, 23 bp, Homo sapiens
atttgcatggccggattatggat

SEQ ID NO: 9250063 - DNA, 22 bp, Homo sapiens
atttgcatgcttctattgtgaa

SEQ ID NO: 9250064 - DNA, 22 bp, Homo sapiens
atttgcatgacctttgcaagtg

SEQ ID NO: 9250065 - DNA, 21 bp, Homo sapiens
atttgcattaaaatattacgc

SEQ ID NO: 9250066 - DNA, 21 bp, Homo sapiens
atttgcattaaaatattacgc

SEQ ID NO: 9250067 - DNA, 22 bp, Homo sapiens
atttgcacacagtctcctgtgg

SEQ ID NO: 9250068 - DNA, 22 bp, Homo sapiens
atttgcagagctctgaattttg

SEQ ID NO: 9250069 - DNA, 22 bp, Homo sapiens
atttgcataaggatgctactgt

SEQ ID NO: 9250070 - DNA, 22 bp, Homo sapiens
atttgcataatagtgatttgta

SEQ ID NO: 9250071 - DNA, 22 bp, Homo sapiens
atttgcataatagtgatttgta

SEQ ID NO: 9250072 - DNA, 22 bp, Homo sapiens
atttgcataatagtgatttgta

SEQ ID NO: 9250073 - DNA, 22 bp, Homo sapiens
atttgacattgacacacctatg

SEQ ID NO: 9250074 - DNA, 23 bp, Homo sapiens
atttgacagagcatagcatttct

SEQ ID NO: 9250075 - DNA, 22 bp, Homo sapiens
atttcttgattccaccagtgaa

SEQ ID NO: 9250076 - DNA, 22 bp, Homo sapiens
atttgattagctgtgtaatttt

SEQ ID NO: 9250077 - DNA, 22 bp, Homo sapiens
atttgattagctgtgtaatttt

SEQ ID NO: 9250078 - DNA, 22 bp, Homo sapiens
gcctgccccttcctgggcaggg

SEQ ID NO: 9250079 - DNA, 22 bp, Homo sapiens
gcctgccccttcctgggcaggg

SEQ ID NO: 9250080 - DNA, 21 bp, Homo sapiens
gcctgccccatgtttctgttg

SEQ ID NO: 9250081 - DNA, 22 bp, Homo sapiens
gcctgccctgaaagaggtgaag

SEQ ID NO: 9250082 - DNA, 21 bp, Homo sapiens
gcctgccctctgtgatggcca

SEQ ID NO: 9250083 - DNA, 22 bp, Homo sapiens
gcctgcctagaattgcagcttt

SEQ ID NO: 9250084 - DNA, 22 bp, Homo sapiens
gcctgcctagaattgcagcttt

SEQ ID NO: 9250085 - DNA, 22 bp, Homo sapiens
gcctgcctagaattgcagcttt

SEQ ID NO: 9250086 - DNA, 18 bp, Homo sapiens
gcctgcctagagcttgcc

SEQ ID NO: 9250087 - DNA, 22 bp, Homo sapiens
gcctgcctagaattgcagcttt

SEQ ID NO: 9250088 - DNA, 22 bp, Homo sapiens
attttacataaggaaggtttaa

SEQ ID NO: 9250089 - DNA, 22 bp, Homo sapiens
attttacataaggaaggtttaa

SEQ ID NO: 9250090 - DNA, 22 bp, Homo sapiens
attttacataaggaaggtttaa

SEQ ID NO: 9250091 - DNA, 23 bp, Homo sapiens
attttacaggtcagttccttgaa

SEQ ID NO: 9250092 - DNA, 23 bp, Homo sapiens
attttacaggtcagttccttgaa

SEQ ID NO: 9250093 - DNA, 22 bp, Homo sapiens
attttactaagtggatatctgt

SEQ ID NO: 9250094 - DNA, 22 bp, Homo sapiens
attttactaagtggatatctgt

SEQ ID NO: 9250095 - DNA, 22 bp, Homo sapiens
gcctgcccacggggctggcata

SEQ ID NO: 9250096 - DNA, 22 bp, Homo sapiens
attttctgtgtgcagataaata

SEQ ID NO: 9250097 - DNA, 22 bp, Homo sapiens
attttctgtgtgcagataaata

SEQ ID NO: 9250098 - DNA, 22 bp, Homo sapiens
attttctgtgtgcagataaata

SEQ ID NO: 9250099 - DNA, 22 bp, Homo sapiens
attttgaaaagcatttgagtaa

SEQ ID NO: 9250100 - DNA, 22 bp, Homo sapiens
attttcttctctccctggctgc

SEQ ID NO: 9250101 - DNA, 22 bp, Homo sapiens
attttcttctctccctggctgc

SEQ ID NO: 9250102 - DNA, 22 bp, Homo sapiens
attttgaaatacttgaaggaaa

SEQ ID NO: 9250103 - DNA, 22 bp, Homo sapiens
attttgaaaagcatttgagtaa

SEQ ID NO: 9250104 - DNA, 18 bp, Homo sapiens
attttgaactgggaatat

SEQ ID NO: 9250105 - DNA, 22 bp, Homo sapiens
gcctggctccctctgcagctcc

SEQ ID NO: 9250106 - DNA, 22 bp, Homo sapiens
gcctggctcctaagagcacaac

SEQ ID NO: 9250107 - DNA, 22 bp, Homo sapiens
gctgagctgctgttcatcctgc

SEQ ID NO: 9250108 - DNA, 22 bp, Homo sapiens
gctgagctgggacagtcctggg

SEQ ID NO: 9250109 - DNA, 22 bp, Homo sapiens
gctgagctgggacagtcctggg

SEQ ID NO: 9250110 - DNA, 22 bp, Homo sapiens
gctgagctgggacagtcctggg

SEQ ID NO: 9250111 - DNA, 22 bp, Homo sapiens
gctgagctgaggcagggctggg

SEQ ID NO: 9250112 - DNA, 22 bp, Homo sapiens
gctgagctgaggcagggctggg

SEQ ID NO: 9250113 - DNA, 22 bp, Homo sapiens
gctgagctgctgttcatcctgc

SEQ ID NO: 9250114 - DNA, 22 bp, Homo sapiens
gctgagctgaggcagggctggg

SEQ ID NO: 9250115 - DNA, 22 bp, Homo sapiens
gctctggttaaaaagaattaaa

SEQ ID NO: 9250116 - DNA, 22 bp, Homo sapiens
gctgaggaaaccaatgctcaga

SEQ ID NO: 9250117 - DNA, 22 bp, Homo sapiens
gctgaggaaaccaatgctcaga

SEQ ID NO: 9250118 - DNA, 22 bp, Homo sapiens
gctgaggaaaccaatgctcaga

SEQ ID NO: 9250119 - DNA, 22 bp, Homo sapiens
gctgagctgggacagtcctggg

SEQ ID NO: 9250120 - DNA, 22 bp, Homo sapiens
gctgaggaagtcaggtggccca

SEQ ID NO: 9250121 - DNA, 22 bp, Homo sapiens
gctgaggaaaggctggaaggga

SEQ ID NO: 9250122 - DNA, 22 bp, Homo sapiens
gctgaggaagtcaggtggccca

SEQ ID NO: 9250123 - DNA, 22 bp, Homo sapiens
gctgaggacatacacattgtgc

SEQ ID NO: 9250124 - DNA, 22 bp, Homo sapiens
gctgaggacatacacattgtgc

SEQ ID NO: 9250125 - DNA, 20 bp, Homo sapiens
gctgaggagcagtgtggttg

SEQ ID NO: 9250126 - DNA, 22 bp, Homo sapiens
gctgaggacatcatggaaggaa

SEQ ID NO: 9250127 - DNA, 22 bp, Homo sapiens
caaattaccctcaacatctaga

SEQ ID NO: 9250128 - DNA, 22 bp, Homo sapiens
caaattcaatgaacatgtttaa

SEQ ID NO: 9250129 - DNA, 22 bp, Homo sapiens
caaatgaatttccctgcaaatg

SEQ ID NO: 9250130 - DNA, 22 bp, Homo sapiens
caaatgaatatttccatgggtt

SEQ ID NO: 9250131 - DNA, 22 bp, Homo sapiens
caaatgaagtccaaagggctta

SEQ ID NO: 9250132 - DNA, 22 bp, Homo sapiens
caaatgaagggagctgaagtct

SEQ ID NO: 9250133 - DNA, 22 bp, Homo sapiens
caaatgaaggtggtgggtcatt

SEQ ID NO: 9250134 - DNA, 22 bp, Homo sapiens
gctgaggagcgagaactctgct

SEQ ID NO: 9250135 - DNA, 22 bp, Homo sapiens
caaatgaagagggcaacttctg

SEQ ID NO: 9250136 - DNA, 20 bp, Homo sapiens
caaatgaagctgttggcctc

SEQ ID NO: 9250137 - DNA, 20 bp, Homo sapiens
caaatccctgctctgtgctg

SEQ ID NO: 9250138 - DNA, 22 bp, Homo sapiens
caaatctaggatgcatgtagtg

SEQ ID NO: 9250139 - DNA, 22 bp, Homo sapiens
caaatctgagtctacaatttta

SEQ ID NO: 9250140 - DNA, 22 bp, Homo sapiens
caaatctatatgttgatattct

SEQ ID NO: 9250141 - DNA, 22 bp, Homo sapiens
caaatcatggctctagcttaca

SEQ ID NO: 9250142 - DNA, 22 bp, Homo sapiens
caaatcatggaataactagaga

SEQ ID NO: 9250143 - DNA, 20 bp, Homo sapiens
caaatccctgctctgtgctg

SEQ ID NO: 9250144 - DNA, 22 bp, Homo sapiens
caaatgaaaatggcgtcttgga

SEQ ID NO: 9250145 - DNA, 22 bp, Homo sapiens
caaatctttaattgaggaatca

SEQ ID NO: 9250146 - DNA, 22 bp, Homo sapiens
gctctgggtgaacttggagcaa

SEQ ID NO: 9250147 - DNA, 22 bp, Homo sapiens
gctctgagacagtagagatggc

SEQ ID NO: 9250148 - DNA, 22 bp, Homo sapiens
caaatcacaatgtgagactgag

SEQ ID NO: 9250149 - DNA, 22 bp, Homo sapiens
caaatattccaggtacatccct

SEQ ID NO: 9250150 - DNA, 22 bp, Homo sapiens
caaatagacttaagcatctgta

SEQ ID NO: 9250151 - DNA, 22 bp, Homo sapiens
caaatattccaggtacatccct

SEQ ID NO: 9250152 - DNA, 22 bp, Homo sapiens
gctctgagaggatgctgagcag

SEQ ID NO: 9250153 - DNA, 22 bp, Homo sapiens
gctctgagaggatgctgagcag

SEQ ID NO: 9250154 - DNA, 22 bp, Homo sapiens
gctcaaagaatattcagaatga

SEQ ID NO: 9250155 - DNA, 22 bp, Homo sapiens
gctacacaatagcgttcactta

SEQ ID NO: 9250156 - DNA, 22 bp, Homo sapiens
gctaattcacagtaggaaattt

SEQ ID NO: 9250157 - DNA, 22 bp, Homo sapiens
gctaatgactgagtttttagca

SEQ ID NO: 9250158 - DNA, 22 bp, Homo sapiens
gctaatcaatgttaaggctgtg

SEQ ID NO: 9250159 - DNA, 22 bp, Homo sapiens
gctaatcaatgttaaggctgtg

SEQ ID NO: 9250160 - DNA, 22 bp, Homo sapiens
gctattgtttattttgaatcta

SEQ ID NO: 9250161 - DNA, 22 bp, Homo sapiens
gctattgtgacagcttttcgcc

SEQ ID NO: 9250162 - DNA, 22 bp, Homo sapiens
gctatgttagacattctcattt

SEQ ID NO: 9250163 - DNA, 22 bp, Homo sapiens
gctatgtgtatctgttagagag

SEQ ID NO: 9250164 - DNA, 22 bp, Homo sapiens
gctatgtgtgttttgctgcagc

SEQ ID NO: 9250165 - DNA, 21 bp, Homo sapiens
gctatgaatgtagaaaattat

SEQ ID NO: 9250166 - DNA, 22 bp, Homo sapiens
gctaaatgatgggaaatctggg

SEQ ID NO: 9250167 - DNA, 22 bp, Homo sapiens
gctaaataatcttcttctgaca

SEQ ID NO: 9250168 - DNA, 22 bp, Homo sapiens
gctaaggccttaactcatggag

SEQ ID NO: 9250169 - DNA, 22 bp, Homo sapiens
gcgtggtgctgccctgcacaca

SEQ ID NO: 9250170 - DNA, 21 bp, Homo sapiens
gcctggctctcactggcctgg

SEQ ID NO: 9250171 - DNA, 22 bp, Homo sapiens
gcgcaggagccgcggagggccg

SEQ ID NO: 9250172 - DNA, 22 bp, Homo sapiens
gcctggctctgagtttctctcc

SEQ ID NO: 9250173 - DNA, 18 bp, Homo sapiens
gctctaattttagaaagg

SEQ ID NO: 9250174 - DNA, 22 bp, Homo sapiens
gctctaactattaagaggtcat

SEQ ID NO: 9250175 - DNA, 22 bp, Homo sapiens
gctctagtaggaatgtccctct

SEQ ID NO: 9250176 - DNA, 22 bp, Homo sapiens
gctcctggatgttcaagtcggc

SEQ ID NO: 9250177 - DNA, 22 bp, Homo sapiens
gctcggtggccagcctgaggcc

SEQ ID NO: 9250178 - DNA, 22 bp, Homo sapiens
gctcaggtcttacccatgcctg

SEQ ID NO: 9250179 - DNA, 22 bp, Homo sapiens
gctcagggtcccttggtgctgg

SEQ ID NO: 9250180 - DNA, 17 bp, Homo sapiens
gctccaggcgtgagtga

SEQ ID NO: 9250181 - DNA, 22 bp, Homo sapiens
gctccaggcgagctggaccaga

SEQ ID NO: 9250182 - DNA, 22 bp, Homo sapiens
gctccaggcgagctggaccaga

SEQ ID NO: 9250183 - DNA, 22 bp, Homo sapiens
gctccaggcagcatagtggatg

SEQ ID NO: 9250184 - DNA, 18 bp, Homo sapiens
gcacagagcccaggctct

SEQ ID NO: 9250185 - DNA, 23 bp, Homo sapiens
gcacagagcagttaggggaagat

SEQ ID NO: 9250186 - DNA, 22 bp, Homo sapiens
gcacagaggaagcacagactct

SEQ ID NO: 9250187 - DNA, 22 bp, Homo sapiens
gcacagaggaagcacagactct

SEQ ID NO: 9250188 - DNA, 22 bp, Homo sapiens
gcacagagcctggtaccgagaa

SEQ ID NO: 9250189 - DNA, 22 bp, Homo sapiens
gcacagggagcaggtctctggt

SEQ ID NO: 9250190 - DNA, 22 bp, Homo sapiens
gcacagaggatgaggcagctct

SEQ ID NO: 9250191 - DNA, 22 bp, Homo sapiens
gcacaggctctcttggggacac

SEQ ID NO: 9250192 - DNA, 22 bp, Homo sapiens
gcacaggctgttggccttcaga

SEQ ID NO: 9250193 - DNA, 22 bp, Homo sapiens
gcactggggtcatagcctccag

SEQ ID NO: 9250194 - DNA, 22 bp, Homo sapiens
gcactgggggcagcagtgaggg

SEQ ID NO: 9250195 - DNA, 22 bp, Homo sapiens
gcactgggtgggagatctgaat

SEQ ID NO: 9250196 - DNA, 22 bp, Homo sapiens
gcactgggtgggagatctgaat

SEQ ID NO: 9250197 - DNA, 22 bp, Homo sapiens
gcactgggtgtgaggcagcgtc

SEQ ID NO: 9250198 - DNA, 22 bp, Homo sapiens
gcactgtgacccagagcaggtg

SEQ ID NO: 9250199 - DNA, 22 bp, Homo sapiens
gcacagggcaacaggtctgtta

SEQ ID NO: 9250200 - DNA, 22 bp, Homo sapiens
gcacagggcaacaggtctgtta

SEQ ID NO: 9250201 - DNA, 22 bp, Homo sapiens
gcacagggagcaggtctctggt

SEQ ID NO: 9250202 - DNA, 22 bp, Homo sapiens
gcactcaggactctcatcagta

SEQ ID NO: 9250203 - DNA, 22 bp, Homo sapiens
gcactcaggactctcatcagta

SEQ ID NO: 9250204 - DNA, 22 bp, Homo sapiens
gcaactgaacatgtgtgtggcc

SEQ ID NO: 9250205 - DNA, 22 bp, Homo sapiens
gcacacaggggagttctcagaa

SEQ ID NO: 9250206 - DNA, 22 bp, Homo sapiens
gcacacaggggagttctcagaa

SEQ ID NO: 9250207 - DNA, 22 bp, Homo sapiens
gcaacaggcagtttgctcatgt

SEQ ID NO: 9250208 - DNA, 22 bp, Homo sapiens
gcaacacagatcttctttgttg

SEQ ID NO: 9250209 - DNA, 22 bp, Homo sapiens
gcaacaagtgtaaacatgcatt

SEQ ID NO: 9250210 - DNA, 22 bp, Homo sapiens
gcaaatgtggcttcctttctag

SEQ ID NO: 9250211 - DNA, 22 bp, Homo sapiens
gcaaaattaaacttagcatcat

SEQ ID NO: 9250212 - DNA, 22 bp, Homo sapiens
gcaaaacagtcgatgcctccca

SEQ ID NO: 9250213 - DNA, 22 bp, Homo sapiens
gatttctgggctttatttcaga

SEQ ID NO: 9250214 - DNA, 22 bp, Homo sapiens
atgtttctcactgtttctctat

SEQ ID NO: 9250215 - DNA, 22 bp, Homo sapiens
atgtttctcactgtttctctat

SEQ ID NO: 9250216 - DNA, 22 bp, Homo sapiens
atgtttctataaagaagtttgg

SEQ ID NO: 9250217 - DNA, 22 bp, Homo sapiens
atgtttctacagcgtccactga

SEQ ID NO: 9250218 - DNA, 22 bp, Homo sapiens
atgtttctagttgtatgtcact

SEQ ID NO: 9250219 - DNA, 22 bp, Homo sapiens
atgtttctagagctttgtccca

SEQ ID NO: 9250220 - DNA, 22 bp, Homo sapiens
gcagccagggagagaaccaggg

SEQ ID NO: 9250221 - DNA, 19 bp, Homo sapiens
gcagccaggtgctctacct

SEQ ID NO: 9250222 - DNA, 22 bp, Homo sapiens
gcagccaggtttgaggaccact

SEQ ID NO: 9250223 - DNA, 19 bp, Homo sapiens
gcagccaggtgctctacct

SEQ ID NO: 9250224 - DNA, 19 bp, Homo sapiens
gcagccaggtgctctacct

SEQ ID NO: 9250225 - DNA, 19 bp, Homo sapiens
gcagccaggtgctctacct

SEQ ID NO: 9250226 - DNA, 22 bp, Homo sapiens
gcagccaggggctgtgacctgt

SEQ ID NO: 9250227 - DNA, 22 bp, Homo sapiens
gcagccaggaagcctttccctc

SEQ ID NO: 9250228 - DNA, 22 bp, Homo sapiens
gcagcaggtctgtcaatgtcat

SEQ ID NO: 9250229 - DNA, 22 bp, Homo sapiens
gcagatgctgctcctctctaga

SEQ ID NO: 9250230 - DNA, 22 bp, Homo sapiens
gcagatgctgagatttatttct

SEQ ID NO: 9250231 - DNA, 22 bp, Homo sapiens
gcaggagagtctgtgccaggtt

SEQ ID NO: 9250232 - DNA, 22 bp, Homo sapiens
gcaggagagtctgtgccaggtt

SEQ ID NO: 9250233 - DNA, 22 bp, Homo sapiens
gcaggagagtctgtgccaggtt

SEQ ID NO: 9250234 - DNA, 18 bp, Homo sapiens
gcaggagatgggtggggt

SEQ ID NO: 9250235 - DNA, 22 bp, Homo sapiens
gcagctttaaaggaggctctga

SEQ ID NO: 9250236 - DNA, 22 bp, Homo sapiens
gcagcctgggcaacagagtgag

SEQ ID NO: 9250237 - DNA, 22 bp, Homo sapiens
gcagcctgggcaacagagtgag

SEQ ID NO: 9250238 - DNA, 22 bp, Homo sapiens
gcagcctgttgtaccagcctgt

SEQ ID NO: 9250239 - DNA, 22 bp, Homo sapiens
gcagcctgttgtaccagcctgt

SEQ ID NO: 9250240 - DNA, 22 bp, Homo sapiens
gcagcctgatgatctgggttgt

SEQ ID NO: 9250241 - DNA, 22 bp, Homo sapiens
gcagcctgatgatctgggttgt

SEQ ID NO: 9250242 - DNA, 22 bp, Homo sapiens
gcagcctgaggccctttctggc

SEQ ID NO: 9250243 - DNA, 17 bp, Homo sapiens
gcagcctcttggtagtg

SEQ ID NO: 9250244 - DNA, 17 bp, Homo sapiens
gcagcctcttggtagtg

SEQ ID NO: 9250245 - DNA, 22 bp, Homo sapiens
gcagaggctccattttacagat

SEQ ID NO: 9250246 - DNA, 22 bp, Homo sapiens
gcagatctttaacagggtcact

SEQ ID NO: 9250247 - DNA, 19 bp, Homo sapiens
gcagatgatgaggctggtc

SEQ ID NO: 9250248 - DNA, 22 bp, Homo sapiens
gcagaggggaagctgaggaatt

SEQ ID NO: 9250249 - DNA, 22 bp, Homo sapiens
gcagaggggaagctgaggaatt

SEQ ID NO: 9250250 - DNA, 22 bp, Homo sapiens
gcagaatagtgactttccttaa

SEQ ID NO: 9250251 - DNA, 16 bp, Homo sapiens
gcagaggaaaggggag

SEQ ID NO: 9250252 - DNA, 22 bp, Homo sapiens
gcagaaggtctggcacttcagg

SEQ ID NO: 9250253 - DNA, 22 bp, Homo sapiens
gcactgtgacccagagcaggtg

SEQ ID NO: 9250254 - DNA, 22 bp, Homo sapiens
gcagaagggaataaggagcttt

SEQ ID NO: 9250255 - DNA, 22 bp, Homo sapiens
attgttttaattccattgtgaa

SEQ ID NO: 9250256 - DNA, 22 bp, Homo sapiens
attgttttattaaatgagccct

SEQ ID NO: 9250257 - DNA, 22 bp, Homo sapiens
attgttttaattccattgtgaa

SEQ ID NO: 9250258 - DNA, 22 bp, Homo sapiens
attgttttaattccattgtgaa

SEQ ID NO: 9250259 - DNA, 22 bp, Homo sapiens
attgtttccccggaattattca

SEQ ID NO: 9250260 - DNA, 22 bp, Homo sapiens
attgtttccccggaattattca

SEQ ID NO: 9250261 - DNA, 22 bp, Homo sapiens
gccactggcgctgtgcagagtg

SEQ ID NO: 9250262 - DNA, 20 bp, Homo sapiens
gccactgggcaccagcaggg

SEQ ID NO: 9250263 - DNA, 20 bp, Homo sapiens
gccactgggcaccagcaggg

SEQ ID NO: 9250264 - DNA, 22 bp, Homo sapiens
atttaaatgcttaagagggttt

SEQ ID NO: 9250265 - DNA, 22 bp, Homo sapiens
atttaaatgcttaagagggttt

SEQ ID NO: 9250266 - DNA, 22 bp, Homo sapiens
atttaaatgcttaagagggttt

SEQ ID NO: 9250267 - DNA, 23 bp, Homo sapiens
attgtttttggctctcagggaat

SEQ ID NO: 9250268 - DNA, 22 bp, Homo sapiens
attgttttgtttcccagtgact

SEQ ID NO: 9250269 - DNA, 22 bp, Homo sapiens
attgttttccaaagatgctgct

SEQ ID NO: 9250270 - DNA, 22 bp, Homo sapiens
attgttttgtagaatgaccctt

SEQ ID NO: 9250271 - DNA, 16 bp, Homo sapiens
attgttttcaattaga

SEQ ID NO: 9250272 - DNA, 16 bp, Homo sapiens
attgttttcaattaga

SEQ ID NO: 9250273 - DNA, 22 bp, Homo sapiens
gcattcctgagaatgcagagtg

SEQ ID NO: 9250274 - DNA, 22 bp, Homo sapiens
gcattcctgagaatgcagagtg

SEQ ID NO: 9250275 - DNA, 22 bp, Homo sapiens
gcattcctgtacctctctgcta

SEQ ID NO: 9250276 - DNA, 22 bp, Homo sapiens
gcattccttggtttaaaacaag

SEQ ID NO: 9250277 - DNA, 22 bp, Homo sapiens
gcattccttggtttaaaacaag

SEQ ID NO: 9250278 - DNA, 22 bp, Homo sapiens
gcattccttggtttaaaacaag

SEQ ID NO: 9250279 - DNA, 22 bp, Homo sapiens
gcattccttgagttccctgtgc

SEQ ID NO: 9250280 - DNA, 15 bp, Homo sapiens
gcattcctcatttcc

SEQ ID NO: 9250281 - DNA, 21 bp, Homo sapiens
gcattcctaggaggtaagcat

SEQ ID NO: 9250282 - DNA, 22 bp, Homo sapiens
gcattcctacaggctgctatga

SEQ ID NO: 9250283 - DNA, 22 bp, Homo sapiens
gcattcatcaaaaatgttcctc

SEQ ID NO: 9250284 - DNA, 22 bp, Homo sapiens
gccacagtgggctggggccaga

SEQ ID NO: 9250285 - DNA, 21 bp, Homo sapiens
gccacgtttcagtcttctcag

SEQ ID NO: 9250286 - DNA, 22 bp, Homo sapiens
gccactgagcccggccattgtt

SEQ ID NO: 9250287 - DNA, 19 bp, Homo sapiens
gccactcctgatgctgccc

SEQ ID NO: 9250288 - DNA, 22 bp, Homo sapiens
gccactgaacattagagctagt

SEQ ID NO: 9250289 - DNA, 22 bp, Homo sapiens
gccactcatgggaggtgtgcaa

SEQ ID NO: 9250290 - DNA, 22 bp, Homo sapiens
gccactgcactccagcccaggc

SEQ ID NO: 9250291 - DNA, 21 bp, Homo sapiens
gccactgcactccagcctggg

SEQ ID NO: 9250292 - DNA, 21 bp, Homo sapiens
gccactgcactccagcctggg

SEQ ID NO: 9250293 - DNA, 22 bp, Homo sapiens
attgtacaatgcctggaacatt

SEQ ID NO: 9250294 - DNA, 22 bp, Homo sapiens
attgtacaatgcctggaacatt

SEQ ID NO: 9250295 - DNA, 22 bp, Homo sapiens
attgtaagaggtttggctgtgt

SEQ ID NO: 9250296 - DNA, 22 bp, Homo sapiens
attgtaagtagaaatgttatgg

SEQ ID NO: 9250297 - DNA, 22 bp, Homo sapiens
gcagtgattggatcagagatgg

SEQ ID NO: 9250298 - DNA, 22 bp, Homo sapiens
attgtacaatgctgaggtttgg

SEQ ID NO: 9250299 - DNA, 22 bp, Homo sapiens
attgtacaatgcctggaacatt

SEQ ID NO: 9250300 - DNA, 22 bp, Homo sapiens
gcagtgctctgcctataatgga

SEQ ID NO: 9250301 - DNA, 22 bp, Homo sapiens
gcagtgctgatcccatggcaga

SEQ ID NO: 9250302 - DNA, 22 bp, Homo sapiens
gcagtgccttgcttctctgtct

SEQ ID NO: 9250303 - DNA, 22 bp, Homo sapiens
gcagtgctaaggattctgcctt

SEQ ID NO: 9250304 - DNA, 22 bp, Homo sapiens
gcagtgctaagtagctggccca

SEQ ID NO: 9250305 - DNA, 22 bp, Homo sapiens
attgttcaaagtgctttgcatg

SEQ ID NO: 9250306 - DNA, 22 bp, Homo sapiens
attgttatgaaaataagatgtt

SEQ ID NO: 9250307 - DNA, 22 bp, Homo sapiens
attgttcaatgtaataattttg

SEQ ID NO: 9250308 - DNA, 22 bp, Homo sapiens
attgttcatgtatgaataaata

SEQ ID NO: 9250309 - DNA, 22 bp, Homo sapiens
attgtgcagcagtggtacctgg

SEQ ID NO: 9250310 - DNA, 20 bp, Homo sapiens
attgtgcagcccttggcaga

SEQ ID NO: 9250311 - DNA, 22 bp, Homo sapiens
attgtgcatctactgtgtgcag

SEQ ID NO: 9250312 - DNA, 22 bp, Homo sapiens
attgtgcagtaaagtccttttc

SEQ ID NO: 9250313 - DNA, 22 bp, Homo sapiens
attgtgcaggtcagttattgca

SEQ ID NO: 9250314 - DNA, 22 bp, Homo sapiens
attgtgcagctctgctcttatt

SEQ ID NO: 9250315 - DNA, 22 bp, Homo sapiens
attgtgcagcacagatcatgac

SEQ ID NO: 9250316 - DNA, 22 bp, Homo sapiens
attgtgcagaattggaattgca

SEQ ID NO: 9250317 - DNA, 22 bp, Homo sapiens
attgtgcagatagtaattagga

SEQ ID NO: 9250318 - DNA, 22 bp, Homo sapiens
attgtgcacctactgtgtgcag

SEQ ID NO: 9250319 - DNA, 22 bp, Homo sapiens
attgttactgggttaatttgga

SEQ ID NO: 9250320 - DNA, 21 bp, Homo sapiens
attgttatcattgtgctgtgt

SEQ ID NO: 9250321 - DNA, 22 bp, Homo sapiens
attgttaatgttgcactaaggt

SEQ ID NO: 9250322 - DNA, 22 bp, Homo sapiens
attgttaatgttgcactaaggt

SEQ ID NO: 9250323 - DNA, 22 bp, Homo sapiens
attgttgagtgcttcagctgta

SEQ ID NO: 9250324 - DNA, 22 bp, Homo sapiens
attgtttacactaacttcataa

SEQ ID NO: 9250325 - DNA, 22 bp, Homo sapiens
attgttgggtagtttgttcagc

SEQ ID NO: 9250326 - DNA, 22 bp, Homo sapiens
attgtttacactaacttcataa

SEQ ID NO: 9250327 - DNA, 22 bp, Homo sapiens
gcattagacccaaggtattttg

SEQ ID NO: 9250328 - DNA, 22 bp, Homo sapiens
gcagggaggtttgctgacctgg

SEQ ID NO: 9250329 - DNA, 22 bp, Homo sapiens
gcagggaggtttgctgacctgg

SEQ ID NO: 9250330 - DNA, 22 bp, Homo sapiens
gcagggatgctgaggctcagtg

SEQ ID NO: 9250331 - DNA, 22 bp, Homo sapiens
gcagggctgggatttgagccca

SEQ ID NO: 9250332 - DNA, 22 bp, Homo sapiens
gcagggctggggctgctcctga

SEQ ID NO: 9250333 - DNA, 22 bp, Homo sapiens
gcaggggtagtgtcttcctgag

SEQ ID NO: 9250334 - DNA, 22 bp, Homo sapiens
gcaggggtagtgtcttcctgag

SEQ ID NO: 9250335 - DNA, 22 bp, Homo sapiens
gcaggggtggaggctgtcctgt

SEQ ID NO: 9250336 - DNA, 22 bp, Homo sapiens
gcagggtccatggaggcagccc

SEQ ID NO: 9250337 - DNA, 22 bp, Homo sapiens
gcagggtccatggaggcagccc

SEQ ID NO: 9250338 - DNA, 22 bp, Homo sapiens
gcagggtccatggaggcagccc

SEQ ID NO: 9250339 - DNA, 22 bp, Homo sapiens
gcagggtctgaggccacagagg

SEQ ID NO: 9250340 - DNA, 22 bp, Homo sapiens
gcagggtcttgagaggcagcca

SEQ ID NO: 9250341 - DNA, 22 bp, Homo sapiens
gcagggtcttgagaggcagcca

SEQ ID NO: 9250342 - DNA, 22 bp, Homo sapiens
gcagggtcttgagaggcagcca

SEQ ID NO: 9250343 - DNA, 22 bp, Homo sapiens
attgtaaagtactgtgtacaat

SEQ ID NO: 9250344 - DNA, 22 bp, Homo sapiens
attgtaaagtactgtgtacaat

SEQ ID NO: 9250345 - DNA, 22 bp, Homo sapiens
attgtaaagtactgtgtacaat

SEQ ID NO: 9250346 - DNA, 22 bp, Homo sapiens
attgtaaatagtgccacaataa

SEQ ID NO: 9250347 - DNA, 22 bp, Homo sapiens
attgtaaaagtattctaagatt

SEQ ID NO: 9250348 - DNA, 22 bp, Homo sapiens
attgtaaaagtattctaagatt

SEQ ID NO: 9250349 - DNA, 22 bp, Homo sapiens
attggtggtgaggacatgccag

SEQ ID NO: 9250350 - DNA, 22 bp, Homo sapiens
attggtggtgaggacatgccag

SEQ ID NO: 9250351 - DNA, 22 bp, Homo sapiens
attggttaagacgcatcatgct

SEQ ID NO: 9250352 - DNA, 22 bp, Homo sapiens
attggttaccactttaaatctt

SEQ ID NO: 9250353 - DNA, 22 bp, Homo sapiens
attggttactcaatttgactga

SEQ ID NO: 9250354 - DNA, 22 bp, Homo sapiens
attggcagttggctgtggttca

SEQ ID NO: 9250355 - DNA, 22 bp, Homo sapiens
attggcagttagtgacgaggct

SEQ ID NO: 9250356 - DNA, 22 bp, Homo sapiens
gcaggtggatcacctgaggtca

SEQ ID NO: 9250357 - DNA, 22 bp, Homo sapiens
gcaggtggatcacctgaggtca

SEQ ID NO: 9250358 - DNA, 22 bp, Homo sapiens
gcaggtggagcagtagtctggt

SEQ ID NO: 9250359 - DNA, 22 bp, Homo sapiens
gcagggtgaaggtcacatagaa

SEQ ID NO: 9250360 - DNA, 22 bp, Homo sapiens
gcaggtggatattgctacttga

SEQ ID NO: 9250361 - DNA, 22 bp, Homo sapiens
gcaggtggatcaccacgtcagg

SEQ ID NO: 9250362 - DNA, 22 bp, Homo sapiens
gcaggtggatattgctacttga

SEQ ID NO: 9250363 - DNA, 22 bp, Homo sapiens
gcaggagcagtcaggggcagct

SEQ ID NO: 9250364 - DNA, 22 bp, Homo sapiens
gcaggagcaatggcctatcaga

SEQ ID NO: 9250365 - DNA, 22 bp, Homo sapiens
gcaggagccacttcagggatgc

SEQ ID NO: 9250366 - DNA, 22 bp, Homo sapiens
gcaggatgaaggcagaggctga

SEQ ID NO: 9250367 - DNA, 22 bp, Homo sapiens
gcaggagccacttcagggatgc

SEQ ID NO: 9250368 - DNA, 22 bp, Homo sapiens
gcaggatgaactaacacctgca

SEQ ID NO: 9250369 - DNA, 22 bp, Homo sapiens
gcaggatggtgccctttctgcc

SEQ ID NO: 9250370 - DNA, 22 bp, Homo sapiens
gcaggattgggcagagggtgaa

SEQ ID NO: 9250371 - DNA, 21 bp, Homo sapiens
gcaggatgcatcttggtgtct

SEQ ID NO: 9250372 - DNA, 22 bp, Homo sapiens
gcaggatgagtgagtacattta

SEQ ID NO: 9250373 - DNA, 22 bp, Homo sapiens
gcaggatgggagcttcactctg

SEQ ID NO: 9250374 - DNA, 22 bp, Homo sapiens
gcaggatgggagcttcactttg

SEQ ID NO: 9250375 - DNA, 22 bp, Homo sapiens
gcagggagggcctttcatgaca

SEQ ID NO: 9250376 - DNA, 22 bp, Homo sapiens
gcagggaggaagagatgcttcc

SEQ ID NO: 9250377 - DNA, 22 bp, Homo sapiens
gcaggctgtggtatgttgggca

SEQ ID NO: 9250378 - DNA, 22 bp, Homo sapiens
gcagggacgccagggacagcaa

SEQ ID NO: 9250379 - DNA, 22 bp, Homo sapiens
gcaggctggtctgaccatccct

SEQ ID NO: 9250380 - DNA, 22 bp, Homo sapiens
gcaggctggtctgaccatccct

SEQ ID NO: 9250381 - DNA, 22 bp, Homo sapiens
gcaggctgtagacaccaaacta

SEQ ID NO: 9250382 - DNA, 22 bp, Homo sapiens
gcaggctgtagacaccaaacta

SEQ ID NO: 9250383 - DNA, 22 bp, Homo sapiens
gcaggctgtctaaagttagagt

SEQ ID NO: 9250384 - DNA, 22 bp, Homo sapiens
gcaggctgtctaaagttagagt

SEQ ID NO: 9250385 - DNA, 22 bp, Homo sapiens
gcaggctgtgaggctcagatgg

SEQ ID NO: 9250386 - DNA, 22 bp, Homo sapiens
gcaggctgtgaggctcagatgg

SEQ ID NO: 9250387 - DNA, 22 bp, Homo sapiens
gcaggctgtgaggctcagatgg

SEQ ID NO: 9250388 - DNA, 22 bp, Homo sapiens
gcaggctgtctaaagttagagt

SEQ ID NO: 9250389 - DNA, 22 bp, Homo sapiens
gcaggctgtctaaagttagagt

SEQ ID NO: 9250390 - DNA, 22 bp, Homo sapiens
gcaggctgtctaaagttagagt

SEQ ID NO: 9250391 - DNA, 22 bp, Homo sapiens
gcaggctgtgaggctcagatgg

SEQ ID NO: 9250392 - DNA, 22 bp, Homo sapiens
gcaggctgtgaggctcagatgg

SEQ ID NO: 9250393 - DNA, 22 bp, Homo sapiens
atcttcaacaacaaattgcctc

SEQ ID NO: 9250394 - DNA, 22 bp, Homo sapiens
atcttcaaagcacatcgtttgt

SEQ ID NO: 9250395 - DNA, 22 bp, Homo sapiens
atcttcaaagcacatcgtttgt

SEQ ID NO: 9250396 - DNA, 22 bp, Homo sapiens
atcttcaacttgatcatttgaa

SEQ ID NO: 9250397 - DNA, 22 bp, Homo sapiens
atcttcaaggaaaaaatacagt

SEQ ID NO: 9250398 - DNA, 22 bp, Homo sapiens
atcttcatcaagttcacagtgg

SEQ ID NO: 9250399 - DNA, 22 bp, Homo sapiens
atcttcccaggctggggagagg

SEQ ID NO: 9250400 - DNA, 22 bp, Homo sapiens
cttgagaagagatttatatttg

SEQ ID NO: 9250401 - DNA, 22 bp, Homo sapiens
cttgagaatcttctctgaagag

SEQ ID NO: 9250402 - DNA, 22 bp, Homo sapiens
cttgagaatcttctctgaagag

SEQ ID NO: 9250403 - DNA, 22 bp, Homo sapiens
cttgagaaaggaacaggaagct

SEQ ID NO: 9250404 - DNA, 22 bp, Homo sapiens
atcttcccaggctggggagagg

SEQ ID NO: 9250405 - DNA, 22 bp, Homo sapiens
atcttcccaggctggggagagg

SEQ ID NO: 9250406 - DNA, 22 bp, Homo sapiens
cttgagaacagggttaggtaac

SEQ ID NO: 9250407 - DNA, 22 bp, Homo sapiens
atgaagcagcgttgtagagtga

SEQ ID NO: 9250408 - DNA, 22 bp, Homo sapiens
cttgaggttttgactcagcttt

SEQ ID NO: 9250409 - DNA, 22 bp, Homo sapiens
cttgaggttttgactcagcttt

SEQ ID NO: 9250410 - DNA, 22 bp, Homo sapiens
atgaagcaggcacagcttcagg

SEQ ID NO: 9250411 - DNA, 22 bp, Homo sapiens
atgaagttctcaataatcatgt

SEQ ID NO: 9250412 - DNA, 22 bp, Homo sapiens
cttgagcacagcggcttcagga

SEQ ID NO: 9250413 - DNA, 22 bp, Homo sapiens
cttgagggactctatgacttag

SEQ ID NO: 9250414 - DNA, 22 bp, Homo sapiens
cttgaggttttgactcagcttt

SEQ ID NO: 9250415 - DNA, 22 bp, Homo sapiens
atgaatgaatgagagtaggtca

SEQ ID NO: 9250416 - DNA, 22 bp, Homo sapiens
atgaatgaagaacatctgtgcc

SEQ ID NO: 9250417 - DNA, 22 bp, Homo sapiens
atgaatccaaagtttactatta

SEQ ID NO: 9250418 - DNA, 22 bp, Homo sapiens
atgaatcaaactgtacactgag

SEQ ID NO: 9250419 - DNA, 22 bp, Homo sapiens
atgaatcaaactgtacactgag

SEQ ID NO: 9250420 - DNA, 22 bp, Homo sapiens
atgaatatgagactgagagcct

SEQ ID NO: 9250421 - DNA, 22 bp, Homo sapiens
atgaatatgagactgagagcct

SEQ ID NO: 9250422 - DNA, 22 bp, Homo sapiens
gaaaagaactgcatgggattaa

SEQ ID NO: 9250423 - DNA, 22 bp, Homo sapiens
gaaaagagaacatctgaggatc

SEQ ID NO: 9250424 - DNA, 22 bp, Homo sapiens
gaaaagagaacatctgaggatc

SEQ ID NO: 9250425 - DNA, 22 bp, Homo sapiens
gaaaactaacggaaaagttagg

SEQ ID NO: 9250426 - DNA, 22 bp, Homo sapiens
gaaaactattggcctagaacaa

SEQ ID NO: 9250427 - DNA, 22 bp, Homo sapiens
gaaaactattggcctagaacaa

SEQ ID NO: 9250428 - DNA, 22 bp, Homo sapiens
gaaaatagttcatcacaatgat

SEQ ID NO: 9250429 - DNA, 22 bp, Homo sapiens
gaaaatagttcatcacaatgat

SEQ ID NO: 9250430 - DNA, 22 bp, Homo sapiens
gaaaataggctgcatctccttc

SEQ ID NO: 9250431 - DNA, 22 bp, Homo sapiens
gaaaataggctgcatctccttc

SEQ ID NO: 9250432 - DNA, 22 bp, Homo sapiens
gaaaatgagcctcagctacatt

SEQ ID NO: 9250433 - DNA, 20 bp, Homo sapiens
gaaaataggccagccaggta

SEQ ID NO: 9250434 - DNA, 22 bp, Homo sapiens
gaaaataggcagatgcattgta

SEQ ID NO: 9250435 - DNA, 20 bp, Homo sapiens
gaaaataggccagccaggta

SEQ ID NO: 9250436 - DNA, 22 bp, Homo sapiens
gaaaatagcagatagaccaatg

SEQ ID NO: 9250437 - DNA, 22 bp, Homo sapiens
gaaaatagcagatagaccaatg

SEQ ID NO: 9250438 - DNA, 22 bp, Homo sapiens
gaaaataggcagatgcattgta

SEQ ID NO: 9250439 - DNA, 22 bp, Homo sapiens
gaaaataggcagatgcattgta

SEQ ID NO: 9250440 - DNA, 22 bp, Homo sapiens
gaaaacatccagagatagacct

SEQ ID NO: 9250441 - DNA, 22 bp, Homo sapiens
ctttttccagcttcagggtggg

SEQ ID NO: 9250442 - DNA, 21 bp, Homo sapiens
gaaaaccatttgcatcatgag

SEQ ID NO: 9250443 - DNA, 22 bp, Homo sapiens
gaaaactaacggaaaagttagg

SEQ ID NO: 9250444 - DNA, 22 bp, Homo sapiens
ctttttccagcttcagggtggg

SEQ ID NO: 9250445 - DNA, 22 bp, Homo sapiens
atgaattgaggaaaacagtcgt

SEQ ID NO: 9250446 - DNA, 19 bp, Homo sapiens
atgaattgagcacttacta

SEQ ID NO: 9250447 - DNA, 21 bp, Homo sapiens
atgaatgatttctactcttaa

SEQ ID NO: 9250448 - DNA, 22 bp, Homo sapiens
atgaatgattttatgtaaatga

SEQ ID NO: 9250449 - DNA, 22 bp, Homo sapiens
atgaatgagtgctaggtttgtc

SEQ ID NO: 9250450 - DNA, 22 bp, Homo sapiens
atgaatgagaaagctgaaatct

SEQ ID NO: 9250451 - DNA, 22 bp, Homo sapiens
atgaatgactgtctactttggg

SEQ ID NO: 9250452 - DNA, 23 bp, Homo sapiens
gaacattcattggttgctttaga

SEQ ID NO: 9250453 - DNA, 22 bp, Homo sapiens
gaacattcacagactcaccatt

SEQ ID NO: 9250454 - DNA, 22 bp, Homo sapiens
gaacattcttggaggaaataac

SEQ ID NO: 9250455 - DNA, 22 bp, Homo sapiens
gaactttatcaaaagttgttta

SEQ ID NO: 9250456 - DNA, 22 bp, Homo sapiens
gaactttattccagaagaaagc

SEQ ID NO: 9250457 - DNA, 22 bp, Homo sapiens
gaactttaattagcttttgtct

SEQ ID NO: 9250458 - DNA, 22 bp, Homo sapiens
gaacatttgatgatgacattgg

SEQ ID NO: 9250459 - DNA, 22 bp, Homo sapiens
gaactttaaaacaaagtacagt

SEQ ID NO: 9250460 - DNA, 22 bp, Homo sapiens
atgcaagatgtatagaagactt

SEQ ID NO: 9250461 - DNA, 22 bp, Homo sapiens
atgcaagattcagcaggaagat

SEQ ID NO: 9250462 - DNA, 22 bp, Homo sapiens
atgcaagtcttaatagtttagg

SEQ ID NO: 9250463 - DNA, 22 bp, Homo sapiens
atgcaatatagggaagatagat

SEQ ID NO: 9250464 - DNA, 22 bp, Homo sapiens
atgcacaagaggctagaaaaga

SEQ ID NO: 9250465 - DNA, 16 bp, Homo sapiens
atgaggcataggctgc

SEQ ID NO: 9250466 - DNA, 22 bp, Homo sapiens
atgaggcatagcagggatcgga

SEQ ID NO: 9250467 - DNA, 22 bp, Homo sapiens
gaaatgatgtctgtgctgccac

SEQ ID NO: 9250468 - DNA, 22 bp, Homo sapiens
atgaggcatctaacattgcaaa

SEQ ID NO: 9250469 - DNA, 22 bp, Homo sapiens
gaacataactattgtgaatagt

SEQ ID NO: 9250470 - DNA, 22 bp, Homo sapiens
gaacaatgagtcattcaggtga

SEQ ID NO: 9250471 - DNA, 22 bp, Homo sapiens
gaacatcatgaagaaaacatat

SEQ ID NO: 9250472 - DNA, 22 bp, Homo sapiens
atgaggcatgtgaggagaaggg

SEQ ID NO: 9250473 - DNA, 22 bp, Homo sapiens
atgaggcattcacagaaggcac

SEQ ID NO: 9250474 - DNA, 22 bp, Homo sapiens
atgaggcattccactcaaactc

SEQ ID NO: 9250475 - DNA, 22 bp, Homo sapiens
gaacaatgaaagacataaactc

SEQ ID NO: 9250476 - DNA, 22 bp, Homo sapiens
gaaatctttgccttagctgtgt

SEQ ID NO: 9250477 - DNA, 22 bp, Homo sapiens
gaaatcttgctcattgtgacaa

SEQ ID NO: 9250478 - DNA, 22 bp, Homo sapiens
gaaatctttatggaaataacaa

SEQ ID NO: 9250479 - DNA, 22 bp, Homo sapiens
gaaatcttttaaccattcattt

SEQ ID NO: 9250480 - DNA, 22 bp, Homo sapiens
gaaatcttttccaattgtttag

SEQ ID NO: 9250481 - DNA, 22 bp, Homo sapiens
gaaatcttttcatctcatttga

SEQ ID NO: 9250482 - DNA, 22 bp, Homo sapiens
gaaatcttccttcagtgaagaa

SEQ ID NO: 9250483 - DNA, 22 bp, Homo sapiens
gaaatcttccaatggtcacatc

SEQ ID NO: 9250484 - DNA, 22 bp, Homo sapiens
gaaatcttttccaattgtttag

SEQ ID NO: 9250485 - DNA, 22 bp, Homo sapiens
gaaatatacatgaagtcggctg

SEQ ID NO: 9250486 - DNA, 22 bp, Homo sapiens
gaaatctacgattagtgaaaat

SEQ ID NO: 9250487 - DNA, 22 bp, Homo sapiens
gaaaatgagcctcagctacatt

SEQ ID NO: 9250488 - DNA, 22 bp, Homo sapiens
gaccctcctactaccctggaaa

SEQ ID NO: 9250489 - DNA, 21 bp, Homo sapiens
gaccccagaccagcagacaca

SEQ ID NO: 9250490 - DNA, 22 bp, Homo sapiens
atgctttatgttctggcatttt

SEQ ID NO: 9250491 - DNA, 22 bp, Homo sapiens
atgctttatgttctggcatttt

SEQ ID NO: 9250492 - DNA, 22 bp, Homo sapiens
gactttccaggtcctgggctat

SEQ ID NO: 9250493 - DNA, 22 bp, Homo sapiens
gactggggtaaggtgaggaggt

SEQ ID NO: 9250494 - DNA, 22 bp, Homo sapiens
gactttctctcctcccaggtgt

SEQ ID NO: 9250495 - DNA, 22 bp, Homo sapiens
gaccctctagatggaagcactg

SEQ ID NO: 9250496 - DNA, 22 bp, Homo sapiens
gaccctctagatggaagcactg

SEQ ID NO: 9250497 - DNA, 22 bp, Homo sapiens
gaccctgactctaatgcttggc

SEQ ID NO: 9250498 - DNA, 22 bp, Homo sapiens
gaccctgccatgagtgacaggg

SEQ ID NO: 9250499 - DNA, 22 bp, Homo sapiens
gaccctgagcaaaagcagttct

SEQ ID NO: 9250500 - DNA, 22 bp, Homo sapiens
atgctttattgttaggtcatgt

SEQ ID NO: 9250501 - DNA, 22 bp, Homo sapiens
atgctttgaagtttttcctcat

SEQ ID NO: 9250502 - DNA, 22 bp, Homo sapiens
atgctttggccaatgagaagtg

SEQ ID NO: 9250503 - DNA, 22 bp, Homo sapiens
atgctttgatttggtttctcta

SEQ ID NO: 9250504 - DNA, 22 bp, Homo sapiens
atgcttttccaggagaaatata

SEQ ID NO: 9250505 - DNA, 22 bp, Homo sapiens
atgcttttatgtcacatggtca

SEQ ID NO: 9250506 - DNA, 22 bp, Homo sapiens
gacataaaccttgagatattaa

SEQ ID NO: 9250507 - DNA, 22 bp, Homo sapiens
gacataaaatggaattctgttg

SEQ ID NO: 9250508 - DNA, 20 bp, Homo sapiens
atgcttaagtgttcattatt

SEQ ID NO: 9250509 - DNA, 22 bp, Homo sapiens
atgcttaagctcagttatatat

SEQ ID NO: 9250510 - DNA, 20 bp, Homo sapiens
atgcttaagtgttcattatt

SEQ ID NO: 9250511 - DNA, 22 bp, Homo sapiens
atgcttaatacactgttaaagg

SEQ ID NO: 9250512 - DNA, 22 bp, Homo sapiens
atgcttgtactaaaaaaatatt

SEQ ID NO: 9250513 - DNA, 22 bp, Homo sapiens
atgcttaatacactgttaaagg

SEQ ID NO: 9250514 - DNA, 22 bp, Homo sapiens
atgctttagtgtcaagtttggg

SEQ ID NO: 9250515 - DNA, 22 bp, Homo sapiens
atgctttacgacaaaaaactca

SEQ ID NO: 9250516 - DNA, 22 bp, Homo sapiens
atgctttacgacaaaaaactca

SEQ ID NO: 9250517 - DNA, 22 bp, Homo sapiens
atgctttatacaaaacacttaa

SEQ ID NO: 9250518 - DNA, 19 bp, Homo sapiens
atgctttatgttatttctt

SEQ ID NO: 9250519 - DNA, 22 bp, Homo sapiens
atgctttacagttttccaaaca

SEQ ID NO: 9250520 - DNA, 22 bp, Homo sapiens
atgctttaaaacgtatgtgtaa

SEQ ID NO: 9250521 - DNA, 22 bp, Homo sapiens
atgctttaaactataaatccac

SEQ ID NO: 9250522 - DNA, 22 bp, Homo sapiens
gacagggaggaaagagactgct

SEQ ID NO: 9250523 - DNA, 22 bp, Homo sapiens
gacagggaggagcagagcttct

SEQ ID NO: 9250524 - DNA, 22 bp, Homo sapiens
gacagtgttacaatttaatgga

SEQ ID NO: 9250525 - DNA, 22 bp, Homo sapiens
gacagtgtttgtataattcctg

SEQ ID NO: 9250526 - DNA, 22 bp, Homo sapiens
gacagtttaagcacctaatatt

SEQ ID NO: 9250527 - DNA, 22 bp, Homo sapiens
gacagtgtgaacatctaatagt

SEQ ID NO: 9250528 - DNA, 22 bp, Homo sapiens
gacagtgtgaacatctaatagt

SEQ ID NO: 9250529 - DNA, 22 bp, Homo sapiens
gaagcaatgtgttttcaacatt

SEQ ID NO: 9250530 - DNA, 22 bp, Homo sapiens
gaagcaattaagtttgtgatct

SEQ ID NO: 9250531 - DNA, 22 bp, Homo sapiens
gaagcaattaagtttgtgatct

SEQ ID NO: 9250532 - DNA, 22 bp, Homo sapiens
gaagcaatgtgttttcaacatt

SEQ ID NO: 9250533 - DNA, 22 bp, Homo sapiens
gaagcaatctggctcccagcca

SEQ ID NO: 9250534 - DNA, 22 bp, Homo sapiens
gaagcaatctggctcccagcca

SEQ ID NO: 9250535 - DNA, 22 bp, Homo sapiens
atgcacaagcaagagataatgg

SEQ ID NO: 9250536 - DNA, 22 bp, Homo sapiens
atgcacaagcaagagataatgg

SEQ ID NO: 9250537 - DNA, 22 bp, Homo sapiens
atgcacaagaggctagaaaaga

SEQ ID NO: 9250538 - DNA, 22 bp, Homo sapiens
gaagcacatggctgtgagcaac

SEQ ID NO: 9250539 - DNA, 22 bp, Homo sapiens
gaagcaatttagaatcagaagc

SEQ ID NO: 9250540 - DNA, 22 bp, Homo sapiens
gaagcaatttagaatcagaagc

SEQ ID NO: 9250541 - DNA, 22 bp, Homo sapiens
gaagcagagcctaaggcagaca

SEQ ID NO: 9250542 - DNA, 22 bp, Homo sapiens
gaagcagaacccactccccaac

SEQ ID NO: 9250543 - DNA, 22 bp, Homo sapiens
gaagcactgcatttcaagatca

SEQ ID NO: 9250544 - DNA, 22 bp, Homo sapiens
gaagcactgtgctgctaagttg

SEQ ID NO: 9250545 - DNA, 22 bp, Homo sapiens
gaatcatagaacattaatagaa

SEQ ID NO: 9250546 - DNA, 22 bp, Homo sapiens
gaatgtaatagtcagtagaaca

SEQ ID NO: 9250547 - DNA, 22 bp, Homo sapiens
gaagcagagcctaaggcagaca

SEQ ID NO: 9250548 - DNA, 22 bp, Homo sapiens
gaatgttactttgattttgtcc

SEQ ID NO: 9250549 - DNA, 22 bp, Homo sapiens
gaatgttagagattcttaggtt

SEQ ID NO: 9250550 - DNA, 22 bp, Homo sapiens
gaatgttatgtatccagtcaca

SEQ ID NO: 9250551 - DNA, 22 bp, Homo sapiens
gaatgttattgaactacgagct

SEQ ID NO: 9250552 - DNA, 22 bp, Homo sapiens
gaatgttattgaactacgagct

SEQ ID NO: 9250553 - DNA, 22 bp, Homo sapiens
gaatgttattggacagcagtgg

SEQ ID NO: 9250554 - DNA, 22 bp, Homo sapiens
gaatgtgggctgtgaagaggag

SEQ ID NO: 9250555 - DNA, 22 bp, Homo sapiens
gaatgttaatgcacttctagct

SEQ ID NO: 9250556 - DNA, 22 bp, Homo sapiens
gaatgttactttgattttgtcc

SEQ ID NO: 9250557 - DNA, 22 bp, Homo sapiens
atgcataatgtatgtattgact

SEQ ID NO: 9250558 - DNA, 22 bp, Homo sapiens
atgcataaagaaagctatctgg

SEQ ID NO: 9250559 - DNA, 22 bp, Homo sapiens
atgcatataaggcacatgtatt

SEQ ID NO: 9250560 - DNA, 22 bp, Homo sapiens
atgcatataatggccagaacaa

SEQ ID NO: 9250561 - DNA, 22 bp, Homo sapiens
atgcatataaggcacatgtatt

SEQ ID NO: 9250562 - DNA, 22 bp, Homo sapiens
atgcatatagaacatttgacat

SEQ ID NO: 9250563 - DNA, 22 bp, Homo sapiens
atgcatataatggccagaacaa

SEQ ID NO: 9250564 - DNA, 22 bp, Homo sapiens
atgcatatagaacatttgacat

SEQ ID NO: 9250565 - DNA, 22 bp, Homo sapiens
atgcatatatacatacacagtc

SEQ ID NO: 9250566 - DNA, 22 bp, Homo sapiens
atgcctggactgacatgcactg

SEQ ID NO: 9250567 - DNA, 22 bp, Homo sapiens
atgcctggactgacatgcactg

SEQ ID NO: 9250568 - DNA, 22 bp, Homo sapiens
atgcctgcttactccaggtgct

SEQ ID NO: 9250569 - DNA, 22 bp, Homo sapiens
atgcctgccatttagaagtctt

SEQ ID NO: 9250570 - DNA, 20 bp, Homo sapiens
atgcctctaattttgcaaac

SEQ ID NO: 9250571 - DNA, 20 bp, Homo sapiens
atgcctctaattttgcaaac

SEQ ID NO: 9250572 - DNA, 22 bp, Homo sapiens
atgcctcctcaaatctgccaca

SEQ ID NO: 9250573 - DNA, 22 bp, Homo sapiens
gacagggactccctggttagaa

SEQ ID NO: 9250574 - DNA, 22 bp, Homo sapiens
gacaggaacataaatgtaggag

SEQ ID NO: 9250575 - DNA, 22 bp, Homo sapiens
gacagggacgaggcttcaggca

SEQ ID NO: 9250576 - DNA, 22 bp, Homo sapiens
atgccctgctctcgggaaggga

SEQ ID NO: 9250577 - DNA, 22 bp, Homo sapiens
atgccacttcattccagcctcg

SEQ ID NO: 9250578 - DNA, 22 bp, Homo sapiens
atgccacttcattccagcctcg

SEQ ID NO: 9250579 - DNA, 22 bp, Homo sapiens
atgcccaatgtcacaatttttg

SEQ ID NO: 9250580 - DNA, 22 bp, Homo sapiens
atgcatatgcaatgcacaattt

SEQ ID NO: 9250581 - DNA, 22 bp, Homo sapiens
atgcatatgcatctgtgtacat

SEQ ID NO: 9250582 - DNA, 22 bp, Homo sapiens
atgcatatgcatctgtgtacat

SEQ ID NO: 9250583 - DNA, 22 bp, Homo sapiens
atgcatatctcctatctcctca

SEQ ID NO: 9250584 - DNA, 22 bp, Homo sapiens
atgcatatatacatacacagtc

SEQ ID NO: 9250585 - DNA, 20 bp, Homo sapiens
atgcatatatgtggtgtctg

SEQ ID NO: 9250586 - DNA, 20 bp, Homo sapiens
atgcatatatgtggtgtctg

SEQ ID NO: 9250587 - DNA, 22 bp, Homo sapiens
atgcatatcagtgattgtttgc

SEQ ID NO: 9250588 - DNA, 22 bp, Homo sapiens
atgcatatcacagtctccatgt

SEQ ID NO: 9250589 - DNA, 22 bp, Homo sapiens
atgcatatcacagtctccatgt

SEQ ID NO: 9250590 - DNA, 19 bp, Homo sapiens
gaggggaggaattgacaag

SEQ ID NO: 9250591 - DNA, 19 bp, Homo sapiens
gaggggaggaattgacaag

SEQ ID NO: 9250592 - DNA, 22 bp, Homo sapiens
gagggggcgtgcaaggctccgc

SEQ ID NO: 9250593 - DNA, 22 bp, Homo sapiens
gagggggtctatgaggtagagc

SEQ ID NO: 9250594 - DNA, 22 bp, Homo sapiens
gaggggggcgccctgcagtgca

SEQ ID NO: 9250595 - DNA, 17 bp, Homo sapiens
gaggtaggaagtgagtc

SEQ ID NO: 9250596 - DNA, 22 bp, Homo sapiens
gaggtaggcagggtgacttggc

SEQ ID NO: 9250597 - DNA, 22 bp, Homo sapiens
gaggtaggaggtaggtattgtg

SEQ ID NO: 9250598 - DNA, 22 bp, Homo sapiens
gaggtagccacagatagagact

SEQ ID NO: 9250599 - DNA, 22 bp, Homo sapiens
gaggtagccacagatagagact

SEQ ID NO: 9250600 - DNA, 22 bp, Homo sapiens
gaggtagcgagtggacagtgca

SEQ ID NO: 9250601 - DNA, 22 bp, Homo sapiens
gaggtagcgagtggacagtgca

SEQ ID NO: 9250602 - DNA, 17 bp, Homo sapiens
gaggtaggaagtgagtc

SEQ ID NO: 9250603 - DNA, 22 bp, Homo sapiens
gaggtacagagtgttccaatgt

SEQ ID NO: 9250604 - DNA, 23 bp, Homo sapiens
gaggtacagcaccagtgaatagg

SEQ ID NO: 9250605 - DNA, 18 bp, Homo sapiens
gaggtagataagattttc

SEQ ID NO: 9250606 - DNA, 22 bp, Homo sapiens
gaggtacatgaggatacacagg

SEQ ID NO: 9250607 - DNA, 22 bp, Homo sapiens
gaggtaggctgtgaaagggggt

SEQ ID NO: 9250608 - DNA, 22 bp, Homo sapiens
gaggtagggcagaggctgaatg

SEQ ID NO: 9250609 - DNA, 22 bp, Homo sapiens
gaggttggggctgcagtgagct

SEQ ID NO: 9250610 - DNA, 22 bp, Homo sapiens
gaggttggggctgcagtgagct

SEQ ID NO: 9250611 - DNA, 22 bp, Homo sapiens
gaggtagggaagacaaatatgc

SEQ ID NO: 9250612 - DNA, 22 bp, Homo sapiens
gaggttggggctgcagtgagct

SEQ ID NO: 9250613 - DNA, 22 bp, Homo sapiens
gagtccaggcatccctcccata

SEQ ID NO: 9250614 - DNA, 18 bp, Homo sapiens
gagtccaggctcttcacc

SEQ ID NO: 9250615 - DNA, 22 bp, Homo sapiens
gagtccagctctgcctcttact

SEQ ID NO: 9250616 - DNA, 22 bp, Homo sapiens
gagtccagctcattgtctggga

SEQ ID NO: 9250617 - DNA, 22 bp, Homo sapiens
gagggatggtagttgacactga

SEQ ID NO: 9250618 - DNA, 22 bp, Homo sapiens
gagggaaaggttaatacatgat

SEQ ID NO: 9250619 - DNA, 22 bp, Homo sapiens
gagggaaacagatgggttgtgg

SEQ ID NO: 9250620 - DNA, 22 bp, Homo sapiens
gaggccaaggtgggcagatcac

SEQ ID NO: 9250621 - DNA, 22 bp, Homo sapiens
gaggccaagttggagaccaggt

SEQ ID NO: 9250622 - DNA, 22 bp, Homo sapiens
gaggccacagctatcagggaca

SEQ ID NO: 9250623 - DNA, 22 bp, Homo sapiens
gaggccaactttggagaacagg

SEQ ID NO: 9250624 - DNA, 22 bp, Homo sapiens
atgtcacatggtcacctctagc

SEQ ID NO: 9250625 - DNA, 22 bp, Homo sapiens
atgtcacagttgcaacatgaat

SEQ ID NO: 9250626 - DNA, 22 bp, Homo sapiens
gaggcattaaagggaatcttct

SEQ ID NO: 9250627 - DNA, 22 bp, Homo sapiens
gaggccacagtcagtgttcatc

SEQ ID NO: 9250628 - DNA, 22 bp, Homo sapiens
gaggccacagctatcagggaca

SEQ ID NO: 9250629 - DNA, 22 bp, Homo sapiens
gaggccacagtcagtgttcatc

SEQ ID NO: 9250630 - DNA, 22 bp, Homo sapiens
gaggccacagtgtctgggggcc

SEQ ID NO: 9250631 - DNA, 22 bp, Homo sapiens
gaggccacagtcctgaggcatc

SEQ ID NO: 9250632 - DNA, 22 bp, Homo sapiens
gaggccacagtcctgaggcatc

SEQ ID NO: 9250633 - DNA, 22 bp, Homo sapiens
gaggccacattacttggtgggt

SEQ ID NO: 9250634 - DNA, 23 bp, Homo sapiens
gaggccacattcccctgcttgag

SEQ ID NO: 9250635 - DNA, 23 bp, Homo sapiens
gaggccacattcccctgcttgag

SEQ ID NO: 9250636 - DNA, 22 bp, Homo sapiens
gaggctgctttgatgacaggag

SEQ ID NO: 9250637 - DNA, 22 bp, Homo sapiens
gaggctggaatattagaaatgt

SEQ ID NO: 9250638 - DNA, 20 bp, Homo sapiens
gagtccaggggcctgtagca

SEQ ID NO: 9250639 - DNA, 20 bp, Homo sapiens
gagtccaggggcctgtagca

SEQ ID NO: 9250640 - DNA, 23 bp, Homo sapiens
gagtgcagaatagacatgcagtg

SEQ ID NO: 9250641 - DNA, 23 bp, Homo sapiens
gagtgcagaatagacatgcagtg

SEQ ID NO: 9250642 - DNA, 22 bp, Homo sapiens
gagtccagttctttccagcagt

SEQ ID NO: 9250643 - DNA, 23 bp, Homo sapiens
gagtgcagaatagacatgcagtg

SEQ ID NO: 9250644 - DNA, 22 bp, Homo sapiens
gagtccagttagtgaggctggg

SEQ ID NO: 9250645 - DNA, 22 bp, Homo sapiens
gagtccaggctgttgctcatct

SEQ ID NO: 9250646 - DNA, 22 bp, Homo sapiens
gagtgcagatgaacagaagatt

SEQ ID NO: 9250647 - DNA, 22 bp, Homo sapiens
gagtgcagatgaacagaagatt

SEQ ID NO: 9250648 - DNA, 23 bp, Homo sapiens
gagtgcagaatagacatgcagtg

SEQ ID NO: 9250649 - DNA, 17 bp, Homo sapiens
gagtgcagacacaagca

SEQ ID NO: 9250650 - DNA, 22 bp, Homo sapiens
gagtgcagatgccagccccagt

SEQ ID NO: 9250651 - DNA, 21 bp, Homo sapiens
gagtgcagcaaggtagagtct

SEQ ID NO: 9250652 - DNA, 21 bp, Homo sapiens
gagtgcagcaaggtagagtct

SEQ ID NO: 9250653 - DNA, 22 bp, Homo sapiens
gagtgcaggcctgagcaccatc

SEQ ID NO: 9250654 - DNA, 21 bp, Homo sapiens
gagtgcaggtctgatgccatc

SEQ ID NO: 9250655 - DNA, 21 bp, Homo sapiens
gagtgcaggtctgatgccatc

SEQ ID NO: 9250656 - DNA, 22 bp, Homo sapiens
atgtttcaatgcactttagcct

SEQ ID NO: 9250657 - DNA, 22 bp, Homo sapiens
atgtttcaaatatatagagttg

SEQ ID NO: 9250658 - DNA, 22 bp, Homo sapiens
atgtttcaaatatatagagttg

SEQ ID NO: 9250659 - DNA, 22 bp, Homo sapiens
atgtttcaccagttttataaga

SEQ ID NO: 9250660 - DNA, 22 bp, Homo sapiens
atgtttcaccagcaaattacct

SEQ ID NO: 9250661 - DNA, 22 bp, Homo sapiens
atgtttcagttctaaagttaga

SEQ ID NO: 9250662 - DNA, 22 bp, Homo sapiens
atgtttcatgactgagcaaaat

SEQ ID NO: 9250663 - DNA, 22 bp, Homo sapiens
atgtttcatttagatatcaggc

SEQ ID NO: 9250664 - DNA, 22 bp, Homo sapiens
atgtttcatttagatatcaggc

SEQ ID NO: 9250665 - DNA, 22 bp, Homo sapiens
atgtttcagggtgatagaaggt

SEQ ID NO: 9250666 - DNA, 22 bp, Homo sapiens
atgtttcagttctaaagttaga

SEQ ID NO: 9250667 - DNA, 22 bp, Homo sapiens
atgtttcaggcgaactaacatg

SEQ ID NO: 9250668 - DNA, 22 bp, Homo sapiens
atgtttcaggaaatcagctaga

SEQ ID NO: 9250669 - DNA, 22 bp, Homo sapiens
atgtttcaccagttttataaga

SEQ ID NO: 9250670 - DNA, 22 bp, Homo sapiens
gatcgagttgtttgttctgggg

SEQ ID NO: 9250671 - DNA, 22 bp, Homo sapiens
gagttatttgtagggattatat

SEQ ID NO: 9250672 - DNA, 22 bp, Homo sapiens
gatatttaactctcacaggtcc

SEQ ID NO: 9250673 - DNA, 22 bp, Homo sapiens
gagttattgggtggaaaggtag

SEQ ID NO: 9250674 - DNA, 22 bp, Homo sapiens
gagttatttcagaaggaaagat

SEQ ID NO: 9250675 - DNA, 22 bp, Homo sapiens
gagttagagccatagagcacgg

SEQ ID NO: 9250676 - DNA, 22 bp, Homo sapiens
gagttatatcctgagtcatatt

SEQ ID NO: 9250677 - DNA, 22 bp, Homo sapiens
gagttataacctagtttaactg

SEQ ID NO: 9250678 - DNA, 22 bp, Homo sapiens
gagttatagatggactattatt

SEQ ID NO: 9250679 - DNA, 22 bp, Homo sapiens
gagttattctaggtcctttgta

SEQ ID NO: 9250680 - DNA, 19 bp, Homo sapiens
gagttattgccagggcatg

SEQ ID NO: 9250681 - DNA, 22 bp, Homo sapiens
gagttatatttgcgatattgga

SEQ ID NO: 9250682 - DNA, 22 bp, Homo sapiens
gagttattaatggctgagtttg

SEQ ID NO: 9250683 - DNA, 22 bp, Homo sapiens
gagttacatggacattctctcc

SEQ ID NO: 9250684 - DNA, 22 bp, Homo sapiens
gagttacattcattgttacgct

SEQ ID NO: 9250685 - DNA, 22 bp, Homo sapiens
gagttacatggacattctctcc

SEQ ID NO: 9250686 - DNA, 22 bp, Homo sapiens
gagttacagagaggattatggt

SEQ ID NO: 9250687 - DNA, 22 bp, Homo sapiens
gagttacatttggtgacacttc

SEQ ID NO: 9250688 - DNA, 22 bp, Homo sapiens
gagttacacagaagtcagtttg

SEQ ID NO: 9250689 - DNA, 22 bp, Homo sapiens
gagttacacaaaatttctattt

SEQ ID NO: 9250690 - DNA, 22 bp, Homo sapiens
gagttaattcgaatattctagc

SEQ ID NO: 9250691 - DNA, 22 bp, Homo sapiens
gatctggaatctgaaggctgag

SEQ ID NO: 9250692 - DNA, 22 bp, Homo sapiens
gatctgaagagttattttctga

SEQ ID NO: 9250693 - DNA, 22 bp, Homo sapiens
gatctgaaaatgctcttcttct

SEQ ID NO: 9250694 - DNA, 22 bp, Homo sapiens
gatctcctggacgtcttgttaa

SEQ ID NO: 9250695 - DNA, 22 bp, Homo sapiens
gagcctggattgtcaccgactt

SEQ ID NO: 9250696 - DNA, 22 bp, Homo sapiens
gagcagtgactggagcatgaga

SEQ ID NO: 9250697 - DNA, 22 bp, Homo sapiens
gagcaggtttcaatgctgatgc

SEQ ID NO: 9250698 - DNA, 22 bp, Homo sapiens
gagcagtaggagaaccctgagc

SEQ ID NO: 9250699 - DNA, 22 bp, Homo sapiens
gagcagtgaagacagaagtaca

SEQ ID NO: 9250700 - DNA, 22 bp, Homo sapiens
gagcaggtctttcatggtgcat

SEQ ID NO: 9250701 - DNA, 22 bp, Homo sapiens
gagcagggccacttctgtacct

SEQ ID NO: 9250702 - DNA, 17 bp, Homo sapiens
gagcagggatgcggttc

SEQ ID NO: 9250703 - DNA, 22 bp, Homo sapiens
gagcagctgagctggaatgaga

SEQ ID NO: 9250704 - DNA, 22 bp, Homo sapiens
gagcagggagacaactctggtg

SEQ ID NO: 9250705 - DNA, 22 bp, Homo sapiens
gagcagggagacaactctggtg

SEQ ID NO: 9250706 - DNA, 22 bp, Homo sapiens
gagcagggagacaactctggtg

SEQ ID NO: 9250707 - DNA, 22 bp, Homo sapiens
gagcagggagacaactctggtg

SEQ ID NO: 9250708 - DNA, 22 bp, Homo sapiens
gagcctgggactgggggtcatg

SEQ ID NO: 9250709 - DNA, 22 bp, Homo sapiens
gagcctggggaccctcctgagt

SEQ ID NO: 9250710 - DNA, 22 bp, Homo sapiens
gagcctgggtccttccctggga

SEQ ID NO: 9250711 - DNA, 22 bp, Homo sapiens
gagcctgggtccttccctggga

SEQ ID NO: 9250712 - DNA, 22 bp, Homo sapiens
gagcctggcctcctgcctcagc

SEQ ID NO: 9250713 - DNA, 22 bp, Homo sapiens
gagcctggcctcctgcctcagc

SEQ ID NO: 9250714 - DNA, 22 bp, Homo sapiens
gagcctggcctcctgcctcagc

SEQ ID NO: 9250715 - DNA, 22 bp, Homo sapiens
gagcctggcctcctgcctcagc

SEQ ID NO: 9250716 - DNA, 22 bp, Homo sapiens
gagcctgggactgggggtcatg

SEQ ID NO: 9250717 - DNA, 20 bp, Homo sapiens
gagcctgggaagtctaaggt

SEQ ID NO: 9250718 - DNA, 20 bp, Homo sapiens
gagcctgggaagtctaaggt

SEQ ID NO: 9250719 - DNA, 18 bp, Homo sapiens
gagctctgcctcccagtc

SEQ ID NO: 9250720 - DNA, 20 bp, Homo sapiens
gagccttcccctcaccactg

SEQ ID NO: 9250721 - DNA, 22 bp, Homo sapiens
gagcctgtgtttcctgtagcca

SEQ ID NO: 9250722 - DNA, 22 bp, Homo sapiens
gagcgcgccacaaggagcggcg

SEQ ID NO: 9250723 - DNA, 22 bp, Homo sapiens
gagaggctgactggctgtcctg

SEQ ID NO: 9250724 - DNA, 22 bp, Homo sapiens
gagaggctgaaatcacaggagc

SEQ ID NO: 9250725 - DNA, 22 bp, Homo sapiens
gagaggctgatcctgcagagaa

SEQ ID NO: 9250726 - DNA, 22 bp, Homo sapiens
gagaggctggcagtgccaggtt

SEQ ID NO: 9250727 - DNA, 22 bp, Homo sapiens
gagaggctggcagtgccaggtt

SEQ ID NO: 9250728 - DNA, 22 bp, Homo sapiens
gagaggctgcatatgcacactg

SEQ ID NO: 9250729 - DNA, 22 bp, Homo sapiens
gagaggtcggggacactgcaaa

SEQ ID NO: 9250730 - DNA, 22 bp, Homo sapiens
gagaggtagaggctctgcttaa

SEQ ID NO: 9250731 - DNA, 22 bp, Homo sapiens
gagaggtagcagtaagaacagg

SEQ ID NO: 9250732 - DNA, 22 bp, Homo sapiens
atgctttttaaacttaattgga

SEQ ID NO: 9250733 - DNA, 22 bp, Homo sapiens
gagaggctctgaggactggggt

SEQ ID NO: 9250734 - DNA, 22 bp, Homo sapiens
gagaggctctgaggactggggt

SEQ ID NO: 9250735 - DNA, 22 bp, Homo sapiens
gagaggctccatgaccccggca

SEQ ID NO: 9250736 - DNA, 22 bp, Homo sapiens
gagaggctccgccactgctcag

SEQ ID NO: 9250737 - DNA, 22 bp, Homo sapiens
gagaggctccgccactgctcag

SEQ ID NO: 9250738 - DNA, 22 bp, Homo sapiens
gagaggtggaggttgcagtgag

SEQ ID NO: 9250739 - DNA, 22 bp, Homo sapiens
gagaggtggaggttgcagtgag

SEQ ID NO: 9250740 - DNA, 22 bp, Homo sapiens
gagaggtgaatgtggatgccac

SEQ ID NO: 9250741 - DNA, 22 bp, Homo sapiens
gagaggtgaaggctgccctggg

SEQ ID NO: 9250742 - DNA, 22 bp, Homo sapiens
gagaggtgaaatagttgtccgg

SEQ ID NO: 9250743 - DNA, 22 bp, Homo sapiens
gagaggtgaaggctgccctggg

SEQ ID NO: 9250744 - DNA, 22 bp, Homo sapiens
gagaggtgaatgtggatgccac

SEQ ID NO: 9250745 - DNA, 16 bp, Homo sapiens
gagcagcctgggcctt

SEQ ID NO: 9250746 - DNA, 22 bp, Homo sapiens
atgtacaaaatgttttgaaatg

SEQ ID NO: 9250747 - DNA, 22 bp, Homo sapiens
atgtacaatctatcacaagaag

SEQ ID NO: 9250748 - DNA, 21 bp, Homo sapiens
atgtcaaatgctttattttat

SEQ ID NO: 9250749 - DNA, 22 bp, Homo sapiens
atgtaatttatgttatccataa

SEQ ID NO: 9250750 - DNA, 22 bp, Homo sapiens
atgtaatagggtaacataacat

SEQ ID NO: 9250751 - DNA, 22 bp, Homo sapiens
atgtaagtttaagcacaacaag

SEQ ID NO: 9250752 - DNA, 22 bp, Homo sapiens
atgtaagtattcaaaatatttc

SEQ ID NO: 9250753 - DNA, 22 bp, Homo sapiens
atgtaaggagccacagtggggg

SEQ ID NO: 9250754 - DNA, 23 bp, Homo sapiens
atgtaagagttccagttactttg

SEQ ID NO: 9250755 - DNA, 22 bp, Homo sapiens
atgtaagactttaagaacctaa

SEQ ID NO: 9250756 - DNA, 22 bp, Homo sapiens
atgtaacaaatggtatacatgt

SEQ ID NO: 9250757 - DNA, 22 bp, Homo sapiens
atgtaacaaatggtatacatgt

SEQ ID NO: 9250758 - DNA, 22 bp, Homo sapiens
atgtaaattgtactgacacacg

SEQ ID NO: 9250759 - DNA, 22 bp, Homo sapiens
gagctctgggaaacaaagtgta

SEQ ID NO: 9250760 - DNA, 22 bp, Homo sapiens
gagctctggcagggcaggtctg

SEQ ID NO: 9250761 - DNA, 22 bp, Homo sapiens
gagcttggtgcacagtggttaa

SEQ ID NO: 9250762 - DNA, 22 bp, Homo sapiens
gagctggggcggatactcagct

SEQ ID NO: 9250763 - DNA, 22 bp, Homo sapiens
gagctggggcggatactcagct

SEQ ID NO: 9250764 - DNA, 22 bp, Homo sapiens
gagctttgagattcttatggta

SEQ ID NO: 9250765 - DNA, 22 bp, Homo sapiens
gagcttggtgttatttctgtgg

SEQ ID NO: 9250766 - DNA, 22 bp, Homo sapiens
gagctttgtctcctggagaccc

SEQ ID NO: 9250767 - DNA, 22 bp, Homo sapiens
gagctttgtgctggtaggtggt

SEQ ID NO: 9250768 - DNA, 22 bp, Homo sapiens
gagctttgttccgtggtggcac

SEQ ID NO: 9250769 - DNA, 22 bp, Homo sapiens
gagctttgtagcaggaaggaag

SEQ ID NO: 9250770 - DNA, 22 bp, Homo sapiens
gagctttgtaaaaaacttgcac

SEQ ID NO: 9250771 - DNA, 22 bp, Homo sapiens
gagctttgtcccttgggggctc

SEQ ID NO: 9250772 - DNA, 22 bp, Homo sapiens
gagctttggtgccaagtatttg

SEQ ID NO: 9250773 - DNA, 22 bp, Homo sapiens
gagctttgctggaagcctgggg

SEQ ID NO: 9250774 - DNA, 22 bp, Homo sapiens
gagctttggggaagaatacaga

SEQ ID NO: 9250775 - DNA, 22 bp, Homo sapiens
gagctttgctggaagcctgggg

SEQ ID NO: 9250776 - DNA, 22 bp, Homo sapiens
gagctttgcattattcagaagc

SEQ ID NO: 9250777 - DNA, 22 bp, Homo sapiens
gagctttgcctaaaactagaat

SEQ ID NO: 9250778 - DNA, 22 bp, Homo sapiens
gagctttgctggaagcctgggg

SEQ ID NO: 9250779 - DNA, 22 bp, Homo sapiens
gagctttgatcgctaagcctca

SEQ ID NO: 9250780 - DNA, 22 bp, Homo sapiens
gaggaagctgcgtggcatttca

SEQ ID NO: 9250781 - DNA, 22 bp, Homo sapiens
gaggaagcagggcttggctgag

SEQ ID NO: 9250782 - DNA, 22 bp, Homo sapiens
gaggaagcagggcttggctgag

SEQ ID NO: 9250783 - DNA, 22 bp, Homo sapiens
gagcttttataccttctctcag

SEQ ID NO: 9250784 - DNA, 22 bp, Homo sapiens
gaggaaggctaaggggcttaga

SEQ ID NO: 9250785 - DNA, 20 bp, Homo sapiens
atggttcaggccagctgtct

SEQ ID NO: 9250786 - DNA, 22 bp, Homo sapiens
cagcagagctgggctttgaatt

SEQ ID NO: 9250787 - DNA, 22 bp, Homo sapiens
cagcagagctgggaataaaatt

SEQ ID NO: 9250788 - DNA, 22 bp, Homo sapiens
cagcagagcatttggtaggagg

SEQ ID NO: 9250789 - DNA, 22 bp, Homo sapiens
cagcagagacggtaagcagaac

SEQ ID NO: 9250790 - DNA, 22 bp, Homo sapiens
cagcagagacggtaagcagaac

SEQ ID NO: 9250791 - DNA, 22 bp, Homo sapiens
cagcagagatgagattcctata

SEQ ID NO: 9250792 - DNA, 22 bp, Homo sapiens
cagcagagctgtgtgggaaggg

SEQ ID NO: 9250793 - DNA, 22 bp, Homo sapiens
cagcagggttaagtgactcacc

SEQ ID NO: 9250794 - DNA, 22 bp, Homo sapiens
cagcagggaagctgtgctgttt

SEQ ID NO: 9250795 - DNA, 22 bp, Homo sapiens
cagcaggtatgtttgttcagca

SEQ ID NO: 9250796 - DNA, 22 bp, Homo sapiens
cagcaggtctcagcagctcctt

SEQ ID NO: 9250797 - DNA, 20 bp, Homo sapiens
cagcagtggatgagagtttt

SEQ ID NO: 9250798 - DNA, 22 bp, Homo sapiens
cagcagtggaactacccaggga

SEQ ID NO: 9250799 - DNA, 22 bp, Homo sapiens
cagcagtgcttcagtgtgagat

SEQ ID NO: 9250800 - DNA, 22 bp, Homo sapiens
cagcagtggctgcaggcagctg

SEQ ID NO: 9250801 - DNA, 22 bp, Homo sapiens
cagcagtggctgcaggcagctg

SEQ ID NO: 9250802 - DNA, 22 bp, Homo sapiens
cagcagtggccatctgtgtggt

SEQ ID NO: 9250803 - DNA, 22 bp, Homo sapiens
cagcagtgatgtgtgagggttc

SEQ ID NO: 9250804 - DNA, 22 bp, Homo sapiens
cagcagtgacaagactaagaag

SEQ ID NO: 9250805 - DNA, 22 bp, Homo sapiens
cagcagtcaggcaaatgggagg

SEQ ID NO: 9250806 - DNA, 22 bp, Homo sapiens
cagcagtaattagtgctgcatg

SEQ ID NO: 9250807 - DNA, 22 bp, Homo sapiens
cagcagtacttctcagaggtat

SEQ ID NO: 9250808 - DNA, 22 bp, Homo sapiens
cagcaggtgctgcctgtcaccc

SEQ ID NO: 9250809 - DNA, 22 bp, Homo sapiens
cagcaggtggacacactcacct

SEQ ID NO: 9250810 - DNA, 22 bp, Homo sapiens
gtcctgacggctgattggcctg

SEQ ID NO: 9250811 - DNA, 22 bp, Homo sapiens
gtcctgacggctgattggcctg

SEQ ID NO: 9250812 - DNA, 22 bp, Homo sapiens
cagcagtgtacaaggtgtcaga

SEQ ID NO: 9250813 - DNA, 22 bp, Homo sapiens
gtcctctgttagaaatgtgctt

SEQ ID NO: 9250814 - DNA, 22 bp, Homo sapiens
gtcctctgtgtaggctgcagac

SEQ ID NO: 9250815 - DNA, 22 bp, Homo sapiens
gtcctatattcttttaaaattt

SEQ ID NO: 9250816 - DNA, 20 bp, Homo sapiens
gtctcaagtatctcacagtc

SEQ ID NO: 9250817 - DNA, 22 bp, Homo sapiens
gtcctgtgggcccaccatgagc

SEQ ID NO: 9250818 - DNA, 22 bp, Homo sapiens
cagcatgcccagactgagctaa

SEQ ID NO: 9250819 - DNA, 22 bp, Homo sapiens
cagcatctttctcttctggagt

SEQ ID NO: 9250820 - DNA, 22 bp, Homo sapiens
gtctccacagcccagctgccac

SEQ ID NO: 9250821 - DNA, 20 bp, Homo sapiens
gtctccactgggggttaacc

SEQ ID NO: 9250822 - DNA, 22 bp, Homo sapiens
gtctccagaagcctagacagcc

SEQ ID NO: 9250823 - DNA, 22 bp, Homo sapiens
gtctcattggttctgccagagt

SEQ ID NO: 9250824 - DNA, 19 bp, Homo sapiens
gtctctggatttcaggtcc

SEQ ID NO: 9250825 - DNA, 22 bp, Homo sapiens
gtctctgggttaagcagtgcat

SEQ ID NO: 9250826 - DNA, 22 bp, Homo sapiens
gtctctgtgtctgagagagccc

SEQ ID NO: 9250827 - DNA, 22 bp, Homo sapiens
gtctctgttatttccagggtca

SEQ ID NO: 9250828 - DNA, 22 bp, Homo sapiens
gtctctgtgccttctccccacc

SEQ ID NO: 9250829 - DNA, 22 bp, Homo sapiens
gtctctgtggctggctccttcc

SEQ ID NO: 9250830 - DNA, 22 bp, Homo sapiens
gtgaaggtggggagcctcagtt

SEQ ID NO: 9250831 - DNA, 22 bp, Homo sapiens
gtctttggagaggtgccatttc

SEQ ID NO: 9250832 - DNA, 22 bp, Homo sapiens
gtctttgctgtctttgctctca

SEQ ID NO: 9250833 - DNA, 22 bp, Homo sapiens
gtctttcttcagagcttggact

SEQ ID NO: 9250834 - DNA, 22 bp, Homo sapiens
gtctttcttaattcaagtgctt

SEQ ID NO: 9250835 - DNA, 22 bp, Homo sapiens
gtctttctgccatgtgaagaga

SEQ ID NO: 9250836 - DNA, 22 bp, Homo sapiens
gtctttctatgcatagagcaga

SEQ ID NO: 9250837 - DNA, 22 bp, Homo sapiens
gtctcttatgggcaggagcaca

SEQ ID NO: 9250838 - DNA, 22 bp, Homo sapiens
gtcttaaaatcagaggatatag

SEQ ID NO: 9250839 - DNA, 19 bp, Homo sapiens
gtcttacaggcaacatgag

SEQ ID NO: 9250840 - DNA, 22 bp, Homo sapiens
gtgaatggggcaggaaggatgg

SEQ ID NO: 9250841 - DNA, 22 bp, Homo sapiens
gtgaatatgatcttatttggaa

SEQ ID NO: 9250842 - DNA, 21 bp, Homo sapiens
gtgaatatgcagcagaggcag

SEQ ID NO: 9250843 - DNA, 22 bp, Homo sapiens
gtgaatgaaaggatgattcttt

SEQ ID NO: 9250844 - DNA, 22 bp, Homo sapiens
gtgaatgacatattttgtactg

SEQ ID NO: 9250845 - DNA, 22 bp, Homo sapiens
gtgaatgatagcttctctttgg

SEQ ID NO: 9250846 - DNA, 22 bp, Homo sapiens
gtgaatgactgttttcagcatt

SEQ ID NO: 9250847 - DNA, 22 bp, Homo sapiens
gtgaataatcacccttctggat

SEQ ID NO: 9250848 - DNA, 22 bp, Homo sapiens
gtgaataactttctatgttaat

SEQ ID NO: 9250849 - DNA, 22 bp, Homo sapiens
gtgcaaaagtaattgcagtttt

SEQ ID NO: 9250850 - DNA, 22 bp, Homo sapiens
gtgcaaaagtaattgcagtttt

SEQ ID NO: 9250851 - DNA, 22 bp, Homo sapiens
gtgcaaaagtaattgcggtttt

SEQ ID NO: 9250852 - DNA, 22 bp, Homo sapiens
gtgcaaaagtaattgctgtttt

SEQ ID NO: 9250853 - DNA, 22 bp, Homo sapiens
gtgcaaaagtcattgtggtttt

SEQ ID NO: 9250854 - DNA, 22 bp, Homo sapiens
gtgcaaaagtacttgcggattt

SEQ ID NO: 9250855 - DNA, 22 bp, Homo sapiens
gtgcaaaagtaattgtggtttt

SEQ ID NO: 9250856 - DNA, 22 bp, Homo sapiens
gtgcaaaagtaattgaggtttt

SEQ ID NO: 9250857 - DNA, 22 bp, Homo sapiens
gtgcaaaagtaattgcagtact

SEQ ID NO: 9250858 - DNA, 22 bp, Homo sapiens
gtgcaaaagtaattacagtttt

SEQ ID NO: 9250859 - DNA, 22 bp, Homo sapiens
gtgcaaaagtaatggcagtttt

SEQ ID NO: 9250860 - DNA, 22 bp, Homo sapiens
gtgaggtcaaagccttgggtat

SEQ ID NO: 9250861 - DNA, 22 bp, Homo sapiens
gtgcaggagccaggggtaggaa

SEQ ID NO: 9250862 - DNA, 22 bp, Homo sapiens
gtgcagctgtggtggagccagg

SEQ ID NO: 9250863 - DNA, 22 bp, Homo sapiens
gtgcagcttcctggtctcagcc

SEQ ID NO: 9250864 - DNA, 22 bp, Homo sapiens
gtgcagctgtgtgagagctcca

SEQ ID NO: 9250865 - DNA, 22 bp, Homo sapiens
gtgcagctgcccaagcctgagc

SEQ ID NO: 9250866 - DNA, 22 bp, Homo sapiens
gtgcagcagggggaagacagtg

SEQ ID NO: 9250867 - DNA, 16 bp, Homo sapiens
gtgcaaaagtgaggag

SEQ ID NO: 9250868 - DNA, 22 bp, Homo sapiens
cagctcctatgagtatgattcc

SEQ ID NO: 9250869 - DNA, 22 bp, Homo sapiens
cagctcctatgagtatgattcc

SEQ ID NO: 9250870 - DNA, 22 bp, Homo sapiens
cagctccctatggtgaggcgac

SEQ ID NO: 9250871 - DNA, 22 bp, Homo sapiens
cagctccccatggttcctgaag

SEQ ID NO: 9250872 - DNA, 22 bp, Homo sapiens
cagctcccgccatcgggaggca

SEQ ID NO: 9250873 - DNA, 22 bp, Homo sapiens
cagctccctatggtgaggcgac

SEQ ID NO: 9250874 - DNA, 22 bp, Homo sapiens
cagctcctcacgagtcttgaaa

SEQ ID NO: 9250875 - DNA, 22 bp, Homo sapiens
cagctcctcacgagtcttgaaa

SEQ ID NO: 9250876 - DNA, 22 bp, Homo sapiens
cagctctgaggaacactccttt

SEQ ID NO: 9250877 - DNA, 21 bp, Homo sapiens
cagctctgagatttctactag

SEQ ID NO: 9250878 - DNA, 21 bp, Homo sapiens
cagctctgagatttctactag

SEQ ID NO: 9250879 - DNA, 22 bp, Homo sapiens
cagctctgagactgaggctatg

SEQ ID NO: 9250880 - DNA, 22 bp, Homo sapiens
cagctctgaggaacactccttt

SEQ ID NO: 9250881 - DNA, 22 bp, Homo sapiens
cagctctgaggaacactccttt

SEQ ID NO: 9250882 - DNA, 22 bp, Homo sapiens
cagctctgaggaacactccttt

SEQ ID NO: 9250883 - DNA, 22 bp, Homo sapiens
cagctctgatgaaatgtaccag

SEQ ID NO: 9250884 - DNA, 22 bp, Homo sapiens
cagctcctgaggactgctggga

SEQ ID NO: 9250885 - DNA, 22 bp, Homo sapiens
cagctctgagactgaggctatg

SEQ ID NO: 9250886 - DNA, 22 bp, Homo sapiens
cagctcctgcagctgctgccgt

SEQ ID NO: 9250887 - DNA, 17 bp, Homo sapiens
cagctctgcagacttcc

SEQ ID NO: 9250888 - DNA, 17 bp, Homo sapiens
cagctctgcagacttcc

SEQ ID NO: 9250889 - DNA, 22 bp, Homo sapiens
cagctccagccaccggggggtg

SEQ ID NO: 9250890 - DNA, 22 bp, Homo sapiens
cagctcagcttcctgggtgtgt

SEQ ID NO: 9250891 - DNA, 22 bp, Homo sapiens
cagctcagcttcctgggtgtgt

SEQ ID NO: 9250892 - DNA, 22 bp, Homo sapiens
gtgctgaggtgggtgggcagcc

SEQ ID NO: 9250893 - DNA, 22 bp, Homo sapiens
gtgctgaggtgggtgggcagcc

SEQ ID NO: 9250894 - DNA, 20 bp, Homo sapiens
gtgctgagggctgggcaatg

SEQ ID NO: 9250895 - DNA, 20 bp, Homo sapiens
gtgctgagggctgggcaatg

SEQ ID NO: 9250896 - DNA, 22 bp, Homo sapiens
cagctccagcccaggcagctcc

SEQ ID NO: 9250897 - DNA, 22 bp, Homo sapiens
cagctccagcctgacaccaaga

SEQ ID NO: 9250898 - DNA, 22 bp, Homo sapiens
cagctcccagagtgaccagcag

SEQ ID NO: 9250899 - DNA, 22 bp, Homo sapiens
cagctcccagtggcagctcctt

SEQ ID NO: 9250900 - DNA, 22 bp, Homo sapiens
cagctcccagtggcagctcctt

SEQ ID NO: 9250901 - DNA, 22 bp, Homo sapiens
cagctccccatggttcctgaag

SEQ ID NO: 9250902 - DNA, 22 bp, Homo sapiens
cagctcccctctgtggggcagt

SEQ ID NO: 9250903 - DNA, 22 bp, Homo sapiens
cagctccccatggttcctgaag

SEQ ID NO: 9250904 - DNA, 22 bp, Homo sapiens
gtgcctgtgccaggggtgtgct

SEQ ID NO: 9250905 - DNA, 22 bp, Homo sapiens
gtgctgagaattgatgtccttg

SEQ ID NO: 9250906 - DNA, 22 bp, Homo sapiens
gtgcctgtgcggactcagggaa

SEQ ID NO: 9250907 - DNA, 22 bp, Homo sapiens
gtgcctggggttgagctatgaa

SEQ ID NO: 9250908 - DNA, 22 bp, Homo sapiens
gtgcctggtttggggagtgttc

SEQ ID NO: 9250909 - DNA, 22 bp, Homo sapiens
gtgcctggtttggggaatgttc

SEQ ID NO: 9250910 - DNA, 22 bp, Homo sapiens
gtgctgagctgcagatgcgctc

SEQ ID NO: 9250911 - DNA, 22 bp, Homo sapiens
gtgctgagctgcagatgcgctc

SEQ ID NO: 9250912 - DNA, 22 bp, Homo sapiens
gtgctgaggagagggggtggtc

SEQ ID NO: 9250913 - DNA, 22 bp, Homo sapiens
gtgctgagcatcatgaggcact

SEQ ID NO: 9250914 - DNA, 22 bp, Homo sapiens
gtgctgagcatcatgaggcact

SEQ ID NO: 9250915 - DNA, 21 bp, Homo sapiens
gtgctgaggatacagtagtaa

SEQ ID NO: 9250916 - DNA, 22 bp, Homo sapiens
gtgctgaggccaatgtcagggt

SEQ ID NO: 9250917 - DNA, 22 bp, Homo sapiens
gtgctgaggatacagctgtgaa

SEQ ID NO: 9250918 - DNA, 22 bp, Homo sapiens
gtgctgaggatacagctgtgaa

SEQ ID NO: 9250919 - DNA, 22 bp, Homo sapiens
gtgctgagcacaaggcccagag

SEQ ID NO: 9250920 - DNA, 22 bp, Homo sapiens
gtgctgagcacaccttggagca

SEQ ID NO: 9250921 - DNA, 22 bp, Homo sapiens
gtgctgagcacagctgcccagg

SEQ ID NO: 9250922 - DNA, 22 bp, Homo sapiens
gtgctgagcacagctgcccagg

SEQ ID NO: 9250923 - DNA, 19 bp, Homo sapiens
gtgctgagatgtggtacta

SEQ ID NO: 9250924 - DNA, 22 bp, Homo sapiens
gtgctgagattacaggtgtgag

SEQ ID NO: 9250925 - DNA, 22 bp, Homo sapiens
gtgctgagattacaggtgtgag

SEQ ID NO: 9250926 - DNA, 22 bp, Homo sapiens
gtgctgagattggagtgagcag

SEQ ID NO: 9250927 - DNA, 22 bp, Homo sapiens
cagcccttcttccaaccagctt

SEQ ID NO: 9250928 - DNA, 22 bp, Homo sapiens
cagcccttgatgataatttatc

SEQ ID NO: 9250929 - DNA, 22 bp, Homo sapiens
cagcccttccaggcagaattct

SEQ ID NO: 9250930 - DNA, 20 bp, Homo sapiens
cagccctttatcctcctatg

SEQ ID NO: 9250931 - DNA, 22 bp, Homo sapiens
cagcccttgtttctaaagctgc

SEQ ID NO: 9250932 - DNA, 22 bp, Homo sapiens
cagcccttgcgacaccctggct

SEQ ID NO: 9250933 - DNA, 20 bp, Homo sapiens
cagcccttgatttacaatcc

SEQ ID NO: 9250934 - DNA, 20 bp, Homo sapiens
cagcctccactcactcagct

SEQ ID NO: 9250935 - DNA, 22 bp, Homo sapiens
gtgccctgacacacctggtgtg

SEQ ID NO: 9250936 - DNA, 22 bp, Homo sapiens
gtgcctgggcatgagcttgttg

SEQ ID NO: 9250937 - DNA, 22 bp, Homo sapiens
gtgcatgtcggggtgcatgtca

SEQ ID NO: 9250938 - DNA, 22 bp, Homo sapiens
gtgcatgtgcatccatgtgtac

SEQ ID NO: 9250939 - DNA, 22 bp, Homo sapiens
gtgcatgttaatggtgtacaaa

SEQ ID NO: 9250940 - DNA, 22 bp, Homo sapiens
gtgcatgtgtctttatagtagc

SEQ ID NO: 9250941 - DNA, 23 bp, Homo sapiens
gtgcatgtgtctttacagtagca

SEQ ID NO: 9250942 - DNA, 22 bp, Homo sapiens
gtgcatgtgtctttatagtaga

SEQ ID NO: 9250943 - DNA, 22 bp, Homo sapiens
gtgcatgaagactcagaaagtc

SEQ ID NO: 9250944 - DNA, 22 bp, Homo sapiens
gtgcaggagctcccgcagtggt

SEQ ID NO: 9250945 - DNA, 22 bp, Homo sapiens
gtgcaggagcttctggcctgac

SEQ ID NO: 9250946 - DNA, 22 bp, Homo sapiens
gtgcaggaggatgacaactgca

SEQ ID NO: 9250947 - DNA, 22 bp, Homo sapiens
gtgcaggaggtaacatagcaaa

SEQ ID NO: 9250948 - DNA, 22 bp, Homo sapiens
gtgcatatgtgtgtatacaaac

SEQ ID NO: 9250949 - DNA, 22 bp, Homo sapiens
gtgcatattttgcacacagatg

SEQ ID NO: 9250950 - DNA, 22 bp, Homo sapiens
cagatagcaaatgggtaagcta

SEQ ID NO: 9250951 - DNA, 22 bp, Homo sapiens
cagatacattaaaatgatgatt

SEQ ID NO: 9250952 - DNA, 22 bp, Homo sapiens
cagatatagtggcttgcctggg

SEQ ID NO: 9250953 - DNA, 22 bp, Homo sapiens
cagataaaattaatattaccaa

SEQ ID NO: 9250954 - DNA, 22 bp, Homo sapiens
cagataaaggcttactagtagt

SEQ ID NO: 9250955 - DNA, 22 bp, Homo sapiens
cagataaatagatagataaact

SEQ ID NO: 9250956 - DNA, 20 bp, Homo sapiens
cagatgctggatcttggtcc

SEQ ID NO: 9250957 - DNA, 22 bp, Homo sapiens
cagatgctatgtattatgtatg

SEQ ID NO: 9250958 - DNA, 22 bp, Homo sapiens
cagatgctatgtattatgtatg

SEQ ID NO: 9250959 - DNA, 22 bp, Homo sapiens
cagatgctgctcacctgattat

SEQ ID NO: 9250960 - DNA, 22 bp, Homo sapiens
ggtgcagcagtttgttcagctt

SEQ ID NO: 9250961 - DNA, 22 bp, Homo sapiens
ggtgcaggaaaattacctggag

SEQ ID NO: 9250962 - DNA, 22 bp, Homo sapiens
ggtgcagaaggaagggagctgg

SEQ ID NO: 9250963 - DNA, 22 bp, Homo sapiens
ggtgcagaggagccagctgggg

SEQ ID NO: 9250964 - DNA, 22 bp, Homo sapiens
ggtgagaggcagaggacagctt

SEQ ID NO: 9250965 - DNA, 21 bp, Homo sapiens
ggggtcaagtgaatggtgttg

SEQ ID NO: 9250966 - DNA, 22 bp, Homo sapiens
ggggtcggggcatagccactta

SEQ ID NO: 9250967 - DNA, 22 bp, Homo sapiens
ggggtgagctgggcctgtgcct

SEQ ID NO: 9250968 - DNA, 22 bp, Homo sapiens
cagagtgaaaactgagctcaaa

SEQ ID NO: 9250969 - DNA, 22 bp, Homo sapiens
cagagtgaaaactgagctcaaa

SEQ ID NO: 9250970 - DNA, 22 bp, Homo sapiens
ggggtgagatcaaggaagccct

SEQ ID NO: 9250971 - DNA, 22 bp, Homo sapiens
ggggtctgggcttagctggaat

SEQ ID NO: 9250972 - DNA, 22 bp, Homo sapiens
cagagtgtattctgcagttgca

SEQ ID NO: 9250973 - DNA, 22 bp, Homo sapiens
cagagtggtgcaagggcagtgt

SEQ ID NO: 9250974 - DNA, 22 bp, Homo sapiens
cagagtgggctgtcagccacca

SEQ ID NO: 9250975 - DNA, 22 bp, Homo sapiens
cagagttcaaagcctgctggga

SEQ ID NO: 9250976 - DNA, 22 bp, Homo sapiens
cagagtgtttctttgggtgggt

SEQ ID NO: 9250977 - DNA, 22 bp, Homo sapiens
cagagtttaaacaaatgaaata

SEQ ID NO: 9250978 - DNA, 22 bp, Homo sapiens
cagagttttgtgaacaacttgg

SEQ ID NO: 9250979 - DNA, 22 bp, Homo sapiens
cagaggctgctctgggtggcat

SEQ ID NO: 9250980 - DNA, 22 bp, Homo sapiens
ggggtagggtgattgtgaagta

SEQ ID NO: 9250981 - DNA, 22 bp, Homo sapiens
ggggtcaagctcagaatcctag

SEQ ID NO: 9250982 - DNA, 21 bp, Homo sapiens
ggggtatacctatgagatagt

SEQ ID NO: 9250983 - DNA, 22 bp, Homo sapiens
cagaggctgccagccatgtgca

SEQ ID NO: 9250984 - DNA, 22 bp, Homo sapiens
cagaggctgccagccatgtgca

SEQ ID NO: 9250985 - DNA, 22 bp, Homo sapiens
cagaggctgccagccatgtgca

SEQ ID NO: 9250986 - DNA, 22 bp, Homo sapiens
cagaggctgctctgggtggcat

SEQ ID NO: 9250987 - DNA, 21 bp, Homo sapiens
cagaggctgagagggcaatct

SEQ ID NO: 9250988 - DNA, 21 bp, Homo sapiens
cagaggctgagagggcaatct

SEQ ID NO: 9250989 - DNA, 22 bp, Homo sapiens
cagaggctgatggctgtagcca

SEQ ID NO: 9250990 - DNA, 22 bp, Homo sapiens
cagaggctgagcagtcagtttg

SEQ ID NO: 9250991 - DNA, 22 bp, Homo sapiens
cagaggctgatgtgggatgggc

SEQ ID NO: 9250992 - DNA, 22 bp, Homo sapiens
cagaggctgatgtgggatgggc

SEQ ID NO: 9250993 - DNA, 22 bp, Homo sapiens
cagaggctgatggctgtagcca

SEQ ID NO: 9250994 - DNA, 22 bp, Homo sapiens
cagaggcaggataagaactgcg

SEQ ID NO: 9250995 - DNA, 21 bp, Homo sapiens
cagaggctgagagggcaatct

SEQ ID NO: 9250996 - DNA, 22 bp, Homo sapiens
cagaggctgaccctgctgttgt

SEQ ID NO: 9250997 - DNA, 22 bp, Homo sapiens
cagaggcctttctacagtgata

SEQ ID NO: 9250998 - DNA, 22 bp, Homo sapiens
ggtgggaaggccactgaaggtt

SEQ ID NO: 9250999 - DNA, 22 bp, Homo sapiens
ggtgggaaggccactgaaggtt

SEQ ID NO: 9251000 - DNA, 22 bp, Homo sapiens
ggtgggaaggccactgaaggtt

SEQ ID NO: 9251001 - DNA, 22 bp, Homo sapiens
ggtgggaaggggccagtgtgcg

SEQ ID NO: 9251002 - DNA, 22 bp, Homo sapiens
ggtgggaaggggccagtgtgcg

SEQ ID NO: 9251003 - DNA, 22 bp, Homo sapiens
cagcactatgacatttaattct

SEQ ID NO: 9251004 - DNA, 22 bp, Homo sapiens
ggtggctgcttcctcaagagga

SEQ ID NO: 9251005 - DNA, 22 bp, Homo sapiens
ggtggcagtggtctctgacaga

SEQ ID NO: 9251006 - DNA, 22 bp, Homo sapiens
ggtggcagtggtctctgacaga

SEQ ID NO: 9251007 - DNA, 22 bp, Homo sapiens
cagatggagtcccgtggagttc

SEQ ID NO: 9251008 - DNA, 22 bp, Homo sapiens
ggtggcaggctggcattggcaa

SEQ ID NO: 9251009 - DNA, 22 bp, Homo sapiens
ggtggcagggagtgtccctggg

SEQ ID NO: 9251010 - DNA, 22 bp, Homo sapiens
cagatggaacacagaaaggaga

SEQ ID NO: 9251011 - DNA, 22 bp, Homo sapiens
cagatgcttttgattctggggt

SEQ ID NO: 9251012 - DNA, 18 bp, Homo sapiens
ggtggcaggtcagatgcc

SEQ ID NO: 9251013 - DNA, 18 bp, Homo sapiens
ggtggcaggtcagatgcc

SEQ ID NO: 9251014 - DNA, 18 bp, Homo sapiens
ggtggcaggtcagatgcc

SEQ ID NO: 9251015 - DNA, 22 bp, Homo sapiens
ggtggcagtagcactgggcctg

SEQ ID NO: 9251016 - DNA, 22 bp, Homo sapiens
ggtggcagtcttaagagatctt

SEQ ID NO: 9251017 - DNA, 22 bp, Homo sapiens
ggtggcagtcttaagagatctt

SEQ ID NO: 9251018 - DNA, 22 bp, Homo sapiens
ggtggcagtcttaagagatctt

SEQ ID NO: 9251019 - DNA, 22 bp, Homo sapiens
gtaagaggagtgggaagcctca

SEQ ID NO: 9251020 - DNA, 22 bp, Homo sapiens
gtaagacaagcggactgccgtt

SEQ ID NO: 9251021 - DNA, 22 bp, Homo sapiens
gtaagacatagatttctcatga

SEQ ID NO: 9251022 - DNA, 22 bp, Homo sapiens
gtaagaggagtgggaagcctca

SEQ ID NO: 9251023 - DNA, 22 bp, Homo sapiens
gtaagaggatcaaggcggtgca

SEQ ID NO: 9251024 - DNA, 20 bp, Homo sapiens
cagcagagacccatggggag

SEQ ID NO: 9251025 - DNA, 22 bp, Homo sapiens
gtaagcattcattgtctgtata

SEQ ID NO: 9251026 - DNA, 22 bp, Homo sapiens
gtaacatttacagttcctagag

SEQ ID NO: 9251027 - DNA, 22 bp, Homo sapiens
gtaacattctagaaacttaaca

SEQ ID NO: 9251028 - DNA, 22 bp, Homo sapiens
gtaacatttacagttcctagag

SEQ ID NO: 9251029 - DNA, 22 bp, Homo sapiens
gtaacgaataaacaagtgataa

SEQ ID NO: 9251030 - DNA, 19 bp, Homo sapiens
ggtgtgccaaatgggaatg

SEQ ID NO: 9251031 - DNA, 22 bp, Homo sapiens
gtaaacatcgacccaacagggg

SEQ ID NO: 9251032 - DNA, 22 bp, Homo sapiens
gtaacattattcatgagataca

SEQ ID NO: 9251033 - DNA, 22 bp, Homo sapiens
ggtgtctgttgcctcctggtta

SEQ ID NO: 9251034 - DNA, 19 bp, Homo sapiens
ggtgtgaagtgaggagtta

SEQ ID NO: 9251035 - DNA, 22 bp, Homo sapiens
ggtgtctcagctgctggcaggg

SEQ ID NO: 9251036 - DNA, 22 bp, Homo sapiens
cagcagactggagtaggcagtg

SEQ ID NO: 9251037 - DNA, 22 bp, Homo sapiens
cagcagacttactagaatgtaa

SEQ ID NO: 9251038 - DNA, 22 bp, Homo sapiens
cagcagagaaattaaacttctg

SEQ ID NO: 9251039 - DNA, 18 bp, Homo sapiens
cagcagagacattcaaaa

SEQ ID NO: 9251040 - DNA, 22 bp, Homo sapiens
cagcagagaaattacatatttg

SEQ ID NO: 9251041 - DNA, 22 bp, Homo sapiens
gggctcaggcctggcctctcac

SEQ ID NO: 9251042 - DNA, 22 bp, Homo sapiens
cagagctgtcatttgccagtga

SEQ ID NO: 9251043 - DNA, 22 bp, Homo sapiens
cagagctgtcatttgccagtga

SEQ ID NO: 9251044 - DNA, 22 bp, Homo sapiens
cagaggaagagatacaagccct

SEQ ID NO: 9251045 - DNA, 22 bp, Homo sapiens
cagaggaaatgggaaggagata

SEQ ID NO: 9251046 - DNA, 22 bp, Homo sapiens
cagaggaacgtttggattgatt

SEQ ID NO: 9251047 - DNA, 22 bp, Homo sapiens
cagagcttgaatgtccatggtt

SEQ ID NO: 9251048 - DNA, 22 bp, Homo sapiens
cagaggaaagtatttctggaag

SEQ ID NO: 9251049 - DNA, 22 bp, Homo sapiens
cagaggcaggaagatgggcagt

SEQ ID NO: 9251050 - DNA, 22 bp, Homo sapiens
cagaggcagaggtcatctctgg

SEQ ID NO: 9251051 - DNA, 22 bp, Homo sapiens
cagaggcagaatggagatttgg

SEQ ID NO: 9251052 - DNA, 22 bp, Homo sapiens
cagaggcagaatggagatttgg

SEQ ID NO: 9251053 - DNA, 22 bp, Homo sapiens
cagaggcagaggtcatctctgg

SEQ ID NO: 9251054 - DNA, 22 bp, Homo sapiens
cagaggcagaggtcatctctgg

SEQ ID NO: 9251055 - DNA, 22 bp, Homo sapiens
gggggcagtaacctcaaagtgt

SEQ ID NO: 9251056 - DNA, 22 bp, Homo sapiens
gggggcaggtctggaactttga

SEQ ID NO: 9251057 - DNA, 22 bp, Homo sapiens
gggggcaggtctggaactttga

SEQ ID NO: 9251058 - DNA, 19 bp, Homo sapiens
cagaggcactttctcttag

SEQ ID NO: 9251059 - DNA, 22 bp, Homo sapiens
gggggcagtaacctcaaagtgt

SEQ ID NO: 9251060 - DNA, 22 bp, Homo sapiens
gggggatgctcaggaggctgct

SEQ ID NO: 9251061 - DNA, 22 bp, Homo sapiens
gggggatgctcaggaggctgct

SEQ ID NO: 9251062 - DNA, 22 bp, Homo sapiens
gggggatgctcaggaggctgct

SEQ ID NO: 9251063 - DNA, 22 bp, Homo sapiens
gggggcagaatgtactcttgtc

SEQ ID NO: 9251064 - DNA, 22 bp, Homo sapiens
gggggcagaatgtactcttgtc

SEQ ID NO: 9251065 - DNA, 22 bp, Homo sapiens
cagaggaagctgggtgtggagt

SEQ ID NO: 9251066 - DNA, 22 bp, Homo sapiens
cagaggaaggctctgggaatgt

SEQ ID NO: 9251067 - DNA, 22 bp, Homo sapiens
cagaggaagcagacacatcttg

SEQ ID NO: 9251068 - DNA, 22 bp, Homo sapiens
cagaggaagggtgctgcgaaag

SEQ ID NO: 9251069 - DNA, 22 bp, Homo sapiens
cagaggaagttccttgatgaga

SEQ ID NO: 9251070 - DNA, 22 bp, Homo sapiens
cagaggacaatagaatggaaag

SEQ ID NO: 9251071 - DNA, 22 bp, Homo sapiens
gggggaggtgaatgcaataagg

SEQ ID NO: 9251072 - DNA, 22 bp, Homo sapiens
gggggaggtgaatgcaataagg

SEQ ID NO: 9251073 - DNA, 22 bp, Homo sapiens
gggggaggtgaatgcaataagg

SEQ ID NO: 9251074 - DNA, 22 bp, Homo sapiens
gggggaggtgaatgcaataagg

SEQ ID NO: 9251075 - DNA, 22 bp, Homo sapiens
ggggcgccccgagggtgcgcac

SEQ ID NO: 9251076 - DNA, 22 bp, Homo sapiens
cagagagaatcttggcagctga

SEQ ID NO: 9251077 - DNA, 22 bp, Homo sapiens
cagagagaatatgtagtatgga

SEQ ID NO: 9251078 - DNA, 22 bp, Homo sapiens
cagagagaatcttggcagctga

SEQ ID NO: 9251079 - DNA, 18 bp, Homo sapiens
cagaagcaggcagtgcag

SEQ ID NO: 9251080 - DNA, 22 bp, Homo sapiens
cagagagaggggctgcctggcc

SEQ ID NO: 9251081 - DNA, 22 bp, Homo sapiens
cagagagaggccactgctatta

SEQ ID NO: 9251082 - DNA, 22 bp, Homo sapiens
cagagagagtcaaatctttgct

SEQ ID NO: 9251083 - DNA, 19 bp, Homo sapiens
cagagagaccaaggcgcca

SEQ ID NO: 9251084 - DNA, 22 bp, Homo sapiens
cagagagagcaggaaacctccg

SEQ ID NO: 9251085 - DNA, 19 bp, Homo sapiens
cagagagaccaaggcgcca

SEQ ID NO: 9251086 - DNA, 22 bp, Homo sapiens
cagagagagcaggaaacctccg

SEQ ID NO: 9251087 - DNA, 22 bp, Homo sapiens
cagagagagcaggaaacctccg

SEQ ID NO: 9251088 - DNA, 22 bp, Homo sapiens
cagagagaggccactgctatta

SEQ ID NO: 9251089 - DNA, 22 bp, Homo sapiens
cagagagaggccactgctatta

SEQ ID NO: 9251090 - DNA, 22 bp, Homo sapiens
cagaagcaagtagtgattcttt

SEQ ID NO: 9251091 - DNA, 22 bp, Homo sapiens
cagaagcaaatgccttgctgag

SEQ ID NO: 9251092 - DNA, 22 bp, Homo sapiens
cagaagcaaatgccttgctgag

SEQ ID NO: 9251093 - DNA, 22 bp, Homo sapiens
cagaagcaaatgccttgctgag

SEQ ID NO: 9251094 - DNA, 22 bp, Homo sapiens
cagaagcaaatgccttgctgag

SEQ ID NO: 9251095 - DNA, 22 bp, Homo sapiens
cagaagcactaggaggaaacgt

SEQ ID NO: 9251096 - DNA, 22 bp, Homo sapiens
cagaagcagaacactagattta

SEQ ID NO: 9251097 - DNA, 23 bp, Homo sapiens
cagaagcacctgttgactgctgc

SEQ ID NO: 9251098 - DNA, 22 bp, Homo sapiens
cagaagcacatgtttacatgta

SEQ ID NO: 9251099 - DNA, 23 bp, Homo sapiens
cagaagcacctgttgactgctgc

SEQ ID NO: 9251100 - DNA, 22 bp, Homo sapiens
cagaagcacatgtttacatgta

SEQ ID NO: 9251101 - DNA, 22 bp, Homo sapiens
cagagcagcctccagggggagc

SEQ ID NO: 9251102 - DNA, 21 bp, Homo sapiens
cagagcagcgttctgctgtgg

SEQ ID NO: 9251103 - DNA, 21 bp, Homo sapiens
cagagcagcgttctgctgtgg

SEQ ID NO: 9251104 - DNA, 22 bp, Homo sapiens
gggcgcgcacgccagacagcct

SEQ ID NO: 9251105 - DNA, 18 bp, Homo sapiens
gggccctggcgtccgccc

SEQ ID NO: 9251106 - DNA, 20 bp, Homo sapiens
gggccctgggattcagagca

SEQ ID NO: 9251107 - DNA, 22 bp, Homo sapiens
cagagcagagtgattgttctgg

SEQ ID NO: 9251108 - DNA, 18 bp, Homo sapiens
cagagcagaggtggagcg

SEQ ID NO: 9251109 - DNA, 22 bp, Homo sapiens
cagagcagatttctaagtattg

SEQ ID NO: 9251110 - DNA, 22 bp, Homo sapiens
cagagcagcagagcttccatgg

SEQ ID NO: 9251111 - DNA, 22 bp, Homo sapiens
gggccctggacgtggcggcaga

SEQ ID NO: 9251112 - DNA, 22 bp, Homo sapiens
gggccctggatttaagcatgga

SEQ ID NO: 9251113 - DNA, 22 bp, Homo sapiens
gggccctgcgtccggaagtctg

SEQ ID NO: 9251114 - DNA, 22 bp, Homo sapiens
gggccagctctgtgatgtaggg

SEQ ID NO: 9251115 - DNA, 22 bp, Homo sapiens
cagagagcttagtgtgctgcat

SEQ ID NO: 9251116 - DNA, 21 bp, Homo sapiens
cagagagctagaacttcatga

SEQ ID NO: 9251117 - DNA, 22 bp, Homo sapiens
cagagagcttagtgtgctgcat

SEQ ID NO: 9251118 - DNA, 22 bp, Homo sapiens
cagagagagtggggtgtggatt

SEQ ID NO: 9251119 - DNA, 22 bp, Homo sapiens
cagagagagtggggtgtggatt

SEQ ID NO: 9251120 - DNA, 22 bp, Homo sapiens
cagagagcacataggatacttt

SEQ ID NO: 9251121 - DNA, 22 bp, Homo sapiens
cagagagcacataggatacttt

SEQ ID NO: 9251122 - DNA, 22 bp, Homo sapiens
cagagagagtcaaatctttgct

SEQ ID NO: 9251123 - DNA, 22 bp, Homo sapiens
cagagagagtctgtccctgaag

SEQ ID NO: 9251124 - DNA, 22 bp, Homo sapiens
gctgaggtggagattgcagtga

SEQ ID NO: 9251125 - DNA, 22 bp, Homo sapiens
gctgaggtggagattgcagtga

SEQ ID NO: 9251126 - DNA, 19 bp, Homo sapiens
gctgaggtggaggaaggag

SEQ ID NO: 9251127 - DNA, 19 bp, Homo sapiens
gctgaggtggaggaaggag

SEQ ID NO: 9251128 - DNA, 19 bp, Homo sapiens
gctgaggtggaggaaggag

SEQ ID NO: 9251129 - DNA, 22 bp, Homo sapiens
gctggcagagagctggtgagga

SEQ ID NO: 9251130 - DNA, 22 bp, Homo sapiens
gctggcagagagctggtgagga

SEQ ID NO: 9251131 - DNA, 19 bp, Homo sapiens
gctggcagatgtggccgtg

SEQ ID NO: 9251132 - DNA, 22 bp, Homo sapiens
gctggcagcattagaccctggg

SEQ ID NO: 9251133 - DNA, 22 bp, Homo sapiens
gctggcagccaagtgaagaggg

SEQ ID NO: 9251134 - DNA, 22 bp, Homo sapiens
gctggccagtgtcccagggatc

SEQ ID NO: 9251135 - DNA, 22 bp, Homo sapiens
gctggcagccaagtgaagaggg

SEQ ID NO: 9251136 - DNA, 22 bp, Homo sapiens
gctggccagtgtggtgaccacc

SEQ ID NO: 9251137 - DNA, 22 bp, Homo sapiens
caaatttaggtaacagtctgta

SEQ ID NO: 9251138 - DNA, 22 bp, Homo sapiens
caaatttaggtaacagtctgta

SEQ ID NO: 9251139 - DNA, 22 bp, Homo sapiens
gctgaggtaggaggttgcagtg

SEQ ID NO: 9251140 - DNA, 23 bp, Homo sapiens
gctgaggtacatttacaggaaga

SEQ ID NO: 9251141 - DNA, 23 bp, Homo sapiens
gctgaggtacatttacaggaaga

SEQ ID NO: 9251142 - DNA, 22 bp, Homo sapiens
gctgaggtaggaggttgcagtg

SEQ ID NO: 9251143 - DNA, 22 bp, Homo sapiens
gctgaggtcaggagctgtgggg

SEQ ID NO: 9251144 - DNA, 20 bp, Homo sapiens
gctgaggtcattatgcctca

SEQ ID NO: 9251145 - DNA, 22 bp, Homo sapiens
gctgaggtcaggagctgtgggg

SEQ ID NO: 9251146 - DNA, 20 bp, Homo sapiens
gctgaggtccctgtggtttt

SEQ ID NO: 9251147 - DNA, 20 bp, Homo sapiens
gctgaggtccctgtggtttt

SEQ ID NO: 9251148 - DNA, 22 bp, Homo sapiens
gctgaggtccagcattcgccta

SEQ ID NO: 9251149 - DNA, 20 bp, Homo sapiens
gctgaggtcattatgcctca

SEQ ID NO: 9251150 - DNA, 23 bp, Homo sapiens
gctgaggtcctgctgagtggtgg

SEQ ID NO: 9251151 - DNA, 23 bp, Homo sapiens
gctgaggtcctgctgagtggtgg

SEQ ID NO: 9251152 - DNA, 22 bp, Homo sapiens
gctgaggtggagattgcagtga

SEQ ID NO: 9251153 - DNA, 22 bp, Homo sapiens
gctgaggtgaggctggaaagga

SEQ ID NO: 9251154 - DNA, 22 bp, Homo sapiens
gctgaggtgaggctggaaagga

SEQ ID NO: 9251155 - DNA, 22 bp, Homo sapiens
caaattgatctgtctttatgaa

SEQ ID NO: 9251156 - DNA, 22 bp, Homo sapiens
caaattcctcagaatcagaaaa

SEQ ID NO: 9251157 - DNA, 18 bp, Homo sapiens
caaattctcattgatttc

SEQ ID NO: 9251158 - DNA, 20 bp, Homo sapiens
gctgggctaccactggccct

SEQ ID NO: 9251159 - DNA, 22 bp, Homo sapiens
gctgggcccagatcccaggatc

SEQ ID NO: 9251160 - DNA, 22 bp, Homo sapiens
gctgggagccgtacctgtcacg

SEQ ID NO: 9251161 - DNA, 22 bp, Homo sapiens
gctggccatggggagtgaggag

SEQ ID NO: 9251162 - DNA, 22 bp, Homo sapiens
gctggccattctctttgagatg

SEQ ID NO: 9251163 - DNA, 22 bp, Homo sapiens
gctggccatggcctgcgccatc

SEQ ID NO: 9251164 - DNA, 22 bp, Homo sapiens
gctggccatatattttgctgtt

SEQ ID NO: 9251165 - DNA, 22 bp, Homo sapiens
gctggccatagaagccaaagag

SEQ ID NO: 9251166 - DNA, 22 bp, Homo sapiens
gctgggagccctggtctgctcc

SEQ ID NO: 9251167 - DNA, 22 bp, Homo sapiens
gctgggagccctggtctgctcc

SEQ ID NO: 9251168 - DNA, 22 bp, Homo sapiens
gctgggagccccgagccagcgc

SEQ ID NO: 9251169 - DNA, 22 bp, Homo sapiens
gctgggagccccgagccagcgc

SEQ ID NO: 9251170 - DNA, 19 bp, Homo sapiens
gctgggagcagaccctccc

SEQ ID NO: 9251171 - DNA, 22 bp, Homo sapiens
gctgggagcaaagccatgcata

SEQ ID NO: 9251172 - DNA, 22 bp, Homo sapiens
gctgggagcaagtactcatctt

SEQ ID NO: 9251173 - DNA, 19 bp, Homo sapiens
gctgggagcagaccctccc

SEQ ID NO: 9251174 - DNA, 22 bp, Homo sapiens
gctgggagcaagtactcatctt

SEQ ID NO: 9251175 - DNA, 22 bp, Homo sapiens
gctgggagcaaagccatgcata

SEQ ID NO: 9251176 - DNA, 22 bp, Homo sapiens
caagttgtacagattgtattag

SEQ ID NO: 9251177 - DNA, 22 bp, Homo sapiens
caagttacattagaaatcatgc

SEQ ID NO: 9251178 - DNA, 22 bp, Homo sapiens
caagttcacgttgctttttgag

SEQ ID NO: 9251179 - DNA, 21 bp, Homo sapiens
caagtgtggatgtggaaggta

SEQ ID NO: 9251180 - DNA, 21 bp, Homo sapiens
caagtgtggatgtggaaggta

SEQ ID NO: 9251181 - DNA, 22 bp, Homo sapiens
caagtgtctatatcagtgcttg

SEQ ID NO: 9251182 - DNA, 20 bp, Homo sapiens
caagtgttattgtgcattta

SEQ ID NO: 9251183 - DNA, 22 bp, Homo sapiens
caagttaattggtattttgatc

SEQ ID NO: 9251184 - DNA, 22 bp, Homo sapiens
caagttaaatttgcatttcaga

SEQ ID NO: 9251185 - DNA, 20 bp, Homo sapiens
caagtgtagaaactaataag

SEQ ID NO: 9251186 - DNA, 22 bp, Homo sapiens
caagtcaatgattataagagtc

SEQ ID NO: 9251187 - DNA, 22 bp, Homo sapiens
caatcccatcaccatctgctct

SEQ ID NO: 9251188 - DNA, 22 bp, Homo sapiens
caatctataaatatcagtttcc

SEQ ID NO: 9251189 - DNA, 22 bp, Homo sapiens
caatctatcctctgattttgta

SEQ ID NO: 9251190 - DNA, 22 bp, Homo sapiens
caatctatagagctttagacta

SEQ ID NO: 9251191 - DNA, 22 bp, Homo sapiens
caatgcacgctcagatttgacc

SEQ ID NO: 9251192 - DNA, 22 bp, Homo sapiens
caatgcacatggacatcaggct

SEQ ID NO: 9251193 - DNA, 22 bp, Homo sapiens
caatgcatacttcgaaatttca

SEQ ID NO: 9251194 - DNA, 22 bp, Homo sapiens
caatgcaatgcaatgcaatgca

SEQ ID NO: 9251195 - DNA, 22 bp, Homo sapiens
caatgcaatgcaatgcaatgca

SEQ ID NO: 9251196 - DNA, 22 bp, Homo sapiens
gctggtgctctgggccctgagg

SEQ ID NO: 9251197 - DNA, 22 bp, Homo sapiens
gctggtgccttgttgttgttac

SEQ ID NO: 9251198 - DNA, 22 bp, Homo sapiens
gctggtgcattagctgcagttc

SEQ ID NO: 9251199 - DNA, 22 bp, Homo sapiens
gctggtgagcaaaggagaagga

SEQ ID NO: 9251200 - DNA, 22 bp, Homo sapiens
gctggtgagcaaaggagaagga

SEQ ID NO: 9251201 - DNA, 22 bp, Homo sapiens
gctggtgattgcctcaggaggc

SEQ ID NO: 9251202 - DNA, 22 bp, Homo sapiens
gctggtgattgcctcaggaggc

SEQ ID NO: 9251203 - DNA, 22 bp, Homo sapiens
gctggtgattgcctcaggaggc

SEQ ID NO: 9251204 - DNA, 22 bp, Homo sapiens
gctggtgcattagctgcagttc

SEQ ID NO: 9251205 - DNA, 22 bp, Homo sapiens
gctggtgcattagctgcagttc

SEQ ID NO: 9251206 - DNA, 22 bp, Homo sapiens
gctggtcctggggttgcagcat

SEQ ID NO: 9251207 - DNA, 22 bp, Homo sapiens
ggaaatgtaatcacagagggtt

SEQ ID NO: 9251208 - DNA, 22 bp, Homo sapiens
ggaacacagaagggctgaaaaa

SEQ ID NO: 9251209 - DNA, 17 bp, Homo sapiens
ggaacaaatactatgca

SEQ ID NO: 9251210 - DNA, 22 bp, Homo sapiens
ggaacactcgtcaaatagcggg

SEQ ID NO: 9251211 - DNA, 22 bp, Homo sapiens
ggaacactgccttttattttcc

SEQ ID NO: 9251212 - DNA, 22 bp, Homo sapiens
ggaacactcagaaatgctcgtc

SEQ ID NO: 9251213 - DNA, 22 bp, Homo sapiens
ggaacacagtgccttacaaact

SEQ ID NO: 9251214 - DNA, 22 bp, Homo sapiens
ggaacacagtgccttacaaact

SEQ ID NO: 9251215 - DNA, 22 bp, Homo sapiens
gcttccagcaccagcagagggg

SEQ ID NO: 9251216 - DNA, 19 bp, Homo sapiens
gcttccagcactgcaggag

SEQ ID NO: 9251217 - DNA, 19 bp, Homo sapiens
gcttccagcactgcaggag

SEQ ID NO: 9251218 - DNA, 19 bp, Homo sapiens
gcttccagcactgcaggag

SEQ ID NO: 9251219 - DNA, 20 bp, Homo sapiens
gcttccaggagggctgatat

SEQ ID NO: 9251220 - DNA, 20 bp, Homo sapiens
gcttccaggagggctgatat

SEQ ID NO: 9251221 - DNA, 22 bp, Homo sapiens
gcttccagggctcagtcactgc

SEQ ID NO: 9251222 - DNA, 22 bp, Homo sapiens
ggaaatcttccttcactctttc

SEQ ID NO: 9251223 - DNA, 22 bp, Homo sapiens
ggaaacaaaccactcatggtgg

SEQ ID NO: 9251224 - DNA, 22 bp, Homo sapiens
ggaaaatttccttcaaaatgtg

SEQ ID NO: 9251225 - DNA, 22 bp, Homo sapiens
gcttccagggctcagtcactgc

SEQ ID NO: 9251226 - DNA, 22 bp, Homo sapiens
gcttccagaatgactaggatgt

SEQ ID NO: 9251227 - DNA, 22 bp, Homo sapiens
caatgtaaatattttctaatca

SEQ ID NO: 9251228 - DNA, 22 bp, Homo sapiens
caatgtaaatattttctaatca

SEQ ID NO: 9251229 - DNA, 22 bp, Homo sapiens
gcttccagacgatcatgtaaga

SEQ ID NO: 9251230 - DNA, 22 bp, Homo sapiens
gcttccagaccccagtccctca

SEQ ID NO: 9251231 - DNA, 21 bp, Homo sapiens
caatggcgagatcttggctca

SEQ ID NO: 9251232 - DNA, 22 bp, Homo sapiens
caatggtggtgtcagaagagat

SEQ ID NO: 9251233 - DNA, 22 bp, Homo sapiens
caatggttctcaaactatcatg

SEQ ID NO: 9251234 - DNA, 22 bp, Homo sapiens
caatgggcctggagagagctgg

SEQ ID NO: 9251235 - DNA, 22 bp, Homo sapiens
caatgcttctcattagccaatg

SEQ ID NO: 9251236 - DNA, 22 bp, Homo sapiens
caatgcttctgagggaattaca

SEQ ID NO: 9251237 - DNA, 22 bp, Homo sapiens
caatgcttttagcttcagcttg

SEQ ID NO: 9251238 - DNA, 22 bp, Homo sapiens
caatgcttttagcttcagcttg

SEQ ID NO: 9251239 - DNA, 22 bp, Homo sapiens
caatgcttttgttctttactca

SEQ ID NO: 9251240 - DNA, 22 bp, Homo sapiens
cacaggagaacccacagattct

SEQ ID NO: 9251241 - DNA, 22 bp, Homo sapiens
cacaggagattgatctattggt

SEQ ID NO: 9251242 - DNA, 22 bp, Homo sapiens
ggaggggccggctgcctgccac

SEQ ID NO: 9251243 - DNA, 22 bp, Homo sapiens
ggaggggcatagttcaccatca

SEQ ID NO: 9251244 - DNA, 22 bp, Homo sapiens
ggaggggccggctgcctgccac

SEQ ID NO: 9251245 - DNA, 22 bp, Homo sapiens
ggaggggcagccatggaactcc

SEQ ID NO: 9251246 - DNA, 22 bp, Homo sapiens
ggaggggcaggtcccaagttgt

SEQ ID NO: 9251247 - DNA, 22 bp, Homo sapiens
ggaggggcaggtcccaagttgt

SEQ ID NO: 9251248 - DNA, 22 bp, Homo sapiens
ggaggggatttagtagatgcta

SEQ ID NO: 9251249 - DNA, 22 bp, Homo sapiens
ggaggggcagccatggaactcc

SEQ ID NO: 9251250 - DNA, 22 bp, Homo sapiens
cacagccttactgagatccact

SEQ ID NO: 9251251 - DNA, 22 bp, Homo sapiens
cacagctgaagtagccatgtgg

SEQ ID NO: 9251252 - DNA, 22 bp, Homo sapiens
ggagggagtttcattcctgccc

SEQ ID NO: 9251253 - DNA, 22 bp, Homo sapiens
ggagggcaacttttcagtaggt

SEQ ID NO: 9251254 - DNA, 22 bp, Homo sapiens
cacagctaggaggaaagcagag

SEQ ID NO: 9251255 - DNA, 22 bp, Homo sapiens
cacagctaggaggaaagcagag

SEQ ID NO: 9251256 - DNA, 22 bp, Homo sapiens
ggaggggatggtttgaccctgg

SEQ ID NO: 9251257 - DNA, 22 bp, Homo sapiens
ggaggggatttagtagatgcta

SEQ ID NO: 9251258 - DNA, 20 bp, Homo sapiens
ggagctggcatccagcctct

SEQ ID NO: 9251259 - DNA, 22 bp, Homo sapiens
ggagctggccctctgagtttgt

SEQ ID NO: 9251260 - DNA, 22 bp, Homo sapiens
ggaggactcaggtctggccatg

SEQ ID NO: 9251261 - DNA, 22 bp, Homo sapiens
ggagcagcttgcatgctcaggg

SEQ ID NO: 9251262 - DNA, 22 bp, Homo sapiens
ggaggagcacttctgagctcag

SEQ ID NO: 9251263 - DNA, 22 bp, Homo sapiens
ggaggagcacttctgagctcag

SEQ ID NO: 9251264 - DNA, 22 bp, Homo sapiens
ggaggagcacttctgagctcag

SEQ ID NO: 9251265 - DNA, 22 bp, Homo sapiens
ggaggagattcccctctcactt

SEQ ID NO: 9251266 - DNA, 22 bp, Homo sapiens
ggaggagcacttgacggggtct

SEQ ID NO: 9251267 - DNA, 22 bp, Homo sapiens
ggaggagcacttgacggggtct

SEQ ID NO: 9251268 - DNA, 22 bp, Homo sapiens
ggaggagcatgagagggtagtg

SEQ ID NO: 9251269 - DNA, 22 bp, Homo sapiens
ggaggagacggagtgattagtg

SEQ ID NO: 9251270 - DNA, 22 bp, Homo sapiens
ggaggagacggagtgattagtg

SEQ ID NO: 9251271 - DNA, 22 bp, Homo sapiens
cacagcagtctttcactaaata

SEQ ID NO: 9251272 - DNA, 22 bp, Homo sapiens
cacagcagtctttcactaaata

SEQ ID NO: 9251273 - DNA, 22 bp, Homo sapiens
cacagcaggtgcttaatgatta

SEQ ID NO: 9251274 - DNA, 22 bp, Homo sapiens
cacagcataatgaaatatactt

SEQ ID NO: 9251275 - DNA, 22 bp, Homo sapiens
cacagcataatgaaatatactt

SEQ ID NO: 9251276 - DNA, 22 bp, Homo sapiens
cacagcagggatgaatggagtg

SEQ ID NO: 9251277 - DNA, 22 bp, Homo sapiens
cacagcccccttgacactctgg

SEQ ID NO: 9251278 - DNA, 22 bp, Homo sapiens
ggagcagccacgtctcagggca

SEQ ID NO: 9251279 - DNA, 22 bp, Homo sapiens
ggagcagccgcgtctcagggca

SEQ ID NO: 9251280 - DNA, 22 bp, Homo sapiens
ggacagctgctttcaggccaca

SEQ ID NO: 9251281 - DNA, 22 bp, Homo sapiens
ggacagctcctgcacttgagta

SEQ ID NO: 9251282 - DNA, 22 bp, Homo sapiens
ggacagcgtggctggtggaggg

SEQ ID NO: 9251283 - DNA, 22 bp, Homo sapiens
ggacagcgtggctggtggaggg

SEQ ID NO: 9251284 - DNA, 17 bp, Homo sapiens
ggagagtgggaatggcc

SEQ ID NO: 9251285 - DNA, 16 bp, Homo sapiens
ggagagtgtctgcaaa

SEQ ID NO: 9251286 - DNA, 22 bp, Homo sapiens
ggagagtgggagcaactgttgc

SEQ ID NO: 9251287 - DNA, 22 bp, Homo sapiens
ggagagtggattccagctgtat

SEQ ID NO: 9251288 - DNA, 18 bp, Homo sapiens
ggagagtgacagagtcgt

SEQ ID NO: 9251289 - DNA, 22 bp, Homo sapiens
ggagagtggattccagctgtat

SEQ ID NO: 9251290 - DNA, 18 bp, Homo sapiens
ggagagtgagatcaaaca

SEQ ID NO: 9251291 - DNA, 22 bp, Homo sapiens
ggagagctgacatcatgatgtt

SEQ ID NO: 9251292 - DNA, 22 bp, Homo sapiens
ggagagctgacatcatgatgtt

SEQ ID NO: 9251293 - DNA, 22 bp, Homo sapiens
cacagagaatactgctcttgct

SEQ ID NO: 9251294 - DNA, 22 bp, Homo sapiens
cacagagaatgatgagtcactg

SEQ ID NO: 9251295 - DNA, 22 bp, Homo sapiens
cacagagaactgtgggagtgtg

SEQ ID NO: 9251296 - DNA, 22 bp, Homo sapiens
ggagatagtccaggtgaaggga

SEQ ID NO: 9251297 - DNA, 22 bp, Homo sapiens
ggagatagtccaggtgaaggga

SEQ ID NO: 9251298 - DNA, 23 bp, Homo sapiens
ggagatctaggttggcatttcct

SEQ ID NO: 9251299 - DNA, 22 bp, Homo sapiens
cacagagacagatctattttgc

SEQ ID NO: 9251300 - DNA, 22 bp, Homo sapiens
cacagagacagaagcacttatg

SEQ ID NO: 9251301 - DNA, 22 bp, Homo sapiens
cacagagaattcccatatgtga

SEQ ID NO: 9251302 - DNA, 22 bp, Homo sapiens
cacagagaatgatgagtcactg

SEQ ID NO: 9251303 - DNA, 22 bp, Homo sapiens
cacagagaattcccatatgtga

SEQ ID NO: 9251304 - DNA, 22 bp, Homo sapiens
cacagagacatgatgtcattgc

SEQ ID NO: 9251305 - DNA, 22 bp, Homo sapiens
cacagagaccccttctggggcc

SEQ ID NO: 9251306 - DNA, 22 bp, Homo sapiens
cacagcaaagacactctcaact

SEQ ID NO: 9251307 - DNA, 22 bp, Homo sapiens
cacagagacatgatgtcattgc

SEQ ID NO: 9251308 - DNA, 22 bp, Homo sapiens
ggacacagataatcacacagat

SEQ ID NO: 9251309 - DNA, 22 bp, Homo sapiens
ggacagagggttgacagagtat

SEQ ID NO: 9251310 - DNA, 22 bp, Homo sapiens
ggacagcacagctcttgacaac

SEQ ID NO: 9251311 - DNA, 22 bp, Homo sapiens
ggacacagacctttctgttcta

SEQ ID NO: 9251312 - DNA, 19 bp, Homo sapiens
ggacacagaaagctgcatt

SEQ ID NO: 9251313 - DNA, 19 bp, Homo sapiens
ggacacagaaagctgcatt

SEQ ID NO: 9251314 - DNA, 22 bp, Homo sapiens
ggacaagcctgtgagtgggttt

SEQ ID NO: 9251315 - DNA, 22 bp, Homo sapiens
ggacaagcctgtgagtgggttt

SEQ ID NO: 9251316 - DNA, 22 bp, Homo sapiens
ggacaagcctcagacaaaactc

SEQ ID NO: 9251317 - DNA, 22 bp, Homo sapiens
ggaacactgccttttattttcc

SEQ ID NO: 9251318 - DNA, 22 bp, Homo sapiens
ggaacaggaaaggagggatgct

SEQ ID NO: 9251319 - DNA, 22 bp, Homo sapiens
ggaacagggatttggcctggtt

SEQ ID NO: 9251320 - DNA, 22 bp, Homo sapiens
ggaagacagaagcctacagctt

SEQ ID NO: 9251321 - DNA, 22 bp, Homo sapiens
ggaagagagggctgggcctcaa

SEQ ID NO: 9251322 - DNA, 22 bp, Homo sapiens
ggaagagaatgatggctatggg

SEQ ID NO: 9251323 - DNA, 19 bp, Homo sapiens
ggaagagaggaaaggtgga

SEQ ID NO: 9251324 - DNA, 22 bp, Homo sapiens
ggctgctgtgacctcaggtgat

SEQ ID NO: 9251325 - DNA, 21 bp, Homo sapiens
ggctgctgtcaccgctgtcac

SEQ ID NO: 9251326 - DNA, 22 bp, Homo sapiens
cagaaatgtactgacatgcagt

SEQ ID NO: 9251327 - DNA, 22 bp, Homo sapiens
cagaaatggagcccaggaatct

SEQ ID NO: 9251328 - DNA, 22 bp, Homo sapiens
cagaaatggagcccaggaatct

SEQ ID NO: 9251329 - DNA, 19 bp, Homo sapiens
ggctgctggttacagaggc

SEQ ID NO: 9251330 - DNA, 22 bp, Homo sapiens
ggctgctggtggaatggtaggc

SEQ ID NO: 9251331 - DNA, 22 bp, Homo sapiens
ggctgctggtggaatggtaggc

SEQ ID NO: 9251332 - DNA, 22 bp, Homo sapiens
ggctgctggtaggggtaggaag

SEQ ID NO: 9251333 - DNA, 22 bp, Homo sapiens
ggctgctggtaggggtaggaag

SEQ ID NO: 9251334 - DNA, 22 bp, Homo sapiens
ggctgctgtactgatgtcagtt

SEQ ID NO: 9251335 - DNA, 22 bp, Homo sapiens
ggctgctgtactgatgtcagtt

SEQ ID NO: 9251336 - DNA, 22 bp, Homo sapiens
ggctgctgtactgatgtcagtt

SEQ ID NO: 9251337 - DNA, 22 bp, Homo sapiens
ggctgggacgatgaggattagt

SEQ ID NO: 9251338 - DNA, 22 bp, Homo sapiens
ggctgggagccccacagagtca

SEQ ID NO: 9251339 - DNA, 22 bp, Homo sapiens
ggctgggagccccacagagtca

SEQ ID NO: 9251340 - DNA, 22 bp, Homo sapiens
ggctgggagccccacagagtca

SEQ ID NO: 9251341 - DNA, 22 bp, Homo sapiens
ggctgggacgatgaggattagt

SEQ ID NO: 9251342 - DNA, 22 bp, Homo sapiens
ggctgggacgatgaggattagt

SEQ ID NO: 9251343 - DNA, 23 bp, Homo sapiens
ggctgggagctccgggtgcacgt

SEQ ID NO: 9251344 - DNA, 22 bp, Homo sapiens
ggctgggagccccacagagtca

SEQ ID NO: 9251345 - DNA, 22 bp, Homo sapiens
ggctgggagccccacagagtca

SEQ ID NO: 9251346 - DNA, 23 bp, Homo sapiens
ggctgggagctccgggtgcacgt

SEQ ID NO: 9251347 - DNA, 23 bp, Homo sapiens
ggctgggagctccgggtgcacgt

SEQ ID NO: 9251348 - DNA, 22 bp, Homo sapiens
cagaaattggaatagagaaata

SEQ ID NO: 9251349 - DNA, 22 bp, Homo sapiens
cagaaattcccatttcagattc

SEQ ID NO: 9251350 - DNA, 22 bp, Homo sapiens
cagaacacattttcagagtcaa

SEQ ID NO: 9251351 - DNA, 22 bp, Homo sapiens
cagaagagatgaaatagtatta

SEQ ID NO: 9251352 - DNA, 22 bp, Homo sapiens
cagaagaggactgggtagctca

SEQ ID NO: 9251353 - DNA, 22 bp, Homo sapiens
cagaagagatgaaatagtatta

SEQ ID NO: 9251354 - DNA, 22 bp, Homo sapiens
cagaacattccatgtgccctgc

SEQ ID NO: 9251355 - DNA, 22 bp, Homo sapiens
cagaagagtagctgaacaagtt

SEQ ID NO: 9251356 - DNA, 20 bp, Homo sapiens
cagaacatgagcatcgagcc

SEQ ID NO: 9251357 - DNA, 22 bp, Homo sapiens
cagaacattcactcatatgtgg

SEQ ID NO: 9251358 - DNA, 19 bp, Homo sapiens
cagaacaggaccaggggcc

SEQ ID NO: 9251359 - DNA, 23 bp, Homo sapiens
ggcttcttgcctgtcttggtgct

SEQ ID NO: 9251360 - DNA, 22 bp, Homo sapiens
ggcttgaagactatgacatttc

SEQ ID NO: 9251361 - DNA, 22 bp, Homo sapiens
ggcttctttttagtaaatgtca

SEQ ID NO: 9251362 - DNA, 22 bp, Homo sapiens
ggctgggagctggacaggccgg

SEQ ID NO: 9251363 - DNA, 17 bp, Homo sapiens
ggcttcagggagctggg

SEQ ID NO: 9251364 - DNA, 22 bp, Homo sapiens
ggcttcttcctggctcctatta

SEQ ID NO: 9251365 - DNA, 22 bp, Homo sapiens
ggcttcttcctggctcctatta

SEQ ID NO: 9251366 - DNA, 19 bp, Homo sapiens
ggcttcagggagttagcat

SEQ ID NO: 9251367 - DNA, 22 bp, Homo sapiens
ggcttggaccagtcacagtggt

SEQ ID NO: 9251368 - DNA, 22 bp, Homo sapiens
ggcttggcagaggtgggtgctt

SEQ ID NO: 9251369 - DNA, 23 bp, Homo sapiens
ggcttgagctggaacagcttggt

SEQ ID NO: 9251370 - DNA, 22 bp, Homo sapiens
ggcttgagacccgggagccaga

SEQ ID NO: 9251371 - DNA, 22 bp, Homo sapiens
ggcttggaaattgcaggacaca

SEQ ID NO: 9251372 - DNA, 22 bp, Homo sapiens
ggctgcagatagccagccacca

SEQ ID NO: 9251373 - DNA, 22 bp, Homo sapiens
ggctgcagatagccagccacca

SEQ ID NO: 9251374 - DNA, 22 bp, Homo sapiens
ggctgcagatagccagccacca

SEQ ID NO: 9251375 - DNA, 22 bp, Homo sapiens
ggctgcagattgtagtctgtta

SEQ ID NO: 9251376 - DNA, 22 bp, Homo sapiens
ggctgcagattgtagtctgtta

SEQ ID NO: 9251377 - DNA, 22 bp, Homo sapiens
ggctgcagattgtagtctgtta

SEQ ID NO: 9251378 - DNA, 22 bp, Homo sapiens
ggctgaggctcatgccatcttg

SEQ ID NO: 9251379 - DNA, 22 bp, Homo sapiens
cactgcctgctggctgtcactt

SEQ ID NO: 9251380 - DNA, 22 bp, Homo sapiens
cactgcctccccaggctccaca

SEQ ID NO: 9251381 - DNA, 22 bp, Homo sapiens
ggctgcagaggcgatctgaggt

SEQ ID NO: 9251382 - DNA, 22 bp, Homo sapiens
ggctgcagaggcgatctgaggt

SEQ ID NO: 9251383 - DNA, 22 bp, Homo sapiens
ggctgaggctcatgccatcttg

SEQ ID NO: 9251384 - DNA, 22 bp, Homo sapiens
ggctgcagcggattggggattg

SEQ ID NO: 9251385 - DNA, 22 bp, Homo sapiens
cactgtctattaatataactta

SEQ ID NO: 9251386 - DNA, 22 bp, Homo sapiens
cactgtctattaatataactta

SEQ ID NO: 9251387 - DNA, 22 bp, Homo sapiens
ggctgcagccctcgcctagcca

SEQ ID NO: 9251388 - DNA, 22 bp, Homo sapiens
ggctgcagccctcgcctagcca

SEQ ID NO: 9251389 - DNA, 22 bp, Homo sapiens
ggctgcagccctcgcctagcca

SEQ ID NO: 9251390 - DNA, 22 bp, Homo sapiens
ggctgcagccctcgcctagcca

SEQ ID NO: 9251391 - DNA, 22 bp, Homo sapiens
ggctgcagcagagggactcacg

SEQ ID NO: 9251392 - DNA, 22 bp, Homo sapiens
ggctgcagcagagggactcacg

SEQ ID NO: 9251393 - DNA, 22 bp, Homo sapiens
cactgtgctcctaactagctgt

SEQ ID NO: 9251394 - DNA, 22 bp, Homo sapiens
ggctgcctcaaagctcaagctc

SEQ ID NO: 9251395 - DNA, 22 bp, Homo sapiens
cactgtcttttgtgaagacaat

SEQ ID NO: 9251396 - DNA, 22 bp, Homo sapiens
cactgtcttttgtgaagacaat

SEQ ID NO: 9251397 - DNA, 22 bp, Homo sapiens
cactgtcttttgtgaagacaat

SEQ ID NO: 9251398 - DNA, 22 bp, Homo sapiens
ggctgccttgaccctggctccg

SEQ ID NO: 9251399 - DNA, 22 bp, Homo sapiens
cactgtcttgattactatgggt

SEQ ID NO: 9251400 - DNA, 22 bp, Homo sapiens
cactgtcttcagtttcactgca

SEQ ID NO: 9251401 - DNA, 22 bp, Homo sapiens
cactgtcttcagtttcactgca

SEQ ID NO: 9251402 - DNA, 22 bp, Homo sapiens
cactgtctgtgtgtccttgggg

SEQ ID NO: 9251403 - DNA, 22 bp, Homo sapiens
cactgtctgagctggtgattag

SEQ ID NO: 9251404 - DNA, 22 bp, Homo sapiens
cactgtctgcttcgactcttca

SEQ ID NO: 9251405 - DNA, 22 bp, Homo sapiens
cactgtctcctagggggacttc

SEQ ID NO: 9251406 - DNA, 22 bp, Homo sapiens
cactgtctgagctggtgattag

SEQ ID NO: 9251407 - DNA, 22 bp, Homo sapiens
cactgtctgcttcgactcttca

SEQ ID NO: 9251408 - DNA, 22 bp, Homo sapiens
cactgtctgggacatgtggtct

SEQ ID NO: 9251409 - DNA, 22 bp, Homo sapiens
ggctgctcaaggactctgatcg

SEQ ID NO: 9251410 - DNA, 22 bp, Homo sapiens
ggctgcggatctaaggctggga

SEQ ID NO: 9251411 - DNA, 22 bp, Homo sapiens
ggctgctgggtcatgatgcaga

SEQ ID NO: 9251412 - DNA, 22 bp, Homo sapiens
ggcgctggccacggtggctctg

SEQ ID NO: 9251413 - DNA, 22 bp, Homo sapiens
ggcgctcagtgttgccccagag

SEQ ID NO: 9251414 - DNA, 22 bp, Homo sapiens
cactgattaagtctgctagagg

SEQ ID NO: 9251415 - DNA, 22 bp, Homo sapiens
cactgagttccctgacatttca

SEQ ID NO: 9251416 - DNA, 22 bp, Homo sapiens
cactgagttccctgacatttca

SEQ ID NO: 9251417 - DNA, 22 bp, Homo sapiens
cactgcaacaacctctacctcc

SEQ ID NO: 9251418 - DNA, 22 bp, Homo sapiens
cactgcaacctcagactcctgg

SEQ ID NO: 9251419 - DNA, 22 bp, Homo sapiens
cactgcaacctccacctcctgg

SEQ ID NO: 9251420 - DNA, 22 bp, Homo sapiens
ggctccagtttccccttggggc

SEQ ID NO: 9251421 - DNA, 22 bp, Homo sapiens
ggctccagtttccccttggggc

SEQ ID NO: 9251422 - DNA, 22 bp, Homo sapiens
cactgcaacctccacctcctgg

SEQ ID NO: 9251423 - DNA, 22 bp, Homo sapiens
ggctcctgtcctcctggagctc

SEQ ID NO: 9251424 - DNA, 22 bp, Homo sapiens
ggctcctgtggcaagacagctt

SEQ ID NO: 9251425 - DNA, 22 bp, Homo sapiens
ggctcctgtcccctcagctgct

SEQ ID NO: 9251426 - DNA, 22 bp, Homo sapiens
ggctcctgtcccctcagctgct

SEQ ID NO: 9251427 - DNA, 22 bp, Homo sapiens
ggctcctgtcccctcagctgct

SEQ ID NO: 9251428 - DNA, 22 bp, Homo sapiens
cactgcccagcgtcttaggcac

SEQ ID NO: 9251429 - DNA, 19 bp, Homo sapiens
ggctcctgtggctgcagcc

SEQ ID NO: 9251430 - DNA, 19 bp, Homo sapiens
ggctcctgtggctgcagcc

SEQ ID NO: 9251431 - DNA, 22 bp, Homo sapiens
cactgcccaggacctgccaccc

SEQ ID NO: 9251432 - DNA, 22 bp, Homo sapiens
cactgccctgggggttgccatc

SEQ ID NO: 9251433 - DNA, 22 bp, Homo sapiens
cactgcccttacatgccctgca

SEQ ID NO: 9251434 - DNA, 22 bp, Homo sapiens
cactgccctcactgtggttctc

SEQ ID NO: 9251435 - DNA, 22 bp, Homo sapiens
cactgccctcactgtggttctc

SEQ ID NO: 9251436 - DNA, 20 bp, Homo sapiens
cactgccctccagcctgagc

SEQ ID NO: 9251437 - DNA, 22 bp, Homo sapiens
ggccccagcctcagtcccctga

SEQ ID NO: 9251438 - DNA, 17 bp, Homo sapiens
ggcctgtgtggctgcag

SEQ ID NO: 9251439 - DNA, 17 bp, Homo sapiens
ggcctgtgtggctgcag

SEQ ID NO: 9251440 - DNA, 22 bp, Homo sapiens
ggcgagggaagtttactgtgag

SEQ ID NO: 9251441 - DNA, 22 bp, Homo sapiens
ggcgagggagcagtgcggtggg

SEQ ID NO: 9251442 - DNA, 22 bp, Homo sapiens
ggcgcaggccttggatcctggt

SEQ ID NO: 9251443 - DNA, 22 bp, Homo sapiens
ggccccagcagaccctcctctg

SEQ ID NO: 9251444 - DNA, 22 bp, Homo sapiens
ggccccagcagaccctcctctg

SEQ ID NO: 9251445 - DNA, 22 bp, Homo sapiens
ggccccagcagtgcttgtttat

SEQ ID NO: 9251446 - DNA, 22 bp, Homo sapiens
ggcccagcacagtgcttggggg

SEQ ID NO: 9251447 - DNA, 22 bp, Homo sapiens
ggcccagacccaagagtggtgg

SEQ ID NO: 9251448 - DNA, 22 bp, Homo sapiens
cacccaggacaaaatatggaat

SEQ ID NO: 9251449 - DNA, 22 bp, Homo sapiens
cacccagcttttgcatcctccg

SEQ ID NO: 9251450 - DNA, 22 bp, Homo sapiens
cacccagccttcacacaggagt

SEQ ID NO: 9251451 - DNA, 22 bp, Homo sapiens
cacccagcattggctaagagag

SEQ ID NO: 9251452 - DNA, 22 bp, Homo sapiens
cacccagcattggctaagagag

SEQ ID NO: 9251453 - DNA, 22 bp, Homo sapiens
cacccagcagcacttaagacta

SEQ ID NO: 9251454 - DNA, 22 bp, Homo sapiens
cacccagcagcacttaagacta

SEQ ID NO: 9251455 - DNA, 22 bp, Homo sapiens
cacccaggcaggtggctgagaa

SEQ ID NO: 9251456 - DNA, 22 bp, Homo sapiens
cacccaggcaggtggctgagaa

SEQ ID NO: 9251457 - DNA, 22 bp, Homo sapiens
cacccaggcatgggttgagatg

SEQ ID NO: 9251458 - DNA, 22 bp, Homo sapiens
cacccaggctagagtgcagtgg

SEQ ID NO: 9251459 - DNA, 22 bp, Homo sapiens
cacccaggctagagtgcagtgg

SEQ ID NO: 9251460 - DNA, 22 bp, Homo sapiens
cacccaggctagagtgcagtgg

SEQ ID NO: 9251461 - DNA, 22 bp, Homo sapiens
ggccagggcctggggactgtcc

SEQ ID NO: 9251462 - DNA, 22 bp, Homo sapiens
cacccaggcaggtggctgagaa

SEQ ID NO: 9251463 - DNA, 22 bp, Homo sapiens
cacccaggacaggccagatgtg

SEQ ID NO: 9251464 - DNA, 22 bp, Homo sapiens
cacatttttactgccaacttaa

SEQ ID NO: 9251465 - DNA, 19 bp, Homo sapiens
cacattttgagtctgagat

SEQ ID NO: 9251466 - DNA, 22 bp, Homo sapiens
cacatttttactgccaacttaa

SEQ ID NO: 9251467 - DNA, 18 bp, Homo sapiens
ggccagccccaggccagc

SEQ ID NO: 9251468 - DNA, 22 bp, Homo sapiens
cacatgcagtttacgtcactga

SEQ ID NO: 9251469 - DNA, 22 bp, Homo sapiens
cacatgcatacctatgtgtata

SEQ ID NO: 9251470 - DNA, 22 bp, Homo sapiens
cacatgcattggcaaaagtgta

SEQ ID NO: 9251471 - DNA, 22 bp, Homo sapiens
cacatgcccagaacttctcatt

SEQ ID NO: 9251472 - DNA, 22 bp, Homo sapiens
ggcaggagaaaggtctcttctt

SEQ ID NO: 9251473 - DNA, 22 bp, Homo sapiens
ggcaggacagtcccagttcaaa

SEQ ID NO: 9251474 - DNA, 20 bp, Homo sapiens
ggcaggaccccagtggcatc

SEQ ID NO: 9251475 - DNA, 20 bp, Homo sapiens
ggcaggacccggtagggagc

SEQ ID NO: 9251476 - DNA, 22 bp, Homo sapiens
ggcagtcacaggggagactggg

SEQ ID NO: 9251477 - DNA, 22 bp, Homo sapiens
ggcagtcaagagggagtctgaa

SEQ ID NO: 9251478 - DNA, 22 bp, Homo sapiens
ggcagtcaagagggagtctgaa

SEQ ID NO: 9251479 - DNA, 22 bp, Homo sapiens
ggcagtcaagagggagtctgaa

SEQ ID NO: 9251480 - DNA, 22 bp, Homo sapiens
ggcaggtgtggtgaccagagat

SEQ ID NO: 9251481 - DNA, 22 bp, Homo sapiens
ggcaggtgtggtgaccagagat

SEQ ID NO: 9251482 - DNA, 22 bp, Homo sapiens
ggcaggtgtgagatcgaggcca

SEQ ID NO: 9251483 - DNA, 22 bp, Homo sapiens
cacatgctagaataaatctcca

SEQ ID NO: 9251484 - DNA, 22 bp, Homo sapiens
ggcaggtgtggtgaccagagat

SEQ ID NO: 9251485 - DNA, 22 bp, Homo sapiens
ggcaggtgtgagctgtaaagga

SEQ ID NO: 9251486 - DNA, 22 bp, Homo sapiens
ggcaggtgtgagatcgaggcca

SEQ ID NO: 9251487 - DNA, 22 bp, Homo sapiens
ggcaggtgtgagatcgaggcca

SEQ ID NO: 9251488 - DNA, 22 bp, Homo sapiens
ggcaggtgtgagctgtaaagga

SEQ ID NO: 9251489 - DNA, 22 bp, Homo sapiens
ggagtctgttttacatgcagga

SEQ ID NO: 9251490 - DNA, 22 bp, Homo sapiens
ggagtctgggaattggagagaa

SEQ ID NO: 9251491 - DNA, 22 bp, Homo sapiens
ggagtctgctcccagacatgat

SEQ ID NO: 9251492 - DNA, 19 bp, Homo sapiens
ggagtttccaatgggtaaa

SEQ ID NO: 9251493 - DNA, 21 bp, Homo sapiens
ggagtttttctggaagggact

SEQ ID NO: 9251494 - DNA, 23 bp, Homo sapiens
ggataaatctcagcttcttccat

SEQ ID NO: 9251495 - DNA, 21 bp, Homo sapiens
ggagtttttctggaagggact

SEQ ID NO: 9251496 - DNA, 22 bp, Homo sapiens
ggagtgaagcaaataatgctgg

SEQ ID NO: 9251497 - DNA, 22 bp, Homo sapiens
ggagtgaagtggcgcgatctcg

SEQ ID NO: 9251498 - DNA, 22 bp, Homo sapiens
ggagtgaatcactagatgcaga

SEQ ID NO: 9251499 - DNA, 22 bp, Homo sapiens
ggagtgactcacagctgggaca

SEQ ID NO: 9251500 - DNA, 22 bp, Homo sapiens
ggcaggaaaacaatgagccagg

SEQ ID NO: 9251501 - DNA, 22 bp, Homo sapiens
ggcaggaagtagcagtctgagc

SEQ ID NO: 9251502 - DNA, 22 bp, Homo sapiens
ggataggaattgagatgctatt

SEQ ID NO: 9251503 - DNA, 18 bp, Homo sapiens
ggataggaccttaggcag

SEQ ID NO: 9251504 - DNA, 18 bp, Homo sapiens
ggataggaccttaggcag

SEQ ID NO: 9251505 - DNA, 22 bp, Homo sapiens
ggataagaaaattgtaataact

SEQ ID NO: 9251506 - DNA, 19 bp, Homo sapiens
ggataaggttggagtgatc

SEQ ID NO: 9251507 - DNA, 22 bp, Homo sapiens
ggatacaactagaagatggcag

SEQ ID NO: 9251508 - DNA, 22 bp, Homo sapiens
tcactctctaagcatgacagac

SEQ ID NO: 9251509 - DNA, 22 bp, Homo sapiens
tcactgcaacctccgcctgctg

SEQ ID NO: 9251510 - DNA, 22 bp, Homo sapiens
tcactgcaacctctgcctcccg

SEQ ID NO: 9251511 - DNA, 22 bp, Homo sapiens
tcactgcaagctccacctcccg

SEQ ID NO: 9251512 - DNA, 22 bp, Homo sapiens
tcactgcaagctcagcctcccg

SEQ ID NO: 9251513 - DNA, 22 bp, Homo sapiens
tcactgcaacctctgccttccg

SEQ ID NO: 9251514 - DNA, 22 bp, Homo sapiens
tcactgcaacctctgcctgcca

SEQ ID NO: 9251515 - DNA, 22 bp, Homo sapiens
tcactgcaacctctgcctcttg

SEQ ID NO: 9251516 - DNA, 22 bp, Homo sapiens
tcactgcaaggaggcttctcaa

SEQ ID NO: 9251517 - DNA, 22 bp, Homo sapiens
tcactgcaatctcagcctcctg

SEQ ID NO: 9251518 - DNA, 22 bp, Homo sapiens
tcactgcaatctctgccttcca

SEQ ID NO: 9251519 - DNA, 22 bp, Homo sapiens
tcactgcaagctcctcctcctg

SEQ ID NO: 9251520 - DNA, 22 bp, Homo sapiens
tcactgcaagctcctcctcctg

SEQ ID NO: 9251521 - DNA, 22 bp, Homo sapiens
tcactgcaagctctgccttccg

SEQ ID NO: 9251522 - DNA, 22 bp, Homo sapiens
tcacattctcagcatctataca

SEQ ID NO: 9251523 - DNA, 22 bp, Homo sapiens
tcacattctcagcatctataca

SEQ ID NO: 9251524 - DNA, 22 bp, Homo sapiens
tcacatgtgtggcagtgcaagt

SEQ ID NO: 9251525 - DNA, 22 bp, Homo sapiens
cagtggcagagaacagagacct

SEQ ID NO: 9251526 - DNA, 22 bp, Homo sapiens
cagtggcagagaacagagacct

SEQ ID NO: 9251527 - DNA, 22 bp, Homo sapiens
cagtggcagagaacagagacct

SEQ ID NO: 9251528 - DNA, 22 bp, Homo sapiens
cagtggcagagaacagagacct

SEQ ID NO: 9251529 - DNA, 17 bp, Homo sapiens
cagtggcagatcttctc

SEQ ID NO: 9251530 - DNA, 22 bp, Homo sapiens
cagtggcagatcaccaactgga

SEQ ID NO: 9251531 - DNA, 22 bp, Homo sapiens
cagtgggtcctgcgtctgccag

SEQ ID NO: 9251532 - DNA, 22 bp, Homo sapiens
cagtggcacccacgggctgggc

SEQ ID NO: 9251533 - DNA, 22 bp, Homo sapiens
cagtggcaatgggacagagcac

SEQ ID NO: 9251534 - DNA, 22 bp, Homo sapiens
cagtggcaatgggacagagcac

SEQ ID NO: 9251535 - DNA, 21 bp, Homo sapiens
tcactgcaatgctaggagaaa

SEQ ID NO: 9251536 - DNA, 22 bp, Homo sapiens
tcactgcactccagcctgggca

SEQ ID NO: 9251537 - DNA, 22 bp, Homo sapiens
tcactgcactccagcctgggtg

SEQ ID NO: 9251538 - DNA, 22 bp, Homo sapiens
tcactgcaggtttttcaggagg

SEQ ID NO: 9251539 - DNA, 22 bp, Homo sapiens
tcactgcagcctctgcctcccg

SEQ ID NO: 9251540 - DNA, 22 bp, Homo sapiens
tcactgcagagacctctagtca

SEQ ID NO: 9251541 - DNA, 22 bp, Homo sapiens
tcactgcacttcagcttgggca

SEQ ID NO: 9251542 - DNA, 22 bp, Homo sapiens
tcactgcagacaacctcagtca

SEQ ID NO: 9251543 - DNA, 19 bp, Homo sapiens
cagtggagattggaggagg

SEQ ID NO: 9251544 - DNA, 22 bp, Homo sapiens
tcacactgtgaagagacaagca

SEQ ID NO: 9251545 - DNA, 22 bp, Homo sapiens
cagtgctgttgtaagctcattg

SEQ ID NO: 9251546 - DNA, 22 bp, Homo sapiens
cagtgctgttgtaagctcattg

SEQ ID NO: 9251547 - DNA, 22 bp, Homo sapiens
tcacacctgtaatcccaggcct

SEQ ID NO: 9251548 - DNA, 22 bp, Homo sapiens
tcacactggcagtgctgaaggc

SEQ ID NO: 9251549 - DNA, 23 bp, Homo sapiens
tcacactggatacacatgcaaga

SEQ ID NO: 9251550 - DNA, 22 bp, Homo sapiens
cagtggaggctcaagtgtgctt

SEQ ID NO: 9251551 - DNA, 22 bp, Homo sapiens
cagtggaggccttgggaccttt

SEQ ID NO: 9251552 - DNA, 22 bp, Homo sapiens
cagtggagtgggactggtctga

SEQ ID NO: 9251553 - DNA, 22 bp, Homo sapiens
cagtggcaatgggacagagcac

SEQ ID NO: 9251554 - DNA, 22 bp, Homo sapiens
cagtggattagccagagctgga

SEQ ID NO: 9251555 - DNA, 22 bp, Homo sapiens
cagtggcaagtccggtattgaa

SEQ ID NO: 9251556 - DNA, 22 bp, Homo sapiens
cagtgcagtcaaggaagaacca

SEQ ID NO: 9251557 - DNA, 22 bp, Homo sapiens
cagtgcagtcaaggaagaacca

SEQ ID NO: 9251558 - DNA, 22 bp, Homo sapiens
cagtgcaggtttagggctgggg

SEQ ID NO: 9251559 - DNA, 22 bp, Homo sapiens
cagtgcagttggtggcaggggt

SEQ ID NO: 9251560 - DNA, 22 bp, Homo sapiens
cagtgcaggtggcagaggacag

SEQ ID NO: 9251561 - DNA, 22 bp, Homo sapiens
tcaaattgtcatcttgataatg

SEQ ID NO: 9251562 - DNA, 22 bp, Homo sapiens
tcaaattttaacatgcattaga

SEQ ID NO: 9251563 - DNA, 22 bp, Homo sapiens
cagtgcaggtttagggctgggg

SEQ ID NO: 9251564 - DNA, 22 bp, Homo sapiens
cagtgcagtttcccagatgctg

SEQ ID NO: 9251565 - DNA, 22 bp, Homo sapiens
cagtgcagtttcccagatgctg

SEQ ID NO: 9251566 - DNA, 22 bp, Homo sapiens
cagtgcatagatcctgaggcct

SEQ ID NO: 9251567 - DNA, 16 bp, Homo sapiens
tcacacatttgttggt

SEQ ID NO: 9251568 - DNA, 23 bp, Homo sapiens
cagtctgcagcccacttgggcag

SEQ ID NO: 9251569 - DNA, 22 bp, Homo sapiens
cagtctctcagctttcagctgt

SEQ ID NO: 9251570 - DNA, 22 bp, Homo sapiens
cagtctctaaatcaatctgaat

SEQ ID NO: 9251571 - DNA, 22 bp, Homo sapiens
cagtctgggactgagctccacc

SEQ ID NO: 9251572 - DNA, 22 bp, Homo sapiens
cagtctggcacagcacactgaa

SEQ ID NO: 9251573 - DNA, 22 bp, Homo sapiens
cagtctgggactgagctccacc

SEQ ID NO: 9251574 - DNA, 22 bp, Homo sapiens
cagtctgggactgagctccacc

SEQ ID NO: 9251575 - DNA, 22 bp, Homo sapiens
cagtcccagctgctcagaaggc

SEQ ID NO: 9251576 - DNA, 22 bp, Homo sapiens
cagtcccagctgctcagaaggc

SEQ ID NO: 9251577 - DNA, 15 bp, Homo sapiens
cagtcccagggaccc

SEQ ID NO: 9251578 - DNA, 22 bp, Homo sapiens
cagtcccagtttgagactctgg

SEQ ID NO: 9251579 - DNA, 22 bp, Homo sapiens
cagtcccagggttggttcagct

SEQ ID NO: 9251580 - DNA, 22 bp, Homo sapiens
cagtcccagggttggttcagct

SEQ ID NO: 9251581 - DNA, 22 bp, Homo sapiens
cagtcccatgagcccagaacat

SEQ ID NO: 9251582 - DNA, 22 bp, Homo sapiens
cagtcccatctcccaggtggct

SEQ ID NO: 9251583 - DNA, 22 bp, Homo sapiens
cagtcccatctcccaggtggct

SEQ ID NO: 9251584 - DNA, 22 bp, Homo sapiens
cagtcttatcctgaaaacaaca

SEQ ID NO: 9251585 - DNA, 22 bp, Homo sapiens
cagtctttgatgcatcctagcc

SEQ ID NO: 9251586 - DNA, 22 bp, Homo sapiens
cagtcttttgtatattagcaga

SEQ ID NO: 9251587 - DNA, 22 bp, Homo sapiens
cagtgaaatagtggacatcaaa

SEQ ID NO: 9251588 - DNA, 22 bp, Homo sapiens
cagtgaaatagtggacatcaaa

SEQ ID NO: 9251589 - DNA, 22 bp, Homo sapiens
tcaaattagtggaataataatg

SEQ ID NO: 9251590 - DNA, 22 bp, Homo sapiens
tcaaattagtggaataataatg

SEQ ID NO: 9251591 - DNA, 22 bp, Homo sapiens
tcaaattagtggaataataatg

SEQ ID NO: 9251592 - DNA, 22 bp, Homo sapiens
tattcctaatttgcagggcatg

SEQ ID NO: 9251593 - DNA, 22 bp, Homo sapiens
tcaaagcttagataatttcttt

SEQ ID NO: 9251594 - DNA, 22 bp, Homo sapiens
tcaaagcatcagtcaatttagg

SEQ ID NO: 9251595 - DNA, 22 bp, Homo sapiens
tcaaagcatggttttgaaagac

SEQ ID NO: 9251596 - DNA, 22 bp, Homo sapiens
cagtcccagacccagaaggtgg

SEQ ID NO: 9251597 - DNA, 22 bp, Homo sapiens
tattccatgccagagtttattg

SEQ ID NO: 9251598 - DNA, 22 bp, Homo sapiens
cagtagatttggtaaactagga

SEQ ID NO: 9251599 - DNA, 22 bp, Homo sapiens
cagtactttgaagatattttag

SEQ ID NO: 9251600 - DNA, 22 bp, Homo sapiens
cagtagcaggatttgggattat

SEQ ID NO: 9251601 - DNA, 22 bp, Homo sapiens
cagtagcaggcactcagcacgt

SEQ ID NO: 9251602 - DNA, 22 bp, Homo sapiens
cagtagcaggcaggtgcttttg

SEQ ID NO: 9251603 - DNA, 20 bp, Homo sapiens
cagtagcaataattagaagc

SEQ ID NO: 9251604 - DNA, 20 bp, Homo sapiens
cagtagcaataattagaagc

SEQ ID NO: 9251605 - DNA, 22 bp, Homo sapiens
cagtagcactagatatgtgtgg

SEQ ID NO: 9251606 - DNA, 22 bp, Homo sapiens
cagtagcactctgtcagtgaag

SEQ ID NO: 9251607 - DNA, 22 bp, Homo sapiens
tattccaactgtcatagtcata

SEQ ID NO: 9251608 - DNA, 22 bp, Homo sapiens
cagtagcagggattattttagg

SEQ ID NO: 9251609 - DNA, 22 bp, Homo sapiens
tatataatttgtaaaagcacct

SEQ ID NO: 9251610 - DNA, 22 bp, Homo sapiens
tatataatttgtaaaagcacct

SEQ ID NO: 9251611 - DNA, 21 bp, Homo sapiens
tatacatgtgtgcatacgtgt

SEQ ID NO: 9251612 - DNA, 22 bp, Homo sapiens
tatataactactattttgctca

SEQ ID NO: 9251613 - DNA, 22 bp, Homo sapiens
tatatagaaaagcagatgttgg

SEQ ID NO: 9251614 - DNA, 22 bp, Homo sapiens
tatatactatgcgattcctgcc

SEQ ID NO: 9251615 - DNA, 22 bp, Homo sapiens
tatattcaatgattagtatcag

SEQ ID NO: 9251616 - DNA, 22 bp, Homo sapiens
tatatatatgcacacacaccta

SEQ ID NO: 9251617 - DNA, 22 bp, Homo sapiens
tagtgttctaagaacatccatg

SEQ ID NO: 9251618 - DNA, 22 bp, Homo sapiens
tagtttctagacagtaagaatt

SEQ ID NO: 9251619 - DNA, 22 bp, Homo sapiens
tagtgttctgggctgagagggg

SEQ ID NO: 9251620 - DNA, 22 bp, Homo sapiens
tagtttctagtcaatcttcttt

SEQ ID NO: 9251621 - DNA, 22 bp, Homo sapiens
tagtttctagacagtaagaatt

SEQ ID NO: 9251622 - DNA, 22 bp, Homo sapiens
tagtttctagacagtaagaatt

SEQ ID NO: 9251623 - DNA, 22 bp, Homo sapiens
tagtgttccagaagcaaacaag

SEQ ID NO: 9251624 - DNA, 22 bp, Homo sapiens
tagtgttaattcagtttataat

SEQ ID NO: 9251625 - DNA, 22 bp, Homo sapiens
tagtgtgtccctggggagtgtt

SEQ ID NO: 9251626 - DNA, 22 bp, Homo sapiens
tagtgtggtatcttctatggaa

SEQ ID NO: 9251627 - DNA, 22 bp, Homo sapiens
tagtttcttcacctgtaaaatg

SEQ ID NO: 9251628 - DNA, 22 bp, Homo sapiens
tagtttctggttcttgctctgg

SEQ ID NO: 9251629 - DNA, 22 bp, Homo sapiens
tagtttcttcacctgtaaaatg

SEQ ID NO: 9251630 - DNA, 22 bp, Homo sapiens
tagtttcttcacctgtaaaatg

SEQ ID NO: 9251631 - DNA, 22 bp, Homo sapiens
tagtttcttgattagccacttt

SEQ ID NO: 9251632 - DNA, 22 bp, Homo sapiens
tagtttctttcacgtagtaata

SEQ ID NO: 9251633 - DNA, 22 bp, Homo sapiens
tagtttctttcacgtagtaata

SEQ ID NO: 9251634 - DNA, 22 bp, Homo sapiens
tagtttgtaatgaggagaagta

SEQ ID NO: 9251635 - DNA, 22 bp, Homo sapiens
tagttttacttgcgatgataat

SEQ ID NO: 9251636 - DNA, 22 bp, Homo sapiens
tagttttacttgcgatgataat

SEQ ID NO: 9251637 - DNA, 22 bp, Homo sapiens
taggtagttacacagcaatgta

SEQ ID NO: 9251638 - DNA, 22 bp, Homo sapiens
cagggccaccctctgctgggtg

SEQ ID NO: 9251639 - DNA, 22 bp, Homo sapiens
cagggccaccctctgctgggtg

SEQ ID NO: 9251640 - DNA, 22 bp, Homo sapiens
cagggccaagctgcagcatctg

SEQ ID NO: 9251641 - DNA, 22 bp, Homo sapiens
cagggccaagttggtgcctttt

SEQ ID NO: 9251642 - DNA, 22 bp, Homo sapiens
cagggccaagctgcagcatctg

SEQ ID NO: 9251643 - DNA, 22 bp, Homo sapiens
tagtaacagcagcttccctgtg

SEQ ID NO: 9251644 - DNA, 22 bp, Homo sapiens
tagtaacaacaactagcatttt

SEQ ID NO: 9251645 - DNA, 17 bp, Homo sapiens
tagtaaatgagtagagc

SEQ ID NO: 9251646 - DNA, 22 bp, Homo sapiens
tagtaaatgtgaaatgtgggga

SEQ ID NO: 9251647 - DNA, 22 bp, Homo sapiens
tagtaaatctcagaaaaagatc

SEQ ID NO: 9251648 - DNA, 22 bp, Homo sapiens
tagtaaatctcagaaaaagatc

SEQ ID NO: 9251649 - DNA, 22 bp, Homo sapiens
cagggctgagtcatatagcctt

SEQ ID NO: 9251650 - DNA, 22 bp, Homo sapiens
cagggctgctggccgtgccctc

SEQ ID NO: 9251651 - DNA, 22 bp, Homo sapiens
cagggctgaggacacaagtaaa

SEQ ID NO: 9251652 - DNA, 22 bp, Homo sapiens
tagtacagtactgggctctagt

SEQ ID NO: 9251653 - DNA, 22 bp, Homo sapiens
tagtacagagacactggaggaa

SEQ ID NO: 9251654 - DNA, 22 bp, Homo sapiens
cagggctgctggccgtgccctc

SEQ ID NO: 9251655 - DNA, 22 bp, Homo sapiens
cagggctggatcctccagactc

SEQ ID NO: 9251656 - DNA, 22 bp, Homo sapiens
cagggctggatcctccagactc

SEQ ID NO: 9251657 - DNA, 22 bp, Homo sapiens
cagggctggatcctccagactc

SEQ ID NO: 9251658 - DNA, 22 bp, Homo sapiens
tagtgattgctgatattccatt

SEQ ID NO: 9251659 - DNA, 23 bp, Homo sapiens
tagtgattggaaaaactagtttt

SEQ ID NO: 9251660 - DNA, 22 bp, Homo sapiens
tatgtacatggagagcaattga

SEQ ID NO: 9251661 - DNA, 22 bp, Homo sapiens
tatgtacatggagagcaattga

SEQ ID NO: 9251662 - DNA, 22 bp, Homo sapiens
tatgtacatgatttcatttgct

SEQ ID NO: 9251663 - DNA, 22 bp, Homo sapiens
tatgtacatgatttcatttgct

SEQ ID NO: 9251664 - DNA, 22 bp, Homo sapiens
tatgtacatgatttcatttgct

SEQ ID NO: 9251665 - DNA, 22 bp, Homo sapiens
tatgtacatcttgagcaatgaa

SEQ ID NO: 9251666 - DNA, 22 bp, Homo sapiens
cagtacatttcatatgattcta

SEQ ID NO: 9251667 - DNA, 22 bp, Homo sapiens
cagtacatttcatatgattcta

SEQ ID NO: 9251668 - DNA, 22 bp, Homo sapiens
cagtaccagtcaccacattgat

SEQ ID NO: 9251669 - DNA, 22 bp, Homo sapiens
cagtaattccaagtgcttatac

SEQ ID NO: 9251670 - DNA, 22 bp, Homo sapiens
cagtaattccaagtgcttatac

SEQ ID NO: 9251671 - DNA, 22 bp, Homo sapiens
tatgtacatcgttgaattcaaa

SEQ ID NO: 9251672 - DNA, 22 bp, Homo sapiens
tatgtacatcgttgaattcaaa

SEQ ID NO: 9251673 - DNA, 22 bp, Homo sapiens
caggtggggcgccctcaggcag

SEQ ID NO: 9251674 - DNA, 22 bp, Homo sapiens
caggtggggagagtgtggagca

SEQ ID NO: 9251675 - DNA, 22 bp, Homo sapiens
caggtggggagagtgtggagca

SEQ ID NO: 9251676 - DNA, 22 bp, Homo sapiens
caggtggggcagctgtgggagc

SEQ ID NO: 9251677 - DNA, 22 bp, Homo sapiens
caggtggggcgccctcaggcag

SEQ ID NO: 9251678 - DNA, 22 bp, Homo sapiens
caggtgggctgcctctccagct

SEQ ID NO: 9251679 - DNA, 22 bp, Homo sapiens
caggtgggcttgggagaacact

SEQ ID NO: 9251680 - DNA, 22 bp, Homo sapiens
caggtgggccggggtttgttct

SEQ ID NO: 9251681 - DNA, 22 bp, Homo sapiens
tatgcaaatcattagatttcct

SEQ ID NO: 9251682 - DNA, 22 bp, Homo sapiens
tatgcaaatgactggtatgttt

SEQ ID NO: 9251683 - DNA, 22 bp, Homo sapiens
tatgcaaacagttcaggtgaca

SEQ ID NO: 9251684 - DNA, 22 bp, Homo sapiens
tatgatttgtagacatttgatt

SEQ ID NO: 9251685 - DNA, 22 bp, Homo sapiens
tatgaagatatatctgatctct

SEQ ID NO: 9251686 - DNA, 22 bp, Homo sapiens
tatgaagacaatgatagcatga

SEQ ID NO: 9251687 - DNA, 22 bp, Homo sapiens
tatgaagaagttctgtgaaatg

SEQ ID NO: 9251688 - DNA, 23 bp, Homo sapiens
tatgatcctccacaccttctctc

SEQ ID NO: 9251689 - DNA, 22 bp, Homo sapiens
tatgatattctaaattgacacc

SEQ ID NO: 9251690 - DNA, 22 bp, Homo sapiens
tatgaagatatatctgatctct

SEQ ID NO: 9251691 - DNA, 22 bp, Homo sapiens
tatgatatgcactttatcagaa

SEQ ID NO: 9251692 - DNA, 22 bp, Homo sapiens
tatattccagttcatctcttga

SEQ ID NO: 9251693 - DNA, 22 bp, Homo sapiens
tatattccagttcatctcttga

SEQ ID NO: 9251694 - DNA, 22 bp, Homo sapiens
tatattcattttaaagccatct

SEQ ID NO: 9251695 - DNA, 22 bp, Homo sapiens
tatctgtatccccatctagcta

SEQ ID NO: 9251696 - DNA, 23 bp, Homo sapiens
tatctgtatttgttcactgctgt

SEQ ID NO: 9251697 - DNA, 22 bp, Homo sapiens
tatgaacattatttttgtctag

SEQ ID NO: 9251698 - DNA, 22 bp, Homo sapiens
tatgaacatgttcattgactta

SEQ ID NO: 9251699 - DNA, 22 bp, Homo sapiens
tatgaactgtgagtgtgatggg

SEQ ID NO: 9251700 - DNA, 22 bp, Homo sapiens
tatgaactgtactgtactaagc

SEQ ID NO: 9251701 - DNA, 22 bp, Homo sapiens
tatgaactgtgagtgtgatggg

SEQ ID NO: 9251702 - DNA, 22 bp, Homo sapiens
tatgaactgctcttgtgttttg

SEQ ID NO: 9251703 - DNA, 23 bp, Homo sapiens
tatgaactgcattgctggtgtgt

SEQ ID NO: 9251704 - DNA, 22 bp, Homo sapiens
tatgaacttttgatgtgacatg

SEQ ID NO: 9251705 - DNA, 22 bp, Homo sapiens
tagaaattcaatgctctgagta

SEQ ID NO: 9251706 - DNA, 22 bp, Homo sapiens
tagaaatgtgataatagcttaa

SEQ ID NO: 9251707 - DNA, 22 bp, Homo sapiens
tagaaagcagtatctccatttt

SEQ ID NO: 9251708 - DNA, 22 bp, Homo sapiens
tagaacagagggttgcccagat

SEQ ID NO: 9251709 - DNA, 22 bp, Homo sapiens
tagaacacagaaatgtgtggcc

SEQ ID NO: 9251710 - DNA, 22 bp, Homo sapiens
cagggagaagtctggtcagtcc

SEQ ID NO: 9251711 - DNA, 22 bp, Homo sapiens
cagggagaggcatcatagggaa

SEQ ID NO: 9251712 - DNA, 22 bp, Homo sapiens
cagggagaggcctctgttgccc

SEQ ID NO: 9251713 - DNA, 22 bp, Homo sapiens
cagggagaagtctggtcagtcc

SEQ ID NO: 9251714 - DNA, 22 bp, Homo sapiens
cagggagaggctggtggagtaa

SEQ ID NO: 9251715 - DNA, 22 bp, Homo sapiens
cagggagaggctggtggagtaa

SEQ ID NO: 9251716 - DNA, 22 bp, Homo sapiens
cagggagaggcctctgttgccc

SEQ ID NO: 9251717 - DNA, 22 bp, Homo sapiens
cagggagatcttggctcctggt

SEQ ID NO: 9251718 - DNA, 22 bp, Homo sapiens
tagacatttctggttattgaca

SEQ ID NO: 9251719 - DNA, 22 bp, Homo sapiens
tagacatttctggttattgaca

SEQ ID NO: 9251720 - DNA, 22 bp, Homo sapiens
tagacatttggagttttatgac

SEQ ID NO: 9251721 - DNA, 22 bp, Homo sapiens
tagacattatttctacccacaa

SEQ ID NO: 9251722 - DNA, 22 bp, Homo sapiens
tagacattggccattcctgtgg

SEQ ID NO: 9251723 - DNA, 22 bp, Homo sapiens
tagacattggccattcctgtgg

SEQ ID NO: 9251724 - DNA, 22 bp, Homo sapiens
tagacattatgtattaagttct

SEQ ID NO: 9251725 - DNA, 22 bp, Homo sapiens
tagacattatgtattaagttct

SEQ ID NO: 9251726 - DNA, 22 bp, Homo sapiens
tagacatttatctccatgtgga

SEQ ID NO: 9251727 - DNA, 22 bp, Homo sapiens
tagacatttctggttattgaca

SEQ ID NO: 9251728 - DNA, 22 bp, Homo sapiens
tagacatacagtgcagtacata

SEQ ID NO: 9251729 - DNA, 22 bp, Homo sapiens
tagacattatgtattaagttct

SEQ ID NO: 9251730 - DNA, 22 bp, Homo sapiens
tagacattaggtaggttcatgg

SEQ ID NO: 9251731 - DNA, 22 bp, Homo sapiens
tagacagtgagctatgagtggt

SEQ ID NO: 9251732 - DNA, 22 bp, Homo sapiens
tagacagttaaactactggtgg

SEQ ID NO: 9251733 - DNA, 22 bp, Homo sapiens
tagacaggagtcaggctagaat

SEQ ID NO: 9251734 - DNA, 22 bp, Homo sapiens
tagaaagcagaaaccatcagag

SEQ ID NO: 9251735 - DNA, 22 bp, Homo sapiens
tagaaagcaaaatcctaccaag

SEQ ID NO: 9251736 - DNA, 22 bp, Homo sapiens
tagaaagatctgtaggcaagag

SEQ ID NO: 9251737 - DNA, 22 bp, Homo sapiens
tagaaagatctgtaggcaagag

SEQ ID NO: 9251738 - DNA, 22 bp, Homo sapiens
tagaaagagcatagtattataa

SEQ ID NO: 9251739 - DNA, 22 bp, Homo sapiens
tagaaagacatgggccagcagc

SEQ ID NO: 9251740 - DNA, 22 bp, Homo sapiens
tagaaagactgtccagatttca

SEQ ID NO: 9251741 - DNA, 22 bp, Homo sapiens
tagaaagactgtccagatttca

SEQ ID NO: 9251742 - DNA, 22 bp, Homo sapiens
tagaaagactgtccagatttca

SEQ ID NO: 9251743 - DNA, 22 bp, Homo sapiens
tacctcaagttccaggaaagcg

SEQ ID NO: 9251744 - DNA, 22 bp, Homo sapiens
tacctcaagttccaggaaagcg

SEQ ID NO: 9251745 - DNA, 22 bp, Homo sapiens
tacctcaagttccaggaaagcg

SEQ ID NO: 9251746 - DNA, 22 bp, Homo sapiens
tagaaagaacttcatgtaaaac

SEQ ID NO: 9251747 - DNA, 22 bp, Homo sapiens
tagaaagacaatgggaagtgct

SEQ ID NO: 9251748 - DNA, 22 bp, Homo sapiens
tagaaagacaatgggaagtgct

SEQ ID NO: 9251749 - DNA, 22 bp, Homo sapiens
tagaaagaacttcatgtaaaac

SEQ ID NO: 9251750 - DNA, 22 bp, Homo sapiens
tagaaacaagggagaggattct

SEQ ID NO: 9251751 - DNA, 22 bp, Homo sapiens
tagaaacaagggagaggattct

SEQ ID NO: 9251752 - DNA, 22 bp, Homo sapiens
caggctgagggttaggccttag

SEQ ID NO: 9251753 - DNA, 22 bp, Homo sapiens
caggctgaggcagtagggtttg

SEQ ID NO: 9251754 - DNA, 22 bp, Homo sapiens
caggctgatagggtccaaagtt

SEQ ID NO: 9251755 - DNA, 22 bp, Homo sapiens
caggctgatcagggctgggatg

SEQ ID NO: 9251756 - DNA, 22 bp, Homo sapiens
caggctgatcagggctgggatg

SEQ ID NO: 9251757 - DNA, 22 bp, Homo sapiens
caggctgcagcagcagtggccc

SEQ ID NO: 9251758 - DNA, 22 bp, Homo sapiens
caggctgcagcagcagtggccc

SEQ ID NO: 9251759 - DNA, 22 bp, Homo sapiens
caggctgcagcagcagtggccc

SEQ ID NO: 9251760 - DNA, 22 bp, Homo sapiens
caggctgattaggcctcgtcca

SEQ ID NO: 9251761 - DNA, 22 bp, Homo sapiens
caggctgcagaggcctttcatg

SEQ ID NO: 9251762 - DNA, 22 bp, Homo sapiens
tacccaggagaaacagcagggc

SEQ ID NO: 9251763 - DNA, 22 bp, Homo sapiens
caggctgcagcagcagtggccc

SEQ ID NO: 9251764 - DNA, 22 bp, Homo sapiens
tacccaggagaaacagcagggc

SEQ ID NO: 9251765 - DNA, 22 bp, Homo sapiens
tacccagcttcaagtcaggact

SEQ ID NO: 9251766 - DNA, 22 bp, Homo sapiens
caggctgcagcagcagtggccc

SEQ ID NO: 9251767 - DNA, 22 bp, Homo sapiens
caggctgcagcagcagtggccc

SEQ ID NO: 9251768 - DNA, 22 bp, Homo sapiens
taccctctcccggtccagcttt

SEQ ID NO: 9251769 - DNA, 19 bp, Homo sapiens
taccctcagggcctcattt

SEQ ID NO: 9251770 - DNA, 22 bp, Homo sapiens
cagggagggacaattgtcacct

SEQ ID NO: 9251771 - DNA, 22 bp, Homo sapiens
cagggagctttgtcttctcatt

SEQ ID NO: 9251772 - DNA, 22 bp, Homo sapiens
tagacatttgtcaagaatgact

SEQ ID NO: 9251773 - DNA, 22 bp, Homo sapiens
tagacatttggcatggttttca

SEQ ID NO: 9251774 - DNA, 22 bp, Homo sapiens
tagacatttggcatggttttca

SEQ ID NO: 9251775 - DNA, 22 bp, Homo sapiens
tagacatttgtcaagaatgact

SEQ ID NO: 9251776 - DNA, 22 bp, Homo sapiens
cagggatggagagactactggc

SEQ ID NO: 9251777 - DNA, 22 bp, Homo sapiens
tagcagcaattacacagtccgt

SEQ ID NO: 9251778 - DNA, 22 bp, Homo sapiens
tagcaatgtgttgacttggtca

SEQ ID NO: 9251779 - DNA, 22 bp, Homo sapiens
tagcacaaagagtctttcagag

SEQ ID NO: 9251780 - DNA, 22 bp, Homo sapiens
tagcaatgtgttgacttggtca

SEQ ID NO: 9251781 - DNA, 22 bp, Homo sapiens
tagcattagagatagaaatagt

SEQ ID NO: 9251782 - DNA, 22 bp, Homo sapiens
tagcattaaaggtaagacatta

SEQ ID NO: 9251783 - DNA, 22 bp, Homo sapiens
tagcatcatgatcagaactgtt

SEQ ID NO: 9251784 - DNA, 22 bp, Homo sapiens
tagcatcagccacaccttgtac

SEQ ID NO: 9251785 - DNA, 22 bp, Homo sapiens
tagcagtgttgccgttggctgc

SEQ ID NO: 9251786 - DNA, 22 bp, Homo sapiens
cagggcagtaccgccctctggc

SEQ ID NO: 9251787 - DNA, 22 bp, Homo sapiens
cagggcagtaccgccctctggc

SEQ ID NO: 9251788 - DNA, 22 bp, Homo sapiens
cagggcagtttgtgcctatgag

SEQ ID NO: 9251789 - DNA, 22 bp, Homo sapiens
cagggcatccgtgctccatgct

SEQ ID NO: 9251790 - DNA, 22 bp, Homo sapiens
tacactgtttgaactgtggtcg

SEQ ID NO: 9251791 - DNA, 22 bp, Homo sapiens
tacactgtttttggaaagaaga

SEQ ID NO: 9251792 - DNA, 22 bp, Homo sapiens
tacagacattcaattttgaccc

SEQ ID NO: 9251793 - DNA, 22 bp, Homo sapiens
tacactgtgtaaaatgcacttt

SEQ ID NO: 9251794 - DNA, 22 bp, Homo sapiens
tacactgtgtaaaatgcacttt

SEQ ID NO: 9251795 - DNA, 22 bp, Homo sapiens
tacactgtgaggtttccaaggg

SEQ ID NO: 9251796 - DNA, 22 bp, Homo sapiens
tacactgtggtaaactcaaagt

SEQ ID NO: 9251797 - DNA, 22 bp, Homo sapiens
tacactgtgacaatcatgacag

SEQ ID NO: 9251798 - DNA, 22 bp, Homo sapiens
tacactgtgacaatcatgacag

SEQ ID NO: 9251799 - DNA, 22 bp, Homo sapiens
tacactgtgacaatcatgacag

SEQ ID NO: 9251800 - DNA, 22 bp, Homo sapiens
tacactgtcttagaaaggggca

SEQ ID NO: 9251801 - DNA, 22 bp, Homo sapiens
tacactgtcagatttcgattgc

SEQ ID NO: 9251802 - DNA, 22 bp, Homo sapiens
caggccctgccttgagggacct

SEQ ID NO: 9251803 - DNA, 22 bp, Homo sapiens
caggccctgccttggcatgtgt

SEQ ID NO: 9251804 - DNA, 22 bp, Homo sapiens
tacactggacaggagtaggaag

SEQ ID NO: 9251805 - DNA, 22 bp, Homo sapiens
tacactggacaggagtaggaag

SEQ ID NO: 9251806 - DNA, 22 bp, Homo sapiens
tacactggccccagggcggggc

SEQ ID NO: 9251807 - DNA, 22 bp, Homo sapiens
tacactggccaaatgcctttgg

SEQ ID NO: 9251808 - DNA, 22 bp, Homo sapiens
tacactggattagctgtcctac

SEQ ID NO: 9251809 - DNA, 22 bp, Homo sapiens
tacactggagcccttggggtct

SEQ ID NO: 9251810 - DNA, 22 bp, Homo sapiens
tacactggctgttttgcagaaa

SEQ ID NO: 9251811 - DNA, 22 bp, Homo sapiens
tacactggggctctgggagtga

SEQ ID NO: 9251812 - DNA, 22 bp, Homo sapiens
tacactgtaggtggcaggcagc

SEQ ID NO: 9251813 - DNA, 22 bp, Homo sapiens
tacactgtacgctctgcttcaa

SEQ ID NO: 9251814 - DNA, 22 bp, Homo sapiens
caggccacgccccggcgtgtga

SEQ ID NO: 9251815 - DNA, 22 bp, Homo sapiens
caggcccagggagggagaccaa

SEQ ID NO: 9251816 - DNA, 22 bp, Homo sapiens
caggccaccagatacatgcccc

SEQ ID NO: 9251817 - DNA, 22 bp, Homo sapiens
caggccaatatcacatgctatg

SEQ ID NO: 9251818 - DNA, 22 bp, Homo sapiens
caggccaatatcacatgctatg

SEQ ID NO: 9251819 - DNA, 22 bp, Homo sapiens
caggccacaagttgggttcaag

SEQ ID NO: 9251820 - DNA, 22 bp, Homo sapiens
caggccacacggcggctccctg

SEQ ID NO: 9251821 - DNA, 22 bp, Homo sapiens
caggccacagctaaagaggatt

SEQ ID NO: 9251822 - DNA, 22 bp, Homo sapiens
caggccctcctgtgatctgcct

SEQ ID NO: 9251823 - DNA, 22 bp, Homo sapiens
gtggagcatgtgaggactgagt

SEQ ID NO: 9251824 - DNA, 23 bp, Homo sapiens
gtggagccacatcacaggctcct

SEQ ID NO: 9251825 - DNA, 22 bp, Homo sapiens
gtggagcataacacactagcct

SEQ ID NO: 9251826 - DNA, 22 bp, Homo sapiens
gtggagcaggactagctgagaa

SEQ ID NO: 9251827 - DNA, 22 bp, Homo sapiens
gtggagcaggactagctgagaa

SEQ ID NO: 9251828 - DNA, 22 bp, Homo sapiens
gtggagcaatcagagggtcagt

SEQ ID NO: 9251829 - DNA, 22 bp, Homo sapiens
gtggagaggagcagctacctca

SEQ ID NO: 9251830 - DNA, 22 bp, Homo sapiens
gtggagcaatcagagggtcagt

SEQ ID NO: 9251831 - DNA, 20 bp, Homo sapiens
gtggagaggctggcgggact

SEQ ID NO: 9251832 - DNA, 22 bp, Homo sapiens
cagctctgccacttcctagcta

SEQ ID NO: 9251833 - DNA, 22 bp, Homo sapiens
cagctctgccacttcctagcta

SEQ ID NO: 9251834 - DNA, 22 bp, Homo sapiens
cagctctgccacttcctagcta

SEQ ID NO: 9251835 - DNA, 17 bp, Homo sapiens
cagctctgcatcttcct

SEQ ID NO: 9251836 - DNA, 17 bp, Homo sapiens
cagctctgcatcttcct

SEQ ID NO: 9251837 - DNA, 17 bp, Homo sapiens
cagctctgcatcttcct

SEQ ID NO: 9251838 - DNA, 17 bp, Homo sapiens
cagctctgcatcttcct

SEQ ID NO: 9251839 - DNA, 22 bp, Homo sapiens
cagctctgcctctggggctgag

SEQ ID NO: 9251840 - DNA, 22 bp, Homo sapiens
cagctctgcctctggggctgag

SEQ ID NO: 9251841 - DNA, 22 bp, Homo sapiens
tacacagatttaaaagcaggga

SEQ ID NO: 9251842 - DNA, 22 bp, Homo sapiens
tacacagatttcagtatcatca

SEQ ID NO: 9251843 - DNA, 22 bp, Homo sapiens
caggccaagtcccaagtgcggg

SEQ ID NO: 9251844 - DNA, 22 bp, Homo sapiens
caggccaataaatgtgatggcc

SEQ ID NO: 9251845 - DNA, 22 bp, Homo sapiens
caggccaactgcatggtgacca

SEQ ID NO: 9251846 - DNA, 22 bp, Homo sapiens
caggccaactgcatggtgacca

SEQ ID NO: 9251847 - DNA, 22 bp, Homo sapiens
caggccaaagatcccattgaca

SEQ ID NO: 9251848 - DNA, 22 bp, Homo sapiens
tacacagaggctgatgtcttag

SEQ ID NO: 9251849 - DNA, 22 bp, Homo sapiens
tacacagaggctgatgtcttag

SEQ ID NO: 9251850 - DNA, 22 bp, Homo sapiens
tacacagatatgtgatcaatca

SEQ ID NO: 9251851 - DNA, 22 bp, Homo sapiens
tacacagagactcaaaagggca

SEQ ID NO: 9251852 - DNA, 22 bp, Homo sapiens
tacacagaggctgatgtcttag

SEQ ID NO: 9251853 - DNA, 22 bp, Homo sapiens
tacacagaggcagctgtctgct

SEQ ID NO: 9251854 - DNA, 22 bp, Homo sapiens
tacaatagggcttttgtttatg

SEQ ID NO: 9251855 - DNA, 22 bp, Homo sapiens
tacaatatgtgaactttggtgt

SEQ ID NO: 9251856 - DNA, 22 bp, Homo sapiens
tacacagaagccagaaggcctg

SEQ ID NO: 9251857 - DNA, 22 bp, Homo sapiens
tacacagactcttcaattcaga

SEQ ID NO: 9251858 - DNA, 22 bp, Homo sapiens
caggcctgtgagttgaggcccc

SEQ ID NO: 9251859 - DNA, 22 bp, Homo sapiens
caggcctgtctgcacatgaggc

SEQ ID NO: 9251860 - DNA, 22 bp, Homo sapiens
caggcctgtgacaccgtgtctg

SEQ ID NO: 9251861 - DNA, 22 bp, Homo sapiens
caggcctgtctgcacatgaggc

SEQ ID NO: 9251862 - DNA, 22 bp, Homo sapiens
caggcctggagtgcaatggcac

SEQ ID NO: 9251863 - DNA, 22 bp, Homo sapiens
caggcctggagtgcaatggcac

SEQ ID NO: 9251864 - DNA, 22 bp, Homo sapiens
tacagctccaaaaatcactgtt

SEQ ID NO: 9251865 - DNA, 23 bp, Homo sapiens
tacagctgcagaatcaggctaag

SEQ ID NO: 9251866 - DNA, 22 bp, Homo sapiens
tacagagacccacaagagactg

SEQ ID NO: 9251867 - DNA, 22 bp, Homo sapiens
tacagcctcgaactcctgcatt

SEQ ID NO: 9251868 - DNA, 22 bp, Homo sapiens
caggctcggtccagtggcaccc

SEQ ID NO: 9251869 - DNA, 22 bp, Homo sapiens
caggctctaggttagtaggaga

SEQ ID NO: 9251870 - DNA, 22 bp, Homo sapiens
caggctgaggcagtagggtttg

SEQ ID NO: 9251871 - DNA, 21 bp, Homo sapiens
caggctctgctagaggagcct

SEQ ID NO: 9251872 - DNA, 22 bp, Homo sapiens
caggctccttcccagggatggt

SEQ ID NO: 9251873 - DNA, 20 bp, Homo sapiens
caggctccgcaggactaggg

SEQ ID NO: 9251874 - DNA, 23 bp, Homo sapiens
caggctcccggaccaggatccgc

SEQ ID NO: 9251875 - DNA, 22 bp, Homo sapiens
caggctccctaagtcagcagcc

SEQ ID NO: 9251876 - DNA, 22 bp, Homo sapiens
caggctccctgggcagtggcag

SEQ ID NO: 9251877 - DNA, 22 bp, Homo sapiens
caggctccctgccagggccggc

SEQ ID NO: 9251878 - DNA, 22 bp, Homo sapiens
tacagttctagtcaaaaatcac

SEQ ID NO: 9251879 - DNA, 20 bp, Homo sapiens
tacagttctgtagaagtaga

SEQ ID NO: 9251880 - DNA, 20 bp, Homo sapiens
tacagttctgtagaagtaga

SEQ ID NO: 9251881 - DNA, 22 bp, Homo sapiens
tacagttctttgaaggatctag

SEQ ID NO: 9251882 - DNA, 22 bp, Homo sapiens
caggctccagcttcctgctcag

SEQ ID NO: 9251883 - DNA, 22 bp, Homo sapiens
caggctcccaccctcctgcagc

SEQ ID NO: 9251884 - DNA, 22 bp, Homo sapiens
tctagaaacatgacattgatct

SEQ ID NO: 9251885 - DNA, 22 bp, Homo sapiens
tctagaaacaggtttctagaaa

SEQ ID NO: 9251886 - DNA, 22 bp, Homo sapiens
tcctgtgttacccttgcagtga

SEQ ID NO: 9251887 - DNA, 22 bp, Homo sapiens
tcctgtgttgatagagatggtt

SEQ ID NO: 9251888 - DNA, 22 bp, Homo sapiens
tcctgtgttctaggtatggtct

SEQ ID NO: 9251889 - DNA, 22 bp, Homo sapiens
tctagaaagtttgtactgattt

SEQ ID NO: 9251890 - DNA, 22 bp, Homo sapiens
tctagaaagtactagagctggt

SEQ ID NO: 9251891 - DNA, 22 bp, Homo sapiens
tctagaaagccaaattaggaat

SEQ ID NO: 9251892 - DNA, 18 bp, Homo sapiens
tctagaaacccagactct

SEQ ID NO: 9251893 - DNA, 18 bp, Homo sapiens
tctagaaacccagactct

SEQ ID NO: 9251894 - DNA, 18 bp, Homo sapiens
tctagaaacccagactct

SEQ ID NO: 9251895 - DNA, 22 bp, Homo sapiens
tctagaaagccaaattaggaat

SEQ ID NO: 9251896 - DNA, 22 bp, Homo sapiens
tctagaaagccaaattaggaat

SEQ ID NO: 9251897 - DNA, 18 bp, Homo sapiens
tctagaaacttctctcct

SEQ ID NO: 9251898 - DNA, 22 bp, Homo sapiens
tctagaaattttgccttgtatt

SEQ ID NO: 9251899 - DNA, 22 bp, Homo sapiens
tctagaaattttgccttgtatt

SEQ ID NO: 9251900 - DNA, 22 bp, Homo sapiens
ccaccctgccttgggccagtga

SEQ ID NO: 9251901 - DNA, 22 bp, Homo sapiens
ccaccctgagccgcaagagcag

SEQ ID NO: 9251902 - DNA, 22 bp, Homo sapiens
tcctgtggtcattcttctgccc

SEQ ID NO: 9251903 - DNA, 22 bp, Homo sapiens
tcctgtggtcattcttctgccc

SEQ ID NO: 9251904 - DNA, 22 bp, Homo sapiens
tcctgtggtctggaaggaatgg

SEQ ID NO: 9251905 - DNA, 22 bp, Homo sapiens
tcctgtgtgggcaggatgagaa

SEQ ID NO: 9251906 - DNA, 19 bp, Homo sapiens
ccacccctttgctgggccc

SEQ ID NO: 9251907 - DNA, 22 bp, Homo sapiens
ccacccctgggtgcagggagcg

SEQ ID NO: 9251908 - DNA, 18 bp, Homo sapiens
ccacccagggggagagga

SEQ ID NO: 9251909 - DNA, 18 bp, Homo sapiens
ccacccagggggagagga

SEQ ID NO: 9251910 - DNA, 18 bp, Homo sapiens
ccacccagggggagagga

SEQ ID NO: 9251911 - DNA, 23 bp, Homo sapiens
tctcagttccagaggctacaagt

SEQ ID NO: 9251912 - DNA, 22 bp, Homo sapiens
ccagagaggccttggcaagaca

SEQ ID NO: 9251913 - DNA, 22 bp, Homo sapiens
tctcagtgtgttgagaggtctg

SEQ ID NO: 9251914 - DNA, 22 bp, Homo sapiens
tctcaggactttgggaagctca

SEQ ID NO: 9251915 - DNA, 22 bp, Homo sapiens
tctcaggaatagagtggcagca

SEQ ID NO: 9251916 - DNA, 22 bp, Homo sapiens
tctcagctgcctgccctgctcc

SEQ ID NO: 9251917 - DNA, 22 bp, Homo sapiens
tctatacacacaaagaatgctt

SEQ ID NO: 9251918 - DNA, 22 bp, Homo sapiens
tctatacatgtgcacacacatc

SEQ ID NO: 9251919 - DNA, 22 bp, Homo sapiens
tctataaatgcagatatgtgtg

SEQ ID NO: 9251920 - DNA, 22 bp, Homo sapiens
tctataatcctatttcaactgc

SEQ ID NO: 9251921 - DNA, 22 bp, Homo sapiens
tctataaattatgcagtctcag

SEQ ID NO: 9251922 - DNA, 22 bp, Homo sapiens
ccagaggtcccctgccaggagg

SEQ ID NO: 9251923 - DNA, 18 bp, Homo sapiens
ccagagggtgcgtcagct

SEQ ID NO: 9251924 - DNA, 18 bp, Homo sapiens
ccagagggtgcgtcagct

SEQ ID NO: 9251925 - DNA, 22 bp, Homo sapiens
ccagaggtctcctgcacgggat

SEQ ID NO: 9251926 - DNA, 22 bp, Homo sapiens
ccagaggtgaacaggaggctgt

SEQ ID NO: 9251927 - DNA, 20 bp, Homo sapiens
ccagagggtagggccgcccc

SEQ ID NO: 9251928 - DNA, 20 bp, Homo sapiens
ccagagggtagggccgcccc

SEQ ID NO: 9251929 - DNA, 22 bp, Homo sapiens
ccagaggggctgagcaggtcac

SEQ ID NO: 9251930 - DNA, 22 bp, Homo sapiens
ccagaggggctgagcaggtcac

SEQ ID NO: 9251931 - DNA, 22 bp, Homo sapiens
ccagagggcaaaatgaagctta

SEQ ID NO: 9251932 - DNA, 21 bp, Homo sapiens
tctctggttggagttgtgcca

SEQ ID NO: 9251933 - DNA, 22 bp, Homo sapiens
tctctgtaaaatgtggatgata

SEQ ID NO: 9251934 - DNA, 22 bp, Homo sapiens
tctctgtaaaatgtggatgata

SEQ ID NO: 9251935 - DNA, 22 bp, Homo sapiens
tctctgtacagtacatgccgtg

SEQ ID NO: 9251936 - DNA, 22 bp, Homo sapiens
tctctgtagacctgaccagcac

SEQ ID NO: 9251937 - DNA, 23 bp, Homo sapiens
tctctgtacagatgaggacacac

SEQ ID NO: 9251938 - DNA, 22 bp, Homo sapiens
tctctgtagggctgcttgagta

SEQ ID NO: 9251939 - DNA, 22 bp, Homo sapiens
tctctgtagttgggcagctgct

SEQ ID NO: 9251940 - DNA, 22 bp, Homo sapiens
tctctgtagttgggcagctgct

SEQ ID NO: 9251941 - DNA, 22 bp, Homo sapiens
tctctgtatcagcacctgctgg

SEQ ID NO: 9251942 - DNA, 22 bp, Homo sapiens
tctctgtagagacagcactgtg

SEQ ID NO: 9251943 - DNA, 22 bp, Homo sapiens
tctctgtagagacagcactgtg

SEQ ID NO: 9251944 - DNA, 22 bp, Homo sapiens
tctctgtatcccagaaccaaaa

SEQ ID NO: 9251945 - DNA, 21 bp, Homo sapiens
tctctgtatccatgggttcca

SEQ ID NO: 9251946 - DNA, 22 bp, Homo sapiens
tctctgtattctgatattcact

SEQ ID NO: 9251947 - DNA, 22 bp, Homo sapiens
ccagatgtccctctcaggtttg

SEQ ID NO: 9251948 - DNA, 22 bp, Homo sapiens
ccagaggctggcaagggctcct

SEQ ID NO: 9251949 - DNA, 22 bp, Homo sapiens
ccagaggctggcagccagctga

SEQ ID NO: 9251950 - DNA, 21 bp, Homo sapiens
ccagagcctgagaggattatg

SEQ ID NO: 9251951 - DNA, 22 bp, Homo sapiens
ccagagcctcttatgaagatcg

SEQ ID NO: 9251952 - DNA, 22 bp, Homo sapiens
ccagaggatcagtactggctgg

SEQ ID NO: 9251953 - DNA, 22 bp, Homo sapiens
ccagagcctcgcccggagcctc

SEQ ID NO: 9251954 - DNA, 22 bp, Homo sapiens
ccagagcctcgcccggagcctc

SEQ ID NO: 9251955 - DNA, 22 bp, Homo sapiens
ccagagcctaagatctgatcct

SEQ ID NO: 9251956 - DNA, 22 bp, Homo sapiens
ccagagcctaagatctgatcct

SEQ ID NO: 9251957 - DNA, 22 bp, Homo sapiens
ccagagcctcaacacaggtcct

SEQ ID NO: 9251958 - DNA, 22 bp, Homo sapiens
ccagaggctggggaaggataca

SEQ ID NO: 9251959 - DNA, 22 bp, Homo sapiens
ccagagggagccaccagggtgt

SEQ ID NO: 9251960 - DNA, 22 bp, Homo sapiens
ccagagggaactgggcctcatt

SEQ ID NO: 9251961 - DNA, 22 bp, Homo sapiens
ccagaggctgggttcacctcag

SEQ ID NO: 9251962 - DNA, 22 bp, Homo sapiens
ccagagggaagaggaagcgctg

SEQ ID NO: 9251963 - DNA, 22 bp, Homo sapiens
ccagagggaactgggcctcatt

SEQ ID NO: 9251964 - DNA, 22 bp, Homo sapiens
ccagagcagggcagcagggctc

SEQ ID NO: 9251965 - DNA, 20 bp, Homo sapiens
ccagagcagccactgaagtt

SEQ ID NO: 9251966 - DNA, 20 bp, Homo sapiens
ccagagcagccactgaagtt

SEQ ID NO: 9251967 - DNA, 22 bp, Homo sapiens
ccagagcagggcagcagggctc

SEQ ID NO: 9251968 - DNA, 22 bp, Homo sapiens
ccagagccagagaggtgcctgc

SEQ ID NO: 9251969 - DNA, 22 bp, Homo sapiens
ccagagccagagaggtgcctgc

SEQ ID NO: 9251970 - DNA, 22 bp, Homo sapiens
ccagagcatgaagggcaatgac

SEQ ID NO: 9251971 - DNA, 22 bp, Homo sapiens
ccagagcccagggtcatgcagg

SEQ ID NO: 9251972 - DNA, 22 bp, Homo sapiens
ccagagcccagggtcatgcagg

SEQ ID NO: 9251973 - DNA, 22 bp, Homo sapiens
ccagagccggctccctcagctt

SEQ ID NO: 9251974 - DNA, 22 bp, Homo sapiens
ccagagcccgggacctggactt

SEQ ID NO: 9251975 - DNA, 22 bp, Homo sapiens
ccagagcccagggtcatgcagg

SEQ ID NO: 9251976 - DNA, 19 bp, Homo sapiens
ccagagcccgccagatggg

SEQ ID NO: 9251977 - DNA, 22 bp, Homo sapiens
catttccacttctgaaaactgg

SEQ ID NO: 9251978 - DNA, 22 bp, Homo sapiens
catttccttcctgctgctcctc

SEQ ID NO: 9251979 - DNA, 22 bp, Homo sapiens
catttcctgtctggaggtcaaa

SEQ ID NO: 9251980 - DNA, 22 bp, Homo sapiens
catttctaagaagatctgggta

SEQ ID NO: 9251981 - DNA, 22 bp, Homo sapiens
catttctaagaaggctgcacat

SEQ ID NO: 9251982 - DNA, 21 bp, Homo sapiens
catttctaagcctggctatag

SEQ ID NO: 9251983 - DNA, 21 bp, Homo sapiens
catttctaagcctggctatag

SEQ ID NO: 9251984 - DNA, 22 bp, Homo sapiens
catttctaccaaatgtgactgg

SEQ ID NO: 9251985 - DNA, 22 bp, Homo sapiens
catttctaccaaatgtgactgg

SEQ ID NO: 9251986 - DNA, 22 bp, Homo sapiens
catttctagggatcataaagta

SEQ ID NO: 9251987 - DNA, 22 bp, Homo sapiens
catttctagagtcccaagaggt

SEQ ID NO: 9251988 - DNA, 22 bp, Homo sapiens
catttctagagtcccaagaggt

SEQ ID NO: 9251989 - DNA, 22 bp, Homo sapiens
catttcatagttgtcacaataa

SEQ ID NO: 9251990 - DNA, 22 bp, Homo sapiens
catttcatagttgtcacaataa

SEQ ID NO: 9251991 - DNA, 22 bp, Homo sapiens
catttcagtgtcttgtgatgaa

SEQ ID NO: 9251992 - DNA, 20 bp, Homo sapiens
catttcattgtgtcttcact

SEQ ID NO: 9251993 - DNA, 22 bp, Homo sapiens
catttcattcctttgaaagtgg

SEQ ID NO: 9251994 - DNA, 21 bp, Homo sapiens
catttcatgattatagaaatg

SEQ ID NO: 9251995 - DNA, 21 bp, Homo sapiens
catttcatgattatagaaatg

SEQ ID NO: 9251996 - DNA, 22 bp, Homo sapiens
tccatatacaacttaatcttta

SEQ ID NO: 9251997 - DNA, 22 bp, Homo sapiens
tccatacccagctttctcacac

SEQ ID NO: 9251998 - DNA, 22 bp, Homo sapiens
catttcaccttagagaattatt

SEQ ID NO: 9251999 - DNA, 22 bp, Homo sapiens
catttattggcatgtagtaggt

SEQ ID NO: 9252000 - DNA, 18 bp, Homo sapiens
tccaggtcccaggggaag

SEQ ID NO: 9252001 - DNA, 19 bp, Homo sapiens
tccagtttggcaggaagac

SEQ ID NO: 9252002 - DNA, 22 bp, Homo sapiens
tccagtttcctgtggctgccta

SEQ ID NO: 9252003 - DNA, 19 bp, Homo sapiens
tccagtttggcaggaagac

SEQ ID NO: 9252004 - DNA, 22 bp, Homo sapiens
tccagtttggttctgttctcca

SEQ ID NO: 9252005 - DNA, 22 bp, Homo sapiens
tccagtttgggtgtgagctgcg

SEQ ID NO: 9252006 - DNA, 22 bp, Homo sapiens
tccagttttgaatcctgcttct

SEQ ID NO: 9252007 - DNA, 21 bp, Homo sapiens
tccataagagaccatctccta

SEQ ID NO: 9252008 - DNA, 22 bp, Homo sapiens
tccataaaccagaaaatcaaga

SEQ ID NO: 9252009 - DNA, 22 bp, Homo sapiens
tccatacataaaatgtttaatg

SEQ ID NO: 9252010 - DNA, 22 bp, Homo sapiens
tccatacacattgaattttagt

SEQ ID NO: 9252011 - DNA, 22 bp, Homo sapiens
cattttcatgagtttctgttca

SEQ ID NO: 9252012 - DNA, 22 bp, Homo sapiens
cattttcatgagtttctgttca

SEQ ID NO: 9252013 - DNA, 19 bp, Homo sapiens
cattttcccatcatccttt

SEQ ID NO: 9252014 - DNA, 22 bp, Homo sapiens
cattttctcaatgaaccctctt

SEQ ID NO: 9252015 - DNA, 22 bp, Homo sapiens
cattttgtgctagacactatgg

SEQ ID NO: 9252016 - DNA, 22 bp, Homo sapiens
tcctgaggctcactttgaatgt

SEQ ID NO: 9252017 - DNA, 22 bp, Homo sapiens
tcctgacttaactactctctgg

SEQ ID NO: 9252018 - DNA, 22 bp, Homo sapiens
tcctgagggctcggggctcatg

SEQ ID NO: 9252019 - DNA, 22 bp, Homo sapiens
tcctgagggcgattcagcaggt

SEQ ID NO: 9252020 - DNA, 22 bp, Homo sapiens
tcctgagggcgattcagcaggt

SEQ ID NO: 9252021 - DNA, 22 bp, Homo sapiens
tcctgagggcgattcagcaggt

SEQ ID NO: 9252022 - DNA, 22 bp, Homo sapiens
cattttcagcacccatctgaaa

SEQ ID NO: 9252023 - DNA, 22 bp, Homo sapiens
cattttcagcacccatctgaaa

SEQ ID NO: 9252024 - DNA, 22 bp, Homo sapiens
cattttcagcacccatctgaaa

SEQ ID NO: 9252025 - DNA, 22 bp, Homo sapiens
cattttcagcacccatctgaaa

SEQ ID NO: 9252026 - DNA, 22 bp, Homo sapiens
cattttatgtttatggagtgct

SEQ ID NO: 9252027 - DNA, 22 bp, Homo sapiens
cattttatgtttatggagtgct

SEQ ID NO: 9252028 - DNA, 22 bp, Homo sapiens
cattttatcctctgggaagcta

SEQ ID NO: 9252029 - DNA, 22 bp, Homo sapiens
cattttatcctctgggaagcta

SEQ ID NO: 9252030 - DNA, 22 bp, Homo sapiens
cattttatcctctgggaagcta

SEQ ID NO: 9252031 - DNA, 22 bp, Homo sapiens
cattttactgactcttgaatta

SEQ ID NO: 9252032 - DNA, 22 bp, Homo sapiens
cattttacctagaagctgaaag

SEQ ID NO: 9252033 - DNA, 21 bp, Homo sapiens
catttctattgatgagaaaag

SEQ ID NO: 9252034 - DNA, 21 bp, Homo sapiens
catttctattgatgagaaaag

SEQ ID NO: 9252035 - DNA, 21 bp, Homo sapiens
catttctattgatgagaaaag

SEQ ID NO: 9252036 - DNA, 22 bp, Homo sapiens
catttctatggcaatgggaaaa

SEQ ID NO: 9252037 - DNA, 22 bp, Homo sapiens
cattttaagatgacctggtttc

SEQ ID NO: 9252038 - DNA, 22 bp, Homo sapiens
cattttaagatgacctggtttc

SEQ ID NO: 9252039 - DNA, 22 bp, Homo sapiens
cattttaaatgatttaagccaa

SEQ ID NO: 9252040 - DNA, 19 bp, Homo sapiens
cattttaagcatccccagt

SEQ ID NO: 9252041 - DNA, 21 bp, Homo sapiens
tcctgccttagtccagagcag

SEQ ID NO: 9252042 - DNA, 22 bp, Homo sapiens
tcctgccttagagcaaggaaaa

SEQ ID NO: 9252043 - DNA, 22 bp, Homo sapiens
tcctgccttagagcaaggaaaa

SEQ ID NO: 9252044 - DNA, 21 bp, Homo sapiens
tcctgccttagtccagagcag

SEQ ID NO: 9252045 - DNA, 21 bp, Homo sapiens
tcctgccttagtccagagcag

SEQ ID NO: 9252046 - DNA, 22 bp, Homo sapiens
tcctgccttcatactgctgtat

SEQ ID NO: 9252047 - DNA, 22 bp, Homo sapiens
tcctgccttagagcaaggaaaa

SEQ ID NO: 9252048 - DNA, 22 bp, Homo sapiens
tcctgccttgcctgggacatca

SEQ ID NO: 9252049 - DNA, 22 bp, Homo sapiens
tcctgccttgcctgggacatca

SEQ ID NO: 9252050 - DNA, 22 bp, Homo sapiens
tcctgccttgcctgggacatca

SEQ ID NO: 9252051 - DNA, 22 bp, Homo sapiens
tcctgccttgcctgggacatca

SEQ ID NO: 9252052 - DNA, 22 bp, Homo sapiens
tcctgccttcatactgctgtat

SEQ ID NO: 9252053 - DNA, 22 bp, Homo sapiens
tcctgccttcatactgctgtat

SEQ ID NO: 9252054 - DNA, 22 bp, Homo sapiens
tcctgccttcatactgctgtat

SEQ ID NO: 9252055 - DNA, 22 bp, Homo sapiens
tcctgccttcatactgctgtat

SEQ ID NO: 9252056 - DNA, 22 bp, Homo sapiens
tcctgagggctgcagtcatagg

SEQ ID NO: 9252057 - DNA, 22 bp, Homo sapiens
tcctgagggctcggggctcatg

SEQ ID NO: 9252058 - DNA, 22 bp, Homo sapiens
tcctgagggctgcagtcatagg

SEQ ID NO: 9252059 - DNA, 23 bp, Homo sapiens
tcctgagggtttcccagccttgg

SEQ ID NO: 9252060 - DNA, 23 bp, Homo sapiens
tcctgagggtttcccagccttgg

SEQ ID NO: 9252061 - DNA, 22 bp, Homo sapiens
tcctgaggtgctcagccaggaa

SEQ ID NO: 9252062 - DNA, 22 bp, Homo sapiens
tcctgaggtatatgctttgcag

SEQ ID NO: 9252063 - DNA, 22 bp, Homo sapiens
tcctgaggtggattgagcagag

SEQ ID NO: 9252064 - DNA, 22 bp, Homo sapiens
tcctgaggtggattgagcagag

SEQ ID NO: 9252065 - DNA, 22 bp, Homo sapiens
tcctgaggtggattgagcagag

SEQ ID NO: 9252066 - DNA, 23 bp, Homo sapiens
ccaagactgttaggagtggggag

SEQ ID NO: 9252067 - DNA, 22 bp, Homo sapiens
ccaacaggtgttctgtttttca

SEQ ID NO: 9252068 - DNA, 22 bp, Homo sapiens
ccaagaggcagaatgcagagaa

SEQ ID NO: 9252069 - DNA, 23 bp, Homo sapiens
ccaagactgttaggagtggggag

SEQ ID NO: 9252070 - DNA, 22 bp, Homo sapiens
ccacaggggtctctgtagctga

SEQ ID NO: 9252071 - DNA, 22 bp, Homo sapiens
ccacaggggtctctgtagctga

SEQ ID NO: 9252072 - DNA, 22 bp, Homo sapiens
tcctggccttagcgaggcggtc

SEQ ID NO: 9252073 - DNA, 22 bp, Homo sapiens
tcctggccttagcgaggcggtc

SEQ ID NO: 9252074 - DNA, 22 bp, Homo sapiens
tcctggccttgcgtcttgggag

SEQ ID NO: 9252075 - DNA, 22 bp, Homo sapiens
ccaccaggacagccctgagggg

SEQ ID NO: 9252076 - DNA, 22 bp, Homo sapiens
tcctggctccactgagcaggcc

SEQ ID NO: 9252077 - DNA, 22 bp, Homo sapiens
ccacagctgacaatggatagac

SEQ ID NO: 9252078 - DNA, 22 bp, Homo sapiens
ccacagctgacaatggatagac

SEQ ID NO: 9252079 - DNA, 22 bp, Homo sapiens
ccacagctgaccgcaggtgagc

SEQ ID NO: 9252080 - DNA, 22 bp, Homo sapiens
ccacagctgaccgcaggtgagc

SEQ ID NO: 9252081 - DNA, 22 bp, Homo sapiens
tcctggaggaataagttttcca

SEQ ID NO: 9252082 - DNA, 22 bp, Homo sapiens
ccacagggcacagacaggaagc

SEQ ID NO: 9252083 - DNA, 22 bp, Homo sapiens
ccacaggctgctgcaggtcccg

SEQ ID NO: 9252084 - DNA, 22 bp, Homo sapiens
catgctgattcttcctgagctt

SEQ ID NO: 9252085 - DNA, 19 bp, Homo sapiens
catgctgacctgctgtggt

SEQ ID NO: 9252086 - DNA, 22 bp, Homo sapiens
catgctgagcacattctgtatt

SEQ ID NO: 9252087 - DNA, 22 bp, Homo sapiens
catgctggtcagccagtggatg

SEQ ID NO: 9252088 - DNA, 22 bp, Homo sapiens
catgctggtcagccagtggatg

SEQ ID NO: 9252089 - DNA, 22 bp, Homo sapiens
tccaagaagcttacaatctaat

SEQ ID NO: 9252090 - DNA, 22 bp, Homo sapiens
catgctccagctccagacaggt

SEQ ID NO: 9252091 - DNA, 22 bp, Homo sapiens
catgctctagattctctctaat

SEQ ID NO: 9252092 - DNA, 22 bp, Homo sapiens
catgctctctggcaacttgtgt

SEQ ID NO: 9252093 - DNA, 22 bp, Homo sapiens
catgctctctggcaacttgtgt

SEQ ID NO: 9252094 - DNA, 22 bp, Homo sapiens
catgctaattcccaggccccaa

SEQ ID NO: 9252095 - DNA, 22 bp, Homo sapiens
catgctaattaattccacctgc

SEQ ID NO: 9252096 - DNA, 22 bp, Homo sapiens
catgctcacaaaagatggcaaa

SEQ ID NO: 9252097 - DNA, 22 bp, Homo sapiens
catgctaaccagagacataaag

SEQ ID NO: 9252098 - DNA, 22 bp, Homo sapiens
catgctaagtcataaaagagta

SEQ ID NO: 9252099 - DNA, 22 bp, Homo sapiens
catgccaacaacaagcaatgag

SEQ ID NO: 9252100 - DNA, 22 bp, Homo sapiens
catgcattttctattcactcag

SEQ ID NO: 9252101 - DNA, 22 bp, Homo sapiens
catgccaagcatgttcagaagt

SEQ ID NO: 9252102 - DNA, 22 bp, Homo sapiens
tcatcagggatattggcctgaa

SEQ ID NO: 9252103 - DNA, 22 bp, Homo sapiens
tcatcagtccttttcattatga

SEQ ID NO: 9252104 - DNA, 22 bp, Homo sapiens
catgcattttctattcactcag

SEQ ID NO: 9252105 - DNA, 22 bp, Homo sapiens
tccaagagttcaaggctacagt

SEQ ID NO: 9252106 - DNA, 22 bp, Homo sapiens
tccaagatctacagcagtttag

SEQ ID NO: 9252107 - DNA, 22 bp, Homo sapiens
tccaagaggagacactgggatg

SEQ ID NO: 9252108 - DNA, 22 bp, Homo sapiens
tccaagaatcactgacacagct

SEQ ID NO: 9252109 - DNA, 22 bp, Homo sapiens
tccaagagaatactggagagta

SEQ ID NO: 9252110 - DNA, 22 bp, Homo sapiens
tccaagaagcttacaatctaat

SEQ ID NO: 9252111 - DNA, 18 bp, Homo sapiens
tccagaggtgttggagcc

SEQ ID NO: 9252112 - DNA, 18 bp, Homo sapiens
tccagaggtgttggagcc

SEQ ID NO: 9252113 - DNA, 18 bp, Homo sapiens
tccagaggtgttggagcc

SEQ ID NO: 9252114 - DNA, 22 bp, Homo sapiens
tccagagtacggaagagtcatc

SEQ ID NO: 9252115 - DNA, 22 bp, Homo sapiens
tccagatagagtcctgttagta

SEQ ID NO: 9252116 - DNA, 22 bp, Homo sapiens
tccaagcactgttaattaaact

SEQ ID NO: 9252117 - DNA, 22 bp, Homo sapiens
tccaagcatgtggtcaggagcc

SEQ ID NO: 9252118 - DNA, 22 bp, Homo sapiens
catgcttaattggagcattcat

SEQ ID NO: 9252119 - DNA, 22 bp, Homo sapiens
catgcttaattggagcattcat

SEQ ID NO: 9252120 - DNA, 22 bp, Homo sapiens
catgcttatatggaaaggaaga

SEQ ID NO: 9252121 - DNA, 22 bp, Homo sapiens
catgcttacttgtctcagcaga

SEQ ID NO: 9252122 - DNA, 22 bp, Homo sapiens
catgcttatatggaaaggaaga

SEQ ID NO: 9252123 - DNA, 22 bp, Homo sapiens
catgcttcctccaaactaccct

SEQ ID NO: 9252124 - DNA, 22 bp, Homo sapiens
catgcttatgatttgctaagcc

SEQ ID NO: 9252125 - DNA, 22 bp, Homo sapiens
catgctttgggtcagaaatgcc

SEQ ID NO: 9252126 - DNA, 22 bp, Homo sapiens
catgctttctgtccaaatgtta

SEQ ID NO: 9252127 - DNA, 22 bp, Homo sapiens
catgctttctgtccaaatgtta

SEQ ID NO: 9252128 - DNA, 22 bp, Homo sapiens
catgctttgggtcagaaatgcc

SEQ ID NO: 9252129 - DNA, 22 bp, Homo sapiens
catgcttttcaatctatcttaa

SEQ ID NO: 9252130 - DNA, 22 bp, Homo sapiens
catgctttttgacaacaagctg

SEQ ID NO: 9252131 - DNA, 22 bp, Homo sapiens
catgcttttcaatctatcttaa

SEQ ID NO: 9252132 - DNA, 23 bp, Homo sapiens
catggaaaactgaaagctgacct

SEQ ID NO: 9252133 - DNA, 22 bp, Homo sapiens
catgcttttttctagtataaat

SEQ ID NO: 9252134 - DNA, 22 bp, Homo sapiens
tccagcagaaaagaggtaggga

SEQ ID NO: 9252135 - DNA, 20 bp, Homo sapiens
tccagcaccctcacagagaa

SEQ ID NO: 9252136 - DNA, 22 bp, Homo sapiens
tccagatggatttaagacctaa

SEQ ID NO: 9252137 - DNA, 22 bp, Homo sapiens
catggaacaaggaagatgtttg

SEQ ID NO: 9252138 - DNA, 22 bp, Homo sapiens
catgggctcttctggactgcac

SEQ ID NO: 9252139 - DNA, 22 bp, Homo sapiens
catgtaaagaatttcacacaag

SEQ ID NO: 9252140 - DNA, 22 bp, Homo sapiens
catgtaaaacactcagaacagt

SEQ ID NO: 9252141 - DNA, 22 bp, Homo sapiens
catgtaaaccattgtgagcatc

SEQ ID NO: 9252142 - DNA, 22 bp, Homo sapiens
catgtaaaaagaagaatctgga

SEQ ID NO: 9252143 - DNA, 22 bp, Homo sapiens
catgtaaaacactcagaacagt

SEQ ID NO: 9252144 - DNA, 22 bp, Homo sapiens
catgtaaaaaattaggtcatct

SEQ ID NO: 9252145 - DNA, 22 bp, Homo sapiens
tccagggcagtgactacagcgg

SEQ ID NO: 9252146 - DNA, 22 bp, Homo sapiens
tccagggcagtgactacagcgg

SEQ ID NO: 9252147 - DNA, 23 bp, Homo sapiens
tccagggcagtggctgggtctgc

SEQ ID NO: 9252148 - DNA, 22 bp, Homo sapiens
cattacaaccccaaattacaaa

SEQ ID NO: 9252149 - DNA, 22 bp, Homo sapiens
cattacaaccccaaattacaaa

SEQ ID NO: 9252150 - DNA, 22 bp, Homo sapiens
tccagggcaggtgctgggctct

SEQ ID NO: 9252151 - DNA, 22 bp, Homo sapiens
cattacaaagttataaacagtt

SEQ ID NO: 9252152 - DNA, 22 bp, Homo sapiens
cattacaaagttataaacagtt

SEQ ID NO: 9252153 - DNA, 22 bp, Homo sapiens
cattaataaacatttcagaaga

SEQ ID NO: 9252154 - DNA, 22 bp, Homo sapiens
cattaatattgttcttctttag

SEQ ID NO: 9252155 - DNA, 22 bp, Homo sapiens
cattacaaacatgttaagattt

SEQ ID NO: 9252156 - DNA, 22 bp, Homo sapiens
tccaggtcccagactgggcagc

SEQ ID NO: 9252157 - DNA, 22 bp, Homo sapiens
tccaggggtgatttttgacttg

SEQ ID NO: 9252158 - DNA, 22 bp, Homo sapiens
tccagggtgtgtttactggggt

SEQ ID NO: 9252159 - DNA, 22 bp, Homo sapiens
tccagggcatgctcagactcag

SEQ ID NO: 9252160 - DNA, 22 bp, Homo sapiens
tccagggcatggggagagagtg

SEQ ID NO: 9252161 - DNA, 22 bp, Homo sapiens
tccagggcatggggagagagtg

SEQ ID NO: 9252162 - DNA, 22 bp, Homo sapiens
tccagggcatggggagagagtg

SEQ ID NO: 9252163 - DNA, 22 bp, Homo sapiens
tccaggggacactgtttctcca

SEQ ID NO: 9252164 - DNA, 21 bp, Homo sapiens
tccaggggccagcacccaagc

SEQ ID NO: 9252165 - DNA, 19 bp, Homo sapiens
tccaggggctccacctcct

SEQ ID NO: 9252166 - DNA, 22 bp, Homo sapiens
tccaggggagactagacccaca

SEQ ID NO: 9252167 - DNA, 22 bp, Homo sapiens
catgttttctaggctttcacaa

SEQ ID NO: 9252168 - DNA, 22 bp, Homo sapiens
catgttttgtgtacagaatatt

SEQ ID NO: 9252169 - DNA, 22 bp, Homo sapiens
catgttttgtgtacagaatatt

SEQ ID NO: 9252170 - DNA, 22 bp, Homo sapiens
cattaagtatttcagttactgt

SEQ ID NO: 9252171 - DNA, 22 bp, Homo sapiens
catgtgtcaaatgatgtagctg

SEQ ID NO: 9252172 - DNA, 22 bp, Homo sapiens
catgttttctaggctttcacaa

SEQ ID NO: 9252173 - DNA, 22 bp, Homo sapiens
catgtgggaagaggccagctgg

SEQ ID NO: 9252174 - DNA, 22 bp, Homo sapiens
tccaggctttttcatgctgtct

SEQ ID NO: 9252175 - DNA, 22 bp, Homo sapiens
catgtgctgtagcagagaggaa

SEQ ID NO: 9252176 - DNA, 22 bp, Homo sapiens
tccaggctttggggcaggagcg

SEQ ID NO: 9252177 - DNA, 22 bp, Homo sapiens
tccaggctttggggcaggagcg

SEQ ID NO: 9252178 - DNA, 22 bp, Homo sapiens
tccaggctttggggcaggagcg

SEQ ID NO: 9252179 - DNA, 22 bp, Homo sapiens
tccaggctttggggcaggagcg

SEQ ID NO: 9252180 - DNA, 22 bp, Homo sapiens
tccaggcttgagaccaggctct

SEQ ID NO: 9252181 - DNA, 22 bp, Homo sapiens
tccaggcttgagaccaggctct

SEQ ID NO: 9252182 - DNA, 22 bp, Homo sapiens
catgtacactcatgtaactata

SEQ ID NO: 9252183 - DNA, 22 bp, Homo sapiens
tccaggcttcacgtctgccctc

SEQ ID NO: 9252184 - DNA, 22 bp, Homo sapiens
tccaggctgtgcgcaccgtgtg

SEQ ID NO: 9252185 - DNA, 22 bp, Homo sapiens
tccaggcttcacgtctgccctc

SEQ ID NO: 9252186 - DNA, 22 bp, Homo sapiens
tccaggctgtgcgcaccgtgtg

SEQ ID NO: 9252187 - DNA, 22 bp, Homo sapiens
tccaggctgtgcatgagtttag

SEQ ID NO: 9252188 - DNA, 22 bp, Homo sapiens
tccaggctgtgcgcaccgtgtg

SEQ ID NO: 9252189 - DNA, 20 bp, Homo sapiens
tccaggctcctccacttagt

SEQ ID NO: 9252190 - DNA, 20 bp, Homo sapiens
tccaggctcctccacttagt

SEQ ID NO: 9252191 - DNA, 22 bp, Homo sapiens
tccaggctgggctgaagggtgc

SEQ ID NO: 9252192 - DNA, 22 bp, Homo sapiens
tccaggctcctgactttttggg

SEQ ID NO: 9252193 - DNA, 22 bp, Homo sapiens
tccaggctgggctgaagggtgc

SEQ ID NO: 9252194 - DNA, 22 bp, Homo sapiens
tccaggctgggctgaagggtgc

SEQ ID NO: 9252195 - DNA, 22 bp, Homo sapiens
tccaggctgtgcatgagtttag

SEQ ID NO: 9252196 - DNA, 22 bp, Homo sapiens
catctaaatttgactccaagga

SEQ ID NO: 9252197 - DNA, 22 bp, Homo sapiens
catcctgaagaagccgcactgt

SEQ ID NO: 9252198 - DNA, 22 bp, Homo sapiens
tcagtttcctggttgtgatatt

SEQ ID NO: 9252199 - DNA, 22 bp, Homo sapiens
catctaaatttgactccaagga

SEQ ID NO: 9252200 - DNA, 18 bp, Homo sapiens
catctacaaatgccagaa

SEQ ID NO: 9252201 - DNA, 22 bp, Homo sapiens
catctacaggagaatgtcactg

SEQ ID NO: 9252202 - DNA, 22 bp, Homo sapiens
catctacatgcttgccactgct

SEQ ID NO: 9252203 - DNA, 22 bp, Homo sapiens
tcataattgtatacatttatgg

SEQ ID NO: 9252204 - DNA, 22 bp, Homo sapiens
tcataatgtagttcatggctgg

SEQ ID NO: 9252205 - DNA, 22 bp, Homo sapiens
tcataatgaccccagagtccgc

SEQ ID NO: 9252206 - DNA, 22 bp, Homo sapiens
tcataagtggtttatatgcttg

SEQ ID NO: 9252207 - DNA, 22 bp, Homo sapiens
tcatacaactaagagtttcaga

SEQ ID NO: 9252208 - DNA, 20 bp, Homo sapiens
tcatacacatgagcatgcag

SEQ ID NO: 9252209 - DNA, 20 bp, Homo sapiens
tcatacacatgagcatgcag

SEQ ID NO: 9252210 - DNA, 22 bp, Homo sapiens
tcatacataacttgtacagtga

SEQ ID NO: 9252211 - DNA, 22 bp, Homo sapiens
tcatcaaagtcaaagaatgact

SEQ ID NO: 9252212 - DNA, 22 bp, Homo sapiens
tcatacataaataagagtttag

SEQ ID NO: 9252213 - DNA, 22 bp, Homo sapiens
tcatcactcattggacaacaga

SEQ ID NO: 9252214 - DNA, 22 bp, Homo sapiens
tcatcacatgtgtagtcatccc

SEQ ID NO: 9252215 - DNA, 20 bp, Homo sapiens
tcatcagataggttagtaca

SEQ ID NO: 9252216 - DNA, 20 bp, Homo sapiens
catcagtgcctgacaggtcc

SEQ ID NO: 9252217 - DNA, 22 bp, Homo sapiens
catcagtgttcactattccttc

SEQ ID NO: 9252218 - DNA, 22 bp, Homo sapiens
catcagtgtggcagttcactgt

SEQ ID NO: 9252219 - DNA, 22 bp, Homo sapiens
catcagcttttctatgtggtga

SEQ ID NO: 9252220 - DNA, 22 bp, Homo sapiens
catcagctttggcgctgagcat

SEQ ID NO: 9252221 - DNA, 22 bp, Homo sapiens
catcagagtggtggcctggtgt

SEQ ID NO: 9252222 - DNA, 22 bp, Homo sapiens
catcagctgagggtgagcagaa

SEQ ID NO: 9252223 - DNA, 22 bp, Homo sapiens
tcagtgtgggtaagcatgctgt

SEQ ID NO: 9252224 - DNA, 22 bp, Homo sapiens
tcagtgtgtacactgagcattt

SEQ ID NO: 9252225 - DNA, 22 bp, Homo sapiens
tcagtgtgattaggctatctga

SEQ ID NO: 9252226 - DNA, 22 bp, Homo sapiens
tcagtgtcttgggcttgaatgc

SEQ ID NO: 9252227 - DNA, 22 bp, Homo sapiens
tcagtgtcttgacctgggtgtg

SEQ ID NO: 9252228 - DNA, 22 bp, Homo sapiens
tcagtgtcttctctttcctacc

SEQ ID NO: 9252229 - DNA, 22 bp, Homo sapiens
catcataataacccagacacag

SEQ ID NO: 9252230 - DNA, 22 bp, Homo sapiens
catcataataacccagacacag

SEQ ID NO: 9252231 - DNA, 22 bp, Homo sapiens
catcataaaattgagataactg

SEQ ID NO: 9252232 - DNA, 22 bp, Homo sapiens
catcataaaattgagataactg

SEQ ID NO: 9252233 - DNA, 22 bp, Homo sapiens
catcatatatttctacaagtgc

SEQ ID NO: 9252234 - DNA, 22 bp, Homo sapiens
catcatcaaaacaaatggagtc

SEQ ID NO: 9252235 - DNA, 22 bp, Homo sapiens
catcatcaaaagtgacagagaa

SEQ ID NO: 9252236 - DNA, 22 bp, Homo sapiens
tcaggcagagctgtggagctct

SEQ ID NO: 9252237 - DNA, 22 bp, Homo sapiens
catatgttgacatttaaacctc

SEQ ID NO: 9252238 - DNA, 22 bp, Homo sapiens
tcaggcagagggagaagccaag

SEQ ID NO: 9252239 - DNA, 22 bp, Homo sapiens
tcaggcagagggagaagccaag

SEQ ID NO: 9252240 - DNA, 22 bp, Homo sapiens
catcaaatggcaagtgaaagct

SEQ ID NO: 9252241 - DNA, 22 bp, Homo sapiens
catcaaatctgacttttcttcc

SEQ ID NO: 9252242 - DNA, 22 bp, Homo sapiens
catcaaagttggtatatttgca

SEQ ID NO: 9252243 - DNA, 22 bp, Homo sapiens
catcaaaattagacattgttga

SEQ ID NO: 9252244 - DNA, 22 bp, Homo sapiens
tcaggctgcccgttcagggctc

SEQ ID NO: 9252245 - DNA, 18 bp, Homo sapiens
tcaggctgccctgtgtct

SEQ ID NO: 9252246 - DNA, 22 bp, Homo sapiens
tcaggctgcccgttcagggctc

SEQ ID NO: 9252247 - DNA, 22 bp, Homo sapiens
tcaggctgcatctgtaagggtg

SEQ ID NO: 9252248 - DNA, 22 bp, Homo sapiens
tcaggctgcagtggcaaaagac

SEQ ID NO: 9252249 - DNA, 22 bp, Homo sapiens
tcaggctgcctatcagactgtg

SEQ ID NO: 9252250 - DNA, 18 bp, Homo sapiens
tcaggctgccctgtgtct

SEQ ID NO: 9252251 - DNA, 22 bp, Homo sapiens
catcagagtcagagctctttct

SEQ ID NO: 9252252 - DNA, 21 bp, Homo sapiens
catcacattactcaaagtcct

SEQ ID NO: 9252253 - DNA, 22 bp, Homo sapiens
tcaggctgatttcttttgaggg

SEQ ID NO: 9252254 - DNA, 22 bp, Homo sapiens
catcaatgtgcagagatgaacg

SEQ ID NO: 9252255 - DNA, 21 bp, Homo sapiens
tcaggctgatgtcgatgttag

SEQ ID NO: 9252256 - DNA, 22 bp, Homo sapiens
tcaggctgcagctgtcagcagc

SEQ ID NO: 9252257 - DNA, 22 bp, Homo sapiens
tcaggctgcagctgtcagcagc

SEQ ID NO: 9252258 - DNA, 22 bp, Homo sapiens
catcaatgtgcagagatgaacg

SEQ ID NO: 9252259 - DNA, 23 bp, Homo sapiens
catcaagtacttttgacaagtgt

SEQ ID NO: 9252260 - DNA, 22 bp, Homo sapiens
catcaagtcatcaaagaattca

SEQ ID NO: 9252261 - DNA, 20 bp, Homo sapiens
catcaacaccttgtcagcct

SEQ ID NO: 9252262 - DNA, 22 bp, Homo sapiens
tcaggaggcggtgctgcctttg

SEQ ID NO: 9252263 - DNA, 22 bp, Homo sapiens
tcaggaggccaccaggacctgt

SEQ ID NO: 9252264 - DNA, 22 bp, Homo sapiens
tcaggaggccggcaggatttga

SEQ ID NO: 9252265 - DNA, 22 bp, Homo sapiens
tcaggaggccaccaggacctgt

SEQ ID NO: 9252266 - DNA, 22 bp, Homo sapiens
tcaggcagaattatcaaaagat

SEQ ID NO: 9252267 - DNA, 22 bp, Homo sapiens
tcaggcagaaaaatcactaatt

SEQ ID NO: 9252268 - DNA, 21 bp, Homo sapiens
tcaggaggctcagactcctgc

SEQ ID NO: 9252269 - DNA, 21 bp, Homo sapiens
tcacttataatgtatttgctg

SEQ ID NO: 9252270 - DNA, 22 bp, Homo sapiens
tcacttataaaatgcaagatct

SEQ ID NO: 9252271 - DNA, 22 bp, Homo sapiens
tcacttaaaaattctagttatg

SEQ ID NO: 9252272 - DNA, 22 bp, Homo sapiens
tcactgtttcctgtactggaca

SEQ ID NO: 9252273 - DNA, 22 bp, Homo sapiens
tcactgttttgcctgcacttcc

SEQ ID NO: 9252274 - DNA, 22 bp, Homo sapiens
tcacttattgctcatctcatgc

SEQ ID NO: 9252275 - DNA, 22 bp, Homo sapiens
tcactgtttcatccctagcact

SEQ ID NO: 9252276 - DNA, 22 bp, Homo sapiens
tcactgtttcctgtactggaca

SEQ ID NO: 9252277 - DNA, 22 bp, Homo sapiens
cagtgtctcaaaacaagttgct

SEQ ID NO: 9252278 - DNA, 22 bp, Homo sapiens
cagtgtcctcagccagcagcta

SEQ ID NO: 9252279 - DNA, 22 bp, Homo sapiens
cagtgtacttggaatgtaacag

SEQ ID NO: 9252280 - DNA, 22 bp, Homo sapiens
ccccagctgcatacttgccaag

SEQ ID NO: 9252281 - DNA, 22 bp, Homo sapiens
ccccagctgcatacttgccaag

SEQ ID NO: 9252282 - DNA, 22 bp, Homo sapiens
ccccagctgcatacttgccaag

SEQ ID NO: 9252283 - DNA, 22 bp, Homo sapiens
ccccaggaagcctcagatttgc

SEQ ID NO: 9252284 - DNA, 22 bp, Homo sapiens
ccccagctgagatttgaggaga

SEQ ID NO: 9252285 - DNA, 22 bp, Homo sapiens
ccccagctcagtgcagggacat

SEQ ID NO: 9252286 - DNA, 22 bp, Homo sapiens
ccccagctcagtgcagggacat

SEQ ID NO: 9252287 - DNA, 18 bp, Homo sapiens
tgctggggtagaatccac

SEQ ID NO: 9252288 - DNA, 22 bp, Homo sapiens
tgctgggggttcagatgagtaa

SEQ ID NO: 9252289 - DNA, 22 bp, Homo sapiens
tgctgggggttcagatgagtaa

SEQ ID NO: 9252290 - DNA, 22 bp, Homo sapiens
tgctgggggctttctggatacc

SEQ ID NO: 9252291 - DNA, 22 bp, Homo sapiens
cccagtggtgctggcatctgtg

SEQ ID NO: 9252292 - DNA, 22 bp, Homo sapiens
cccagtggggaaatagctagct

SEQ ID NO: 9252293 - DNA, 22 bp, Homo sapiens
tgctgcctttgtggggtcactg

SEQ ID NO: 9252294 - DNA, 22 bp, Homo sapiens
tgctgggcaccagtgcctgcag

SEQ ID NO: 9252295 - DNA, 21 bp, Homo sapiens
tgcttccctgggccacactga

SEQ ID NO: 9252296 - DNA, 22 bp, Homo sapiens
ccccaggagcttgttttagaga

SEQ ID NO: 9252297 - DNA, 22 bp, Homo sapiens
ccccaggagatttgggagcaca

SEQ ID NO: 9252298 - DNA, 22 bp, Homo sapiens
ccccaggagaaatcttaaacta

SEQ ID NO: 9252299 - DNA, 22 bp, Homo sapiens
ccccaggagatttgggagcaca

SEQ ID NO: 9252300 - DNA, 22 bp, Homo sapiens
ccccaggacacatggaccaagt

SEQ ID NO: 9252301 - DNA, 22 bp, Homo sapiens
ccccaggacgtggccctcatag

SEQ ID NO: 9252302 - DNA, 16 bp, Homo sapiens
ccccaggacttggcac

SEQ ID NO: 9252303 - DNA, 22 bp, Homo sapiens
tgcttccttgatcattcccaaa

SEQ ID NO: 9252304 - DNA, 22 bp, Homo sapiens
tgcttccttgatcattcccaaa

SEQ ID NO: 9252305 - DNA, 22 bp, Homo sapiens
tgcttccttgatcattcccaaa

SEQ ID NO: 9252306 - DNA, 22 bp, Homo sapiens
tgcttccttgagctctccaatc

SEQ ID NO: 9252307 - DNA, 22 bp, Homo sapiens
tgcttccttgagctctccaatc

SEQ ID NO: 9252308 - DNA, 22 bp, Homo sapiens
tgcttccttcccgttcttctcc

SEQ ID NO: 9252309 - DNA, 22 bp, Homo sapiens
tgcttccttcccgttcttctcc

SEQ ID NO: 9252310 - DNA, 20 bp, Homo sapiens
tgcttcctggccactgcggg

SEQ ID NO: 9252311 - DNA, 22 bp, Homo sapiens
tgcttccttcccgttcttctcc

SEQ ID NO: 9252312 - DNA, 22 bp, Homo sapiens
tgcttcctgctaaggctgcctg

SEQ ID NO: 9252313 - DNA, 22 bp, Homo sapiens
tgcttcctgaggccgtcttctc

SEQ ID NO: 9252314 - DNA, 22 bp, Homo sapiens
tgcttcctgaggccgtcttctc

SEQ ID NO: 9252315 - DNA, 22 bp, Homo sapiens
tgcttcctgaggccgtcttctc

SEQ ID NO: 9252316 - DNA, 19 bp, Homo sapiens
tgcttcctcaccatctccc

SEQ ID NO: 9252317 - DNA, 22 bp, Homo sapiens
tgcttcctatccacacaatgcc

SEQ ID NO: 9252318 - DNA, 22 bp, Homo sapiens
tgcttccgctaaaaattaatcc

SEQ ID NO: 9252319 - DNA, 22 bp, Homo sapiens
tgcttcctatccacacaatgcc

SEQ ID NO: 9252320 - DNA, 22 bp, Homo sapiens
tgcttcctatccacacaatgcc

SEQ ID NO: 9252321 - DNA, 22 bp, Homo sapiens
tgcttgggcggccagcatggcg

SEQ ID NO: 9252322 - DNA, 22 bp, Homo sapiens
tgcttgctggaggcagacagaa

SEQ ID NO: 9252323 - DNA, 22 bp, Homo sapiens
ccctccctctgctgggtgtaga

SEQ ID NO: 9252324 - DNA, 22 bp, Homo sapiens
ccctccccagggtcatattgaa

SEQ ID NO: 9252325 - DNA, 22 bp, Homo sapiens
ccctccccacaaagcttcacac

SEQ ID NO: 9252326 - DNA, 20 bp, Homo sapiens
tgcttgtcatgcactcaggc

SEQ ID NO: 9252327 - DNA, 22 bp, Homo sapiens
ccctccagtgtcccagtgggga

SEQ ID NO: 9252328 - DNA, 22 bp, Homo sapiens
ccctccccacaaagcttcacac

SEQ ID NO: 9252329 - DNA, 19 bp, Homo sapiens
tgctcaggccaaggagccc

SEQ ID NO: 9252330 - DNA, 22 bp, Homo sapiens
tgctagtgcagggttttcagtt

SEQ ID NO: 9252331 - DNA, 22 bp, Homo sapiens
tgctagatggagcagaatagct

SEQ ID NO: 9252332 - DNA, 23 bp, Homo sapiens
tgctactcaaagtgtggtcccag

SEQ ID NO: 9252333 - DNA, 22 bp, Homo sapiens
tgctacataggatagctcaaat

SEQ ID NO: 9252334 - DNA, 19 bp, Homo sapiens
tgctagaaattctgtgact

SEQ ID NO: 9252335 - DNA, 22 bp, Homo sapiens
tgctaatgtcctgaccgttctg

SEQ ID NO: 9252336 - DNA, 22 bp, Homo sapiens
tgctaatgtttcatttttagat

SEQ ID NO: 9252337 - DNA, 19 bp, Homo sapiens
tgctaagtcctttagaggc

SEQ ID NO: 9252338 - DNA, 22 bp, Homo sapiens
tgcaggtgctgtgtcaagagag

SEQ ID NO: 9252339 - DNA, 22 bp, Homo sapiens
tgctacaaattcgtaatcaatt

SEQ ID NO: 9252340 - DNA, 22 bp, Homo sapiens
tgctacactcaatcagtgctat

SEQ ID NO: 9252341 - DNA, 22 bp, Homo sapiens
tgctacagagccaggaagagtg

SEQ ID NO: 9252342 - DNA, 22 bp, Homo sapiens
tgcaggtgcctcttgagcttgt

SEQ ID NO: 9252343 - DNA, 22 bp, Homo sapiens
tgcaggtgccatcgctgctcat

SEQ ID NO: 9252344 - DNA, 22 bp, Homo sapiens
tgcaggtgcgttttcaagcctc

SEQ ID NO: 9252345 - DNA, 22 bp, Homo sapiens
tgcaggtgcctcttgagcttgt

SEQ ID NO: 9252346 - DNA, 22 bp, Homo sapiens
tgctgccttctaggcgtgccct

SEQ ID NO: 9252347 - DNA, 22 bp, Homo sapiens
tgctgccttagcagccaggcaa

SEQ ID NO: 9252348 - DNA, 22 bp, Homo sapiens
tgctgcctggtttcttcttgct

SEQ ID NO: 9252349 - DNA, 22 bp, Homo sapiens
tgctgcctggagccttttgttt

SEQ ID NO: 9252350 - DNA, 22 bp, Homo sapiens
tgctctggacgctgagtggttt

SEQ ID NO: 9252351 - DNA, 22 bp, Homo sapiens
tgctgcaggcaatagaaaacct

SEQ ID NO: 9252352 - DNA, 20 bp, Homo sapiens
tgctctggaaatggtctgag

SEQ ID NO: 9252353 - DNA, 22 bp, Homo sapiens
tgctctggaatagtcctaggca

SEQ ID NO: 9252354 - DNA, 22 bp, Homo sapiens
tgctcaggtcgttctgcccctt

SEQ ID NO: 9252355 - DNA, 22 bp, Homo sapiens
cccagtcctaaagcagacgcca

SEQ ID NO: 9252356 - DNA, 22 bp, Homo sapiens
cccagtgccaggcacaggcagc

SEQ ID NO: 9252357 - DNA, 22 bp, Homo sapiens
cccagtggctgtccccatgggc

SEQ ID NO: 9252358 - DNA, 22 bp, Homo sapiens
cccagtggaaggagtagaagac

SEQ ID NO: 9252359 - DNA, 22 bp, Homo sapiens
cccagtggagataggagtgtgg

SEQ ID NO: 9252360 - DNA, 22 bp, Homo sapiens
cccagtggaaggagtagaagac

SEQ ID NO: 9252361 - DNA, 18 bp, Homo sapiens
cccagtgctcactgcctc

SEQ ID NO: 9252362 - DNA, 22 bp, Homo sapiens
tggcaggtagtcagaggcgaca

SEQ ID NO: 9252363 - DNA, 22 bp, Homo sapiens
ccctttagcccctgcagagact

SEQ ID NO: 9252364 - DNA, 22 bp, Homo sapiens
cccttggaaggtagctggcagt

SEQ ID NO: 9252365 - DNA, 22 bp, Homo sapiens
cccttggaggaagctctaggct

SEQ ID NO: 9252366 - DNA, 19 bp, Homo sapiens
tggcagggagagtttgaag

SEQ ID NO: 9252367 - DNA, 22 bp, Homo sapiens
tggcagggagccaccggtcatg

SEQ ID NO: 9252368 - DNA, 22 bp, Homo sapiens
cccttgaagactagaatgagga

SEQ ID NO: 9252369 - DNA, 22 bp, Homo sapiens
cccttgaagactagaatgagga

SEQ ID NO: 9252370 - DNA, 22 bp, Homo sapiens
cccttgaaggcagggagtcctg

SEQ ID NO: 9252371 - DNA, 22 bp, Homo sapiens
cccttgaattttcagagagggg

SEQ ID NO: 9252372 - DNA, 22 bp, Homo sapiens
ccctgggagaagttgagggctg

SEQ ID NO: 9252373 - DNA, 22 bp, Homo sapiens
ccctgggagaagttgagggctg

SEQ ID NO: 9252374 - DNA, 22 bp, Homo sapiens
ccctgggagaagttgagggctg

SEQ ID NO: 9252375 - DNA, 22 bp, Homo sapiens
ccctgggacccgctgcagaggc

SEQ ID NO: 9252376 - DNA, 22 bp, Homo sapiens
ccctggctggaaattaagtagt

SEQ ID NO: 9252377 - DNA, 22 bp, Homo sapiens
ccctgggaagtattccagctat

SEQ ID NO: 9252378 - DNA, 22 bp, Homo sapiens
ccctgggaggcttccaggcaga

SEQ ID NO: 9252379 - DNA, 22 bp, Homo sapiens
tggcaggaaaaacattggagat

SEQ ID NO: 9252380 - DNA, 19 bp, Homo sapiens
tggcaggcccaggatggac

SEQ ID NO: 9252381 - DNA, 22 bp, Homo sapiens
tggcagggaatacagatgttta

SEQ ID NO: 9252382 - DNA, 22 bp, Homo sapiens
tggcaggctgagttggcctggt

SEQ ID NO: 9252383 - DNA, 22 bp, Homo sapiens
tggcagagaacacacatgattc

SEQ ID NO: 9252384 - DNA, 19 bp, Homo sapiens
tggcagacacaccttcttc

SEQ ID NO: 9252385 - DNA, 21 bp, Homo sapiens
tggcagacaggaggagctcac

SEQ ID NO: 9252386 - DNA, 22 bp, Homo sapiens
tggcagactttagggtctacat

SEQ ID NO: 9252387 - DNA, 22 bp, Homo sapiens
tggcagagaacacacatgattc

SEQ ID NO: 9252388 - DNA, 22 bp, Homo sapiens
tggcagaaagaaccatgtgcaa

SEQ ID NO: 9252389 - DNA, 22 bp, Homo sapiens
tggcagaagtacacaagcatgc

SEQ ID NO: 9252390 - DNA, 22 bp, Homo sapiens
tggcagaagttcactagtagct

SEQ ID NO: 9252391 - DNA, 22 bp, Homo sapiens
ccctggagtgtgacgaggcatt

SEQ ID NO: 9252392 - DNA, 22 bp, Homo sapiens
ccctggaggtcagaggcctggg

SEQ ID NO: 9252393 - DNA, 22 bp, Homo sapiens
ccctggaggtcagaggcctggg

SEQ ID NO: 9252394 - DNA, 22 bp, Homo sapiens
ccctggagggcagacagatgcc

SEQ ID NO: 9252395 - DNA, 22 bp, Homo sapiens
ccctggaggttgaggctgcagt

SEQ ID NO: 9252396 - DNA, 22 bp, Homo sapiens
ccctggaggttgaggctgcagt

SEQ ID NO: 9252397 - DNA, 22 bp, Homo sapiens
ccctggagtcctggcagttgat

SEQ ID NO: 9252398 - DNA, 22 bp, Homo sapiens
ccctggagtagcactgggtcgc

SEQ ID NO: 9252399 - DNA, 22 bp, Homo sapiens
ccctggagtcaggttggcctgg

SEQ ID NO: 9252400 - DNA, 22 bp, Homo sapiens
tggagatgtaaagcaaggctta

SEQ ID NO: 9252401 - DNA, 22 bp, Homo sapiens
tggagatgggttaatggagaga

SEQ ID NO: 9252402 - DNA, 22 bp, Homo sapiens
tggagatgggttaatggagaga

SEQ ID NO: 9252403 - DNA, 22 bp, Homo sapiens
tggagatgggaaaaaggaggta

SEQ ID NO: 9252404 - DNA, 22 bp, Homo sapiens
tggagatggcctcaggccctca

SEQ ID NO: 9252405 - DNA, 22 bp, Homo sapiens
tggagatggcctcaggccctca

SEQ ID NO: 9252406 - DNA, 22 bp, Homo sapiens
tggagatggcctcaggccctca

SEQ ID NO: 9252407 - DNA, 22 bp, Homo sapiens
tggagatgcacgagcaggtgga

SEQ ID NO: 9252408 - DNA, 22 bp, Homo sapiens
tggagatgcacgagcaggtgga

SEQ ID NO: 9252409 - DNA, 23 bp, Homo sapiens
tggagatgccccactccctgtct

SEQ ID NO: 9252410 - DNA, 23 bp, Homo sapiens
tggagatgccccactccctgtct

SEQ ID NO: 9252411 - DNA, 22 bp, Homo sapiens
tggaggacgtgtccaccatgaa

SEQ ID NO: 9252412 - DNA, 22 bp, Homo sapiens
tggaggacaggactggacagcc

SEQ ID NO: 9252413 - DNA, 22 bp, Homo sapiens
tggaggaagtggacagttgtgt

SEQ ID NO: 9252414 - DNA, 22 bp, Homo sapiens
tggaggaagtggacagttgtgt

SEQ ID NO: 9252415 - DNA, 22 bp, Homo sapiens
tggaggaagtggctggccagaa

SEQ ID NO: 9252416 - DNA, 22 bp, Homo sapiens
tggaggcataggcctgggccct

SEQ ID NO: 9252417 - DNA, 22 bp, Homo sapiens
tggaggcatcagagtgcttggc

SEQ ID NO: 9252418 - DNA, 22 bp, Homo sapiens
tggaggcatcagagtgcttggc

SEQ ID NO: 9252419 - DNA, 22 bp, Homo sapiens
tggaggcatgacagtgtctgga

SEQ ID NO: 9252420 - DNA, 22 bp, Homo sapiens
tggaggagaactccctggctac

SEQ ID NO: 9252421 - DNA, 22 bp, Homo sapiens
tggaggacgtgtccaccatgaa

SEQ ID NO: 9252422 - DNA, 22 bp, Homo sapiens
tggaggcagtttaagtctgaga

SEQ ID NO: 9252423 - DNA, 22 bp, Homo sapiens
tggaggcataggcctgggccct

SEQ ID NO: 9252424 - DNA, 22 bp, Homo sapiens
tggaggcagtttaagtctgaga

SEQ ID NO: 9252425 - DNA, 22 bp, Homo sapiens
ccctggaggaccccaatgtggc

SEQ ID NO: 9252426 - DNA, 22 bp, Homo sapiens
tggaggcatgacagtgtctgga

SEQ ID NO: 9252427 - DNA, 22 bp, Homo sapiens
tggaggcattgtgactgctgaa

SEQ ID NO: 9252428 - DNA, 22 bp, Homo sapiens
tggagacacaggaccagactgc

SEQ ID NO: 9252429 - DNA, 22 bp, Homo sapiens
tggagaattctatgttgagggg

SEQ ID NO: 9252430 - DNA, 22 bp, Homo sapiens
tggaaagaaaaacaggccatga

SEQ ID NO: 9252431 - DNA, 22 bp, Homo sapiens
tggaaagaaagtaaaggcgtat

SEQ ID NO: 9252432 - DNA, 22 bp, Homo sapiens
tggaaagaattcctatggttca

SEQ ID NO: 9252433 - DNA, 22 bp, Homo sapiens
tggagactctgcatctgtgaca

SEQ ID NO: 9252434 - DNA, 21 bp, Homo sapiens
tggagactctggttctttgtg

SEQ ID NO: 9252435 - DNA, 22 bp, Homo sapiens
tggagactgactgcctgtattt

SEQ ID NO: 9252436 - DNA, 22 bp, Homo sapiens
tggagactgataaaggctattg

SEQ ID NO: 9252437 - DNA, 22 bp, Homo sapiens
tggagatgaggacatggacgtc

SEQ ID NO: 9252438 - DNA, 22 bp, Homo sapiens
tggagatgaggacatggacgtc

SEQ ID NO: 9252439 - DNA, 22 bp, Homo sapiens
tggagatgaatatgtgtacctg

SEQ ID NO: 9252440 - DNA, 22 bp, Homo sapiens
tggagagtttagcctactggaa

SEQ ID NO: 9252441 - DNA, 22 bp, Homo sapiens
tggagatgaacatggtgatgtt

SEQ ID NO: 9252442 - DNA, 22 bp, Homo sapiens
tggagagaaaaaagacagttct

SEQ ID NO: 9252443 - DNA, 22 bp, Homo sapiens
ccctccctgtgtgcctcatttg

SEQ ID NO: 9252444 - DNA, 22 bp, Homo sapiens
ccctccctgaagaagttactct

SEQ ID NO: 9252445 - DNA, 22 bp, Homo sapiens
ccctccctgaagaagttactct

SEQ ID NO: 9252446 - DNA, 22 bp, Homo sapiens
ccctccctgtgtgcctcatttg

SEQ ID NO: 9252447 - DNA, 22 bp, Homo sapiens
ccctccctgtgtgcctcatttg

SEQ ID NO: 9252448 - DNA, 22 bp, Homo sapiens
ccctccctgtgtgcctcatttg

SEQ ID NO: 9252449 - DNA, 22 bp, Homo sapiens
ccctccctttgtctttatgaac

SEQ ID NO: 9252450 - DNA, 23 bp, Homo sapiens
tggaaacattctgaatgtccatc

SEQ ID NO: 9252451 - DNA, 23 bp, Homo sapiens
tggaaacattctgaatgtccatc

SEQ ID NO: 9252452 - DNA, 22 bp, Homo sapiens
tggaaactgggagttaaatgta

SEQ ID NO: 9252453 - DNA, 19 bp, Homo sapiens
tggaaactcctgatattag

SEQ ID NO: 9252454 - DNA, 19 bp, Homo sapiens
tggaaactcctgatattag

SEQ ID NO: 9252455 - DNA, 22 bp, Homo sapiens
tggaaactctacctctctaaga

SEQ ID NO: 9252456 - DNA, 22 bp, Homo sapiens
tggaaagaaaaacaggccatga

SEQ ID NO: 9252457 - DNA, 22 bp, Homo sapiens
tggaaactgtggtatttcttta

SEQ ID NO: 9252458 - DNA, 22 bp, Homo sapiens
tggaaactagagagtttgtatt

SEQ ID NO: 9252459 - DNA, 22 bp, Homo sapiens
cctgatggagccctgctgcatg

SEQ ID NO: 9252460 - DNA, 22 bp, Homo sapiens
cctgatggagccctgctgcatg

SEQ ID NO: 9252461 - DNA, 22 bp, Homo sapiens
cctgagtggtgctaagcagata

SEQ ID NO: 9252462 - DNA, 22 bp, Homo sapiens
cctgagtgcttccagagtcatg

SEQ ID NO: 9252463 - DNA, 22 bp, Homo sapiens
cctgagtgccatgagagcaccc

SEQ ID NO: 9252464 - DNA, 21 bp, Homo sapiens
cctgagtgagacctggcccgt

SEQ ID NO: 9252465 - DNA, 22 bp, Homo sapiens
cctgaggtcatggtccagtgtt

SEQ ID NO: 9252466 - DNA, 22 bp, Homo sapiens
cctgaggtctagagtcagggtg

SEQ ID NO: 9252467 - DNA, 22 bp, Homo sapiens
cctgaggtcatggtccagtgtt

SEQ ID NO: 9252468 - DNA, 22 bp, Homo sapiens
cctgaggtcatggtccagtgtt

SEQ ID NO: 9252469 - DNA, 22 bp, Homo sapiens
cctgagtgaattccctcactgt

SEQ ID NO: 9252470 - DNA, 22 bp, Homo sapiens
cctgcagacacttgtccagcaa

SEQ ID NO: 9252471 - DNA, 22 bp, Homo sapiens
cctgcagacacttgtccagcaa

SEQ ID NO: 9252472 - DNA, 22 bp, Homo sapiens
tggggagcacggtagggaaatg

SEQ ID NO: 9252473 - DNA, 23 bp, Homo sapiens
tggggagagttaccctggaagcg

SEQ ID NO: 9252474 - DNA, 22 bp, Homo sapiens
cctgcagggaatcgaggcagaa

SEQ ID NO: 9252475 - DNA, 22 bp, Homo sapiens
cctgcagggaatcgaggcagaa

SEQ ID NO: 9252476 - DNA, 22 bp, Homo sapiens
cctgcaggctgcaggccagttc

SEQ ID NO: 9252477 - DNA, 22 bp, Homo sapiens
cctgcaggctgcaggccagttc

SEQ ID NO: 9252478 - DNA, 22 bp, Homo sapiens
cctgcagggaatcgaggcagaa

SEQ ID NO: 9252479 - DNA, 22 bp, Homo sapiens
cctgcagctttgcctcctgaac

SEQ ID NO: 9252480 - DNA, 22 bp, Homo sapiens
cctgcagaccacactcagtcct

SEQ ID NO: 9252481 - DNA, 22 bp, Homo sapiens
tgggctccagcacctgtgctct

SEQ ID NO: 9252482 - DNA, 22 bp, Homo sapiens
tgggctccagcacctgtgctct

SEQ ID NO: 9252483 - DNA, 22 bp, Homo sapiens
tgggctccagcacctgtgctct

SEQ ID NO: 9252484 - DNA, 22 bp, Homo sapiens
tgggctccagcacctgtgctct

SEQ ID NO: 9252485 - DNA, 22 bp, Homo sapiens
tgggctcatgtttctttgagga

SEQ ID NO: 9252486 - DNA, 22 bp, Homo sapiens
tgggctccggcggcctcaggct

SEQ ID NO: 9252487 - DNA, 22 bp, Homo sapiens
tgggctccggcggcctcaggct

SEQ ID NO: 9252488 - DNA, 22 bp, Homo sapiens
tgggctccagcacctgtgctct

SEQ ID NO: 9252489 - DNA, 22 bp, Homo sapiens
tgggctcctcgtcactcgctgt

SEQ ID NO: 9252490 - DNA, 22 bp, Homo sapiens
tgggctccgttgcctggggcag

SEQ ID NO: 9252491 - DNA, 23 bp, Homo sapiens
tgggcctggcctcccagtccagc

SEQ ID NO: 9252492 - DNA, 22 bp, Homo sapiens
tgggcctggccctgtggaggag

SEQ ID NO: 9252493 - DNA, 22 bp, Homo sapiens
tgggctcatggcccagcactgg

SEQ ID NO: 9252494 - DNA, 22 bp, Homo sapiens
tgggcctggacaaggccactag

SEQ ID NO: 9252495 - DNA, 22 bp, Homo sapiens
tgggcctggacatctgtatttt

SEQ ID NO: 9252496 - DNA, 22 bp, Homo sapiens
tgggcaggcaagtgaatacctt

SEQ ID NO: 9252497 - DNA, 22 bp, Homo sapiens
tgggcctggagtttgtccagag

SEQ ID NO: 9252498 - DNA, 22 bp, Homo sapiens
tgggcctggagccctggagagt

SEQ ID NO: 9252499 - DNA, 22 bp, Homo sapiens
tgggcaggataatatctcatgt

SEQ ID NO: 9252500 - DNA, 22 bp, Homo sapiens
tgggcaggataatatctcatgt

SEQ ID NO: 9252501 - DNA, 22 bp, Homo sapiens
tgggcaggatgcgttgattctt

SEQ ID NO: 9252502 - DNA, 22 bp, Homo sapiens
tgggcaggagagaagctaaaga

SEQ ID NO: 9252503 - DNA, 22 bp, Homo sapiens
tgggcaggagagaagctaaaga

SEQ ID NO: 9252504 - DNA, 22 bp, Homo sapiens
tgggcaggcaagtgaatacctt

SEQ ID NO: 9252505 - DNA, 22 bp, Homo sapiens
tgggcaggcaagtgaatacctt

SEQ ID NO: 9252506 - DNA, 22 bp, Homo sapiens
tgggcaggatgcgttgattctt

SEQ ID NO: 9252507 - DNA, 21 bp, Homo sapiens
tggtacaccttgcctgtcaga

SEQ ID NO: 9252508 - DNA, 22 bp, Homo sapiens
cctgcccagcttcacctcaggc

SEQ ID NO: 9252509 - DNA, 22 bp, Homo sapiens
tggtaggaatgattacgacttt

SEQ ID NO: 9252510 - DNA, 22 bp, Homo sapiens
tggtagcaacatctcagtggct

SEQ ID NO: 9252511 - DNA, 22 bp, Homo sapiens
tggtaggagatatggtctccga

SEQ ID NO: 9252512 - DNA, 22 bp, Homo sapiens
cctgcccagagcccctttcact

SEQ ID NO: 9252513 - DNA, 22 bp, Homo sapiens
cctgcccagagcccctttcact

SEQ ID NO: 9252514 - DNA, 22 bp, Homo sapiens
cctgcccttctttccccagcat

SEQ ID NO: 9252515 - DNA, 22 bp, Homo sapiens
cctgccctgtgtttggggacta

SEQ ID NO: 9252516 - DNA, 22 bp, Homo sapiens
cctgcctatgagacgttttgcc

SEQ ID NO: 9252517 - DNA, 22 bp, Homo sapiens
cctgcctactgagttttatatt

SEQ ID NO: 9252518 - DNA, 22 bp, Homo sapiens
cctgcctatgtaagtggtttct

SEQ ID NO: 9252519 - DNA, 22 bp, Homo sapiens
cctgcctcaggactctgcatat

SEQ ID NO: 9252520 - DNA, 22 bp, Homo sapiens
cctgcctcatcaacttgtcgtg

SEQ ID NO: 9252521 - DNA, 22 bp, Homo sapiens
cctgcctcaggactctgcatat

SEQ ID NO: 9252522 - DNA, 22 bp, Homo sapiens
tggttacatcatcccattctga

SEQ ID NO: 9252523 - DNA, 22 bp, Homo sapiens
cctgcctgcagaaagtatctcc

SEQ ID NO: 9252524 - DNA, 22 bp, Homo sapiens
cctgcctgcagaaagtatctcc

SEQ ID NO: 9252525 - DNA, 22 bp, Homo sapiens
tggtgggagtccgctgtgctgc

SEQ ID NO: 9252526 - DNA, 22 bp, Homo sapiens
cctgcctgattccaggatggct

SEQ ID NO: 9252527 - DNA, 22 bp, Homo sapiens
cctgcctgattccaggatggct

SEQ ID NO: 9252528 - DNA, 22 bp, Homo sapiens
cctgcctgcaaaatgggacaag

SEQ ID NO: 9252529 - DNA, 22 bp, Homo sapiens
cctgcctgcaccttctctgggg

SEQ ID NO: 9252530 - DNA, 22 bp, Homo sapiens
cctgcctgcaaaatgggacaag

SEQ ID NO: 9252531 - DNA, 22 bp, Homo sapiens
cctgcctgcaccttctctgggg

SEQ ID NO: 9252532 - DNA, 22 bp, Homo sapiens
cctgcctgacagagaaggttca

SEQ ID NO: 9252533 - DNA, 22 bp, Homo sapiens
cctgcctgacagagaaggttca

SEQ ID NO: 9252534 - DNA, 22 bp, Homo sapiens
cctgcctgaaggtcagccaccc

SEQ ID NO: 9252535 - DNA, 23 bp, Homo sapiens
cctgcctccccatcagttataca

SEQ ID NO: 9252536 - DNA, 22 bp, Homo sapiens
cctgcctcatcaacttgtcgtg

SEQ ID NO: 9252537 - DNA, 22 bp, Homo sapiens
cctgcctcccagaggtcctcta

SEQ ID NO: 9252538 - DNA, 22 bp, Homo sapiens
tgggtgggagcaccctgtctgg

SEQ ID NO: 9252539 - DNA, 22 bp, Homo sapiens
tgggtgggagcaccctgtctgg

SEQ ID NO: 9252540 - DNA, 22 bp, Homo sapiens
tgggtgggagcaccctgtctgg

SEQ ID NO: 9252541 - DNA, 22 bp, Homo sapiens
tgggtgggagcaccctgtctgg

SEQ ID NO: 9252542 - DNA, 23 bp, Homo sapiens
tggtaatagggagcagaaggtag

SEQ ID NO: 9252543 - DNA, 18 bp, Homo sapiens
tgggtggctagggagttt

SEQ ID NO: 9252544 - DNA, 22 bp, Homo sapiens
tgggtggaataaatcagttctg

SEQ ID NO: 9252545 - DNA, 22 bp, Homo sapiens
tgggtccacaaacatcagatat

SEQ ID NO: 9252546 - DNA, 22 bp, Homo sapiens
tgggtggaataaatcagttctg

SEQ ID NO: 9252547 - DNA, 22 bp, Homo sapiens
tgggtggcacttctggggtcca

SEQ ID NO: 9252548 - DNA, 22 bp, Homo sapiens
cctgcaggtaaggctaactgcc

SEQ ID NO: 9252549 - DNA, 22 bp, Homo sapiens
cctgcaggtccccggatgcgca

SEQ ID NO: 9252550 - DNA, 22 bp, Homo sapiens
cctgcaggtccccggatgcgca

SEQ ID NO: 9252551 - DNA, 22 bp, Homo sapiens
cctgcagggtgctgccacagat

SEQ ID NO: 9252552 - DNA, 22 bp, Homo sapiens
cctgcaggggagagacttctag

SEQ ID NO: 9252553 - DNA, 22 bp, Homo sapiens
cctgcaggggagagacttctag

SEQ ID NO: 9252554 - DNA, 19 bp, Homo sapiens
cctgcagggatgagaggtt

SEQ ID NO: 9252555 - DNA, 19 bp, Homo sapiens
cctgcagggatgagaggtt

SEQ ID NO: 9252556 - DNA, 22 bp, Homo sapiens
cctgcaggtttcccccggacgg

SEQ ID NO: 9252557 - DNA, 22 bp, Homo sapiens
cctgcaggttgcagaggcggaa

SEQ ID NO: 9252558 - DNA, 22 bp, Homo sapiens
cctgcaggttgcagaggcggaa

SEQ ID NO: 9252559 - DNA, 22 bp, Homo sapiens
cctgcaggtccccggatgcgca

SEQ ID NO: 9252560 - DNA, 22 bp, Homo sapiens
cctgccagaaaagagggagttc

SEQ ID NO: 9252561 - DNA, 22 bp, Homo sapiens
cctctccagttttaacgtgacc

SEQ ID NO: 9252562 - DNA, 22 bp, Homo sapiens
cctctccagcggcctcagggcc

SEQ ID NO: 9252563 - DNA, 20 bp, Homo sapiens
cctcctggtcaggtgtgcag

SEQ ID NO: 9252564 - DNA, 20 bp, Homo sapiens
cctcctggtcaggtgtgcag

SEQ ID NO: 9252565 - DNA, 22 bp, Homo sapiens
cctcctggtaattagcgaaagg

SEQ ID NO: 9252566 - DNA, 22 bp, Homo sapiens
cctcctgggttcaagcgattct

SEQ ID NO: 9252567 - DNA, 22 bp, Homo sapiens
cctcctggtaattagcgaaagg

SEQ ID NO: 9252568 - DNA, 22 bp, Homo sapiens
tggcttcccatagcttgctagt

SEQ ID NO: 9252569 - DNA, 22 bp, Homo sapiens
cctcctggtccagcatctcttt

SEQ ID NO: 9252570 - DNA, 22 bp, Homo sapiens
tggcttctttccactgtcctgt

SEQ ID NO: 9252571 - DNA, 22 bp, Homo sapiens
tggcttctttccactgtcctgt

SEQ ID NO: 9252572 - DNA, 22 bp, Homo sapiens
tggcttctttccactgtcctgt

SEQ ID NO: 9252573 - DNA, 22 bp, Homo sapiens
tggcttggctaagatctaagct

SEQ ID NO: 9252574 - DNA, 22 bp, Homo sapiens
tggcttctttgtagaaattgaa

SEQ ID NO: 9252575 - DNA, 20 bp, Homo sapiens
tggcttgtttctatgggcag

SEQ ID NO: 9252576 - DNA, 22 bp, Homo sapiens
tggcttggtgagcagagtgtag

SEQ ID NO: 9252577 - DNA, 22 bp, Homo sapiens
tgggacagggaatctgatcccc

SEQ ID NO: 9252578 - DNA, 22 bp, Homo sapiens
tgggagagataggcttctggac

SEQ ID NO: 9252579 - DNA, 22 bp, Homo sapiens
tgggagagaattctggtgactg

SEQ ID NO: 9252580 - DNA, 22 bp, Homo sapiens
tgggacaggaggcctctggaga

SEQ ID NO: 9252581 - DNA, 22 bp, Homo sapiens
tgggacaggatgaccagaaggt

SEQ ID NO: 9252582 - DNA, 22 bp, Homo sapiens
tgggacagattataagtctgca

SEQ ID NO: 9252583 - DNA, 22 bp, Homo sapiens
tgggacaggaggcctctggaga

SEQ ID NO: 9252584 - DNA, 22 bp, Homo sapiens
tgggacaggaggcctctggaga

SEQ ID NO: 9252585 - DNA, 22 bp, Homo sapiens
tgggacaggaggcctctggaga

SEQ ID NO: 9252586 - DNA, 22 bp, Homo sapiens
tgggacagagtgagctttggcc

SEQ ID NO: 9252587 - DNA, 22 bp, Homo sapiens
tgggacagagtgagctttggcc

SEQ ID NO: 9252588 - DNA, 22 bp, Homo sapiens
tgggcactgtagctggtgctgg

SEQ ID NO: 9252589 - DNA, 22 bp, Homo sapiens
tgggcactgtagctggtgctgg

SEQ ID NO: 9252590 - DNA, 21 bp, Homo sapiens
tgggcactgagggtgctgctc

SEQ ID NO: 9252591 - DNA, 22 bp, Homo sapiens
tgggcactggaagcctgctgtg

SEQ ID NO: 9252592 - DNA, 21 bp, Homo sapiens
tgggatagaaatatggctgct

SEQ ID NO: 9252593 - DNA, 23 bp, Homo sapiens
tgggatagaatttcatggctgct

SEQ ID NO: 9252594 - DNA, 22 bp, Homo sapiens
tgggatagaaatttagaacaag

SEQ ID NO: 9252595 - DNA, 22 bp, Homo sapiens
tgggatagaaatttagaacaag

SEQ ID NO: 9252596 - DNA, 22 bp, Homo sapiens
tgggcagaaggaagagccacct

SEQ ID NO: 9252597 - DNA, 22 bp, Homo sapiens
tgggcagaatgtgggatccaga

SEQ ID NO: 9252598 - DNA, 22 bp, Homo sapiens
tgggcagaaggaagagccacct

SEQ ID NO: 9252599 - DNA, 22 bp, Homo sapiens
tgggcagaaatcagtatcagat

SEQ ID NO: 9252600 - DNA, 22 bp, Homo sapiens
cctcctgggactcattagcacc

SEQ ID NO: 9252601 - DNA, 22 bp, Homo sapiens
cctcctgggactcattagcacc

SEQ ID NO: 9252602 - DNA, 22 bp, Homo sapiens
cctcctgggacaggctggcaca

SEQ ID NO: 9252603 - DNA, 22 bp, Homo sapiens
cctcctggcttttcccattgaa

SEQ ID NO: 9252604 - DNA, 22 bp, Homo sapiens
cctcctgggacaggctggcaca

SEQ ID NO: 9252605 - DNA, 22 bp, Homo sapiens
cctcctggccctgggcctggaa

SEQ ID NO: 9252606 - DNA, 22 bp, Homo sapiens
cctcctggccctgggcctggaa

SEQ ID NO: 9252607 - DNA, 22 bp, Homo sapiens
cctcctctggtgctgccaaccc

SEQ ID NO: 9252608 - DNA, 22 bp, Homo sapiens
cctcctggcctgtgcagagccc

SEQ ID NO: 9252609 - DNA, 22 bp, Homo sapiens
cctcctggcctgtgcagagccc

SEQ ID NO: 9252610 - DNA, 22 bp, Homo sapiens
cctcctgggctcctgtctgcac

SEQ ID NO: 9252611 - DNA, 22 bp, Homo sapiens
cctcctgggctcctgtctgcac

SEQ ID NO: 9252612 - DNA, 22 bp, Homo sapiens
cctcctgggccttgctctgtga

SEQ ID NO: 9252613 - DNA, 22 bp, Homo sapiens
cctcctgggccttgctctgtga

SEQ ID NO: 9252614 - DNA, 22 bp, Homo sapiens
cctcctgggagagcacggaggg

SEQ ID NO: 9252615 - DNA, 22 bp, Homo sapiens
cctcctgggagagcacggaggg

SEQ ID NO: 9252616 - DNA, 23 bp, Homo sapiens
cctcctgggcacaggcctgatgg

SEQ ID NO: 9252617 - DNA, 23 bp, Homo sapiens
cctcctgggcacaggcctgatgg

SEQ ID NO: 9252618 - DNA, 22 bp, Homo sapiens
cctcccacattgaggacatgct

SEQ ID NO: 9252619 - DNA, 22 bp, Homo sapiens
cctcccaccatttagagagagc

SEQ ID NO: 9252620 - DNA, 22 bp, Homo sapiens
cctcccaccgtatctcagtggc

SEQ ID NO: 9252621 - DNA, 19 bp, Homo sapiens
cctcccacggattccttcc

SEQ ID NO: 9252622 - DNA, 23 bp, Homo sapiens
cctcccacctatttcactttctt

SEQ ID NO: 9252623 - DNA, 23 bp, Homo sapiens
cctcccacctatttcactttctt

SEQ ID NO: 9252624 - DNA, 22 bp, Homo sapiens
cctcccacttcttgctgaggtc

SEQ ID NO: 9252625 - DNA, 17 bp, Homo sapiens
cctcccacaccgccctg

SEQ ID NO: 9252626 - DNA, 17 bp, Homo sapiens
cctcccacaccgccctg

SEQ ID NO: 9252627 - DNA, 22 bp, Homo sapiens
cctccatgtaaaggtcccctca

SEQ ID NO: 9252628 - DNA, 22 bp, Homo sapiens
cctccatgtaaaggtcccctca

SEQ ID NO: 9252629 - DNA, 22 bp, Homo sapiens
cctcccacatcctagctctgct

SEQ ID NO: 9252630 - DNA, 22 bp, Homo sapiens
cctccatctccagcttctgcct

SEQ ID NO: 9252631 - DNA, 22 bp, Homo sapiens
cctccatctccagcttctgcct

SEQ ID NO: 9252632 - DNA, 22 bp, Homo sapiens
cctccagtcacctggatgagaa

SEQ ID NO: 9252633 - DNA, 22 bp, Homo sapiens
cctccagtactccagtccagcg

SEQ ID NO: 9252634 - DNA, 22 bp, Homo sapiens
cctccagtactccagtccagcg

SEQ ID NO: 9252635 - DNA, 22 bp, Homo sapiens
tggcagtgggaagctggaagtc

SEQ ID NO: 9252636 - DNA, 22 bp, Homo sapiens
tggcagtgggaagctggaagtc

SEQ ID NO: 9252637 - DNA, 22 bp, Homo sapiens
tggcagtgggaagctggaagtc

SEQ ID NO: 9252638 - DNA, 22 bp, Homo sapiens
tggcagtgggaagctggaagtc

SEQ ID NO: 9252639 - DNA, 22 bp, Homo sapiens
tggcagtgggaagctggaagtc

SEQ ID NO: 9252640 - DNA, 22 bp, Homo sapiens
tggcagtgtataggtggctcct

SEQ ID NO: 9252641 - DNA, 22 bp, Homo sapiens
tggcagtggtgtctgcacaggc

SEQ ID NO: 9252642 - DNA, 22 bp, Homo sapiens
tggcagtgtgggaggaaggtac

SEQ ID NO: 9252643 - DNA, 22 bp, Homo sapiens
tggcagtgtcttgctggggcag

SEQ ID NO: 9252644 - DNA, 22 bp, Homo sapiens
tggcagtgtcttgctggggcag

SEQ ID NO: 9252645 - DNA, 22 bp, Homo sapiens
tggccaagccactgctgggtct

SEQ ID NO: 9252646 - DNA, 22 bp, Homo sapiens
tggccaagccactgctgggtct

SEQ ID NO: 9252647 - DNA, 22 bp, Homo sapiens
tggccaagatgcgacctctcag

SEQ ID NO: 9252648 - DNA, 21 bp, Homo sapiens
tggccaaactggagcatttga

SEQ ID NO: 9252649 - DNA, 21 bp, Homo sapiens
tggcatttgtacagggacttt

SEQ ID NO: 9252650 - DNA, 22 bp, Homo sapiens
cctccagggcccctctcactgg

SEQ ID NO: 9252651 - DNA, 22 bp, Homo sapiens
cctccagggcccctctcactgg

SEQ ID NO: 9252652 - DNA, 21 bp, Homo sapiens
cctccaggtgattccgtgctc

SEQ ID NO: 9252653 - DNA, 22 bp, Homo sapiens
cctccagggcccctctcactgg

SEQ ID NO: 9252654 - DNA, 20 bp, Homo sapiens
tggccaagtatccaactgga

SEQ ID NO: 9252655 - DNA, 20 bp, Homo sapiens
tggccaagtatccaactgga

SEQ ID NO: 9252656 - DNA, 22 bp, Homo sapiens
cctccagctgcctcagtctctt

SEQ ID NO: 9252657 - DNA, 19 bp, Homo sapiens
tgcaagtgtcttggacaag

SEQ ID NO: 9252658 - DNA, 22 bp, Homo sapiens
tgcaagtaattccagctactga

SEQ ID NO: 9252659 - DNA, 22 bp, Homo sapiens
tgcaagtagtccagcctttggg

SEQ ID NO: 9252660 - DNA, 22 bp, Homo sapiens
tgcaataaagtgctataaatcc

SEQ ID NO: 9252661 - DNA, 22 bp, Homo sapiens
tgcaataacccagtatctgtga

SEQ ID NO: 9252662 - DNA, 22 bp, Homo sapiens
tgcaataaagtgctataaatcc

SEQ ID NO: 9252663 - DNA, 22 bp, Homo sapiens
tgcaataacccagtatctgtga

SEQ ID NO: 9252664 - DNA, 22 bp, Homo sapiens
tgataaatccatgtaaatggta

SEQ ID NO: 9252665 - DNA, 22 bp, Homo sapiens
tgataatgttcgagaatgaaga

SEQ ID NO: 9252666 - DNA, 22 bp, Homo sapiens
tgcaatatgttgcattgtatgg

SEQ ID NO: 9252667 - DNA, 22 bp, Homo sapiens
tgcaataaggagtaatagtaaa

SEQ ID NO: 9252668 - DNA, 22 bp, Homo sapiens
tgcaataactactttaatgttg

SEQ ID NO: 9252669 - DNA, 22 bp, Homo sapiens
tgcaataacccagtatctgtga

SEQ ID NO: 9252670 - DNA, 22 bp, Homo sapiens
tgcaataacccagtatctgtga

SEQ ID NO: 9252671 - DNA, 22 bp, Homo sapiens
tgcaataagttgtgttatcact

SEQ ID NO: 9252672 - DNA, 22 bp, Homo sapiens
tgcaataagttgtgttatcact

SEQ ID NO: 9252673 - DNA, 22 bp, Homo sapiens
tgcaataaggagtaatagtaaa

SEQ ID NO: 9252674 - DNA, 22 bp, Homo sapiens
tgcaataaggagtaatagtaaa

SEQ ID NO: 9252675 - DNA, 22 bp, Homo sapiens
cccaagggatgcttgagtagtt

SEQ ID NO: 9252676 - DNA, 22 bp, Homo sapiens
cccaaggggtgttgatggagga

SEQ ID NO: 9252677 - DNA, 22 bp, Homo sapiens
tgcactagccacatttcaaatg

SEQ ID NO: 9252678 - DNA, 22 bp, Homo sapiens
tgcactatttcgccatggttgt

SEQ ID NO: 9252679 - DNA, 22 bp, Homo sapiens
tgcacagatgctaggaggtgaa

SEQ ID NO: 9252680 - DNA, 22 bp, Homo sapiens
tgcactccaggctgggtgacag

SEQ ID NO: 9252681 - DNA, 23 bp, Homo sapiens
cccaagcctgtgccctctgactc

SEQ ID NO: 9252682 - DNA, 22 bp, Homo sapiens
cccaagccagaccctgaccctg

SEQ ID NO: 9252683 - DNA, 19 bp, Homo sapiens
tgcaatcagctacccaggt

SEQ ID NO: 9252684 - DNA, 22 bp, Homo sapiens
cccaaggaagacgcttgtgata

SEQ ID NO: 9252685 - DNA, 22 bp, Homo sapiens
cccaagcctttcaaaactcaga

SEQ ID NO: 9252686 - DNA, 23 bp, Homo sapiens
cccaagcctgtgccctctgactc

SEQ ID NO: 9252687 - DNA, 22 bp, Homo sapiens
cccaaggctgcagtgagcatga

SEQ ID NO: 9252688 - DNA, 21 bp, Homo sapiens
cccaagggaggcaggataagg

SEQ ID NO: 9252689 - DNA, 22 bp, Homo sapiens
cccaaggcctctccttggcttg

SEQ ID NO: 9252690 - DNA, 21 bp, Homo sapiens
cccagagcctagggagggcac

SEQ ID NO: 9252691 - DNA, 17 bp, Homo sapiens
cccagagatgctgcctt

SEQ ID NO: 9252692 - DNA, 22 bp, Homo sapiens
cccagagctgagggggcacgtt

SEQ ID NO: 9252693 - DNA, 22 bp, Homo sapiens
cccagagctcagtgtgcaaggt

SEQ ID NO: 9252694 - DNA, 23 bp, Homo sapiens
cccagaggagcagggcgtgagat

SEQ ID NO: 9252695 - DNA, 23 bp, Homo sapiens
cccagaggagcagggcgtgagat

SEQ ID NO: 9252696 - DNA, 22 bp, Homo sapiens
cccagaggaggatctcggcccg

SEQ ID NO: 9252697 - DNA, 23 bp, Homo sapiens
cccagaggagcagggcgtgagat

SEQ ID NO: 9252698 - DNA, 23 bp, Homo sapiens
cccagaggagcagggcgtgagat

SEQ ID NO: 9252699 - DNA, 18 bp, Homo sapiens
cccagaggaatgcctgga

SEQ ID NO: 9252700 - DNA, 22 bp, Homo sapiens
tgcactgaatagtagactgtac

SEQ ID NO: 9252701 - DNA, 22 bp, Homo sapiens
tgcactggggtcccagcgcacg

SEQ ID NO: 9252702 - DNA, 22 bp, Homo sapiens
tgcactgatcctgaccagtgaa

SEQ ID NO: 9252703 - DNA, 22 bp, Homo sapiens
tgcactgatgttttgccaagga

SEQ ID NO: 9252704 - DNA, 22 bp, Homo sapiens
tgcactttgcaggcatggaaac

SEQ ID NO: 9252705 - DNA, 22 bp, Homo sapiens
tgcacttgtgttttcagaatct

SEQ ID NO: 9252706 - DNA, 22 bp, Homo sapiens
tgcagagaagaggacagttcta

SEQ ID NO: 9252707 - DNA, 22 bp, Homo sapiens
tgcagagaaaccagtggaggac

SEQ ID NO: 9252708 - DNA, 22 bp, Homo sapiens
tgcagctgattaaagggcagac

SEQ ID NO: 9252709 - DNA, 22 bp, Homo sapiens
tgcagctgattaaagggcagac

SEQ ID NO: 9252710 - DNA, 22 bp, Homo sapiens
cccagaggggtcgtctgagggg

SEQ ID NO: 9252711 - DNA, 22 bp, Homo sapiens
cccagagggtggaggttgcagt

SEQ ID NO: 9252712 - DNA, 20 bp, Homo sapiens
tgcagctgcaggagggtggg

SEQ ID NO: 9252713 - DNA, 20 bp, Homo sapiens
tgcagctgcaggagggtggg

SEQ ID NO: 9252714 - DNA, 22 bp, Homo sapiens
cccagaggctgagttgggagca

SEQ ID NO: 9252715 - DNA, 22 bp, Homo sapiens
cccagagggaagggaatgaggt

SEQ ID NO: 9252716 - DNA, 22 bp, Homo sapiens
cccagaggctgagttgggagca

SEQ ID NO: 9252717 - DNA, 22 bp, Homo sapiens
cccagaggaggatctcggcccg

SEQ ID NO: 9252718 - DNA, 22 bp, Homo sapiens
cccagaggaggcaaagctctgt

SEQ ID NO: 9252719 - DNA, 22 bp, Homo sapiens
cccagaggggtcgtctgagggg

SEQ ID NO: 9252720 - DNA, 22 bp, Homo sapiens
cccagaggggtcgtctgagggg

SEQ ID NO: 9252721 - DNA, 22 bp, Homo sapiens
cccagagggctgaggatatgaa

SEQ ID NO: 9252722 - DNA, 22 bp, Homo sapiens
cccagagggctgaggatatgaa

SEQ ID NO: 9252723 - DNA, 22 bp, Homo sapiens
cccagagggaagggaatgaggt

SEQ ID NO: 9252724 - DNA, 23 bp, Homo sapiens
tgcagctgcctctggcgggccgg

SEQ ID NO: 9252725 - DNA, 22 bp, Homo sapiens
tgcagctgcctagggctggctt

SEQ ID NO: 9252726 - DNA, 22 bp, Homo sapiens
tgcaggaatagctacagagctg

SEQ ID NO: 9252727 - DNA, 22 bp, Homo sapiens
tgcaggaattttttgcagaaag

SEQ ID NO: 9252728 - DNA, 23 bp, Homo sapiens
tgcaggactactcgagcactgct

SEQ ID NO: 9252729 - DNA, 22 bp, Homo sapiens
tgcaggactcaagggtagcagg

SEQ ID NO: 9252730 - DNA, 23 bp, Homo sapiens
tgcaggactactcgagcactgct

SEQ ID NO: 9252731 - DNA, 22 bp, Homo sapiens
tgcagggatcctagctgaagag

SEQ ID NO: 9252732 - DNA, 22 bp, Homo sapiens
cccagcagggtctctgtgtcta

SEQ ID NO: 9252733 - DNA, 22 bp, Homo sapiens
tgcagggccttgggatgtgtcc

SEQ ID NO: 9252734 - DNA, 22 bp, Homo sapiens
tgcagggccttgttgatgtgct

SEQ ID NO: 9252735 - DNA, 22 bp, Homo sapiens
cccagcagcctggatgttcttt

SEQ ID NO: 9252736 - DNA, 22 bp, Homo sapiens
tgcaggccggccctaggcctca

SEQ ID NO: 9252737 - DNA, 22 bp, Homo sapiens
tgcaggcctcacacctggcacc

SEQ ID NO: 9252738 - DNA, 21 bp, Homo sapiens
tgcaggcaggcagagatgctg

SEQ ID NO: 9252739 - DNA, 22 bp, Homo sapiens
tgcaggagaaagtacggagcgt

SEQ ID NO: 9252740 - DNA, 22 bp, Homo sapiens
tgcaggcagtaggccagctcca

SEQ ID NO: 9252741 - DNA, 22 bp, Homo sapiens
tgcaggcaggggatgagcagcc

SEQ ID NO: 9252742 - DNA, 22 bp, Homo sapiens
tgcaggcaggggatgagcagcc

SEQ ID NO: 9252743 - DNA, 22 bp, Homo sapiens
tgagcagtaacagctcacaggg

SEQ ID NO: 9252744 - DNA, 17 bp, Homo sapiens
tgagcagtagaagatgc

SEQ ID NO: 9252745 - DNA, 22 bp, Homo sapiens
tgagcagtaggtctgaatagtg

SEQ ID NO: 9252746 - DNA, 22 bp, Homo sapiens
tgagcaggtgagtctagggcag

SEQ ID NO: 9252747 - DNA, 22 bp, Homo sapiens
tgagcaggtgagtctagggcag

SEQ ID NO: 9252748 - DNA, 18 bp, Homo sapiens
tgagcaggggctgacctt

SEQ ID NO: 9252749 - DNA, 22 bp, Homo sapiens
tgagcagagacgggggcctcca

SEQ ID NO: 9252750 - DNA, 22 bp, Homo sapiens
ccagggctgctgtgggactcca

SEQ ID NO: 9252751 - DNA, 22 bp, Homo sapiens
ccagggctgctgtgggactcca

SEQ ID NO: 9252752 - DNA, 22 bp, Homo sapiens
ccagggctgctgtgggactcca

SEQ ID NO: 9252753 - DNA, 22 bp, Homo sapiens
ccagggctgctgggggagttga

SEQ ID NO: 9252754 - DNA, 22 bp, Homo sapiens
ccagggctgctgggggagttga

SEQ ID NO: 9252755 - DNA, 22 bp, Homo sapiens
ccagggctgctcattggctggt

SEQ ID NO: 9252756 - DNA, 22 bp, Homo sapiens
ccaggtgggaggaaagcagaga

SEQ ID NO: 9252757 - DNA, 22 bp, Homo sapiens
ccaggtgggaggaaagcagaga

SEQ ID NO: 9252758 - DNA, 17 bp, Homo sapiens
ccaggtgggaggtgggg

SEQ ID NO: 9252759 - DNA, 17 bp, Homo sapiens
ccaggtgggaggtgggg

SEQ ID NO: 9252760 - DNA, 22 bp, Homo sapiens
ccaggtggccctgccctactct

SEQ ID NO: 9252761 - DNA, 22 bp, Homo sapiens
ccaggtggacggcgagtacagg

SEQ ID NO: 9252762 - DNA, 22 bp, Homo sapiens
ccaggtggaggtgtgaggtcct

SEQ ID NO: 9252763 - DNA, 22 bp, Homo sapiens
ccagtccagtgccatgcatggc

SEQ ID NO: 9252764 - DNA, 22 bp, Homo sapiens
tgagcccagagatctgagctat

SEQ ID NO: 9252765 - DNA, 22 bp, Homo sapiens
tgagcccagagcccttgtaggg

SEQ ID NO: 9252766 - DNA, 22 bp, Homo sapiens
tgagcccagagatctgagctat

SEQ ID NO: 9252767 - DNA, 23 bp, Homo sapiens
tgagcccaggaggtcaaggctgc

SEQ ID NO: 9252768 - DNA, 23 bp, Homo sapiens
tgagcccaggaggtcaaggctgc

SEQ ID NO: 9252769 - DNA, 22 bp, Homo sapiens
ccagtgcaggtgagcaccaggt

SEQ ID NO: 9252770 - DNA, 22 bp, Homo sapiens
ccagtctgcagcccctggggac

SEQ ID NO: 9252771 - DNA, 22 bp, Homo sapiens
ccagtgcaggtgagcaccaggt

SEQ ID NO: 9252772 - DNA, 22 bp, Homo sapiens
tgagcccaggagtatgaggctg

SEQ ID NO: 9252773 - DNA, 22 bp, Homo sapiens
ccagtctgaggcctggtgaggg

SEQ ID NO: 9252774 - DNA, 22 bp, Homo sapiens
ccagtctgaggcctggtgaggg

SEQ ID NO: 9252775 - DNA, 22 bp, Homo sapiens
tgagcccaggagttggagaccg

SEQ ID NO: 9252776 - DNA, 22 bp, Homo sapiens
tgagccatgggactccaaggga

SEQ ID NO: 9252777 - DNA, 22 bp, Homo sapiens
tgagccagtggaagatggcagt

SEQ ID NO: 9252778 - DNA, 22 bp, Homo sapiens
tgagccagtggaagatggcagt

SEQ ID NO: 9252779 - DNA, 22 bp, Homo sapiens
tgagccagtgtggtaaagctga

SEQ ID NO: 9252780 - DNA, 22 bp, Homo sapiens
tgagccagtggaagatggcagt

SEQ ID NO: 9252781 - DNA, 19 bp, Homo sapiens
ccagtcccatacaggagat

SEQ ID NO: 9252782 - DNA, 19 bp, Homo sapiens
ccagtcccatacaggagat

SEQ ID NO: 9252783 - DNA, 22 bp, Homo sapiens
ccagtcccaggcagaaatccag

SEQ ID NO: 9252784 - DNA, 22 bp, Homo sapiens
ccagtcccagctctgccatgct

SEQ ID NO: 9252785 - DNA, 22 bp, Homo sapiens
ccagtcccagctctgccatgct

SEQ ID NO: 9252786 - DNA, 22 bp, Homo sapiens
tgaggcagtgctgggaagcctg

SEQ ID NO: 9252787 - DNA, 22 bp, Homo sapiens
ccagtggccatgcacgagcagc

SEQ ID NO: 9252788 - DNA, 22 bp, Homo sapiens
ccagtggagtttttatacccag

SEQ ID NO: 9252789 - DNA, 22 bp, Homo sapiens
ccagtggacttctccctgtggt

SEQ ID NO: 9252790 - DNA, 22 bp, Homo sapiens
ccagtggaaatgtggtcaggat

SEQ ID NO: 9252791 - DNA, 22 bp, Homo sapiens
ccagtggacaatttctgaggaa

SEQ ID NO: 9252792 - DNA, 22 bp, Homo sapiens
ccagtggaattaaaaataagtg

SEQ ID NO: 9252793 - DNA, 22 bp, Homo sapiens
ccagtgcttctttgctagctgg

SEQ ID NO: 9252794 - DNA, 21 bp, Homo sapiens
ccagtgctacagctgcctgac

SEQ ID NO: 9252795 - DNA, 21 bp, Homo sapiens
ccagtgctacagctgcctgac

SEQ ID NO: 9252796 - DNA, 21 bp, Homo sapiens
ccagtgctacagctgcctgac

SEQ ID NO: 9252797 - DNA, 22 bp, Homo sapiens
ccagtgctaaggtagcctctgc

SEQ ID NO: 9252798 - DNA, 22 bp, Homo sapiens
ccagtgcccagctgcccaggca

SEQ ID NO: 9252799 - DNA, 22 bp, Homo sapiens
ccagtgcagtccccctgaactg

SEQ ID NO: 9252800 - DNA, 22 bp, Homo sapiens
ccagtgcccagtctccctggtc

SEQ ID NO: 9252801 - DNA, 22 bp, Homo sapiens
ccagtgcctgtgggcatggtgc

SEQ ID NO: 9252802 - DNA, 22 bp, Homo sapiens
ccagtgcctatctcctctggga

SEQ ID NO: 9252803 - DNA, 22 bp, Homo sapiens
tgaggcccagccgccctgagag

SEQ ID NO: 9252804 - DNA, 22 bp, Homo sapiens
tgaggcccagccgccctgagag

SEQ ID NO: 9252805 - DNA, 20 bp, Homo sapiens
tgaggcccagcagagtcggg

SEQ ID NO: 9252806 - DNA, 22 bp, Homo sapiens
tgaggcccagccgccctgagag

SEQ ID NO: 9252807 - DNA, 22 bp, Homo sapiens
tgaggcccatctgagattttga

SEQ ID NO: 9252808 - DNA, 22 bp, Homo sapiens
tgaggctgaaactggcgataga

SEQ ID NO: 9252809 - DNA, 22 bp, Homo sapiens
tgaggctgaaactggcgataga

SEQ ID NO: 9252810 - DNA, 18 bp, Homo sapiens
tgaggctgaatatggggc

SEQ ID NO: 9252811 - DNA, 22 bp, Homo sapiens
tgaggctgacaaaagatgaggt

SEQ ID NO: 9252812 - DNA, 22 bp, Homo sapiens
tgaggctgacaaaagatgaggt

SEQ ID NO: 9252813 - DNA, 22 bp, Homo sapiens
tgaggctgacaaaagatgaggt

SEQ ID NO: 9252814 - DNA, 22 bp, Homo sapiens
tgaggctgagatatcagggagg

SEQ ID NO: 9252815 - DNA, 22 bp, Homo sapiens
tgaggctgagatatcagggagg

SEQ ID NO: 9252816 - DNA, 22 bp, Homo sapiens
tgaggctgagatatcagggagg

SEQ ID NO: 9252817 - DNA, 22 bp, Homo sapiens
tgaggccaggcaaaggcgatct

SEQ ID NO: 9252818 - DNA, 22 bp, Homo sapiens
tgaggccagggattccatcatt

SEQ ID NO: 9252819 - DNA, 22 bp, Homo sapiens
tgaggccagtctcatcacaggc

SEQ ID NO: 9252820 - DNA, 22 bp, Homo sapiens
tgaggccagtctcatcacaggc

SEQ ID NO: 9252821 - DNA, 22 bp, Homo sapiens
tgaggccagtgacatatattaa

SEQ ID NO: 9252822 - DNA, 17 bp, Homo sapiens
tgaggccatggcaccat

SEQ ID NO: 9252823 - DNA, 22 bp, Homo sapiens
tgaggccatggtcttcccagtc

SEQ ID NO: 9252824 - DNA, 22 bp, Homo sapiens
tgaggccatggaactagcttgg

SEQ ID NO: 9252825 - DNA, 22 bp, Homo sapiens
tgaggccatgcccgtgccggcc

SEQ ID NO: 9252826 - DNA, 22 bp, Homo sapiens
tgaggccatggaactagcttgg

SEQ ID NO: 9252827 - DNA, 22 bp, Homo sapiens
ccagtgttttccagtttgccca

SEQ ID NO: 9252828 - DNA, 18 bp, Homo sapiens
tgaggctgagggtagagg

SEQ ID NO: 9252829 - DNA, 23 bp, Homo sapiens
tgaggctgattgatttttgctca

SEQ ID NO: 9252830 - DNA, 18 bp, Homo sapiens
tgaggctgagggtagagg

SEQ ID NO: 9252831 - DNA, 22 bp, Homo sapiens
ccatcaatgactaataaaatag

SEQ ID NO: 9252832 - DNA, 22 bp, Homo sapiens
ccatcacagtccccatcgtgat

SEQ ID NO: 9252833 - DNA, 22 bp, Homo sapiens
ccatcctgcaggacctccatat

SEQ ID NO: 9252834 - DNA, 22 bp, Homo sapiens
tgaggtcccaggggtagtgtgc

SEQ ID NO: 9252835 - DNA, 22 bp, Homo sapiens
tgaggtcatggctgatatttcc

SEQ ID NO: 9252836 - DNA, 22 bp, Homo sapiens
tgagtcagtctgccctggcttc

SEQ ID NO: 9252837 - DNA, 20 bp, Homo sapiens
tgagtcagctgcatgggtgg

SEQ ID NO: 9252838 - DNA, 22 bp, Homo sapiens
tgaggtcctgcatgttgaggtc

SEQ ID NO: 9252839 - DNA, 22 bp, Homo sapiens
ccatccaggctgtgggtgagct

SEQ ID NO: 9252840 - DNA, 22 bp, Homo sapiens
ccatccctgggccatgtcccct

SEQ ID NO: 9252841 - DNA, 22 bp, Homo sapiens
tgagttcttcacattacctacg

SEQ ID NO: 9252842 - DNA, 22 bp, Homo sapiens
tgataaatccatgtaaatggta

SEQ ID NO: 9252843 - DNA, 22 bp, Homo sapiens
tgagttttttcaacatatgaag

SEQ ID NO: 9252844 - DNA, 21 bp, Homo sapiens
tgagtctctcagcttcaggta

SEQ ID NO: 9252845 - DNA, 21 bp, Homo sapiens
tgagtctcccttagcccacgc

SEQ ID NO: 9252846 - DNA, 22 bp, Homo sapiens
tgagtctcccaagtagttggaa

SEQ ID NO: 9252847 - DNA, 22 bp, Homo sapiens
tgagtcctgtctttgtcactta

SEQ ID NO: 9252848 - DNA, 22 bp, Homo sapiens
tgagtcctgtctttgtcactta

SEQ ID NO: 9252849 - DNA, 22 bp, Homo sapiens
tgagtcctggctttgggatgta

SEQ ID NO: 9252850 - DNA, 23 bp, Homo sapiens
tgagtctactcaccacaactggg

SEQ ID NO: 9252851 - DNA, 22 bp, Homo sapiens
tgagtcctgctgagcagagagg

SEQ ID NO: 9252852 - DNA, 22 bp, Homo sapiens
ccagggcagtgggagaaggtgc

SEQ ID NO: 9252853 - DNA, 22 bp, Homo sapiens
ccagggcagtgggagaaggtgc

SEQ ID NO: 9252854 - DNA, 22 bp, Homo sapiens
ccagggcatcacatccagtgtt

SEQ ID NO: 9252855 - DNA, 22 bp, Homo sapiens
ccagggcatcacatccagtgtt

SEQ ID NO: 9252856 - DNA, 22 bp, Homo sapiens
ccagggcatcctcacatcgcag

SEQ ID NO: 9252857 - DNA, 22 bp, Homo sapiens
tgaaggtgtttatacctcagat

SEQ ID NO: 9252858 - DNA, 22 bp, Homo sapiens
tgaaggtgtctttgtgaacatc

SEQ ID NO: 9252859 - DNA, 19 bp, Homo sapiens
tgaaggtgtatgtgctggg

SEQ ID NO: 9252860 - DNA, 22 bp, Homo sapiens
tgaaggtgtatgctgtgggtca

SEQ ID NO: 9252861 - DNA, 22 bp, Homo sapiens
tgaagtcagggattccatgaag

SEQ ID NO: 9252862 - DNA, 22 bp, Homo sapiens
tgaagtccctgacatttagaaa

SEQ ID NO: 9252863 - DNA, 22 bp, Homo sapiens
tgaagtatccatcttgttctag

SEQ ID NO: 9252864 - DNA, 22 bp, Homo sapiens
tgaagtacccgtttttattgca

SEQ ID NO: 9252865 - DNA, 22 bp, Homo sapiens
tgaagtctctgttttctcattt

SEQ ID NO: 9252866 - DNA, 23 bp, Homo sapiens
tgaagtgaaatttcacaagggac

SEQ ID NO: 9252867 - DNA, 22 bp, Homo sapiens
tgaagtgacctggggcagtgta

SEQ ID NO: 9252868 - DNA, 22 bp, Homo sapiens
ccagggctccattgctcatcct

SEQ ID NO: 9252869 - DNA, 22 bp, Homo sapiens
tgaagtgtcatttacatttcta

SEQ ID NO: 9252870 - DNA, 22 bp, Homo sapiens
tgaagttagaactatgaggata

SEQ ID NO: 9252871 - DNA, 22 bp, Homo sapiens
ccagggctccccagaagtaccc

SEQ ID NO: 9252872 - DNA, 22 bp, Homo sapiens
ccagggctctatgagggtggag

SEQ ID NO: 9252873 - DNA, 22 bp, Homo sapiens
ccagggctcgggtgcttagtca

SEQ ID NO: 9252874 - DNA, 22 bp, Homo sapiens
ccagggctgagctgtgaccatg

SEQ ID NO: 9252875 - DNA, 22 bp, Homo sapiens
ccagggctgagctgtgaccatg

SEQ ID NO: 9252876 - DNA, 22 bp, Homo sapiens
ccagggctgcctggccgtgtgt

SEQ ID NO: 9252877 - DNA, 22 bp, Homo sapiens
ccagggctgccgcatccctggt

SEQ ID NO: 9252878 - DNA, 22 bp, Homo sapiens
ccagggctctatgagggtggag

SEQ ID NO: 9252879 - DNA, 22 bp, Homo sapiens
ccagggctctgcttctgccatg

SEQ ID NO: 9252880 - DNA, 22 bp, Homo sapiens
ccagggctctgcttctgccatg

SEQ ID NO: 9252881 - DNA, 22 bp, Homo sapiens
ccagggctgagctgtgaccatg

SEQ ID NO: 9252882 - DNA, 22 bp, Homo sapiens
ccagggctgagactgtattggg

SEQ ID NO: 9252883 - DNA, 22 bp, Homo sapiens
ccagggcacgttgggacagtac

SEQ ID NO: 9252884 - DNA, 22 bp, Homo sapiens
ccagggcaattatttggagggt

SEQ ID NO: 9252885 - DNA, 22 bp, Homo sapiens
ccagggcacgttgggacagtac

SEQ ID NO: 9252886 - DNA, 22 bp, Homo sapiens
ccagggcagggaccacgtgtct

SEQ ID NO: 9252887 - DNA, 22 bp, Homo sapiens
ccagggcagggaccacgtgtct

SEQ ID NO: 9252888 - DNA, 22 bp, Homo sapiens
ccagggcaggagaaagactcac

SEQ ID NO: 9252889 - DNA, 22 bp, Homo sapiens
ccagggcaggggctggagttca

SEQ ID NO: 9252890 - DNA, 22 bp, Homo sapiens
ccagggcaacgctgtctcagag

SEQ ID NO: 9252891 - DNA, 22 bp, Homo sapiens
ccagggcaacgctgtctcagag

SEQ ID NO: 9252892 - DNA, 22 bp, Homo sapiens
ccagggcaataggaacactttt

SEQ ID NO: 9252893 - DNA, 22 bp, Homo sapiens
ccagggcaattatttggagggt

SEQ ID NO: 9252894 - DNA, 22 bp, Homo sapiens
ccagggcaacgctgtctcagag

SEQ ID NO: 9252895 - DNA, 22 bp, Homo sapiens
ccagggcaaatgagatcatagc

SEQ ID NO: 9252896 - DNA, 21 bp, Homo sapiens
ccagggatgttgaactgaaag

SEQ ID NO: 9252897 - DNA, 23 bp, Homo sapiens
ccagggagtgctactatcaagcc

SEQ ID NO: 9252898 - DNA, 22 bp, Homo sapiens
ccagggatgccaagctttacca

SEQ ID NO: 9252899 - DNA, 22 bp, Homo sapiens
ccagggatgcagaggttgcagt

SEQ ID NO: 9252900 - DNA, 18 bp, Homo sapiens
ccagggatgcatggtccc

SEQ ID NO: 9252901 - DNA, 22 bp, Homo sapiens
ccagggagggtcctgtggcttc

SEQ ID NO: 9252902 - DNA, 23 bp, Homo sapiens
ccagggaggttgattggttaccc

SEQ ID NO: 9252903 - DNA, 22 bp, Homo sapiens
ccagggagggtcctgtggcttc

SEQ ID NO: 9252904 - DNA, 22 bp, Homo sapiens
tgaaatgatatctgataacaaa

SEQ ID NO: 9252905 - DNA, 22 bp, Homo sapiens
tgaaatgagcatttattcttta

SEQ ID NO: 9252906 - DNA, 22 bp, Homo sapiens
tgaaatgagcatttattcttta

SEQ ID NO: 9252907 - DNA, 22 bp, Homo sapiens
tcttttctgccacagcctgagc

SEQ ID NO: 9252908 - DNA, 22 bp, Homo sapiens
tcttttctgccacagcctgagc

SEQ ID NO: 9252909 - DNA, 22 bp, Homo sapiens
tcttttctggactctgcatgga

SEQ ID NO: 9252910 - DNA, 22 bp, Homo sapiens
tcttgcaggcggctcagcaacc

SEQ ID NO: 9252911 - DNA, 22 bp, Homo sapiens
tcttttcttgcattattgcact

SEQ ID NO: 9252912 - DNA, 22 bp, Homo sapiens
tcttttcttgcattattgcact

SEQ ID NO: 9252913 - DNA, 22 bp, Homo sapiens
tcttttcttcttaatggttaat

SEQ ID NO: 9252914 - DNA, 22 bp, Homo sapiens
tcttttcttgcattattgcact

SEQ ID NO: 9252915 - DNA, 21 bp, Homo sapiens
tcttttgtaactatttcagcc

SEQ ID NO: 9252916 - DNA, 22 bp, Homo sapiens
tcttttgtgaggacaaggtacg

SEQ ID NO: 9252917 - DNA, 22 bp, Homo sapiens
tcttttgtcggtgtatcatgga

SEQ ID NO: 9252918 - DNA, 22 bp, Homo sapiens
tcttttgtcatcccttgtacat

SEQ ID NO: 9252919 - DNA, 22 bp, Homo sapiens
tcttgcagacagcttccagcct

SEQ ID NO: 9252920 - DNA, 19 bp, Homo sapiens
tcttgcagccccagcaggc

SEQ ID NO: 9252921 - DNA, 19 bp, Homo sapiens
tcttgcagccccagcaggc

SEQ ID NO: 9252922 - DNA, 22 bp, Homo sapiens
tcttgcagcttcatctgcaatt

SEQ ID NO: 9252923 - DNA, 22 bp, Homo sapiens
tcttgcacttcatgaatatgtt

SEQ ID NO: 9252924 - DNA, 22 bp, Homo sapiens
tcttgcagacagcttccagcct

SEQ ID NO: 9252925 - DNA, 22 bp, Homo sapiens
tcttgcagaaaatagtatagat

SEQ ID NO: 9252926 - DNA, 23 bp, Homo sapiens
ccaggcctctcagagggtgtgcc

SEQ ID NO: 9252927 - DNA, 22 bp, Homo sapiens
ccaggcctctggctgcttagtc

SEQ ID NO: 9252928 - DNA, 22 bp, Homo sapiens
ccaggcctctggctgcttagtc

SEQ ID NO: 9252929 - DNA, 22 bp, Homo sapiens
ccaggcctgattgggaatcttg

SEQ ID NO: 9252930 - DNA, 22 bp, Homo sapiens
ccaggcctgattgggaatcttg

SEQ ID NO: 9252931 - DNA, 22 bp, Homo sapiens
tgaaacaagtttaagggatcta

SEQ ID NO: 9252932 - DNA, 21 bp, Homo sapiens
tgaaacaatcagacagagtct

SEQ ID NO: 9252933 - DNA, 22 bp, Homo sapiens
tgaaacaagatccacagacttg

SEQ ID NO: 9252934 - DNA, 18 bp, Homo sapiens
tgaaacaagaatggtgca

SEQ ID NO: 9252935 - DNA, 21 bp, Homo sapiens
ccaggctggccatggtattga

SEQ ID NO: 9252936 - DNA, 17 bp, Homo sapiens
tgaaacaccaagactgt

SEQ ID NO: 9252937 - DNA, 22 bp, Homo sapiens
ccaggcttccctgagaggctgc

SEQ ID NO: 9252938 - DNA, 22 bp, Homo sapiens
ccaggcttccctgagaggctgc

SEQ ID NO: 9252939 - DNA, 22 bp, Homo sapiens
ccaggcttcaggagtggtttcc

SEQ ID NO: 9252940 - DNA, 22 bp, Homo sapiens
ccaggcttcctaatgtgtgcag

SEQ ID NO: 9252941 - DNA, 22 bp, Homo sapiens
ccaggcttcctaatgtgtgcag

SEQ ID NO: 9252942 - DNA, 22 bp, Homo sapiens
tgaaatgacagtcttaagctct

SEQ ID NO: 9252943 - DNA, 22 bp, Homo sapiens
ccaggctgtggtttagatagag

SEQ ID NO: 9252944 - DNA, 22 bp, Homo sapiens
ccaggctgttttcaaacttggg

SEQ ID NO: 9252945 - DNA, 22 bp, Homo sapiens
ccaggcttattatcttctccat

SEQ ID NO: 9252946 - DNA, 22 bp, Homo sapiens
ccaggctgttttcaaacttggg

SEQ ID NO: 9252947 - DNA, 22 bp, Homo sapiens
ccaggctgtggtttagatagag

SEQ ID NO: 9252948 - DNA, 22 bp, Homo sapiens
ccaggctgtggtttagatagag

SEQ ID NO: 9252949 - DNA, 22 bp, Homo sapiens
ccaggctgtggtttagatagag

SEQ ID NO: 9252950 - DNA, 22 bp, Homo sapiens
ccaggctgtgcttttcataaat

SEQ ID NO: 9252951 - DNA, 22 bp, Homo sapiens
ccaggctgtgcttttcataaat

SEQ ID NO: 9252952 - DNA, 22 bp, Homo sapiens
ccaggctgtgcttttcataaat

SEQ ID NO: 9252953 - DNA, 22 bp, Homo sapiens
ccaggctgtaagagtgatgttg

SEQ ID NO: 9252954 - DNA, 22 bp, Homo sapiens
ccaggcagagggatccccatcc

SEQ ID NO: 9252955 - DNA, 22 bp, Homo sapiens
tcttacaagaaggaaaagggag

SEQ ID NO: 9252956 - DNA, 20 bp, Homo sapiens
tcttacaatcgttacatcca

SEQ ID NO: 9252957 - DNA, 22 bp, Homo sapiens
tcttacaagtcacccgctttct

SEQ ID NO: 9252958 - DNA, 20 bp, Homo sapiens
tcttacaatcgttacatcca

SEQ ID NO: 9252959 - DNA, 22 bp, Homo sapiens
tcttacatatagcatgagtaca

SEQ ID NO: 9252960 - DNA, 22 bp, Homo sapiens
tcttaatgctagccaatagaga

SEQ ID NO: 9252961 - DNA, 22 bp, Homo sapiens
tcttacaagaaataagccaatg

SEQ ID NO: 9252962 - DNA, 22 bp, Homo sapiens
ccaggcacttgtttgccaggca

SEQ ID NO: 9252963 - DNA, 22 bp, Homo sapiens
ccaggaggctcttgtccctggt

SEQ ID NO: 9252964 - DNA, 22 bp, Homo sapiens
ccaggaggctctgactggaccc

SEQ ID NO: 9252965 - DNA, 22 bp, Homo sapiens
ccaggaggctctgactggaccc

SEQ ID NO: 9252966 - DNA, 22 bp, Homo sapiens
ccaggaggcggaggttgcagtg

SEQ ID NO: 9252967 - DNA, 22 bp, Homo sapiens
ccaggaggcggaggttgcagtg

SEQ ID NO: 9252968 - DNA, 22 bp, Homo sapiens
ccaggaggcggaggttgcagtg

SEQ ID NO: 9252969 - DNA, 22 bp, Homo sapiens
tcttctctcatgtaggagggaa

SEQ ID NO: 9252970 - DNA, 22 bp, Homo sapiens
tcttctctcctgcttggcagaa

SEQ ID NO: 9252971 - DNA, 22 bp, Homo sapiens
tcttctctgtggcctggtggtg

SEQ ID NO: 9252972 - DNA, 22 bp, Homo sapiens
tcttctctcctgcttggcagaa

SEQ ID NO: 9252973 - DNA, 22 bp, Homo sapiens
tcttcctatggggctgcaggaa

SEQ ID NO: 9252974 - DNA, 22 bp, Homo sapiens
tcttagaaatgaagttctttct

SEQ ID NO: 9252975 - DNA, 22 bp, Homo sapiens
tcttagaaactgtatcgattag

SEQ ID NO: 9252976 - DNA, 22 bp, Homo sapiens
tcttagaaaaatggtatgtttt

SEQ ID NO: 9252977 - DNA, 22 bp, Homo sapiens
tcttctgaaggtaggaagcatt

SEQ ID NO: 9252978 - DNA, 19 bp, Homo sapiens
tcttctgacttcaagaaac

SEQ ID NO: 9252979 - DNA, 22 bp, Homo sapiens
tcttctgagacttctctttggt

SEQ ID NO: 9252980 - DNA, 22 bp, Homo sapiens
tcttctctgtggcctggtggtg

SEQ ID NO: 9252981 - DNA, 22 bp, Homo sapiens
tcttctctgtggcctggtggtg

SEQ ID NO: 9252982 - DNA, 17 bp, Homo sapiens
tcttctcttccagtctt

SEQ ID NO: 9252983 - DNA, 17 bp, Homo sapiens
tcttctcttccagtctt

SEQ ID NO: 9252984 - DNA, 17 bp, Homo sapiens
tcttctcttccagtctt

SEQ ID NO: 9252985 - DNA, 22 bp, Homo sapiens
ccaggcctcccttttccagcca

SEQ ID NO: 9252986 - DNA, 22 bp, Homo sapiens
ccaggcctcctgtgagtggacc

SEQ ID NO: 9252987 - DNA, 19 bp, Homo sapiens
ccaggcctcctgggaggtc

SEQ ID NO: 9252988 - DNA, 22 bp, Homo sapiens
ccaggcagctctgatttatgtc

SEQ ID NO: 9252989 - DNA, 22 bp, Homo sapiens
ccaggcagccaagtgtgtgtgt

SEQ ID NO: 9252990 - DNA, 22 bp, Homo sapiens
ccaggcaggcagcgttctcagg

SEQ ID NO: 9252991 - DNA, 22 bp, Homo sapiens
ccaggcaggcgatggtgcagtg

SEQ ID NO: 9252992 - DNA, 22 bp, Homo sapiens
ccaggcaggcgatggtgcagtg

SEQ ID NO: 9252993 - DNA, 22 bp, Homo sapiens
tctggggagtgcctaagtggaa

SEQ ID NO: 9252994 - DNA, 22 bp, Homo sapiens
tctggggagtcaaagagacctg

SEQ ID NO: 9252995 - DNA, 22 bp, Homo sapiens
tctggggagtcaaagagacctg

SEQ ID NO: 9252996 - DNA, 17 bp, Homo sapiens
ccaggagagatgcttgt

SEQ ID NO: 9252997 - DNA, 17 bp, Homo sapiens
ccaggagagatgcttgt

SEQ ID NO: 9252998 - DNA, 22 bp, Homo sapiens
tctggggatgaggacctagatg

SEQ ID NO: 9252999 - DNA, 22 bp, Homo sapiens
ccaggagcaacttgaaggcaag

SEQ ID NO: 9253000 - DNA, 22 bp, Homo sapiens
ccaggagcaacttgaaggcaag

SEQ ID NO: 9253001 - DNA, 22 bp, Homo sapiens
ccaggagcaacttgaaggcaag

SEQ ID NO: 9253002 - DNA, 22 bp, Homo sapiens
ccaggagagcaaaggtcactct

SEQ ID NO: 9253003 - DNA, 22 bp, Homo sapiens
ccaggagagcaaaggtcactct

SEQ ID NO: 9253004 - DNA, 21 bp, Homo sapiens
tctggggaagacatctaggat

SEQ ID NO: 9253005 - DNA, 21 bp, Homo sapiens
tctggggaagacatctaggat

SEQ ID NO: 9253006 - DNA, 22 bp, Homo sapiens
tctgggctctgtcagcacctct

SEQ ID NO: 9253007 - DNA, 22 bp, Homo sapiens
tctggggagcagccctggtgag

SEQ ID NO: 9253008 - DNA, 22 bp, Homo sapiens
tctggggacggggcccagcaat

SEQ ID NO: 9253009 - DNA, 22 bp, Homo sapiens
tctggggagggagccacaggtc

SEQ ID NO: 9253010 - DNA, 22 bp, Homo sapiens
tctggggaccatggcatctaaa

SEQ ID NO: 9253011 - DNA, 22 bp, Homo sapiens
ccagcaccttgatcttggagtt

SEQ ID NO: 9253012 - DNA, 22 bp, Homo sapiens
ccagcactcctgtctcaagtct

SEQ ID NO: 9253013 - DNA, 22 bp, Homo sapiens
ccagcactctattgaatattct

SEQ ID NO: 9253014 - DNA, 22 bp, Homo sapiens
ccagcactctgtcccagcttcc

SEQ ID NO: 9253015 - DNA, 22 bp, Homo sapiens
tctgggcctcacctgctgctca

SEQ ID NO: 9253016 - DNA, 22 bp, Homo sapiens
tctgggctctgtcagcacctct

SEQ ID NO: 9253017 - DNA, 22 bp, Homo sapiens
ccaggagccctgccacaatggt

SEQ ID NO: 9253018 - DNA, 22 bp, Homo sapiens
ccaggagccactcaggcccaca

SEQ ID NO: 9253019 - DNA, 22 bp, Homo sapiens
ccaggagccactcaggcccaca

SEQ ID NO: 9253020 - DNA, 22 bp, Homo sapiens
ccaggagcattaagagaacata

SEQ ID NO: 9253021 - DNA, 22 bp, Homo sapiens
ccaggagcagggctggctgcac

SEQ ID NO: 9253022 - DNA, 19 bp, Homo sapiens
ccaggagcagtggtgagct

SEQ ID NO: 9253023 - DNA, 22 bp, Homo sapiens
ccaggagcagggctggctgcac

SEQ ID NO: 9253024 - DNA, 22 bp, Homo sapiens
ccaggagcagggctggctgcac

SEQ ID NO: 9253025 - DNA, 22 bp, Homo sapiens
ccaggagcaggagctggacaga

SEQ ID NO: 9253026 - DNA, 22 bp, Homo sapiens
ccaggagcagccggcccacctg

SEQ ID NO: 9253027 - DNA, 22 bp, Homo sapiens
ccaggagcagagtaggtgttca

SEQ ID NO: 9253028 - DNA, 22 bp, Homo sapiens
ccaggagcagagtaggtgttca

SEQ ID NO: 9253029 - DNA, 22 bp, Homo sapiens
ccaggagcctgggccaggctgg

SEQ ID NO: 9253030 - DNA, 20 bp, Homo sapiens
tctgttattgcatgtacata

SEQ ID NO: 9253031 - DNA, 20 bp, Homo sapiens
tctgttattgcatgtacata

SEQ ID NO: 9253032 - DNA, 22 bp, Homo sapiens
tctgttcaggtttcagagaact

SEQ ID NO: 9253033 - DNA, 22 bp, Homo sapiens
tctgttccatgttttgttccat

SEQ ID NO: 9253034 - DNA, 22 bp, Homo sapiens
tctgttcatgtctttttaagtg

SEQ ID NO: 9253035 - DNA, 17 bp, Homo sapiens
tctgttcatgcatacct

SEQ ID NO: 9253036 - DNA, 22 bp, Homo sapiens
ccaggaggcggaggttgcagcg

SEQ ID NO: 9253037 - DNA, 22 bp, Homo sapiens
tctgttctaagcattctatgtg

SEQ ID NO: 9253038 - DNA, 22 bp, Homo sapiens
tctgttcttaaagcattcttgc

SEQ ID NO: 9253039 - DNA, 23 bp, Homo sapiens
gaagccacacaaaggtcgccaag

SEQ ID NO: 9253040 - DNA, 22 bp, Homo sapiens
gaagccacaactttttcttagc

SEQ ID NO: 9253041 - DNA, 22 bp, Homo sapiens
gaagccacagggaaggagaaca

SEQ ID NO: 9253042 - DNA, 22 bp, Homo sapiens
gaagccacagagattgtggggg

SEQ ID NO: 9253043 - DNA, 22 bp, Homo sapiens
gaagccaccctccttccagccc

SEQ ID NO: 9253044 - DNA, 22 bp, Homo sapiens
gaagccactatagatattctaa

SEQ ID NO: 9253045 - DNA, 22 bp, Homo sapiens
gaaggagctaaagggagccctg

SEQ ID NO: 9253046 - DNA, 22 bp, Homo sapiens
gaaggagctaaagggagccctg

SEQ ID NO: 9253047 - DNA, 20 bp, Homo sapiens
gaagccagaggggaaaggag

SEQ ID NO: 9253048 - DNA, 22 bp, Homo sapiens
gaaggcaggcttctgattaggt

SEQ ID NO: 9253049 - DNA, 22 bp, Homo sapiens
gaaggcagggaatgtggtgcta

SEQ ID NO: 9253050 - DNA, 22 bp, Homo sapiens
gaaggcactgaactccttctgg

SEQ ID NO: 9253051 - DNA, 22 bp, Homo sapiens
gaaggcaggtttttcaaaactg

SEQ ID NO: 9253052 - DNA, 22 bp, Homo sapiens
gaaggcagtaaatggctgtttt

SEQ ID NO: 9253053 - DNA, 22 bp, Homo sapiens
gaaggccacaagagaagttaag

SEQ ID NO: 9253054 - DNA, 22 bp, Homo sapiens
gaaggccacggaatggagctgg

SEQ ID NO: 9253055 - DNA, 22 bp, Homo sapiens
gaaggccattgcgtcctgggat

SEQ ID NO: 9253056 - DNA, 22 bp, Homo sapiens
gaagggagaaggttgggtgacg

SEQ ID NO: 9253057 - DNA, 22 bp, Homo sapiens
gaagggagaaggttgggtgacg

SEQ ID NO: 9253058 - DNA, 22 bp, Homo sapiens
gaagggagaaggttgggtgacg

SEQ ID NO: 9253059 - DNA, 18 bp, Homo sapiens
gaagggagctggaatgca

SEQ ID NO: 9253060 - DNA, 22 bp, Homo sapiens
gaagggagaaggttgggtgacg

SEQ ID NO: 9253061 - DNA, 22 bp, Homo sapiens
gaagggaaggaaagaaccagca

SEQ ID NO: 9253062 - DNA, 22 bp, Homo sapiens
gaagcaagtgcaaggaagaggc

SEQ ID NO: 9253063 - DNA, 22 bp, Homo sapiens
gaagcagcagctggggacagtt

SEQ ID NO: 9253064 - DNA, 22 bp, Homo sapiens
gaagcagctaggatcttcattt

SEQ ID NO: 9253065 - DNA, 22 bp, Homo sapiens
gaagcagtatcctgacagcacc

SEQ ID NO: 9253066 - DNA, 22 bp, Homo sapiens
gaagcagtcagcagcacctttg

SEQ ID NO: 9253067 - DNA, 22 bp, Homo sapiens
gaagcagtagcaactgtgtctt

SEQ ID NO: 9253068 - DNA, 22 bp, Homo sapiens
gaagcagtagattcctactcat

SEQ ID NO: 9253069 - DNA, 22 bp, Homo sapiens
gaagcagtagcaactgtgtctt

SEQ ID NO: 9253070 - DNA, 18 bp, Homo sapiens
gaagcatatttgttcttc

SEQ ID NO: 9253071 - DNA, 22 bp, Homo sapiens
gaagcatgctaaggattctcag

SEQ ID NO: 9253072 - DNA, 22 bp, Homo sapiens
gaagcatcagcaatggctggaa

SEQ ID NO: 9253073 - DNA, 22 bp, Homo sapiens
gaagcagtttctgtaatgaaat

SEQ ID NO: 9253074 - DNA, 22 bp, Homo sapiens
gaagcagttcgaaagcagttgg

SEQ ID NO: 9253075 - DNA, 22 bp, Homo sapiens
gaagcagtgtgaacccatgtaa

SEQ ID NO: 9253076 - DNA, 22 bp, Homo sapiens
gaagcagtgtgaacccatgtaa

SEQ ID NO: 9253077 - DNA, 22 bp, Homo sapiens
gaagccaagtgcaaatgcctta

SEQ ID NO: 9253078 - DNA, 22 bp, Homo sapiens
gaagccaacattccaagtagaa

SEQ ID NO: 9253079 - DNA, 22 bp, Homo sapiens
gaagcatgctaaggattctcag

SEQ ID NO: 9253080 - DNA, 22 bp, Homo sapiens
gaaaggagagggttaaggagct

SEQ ID NO: 9253081 - DNA, 18 bp, Homo sapiens
gaaaggagagacagtagg

SEQ ID NO: 9253082 - DNA, 18 bp, Homo sapiens
gaaaggagagacagtagg

SEQ ID NO: 9253083 - DNA, 22 bp, Homo sapiens
gaaaggagggaaacagagcggt

SEQ ID NO: 9253084 - DNA, 22 bp, Homo sapiens
gaaaggagggaaacagagcggt

SEQ ID NO: 9253085 - DNA, 22 bp, Homo sapiens
gaaaggagtgctttccaggtct

SEQ ID NO: 9253086 - DNA, 20 bp, Homo sapiens
gaaaggagtgtccctgtgag

SEQ ID NO: 9253087 - DNA, 18 bp, Homo sapiens
gaaaggagagacagtagg

SEQ ID NO: 9253088 - DNA, 22 bp, Homo sapiens
gaaaggaacttgtgagtgggag

SEQ ID NO: 9253089 - DNA, 22 bp, Homo sapiens
gaaaggaaattgagggacgcat

SEQ ID NO: 9253090 - DNA, 22 bp, Homo sapiens
gaaaggaaattgagggacgcat

SEQ ID NO: 9253091 - DNA, 22 bp, Homo sapiens
gaaaggaaatattctaagcact

SEQ ID NO: 9253092 - DNA, 22 bp, Homo sapiens
gaaaggaaatattctaagcact

SEQ ID NO: 9253093 - DNA, 22 bp, Homo sapiens
gaaagctgaaccaggaaccatg

SEQ ID NO: 9253094 - DNA, 22 bp, Homo sapiens
gaagggtgcatggagggaagtc

SEQ ID NO: 9253095 - DNA, 22 bp, Homo sapiens
gaagggtgcatggagggaagtc

SEQ ID NO: 9253096 - DNA, 22 bp, Homo sapiens
gaagggtgtgatttgcctgaga

SEQ ID NO: 9253097 - DNA, 22 bp, Homo sapiens
gaagggtgtgtgtgagggacac

SEQ ID NO: 9253098 - DNA, 22 bp, Homo sapiens
gaagggtgcatggagggaagtc

SEQ ID NO: 9253099 - DNA, 22 bp, Homo sapiens
gaagggggttgcagtctagggt

SEQ ID NO: 9253100 - DNA, 22 bp, Homo sapiens
gaagggtgtgtgtgagggacac

SEQ ID NO: 9253101 - DNA, 22 bp, Homo sapiens
gaagggtgtgtgtgagggacac

SEQ ID NO: 9253102 - DNA, 22 bp, Homo sapiens
gaaggtggcgagcggattgctg

SEQ ID NO: 9253103 - DNA, 22 bp, Homo sapiens
gaagggcttggctgggaggcca

SEQ ID NO: 9253104 - DNA, 22 bp, Homo sapiens
gaagggctttctgggagaagag

SEQ ID NO: 9253105 - DNA, 18 bp, Homo sapiens
gaagggagctggaatgca

SEQ ID NO: 9253106 - DNA, 18 bp, Homo sapiens
gaagggagctggaatgca

SEQ ID NO: 9253107 - DNA, 19 bp, Homo sapiens
gaaggggaaggtgggtacc

SEQ ID NO: 9253108 - DNA, 22 bp, Homo sapiens
gaaggggaaagttgagcaaata

SEQ ID NO: 9253109 - DNA, 22 bp, Homo sapiens
gaaggggactggcagctgcaga

SEQ ID NO: 9253110 - DNA, 22 bp, Homo sapiens
gaaggggactggcagctgcaga

SEQ ID NO: 9253111 - DNA, 22 bp, Homo sapiens
gaatcccaatctgttattgaca

SEQ ID NO: 9253112 - DNA, 22 bp, Homo sapiens
gaatctatgcctcatatagacc

SEQ ID NO: 9253113 - DNA, 22 bp, Homo sapiens
gaatctatgcctcatatagacc

SEQ ID NO: 9253114 - DNA, 22 bp, Homo sapiens
gaatcttacctctctattgttg

SEQ ID NO: 9253115 - DNA, 22 bp, Homo sapiens
gaatcttagaaaggttaaggaa

SEQ ID NO: 9253116 - DNA, 22 bp, Homo sapiens
gaatcttagtctcctaacggct

SEQ ID NO: 9253117 - DNA, 22 bp, Homo sapiens
gaatcttatgtggtgttttcta

SEQ ID NO: 9253118 - DNA, 22 bp, Homo sapiens
gaatcttaaatcggaatcttaa

SEQ ID NO: 9253119 - DNA, 20 bp, Homo sapiens
gaatcttactacattctctc

SEQ ID NO: 9253120 - DNA, 22 bp, Homo sapiens
gaatcttatccccagtccttaa

SEQ ID NO: 9253121 - DNA, 22 bp, Homo sapiens
gaatcttatttttaaatcttcc

SEQ ID NO: 9253122 - DNA, 22 bp, Homo sapiens
gaatcttatttttaaatcttcc

SEQ ID NO: 9253123 - DNA, 22 bp, Homo sapiens
gaaggtttactgaagatttaaa

SEQ ID NO: 9253124 - DNA, 22 bp, Homo sapiens
gaaggtttgaaataggtataga

SEQ ID NO: 9253125 - DNA, 17 bp, Homo sapiens
gaaggtttctcttaggt

SEQ ID NO: 9253126 - DNA, 22 bp, Homo sapiens
gaaggtttgatccttatttata

SEQ ID NO: 9253127 - DNA, 22 bp, Homo sapiens
gaatatttgtaattactgttga

SEQ ID NO: 9253128 - DNA, 22 bp, Homo sapiens
gaatgatattatttcgtgctgg

SEQ ID NO: 9253129 - DNA, 22 bp, Homo sapiens
gaatgatatattagcagatttt

SEQ ID NO: 9253130 - DNA, 22 bp, Homo sapiens
gacactttaggccaccatgcaa

SEQ ID NO: 9253131 - DNA, 22 bp, Homo sapiens
gacactttaggatttaaaagtc

SEQ ID NO: 9253132 - DNA, 22 bp, Homo sapiens
gacactgttatggtgaggtaag

SEQ ID NO: 9253133 - DNA, 22 bp, Homo sapiens
gacactgttatggtgaggtaag

SEQ ID NO: 9253134 - DNA, 22 bp, Homo sapiens
gacactgtgctagctgggctta

SEQ ID NO: 9253135 - DNA, 22 bp, Homo sapiens
gacactgtgctagctgggctta

SEQ ID NO: 9253136 - DNA, 22 bp, Homo sapiens
gacactgtcccacagaattcga

SEQ ID NO: 9253137 - DNA, 22 bp, Homo sapiens
gacactggatttctagaaatgt

SEQ ID NO: 9253138 - DNA, 22 bp, Homo sapiens
gacactggcttgtcccgccatc

SEQ ID NO: 9253139 - DNA, 22 bp, Homo sapiens
gacactggatttctagaaatgt

SEQ ID NO: 9253140 - DNA, 22 bp, Homo sapiens
gacactggaaatattgaattgg

SEQ ID NO: 9253141 - DNA, 22 bp, Homo sapiens
gacactggaaatattgaattgg

SEQ ID NO: 9253142 - DNA, 22 bp, Homo sapiens
gaatgaaagatttgcattctat

SEQ ID NO: 9253143 - DNA, 22 bp, Homo sapiens
gaatgaacaaatgtggtggaga

SEQ ID NO: 9253144 - DNA, 22 bp, Homo sapiens
gaatgaacaaggatgttcatcc

SEQ ID NO: 9253145 - DNA, 22 bp, Homo sapiens
gaatgagactatgcgagtgtga

SEQ ID NO: 9253146 - DNA, 22 bp, Homo sapiens
gaatgagttaatatttgcttgg

SEQ ID NO: 9253147 - DNA, 22 bp, Homo sapiens
gaatgataaatggaagcagcat

SEQ ID NO: 9253148 - DNA, 22 bp, Homo sapiens
gaatgatagagctgccttcgga

SEQ ID NO: 9253149 - DNA, 22 bp, Homo sapiens
gacagacaggaggccacctgct

SEQ ID NO: 9253150 - DNA, 22 bp, Homo sapiens
gacagacaggggttctcctgga

SEQ ID NO: 9253151 - DNA, 22 bp, Homo sapiens
gacagacaggtgtggtaggcac

SEQ ID NO: 9253152 - DNA, 22 bp, Homo sapiens
gacagacaggaggcattcaggg

SEQ ID NO: 9253153 - DNA, 22 bp, Homo sapiens
gacagacactgtgtcctcactt

SEQ ID NO: 9253154 - DNA, 22 bp, Homo sapiens
gacagaagaggaacttggacag

SEQ ID NO: 9253155 - DNA, 22 bp, Homo sapiens
gacagaagaggaacttggacag

SEQ ID NO: 9253156 - DNA, 22 bp, Homo sapiens
gacactttctcaggtaaagcat

SEQ ID NO: 9253157 - DNA, 22 bp, Homo sapiens
gacagacacaattgatccatga

SEQ ID NO: 9253158 - DNA, 17 bp, Homo sapiens
gactgaggtaaggtgag

SEQ ID NO: 9253159 - DNA, 22 bp, Homo sapiens
gactgagggatagaggtgcttc

SEQ ID NO: 9253160 - DNA, 22 bp, Homo sapiens
gactgagggatagaggtgcttc

SEQ ID NO: 9253161 - DNA, 22 bp, Homo sapiens
gactgaggctcccctaggctca

SEQ ID NO: 9253162 - DNA, 22 bp, Homo sapiens
gactgagggacagggcagtgga

SEQ ID NO: 9253163 - DNA, 22 bp, Homo sapiens
gactgaggaggtaaggtttgaa

SEQ ID NO: 9253164 - DNA, 22 bp, Homo sapiens
gactgagaatcatagaaggcaa

SEQ ID NO: 9253165 - DNA, 22 bp, Homo sapiens
gactctttcaaacagaaagcca

SEQ ID NO: 9253166 - DNA, 22 bp, Homo sapiens
gactctcaagcacaagtccacc

SEQ ID NO: 9253167 - DNA, 22 bp, Homo sapiens
gaccacagtccagtcatcatgg

SEQ ID NO: 9253168 - DNA, 22 bp, Homo sapiens
gaccacaggtatgggcttggca

SEQ ID NO: 9253169 - DNA, 21 bp, Homo sapiens
gaccacagggaaggtcttgca

SEQ ID NO: 9253170 - DNA, 22 bp, Homo sapiens
gaccacagctacaagggcaagg

SEQ ID NO: 9253171 - DNA, 22 bp, Homo sapiens
gacatttagaagttagattcaa

SEQ ID NO: 9253172 - DNA, 22 bp, Homo sapiens
gactccaggtgtccaggcctcc

SEQ ID NO: 9253173 - DNA, 22 bp, Homo sapiens
gactccatccaatctgtgttct

SEQ ID NO: 9253174 - DNA, 22 bp, Homo sapiens
gaccagctggtgaaaaccaatt

SEQ ID NO: 9253175 - DNA, 22 bp, Homo sapiens
gaccagctggtcctgtcctggg

SEQ ID NO: 9253176 - DNA, 22 bp, Homo sapiens
gaccaggaaagagtgtgactaa

SEQ ID NO: 9253177 - DNA, 22 bp, Homo sapiens
gaccagctggtcctgtcctggg

SEQ ID NO: 9253178 - DNA, 22 bp, Homo sapiens
gaccagctgataaggcatataa

SEQ ID NO: 9253179 - DNA, 22 bp, Homo sapiens
gaccagctctctgaagaaagag

SEQ ID NO: 9253180 - DNA, 22 bp, Homo sapiens
gaccagctacttgtacagttca

SEQ ID NO: 9253181 - DNA, 22 bp, Homo sapiens
gacatttaaggcagtcacttaa

SEQ ID NO: 9253182 - DNA, 22 bp, Homo sapiens
gacatttaaggcagtcacttaa

SEQ ID NO: 9253183 - DNA, 22 bp, Homo sapiens
gacatttagaagtctaatggcc

SEQ ID NO: 9253184 - DNA, 22 bp, Homo sapiens
gacattgaagtatttttgtcga

SEQ ID NO: 9253185 - DNA, 20 bp, Homo sapiens
gacattgtaattaatgatga

SEQ ID NO: 9253186 - DNA, 22 bp, Homo sapiens
gacattgtggttattaaatgtt

SEQ ID NO: 9253187 - DNA, 22 bp, Homo sapiens
gacagaggagaagatgctgtgg

SEQ ID NO: 9253188 - DNA, 22 bp, Homo sapiens
gacagagaggctgagcagtaca

SEQ ID NO: 9253189 - DNA, 22 bp, Homo sapiens
gacagagaggctgagcagtaca

SEQ ID NO: 9253190 - DNA, 22 bp, Homo sapiens
gacagacatttcctgatccaat

SEQ ID NO: 9253191 - DNA, 22 bp, Homo sapiens
gacagacatttcctgatccaat

SEQ ID NO: 9253192 - DNA, 22 bp, Homo sapiens
gacagcagacagcctggcccct

SEQ ID NO: 9253193 - DNA, 22 bp, Homo sapiens
gacagcagagcagactaatgga

SEQ ID NO: 9253194 - DNA, 22 bp, Homo sapiens
gacagcagacagaactacctgc

SEQ ID NO: 9253195 - DNA, 22 bp, Homo sapiens
gacagcagacagaactacctgc

SEQ ID NO: 9253196 - DNA, 22 bp, Homo sapiens
gactgaggtgacctaggactac

SEQ ID NO: 9253197 - DNA, 22 bp, Homo sapiens
gactgaggtgcccagaggtgac

SEQ ID NO: 9253198 - DNA, 22 bp, Homo sapiens
gactgcagtgaaggcacatggg

SEQ ID NO: 9253199 - DNA, 22 bp, Homo sapiens
gagaaacactgttagtttatta

SEQ ID NO: 9253200 - DNA, 22 bp, Homo sapiens
gagaaacactgttagtttatta

SEQ ID NO: 9253201 - DNA, 22 bp, Homo sapiens
gagaaacactgttagtttatta

SEQ ID NO: 9253202 - DNA, 19 bp, Homo sapiens
gagaaaccccgtctttagg

SEQ ID NO: 9253203 - DNA, 22 bp, Homo sapiens
gagaaaccgattctgcatgtca

SEQ ID NO: 9253204 - DNA, 23 bp, Homo sapiens
gagaaacctcggtaagcaggagg

SEQ ID NO: 9253205 - DNA, 22 bp, Homo sapiens
gagaaacaggaattgagtcgct

SEQ ID NO: 9253206 - DNA, 22 bp, Homo sapiens
gagaaacaggaattgagtcgct

SEQ ID NO: 9253207 - DNA, 22 bp, Homo sapiens
gagaaactaacatctgaaggtg

SEQ ID NO: 9253208 - DNA, 22 bp, Homo sapiens
gagaaacctgtaaggaaggaag

SEQ ID NO: 9253209 - DNA, 18 bp, Homo sapiens
gagaaacctgtgaatgct

SEQ ID NO: 9253210 - DNA, 22 bp, Homo sapiens
gagaaacttggagttattctgg

SEQ ID NO: 9253211 - DNA, 22 bp, Homo sapiens
gagaaagacgtaggctgggagg

SEQ ID NO: 9253212 - DNA, 22 bp, Homo sapiens
gagaaagacgtaggctgggagg

SEQ ID NO: 9253213 - DNA, 22 bp, Homo sapiens
gagaaagatggaatcttacagg

SEQ ID NO: 9253214 - DNA, 19 bp, Homo sapiens
gagaaagcaggcacagcac

SEQ ID NO: 9253215 - DNA, 19 bp, Homo sapiens
gagaaagcaggcacagcac

SEQ ID NO: 9253216 - DNA, 22 bp, Homo sapiens
gagaaagcttcagaaatggcct

SEQ ID NO: 9253217 - DNA, 22 bp, Homo sapiens
gagaaagcttcagaaatggcct

SEQ ID NO: 9253218 - DNA, 22 bp, Homo sapiens
gagaaagatgtaggctgggagg

SEQ ID NO: 9253219 - DNA, 22 bp, Homo sapiens
gagaaagatgtaggctgggagg

SEQ ID NO: 9253220 - DNA, 22 bp, Homo sapiens
gagaaagattgtccttcagggg

SEQ ID NO: 9253221 - DNA, 22 bp, Homo sapiens
gagaaagattgtccttcagggg

SEQ ID NO: 9253222 - DNA, 22 bp, Homo sapiens
gagacagatgctgctggagcat

SEQ ID NO: 9253223 - DNA, 22 bp, Homo sapiens
gagaaagcttctttcccacagg

SEQ ID NO: 9253224 - DNA, 22 bp, Homo sapiens
gagaaagcttctttcccacagg

SEQ ID NO: 9253225 - DNA, 22 bp, Homo sapiens
gagacagatgctgctggagcat

SEQ ID NO: 9253226 - DNA, 22 bp, Homo sapiens
gagacagatgctgctggagcat

SEQ ID NO: 9253227 - DNA, 22 bp, Homo sapiens
gagacctgcagctgtagtctgc

SEQ ID NO: 9253228 - DNA, 22 bp, Homo sapiens
gagacctggaggatgtggatgg

SEQ ID NO: 9253229 - DNA, 22 bp, Homo sapiens
gagactgcatagatggccacaa

SEQ ID NO: 9253230 - DNA, 22 bp, Homo sapiens
gagactgatggggctcccagaa

SEQ ID NO: 9253231 - DNA, 22 bp, Homo sapiens
gagactgtaagctccttgagga

SEQ ID NO: 9253232 - DNA, 22 bp, Homo sapiens
gagacttagagctccttgaggg

SEQ ID NO: 9253233 - DNA, 22 bp, Homo sapiens
gagagaaaacaagttctccatt

SEQ ID NO: 9253234 - DNA, 22 bp, Homo sapiens
gagagaaaaatgagcttcattg

SEQ ID NO: 9253235 - DNA, 22 bp, Homo sapiens
gagagaaaggataacagctcaa

SEQ ID NO: 9253236 - DNA, 22 bp, Homo sapiens
gagagaaagcccctgcatccct

SEQ ID NO: 9253237 - DNA, 22 bp, Homo sapiens
gagagaaaagggggaattgatt

SEQ ID NO: 9253238 - DNA, 22 bp, Homo sapiens
gagagaaaagggggaattgatt

SEQ ID NO: 9253239 - DNA, 22 bp, Homo sapiens
gagagaaaacaagttctccatt

SEQ ID NO: 9253240 - DNA, 21 bp, Homo sapiens
gagagggcattataggaagtg

SEQ ID NO: 9253241 - DNA, 21 bp, Homo sapiens
gagagggcattataggaagtg

SEQ ID NO: 9253242 - DNA, 22 bp, Homo sapiens
gagagggccagggtgagaacta

SEQ ID NO: 9253243 - DNA, 22 bp, Homo sapiens
gagagggctctgtgtgggtact

SEQ ID NO: 9253244 - DNA, 22 bp, Homo sapiens
gagagggctgcctggtgtgagg

SEQ ID NO: 9253245 - DNA, 18 bp, Homo sapiens
gagagggatccctcagga

SEQ ID NO: 9253246 - DNA, 18 bp, Homo sapiens
gagagggatccctcagga

SEQ ID NO: 9253247 - DNA, 18 bp, Homo sapiens
gagagggatccctcagga

SEQ ID NO: 9253248 - DNA, 18 bp, Homo sapiens
gagagggatccctcagga

SEQ ID NO: 9253249 - DNA, 22 bp, Homo sapiens
gagagaaaggcttgcaggctgt

SEQ ID NO: 9253250 - DNA, 22 bp, Homo sapiens
gagagaaatgtgcagtttgggc

SEQ ID NO: 9253251 - DNA, 22 bp, Homo sapiens
gaggcagcttagggtactgact

SEQ ID NO: 9253252 - DNA, 22 bp, Homo sapiens
gaggcagcttggggctgtgggt

SEQ ID NO: 9253253 - DNA, 22 bp, Homo sapiens
gaggcaggaggattgcttgagc

SEQ ID NO: 9253254 - DNA, 22 bp, Homo sapiens
gaggcaggccctgaatgagtca

SEQ ID NO: 9253255 - DNA, 22 bp, Homo sapiens
gaggcaggccctgaatgagtca

SEQ ID NO: 9253256 - DNA, 22 bp, Homo sapiens
gaggcaggcagattgcttgagg

SEQ ID NO: 9253257 - DNA, 22 bp, Homo sapiens
gaggcaggcagattgcttgagg

SEQ ID NO: 9253258 - DNA, 22 bp, Homo sapiens
gaggcaggaggattgcttgagc

SEQ ID NO: 9253259 - DNA, 22 bp, Homo sapiens
gaggcaggcactgttatcagca

SEQ ID NO: 9253260 - DNA, 22 bp, Homo sapiens
gaggagcacatgaggctgaggg

SEQ ID NO: 9253261 - DNA, 22 bp, Homo sapiens
gaggagcacatgaggctgaggg

SEQ ID NO: 9253262 - DNA, 22 bp, Homo sapiens
gaggagcacatgaggctgaggg

SEQ ID NO: 9253263 - DNA, 22 bp, Homo sapiens
gaggagcatgggaaggctctgg

SEQ ID NO: 9253264 - DNA, 22 bp, Homo sapiens
gaggagcatgggaaggctctgg

SEQ ID NO: 9253265 - DNA, 22 bp, Homo sapiens
gaggagagggctgcgggcccac

SEQ ID NO: 9253266 - DNA, 22 bp, Homo sapiens
gaggagaggggctcccaagagc

SEQ ID NO: 9253267 - DNA, 22 bp, Homo sapiens
gaggagaggggctcccaagagc

SEQ ID NO: 9253268 - DNA, 22 bp, Homo sapiens
gaggctcagagggagcatggtc

SEQ ID NO: 9253269 - DNA, 22 bp, Homo sapiens
gaggctgaacaggttctcatga

SEQ ID NO: 9253270 - DNA, 22 bp, Homo sapiens
gaggctgaagtgtacatgggtg

SEQ ID NO: 9253271 - DNA, 22 bp, Homo sapiens
gaggctgagagtttgttctact

SEQ ID NO: 9253272 - DNA, 22 bp, Homo sapiens
gaggctgagagtttgttctact

SEQ ID NO: 9253273 - DNA, 22 bp, Homo sapiens
gaggctgagagtttgttctact

SEQ ID NO: 9253274 - DNA, 22 bp, Homo sapiens
gaggctgaggcaggaggatcac

SEQ ID NO: 9253275 - DNA, 22 bp, Homo sapiens
gaggctgaggcaggaggatcac

SEQ ID NO: 9253276 - DNA, 22 bp, Homo sapiens
gaggctgacggcaccatcttct

SEQ ID NO: 9253277 - DNA, 22 bp, Homo sapiens
gaggctgagactctgaattttt

SEQ ID NO: 9253278 - DNA, 22 bp, Homo sapiens
gaggctgaatggccagaagcca

SEQ ID NO: 9253279 - DNA, 22 bp, Homo sapiens
gaggctgaatggccagaagcca

SEQ ID NO: 9253280 - DNA, 22 bp, Homo sapiens
gaggctgaatggccagaagcca

SEQ ID NO: 9253281 - DNA, 22 bp, Homo sapiens
gaggctgaatggccagaagcca

SEQ ID NO: 9253282 - DNA, 20 bp, Homo sapiens
gaggctgaagtgtttttgct

SEQ ID NO: 9253283 - DNA, 22 bp, Homo sapiens
gaggctgaagtgtacatgggtg

SEQ ID NO: 9253284 - DNA, 22 bp, Homo sapiens
gaggcagtttgccatgccagga

SEQ ID NO: 9253285 - DNA, 22 bp, Homo sapiens
gaggcagtaattgtgggcaata

SEQ ID NO: 9253286 - DNA, 22 bp, Homo sapiens
gaggcagggtgttgattacaga

SEQ ID NO: 9253287 - DNA, 22 bp, Homo sapiens
gaggcagggtgttgattacaga

SEQ ID NO: 9253288 - DNA, 22 bp, Homo sapiens
gaggcagggtgttgattacaga

SEQ ID NO: 9253289 - DNA, 22 bp, Homo sapiens
gagggctgatgttgccacctca

SEQ ID NO: 9253290 - DNA, 22 bp, Homo sapiens
gagggctgcaatgagacagaga

SEQ ID NO: 9253291 - DNA, 22 bp, Homo sapiens
gagggctgcaatgagacagaga

SEQ ID NO: 9253292 - DNA, 22 bp, Homo sapiens
gagggctgcaatgagacagaga

SEQ ID NO: 9253293 - DNA, 22 bp, Homo sapiens
gagggctgctgccagatatgcc

SEQ ID NO: 9253294 - DNA, 22 bp, Homo sapiens
gagggctgctgccagatatgcc

SEQ ID NO: 9253295 - DNA, 22 bp, Homo sapiens
gagggctgctggaaaaatgcag

SEQ ID NO: 9253296 - DNA, 22 bp, Homo sapiens
gagggctgctgccagatatgcc

SEQ ID NO: 9253297 - DNA, 22 bp, Homo sapiens
gagggctgctgccagatatgcc

SEQ ID NO: 9253298 - DNA, 22 bp, Homo sapiens
gagggctgccacgttgggcgag

SEQ ID NO: 9253299 - DNA, 22 bp, Homo sapiens
gaggggctggctgtggtcccat

SEQ ID NO: 9253300 - DNA, 22 bp, Homo sapiens
gaggggctggcacgatggctgc

SEQ ID NO: 9253301 - DNA, 22 bp, Homo sapiens
gaggggaaagtgtgaggctgcg

SEQ ID NO: 9253302 - DNA, 22 bp, Homo sapiens
gaggggctctttaatagtaaca

SEQ ID NO: 9253303 - DNA, 22 bp, Homo sapiens
gaggggctgccctggtgtcagg

SEQ ID NO: 9253304 - DNA, 22 bp, Homo sapiens
gagggctgtggggcatgaccag

SEQ ID NO: 9253305 - DNA, 22 bp, Homo sapiens
gagggctgtggggcatgaccag

SEQ ID NO: 9253306 - DNA, 22 bp, Homo sapiens
gagggctgtggggcatgaccag

SEQ ID NO: 9253307 - DNA, 22 bp, Homo sapiens
gagggctgtgaaggagcgggtt

SEQ ID NO: 9253308 - DNA, 22 bp, Homo sapiens
gagggctgtgaaggagcgggtt

SEQ ID NO: 9253309 - DNA, 22 bp, Homo sapiens
gagggctggggcttaggcttag

SEQ ID NO: 9253310 - DNA, 22 bp, Homo sapiens
gagggctgctggaaaaatgcag

SEQ ID NO: 9253311 - DNA, 22 bp, Homo sapiens
gagggctgctggaaaaatgcag

SEQ ID NO: 9253312 - DNA, 22 bp, Homo sapiens
gagggctgctggaaaaatgcag

SEQ ID NO: 9253313 - DNA, 22 bp, Homo sapiens
gagggctggggcttaggcttag

SEQ ID NO: 9253314 - DNA, 22 bp, Homo sapiens
gaggctgcaggcaatgctgccc

SEQ ID NO: 9253315 - DNA, 22 bp, Homo sapiens
gaggctgcaggcaatgctgccc

SEQ ID NO: 9253316 - DNA, 22 bp, Homo sapiens
gaggctgcaggcaatgctgccc

SEQ ID NO: 9253317 - DNA, 22 bp, Homo sapiens
gaggctgagtagctttgtgctc

SEQ ID NO: 9253318 - DNA, 22 bp, Homo sapiens
gaggctgatgctgcctcacaga

SEQ ID NO: 9253319 - DNA, 22 bp, Homo sapiens
gaggctgattcggggaacagca

SEQ ID NO: 9253320 - DNA, 22 bp, Homo sapiens
gaggctgattcggggaacagca

SEQ ID NO: 9253321 - DNA, 22 bp, Homo sapiens
gaggctgcagctatcagacatt

SEQ ID NO: 9253322 - DNA, 22 bp, Homo sapiens
gaggctgaggttgcagtgagcc

SEQ ID NO: 9253323 - DNA, 22 bp, Homo sapiens
gaggctgaggttgcagtgagct

SEQ ID NO: 9253324 - DNA, 22 bp, Homo sapiens
gaggctgaggttgcagtgagcc

SEQ ID NO: 9253325 - DNA, 22 bp, Homo sapiens
gaggctgaggttgcagtgagcc

SEQ ID NO: 9253326 - DNA, 22 bp, Homo sapiens
gaggctgaggttgcagtgagct

SEQ ID NO: 9253327 - DNA, 22 bp, Homo sapiens
gaggctgaggttgcagtgagct

SEQ ID NO: 9253328 - DNA, 22 bp, Homo sapiens
gaggctgagggttagagagtca

SEQ ID NO: 9253329 - DNA, 22 bp, Homo sapiens
gaggctgagggttagagagtca

SEQ ID NO: 9253330 - DNA, 22 bp, Homo sapiens
gaggctgaggcaggaggatcac

SEQ ID NO: 9253331 - DNA, 22 bp, Homo sapiens
gaggctgaggcggatggatcac

SEQ ID NO: 9253332 - DNA, 22 bp, Homo sapiens
gaggctgaggcggatggatcac

SEQ ID NO: 9253333 - DNA, 22 bp, Homo sapiens
gagggaggggagctccaccctc

SEQ ID NO: 9253334 - DNA, 22 bp, Homo sapiens
gagggagggccaggtcccaacc

SEQ ID NO: 9253335 - DNA, 22 bp, Homo sapiens
gagggagggccaggtcccaacc

SEQ ID NO: 9253336 - DNA, 22 bp, Homo sapiens
gagggagggccaggtcccaacc

SEQ ID NO: 9253337 - DNA, 22 bp, Homo sapiens
gagggagggactagcattctct

SEQ ID NO: 9253338 - DNA, 22 bp, Homo sapiens
gagggagggactagcattctct

SEQ ID NO: 9253339 - DNA, 22 bp, Homo sapiens
gagggaggcatcatgaatccag

SEQ ID NO: 9253340 - DNA, 22 bp, Homo sapiens
gagggaggcatcatgaatccag

SEQ ID NO: 9253341 - DNA, 22 bp, Homo sapiens
gagggagctatgaatagaagaa

SEQ ID NO: 9253342 - DNA, 22 bp, Homo sapiens
gagggagagtgatggaccattg

SEQ ID NO: 9253343 - DNA, 22 bp, Homo sapiens
gagggagagtgatggaccattg

SEQ ID NO: 9253344 - DNA, 22 bp, Homo sapiens
gagggagaattgcagccagcgt

SEQ ID NO: 9253345 - DNA, 22 bp, Homo sapiens
gagggagagtgatggaccattg

SEQ ID NO: 9253346 - DNA, 22 bp, Homo sapiens
gagggagccgccacagactggg

SEQ ID NO: 9253347 - DNA, 22 bp, Homo sapiens
gagggagagtgatggaccattg

SEQ ID NO: 9253348 - DNA, 22 bp, Homo sapiens
gagcccaggaagtggaggctga

SEQ ID NO: 9253349 - DNA, 22 bp, Homo sapiens
gagcccaggagtttgatgctgc

SEQ ID NO: 9253350 - DNA, 22 bp, Homo sapiens
gagcccagcttgcacatggagc

SEQ ID NO: 9253351 - DNA, 22 bp, Homo sapiens
gagcccagctgtccttggcaaa

SEQ ID NO: 9253352 - DNA, 22 bp, Homo sapiens
gagcccagcccagagccatatg

SEQ ID NO: 9253353 - DNA, 22 bp, Homo sapiens
gagccagtgatcagacagggag

SEQ ID NO: 9253354 - DNA, 22 bp, Homo sapiens
gagcatggtgcttcagtgaagg

SEQ ID NO: 9253355 - DNA, 22 bp, Homo sapiens
gagcatggttccataggttggt

SEQ ID NO: 9253356 - DNA, 22 bp, Homo sapiens
gagcccaggttctgcttccagc

SEQ ID NO: 9253357 - DNA, 22 bp, Homo sapiens
gagcccaggttctgcttccagc

SEQ ID NO: 9253358 - DNA, 22 bp, Homo sapiens
gagccctgaacaacagcaggaa

SEQ ID NO: 9253359 - DNA, 22 bp, Homo sapiens
gagccctgaacaacagcaggaa

SEQ ID NO: 9253360 - DNA, 22 bp, Homo sapiens
gagccctgaacaacagcaggaa

SEQ ID NO: 9253361 - DNA, 22 bp, Homo sapiens
gagccctgagagttgtgaggcc

SEQ ID NO: 9253362 - DNA, 22 bp, Homo sapiens
gagccctgacactgagggagtt

SEQ ID NO: 9253363 - DNA, 22 bp, Homo sapiens
gagccctgacactgagggagtt

SEQ ID NO: 9253364 - DNA, 22 bp, Homo sapiens
gagcccaggcagaggttgcagt

SEQ ID NO: 9253365 - DNA, 22 bp, Homo sapiens
gagcccagggcaggcaaggcag

SEQ ID NO: 9253366 - DNA, 22 bp, Homo sapiens
gagcccagggtgaaatagcagc

SEQ ID NO: 9253367 - DNA, 22 bp, Homo sapiens
gagcccagggtgaaatagcagc

SEQ ID NO: 9253368 - DNA, 21 bp, Homo sapiens
gagcatggcttacatcagcag

SEQ ID NO: 9253369 - DNA, 22 bp, Homo sapiens
gagcatggatcatgtgctgggt

SEQ ID NO: 9253370 - DNA, 18 bp, Homo sapiens
gagcatgggcagtgggga

SEQ ID NO: 9253371 - DNA, 22 bp, Homo sapiens
gagcatggatagaaggtgggat

SEQ ID NO: 9253372 - DNA, 22 bp, Homo sapiens
gagcatcttgttcccaacttct

SEQ ID NO: 9253373 - DNA, 22 bp, Homo sapiens
gagcagtggttgaacagaggca

SEQ ID NO: 9253374 - DNA, 22 bp, Homo sapiens
gagcagtggttgaacagaggca

SEQ ID NO: 9253375 - DNA, 22 bp, Homo sapiens
gagcatccatgactttggcttt

SEQ ID NO: 9253376 - DNA, 22 bp, Homo sapiens
gagcatcgctgagatcccagac

SEQ ID NO: 9253377 - DNA, 22 bp, Homo sapiens
gagaggggtttgccatcctatg

SEQ ID NO: 9253378 - DNA, 22 bp, Homo sapiens
gagagggtgcctggaagccagg

SEQ ID NO: 9253379 - DNA, 22 bp, Homo sapiens
gagcaggcttgcagagaagggg

SEQ ID NO: 9253380 - DNA, 22 bp, Homo sapiens
gagaggtaatttgaagtgcaaa

SEQ ID NO: 9253381 - DNA, 22 bp, Homo sapiens
gagcagtgggaaggaacagggt

SEQ ID NO: 9253382 - DNA, 22 bp, Homo sapiens
gagcagtgggaaggaacagggt

SEQ ID NO: 9253383 - DNA, 22 bp, Homo sapiens
gagcagtgatgggaggacgtca

SEQ ID NO: 9253384 - DNA, 22 bp, Homo sapiens
gagcagtgagtgaatgttgcct

SEQ ID NO: 9253385 - DNA, 22 bp, Homo sapiens
gagcagggagacaactctggtg

SEQ ID NO: 9253386 - DNA, 22 bp, Homo sapiens
gagaggggcccaagccacatag

SEQ ID NO: 9253387 - DNA, 22 bp, Homo sapiens
gagaggggcgcgcagctcgcga

SEQ ID NO: 9253388 - DNA, 22 bp, Homo sapiens
gagaggggcgcgcagctcgcga

SEQ ID NO: 9253389 - DNA, 22 bp, Homo sapiens
gagaggggcgcgcagctcgcga

SEQ ID NO: 9253390 - DNA, 22 bp, Homo sapiens
gagaggggacctgtgtgtctag

SEQ ID NO: 9253391 - DNA, 22 bp, Homo sapiens
gagagggctgcctggtgtgagg

SEQ ID NO: 9253392 - DNA, 22 bp, Homo sapiens
gagccctgtagcaagtcatgtc

SEQ ID NO: 9253393 - DNA, 22 bp, Homo sapiens
gagccctgtagcaagtcatgtc

SEQ ID NO: 9253394 - DNA, 22 bp, Homo sapiens
gagccctgtagcaagtcatgtc

SEQ ID NO: 9253395 - DNA, 18 bp, Homo sapiens
gagccctgggagatctct

SEQ ID NO: 9253396 - DNA, 22 bp, Homo sapiens
gagccctggcagtctgggatgg

SEQ ID NO: 9253397 - DNA, 22 bp, Homo sapiens
gagccctgtgaggaaagagggt

SEQ ID NO: 9253398 - DNA, 22 bp, Homo sapiens
gagctgagatcatgtacactag

SEQ ID NO: 9253399 - DNA, 22 bp, Homo sapiens
gagctgagatcgtgccattgca

SEQ ID NO: 9253400 - DNA, 18 bp, Homo sapiens
gagccctgagtctgcaca

SEQ ID NO: 9253401 - DNA, 22 bp, Homo sapiens
gagccctggcagtctgggatgg

SEQ ID NO: 9253402 - DNA, 22 bp, Homo sapiens
gagctgagatttgaagcaagtt

SEQ ID NO: 9253403 - DNA, 22 bp, Homo sapiens
gagctgagatttgaagcaagtt

SEQ ID NO: 9253404 - DNA, 22 bp, Homo sapiens
gagctgagatttgaagcaagtt

SEQ ID NO: 9253405 - DNA, 22 bp, Homo sapiens
gagctgagcagggagcctcact

SEQ ID NO: 9253406 - DNA, 22 bp, Homo sapiens
gagctgagcctgggtggaccgc

SEQ ID NO: 9253407 - DNA, 22 bp, Homo sapiens
gagctgagcctgggtggaccgc

SEQ ID NO: 9253408 - DNA, 22 bp, Homo sapiens
gagctgagcttaactccttgaa

SEQ ID NO: 9253409 - DNA, 22 bp, Homo sapiens
gagctgagggtctaggagggtt

SEQ ID NO: 9253410 - DNA, 22 bp, Homo sapiens
gagctgaggctgaggcctcact

SEQ ID NO: 9253411 - DNA, 22 bp, Homo sapiens
gagctgaggctcaggctggcgt

SEQ ID NO: 9253412 - DNA, 22 bp, Homo sapiens
gagctgaggctcaggctggcgt

SEQ ID NO: 9253413 - DNA, 22 bp, Homo sapiens
gagctgcctgtgtgccatgatg

SEQ ID NO: 9253414 - DNA, 22 bp, Homo sapiens
gagctgcctgaacaagcagcag

SEQ ID NO: 9253415 - DNA, 22 bp, Homo sapiens
gagctgagtatgaaggatgtga

SEQ ID NO: 9253416 - DNA, 22 bp, Homo sapiens
gagctgccggcccacagtacta

SEQ ID NO: 9253417 - DNA, 22 bp, Homo sapiens
gagctgcctacattgccaagag

SEQ ID NO: 9253418 - DNA, 22 bp, Homo sapiens
gagctgagtatcccactgaagt

SEQ ID NO: 9253419 - DNA, 22 bp, Homo sapiens
gagctgagtatcccactgaagt

SEQ ID NO: 9253420 - DNA, 22 bp, Homo sapiens
gagctgagtagaggctgctccc

SEQ ID NO: 9253421 - DNA, 22 bp, Homo sapiens
gagctgaggtgatgtggtcgtt

SEQ ID NO: 9253422 - DNA, 22 bp, Homo sapiens
gagctgagggtctaggagggtt

SEQ ID NO: 9253423 - DNA, 22 bp, Homo sapiens
gagctgagggtctaggagggtt

SEQ ID NO: 9253424 - DNA, 22 bp, Homo sapiens
gagctgagggtctaggagggtt

SEQ ID NO: 9253425 - DNA, 22 bp, Homo sapiens
gagctgagggtctaggagggtt

SEQ ID NO: 9253426 - DNA, 22 bp, Homo sapiens
gaggaagaaagcataggtgggg

SEQ ID NO: 9253427 - DNA, 22 bp, Homo sapiens
gaggaacttatgatattctact

SEQ ID NO: 9253428 - DNA, 19 bp, Homo sapiens
gaggaactggcttggttcc

SEQ ID NO: 9253429 - DNA, 18 bp, Homo sapiens
gaggaacattcacctcct

SEQ ID NO: 9253430 - DNA, 22 bp, Homo sapiens
gaggaacagcagccacatgtcc

SEQ ID NO: 9253431 - DNA, 22 bp, Homo sapiens
gaggaagaagggattagaactc

SEQ ID NO: 9253432 - DNA, 22 bp, Homo sapiens
gaggaagaagcaaaccagctaa

SEQ ID NO: 9253433 - DNA, 22 bp, Homo sapiens
gaggagagagggactgtctgca

SEQ ID NO: 9253434 - DNA, 22 bp, Homo sapiens
gagctgcctgttgcatagcaac

SEQ ID NO: 9253435 - DNA, 22 bp, Homo sapiens
gagctgcctgtgtgccatgatg

SEQ ID NO: 9253436 - DNA, 19 bp, Homo sapiens
gagctgccttttgaagacc

SEQ ID NO: 9253437 - DNA, 19 bp, Homo sapiens
gagctgccttttgaagacc

SEQ ID NO: 9253438 - DNA, 22 bp, Homo sapiens
gaggaaaatgggacaggctgta

SEQ ID NO: 9253439 - DNA, 22 bp, Homo sapiens
gaggaaaatgcaacaggaatgc

SEQ ID NO: 9253440 - DNA, 22 bp, Homo sapiens
gaggaaagagtcaaatctgaag

SEQ ID NO: 9253441 - DNA, 22 bp, Homo sapiens
gaggaaaatgggacaggctgta

SEQ ID NO: 9253442 - DNA, 18 bp, Homo sapiens
gaggaaacaaggcagagg

SEQ ID NO: 9253443 - DNA, 18 bp, Homo sapiens
gaggaaacaggctctgtg

SEQ ID NO: 9253444 - DNA, 22 bp, Homo sapiens
gaggaaacattgtagaagcagt

SEQ ID NO: 9253445 - DNA, 23 bp, Homo sapiens
gaggaaagaatatagatgcaatc

SEQ ID NO: 9253446 - DNA, 22 bp, Homo sapiens
ctgggccttgcatcccagagcc

SEQ ID NO: 9253447 - DNA, 22 bp, Homo sapiens
ctgggccttgcatcccagagcc

SEQ ID NO: 9253448 - DNA, 22 bp, Homo sapiens
ctgggccttatgagtacctgga

SEQ ID NO: 9253449 - DNA, 22 bp, Homo sapiens
ctgggcctccagctctgccagc

SEQ ID NO: 9253450 - DNA, 22 bp, Homo sapiens
ctgggctacgtgttgacagcat

SEQ ID NO: 9253451 - DNA, 22 bp, Homo sapiens
ctgggctaattaagcacagctg

SEQ ID NO: 9253452 - DNA, 22 bp, Homo sapiens
ctgggctacgtgttgacagcat

SEQ ID NO: 9253453 - DNA, 22 bp, Homo sapiens
ctgggctaattaagcacagctg

SEQ ID NO: 9253454 - DNA, 22 bp, Homo sapiens
ctgggccttggattgacactgt

SEQ ID NO: 9253455 - DNA, 22 bp, Homo sapiens
ctgggcctttgcttattaattt

SEQ ID NO: 9253456 - DNA, 22 bp, Homo sapiens
ctgggctagaaggaccaggatg

SEQ ID NO: 9253457 - DNA, 22 bp, Homo sapiens
ctgggctcaaatcctatctcca

SEQ ID NO: 9253458 - DNA, 22 bp, Homo sapiens
ctgggctcaaatcctatctcca

SEQ ID NO: 9253459 - DNA, 22 bp, Homo sapiens
ctgggctggagtgcaatggcgc

SEQ ID NO: 9253460 - DNA, 22 bp, Homo sapiens
ctgggctggagtgcaatggcgc

SEQ ID NO: 9253461 - DNA, 22 bp, Homo sapiens
ctgggcttaggacctggtgcgg

SEQ ID NO: 9253462 - DNA, 22 bp, Homo sapiens
ctgggcttagcagctcctggtc

SEQ ID NO: 9253463 - DNA, 22 bp, Homo sapiens
ctgggctggcgcatccgacacg

SEQ ID NO: 9253464 - DNA, 22 bp, Homo sapiens
ctgggcagcctcacacaatgtt

SEQ ID NO: 9253465 - DNA, 22 bp, Homo sapiens
ctgggcagcctcacacaatgtt

SEQ ID NO: 9253466 - DNA, 22 bp, Homo sapiens
ctgggcagctaccaccactgct

SEQ ID NO: 9253467 - DNA, 22 bp, Homo sapiens
ctgggcagctaccaccactgct

SEQ ID NO: 9253468 - DNA, 22 bp, Homo sapiens
ctgggcagctccataccaccca

SEQ ID NO: 9253469 - DNA, 22 bp, Homo sapiens
ctgggcagctgtatcagggagt

SEQ ID NO: 9253470 - DNA, 22 bp, Homo sapiens
ctgggcagctgtatcagggagt

SEQ ID NO: 9253471 - DNA, 22 bp, Homo sapiens
ctgggcagctgtgcaaacaata

SEQ ID NO: 9253472 - DNA, 22 bp, Homo sapiens
ctgggcagctgtgcaaacaata

SEQ ID NO: 9253473 - DNA, 22 bp, Homo sapiens
ctgggcagctgtgcaaacaata

SEQ ID NO: 9253474 - DNA, 22 bp, Homo sapiens
ctgggcagctgtatcagggagt

SEQ ID NO: 9253475 - DNA, 22 bp, Homo sapiens
ctgggcagctgtatcagggagt

SEQ ID NO: 9253476 - DNA, 22 bp, Homo sapiens
ctgggcagaattttaggatggc

SEQ ID NO: 9253477 - DNA, 22 bp, Homo sapiens
ctgggcagaattttaggatggc

SEQ ID NO: 9253478 - DNA, 22 bp, Homo sapiens
ctgggcactttggggagcctac

SEQ ID NO: 9253479 - DNA, 22 bp, Homo sapiens
ctgggcagaattttaggatggc

SEQ ID NO: 9253480 - DNA, 22 bp, Homo sapiens
ctgggcactttggggagcctac

SEQ ID NO: 9253481 - DNA, 22 bp, Homo sapiens
ctgggcagagtccggaagatgg

SEQ ID NO: 9253482 - DNA, 22 bp, Homo sapiens
ctgggcagagtccggaagatgg

SEQ ID NO: 9253483 - DNA, 22 bp, Homo sapiens
ctgggcagagtccggaagatgg

SEQ ID NO: 9253484 - DNA, 22 bp, Homo sapiens
ctgggcagagtccggaagatgg

SEQ ID NO: 9253485 - DNA, 22 bp, Homo sapiens
ctgggcagagctaacacctgag

SEQ ID NO: 9253486 - DNA, 22 bp, Homo sapiens
ctgggcacctttgcagcaggct

SEQ ID NO: 9253487 - DNA, 22 bp, Homo sapiens
ctgggcactgcagcaggcatca

SEQ ID NO: 9253488 - DNA, 22 bp, Homo sapiens
ctgggcacttgctcacagctct

SEQ ID NO: 9253489 - DNA, 22 bp, Homo sapiens
ctgggcacttgctcacagctct

SEQ ID NO: 9253490 - DNA, 17 bp, Homo sapiens
ctgggatgtggactctt

SEQ ID NO: 9253491 - DNA, 22 bp, Homo sapiens
ctgggcaatatgctgggcctgg

SEQ ID NO: 9253492 - DNA, 17 bp, Homo sapiens
ctgggatgtggactctt

SEQ ID NO: 9253493 - DNA, 22 bp, Homo sapiens
ctgggagcggctgtcactggtt

SEQ ID NO: 9253494 - DNA, 22 bp, Homo sapiens
ctgggagcgcagcaggcacaac

SEQ ID NO: 9253495 - DNA, 22 bp, Homo sapiens
ctgggagcgcagcaggcacaac

SEQ ID NO: 9253496 - DNA, 22 bp, Homo sapiens
ctgggagcccgcgtcctggtgg

SEQ ID NO: 9253497 - DNA, 22 bp, Homo sapiens
ctgggagattgctagagatgca

SEQ ID NO: 9253498 - DNA, 22 bp, Homo sapiens
ctgggagattgctagagatgca

SEQ ID NO: 9253499 - DNA, 22 bp, Homo sapiens
ctgggagattgctagagatgca

SEQ ID NO: 9253500 - DNA, 22 bp, Homo sapiens
ctgggacagagcagcagtgggg

SEQ ID NO: 9253501 - DNA, 22 bp, Homo sapiens
ctgggacacccaaggaaagagc

SEQ ID NO: 9253502 - DNA, 22 bp, Homo sapiens
ctgggaagaatccaagggccct

SEQ ID NO: 9253503 - DNA, 22 bp, Homo sapiens
ctgggacacccaaggaaagagc

SEQ ID NO: 9253504 - DNA, 19 bp, Homo sapiens
ctgcttcaggcgccttgcc

SEQ ID NO: 9253505 - DNA, 22 bp, Homo sapiens
ctgcttcatatttcatagtgat

SEQ ID NO: 9253506 - DNA, 22 bp, Homo sapiens
ctgcttcacttcggttgcatag

SEQ ID NO: 9253507 - DNA, 22 bp, Homo sapiens
ctgcttcacgttgtgccttgtt

SEQ ID NO: 9253508 - DNA, 22 bp, Homo sapiens
ctgcttcaccctgcctgagaac

SEQ ID NO: 9253509 - DNA, 22 bp, Homo sapiens
ctgcttccatgcaatggcagtc

SEQ ID NO: 9253510 - DNA, 22 bp, Homo sapiens
ctgcttccataaataatgtgct

SEQ ID NO: 9253511 - DNA, 20 bp, Homo sapiens
ctgctgtgtgtgcctcagcc

SEQ ID NO: 9253512 - DNA, 20 bp, Homo sapiens
ctgctgtgtgtgcctcagcc

SEQ ID NO: 9253513 - DNA, 23 bp, Homo sapiens
ctgctgtgttggtctcgatggga

SEQ ID NO: 9253514 - DNA, 22 bp, Homo sapiens
ctgcttcacccaactttgggat

SEQ ID NO: 9253515 - DNA, 22 bp, Homo sapiens
ctgcttatggagatgagtaaga

SEQ ID NO: 9253516 - DNA, 22 bp, Homo sapiens
ctgctgtttggtgagtgagaaa

SEQ ID NO: 9253517 - DNA, 20 bp, Homo sapiens
ctgcttaagtaagtgacaca

SEQ ID NO: 9253518 - DNA, 22 bp, Homo sapiens
ctgcttaaaatgcagattctgt

SEQ ID NO: 9253519 - DNA, 20 bp, Homo sapiens
ctgcttaagtaagtgacaca

SEQ ID NO: 9253520 - DNA, 22 bp, Homo sapiens
ctgggacagctgagacaggaga

SEQ ID NO: 9253521 - DNA, 22 bp, Homo sapiens
ctgggacagctgagacaggaga

SEQ ID NO: 9253522 - DNA, 22 bp, Homo sapiens
ctgggacagctgagacaggaga

SEQ ID NO: 9253523 - DNA, 22 bp, Homo sapiens
ctgggacagctgagacaggaga

SEQ ID NO: 9253524 - DNA, 22 bp, Homo sapiens
ctgggacagctgagacaggaga

SEQ ID NO: 9253525 - DNA, 22 bp, Homo sapiens
ctgggacatattgctagtgttg

SEQ ID NO: 9253526 - DNA, 22 bp, Homo sapiens
ctgggacatgatagaaacagat

SEQ ID NO: 9253527 - DNA, 18 bp, Homo sapiens
ctgggactcaatgctact

SEQ ID NO: 9253528 - DNA, 18 bp, Homo sapiens
ctgggactcaatgctact

SEQ ID NO: 9253529 - DNA, 19 bp, Homo sapiens
ctgggactcctgatacctt

SEQ ID NO: 9253530 - DNA, 22 bp, Homo sapiens
ctgggactcagaccagttctgt

SEQ ID NO: 9253531 - DNA, 22 bp, Homo sapiens
ctgggactcagaccagttctgt

SEQ ID NO: 9253532 - DNA, 22 bp, Homo sapiens
ctgggactgccattcacagcca

SEQ ID NO: 9253533 - DNA, 22 bp, Homo sapiens
ctgggactggacctctgcctgg

SEQ ID NO: 9253534 - DNA, 19 bp, Homo sapiens
ctgggactcctgatacctt

SEQ ID NO: 9253535 - DNA, 19 bp, Homo sapiens
ctgggactcctgatacctt

SEQ ID NO: 9253536 - DNA, 19 bp, Homo sapiens
ctgggactcctgatacctt

SEQ ID NO: 9253537 - DNA, 22 bp, Homo sapiens
ctgggactgccattcacagcca

SEQ ID NO: 9253538 - DNA, 22 bp, Homo sapiens
ctgggactgccattcacagcca

SEQ ID NO: 9253539 - DNA, 22 bp, Homo sapiens
ctgggacttgtagtctcggcgc

SEQ ID NO: 9253540 - DNA, 22 bp, Homo sapiens
ctgggacttgcagagcaggagg

SEQ ID NO: 9253541 - DNA, 22 bp, Homo sapiens
ctgggacttgggctatgctctg

SEQ ID NO: 9253542 - DNA, 22 bp, Homo sapiens
ctgggactggacctctgcctgg

SEQ ID NO: 9253543 - DNA, 22 bp, Homo sapiens
ctgggactgggtcctcaggaca

SEQ ID NO: 9253544 - DNA, 22 bp, Homo sapiens
ctgggactgggtcctcaggaca

SEQ ID NO: 9253545 - DNA, 22 bp, Homo sapiens
ctgggacttgatgaaatgactg

SEQ ID NO: 9253546 - DNA, 22 bp, Homo sapiens
ctgggacttgcagagcaggagg

SEQ ID NO: 9253547 - DNA, 22 bp, Homo sapiens
ctgggacttgcagagcaggagg

SEQ ID NO: 9253548 - DNA, 22 bp, Homo sapiens
ctgggagaggtggtgggaagta

SEQ ID NO: 9253549 - DNA, 22 bp, Homo sapiens
ctgggagaggtggtgggaagta

SEQ ID NO: 9253550 - DNA, 22 bp, Homo sapiens
ctgggagaggtggtgggaagta

SEQ ID NO: 9253551 - DNA, 22 bp, Homo sapiens
ctgggagattcaggtgaagttt

SEQ ID NO: 9253552 - DNA, 22 bp, Homo sapiens
ctgggagattgaggccatggtg

SEQ ID NO: 9253553 - DNA, 22 bp, Homo sapiens
ctgggagattgaggccatggtg

SEQ ID NO: 9253554 - DNA, 22 bp, Homo sapiens
ctgggagattgctagagatgca

SEQ ID NO: 9253555 - DNA, 22 bp, Homo sapiens
ctgggagatctgttgggactgg

SEQ ID NO: 9253556 - DNA, 22 bp, Homo sapiens
ctgggagatctcctgagggcag

SEQ ID NO: 9253557 - DNA, 22 bp, Homo sapiens
ctgggagatctcctgagggcag

SEQ ID NO: 9253558 - DNA, 22 bp, Homo sapiens
ctgggagatctcctgagggcag

SEQ ID NO: 9253559 - DNA, 22 bp, Homo sapiens
ctgggagatgactcagagcagg

SEQ ID NO: 9253560 - DNA, 22 bp, Homo sapiens
ctgggagatgactcagagcagg

SEQ ID NO: 9253561 - DNA, 22 bp, Homo sapiens
ctgggagatctgttgggactgg

SEQ ID NO: 9253562 - DNA, 23 bp, Homo sapiens
ctggtcagaggctgctggaaggg

SEQ ID NO: 9253563 - DNA, 22 bp, Homo sapiens
ctggtccttgctacccagcaag

SEQ ID NO: 9253564 - DNA, 18 bp, Homo sapiens
ctggtctcccttcgcttt

SEQ ID NO: 9253565 - DNA, 18 bp, Homo sapiens
ctggtctcccttcgcttt

SEQ ID NO: 9253566 - DNA, 22 bp, Homo sapiens
ctggtcactggtctcatccagc

SEQ ID NO: 9253567 - DNA, 20 bp, Homo sapiens
ctggggagcctcgcggtggc

SEQ ID NO: 9253568 - DNA, 22 bp, Homo sapiens
ctggtctgggatgagggatgta

SEQ ID NO: 9253569 - DNA, 22 bp, Homo sapiens
ctggtgaatattggaggcattg

SEQ ID NO: 9253570 - DNA, 22 bp, Homo sapiens
ctggggagaagcgactcggctg

SEQ ID NO: 9253571 - DNA, 22 bp, Homo sapiens
ctggggagaagcgactcggctg

SEQ ID NO: 9253572 - DNA, 22 bp, Homo sapiens
ctggggagacgatcgatgttct

SEQ ID NO: 9253573 - DNA, 22 bp, Homo sapiens
ctggggagacgatcgatgttct

SEQ ID NO: 9253574 - DNA, 22 bp, Homo sapiens
ctgggcttctccccctggcaga

SEQ ID NO: 9253575 - DNA, 22 bp, Homo sapiens
ctgggcttgagttcctgctcgt

SEQ ID NO: 9253576 - DNA, 22 bp, Homo sapiens
ctgggctttcaggccctaaggc

SEQ ID NO: 9253577 - DNA, 22 bp, Homo sapiens
ctggggaacgcagcgagcagcg

SEQ ID NO: 9253578 - DNA, 22 bp, Homo sapiens
ctgggctttggtactgtgatta

SEQ ID NO: 9253579 - DNA, 22 bp, Homo sapiens
ctgtaaaacactgtagtatctg

SEQ ID NO: 9253580 - DNA, 22 bp, Homo sapiens
ctggtgccattctgtggcctag

SEQ ID NO: 9253581 - DNA, 22 bp, Homo sapiens
ctggtgccattctgtggcctag

SEQ ID NO: 9253582 - DNA, 22 bp, Homo sapiens
ctgtacaaagtagctgctggga

SEQ ID NO: 9253583 - DNA, 22 bp, Homo sapiens
ctgtacaaagtagctgctggga

SEQ ID NO: 9253584 - DNA, 22 bp, Homo sapiens
ctggtgagactcagggatgctt

SEQ ID NO: 9253585 - DNA, 22 bp, Homo sapiens
ctggtgaccttgccccaggtca

SEQ ID NO: 9253586 - DNA, 22 bp, Homo sapiens
ctggtgcaagattccctgcttc

SEQ ID NO: 9253587 - DNA, 22 bp, Homo sapiens
ctggtgcaaggctttggaatcc

SEQ ID NO: 9253588 - DNA, 22 bp, Homo sapiens
ctggtgcacatgaaagagaagg

SEQ ID NO: 9253589 - DNA, 22 bp, Homo sapiens
ctggtgcaaaagtaattgtggt

SEQ ID NO: 9253590 - DNA, 22 bp, Homo sapiens
ctggtgcaggaaggagctggca

SEQ ID NO: 9253591 - DNA, 22 bp, Homo sapiens
ctggtgcactacagcctggaac

SEQ ID NO: 9253592 - DNA, 22 bp, Homo sapiens
ctggtgcacgtggctgcagtcg

SEQ ID NO: 9253593 - DNA, 22 bp, Homo sapiens
ctggtgcacattcgctctcata

SEQ ID NO: 9253594 - DNA, 22 bp, Homo sapiens
ctggtgcacgtggctgcagtcg

SEQ ID NO: 9253595 - DNA, 22 bp, Homo sapiens
ctggtgcatgtggccttgctct

SEQ ID NO: 9253596 - DNA, 22 bp, Homo sapiens
ctggtgcaggaaggagctggca

SEQ ID NO: 9253597 - DNA, 22 bp, Homo sapiens
ctggtgcaggaaggagctggca

SEQ ID NO: 9253598 - DNA, 22 bp, Homo sapiens
ctggtgcaggaaggagctggca

SEQ ID NO: 9253599 - DNA, 23 bp, Homo sapiens
ctgtagctaaaagctgggatttg

SEQ ID NO: 9253600 - DNA, 22 bp, Homo sapiens
ctgtagccagtttggcctcacc

SEQ ID NO: 9253601 - DNA, 22 bp, Homo sapiens
ctgtagccagaagcagaaggcc

SEQ ID NO: 9253602 - DNA, 22 bp, Homo sapiens
ctgtagcaagttattcaataaa

SEQ ID NO: 9253603 - DNA, 22 bp, Homo sapiens
ctgtagagaaagcatggaagct

SEQ ID NO: 9253604 - DNA, 22 bp, Homo sapiens
ctgtacatcccgagagccagta

SEQ ID NO: 9253605 - DNA, 22 bp, Homo sapiens
ctgtacaggtcaatgataagat

SEQ ID NO: 9253606 - DNA, 22 bp, Homo sapiens
ctgtacaatgttacctatttat

SEQ ID NO: 9253607 - DNA, 22 bp, Homo sapiens
ctgtacaagtccttcatcaggg

SEQ ID NO: 9253608 - DNA, 22 bp, Homo sapiens
ctgtacagaagctagagcaaat

SEQ ID NO: 9253609 - DNA, 22 bp, Homo sapiens
ctgtattttcatgcctacgtac

SEQ ID NO: 9253610 - DNA, 22 bp, Homo sapiens
ctgtcaatgacagttatttggg

SEQ ID NO: 9253611 - DNA, 22 bp, Homo sapiens
ctgtcacactgatatcaggctt

SEQ ID NO: 9253612 - DNA, 22 bp, Homo sapiens
ctgtcacactgatatcaggctt

SEQ ID NO: 9253613 - DNA, 22 bp, Homo sapiens
ctgtataaacatattttcaagt

SEQ ID NO: 9253614 - DNA, 22 bp, Homo sapiens
ctgtataaacatattttcaagt

SEQ ID NO: 9253615 - DNA, 22 bp, Homo sapiens
ctgtataacatcttttgtttcc

SEQ ID NO: 9253616 - DNA, 22 bp, Homo sapiens
ctgtataaccccatgcgactgt

SEQ ID NO: 9253617 - DNA, 22 bp, Homo sapiens
ctgtataagataccacactgaa

SEQ ID NO: 9253618 - DNA, 20 bp, Homo sapiens
ctgtagggtgcagcaggctc

SEQ ID NO: 9253619 - DNA, 22 bp, Homo sapiens
ctgtataattcatgctcttatt

SEQ ID NO: 9253620 - DNA, 22 bp, Homo sapiens
ctgtatatggcttactttatat

SEQ ID NO: 9253621 - DNA, 22 bp, Homo sapiens
ctgtcagcttctcctggccaga

SEQ ID NO: 9253622 - DNA, 19 bp, Homo sapiens
ctgtcaggggctggatgtt

SEQ ID NO: 9253623 - DNA, 22 bp, Homo sapiens
ctgtcagcactctactacagat

SEQ ID NO: 9253624 - DNA, 22 bp, Homo sapiens
ctgtcacctgttcactgcagca

SEQ ID NO: 9253625 - DNA, 22 bp, Homo sapiens
ctgtctctgttgcctgtaggtg

SEQ ID NO: 9253626 - DNA, 22 bp, Homo sapiens
ctgtctgccaataatctatggc

SEQ ID NO: 9253627 - DNA, 22 bp, Homo sapiens
ctgtctgccaataatctatggc

SEQ ID NO: 9253628 - DNA, 19 bp, Homo sapiens
ctgtccttggctgcactgt

SEQ ID NO: 9253629 - DNA, 22 bp, Homo sapiens
ctgtcctgtggacctgaggacg

SEQ ID NO: 9253630 - DNA, 22 bp, Homo sapiens
ctgtcctgtggacctgaggacg

SEQ ID NO: 9253631 - DNA, 22 bp, Homo sapiens
ctgtcctgtggtgacaggtaca

SEQ ID NO: 9253632 - DNA, 22 bp, Homo sapiens
ctgtctgtgcctcttctcccag

SEQ ID NO: 9253633 - DNA, 22 bp, Homo sapiens
ctgtgccctggccaggcctctc

SEQ ID NO: 9253634 - DNA, 17 bp, Homo sapiens
ctgtgctcgagtgatgg

SEQ ID NO: 9253635 - DNA, 22 bp, Homo sapiens
ctgtgccctgtggctggcacct

SEQ ID NO: 9253636 - DNA, 22 bp, Homo sapiens
ctgtgccctgtggctggcacct

SEQ ID NO: 9253637 - DNA, 22 bp, Homo sapiens
ctgtgccctggccaggcctctc

SEQ ID NO: 9253638 - DNA, 22 bp, Homo sapiens
ctgtgctgattcagcacaggcc

SEQ ID NO: 9253639 - DNA, 22 bp, Homo sapiens
ctgtgctgagtgatgtgactta

SEQ ID NO: 9253640 - DNA, 22 bp, Homo sapiens
ctgtgctctggcatcgctgcaa

SEQ ID NO: 9253641 - DNA, 22 bp, Homo sapiens
ctgtgctggagatgggccagag

SEQ ID NO: 9253642 - DNA, 22 bp, Homo sapiens
ctgtgctgcagacgcagtagct

SEQ ID NO: 9253643 - DNA, 22 bp, Homo sapiens
ctgtgctggagatgggccagag

SEQ ID NO: 9253644 - DNA, 22 bp, Homo sapiens
ctgtctgctagaacatctatac

SEQ ID NO: 9253645 - DNA, 22 bp, Homo sapiens
ctgtctgctagaacatctatac

SEQ ID NO: 9253646 - DNA, 22 bp, Homo sapiens
ctgtctgctatgcttgttgtca

SEQ ID NO: 9253647 - DNA, 22 bp, Homo sapiens
ctgtctgggtctacatcctctg

SEQ ID NO: 9253648 - DNA, 22 bp, Homo sapiens
ctgtctggatataccttggcca

SEQ ID NO: 9253649 - DNA, 22 bp, Homo sapiens
ctgtctggccggcccagcttcc

SEQ ID NO: 9253650 - DNA, 22 bp, Homo sapiens
ctgtctggtgtccctgtctaca

SEQ ID NO: 9253651 - DNA, 22 bp, Homo sapiens
ctgtctgtactgagagttctgt

SEQ ID NO: 9253652 - DNA, 22 bp, Homo sapiens
cttctcaaactgagactgtcta

SEQ ID NO: 9253653 - DNA, 22 bp, Homo sapiens
cttctattcactggtcacagtt

SEQ ID NO: 9253654 - DNA, 22 bp, Homo sapiens
cttctcagaggccagaagctat

SEQ ID NO: 9253655 - DNA, 23 bp, Homo sapiens
cttctcagaagtctgtgccagga

SEQ ID NO: 9253656 - DNA, 22 bp, Homo sapiens
cttctcagcattttgtcagtct

SEQ ID NO: 9253657 - DNA, 23 bp, Homo sapiens
cttctcagtagtacacacactat

SEQ ID NO: 9253658 - DNA, 22 bp, Homo sapiens
cttctacacatccctcttgctt

SEQ ID NO: 9253659 - DNA, 22 bp, Homo sapiens
cttctacacatccctcttgctt

SEQ ID NO: 9253660 - DNA, 22 bp, Homo sapiens
cttctaattcttatgtaagctt

SEQ ID NO: 9253661 - DNA, 22 bp, Homo sapiens
cttctaggcttctcagggggca

SEQ ID NO: 9253662 - DNA, 22 bp, Homo sapiens
cttccttccacaccttcagaat

SEQ ID NO: 9253663 - DNA, 22 bp, Homo sapiens
cttcctgttgtcacagtctgcg

SEQ ID NO: 9253664 - DNA, 22 bp, Homo sapiens
cttccttcaatataatttttac

SEQ ID NO: 9253665 - DNA, 22 bp, Homo sapiens
cttccttcaatataatttttac

SEQ ID NO: 9253666 - DNA, 22 bp, Homo sapiens
cttccaagttgctctgctgacc

SEQ ID NO: 9253667 - DNA, 22 bp, Homo sapiens
cttccaagatgaacagcaagcg

SEQ ID NO: 9253668 - DNA, 20 bp, Homo sapiens
cttccaccagggccgctgat

SEQ ID NO: 9253669 - DNA, 22 bp, Homo sapiens
cttcatttccatccaactggga

SEQ ID NO: 9253670 - DNA, 22 bp, Homo sapiens
cttcatttggcaggctggcctc

SEQ ID NO: 9253671 - DNA, 22 bp, Homo sapiens
cttcatttggagaactgtgctt

SEQ ID NO: 9253672 - DNA, 22 bp, Homo sapiens
cttcatttcaggctgaagaata

SEQ ID NO: 9253673 - DNA, 22 bp, Homo sapiens
cttcatttcaggctgaagaata

SEQ ID NO: 9253674 - DNA, 22 bp, Homo sapiens
cttcatttcaggctgaagaata

SEQ ID NO: 9253675 - DNA, 22 bp, Homo sapiens
cttcattaatgtctataagttt

SEQ ID NO: 9253676 - DNA, 22 bp, Homo sapiens
cttcatttcaggctgaagaata

SEQ ID NO: 9253677 - DNA, 19 bp, Homo sapiens
cttcattcttcagcttttg

SEQ ID NO: 9253678 - DNA, 22 bp, Homo sapiens
cttatatttgtcaactttacaa

SEQ ID NO: 9253679 - DNA, 22 bp, Homo sapiens
cttcagtgttgccagggcctag

SEQ ID NO: 9253680 - DNA, 22 bp, Homo sapiens
cttatagtatgatgttgagaat

SEQ ID NO: 9253681 - DNA, 22 bp, Homo sapiens
cttatactgaaaaattatttgt

SEQ ID NO: 9253682 - DNA, 22 bp, Homo sapiens
cttaggatgagtttttgcgttt

SEQ ID NO: 9253683 - DNA, 22 bp, Homo sapiens
cttaggatttaatttcagactc

SEQ ID NO: 9253684 - DNA, 22 bp, Homo sapiens
cttagtgaggaatgaatttgtt

SEQ ID NO: 9253685 - DNA, 22 bp, Homo sapiens
cttagtgacatgtattcttcat

SEQ ID NO: 9253686 - DNA, 22 bp, Homo sapiens
cttagtttaggtaaacccagca

SEQ ID NO: 9253687 - DNA, 22 bp, Homo sapiens
cttagtttttgccctggagttt

SEQ ID NO: 9253688 - DNA, 22 bp, Homo sapiens
cttataaagtccatctgaacaa

SEQ ID NO: 9253689 - DNA, 22 bp, Homo sapiens
cttataaagtccatctgaacaa

SEQ ID NO: 9253690 - DNA, 22 bp, Homo sapiens
cttataaagtccatctgaacaa

SEQ ID NO: 9253691 - DNA, 22 bp, Homo sapiens
cttagctttgtcctaggtctct

SEQ ID NO: 9253692 - DNA, 22 bp, Homo sapiens
cttagctttaaaagtgagatct

SEQ ID NO: 9253693 - DNA, 22 bp, Homo sapiens
cttagcttctctgcatctgtgt

SEQ ID NO: 9253694 - DNA, 22 bp, Homo sapiens
cttagcttctctgcatctgtgt

SEQ ID NO: 9253695 - DNA, 22 bp, Homo sapiens
cttagcttcactgggtctcagt

SEQ ID NO: 9253696 - DNA, 22 bp, Homo sapiens
cttagcttcattattggtggcc

SEQ ID NO: 9253697 - DNA, 20 bp, Homo sapiens
cttagcttctaaggttctgg

SEQ ID NO: 9253698 - DNA, 22 bp, Homo sapiens
cttagcatgcagtgttctgccc

SEQ ID NO: 9253699 - DNA, 22 bp, Homo sapiens
cttagcagataaaaaccttcag

SEQ ID NO: 9253700 - DNA, 22 bp, Homo sapiens
cttagccagctaacttaagcac

SEQ ID NO: 9253701 - DNA, 22 bp, Homo sapiens
cttagcatgtggtgtccttgta

SEQ ID NO: 9253702 - DNA, 20 bp, Homo sapiens
cttagctagtaagaagctgt

SEQ ID NO: 9253703 - DNA, 22 bp, Homo sapiens
cttaggaatgtcccttcccaca

SEQ ID NO: 9253704 - DNA, 22 bp, Homo sapiens
cttagcttttccagcttctaga

SEQ ID NO: 9253705 - DNA, 22 bp, Homo sapiens
cttagctttgtttaacacaggg

SEQ ID NO: 9253706 - DNA, 22 bp, Homo sapiens
cttagctttgtcctaggtctct

SEQ ID NO: 9253707 - DNA, 22 bp, Homo sapiens
cttaggaaagtttctgcttatg

SEQ ID NO: 9253708 - DNA, 22 bp, Homo sapiens
cttaggaaagttggctgatttc

SEQ ID NO: 9253709 - DNA, 22 bp, Homo sapiens
cttaggaacacttactggtact

SEQ ID NO: 9253710 - DNA, 22 bp, Homo sapiens
cttaggaaatatatactaaact

SEQ ID NO: 9253711 - DNA, 22 bp, Homo sapiens
ctgtttttcagaaggtaaggga

SEQ ID NO: 9253712 - DNA, 22 bp, Homo sapiens
ctgtttttgtgctgtgtctccc

SEQ ID NO: 9253713 - DNA, 22 bp, Homo sapiens
cttaaaatctggcagttagcta

SEQ ID NO: 9253714 - DNA, 22 bp, Homo sapiens
cttaaaagttgcttccctaact

SEQ ID NO: 9253715 - DNA, 22 bp, Homo sapiens
cttaaaatctggcagttagcta

SEQ ID NO: 9253716 - DNA, 18 bp, Homo sapiens
cttaaactgtccccagta

SEQ ID NO: 9253717 - DNA, 22 bp, Homo sapiens
cttaaactgaaagctacaagat

SEQ ID NO: 9253718 - DNA, 18 bp, Homo sapiens
cttaaactgtccccagta

SEQ ID NO: 9253719 - DNA, 22 bp, Homo sapiens
cttaaactgggcattcagagaa

SEQ ID NO: 9253720 - DNA, 22 bp, Homo sapiens
cttaaactgaaagctacaagat

SEQ ID NO: 9253721 - DNA, 22 bp, Homo sapiens
cttaaaatctggcagttagcta

SEQ ID NO: 9253722 - DNA, 20 bp, Homo sapiens
cttaaacacagagatagatt

SEQ ID NO: 9253723 - DNA, 21 bp, Homo sapiens
ctgtttgcaagcctatgtgtc

SEQ ID NO: 9253724 - DNA, 22 bp, Homo sapiens
ctgtttgtccaacttgtcccga

SEQ ID NO: 9253725 - DNA, 22 bp, Homo sapiens
ctgttttaatggagactgatgt

SEQ ID NO: 9253726 - DNA, 22 bp, Homo sapiens
ctgttttatctcaagagttcaa

SEQ ID NO: 9253727 - DNA, 22 bp, Homo sapiens
ctgttttatctcaagagttcaa

SEQ ID NO: 9253728 - DNA, 22 bp, Homo sapiens
ctgttttctagggctgaggtga

SEQ ID NO: 9253729 - DNA, 22 bp, Homo sapiens
ctgttttctacagtctgggtct

SEQ ID NO: 9253730 - DNA, 22 bp, Homo sapiens
ctgttttcctgggttccatgag

SEQ ID NO: 9253731 - DNA, 22 bp, Homo sapiens
ctgttttccctggagttcagca

SEQ ID NO: 9253732 - DNA, 22 bp, Homo sapiens
ctgttttcaaagagagagaatg

SEQ ID NO: 9253733 - DNA, 21 bp, Homo sapiens
ctgtggaagggaactagaggg

SEQ ID NO: 9253734 - DNA, 22 bp, Homo sapiens
ctgtggaaggacttagcgatac

SEQ ID NO: 9253735 - DNA, 19 bp, Homo sapiens
ctgtttctgagcttgcttt

SEQ ID NO: 9253736 - DNA, 21 bp, Homo sapiens
ctgtttcttgtgaagtgacac

SEQ ID NO: 9253737 - DNA, 22 bp, Homo sapiens
ctgtgcttgacagtgggaagca

SEQ ID NO: 9253738 - DNA, 22 bp, Homo sapiens
ctgtgcttgcgggtgtggagcc

SEQ ID NO: 9253739 - DNA, 22 bp, Homo sapiens
ctgtgctttcaggccgctgtgt

SEQ ID NO: 9253740 - DNA, 20 bp, Homo sapiens
ctgtgctttggaacctggaa

SEQ ID NO: 9253741 - DNA, 22 bp, Homo sapiens
cttacaaatacacttaggagag

SEQ ID NO: 9253742 - DNA, 22 bp, Homo sapiens
cttacaaatacacttaggagag

SEQ ID NO: 9253743 - DNA, 22 bp, Homo sapiens
cttacaaaggagaggagatagg

SEQ ID NO: 9253744 - DNA, 22 bp, Homo sapiens
cttacaaaggagaggagatagg

SEQ ID NO: 9253745 - DNA, 22 bp, Homo sapiens
cttacaaaggagaggagatagg

SEQ ID NO: 9253746 - DNA, 22 bp, Homo sapiens
cttaatttcaaactgctagtga

SEQ ID NO: 9253747 - DNA, 22 bp, Homo sapiens
cttaatttttgtagtagatgga

SEQ ID NO: 9253748 - DNA, 22 bp, Homo sapiens
cttaatttaagcctagaatgca

SEQ ID NO: 9253749 - DNA, 22 bp, Homo sapiens
cttaatttaaaatagttcaggc

SEQ ID NO: 9253750 - DNA, 22 bp, Homo sapiens
cttaatttaaaatagttcaggc

SEQ ID NO: 9253751 - DNA, 22 bp, Homo sapiens
cttaaagatgtcaaggctgttt

SEQ ID NO: 9253752 - DNA, 22 bp, Homo sapiens
cttaaagatgtcaaggctgttt

SEQ ID NO: 9253753 - DNA, 22 bp, Homo sapiens
cttaaatccatcatttctaatc

SEQ ID NO: 9253754 - DNA, 22 bp, Homo sapiens
cttaaattttcatctacaagaa

SEQ ID NO: 9253755 - DNA, 22 bp, Homo sapiens
cttaaattggatgagttaagtt

SEQ ID NO: 9253756 - DNA, 22 bp, Homo sapiens
cttaattacccaatgtggtagg

SEQ ID NO: 9253757 - DNA, 22 bp, Homo sapiens
cttaatgtggacctggtttcta

SEQ ID NO: 9253758 - DNA, 22 bp, Homo sapiens
cttagaaatgcagattctcagg

SEQ ID NO: 9253759 - DNA, 22 bp, Homo sapiens
cttagaaatgcagattctcagg

SEQ ID NO: 9253760 - DNA, 22 bp, Homo sapiens
cttagcagaagcttcagcttca

SEQ ID NO: 9253761 - DNA, 22 bp, Homo sapiens
cttagcagaattccaagcttga

SEQ ID NO: 9253762 - DNA, 22 bp, Homo sapiens
cttacatttaatcatgtgtcat

SEQ ID NO: 9253763 - DNA, 22 bp, Homo sapiens
cttacattgtcttagttttcaa

SEQ ID NO: 9253764 - DNA, 22 bp, Homo sapiens
cttacattaagtaagagattga

SEQ ID NO: 9253765 - DNA, 22 bp, Homo sapiens
cttacattaagtaagagattga

SEQ ID NO: 9253766 - DNA, 22 bp, Homo sapiens
cttacatactgagaaaatatcc

SEQ ID NO: 9253767 - DNA, 22 bp, Homo sapiens
cttacacttcatctcatccagg

SEQ ID NO: 9253768 - DNA, 22 bp, Homo sapiens
cttctgggccatggccttcctc

SEQ ID NO: 9253769 - DNA, 22 bp, Homo sapiens
cttctgggcattcagctgcaca

SEQ ID NO: 9253770 - DNA, 22 bp, Homo sapiens
cttctggggatggagcccagaa

SEQ ID NO: 9253771 - DNA, 22 bp, Homo sapiens
cttctggggatggagcccagaa

SEQ ID NO: 9253772 - DNA, 22 bp, Homo sapiens
cttctgggcagaagttttgaga

SEQ ID NO: 9253773 - DNA, 22 bp, Homo sapiens
cttctgggcatggcagagcctg

SEQ ID NO: 9253774 - DNA, 22 bp, Homo sapiens
cttctgggcattcagctgcaca

SEQ ID NO: 9253775 - DNA, 22 bp, Homo sapiens
cttctgggcattcagctgcaca

SEQ ID NO: 9253776 - DNA, 22 bp, Homo sapiens
cttctgggatttttgaagactc

SEQ ID NO: 9253777 - DNA, 22 bp, Homo sapiens
cttctgggattaatttttcctg

SEQ ID NO: 9253778 - DNA, 23 bp, Homo sapiens
cttctggctctatatcagaattc

SEQ ID NO: 9253779 - DNA, 22 bp, Homo sapiens
cttctgggagagcttttgcttc

SEQ ID NO: 9253780 - DNA, 20 bp, Homo sapiens
cttctggctggtcaaggact

SEQ ID NO: 9253781 - DNA, 22 bp, Homo sapiens
cttctggcaaaacaggcagaaa

SEQ ID NO: 9253782 - DNA, 23 bp, Homo sapiens
cttctggctctatatcagaattc

SEQ ID NO: 9253783 - DNA, 22 bp, Homo sapiens
cttctggaggctccagggaggt

SEQ ID NO: 9253784 - DNA, 22 bp, Homo sapiens
cttctgaagtgtttgatgattg

SEQ ID NO: 9253785 - DNA, 22 bp, Homo sapiens
cttctgacccctggtctacagc

SEQ ID NO: 9253786 - DNA, 22 bp, Homo sapiens
cttctgaatggctgtgtatgct

SEQ ID NO: 9253787 - DNA, 22 bp, Homo sapiens
cttctcttggtagttcttgttg

SEQ ID NO: 9253788 - DNA, 22 bp, Homo sapiens
cttctcttggtagttcttgttg

SEQ ID NO: 9253789 - DNA, 22 bp, Homo sapiens
cttctgaagaggttatcataga

SEQ ID NO: 9253790 - DNA, 22 bp, Homo sapiens
cttctgaagaggttatcataga

SEQ ID NO: 9253791 - DNA, 22 bp, Homo sapiens
cttgtttttaagagatgtttac

SEQ ID NO: 9253792 - DNA, 22 bp, Homo sapiens
cttgttttggctagtatgatgt

SEQ ID NO: 9253793 - DNA, 22 bp, Homo sapiens
cttgttttggctagtatgatgt

SEQ ID NO: 9253794 - DNA, 22 bp, Homo sapiens
cttgttttggctagtatgatgt

SEQ ID NO: 9253795 - DNA, 22 bp, Homo sapiens
cttgtttttaagagatgtttac

SEQ ID NO: 9253796 - DNA, 22 bp, Homo sapiens
cttgttttggaacagagtgaat

SEQ ID NO: 9253797 - DNA, 22 bp, Homo sapiens
cttgttttggaacagagtgaat

SEQ ID NO: 9253798 - DNA, 22 bp, Homo sapiens
cttgttttcttctgcagtctat

SEQ ID NO: 9253799 - DNA, 22 bp, Homo sapiens
cttgttttgaaagcagtggcca

SEQ ID NO: 9253800 - DNA, 22 bp, Homo sapiens
cttgttttgaaagcagtggcca

SEQ ID NO: 9253801 - DNA, 21 bp, Homo sapiens
cttgttttgaaaggactggcc

SEQ ID NO: 9253802 - DNA, 21 bp, Homo sapiens
cttgttttgaaaggactggcc

SEQ ID NO: 9253803 - DNA, 22 bp, Homo sapiens
cttgttttcttctgcagtctat

SEQ ID NO: 9253804 - DNA, 22 bp, Homo sapiens
cttgttttctaaaacatcattt

SEQ ID NO: 9253805 - DNA, 22 bp, Homo sapiens
cttgttttctaaaacatcattt

SEQ ID NO: 9253806 - DNA, 22 bp, Homo sapiens
cttctgggtgtggagtgaggac

SEQ ID NO: 9253807 - DNA, 22 bp, Homo sapiens
cttctgggtgtggagtgaggac

SEQ ID NO: 9253808 - DNA, 22 bp, Homo sapiens
cttctgggtgtggagtgaggac

SEQ ID NO: 9253809 - DNA, 22 bp, Homo sapiens
cttctgggttgcaggtcttggc

SEQ ID NO: 9253810 - DNA, 22 bp, Homo sapiens
cttctgggtgcctgtgagtgtt

SEQ ID NO: 9253811 - DNA, 22 bp, Homo sapiens
cttctgggtaattcttcttcat

SEQ ID NO: 9253812 - DNA, 22 bp, Homo sapiens
cttctgggttgcaggtcttggc

SEQ ID NO: 9253813 - DNA, 22 bp, Homo sapiens
cttgtgcaaatcctcgagcaca

SEQ ID NO: 9253814 - DNA, 22 bp, Homo sapiens
cttgtgcaagaaacctggaatg

SEQ ID NO: 9253815 - DNA, 22 bp, Homo sapiens
cttgtgcaattgacattgaatc

SEQ ID NO: 9253816 - DNA, 22 bp, Homo sapiens
cttgtgcatttcattcctcagg

SEQ ID NO: 9253817 - DNA, 22 bp, Homo sapiens
cttgtgcatctcttcatgacca

SEQ ID NO: 9253818 - DNA, 22 bp, Homo sapiens
cttgtgcatcatagtttgccaa

SEQ ID NO: 9253819 - DNA, 22 bp, Homo sapiens
cttgtgcataagaagacctgag

SEQ ID NO: 9253820 - DNA, 22 bp, Homo sapiens
cttgtgcagcctcctcttgcag

SEQ ID NO: 9253821 - DNA, 19 bp, Homo sapiens
cttgtgcagttcacgctca

SEQ ID NO: 9253822 - DNA, 23 bp, Homo sapiens
ctttaatgaaattctctgtgaag

SEQ ID NO: 9253823 - DNA, 22 bp, Homo sapiens
ctttaatgagtctttctgctgt

SEQ ID NO: 9253824 - DNA, 22 bp, Homo sapiens
ctttaattaggaagtataatga

SEQ ID NO: 9253825 - DNA, 22 bp, Homo sapiens
ctttaattcagatttgaaggga

SEQ ID NO: 9253826 - DNA, 22 bp, Homo sapiens
ctttaattaggaagtataatga

SEQ ID NO: 9253827 - DNA, 22 bp, Homo sapiens
ctttaaataatacaaggtccag

SEQ ID NO: 9253828 - DNA, 22 bp, Homo sapiens
ctttaagactaaattagagttt

SEQ ID NO: 9253829 - DNA, 22 bp, Homo sapiens
ctttaagactaaattagagttt

SEQ ID NO: 9253830 - DNA, 22 bp, Homo sapiens
ctttacaaactataaagtgcgg

SEQ ID NO: 9253831 - DNA, 22 bp, Homo sapiens
ctttaattgtagctcccataat

SEQ ID NO: 9253832 - DNA, 22 bp, Homo sapiens
ctttaattctcaggtgcacata

SEQ ID NO: 9253833 - DNA, 22 bp, Homo sapiens
ctttacaaactataaagtgcgg

SEQ ID NO: 9253834 - DNA, 22 bp, Homo sapiens
ctttacaaatagggagggagtg

SEQ ID NO: 9253835 - DNA, 22 bp, Homo sapiens
ctttctcttcagcacccagccc

SEQ ID NO: 9253836 - DNA, 22 bp, Homo sapiens
ctttctcttcactgtcatgatc

SEQ ID NO: 9253837 - DNA, 22 bp, Homo sapiens
ctttctttgtccaccaacaatg

SEQ ID NO: 9253838 - DNA, 22 bp, Homo sapiens
ctttctcttcagcacccagccc

SEQ ID NO: 9253839 - DNA, 22 bp, Homo sapiens
ctttctcttcgaaaacctgccc

SEQ ID NO: 9253840 - DNA, 22 bp, Homo sapiens
ctttgaaaacacacgaatagac

SEQ ID NO: 9253841 - DNA, 22 bp, Homo sapiens
ctttgaaaacttaaataacagc

SEQ ID NO: 9253842 - DNA, 22 bp, Homo sapiens
ctttctttgtccaccaacaatg

SEQ ID NO: 9253843 - DNA, 22 bp, Homo sapiens
ctttgaaattcttcagctgaag

SEQ ID NO: 9253844 - DNA, 22 bp, Homo sapiens
ctttgaaaatgtggttaagggt

SEQ ID NO: 9253845 - DNA, 22 bp, Homo sapiens
cttttcttgtattggatgcccc

SEQ ID NO: 9253846 - DNA, 22 bp, Homo sapiens
cttttcttgtattggatgcccc

SEQ ID NO: 9253847 - DNA, 22 bp, Homo sapiens
cttttcttctcacggctgtcag

SEQ ID NO: 9253848 - DNA, 22 bp, Homo sapiens
cttttcttctcacggctgtcag

SEQ ID NO: 9253849 - DNA, 22 bp, Homo sapiens
cttttcttgtattggatgcccc

SEQ ID NO: 9253850 - DNA, 22 bp, Homo sapiens
cttttcttactcccgcaaggca

SEQ ID NO: 9253851 - DNA, 21 bp, Homo sapiens
cttttctgtgttcctccctgt

SEQ ID NO: 9253852 - DNA, 22 bp, Homo sapiens
cttttcttatgtggacgtacct

SEQ ID NO: 9253853 - DNA, 22 bp, Homo sapiens
cttttcttatgtggacgtacct

SEQ ID NO: 9253854 - DNA, 22 bp, Homo sapiens
cttttcctattgattctgttac

SEQ ID NO: 9253855 - DNA, 22 bp, Homo sapiens
cttttctagagccgcagcccta

SEQ ID NO: 9253856 - DNA, 22 bp, Homo sapiens
cttttctctgcaccatgtgtga

SEQ ID NO: 9253857 - DNA, 22 bp, Homo sapiens
cttttctctgcgggtctttcat

SEQ ID NO: 9253858 - DNA, 22 bp, Homo sapiens
cttttctcttacattccactgg

SEQ ID NO: 9253859 - DNA, 22 bp, Homo sapiens
cttttctcttacattccactgg

SEQ ID NO: 9253860 - DNA, 22 bp, Homo sapiens
cttttctggaatcatctctaac

SEQ ID NO: 9253861 - DNA, 22 bp, Homo sapiens
cttttctggaatcatctctaac

SEQ ID NO: 9253862 - DNA, 22 bp, Homo sapiens
ctttgcagcaatttctgttaaa

SEQ ID NO: 9253863 - DNA, 22 bp, Homo sapiens
ctttgcagaaataaacttgatg

SEQ ID NO: 9253864 - DNA, 21 bp, Homo sapiens
cttttacattcagtcatgatg

SEQ ID NO: 9253865 - DNA, 22 bp, Homo sapiens
cttttcattgtttgtacatgca

SEQ ID NO: 9253866 - DNA, 22 bp, Homo sapiens
cttttacactcatctgggaggg

SEQ ID NO: 9253867 - DNA, 22 bp, Homo sapiens
cttttacagtggacctgccatt

SEQ ID NO: 9253868 - DNA, 19 bp, Homo sapiens
ctttgcaggggatgggtga

SEQ ID NO: 9253869 - DNA, 22 bp, Homo sapiens
gaaaattattgaaaatggctct

SEQ ID NO: 9253870 - DNA, 22 bp, Homo sapiens
gaaaatgtttcctgttatttgc

SEQ ID NO: 9253871 - DNA, 22 bp, Homo sapiens
gaaaatagcagatagaccaatg

SEQ ID NO: 9253872 - DNA, 22 bp, Homo sapiens
gaaaatacttcagtgttctggc

SEQ ID NO: 9253873 - DNA, 22 bp, Homo sapiens
cttttgcagccattattgctgc

SEQ ID NO: 9253874 - DNA, 22 bp, Homo sapiens
cttttgcacccagagttatttg

SEQ ID NO: 9253875 - DNA, 22 bp, Homo sapiens
cttttgcaccttttaagtaatg

SEQ ID NO: 9253876 - DNA, 22 bp, Homo sapiens
gaaaatttctgccacatgtgtg

SEQ ID NO: 9253877 - DNA, 22 bp, Homo sapiens
gaaaatttctgccacatgtgtg

SEQ ID NO: 9253878 - DNA, 22 bp, Homo sapiens
gaaacaatcatcatgtgatttg

SEQ ID NO: 9253879 - DNA, 22 bp, Homo sapiens
gaaacaatcatcatgtgatttg

SEQ ID NO: 9253880 - DNA, 22 bp, Homo sapiens
gaaaatttaattctcttctgtg

SEQ ID NO: 9253881 - DNA, 22 bp, Homo sapiens
gaaaatttaattctcttctgtg

SEQ ID NO: 9253882 - DNA, 22 bp, Homo sapiens
gaaaattattgaaaatggctct

SEQ ID NO: 9253883 - DNA, 22 bp, Homo sapiens
gaaaatttagaactgaacttct

SEQ ID NO: 9253884 - DNA, 22 bp, Homo sapiens
gaaaatttagaactgaacttct

SEQ ID NO: 9253885 - DNA, 22 bp, Homo sapiens
gaaaatttagaactgaacttct

SEQ ID NO: 9253886 - DNA, 22 bp, Homo sapiens
gaaacacatatgaacagttgat

SEQ ID NO: 9253887 - DNA, 22 bp, Homo sapiens
gaaacaatttttgttgtctaag

SEQ ID NO: 9253888 - DNA, 22 bp, Homo sapiens
gaaacacatatgaacagttgat

SEQ ID NO: 9253889 - DNA, 22 bp, Homo sapiens
gaaacactatgccaagacaggg

SEQ ID NO: 9253890 - DNA, 22 bp, Homo sapiens
gaaacagcacgtttggagagat

SEQ ID NO: 9253891 - DNA, 22 bp, Homo sapiens
gaaacagcacgtttggagagat

SEQ ID NO: 9253892 - DNA, 18 bp, Homo sapiens
gaaagccatgcagcagtg

SEQ ID NO: 9253893 - DNA, 22 bp, Homo sapiens
gaaagccatagcccagctttac

SEQ ID NO: 9253894 - DNA, 22 bp, Homo sapiens
gaaagccatctggctgctggga

SEQ ID NO: 9253895 - DNA, 22 bp, Homo sapiens
gaaagccatctggctgctggga

SEQ ID NO: 9253896 - DNA, 22 bp, Homo sapiens
gaaagcatccgcctggaggtgg

SEQ ID NO: 9253897 - DNA, 22 bp, Homo sapiens
gaaagaggaaggagatgtatta

SEQ ID NO: 9253898 - DNA, 22 bp, Homo sapiens
gaaagagaggggctgagatgca

SEQ ID NO: 9253899 - DNA, 22 bp, Homo sapiens
gaaagagaggggctgagatgca

SEQ ID NO: 9253900 - DNA, 22 bp, Homo sapiens
ctgctgcccctgagctcagcct

SEQ ID NO: 9253901 - DNA, 22 bp, Homo sapiens
ctgctgccctagacccagtcct

SEQ ID NO: 9253902 - DNA, 20 bp, Homo sapiens
ctgctgccctgtcagcctct

SEQ ID NO: 9253903 - DNA, 22 bp, Homo sapiens
ctgctgagccctggcacaggtg

SEQ ID NO: 9253904 - DNA, 20 bp, Homo sapiens
ctgctgccctgtcagcctct

SEQ ID NO: 9253905 - DNA, 20 bp, Homo sapiens
ctgctgccctgtcagcctct

SEQ ID NO: 9253906 - DNA, 22 bp, Homo sapiens
ctgctgccggcgagcctccctt

SEQ ID NO: 9253907 - DNA, 19 bp, Homo sapiens
ctgctctccttgacttgga

SEQ ID NO: 9253908 - DNA, 22 bp, Homo sapiens
ctgctctccccaggccagtctg

SEQ ID NO: 9253909 - DNA, 22 bp, Homo sapiens
ctgctctaactgcattagtttt

SEQ ID NO: 9253910 - DNA, 22 bp, Homo sapiens
ctgctctaggttcctgcatatg

SEQ ID NO: 9253911 - DNA, 22 bp, Homo sapiens
ctgctggcaagcccagttggag

SEQ ID NO: 9253912 - DNA, 22 bp, Homo sapiens
ctgctgggaaggtctgctcagt

SEQ ID NO: 9253913 - DNA, 22 bp, Homo sapiens
ctgctgcctgattgcagacctc

SEQ ID NO: 9253914 - DNA, 22 bp, Homo sapiens
ctgctgctcgaccagtcccagg

SEQ ID NO: 9253915 - DNA, 22 bp, Homo sapiens
ctgctgctgagagctcagcctg

SEQ ID NO: 9253916 - DNA, 21 bp, Homo sapiens
ctgctgctggggtctgggcag

SEQ ID NO: 9253917 - DNA, 22 bp, Homo sapiens
ctgctgctgctatctacccagg

SEQ ID NO: 9253918 - DNA, 22 bp, Homo sapiens
ctgcctcttgacagatcgtggc

SEQ ID NO: 9253919 - DNA, 22 bp, Homo sapiens
ctgcctcttgacagatcgtggc

SEQ ID NO: 9253920 - DNA, 22 bp, Homo sapiens
ctgcctcttaagtggatggagt

SEQ ID NO: 9253921 - DNA, 22 bp, Homo sapiens
ctgcctctgttgggcatggtct

SEQ ID NO: 9253922 - DNA, 22 bp, Homo sapiens
ctgcctgagtggaggtcgaggg

SEQ ID NO: 9253923 - DNA, 22 bp, Homo sapiens
ctgcctgcactgcctggctcca

SEQ ID NO: 9253924 - DNA, 22 bp, Homo sapiens
ctgcctgcactgcctggctcca

SEQ ID NO: 9253925 - DNA, 22 bp, Homo sapiens
ctgcctgcactgcctggctcca

SEQ ID NO: 9253926 - DNA, 22 bp, Homo sapiens
ctgcctgcaggacacctcgcta

SEQ ID NO: 9253927 - DNA, 22 bp, Homo sapiens
ctgcctgcaggacacctcgcta

SEQ ID NO: 9253928 - DNA, 22 bp, Homo sapiens
ctgcctgcatcccacagtgggg

SEQ ID NO: 9253929 - DNA, 22 bp, Homo sapiens
ctgcctgcatcccacagtgggg

SEQ ID NO: 9253930 - DNA, 22 bp, Homo sapiens
ctgcctgcatcccacagtgggg

SEQ ID NO: 9253931 - DNA, 22 bp, Homo sapiens
ctgcctgccacgttcagctgta

SEQ ID NO: 9253932 - DNA, 22 bp, Homo sapiens
ctgcctgcatgctgccatagct

SEQ ID NO: 9253933 - DNA, 22 bp, Homo sapiens
ctgcctgcctggagacagatgg

SEQ ID NO: 9253934 - DNA, 22 bp, Homo sapiens
ctgcctgcctggagacagatgg

SEQ ID NO: 9253935 - DNA, 22 bp, Homo sapiens
ctgcctgccacgttcagctgta

SEQ ID NO: 9253936 - DNA, 22 bp, Homo sapiens
ctgcctgccttggcctccagga

SEQ ID NO: 9253937 - DNA, 22 bp, Homo sapiens
ctgcctgccttggcctccagga

SEQ ID NO: 9253938 - DNA, 22 bp, Homo sapiens
ctgcctgcgccaccaccacgtc

SEQ ID NO: 9253939 - DNA, 22 bp, Homo sapiens
ctgctccagacacctgcagggg

SEQ ID NO: 9253940 - DNA, 22 bp, Homo sapiens
ctgcgttctgcctggcggccta

SEQ ID NO: 9253941 - DNA, 22 bp, Homo sapiens
ctgctcctctgaggtagccaca

SEQ ID NO: 9253942 - DNA, 22 bp, Homo sapiens
ctgctcctggtcatcctccact

SEQ ID NO: 9253943 - DNA, 22 bp, Homo sapiens
ctgctcctgtccagcagggcca

SEQ ID NO: 9253944 - DNA, 22 bp, Homo sapiens
ctgcctctattcactgaggcag

SEQ ID NO: 9253945 - DNA, 22 bp, Homo sapiens
ctgcctctattcactgaggcag

SEQ ID NO: 9253946 - DNA, 22 bp, Homo sapiens
ctgcctctataggagtccacca

SEQ ID NO: 9253947 - DNA, 22 bp, Homo sapiens
ctgcctctggcctcaggcccag

SEQ ID NO: 9253948 - DNA, 22 bp, Homo sapiens
ctgcctctgttgggcatggtct

SEQ ID NO: 9253949 - DNA, 22 bp, Homo sapiens
ctgcctctggttttggtccctg

SEQ ID NO: 9253950 - DNA, 22 bp, Homo sapiens
ctgccctgcttgtttccagtgg

SEQ ID NO: 9253951 - DNA, 22 bp, Homo sapiens
ctgccctggcagcctaccatgg

SEQ ID NO: 9253952 - DNA, 22 bp, Homo sapiens
ctgccctgcttgatgacagcga

SEQ ID NO: 9253953 - DNA, 22 bp, Homo sapiens
ctgccctgcttgatgacagcga

SEQ ID NO: 9253954 - DNA, 22 bp, Homo sapiens
ctgccctgcttgatgacagcga

SEQ ID NO: 9253955 - DNA, 22 bp, Homo sapiens
ctgccctggccactgtgcccag

SEQ ID NO: 9253956 - DNA, 22 bp, Homo sapiens
ctgccctggccactgtgcccag

SEQ ID NO: 9253957 - DNA, 22 bp, Homo sapiens
ctgccctgggagtacctgtcct

SEQ ID NO: 9253958 - DNA, 22 bp, Homo sapiens
ctgccctgggagtacctgtcct

SEQ ID NO: 9253959 - DNA, 22 bp, Homo sapiens
ctgccctgggatggtctgtgcg

SEQ ID NO: 9253960 - DNA, 22 bp, Homo sapiens
ctgccctgagtcatgccagatg

SEQ ID NO: 9253961 - DNA, 22 bp, Homo sapiens
ctgccctgagtcatgccagatg

SEQ ID NO: 9253962 - DNA, 22 bp, Homo sapiens
ctgccctgagggcctgtgtgtt

SEQ ID NO: 9253963 - DNA, 22 bp, Homo sapiens
ctgcccctggtgatggacgcca

SEQ ID NO: 9253964 - DNA, 22 bp, Homo sapiens
ctgccctgcctggccagtgtgg

SEQ ID NO: 9253965 - DNA, 22 bp, Homo sapiens
ctgccctgcttgatgacagcga

SEQ ID NO: 9253966 - DNA, 22 bp, Homo sapiens
ctgccctgctggagatcacagt

SEQ ID NO: 9253967 - DNA, 22 bp, Homo sapiens
ctgccctgcccaggccttgggc

SEQ ID NO: 9253968 - DNA, 22 bp, Homo sapiens
ctgccctgcagctccacggact

SEQ ID NO: 9253969 - DNA, 22 bp, Homo sapiens
ctgccctgcctggccagtgtgg

SEQ ID NO: 9253970 - DNA, 20 bp, Homo sapiens
ctgccctgccctgggtcctg

SEQ ID NO: 9253971 - DNA, 22 bp, Homo sapiens
ctgcagtgcaagcccagatgga

SEQ ID NO: 9253972 - DNA, 22 bp, Homo sapiens
ctgcagtgcctgccactgagcc

SEQ ID NO: 9253973 - DNA, 22 bp, Homo sapiens
ctgcagtgcctgccactgagcc

SEQ ID NO: 9253974 - DNA, 22 bp, Homo sapiens
ctgcagtgttctggaatgcatt

SEQ ID NO: 9253975 - DNA, 22 bp, Homo sapiens
ctgcagtgcaagcccagatgga

SEQ ID NO: 9253976 - DNA, 22 bp, Homo sapiens
ctgcagtctgacatacgaggac

SEQ ID NO: 9253977 - DNA, 22 bp, Homo sapiens
ctgcagtcttccttccttaggc

SEQ ID NO: 9253978 - DNA, 22 bp, Homo sapiens
ctgcagtgaaatcaggaagcaa

SEQ ID NO: 9253979 - DNA, 22 bp, Homo sapiens
ctgcagtatgagctacccaggt

SEQ ID NO: 9253980 - DNA, 22 bp, Homo sapiens
ctgcagtcagcttttaagatct

SEQ ID NO: 9253981 - DNA, 23 bp, Homo sapiens
ctgcagtcgccggcctgggtgcc

SEQ ID NO: 9253982 - DNA, 23 bp, Homo sapiens
ctgcagtcgccggcctgggtgcc

SEQ ID NO: 9253983 - DNA, 20 bp, Homo sapiens
ctgcagtcccctctgaatca

SEQ ID NO: 9253984 - DNA, 22 bp, Homo sapiens
ctgcagtcatctgaagattttg

SEQ ID NO: 9253985 - DNA, 22 bp, Homo sapiens
ctgcagtgttctggaatgcatt

SEQ ID NO: 9253986 - DNA, 22 bp, Homo sapiens
ctgcagtgttctggaatgcatt

SEQ ID NO: 9253987 - DNA, 22 bp, Homo sapiens
ctgcagttctttggcttttaga

SEQ ID NO: 9253988 - DNA, 22 bp, Homo sapiens
ctgcagttgactccctgtttgc

SEQ ID NO: 9253989 - DNA, 22 bp, Homo sapiens
ctgcagttcttctcctcaaggc

SEQ ID NO: 9253990 - DNA, 22 bp, Homo sapiens
ctgcagttctcaatttctattg

SEQ ID NO: 9253991 - DNA, 22 bp, Homo sapiens
ctgcagtttgtaaacattttaa

SEQ ID NO: 9253992 - DNA, 22 bp, Homo sapiens
ctgcagtttgctaagagacaaa

SEQ ID NO: 9253993 - DNA, 22 bp, Homo sapiens
ctgcagtttgctaagagacaaa

SEQ ID NO: 9253994 - DNA, 22 bp, Homo sapiens
ctgcagtttcagcctttctggc

SEQ ID NO: 9253995 - DNA, 22 bp, Homo sapiens
ctgcagtttgaccttgttttct

SEQ ID NO: 9253996 - DNA, 22 bp, Homo sapiens
ctgcagttggctgagacccccc

SEQ ID NO: 9253997 - DNA, 22 bp, Homo sapiens
ctgcagttgggtgacccaatat

SEQ ID NO: 9253998 - DNA, 22 bp, Homo sapiens
ctgcagttggataaagatactt

SEQ ID NO: 9253999 - DNA, 22 bp, Homo sapiens
ctgcagttggtgggtcctcggt

SEQ ID NO: 9254000 - DNA, 23 bp, Homo sapiens
ctgcatatggaggttagcaactc

SEQ ID NO: 9254001 - DNA, 22 bp, Homo sapiens
ctgcatatgatagatgccttgc

SEQ ID NO: 9254002 - DNA, 22 bp, Homo sapiens
ctgcatatgagaataggagaaa

SEQ ID NO: 9254003 - DNA, 22 bp, Homo sapiens
ctgcatatcaaattactcctgg

SEQ ID NO: 9254004 - DNA, 22 bp, Homo sapiens
ctgagggccttctatgctgagc

SEQ ID NO: 9254005 - DNA, 21 bp, Homo sapiens
ctgagggccgcagctgggctc

SEQ ID NO: 9254006 - DNA, 22 bp, Homo sapiens
ctgagggctggagctgaggcct

SEQ ID NO: 9254007 - DNA, 23 bp, Homo sapiens
ctgagggctggtctgaagtctgc

SEQ ID NO: 9254008 - DNA, 22 bp, Homo sapiens
ctgagggccttggctcctgccc

SEQ ID NO: 9254009 - DNA, 22 bp, Homo sapiens
ctgagggccttggctcctgccc

SEQ ID NO: 9254010 - DNA, 22 bp, Homo sapiens
ctgcaggggcctcgagcacagg

SEQ ID NO: 9254011 - DNA, 22 bp, Homo sapiens
ctgcaggggcctcgagcacagg

SEQ ID NO: 9254012 - DNA, 21 bp, Homo sapiens
ctgcaggtgctgccatcaggg

SEQ ID NO: 9254013 - DNA, 22 bp, Homo sapiens
ctgcaggtctctgtgtgcattc

SEQ ID NO: 9254014 - DNA, 22 bp, Homo sapiens
ctgcaggttgagcagccaggtt

SEQ ID NO: 9254015 - DNA, 22 bp, Homo sapiens
ctgcaggttgagcagccaggtt

SEQ ID NO: 9254016 - DNA, 22 bp, Homo sapiens
ctgaaaaatatgttttggagaa

SEQ ID NO: 9254017 - DNA, 22 bp, Homo sapiens
ctgaaaatgttacacaggaaga

SEQ ID NO: 9254018 - DNA, 19 bp, Homo sapiens
ctgaaacacagagagggct

SEQ ID NO: 9254019 - DNA, 19 bp, Homo sapiens
ctgaaacacagagagggct

SEQ ID NO: 9254020 - DNA, 22 bp, Homo sapiens
ctgaaactacagtaaggagaac

SEQ ID NO: 9254021 - DNA, 22 bp, Homo sapiens
ctgaaactatggggaggggagc

SEQ ID NO: 9254022 - DNA, 22 bp, Homo sapiens
ctgaaacattgcaataacaaag

SEQ ID NO: 9254023 - DNA, 22 bp, Homo sapiens
ctgaaagaataagatgtttaca

SEQ ID NO: 9254024 - DNA, 22 bp, Homo sapiens
ctgaaagaataagatgtttaca

SEQ ID NO: 9254025 - DNA, 22 bp, Homo sapiens
ctgaaagaataagatgtttaca

SEQ ID NO: 9254026 - DNA, 22 bp, Homo sapiens
tttttcttaaatgtgggttggc

SEQ ID NO: 9254027 - DNA, 22 bp, Homo sapiens
tttttcttaaatgtgggttggc

SEQ ID NO: 9254028 - DNA, 22 bp, Homo sapiens
tttttcttgtgctggatctaat

SEQ ID NO: 9254029 - DNA, 23 bp, Homo sapiens
ttttttgtcttgctaggctgccc

SEQ ID NO: 9254030 - DNA, 22 bp, Homo sapiens
tttttcttgtgctggatctaat

SEQ ID NO: 9254031 - DNA, 22 bp, Homo sapiens
ttttttgttgggtagaacggaa

SEQ ID NO: 9254032 - DNA, 22 bp, Homo sapiens
ttttttgttgggtagaacggaa

SEQ ID NO: 9254033 - DNA, 23 bp, Homo sapiens
ttttttgtcttgctaggctgccc

SEQ ID NO: 9254034 - DNA, 20 bp, Homo sapiens
tttttctgggcttccatagc

SEQ ID NO: 9254035 - DNA, 20 bp, Homo sapiens
tttttctgggcttccatagc

SEQ ID NO: 9254036 - DNA, 22 bp, Homo sapiens
tttttctggataactgtatctc

SEQ ID NO: 9254037 - DNA, 22 bp, Homo sapiens
tttttctgtctcttacattgca

SEQ ID NO: 9254038 - DNA, 22 bp, Homo sapiens
ctgaagatgtctgagatgctca

SEQ ID NO: 9254039 - DNA, 20 bp, Homo sapiens
ctgaaagacgtaacagtgca

SEQ ID NO: 9254040 - DNA, 22 bp, Homo sapiens
ctgaaggaagcaggtggcctgt

SEQ ID NO: 9254041 - DNA, 22 bp, Homo sapiens
ctgaaggacacgtgaggagcca

SEQ ID NO: 9254042 - DNA, 22 bp, Homo sapiens
ctgaagcaaaggatcgagctaa

SEQ ID NO: 9254043 - DNA, 22 bp, Homo sapiens
ctgaaggagcatagtcagtttt

SEQ ID NO: 9254044 - DNA, 22 bp, Homo sapiens
ctgaaggacttggtgatagttg

SEQ ID NO: 9254045 - DNA, 22 bp, Homo sapiens
ctgaaggagaaggccactgttc

SEQ ID NO: 9254046 - DNA, 18 bp, Homo sapiens
ctgaaggatccaggtgta

SEQ ID NO: 9254047 - DNA, 22 bp, Homo sapiens
ctgaaggaggtagagtgacata

SEQ ID NO: 9254048 - DNA, 22 bp, Homo sapiens
ctgaagtcagatggcacaaggt

SEQ ID NO: 9254049 - DNA, 22 bp, Homo sapiens
ctgaagtcatacactgttctga

SEQ ID NO: 9254050 - DNA, 22 bp, Homo sapiens
ctgaaggatttagttctttgct

SEQ ID NO: 9254051 - DNA, 22 bp, Homo sapiens
ctgaagtcatacactgttctga

SEQ ID NO: 9254052 - DNA, 19 bp, Homo sapiens
ctgaagtcttttcagctgg

SEQ ID NO: 9254053 - DNA, 22 bp, Homo sapiens
ttttctcaggtgcttatctaag

SEQ ID NO: 9254054 - DNA, 22 bp, Homo sapiens
ttttctcaggtgcttatctaag

SEQ ID NO: 9254055 - DNA, 22 bp, Homo sapiens
ttttctcaggtgcttatctaag

SEQ ID NO: 9254056 - DNA, 22 bp, Homo sapiens
ttttctcaggtgcttatctaag

SEQ ID NO: 9254057 - DNA, 22 bp, Homo sapiens
ttttcctgttaaatctgggcac

SEQ ID NO: 9254058 - DNA, 20 bp, Homo sapiens
ttttcctgtggtttgatatg

SEQ ID NO: 9254059 - DNA, 20 bp, Homo sapiens
ttttcctgtggtttgatatg

SEQ ID NO: 9254060 - DNA, 23 bp, Homo sapiens
ttttcctgtggagacatgactgg

SEQ ID NO: 9254061 - DNA, 22 bp, Homo sapiens
ttttcctgtccaggcaattatt

SEQ ID NO: 9254062 - DNA, 22 bp, Homo sapiens
ttttcctgggctttctgtgtaa

SEQ ID NO: 9254063 - DNA, 22 bp, Homo sapiens
ttttcctggagatggagttgtt

SEQ ID NO: 9254064 - DNA, 22 bp, Homo sapiens
ttttcctggggcttctggactc

SEQ ID NO: 9254065 - DNA, 22 bp, Homo sapiens
ttttcagtttgcactgcagtgc

SEQ ID NO: 9254066 - DNA, 22 bp, Homo sapiens
ttttcctctgtatttgaaatgc

SEQ ID NO: 9254067 - DNA, 22 bp, Homo sapiens
ctctggagtgcagcctggtggc

SEQ ID NO: 9254068 - DNA, 22 bp, Homo sapiens
ttttcctgcctgtctctagagg

SEQ ID NO: 9254069 - DNA, 19 bp, Homo sapiens
ttttcctgcctcattgttt

SEQ ID NO: 9254070 - DNA, 22 bp, Homo sapiens
ttttcctgcctgtctctagagg

SEQ ID NO: 9254071 - DNA, 22 bp, Homo sapiens
ttttcctgcctttgctcaggga

SEQ ID NO: 9254072 - DNA, 22 bp, Homo sapiens
ttttcctctgttattagtgtga

SEQ ID NO: 9254073 - DNA, 19 bp, Homo sapiens
ttttcctgcctcattgttt

SEQ ID NO: 9254074 - DNA, 22 bp, Homo sapiens
ttttctctacaaaataaccagc

SEQ ID NO: 9254075 - DNA, 22 bp, Homo sapiens
ttttctctacaaaataaccagc

SEQ ID NO: 9254076 - DNA, 22 bp, Homo sapiens
ttttctctacaaaataaccagc

SEQ ID NO: 9254077 - DNA, 22 bp, Homo sapiens
ttttctctacaaaataaccagc

SEQ ID NO: 9254078 - DNA, 22 bp, Homo sapiens
ttttctctatattgtctgtgaa

SEQ ID NO: 9254079 - DNA, 22 bp, Homo sapiens
ttttctcccgctggctgctctt

SEQ ID NO: 9254080 - DNA, 22 bp, Homo sapiens
ttttctcctttcaagatagcat

SEQ ID NO: 9254081 - DNA, 22 bp, Homo sapiens
ttttctcctaagacccttcacc

SEQ ID NO: 9254082 - DNA, 17 bp, Homo sapiens
ttttctcctgcccattc

SEQ ID NO: 9254083 - DNA, 19 bp, Homo sapiens
tttttacaagtaggtgtga

SEQ ID NO: 9254084 - DNA, 22 bp, Homo sapiens
ttttctctccaggtggggtgat

SEQ ID NO: 9254085 - DNA, 22 bp, Homo sapiens
tttttctgccattcaaagagga

SEQ ID NO: 9254086 - DNA, 18 bp, Homo sapiens
tttttctgataaaacaag

SEQ ID NO: 9254087 - DNA, 22 bp, Homo sapiens
ctgagctgtgtggtcctgggca

SEQ ID NO: 9254088 - DNA, 22 bp, Homo sapiens
ctgagctgggctctcttgaggg

SEQ ID NO: 9254089 - DNA, 22 bp, Homo sapiens
ctgagctggtctatggacttgg

SEQ ID NO: 9254090 - DNA, 22 bp, Homo sapiens
ctgagctggtgtttcagggtca

SEQ ID NO: 9254091 - DNA, 22 bp, Homo sapiens
ctgagctggtgtttcagggtca

SEQ ID NO: 9254092 - DNA, 22 bp, Homo sapiens
ctgagctggtggaagcatgcag

SEQ ID NO: 9254093 - DNA, 22 bp, Homo sapiens
ctgagcttcagtgcactgggag

SEQ ID NO: 9254094 - DNA, 22 bp, Homo sapiens
ctgagcttaaccctgttagcaa

SEQ ID NO: 9254095 - DNA, 22 bp, Homo sapiens
ctgagctgtttaatcccagata

SEQ ID NO: 9254096 - DNA, 22 bp, Homo sapiens
ctgagctgttactctgtcctcg

SEQ ID NO: 9254097 - DNA, 22 bp, Homo sapiens
ctgagctgttactctgtcctcg

SEQ ID NO: 9254098 - DNA, 22 bp, Homo sapiens
ctgagcttccagttcctccagg

SEQ ID NO: 9254099 - DNA, 22 bp, Homo sapiens
ctgagcttggcttatctccagc

SEQ ID NO: 9254100 - DNA, 22 bp, Homo sapiens
ctgaggaagaggtaccatttgt

SEQ ID NO: 9254101 - DNA, 22 bp, Homo sapiens
ctgaggaaagtattgcctggtg

SEQ ID NO: 9254102 - DNA, 22 bp, Homo sapiens
ctgaggaatgagtgaggagcca

SEQ ID NO: 9254103 - DNA, 22 bp, Homo sapiens
ctgaggaaggctgggggcatcc

SEQ ID NO: 9254104 - DNA, 22 bp, Homo sapiens
ctgagggcaccgacagagtgga

SEQ ID NO: 9254105 - DNA, 18 bp, Homo sapiens
ctgagggcaacagaggct

SEQ ID NO: 9254106 - DNA, 22 bp, Homo sapiens
ctgagggccctgaagcttggca

SEQ ID NO: 9254107 - DNA, 22 bp, Homo sapiens
ctgagggcatgaacattccata

SEQ ID NO: 9254108 - DNA, 22 bp, Homo sapiens
ctgagggcagtgatgaaggtga

SEQ ID NO: 9254109 - DNA, 22 bp, Homo sapiens
ctgaggctgggcatggggtcca

SEQ ID NO: 9254110 - DNA, 18 bp, Homo sapiens
ctgaggctggcaggagcc

SEQ ID NO: 9254111 - DNA, 18 bp, Homo sapiens
ctgaggctggcaggagcc

SEQ ID NO: 9254112 - DNA, 18 bp, Homo sapiens
ctgaggctggcaggagcc

SEQ ID NO: 9254113 - DNA, 22 bp, Homo sapiens
ctgagatcccaggcagggtggc

SEQ ID NO: 9254114 - DNA, 22 bp, Homo sapiens
ctgagatggagtttcgctcttc

SEQ ID NO: 9254115 - DNA, 22 bp, Homo sapiens
ctgagatggagttttgctcttg

SEQ ID NO: 9254116 - DNA, 22 bp, Homo sapiens
ctgagatggccactgggtctca

SEQ ID NO: 9254117 - DNA, 22 bp, Homo sapiens
ctgagatggtctctttgttact

SEQ ID NO: 9254118 - DNA, 20 bp, Homo sapiens
ctgagagtctgtgcttagtc

SEQ ID NO: 9254119 - DNA, 22 bp, Homo sapiens
ctgagagtgtggcttccaggcc

SEQ ID NO: 9254120 - DNA, 22 bp, Homo sapiens
ctgagctgggagtagagactct

SEQ ID NO: 9254121 - DNA, 22 bp, Homo sapiens
ctgagcacctgctgtgtgccag

SEQ ID NO: 9254122 - DNA, 22 bp, Homo sapiens
ctgagcctgtgtttctctggca

SEQ ID NO: 9254123 - DNA, 22 bp, Homo sapiens
ctgagccttattcaccagccct

SEQ ID NO: 9254124 - DNA, 20 bp, Homo sapiens
ctgagcgtctaagaggtgag

SEQ ID NO: 9254125 - DNA, 22 bp, Homo sapiens
ctgagcgcgggacctgaggctg

SEQ ID NO: 9254126 - DNA, 22 bp, Homo sapiens
ctgagagatgatatagcttaat

SEQ ID NO: 9254127 - DNA, 22 bp, Homo sapiens
ctgagagatcaagccacaggat

SEQ ID NO: 9254128 - DNA, 22 bp, Homo sapiens
ctgaataattttctgttgtatg

SEQ ID NO: 9254129 - DNA, 22 bp, Homo sapiens
ctgaataattttatagttgctg

SEQ ID NO: 9254130 - DNA, 22 bp, Homo sapiens
ctgaataatgttctcttgtatg

SEQ ID NO: 9254131 - DNA, 22 bp, Homo sapiens
ctgaataatgttctcttgtatg

SEQ ID NO: 9254132 - DNA, 22 bp, Homo sapiens
ctgaataattttatagttgctg

SEQ ID NO: 9254133 - DNA, 22 bp, Homo sapiens
ctgaagttctacaagcctcagg

SEQ ID NO: 9254134 - DNA, 22 bp, Homo sapiens
ctgaataatacagactagcttc

SEQ ID NO: 9254135 - DNA, 22 bp, Homo sapiens
ctgaataatattccattatgag

SEQ ID NO: 9254136 - DNA, 22 bp, Homo sapiens
ctgaataatattccattatgag

SEQ ID NO: 9254137 - DNA, 22 bp, Homo sapiens
ctgagaggtaagcagcgcagtg

SEQ ID NO: 9254138 - DNA, 22 bp, Homo sapiens
ctgagaggtaagcagcgcagtg

SEQ ID NO: 9254139 - DNA, 22 bp, Homo sapiens
ctgagaggtaagcagcgcagtg

SEQ ID NO: 9254140 - DNA, 22 bp, Homo sapiens
ctgagagtattggcaggcttgg

SEQ ID NO: 9254141 - DNA, 22 bp, Homo sapiens
ctgagagtcagtggagtggtgt

SEQ ID NO: 9254142 - DNA, 22 bp, Homo sapiens
tttgaataaacggttaatgttc

SEQ ID NO: 9254143 - DNA, 22 bp, Homo sapiens
ctctggaattgacctgggaggg

SEQ ID NO: 9254144 - DNA, 22 bp, Homo sapiens
tttgaataaacggttaatgttc

SEQ ID NO: 9254145 - DNA, 19 bp, Homo sapiens
ctctggagcagacactgga

SEQ ID NO: 9254146 - DNA, 22 bp, Homo sapiens
ctctgcttgtgtcaggcatgct

SEQ ID NO: 9254147 - DNA, 18 bp, Homo sapiens
tttgaaggatggcctgga

SEQ ID NO: 9254148 - DNA, 22 bp, Homo sapiens
tttgaagggcacgacaatagtt

SEQ ID NO: 9254149 - DNA, 22 bp, Homo sapiens
tttgaagggcacgacaatagtt

SEQ ID NO: 9254150 - DNA, 22 bp, Homo sapiens
tttgaagtcaaagattgattcc

SEQ ID NO: 9254151 - DNA, 22 bp, Homo sapiens
ctctggagggaggctgagctgg

SEQ ID NO: 9254152 - DNA, 22 bp, Homo sapiens
ctctggaggcagcaccagccag

SEQ ID NO: 9254153 - DNA, 22 bp, Homo sapiens
ctctggaggttgagcccagcaa

SEQ ID NO: 9254154 - DNA, 22 bp, Homo sapiens
tttcttatattctgtcattgtt

SEQ ID NO: 9254155 - DNA, 22 bp, Homo sapiens
tttcttatactatattgtcatc

SEQ ID NO: 9254156 - DNA, 22 bp, Homo sapiens
tttcttatactatattgtcatc

SEQ ID NO: 9254157 - DNA, 19 bp, Homo sapiens
tttcttaggcctttggcct

SEQ ID NO: 9254158 - DNA, 22 bp, Homo sapiens
tttcttaatttgagttccacta

SEQ ID NO: 9254159 - DNA, 19 bp, Homo sapiens
tttctgtttgcttctggtt

SEQ ID NO: 9254160 - DNA, 19 bp, Homo sapiens
tttctgtttgcttctggtt

SEQ ID NO: 9254161 - DNA, 22 bp, Homo sapiens
tttcttagcgatgcttgataaa

SEQ ID NO: 9254162 - DNA, 22 bp, Homo sapiens
tttcttgaccactatgttgata

SEQ ID NO: 9254163 - DNA, 22 bp, Homo sapiens
tttcttgaagtcctaaccctca

SEQ ID NO: 9254164 - DNA, 22 bp, Homo sapiens
tttcttctttcccagtgatggg

SEQ ID NO: 9254165 - DNA, 22 bp, Homo sapiens
tttcttcttgatttaaacaggg

SEQ ID NO: 9254166 - DNA, 22 bp, Homo sapiens
tttcttcttgagtaaccagatt

SEQ ID NO: 9254167 - DNA, 22 bp, Homo sapiens
tttcttcttgatttaaacaggg

SEQ ID NO: 9254168 - DNA, 22 bp, Homo sapiens
tttcttctgtttgtagttacac

SEQ ID NO: 9254169 - DNA, 22 bp, Homo sapiens
tttcttcttgagtaaccagatt

SEQ ID NO: 9254170 - DNA, 22 bp, Homo sapiens
tttcttcttgatttaaacaggg

SEQ ID NO: 9254171 - DNA, 22 bp, Homo sapiens
tttcttcttaatactggctgct

SEQ ID NO: 9254172 - DNA, 22 bp, Homo sapiens
ctctgcttcatccaccactggc

SEQ ID NO: 9254173 - DNA, 19 bp, Homo sapiens
ctctgcctctggctgtggc

SEQ ID NO: 9254174 - DNA, 19 bp, Homo sapiens
ctctgcctctggctgtggc

SEQ ID NO: 9254175 - DNA, 19 bp, Homo sapiens
ctctgcctctggctgtggc

SEQ ID NO: 9254176 - DNA, 22 bp, Homo sapiens
tttcttgagctaggaacctggg

SEQ ID NO: 9254177 - DNA, 22 bp, Homo sapiens
tttcttgattagctgtggctca

SEQ ID NO: 9254178 - DNA, 22 bp, Homo sapiens
tttcttgagtgatgcttagtgt

SEQ ID NO: 9254179 - DNA, 22 bp, Homo sapiens
ctctctggatatttgtatgctg

SEQ ID NO: 9254180 - DNA, 22 bp, Homo sapiens
ctctctggcacttcattgctgt

SEQ ID NO: 9254181 - DNA, 22 bp, Homo sapiens
ctctctggcccatcctgttgcc

SEQ ID NO: 9254182 - DNA, 22 bp, Homo sapiens
ctctctggcccatcctgttgcc

SEQ ID NO: 9254183 - DNA, 22 bp, Homo sapiens
ctctctggcacttcattgctgt

SEQ ID NO: 9254184 - DNA, 22 bp, Homo sapiens
ctctgagctgaaacatgagcat

SEQ ID NO: 9254185 - DNA, 22 bp, Homo sapiens
ctctgagctgaaacatgagcat

SEQ ID NO: 9254186 - DNA, 22 bp, Homo sapiens
ctctgagctcgtgcagtacttc

SEQ ID NO: 9254187 - DNA, 22 bp, Homo sapiens
ctctgacagccttcattatgca

SEQ ID NO: 9254188 - DNA, 22 bp, Homo sapiens
ctctgacagccttcattatgca

SEQ ID NO: 9254189 - DNA, 22 bp, Homo sapiens
ctctgaggaagtcaagtagcca

SEQ ID NO: 9254190 - DNA, 22 bp, Homo sapiens
ctctgagggctgtcaggaaagg

SEQ ID NO: 9254191 - DNA, 22 bp, Homo sapiens
ctctgaggtcagggcccggcaa

SEQ ID NO: 9254192 - DNA, 19 bp, Homo sapiens
tttctgcagcccagcagca

SEQ ID NO: 9254193 - DNA, 22 bp, Homo sapiens
tttctgcaggtattgcataagt

SEQ ID NO: 9254194 - DNA, 20 bp, Homo sapiens
tttctgcagggagctgggct

SEQ ID NO: 9254195 - DNA, 22 bp, Homo sapiens
tttctgtttagcataaagtggc

SEQ ID NO: 9254196 - DNA, 22 bp, Homo sapiens
tttctgtttagcataaagtggc

SEQ ID NO: 9254197 - DNA, 19 bp, Homo sapiens
tttctgtttgcttctggtt

SEQ ID NO: 9254198 - DNA, 19 bp, Homo sapiens
tttctgtttgcttctggtt

SEQ ID NO: 9254199 - DNA, 22 bp, Homo sapiens
tttctgttgtacttaaactagg

SEQ ID NO: 9254200 - DNA, 22 bp, Homo sapiens
tttctgttgtacttaaactagg

SEQ ID NO: 9254201 - DNA, 22 bp, Homo sapiens
tttctgttgtatggcttctgca

SEQ ID NO: 9254202 - DNA, 22 bp, Homo sapiens
tttctgatatactgtagaatcc

SEQ ID NO: 9254203 - DNA, 22 bp, Homo sapiens
tttctgatattcatttagaaga

SEQ ID NO: 9254204 - DNA, 22 bp, Homo sapiens
ctctgaggtccttcccagctct

SEQ ID NO: 9254205 - DNA, 22 bp, Homo sapiens
tttctgcaagtgtagataccca

SEQ ID NO: 9254206 - DNA, 22 bp, Homo sapiens
tttctgcacatttctaaagttg

SEQ ID NO: 9254207 - DNA, 22 bp, Homo sapiens
tttctgcaaacttccacgtctc

SEQ ID NO: 9254208 - DNA, 22 bp, Homo sapiens
tttctgcaaaataaatagtgac

SEQ ID NO: 9254209 - DNA, 22 bp, Homo sapiens
tttctgattctcactttggcat

SEQ ID NO: 9254210 - DNA, 22 bp, Homo sapiens
tttctgatttgacttgaagtat

SEQ ID NO: 9254211 - DNA, 22 bp, Homo sapiens
ctctagctgaggtcactgctat

SEQ ID NO: 9254212 - DNA, 22 bp, Homo sapiens
ctctaggctgcccaggagctga

SEQ ID NO: 9254213 - DNA, 22 bp, Homo sapiens
ctctagcttttgataccagtgt

SEQ ID NO: 9254214 - DNA, 22 bp, Homo sapiens
ctctactcttaacacagctagg

SEQ ID NO: 9254215 - DNA, 22 bp, Homo sapiens
tttctctattaggggctagctt

SEQ ID NO: 9254216 - DNA, 22 bp, Homo sapiens
tttctctattaggggctagctt

SEQ ID NO: 9254217 - DNA, 22 bp, Homo sapiens
ctctctggacttgagtatcagc

SEQ ID NO: 9254218 - DNA, 22 bp, Homo sapiens
ctctctggacttgagtatcagc

SEQ ID NO: 9254219 - DNA, 20 bp, Homo sapiens
ctctctggaaggtgggagcc

SEQ ID NO: 9254220 - DNA, 22 bp, Homo sapiens
ctctctggaagggggagctgat

SEQ ID NO: 9254221 - DNA, 22 bp, Homo sapiens
ctctctggaagggggagctgat

SEQ ID NO: 9254222 - DNA, 23 bp, Homo sapiens
tttctctgagaagcagttctcta

SEQ ID NO: 9254223 - DNA, 22 bp, Homo sapiens
tttctctccccaagtggaattg

SEQ ID NO: 9254224 - DNA, 22 bp, Homo sapiens
tttctctcagcctgtagaaact

SEQ ID NO: 9254225 - DNA, 19 bp, Homo sapiens
tttctctccctcatcccga

SEQ ID NO: 9254226 - DNA, 22 bp, Homo sapiens
tttctctctacagtactttcat

SEQ ID NO: 9254227 - DNA, 22 bp, Homo sapiens
tttctctctacagtactttcat

SEQ ID NO: 9254228 - DNA, 22 bp, Homo sapiens
tttctctctggccctgattgtc

SEQ ID NO: 9254229 - DNA, 23 bp, Homo sapiens
tttctctgagaagcagttctcta

SEQ ID NO: 9254230 - DNA, 22 bp, Homo sapiens
tttctctcttaaggagtttaaa

SEQ ID NO: 9254231 - DNA, 23 bp, Homo sapiens
tttctctgagaagcagttctcta

SEQ ID NO: 9254232 - DNA, 22 bp, Homo sapiens
tttctctcttaaggagtttaaa

SEQ ID NO: 9254233 - DNA, 18 bp, Homo sapiens
tttatatggatagagacc

SEQ ID NO: 9254234 - DNA, 22 bp, Homo sapiens
tttatatgaaagtgaccagtgg

SEQ ID NO: 9254235 - DNA, 22 bp, Homo sapiens
tttatatgtttgtacaattaag

SEQ ID NO: 9254236 - DNA, 22 bp, Homo sapiens
tttatatgtttgtacaattaag

SEQ ID NO: 9254237 - DNA, 22 bp, Homo sapiens
tttatatgtgaaggtttgcaga

SEQ ID NO: 9254238 - DNA, 23 bp, Homo sapiens
ctcctggagggtccggccctgcc

SEQ ID NO: 9254239 - DNA, 22 bp, Homo sapiens
ctcctggacatggagcggagga

SEQ ID NO: 9254240 - DNA, 22 bp, Homo sapiens
tttacacaaaagatagcacacc

SEQ ID NO: 9254241 - DNA, 22 bp, Homo sapiens
tttacaattggttttctctaat

SEQ ID NO: 9254242 - DNA, 22 bp, Homo sapiens
tttacaattctctaccagtgtt

SEQ ID NO: 9254243 - DNA, 22 bp, Homo sapiens
tttacaattggttttctctaat

SEQ ID NO: 9254244 - DNA, 22 bp, Homo sapiens
tttacaatagggtctgaatgaa

SEQ ID NO: 9254245 - DNA, 22 bp, Homo sapiens
ctcctcagttgtcccatggaga

SEQ ID NO: 9254246 - DNA, 20 bp, Homo sapiens
ctcctcagttccatgggagg

SEQ ID NO: 9254247 - DNA, 22 bp, Homo sapiens
ctcctgagctctgaggaagctt

SEQ ID NO: 9254248 - DNA, 22 bp, Homo sapiens
tttacacagaggacactgggct

SEQ ID NO: 9254249 - DNA, 22 bp, Homo sapiens
tttatattacctggaatagctt

SEQ ID NO: 9254250 - DNA, 22 bp, Homo sapiens
tttatatgtttgtacaattaag

SEQ ID NO: 9254251 - DNA, 22 bp, Homo sapiens
tttatattacctggaatagctt

SEQ ID NO: 9254252 - DNA, 22 bp, Homo sapiens
ctcctgtatgttgggcttcaca

SEQ ID NO: 9254253 - DNA, 22 bp, Homo sapiens
ctcctggttcctgtcttaaata

SEQ ID NO: 9254254 - DNA, 22 bp, Homo sapiens
ctcctgggcttcgaaggctccc

SEQ ID NO: 9254255 - DNA, 22 bp, Homo sapiens
ctcctgtcaataggctcctggc

SEQ ID NO: 9254256 - DNA, 22 bp, Homo sapiens
ctcctgtcaataggctcctggc

SEQ ID NO: 9254257 - DNA, 22 bp, Homo sapiens
ctcctgtcaataggctcctggc

SEQ ID NO: 9254258 - DNA, 22 bp, Homo sapiens
ctcctgtcagaagcatcctgag

SEQ ID NO: 9254259 - DNA, 22 bp, Homo sapiens
ctcctgtcagaagcatcctgag

SEQ ID NO: 9254260 - DNA, 22 bp, Homo sapiens
ctcctgtggtcaagggtgggac

SEQ ID NO: 9254261 - DNA, 22 bp, Homo sapiens
tttcaaagtcaagaaggatact

SEQ ID NO: 9254262 - DNA, 22 bp, Homo sapiens
ctcctgtcccggggaccgccga

SEQ ID NO: 9254263 - DNA, 22 bp, Homo sapiens
ctcctgtgcatgcatctcccta

SEQ ID NO: 9254264 - DNA, 20 bp, Homo sapiens
ctcctgtgcctctctgggcc

SEQ ID NO: 9254265 - DNA, 22 bp, Homo sapiens
ctcctgtggctttctgatttca

SEQ ID NO: 9254266 - DNA, 22 bp, Homo sapiens
ctctaaatccaaataagtgtcc

SEQ ID NO: 9254267 - DNA, 22 bp, Homo sapiens
ctctaaatccacggtatagttg

SEQ ID NO: 9254268 - DNA, 21 bp, Homo sapiens
ctctacattcccagcaactct

SEQ ID NO: 9254269 - DNA, 22 bp, Homo sapiens
ctctacagctgctgcccctggt

SEQ ID NO: 9254270 - DNA, 22 bp, Homo sapiens
ctccttcctggttagcacctta

SEQ ID NO: 9254271 - DNA, 22 bp, Homo sapiens
ctccttcctggttagcacctta

SEQ ID NO: 9254272 - DNA, 22 bp, Homo sapiens
ctccttctcctcgggaggccag

SEQ ID NO: 9254273 - DNA, 22 bp, Homo sapiens
ctcgtgatccgcccacctcagc

SEQ ID NO: 9254274 - DNA, 22 bp, Homo sapiens
ctcgttgctgaagccaaagtca

SEQ ID NO: 9254275 - DNA, 22 bp, Homo sapiens
tttcaaagttgggaattgtaat

SEQ ID NO: 9254276 - DNA, 22 bp, Homo sapiens
tttcaaagttgggaattgtaat

SEQ ID NO: 9254277 - DNA, 22 bp, Homo sapiens
tttcaaataccataaacctaat

SEQ ID NO: 9254278 - DNA, 22 bp, Homo sapiens
tttcaaataccataaacctaat

SEQ ID NO: 9254279 - DNA, 22 bp, Homo sapiens
tttcaaataccataaacctaat

SEQ ID NO: 9254280 - DNA, 22 bp, Homo sapiens
tttcaaagttgggaattgtaat

SEQ ID NO: 9254281 - DNA, 22 bp, Homo sapiens
tttcaaagtggagaattagaca

SEQ ID NO: 9254282 - DNA, 22 bp, Homo sapiens
tttcaaagtcaatatcattacc

SEQ ID NO: 9254283 - DNA, 22 bp, Homo sapiens
tttcaaatggagtcgtgaaatg

SEQ ID NO: 9254284 - DNA, 22 bp, Homo sapiens
tttcaaatagaatctttccaaa

SEQ ID NO: 9254285 - DNA, 21 bp, Homo sapiens
ctcctcaggaccagccacagg

SEQ ID NO: 9254286 - DNA, 22 bp, Homo sapiens
ctcctcagtcaggtctagggtc

SEQ ID NO: 9254287 - DNA, 19 bp, Homo sapiens
ctcctcagtcccagaggtc

SEQ ID NO: 9254288 - DNA, 22 bp, Homo sapiens
ctcccttcaggagaggctcaca

SEQ ID NO: 9254289 - DNA, 22 bp, Homo sapiens
ctccctggtctttcccatcatt

SEQ ID NO: 9254290 - DNA, 22 bp, Homo sapiens
ctccctggggctcctcctattt

SEQ ID NO: 9254291 - DNA, 22 bp, Homo sapiens
ctccctggtgtcccctccagga

SEQ ID NO: 9254292 - DNA, 22 bp, Homo sapiens
ctccctgggcagatgtggctct

SEQ ID NO: 9254293 - DNA, 22 bp, Homo sapiens
ctccctgggcagatgtggctct

SEQ ID NO: 9254294 - DNA, 22 bp, Homo sapiens
ctccctggctttgtcctgaggc

SEQ ID NO: 9254295 - DNA, 23 bp, Homo sapiens
ctccctggagtttctggaagatg

SEQ ID NO: 9254296 - DNA, 22 bp, Homo sapiens
ctccctggcacagcgagaggtt

SEQ ID NO: 9254297 - DNA, 22 bp, Homo sapiens
ctccctggcacagcgagaggtt

SEQ ID NO: 9254298 - DNA, 22 bp, Homo sapiens
ctccctggcagccgcactcctg

SEQ ID NO: 9254299 - DNA, 22 bp, Homo sapiens
ctccctggaggtgagctggcac

SEQ ID NO: 9254300 - DNA, 22 bp, Homo sapiens
ctccctggaggcccagacctgg

SEQ ID NO: 9254301 - DNA, 22 bp, Homo sapiens
ctccctggaggcccagacctgg

SEQ ID NO: 9254302 - DNA, 22 bp, Homo sapiens
ctccctgcttgtttcccttcag

SEQ ID NO: 9254303 - DNA, 22 bp, Homo sapiens
ttgtttaatatcgtgaagtact

SEQ ID NO: 9254304 - DNA, 22 bp, Homo sapiens
ctccccaggttcaggaggtggg

SEQ ID NO: 9254305 - DNA, 22 bp, Homo sapiens
ctccccaggttcaggaggtggg

SEQ ID NO: 9254306 - DNA, 22 bp, Homo sapiens
ctccccagcattctgacttcct

SEQ ID NO: 9254307 - DNA, 22 bp, Homo sapiens
ctccccagcattctgacttcct

SEQ ID NO: 9254308 - DNA, 22 bp, Homo sapiens
ctccccagctcgcgggtgacgg

SEQ ID NO: 9254309 - DNA, 22 bp, Homo sapiens
ttgtttcagcccagatctttac

SEQ ID NO: 9254310 - DNA, 22 bp, Homo sapiens
ctccctcacaaagcattctctt

SEQ ID NO: 9254311 - DNA, 22 bp, Homo sapiens
ttgtttcaaatatttcagaata

SEQ ID NO: 9254312 - DNA, 22 bp, Homo sapiens
ttgtttcaaatatttcagaata

SEQ ID NO: 9254313 - DNA, 22 bp, Homo sapiens
ttgtttatgtgttgtctatggc

SEQ ID NO: 9254314 - DNA, 22 bp, Homo sapiens
ctcccagggccatcgagtcact

SEQ ID NO: 9254315 - DNA, 22 bp, Homo sapiens
ctcaggctctggccatccaagg

SEQ ID NO: 9254316 - DNA, 22 bp, Homo sapiens
ctcaggctctgtactccctttg

SEQ ID NO: 9254317 - DNA, 22 bp, Homo sapiens
ctcaggctccagacttccgtcc

SEQ ID NO: 9254318 - DNA, 22 bp, Homo sapiens
ctcaggctctggccatccaagg

SEQ ID NO: 9254319 - DNA, 22 bp, Homo sapiens
ctcaggctgccctgacagcccc

SEQ ID NO: 9254320 - DNA, 21 bp, Homo sapiens
ctcaggctggcagcaggctag

SEQ ID NO: 9254321 - DNA, 22 bp, Homo sapiens
ctcaggctgtgatgtgatggca

SEQ ID NO: 9254322 - DNA, 22 bp, Homo sapiens
ctcaggctgtctaatggattag

SEQ ID NO: 9254323 - DNA, 22 bp, Homo sapiens
ctcagggaagctatggtgaggg

SEQ ID NO: 9254324 - DNA, 22 bp, Homo sapiens
ctcaggctgtgatgtgatggca

SEQ ID NO: 9254325 - DNA, 22 bp, Homo sapiens
cgtcccagttccagccgcgctg

SEQ ID NO: 9254326 - DNA, 20 bp, Homo sapiens
cgtccccttgagcaggtccc

SEQ ID NO: 9254327 - DNA, 22 bp, Homo sapiens
cgtcccctcgttcccactttgg

SEQ ID NO: 9254328 - DNA, 22 bp, Homo sapiens
cgtccagggcgggctcccctca

SEQ ID NO: 9254329 - DNA, 22 bp, Homo sapiens
cgtcatcacggcaagcatctcc

SEQ ID NO: 9254330 - DNA, 22 bp, Homo sapiens
cgtcatcacggcaagcatctcc

SEQ ID NO: 9254331 - DNA, 22 bp, Homo sapiens
cgtctagacagtttccaaaaga

SEQ ID NO: 9254332 - DNA, 22 bp, Homo sapiens
cgtcccgggttcacgccattct

SEQ ID NO: 9254333 - DNA, 22 bp, Homo sapiens
ttccagaaatctttcagctcaa

SEQ ID NO: 9254334 - DNA, 22 bp, Homo sapiens
ttccactggctttcagtgatct

SEQ ID NO: 9254335 - DNA, 22 bp, Homo sapiens
ttccactgattttggttgacct

SEQ ID NO: 9254336 - DNA, 22 bp, Homo sapiens
ttcctcctacgcttatcacttt

SEQ ID NO: 9254337 - DNA, 17 bp, Homo sapiens
ttcctcctcaccatgtt

SEQ ID NO: 9254338 - DNA, 22 bp, Homo sapiens
ttcctccagcctggagcacttc

SEQ ID NO: 9254339 - DNA, 22 bp, Homo sapiens
ttcctccagcctggagcacttc

SEQ ID NO: 9254340 - DNA, 22 bp, Homo sapiens
ttcctaacaaacttcagtgaat

SEQ ID NO: 9254341 - DNA, 22 bp, Homo sapiens
cgtgaaatgagttgaattattg

SEQ ID NO: 9254342 - DNA, 21 bp, Homo sapiens
ttcctctgcaactgatgctca

SEQ ID NO: 9254343 - DNA, 22 bp, Homo sapiens
ttcctctgaaatggcttggaaa

SEQ ID NO: 9254344 - DNA, 22 bp, Homo sapiens
ttcctccttgtcctagttactg

SEQ ID NO: 9254345 - DNA, 22 bp, Homo sapiens
cgcagcagccccgtggtaggtg

SEQ ID NO: 9254346 - DNA, 22 bp, Homo sapiens
ttcagtttcaaatcctgtgaag

SEQ ID NO: 9254347 - DNA, 22 bp, Homo sapiens
ttcagtttccacttacatttaa

SEQ ID NO: 9254348 - DNA, 22 bp, Homo sapiens
ttcagtttcagtcttgcaaaaa

SEQ ID NO: 9254349 - DNA, 22 bp, Homo sapiens
ttcagtttcagtcttgcaaaaa

SEQ ID NO: 9254350 - DNA, 22 bp, Homo sapiens
ttcagtttcgttatctatgaga

SEQ ID NO: 9254351 - DNA, 22 bp, Homo sapiens
ttcagtttctaaagatgttcct

SEQ ID NO: 9254352 - DNA, 22 bp, Homo sapiens
ttcagtttcgttatctatgaga

SEQ ID NO: 9254353 - DNA, 22 bp, Homo sapiens
ttcagtttcgttatctatgaga

SEQ ID NO: 9254354 - DNA, 22 bp, Homo sapiens
ttcagtttcgttatctatgaga

SEQ ID NO: 9254355 - DNA, 22 bp, Homo sapiens
ttcagtttccctaaagccaatt

SEQ ID NO: 9254356 - DNA, 22 bp, Homo sapiens
ttcagtttccctaaagccaatt

SEQ ID NO: 9254357 - DNA, 22 bp, Homo sapiens
ttcagtttgaattctgtagaac

SEQ ID NO: 9254358 - DNA, 22 bp, Homo sapiens
ttcagtttgaattctgtagaac

SEQ ID NO: 9254359 - DNA, 22 bp, Homo sapiens
ttcagtttgaattctgtagaac

SEQ ID NO: 9254360 - DNA, 22 bp, Homo sapiens
ttcagtttgaattctgtagaac

SEQ ID NO: 9254361 - DNA, 21 bp, Homo sapiens
ttcagtttcttcctcatctat

SEQ ID NO: 9254362 - DNA, 18 bp, Homo sapiens
ttcagtttctagttcctt

SEQ ID NO: 9254363 - DNA, 22 bp, Homo sapiens
ttcagtttcttccctgtgaaat

SEQ ID NO: 9254364 - DNA, 22 bp, Homo sapiens
cggctggtgtcgggcacagcaa

SEQ ID NO: 9254365 - DNA, 22 bp, Homo sapiens
cggctggtgtcgggcacagcaa

SEQ ID NO: 9254366 - DNA, 22 bp, Homo sapiens
cggctgggttcggctgcaggcc

SEQ ID NO: 9254367 - DNA, 22 bp, Homo sapiens
cggctggtgtcgggcacagcaa

SEQ ID NO: 9254368 - DNA, 22 bp, Homo sapiens
ttccaaattaaaatgtacaatg

SEQ ID NO: 9254369 - DNA, 22 bp, Homo sapiens
ttccaaattaaaatgtacaatg

SEQ ID NO: 9254370 - DNA, 22 bp, Homo sapiens
cgggagcacgggaggcggagct

SEQ ID NO: 9254371 - DNA, 22 bp, Homo sapiens
ctaaattatcatgagaattatg

SEQ ID NO: 9254372 - DNA, 22 bp, Homo sapiens
ctaactacaagcggggcatcct

SEQ ID NO: 9254373 - DNA, 22 bp, Homo sapiens
ctaacgaatatgtatgcatgtt

SEQ ID NO: 9254374 - DNA, 22 bp, Homo sapiens
ctaacgaaatacctcagacttt

SEQ ID NO: 9254375 - DNA, 22 bp, Homo sapiens
ttccttttgcaaggtcctctag

SEQ ID NO: 9254376 - DNA, 22 bp, Homo sapiens
ctacatcagaacatttacccta

SEQ ID NO: 9254377 - DNA, 22 bp, Homo sapiens
ctacatcacttaattcttagaa

SEQ ID NO: 9254378 - DNA, 22 bp, Homo sapiens
ctacatggagaagaaaattctt

SEQ ID NO: 9254379 - DNA, 22 bp, Homo sapiens
ctacattaaattggcttactta

SEQ ID NO: 9254380 - DNA, 18 bp, Homo sapiens
ctacattcataggaaagg

SEQ ID NO: 9254381 - DNA, 22 bp, Homo sapiens
ctacataatctggatttgtctg

SEQ ID NO: 9254382 - DNA, 22 bp, Homo sapiens
ctacatcaagtaatcttcaaaa

SEQ ID NO: 9254383 - DNA, 22 bp, Homo sapiens
ctacagtgtcgtgtggtttctg

SEQ ID NO: 9254384 - DNA, 22 bp, Homo sapiens
ctacagtgaagactagctatag

SEQ ID NO: 9254385 - DNA, 22 bp, Homo sapiens
ttctacctcctagaaaatctgg

SEQ ID NO: 9254386 - DNA, 22 bp, Homo sapiens
ttctacctcagtttcccactta

SEQ ID NO: 9254387 - DNA, 22 bp, Homo sapiens
ttctacatttaaaaggaaaatc

SEQ ID NO: 9254388 - DNA, 22 bp, Homo sapiens
ttctacatatatttttctcact

SEQ ID NO: 9254389 - DNA, 22 bp, Homo sapiens
ttctacatgagaaaatgtattt

SEQ ID NO: 9254390 - DNA, 22 bp, Homo sapiens
ttctacatgagaaaatgtattt

SEQ ID NO: 9254391 - DNA, 22 bp, Homo sapiens
ttctacatggttgctcagaggg

SEQ ID NO: 9254392 - DNA, 22 bp, Homo sapiens
ttctacattgtgaagttcttta

SEQ ID NO: 9254393 - DNA, 22 bp, Homo sapiens
ttctcctgcgcaggcccaggga

SEQ ID NO: 9254394 - DNA, 22 bp, Homo sapiens
ttctcctggagtgcttgttggg

SEQ ID NO: 9254395 - DNA, 22 bp, Homo sapiens
ttctcctgcccttggacttcca

SEQ ID NO: 9254396 - DNA, 22 bp, Homo sapiens
ttctcattctgactcagtgtag

SEQ ID NO: 9254397 - DNA, 19 bp, Homo sapiens
ttctcattcctttccactt

SEQ ID NO: 9254398 - DNA, 22 bp, Homo sapiens
ttctcatgaaactcgcttcctc

SEQ ID NO: 9254399 - DNA, 22 bp, Homo sapiens
ttctcatgatgcaattcatccc

SEQ ID NO: 9254400 - DNA, 22 bp, Homo sapiens
ttctcatgatgcaattcatccc

SEQ ID NO: 9254401 - DNA, 22 bp, Homo sapiens
ttctcatgaaactcgcttcctc

SEQ ID NO: 9254402 - DNA, 22 bp, Homo sapiens
ttctcatgtaaatgccatcatc

SEQ ID NO: 9254403 - DNA, 22 bp, Homo sapiens
ttctcatggtgtctttatacat

SEQ ID NO: 9254404 - DNA, 22 bp, Homo sapiens
ttctcattctgactcagtgtag

SEQ ID NO: 9254405 - DNA, 22 bp, Homo sapiens
ttctatttttgtggaactgtag

SEQ ID NO: 9254406 - DNA, 22 bp, Homo sapiens
ctacatttacacagttaggctt

SEQ ID NO: 9254407 - DNA, 22 bp, Homo sapiens
ctacattctgggaaatcagatg

SEQ ID NO: 9254408 - DNA, 22 bp, Homo sapiens
ttctcagtttcactgataacag

SEQ ID NO: 9254409 - DNA, 22 bp, Homo sapiens
ttctcagtttcactgataacag

SEQ ID NO: 9254410 - DNA, 22 bp, Homo sapiens
ttctcagtagttagcatttgtg

SEQ ID NO: 9254411 - DNA, 22 bp, Homo sapiens
ttctcagtattacatgctaatg

SEQ ID NO: 9254412 - DNA, 19 bp, Homo sapiens
ctagggcttggcagcaggc

SEQ ID NO: 9254413 - DNA, 22 bp, Homo sapiens
ttctccttggtttatgggacat

SEQ ID NO: 9254414 - DNA, 22 bp, Homo sapiens
ttctccttgttcccttcaattg

SEQ ID NO: 9254415 - DNA, 22 bp, Homo sapiens
ttctccttgaaaagctgcatct

SEQ ID NO: 9254416 - DNA, 22 bp, Homo sapiens
ttctccttgaaaagctgcatct

SEQ ID NO: 9254417 - DNA, 22 bp, Homo sapiens
ttctccttcctggttttcaggc

SEQ ID NO: 9254418 - DNA, 22 bp, Homo sapiens
ttctccttattcatagttgtct

SEQ ID NO: 9254419 - DNA, 22 bp, Homo sapiens
ttctcctggggccgtgatgtga

SEQ ID NO: 9254420 - DNA, 22 bp, Homo sapiens
ctagtgtttggaagtcatagcc

SEQ ID NO: 9254421 - DNA, 22 bp, Homo sapiens
ctagtgtttattaatcatgagg

SEQ ID NO: 9254422 - DNA, 22 bp, Homo sapiens
ctagtgtttattaatcatgagg

SEQ ID NO: 9254423 - DNA, 22 bp, Homo sapiens
ctagtgtttattaacataattc

SEQ ID NO: 9254424 - DNA, 22 bp, Homo sapiens
ctagttctagatccctgaggaa

SEQ ID NO: 9254425 - DNA, 22 bp, Homo sapiens
ctagttctaaatctgttgtcca

SEQ ID NO: 9254426 - DNA, 22 bp, Homo sapiens
ctagtggaaactaactggaatt

SEQ ID NO: 9254427 - DNA, 22 bp, Homo sapiens
ctagtgaacgtggtactatgga

SEQ ID NO: 9254428 - DNA, 22 bp, Homo sapiens
ctagtttaaagcagctgaaagg

SEQ ID NO: 9254429 - DNA, 22 bp, Homo sapiens
ctagttgtttaatattgattga

SEQ ID NO: 9254430 - DNA, 22 bp, Homo sapiens
ctagttctcctgaaatgtttgg

SEQ ID NO: 9254431 - DNA, 22 bp, Homo sapiens
ctagttctgccattcagtgtca

SEQ ID NO: 9254432 - DNA, 22 bp, Homo sapiens
ctagttcttaactgttatgatt

SEQ ID NO: 9254433 - DNA, 22 bp, Homo sapiens
ctcagaaaacctctttcttgat

SEQ ID NO: 9254434 - DNA, 20 bp, Homo sapiens
ctcagaaaagctaaggagaa

SEQ ID NO: 9254435 - DNA, 22 bp, Homo sapiens
ctcactgtctgtactagctgat

SEQ ID NO: 9254436 - DNA, 22 bp, Homo sapiens
ctcactggcaagactacaggtg

SEQ ID NO: 9254437 - DNA, 22 bp, Homo sapiens
ctcactgcaagctctgcctccc

SEQ ID NO: 9254438 - DNA, 22 bp, Homo sapiens
ctcactgcaagctctgcctcca

SEQ ID NO: 9254439 - DNA, 22 bp, Homo sapiens
ctcactgcaagctccgcctccc

SEQ ID NO: 9254440 - DNA, 22 bp, Homo sapiens
ctcactgcaagttccacctacc

SEQ ID NO: 9254441 - DNA, 22 bp, Homo sapiens
ctcactggcaagactacaggtg

SEQ ID NO: 9254442 - DNA, 22 bp, Homo sapiens
ctcactgccctgaagttgggtt

SEQ ID NO: 9254443 - DNA, 22 bp, Homo sapiens
ttgaatcattacaatagataag

SEQ ID NO: 9254444 - DNA, 22 bp, Homo sapiens
ttgaatctatgtattcagtgta

SEQ ID NO: 9254445 - DNA, 22 bp, Homo sapiens
ttgaagtttaatggtagattcc

SEQ ID NO: 9254446 - DNA, 22 bp, Homo sapiens
ttgaataaatgagcagtgaatt

SEQ ID NO: 9254447 - DNA, 22 bp, Homo sapiens
ttcttcccttcattccaccacc

SEQ ID NO: 9254448 - DNA, 22 bp, Homo sapiens
ttgaaatatggattgaccttga

SEQ ID NO: 9254449 - DNA, 22 bp, Homo sapiens
ttgaaatatcaagttattagtg

SEQ ID NO: 9254450 - DNA, 22 bp, Homo sapiens
ttgaagttgcacattataattt

SEQ ID NO: 9254451 - DNA, 22 bp, Homo sapiens
ttcttcatgctgttgctgcttg

SEQ ID NO: 9254452 - DNA, 22 bp, Homo sapiens
ttcttcatgggttcttttagga

SEQ ID NO: 9254453 - DNA, 22 bp, Homo sapiens
ttcttcatgctgttgctgcttg

SEQ ID NO: 9254454 - DNA, 22 bp, Homo sapiens
ttcttcattcccttacttccga

SEQ ID NO: 9254455 - DNA, 22 bp, Homo sapiens
ttctgaaaattgggtcatactt

SEQ ID NO: 9254456 - DNA, 22 bp, Homo sapiens
ttctgaaaattgggtcatactt

SEQ ID NO: 9254457 - DNA, 23 bp, Homo sapiens
ttctgaaaatagatagtggctcc

SEQ ID NO: 9254458 - DNA, 22 bp, Homo sapiens
ttctgaaaattgggtcatactt

SEQ ID NO: 9254459 - DNA, 22 bp, Homo sapiens
ttctgaaaccactgaccaacta

SEQ ID NO: 9254460 - DNA, 22 bp, Homo sapiens
ttctgaaaattgggtcatactt

SEQ ID NO: 9254461 - DNA, 20 bp, Homo sapiens
ttctgaaagcagcagaggga

SEQ ID NO: 9254462 - DNA, 22 bp, Homo sapiens
ttctgaaaccttcagtatgaag

SEQ ID NO: 9254463 - DNA, 20 bp, Homo sapiens
ttctgaaagcagcagaggga

SEQ ID NO: 9254464 - DNA, 20 bp, Homo sapiens
ttctgaaagcagcagaggga

SEQ ID NO: 9254465 - DNA, 22 bp, Homo sapiens
ttctgaaaccactgaccaacta

SEQ ID NO: 9254466 - DNA, 22 bp, Homo sapiens
ttctgaaaccactgaccaacta

SEQ ID NO: 9254467 - DNA, 22 bp, Homo sapiens
ttctgaaaacacactttgcagc

SEQ ID NO: 9254468 - DNA, 22 bp, Homo sapiens
ttctctttttgcatctcaacct

SEQ ID NO: 9254469 - DNA, 22 bp, Homo sapiens
ttctctttttgcatctcaacct

SEQ ID NO: 9254470 - DNA, 22 bp, Homo sapiens
ttctgaaataggagatagctgt

SEQ ID NO: 9254471 - DNA, 22 bp, Homo sapiens
ttctgaaatgagatataaggta

SEQ ID NO: 9254472 - DNA, 22 bp, Homo sapiens
ttctgaaataggagatagctgt

SEQ ID NO: 9254473 - DNA, 22 bp, Homo sapiens
ttctgaaagtctttttaagtta

SEQ ID NO: 9254474 - DNA, 22 bp, Homo sapiens
ttctgaaatgagatataaggta

SEQ ID NO: 9254475 - DNA, 22 bp, Homo sapiens
ttctgaaattcgactatccaat

SEQ ID NO: 9254476 - DNA, 22 bp, Homo sapiens
ttctgaaaggcaggttgtttgc

SEQ ID NO: 9254477 - DNA, 22 bp, Homo sapiens
ttctgaaaggcaggttgtttgc

SEQ ID NO: 9254478 - DNA, 22 bp, Homo sapiens
ttctgaaaggcatgtcaggtag

SEQ ID NO: 9254479 - DNA, 22 bp, Homo sapiens
ttctgaaagccaattcattgaa

SEQ ID NO: 9254480 - DNA, 22 bp, Homo sapiens
ttctgaaatttcaactttacta

SEQ ID NO: 9254481 - DNA, 22 bp, Homo sapiens
ttctgaaattcgactatccaat

SEQ ID NO: 9254482 - DNA, 22 bp, Homo sapiens
ttctgaaatttctgtagatctt

SEQ ID NO: 9254483 - DNA, 22 bp, Homo sapiens
ttctgtctccctgatgtagagc

SEQ ID NO: 9254484 - DNA, 22 bp, Homo sapiens
ttcttaaaattcaagctaggtt

SEQ ID NO: 9254485 - DNA, 20 bp, Homo sapiens
ttcttaaagacctcactttg

SEQ ID NO: 9254486 - DNA, 22 bp, Homo sapiens
ttcttaaaattcaagctaggtt

SEQ ID NO: 9254487 - DNA, 20 bp, Homo sapiens
ttcttaaagacctcactttg

SEQ ID NO: 9254488 - DNA, 22 bp, Homo sapiens
ttcttaaagaggcaaaacacag

SEQ ID NO: 9254489 - DNA, 22 bp, Homo sapiens
ttcttaaagaggcaaaacacag

SEQ ID NO: 9254490 - DNA, 22 bp, Homo sapiens
ttcttaaagaggcaaaacacag

SEQ ID NO: 9254491 - DNA, 22 bp, Homo sapiens
ttcttacaagtatgacgtagca

SEQ ID NO: 9254492 - DNA, 22 bp, Homo sapiens
ttcttaatacctattttctacc

SEQ ID NO: 9254493 - DNA, 22 bp, Homo sapiens
ttcttaatctgtgtgggttcga

SEQ ID NO: 9254494 - DNA, 22 bp, Homo sapiens
ttcttaatcccacaaatcttca

SEQ ID NO: 9254495 - DNA, 22 bp, Homo sapiens
ttcttacaaacaagatcattga

SEQ ID NO: 9254496 - DNA, 19 bp, Homo sapiens
ttcttacaacaccctggga

SEQ ID NO: 9254497 - DNA, 23 bp, Homo sapiens
ttcttacaaggctggcccacttg

SEQ ID NO: 9254498 - DNA, 19 bp, Homo sapiens
ttcttacaacaccctggga

SEQ ID NO: 9254499 - DNA, 23 bp, Homo sapiens
ttcttacaaggctggcccacttg

SEQ ID NO: 9254500 - DNA, 22 bp, Homo sapiens
ttgcactccagcccgagcaaca

SEQ ID NO: 9254501 - DNA, 22 bp, Homo sapiens
ttgccctgtggggcctccagcc

SEQ ID NO: 9254502 - DNA, 22 bp, Homo sapiens
ttgctgagcagtgtttaattgt

SEQ ID NO: 9254503 - DNA, 22 bp, Homo sapiens
ttgcactagacacatttcaagt

SEQ ID NO: 9254504 - DNA, 20 bp, Homo sapiens
ttgcacagagaaggaggcag

SEQ ID NO: 9254505 - DNA, 22 bp, Homo sapiens
ttgctggcttgaagatagagga

SEQ ID NO: 9254506 - DNA, 22 bp, Homo sapiens
ttgctgtagggggaaaatactt

SEQ ID NO: 9254507 - DNA, 22 bp, Homo sapiens
ctcaggctaagaaggccaagtg

SEQ ID NO: 9254508 - DNA, 22 bp, Homo sapiens
ttgctgatttccccttgagtgt

SEQ ID NO: 9254509 - DNA, 22 bp, Homo sapiens
ttgctgattctgtatttaaggt

SEQ ID NO: 9254510 - DNA, 22 bp, Homo sapiens
ttgctgatttgtttctattcca

SEQ ID NO: 9254511 - DNA, 22 bp, Homo sapiens
ttgctgataaaataaaccaaga

SEQ ID NO: 9254512 - DNA, 22 bp, Homo sapiens
ttgctgataccatgaatgttaa

SEQ ID NO: 9254513 - DNA, 22 bp, Homo sapiens
ttgctgagctttggcaaggaag

SEQ ID NO: 9254514 - DNA, 22 bp, Homo sapiens
ttgctgatggtattatgctagt

SEQ ID NO: 9254515 - DNA, 22 bp, Homo sapiens
ttgctgatggagggaatgctca

SEQ ID NO: 9254516 - DNA, 22 bp, Homo sapiens
ctcagccaggtgggggtcggga

SEQ ID NO: 9254517 - DNA, 22 bp, Homo sapiens
ctcagccagtgatctttccttt

SEQ ID NO: 9254518 - DNA, 22 bp, Homo sapiens
ctcagccatgcaacatgctggg

SEQ ID NO: 9254519 - DNA, 22 bp, Homo sapiens
ctcagccagacatgacccagtc

SEQ ID NO: 9254520 - DNA, 22 bp, Homo sapiens
ctcagccatgtcatgcctacct

SEQ ID NO: 9254521 - DNA, 22 bp, Homo sapiens
ctcagccatgcaacatgctggg

SEQ ID NO: 9254522 - DNA, 22 bp, Homo sapiens
ctcaggcccacagcagacccac

SEQ ID NO: 9254523 - DNA, 23 bp, Homo sapiens
ttgcaaaatgcaattgagttaga

SEQ ID NO: 9254524 - DNA, 23 bp, Homo sapiens
ttgcaaaatgagtcttgagtgaa

SEQ ID NO: 9254525 - DNA, 23 bp, Homo sapiens
ttgcaaaatgcaattgagttaga

SEQ ID NO: 9254526 - DNA, 22 bp, Homo sapiens
ttgcaaaagccgaggcactcca

SEQ ID NO: 9254527 - DNA, 22 bp, Homo sapiens
ttgcaaaagcaattgcagtttt

SEQ ID NO: 9254528 - DNA, 22 bp, Homo sapiens
ttgcaaaaccatcctaagtaaa

SEQ ID NO: 9254529 - DNA, 22 bp, Homo sapiens
ttgatttttttctactatgcgc

SEQ ID NO: 9254530 - DNA, 22 bp, Homo sapiens
ttgatattttgcacgcttggta

SEQ ID NO: 9254531 - DNA, 22 bp, Homo sapiens
ctcagaaacggagctgccattt

SEQ ID NO: 9254532 - DNA, 22 bp, Homo sapiens
ctcagaaagcaatctggtgagg

SEQ ID NO: 9254533 - DNA, 22 bp, Homo sapiens
ccttggcttgtgggctgcagcc

SEQ ID NO: 9254534 - DNA, 22 bp, Homo sapiens
ccttggcttccttccctctaga

SEQ ID NO: 9254535 - DNA, 22 bp, Homo sapiens
ttacctgcaactcccatggtga

SEQ ID NO: 9254536 - DNA, 22 bp, Homo sapiens
ttaccttgtaaaacatattcct

SEQ ID NO: 9254537 - DNA, 22 bp, Homo sapiens
ccttggcttaccttctgtgtgg

SEQ ID NO: 9254538 - DNA, 22 bp, Homo sapiens
ccttggctggaattactctggg

SEQ ID NO: 9254539 - DNA, 21 bp, Homo sapiens
ccttggctggcatctagcacc

SEQ ID NO: 9254540 - DNA, 22 bp, Homo sapiens
ccttggctggaattactctggg

SEQ ID NO: 9254541 - DNA, 22 bp, Homo sapiens
ccttggtgctctgctgggatgg

SEQ ID NO: 9254542 - DNA, 22 bp, Homo sapiens
ccttggtccaaccctgcacagc

SEQ ID NO: 9254543 - DNA, 22 bp, Homo sapiens
ccttggtttccaggatgaggct

SEQ ID NO: 9254544 - DNA, 22 bp, Homo sapiens
ccttggttttaccaggtgttca

SEQ ID NO: 9254545 - DNA, 22 bp, Homo sapiens
ccttgggtgtttaatagatata

SEQ ID NO: 9254546 - DNA, 22 bp, Homo sapiens
ccttgggttccaagtcactgaa

SEQ ID NO: 9254547 - DNA, 22 bp, Homo sapiens
ccttgtgtttacacctgtcttt

SEQ ID NO: 9254548 - DNA, 22 bp, Homo sapiens
cctttaaatggatgttcaactg

SEQ ID NO: 9254549 - DNA, 18 bp, Homo sapiens
ttatggctgtgaaagagt

SEQ ID NO: 9254550 - DNA, 18 bp, Homo sapiens
ttatggctgtgaaagagt

SEQ ID NO: 9254551 - DNA, 22 bp, Homo sapiens
ttatggcttctgtgaagaattt

SEQ ID NO: 9254552 - DNA, 22 bp, Homo sapiens
ttatctacgtatttaaactctt

SEQ ID NO: 9254553 - DNA, 22 bp, Homo sapiens
ttatctacgtatttaaactctt

SEQ ID NO: 9254554 - DNA, 22 bp, Homo sapiens
cctttaaatggatgttcaactg

SEQ ID NO: 9254555 - DNA, 22 bp, Homo sapiens
cctttaatttacaatgttaatt

SEQ ID NO: 9254556 - DNA, 23 bp, Homo sapiens
ccttctgttaaccatctgggggg

SEQ ID NO: 9254557 - DNA, 22 bp, Homo sapiens
ccttctgtctccctcatattga

SEQ ID NO: 9254558 - DNA, 22 bp, Homo sapiens
ccttctggatgtgctaaggaag

SEQ ID NO: 9254559 - DNA, 22 bp, Homo sapiens
ccttctgtgtgcccacgtttat

SEQ ID NO: 9254560 - DNA, 22 bp, Homo sapiens
ccttctgagcttcaatttcagt

SEQ ID NO: 9254561 - DNA, 22 bp, Homo sapiens
ccttctgataactgtgaaattg

SEQ ID NO: 9254562 - DNA, 22 bp, Homo sapiens
ccttctgatactgacatcattt

SEQ ID NO: 9254563 - DNA, 21 bp, Homo sapiens
ccttctcttgcttcagcttca

SEQ ID NO: 9254564 - DNA, 22 bp, Homo sapiens
ccttctgctccctggccagggc

SEQ ID NO: 9254565 - DNA, 22 bp, Homo sapiens
ttaccattccatgacatcagga

SEQ ID NO: 9254566 - DNA, 22 bp, Homo sapiens
ttaccattcaagttctctcctt

SEQ ID NO: 9254567 - DNA, 22 bp, Homo sapiens
ttaccattattaggtggacttg

SEQ ID NO: 9254568 - DNA, 22 bp, Homo sapiens
ttaccattttataagttaaagt

SEQ ID NO: 9254569 - DNA, 22 bp, Homo sapiens
ttacctaaaatagctcaattta

SEQ ID NO: 9254570 - DNA, 22 bp, Homo sapiens
ttaccaagctctgcatgttaag

SEQ ID NO: 9254571 - DNA, 22 bp, Homo sapiens
ttaccaagctctgcatgttaag

SEQ ID NO: 9254572 - DNA, 22 bp, Homo sapiens
ttaccaagctctgcatgttaag

SEQ ID NO: 9254573 - DNA, 22 bp, Homo sapiens
ttaccacacttatttacattgg

SEQ ID NO: 9254574 - DNA, 22 bp, Homo sapiens
ttaccataaagtttatctttct

SEQ ID NO: 9254575 - DNA, 22 bp, Homo sapiens
ttaccacagtgcctgtctaatg

SEQ ID NO: 9254576 - DNA, 20 bp, Homo sapiens
ccttctctggaattgcctcc

SEQ ID NO: 9254577 - DNA, 21 bp, Homo sapiens
ccttctcttgcttcagcttca

SEQ ID NO: 9254578 - DNA, 21 bp, Homo sapiens
ccttctcttgcttcagcttca

SEQ ID NO: 9254579 - DNA, 22 bp, Homo sapiens
ttacagaagagtaacttggcaa

SEQ ID NO: 9254580 - DNA, 22 bp, Homo sapiens
ttacagaaggaacactactcag

SEQ ID NO: 9254581 - DNA, 22 bp, Homo sapiens
ttacagaaaatgtgttttaact

SEQ ID NO: 9254582 - DNA, 20 bp, Homo sapiens
ttacagaaatgatgttattt

SEQ ID NO: 9254583 - DNA, 22 bp, Homo sapiens
ttacagaactgtcttgaaattt

SEQ ID NO: 9254584 - DNA, 22 bp, Homo sapiens
ttattattttgtgtacagcaaa

SEQ ID NO: 9254585 - DNA, 22 bp, Homo sapiens
ttattattttgtgtacagcaaa

SEQ ID NO: 9254586 - DNA, 22 bp, Homo sapiens
ttattattgtgacctgagaatg

SEQ ID NO: 9254587 - DNA, 22 bp, Homo sapiens
cgcaccactgaattccagcctg

SEQ ID NO: 9254588 - DNA, 22 bp, Homo sapiens
ttattattgtggttgcattatc

SEQ ID NO: 9254589 - DNA, 22 bp, Homo sapiens
ttattattgtggttgcattatc

SEQ ID NO: 9254590 - DNA, 22 bp, Homo sapiens
ttatttttaaaagttcacacag

SEQ ID NO: 9254591 - DNA, 23 bp, Homo sapiens
ttattttgtcagaagggactttt

SEQ ID NO: 9254592 - DNA, 22 bp, Homo sapiens
ttatttcatgtaaaatttatgt

SEQ ID NO: 9254593 - DNA, 22 bp, Homo sapiens
ttattcactcatttaacattat

SEQ ID NO: 9254594 - DNA, 22 bp, Homo sapiens
ttattcactcattaaagcagga

SEQ ID NO: 9254595 - DNA, 22 bp, Homo sapiens
ttattcaccagtgtaaaacact

SEQ ID NO: 9254596 - DNA, 22 bp, Homo sapiens
cgcaccactgaattccagcctg

SEQ ID NO: 9254597 - DNA, 22 bp, Homo sapiens
cgcaccactgaattccagcctg

SEQ ID NO: 9254598 - DNA, 22 bp, Homo sapiens
cgcagaagaggttgtctagtcc

SEQ ID NO: 9254599 - DNA, 22 bp, Homo sapiens
ttcaaaacagctagatattgga

SEQ ID NO: 9254600 - DNA, 21 bp, Homo sapiens
cgcagagcgaacttgcggcgc

SEQ ID NO: 9254601 - DNA, 22 bp, Homo sapiens
cgcagagggcaggcagtgctgg

SEQ ID NO: 9254602 - DNA, 22 bp, Homo sapiens
cgcagagggcaggcagtgctgg

SEQ ID NO: 9254603 - DNA, 22 bp, Homo sapiens
ttatttttaaaagttcacacag

SEQ ID NO: 9254604 - DNA, 22 bp, Homo sapiens
ttatttttaaaagttcacacag

SEQ ID NO: 9254605 - DNA, 22 bp, Homo sapiens
ttatttttaaaagttcacacag

SEQ ID NO: 9254606 - DNA, 22 bp, Homo sapiens
ttatttttaaaagttcacacag

SEQ ID NO: 9254607 - DNA, 17 bp, Homo sapiens
ttattttttgggctgag

SEQ ID NO: 9254608 - DNA, 17 bp, Homo sapiens
ttattttttgggctgag

SEQ ID NO: 9254609 - DNA, 22 bp, Homo sapiens
ttcaaaaaggtatgttcaagtc

SEQ ID NO: 9254610 - DNA, 22 bp, Homo sapiens
ttcaaaaaggtatgttcaagtc

SEQ ID NO: 9254611 - DNA, 22 bp, Homo sapiens
ttcaaaaaggtatgttcaagtc

SEQ ID NO: 9254612 - DNA, 22 bp, Homo sapiens
cgagcagaatggagggtgccga

SEQ ID NO: 9254613 - DNA, 22 bp, Homo sapiens
cgagcagaagcctggtggtctg

SEQ ID NO: 9254614 - DNA, 22 bp, Homo sapiens
cgagcagagcagagacgtctgg

SEQ ID NO: 9254615 - DNA, 22 bp, Homo sapiens
cgaggtagtggcggccgcggcc

SEQ ID NO: 9254616 - DNA, 17 bp, Homo sapiens
cgagggcttgctggctc

SEQ ID NO: 9254617 - DNA, 22 bp, Homo sapiens
cgcaactcagcaacttaactgc

SEQ ID NO: 9254618 - DNA, 22 bp, Homo sapiens
cgcaccactgaattccagcctg

SEQ ID NO: 9254619 - DNA, 22 bp, Homo sapiens
cgcaccactgaattccagcctg

SEQ ID NO: 9254620 - DNA, 22 bp, Homo sapiens
cgatgggggcagtgttacattg

SEQ ID NO: 9254621 - DNA, 22 bp, Homo sapiens
cgatggtatcggccagccccgg

SEQ ID NO: 9254622 - DNA, 18 bp, Homo sapiens
cgatgtgtatgtgatttg

SEQ ID NO: 9254623 - DNA, 22 bp, Homo sapiens
ttatgggagcaattggggaggt

SEQ ID NO: 9254624 - DNA, 22 bp, Homo sapiens
ttatgtaatttgtttgctcttc

SEQ ID NO: 9254625 - DNA, 22 bp, Homo sapiens
ttatgtaagtggagtcatatag

SEQ ID NO: 9254626 - DNA, 22 bp, Homo sapiens
ttatgtacctgaattagtaaag

SEQ ID NO: 9254627 - DNA, 22 bp, Homo sapiens
ttatgtacctgaattagtaaag

SEQ ID NO: 9254628 - DNA, 20 bp, Homo sapiens
cctttctggagtgctgttca

SEQ ID NO: 9254629 - DNA, 22 bp, Homo sapiens
cctttctgacagtgatgggggg

SEQ ID NO: 9254630 - DNA, 22 bp, Homo sapiens
cctttctgatggcctcccagcc

SEQ ID NO: 9254631 - DNA, 22 bp, Homo sapiens
cctttctggtatttaaccaaag

SEQ ID NO: 9254632 - DNA, 22 bp, Homo sapiens
cctttctgtgttgccctatttg

SEQ ID NO: 9254633 - DNA, 22 bp, Homo sapiens
ttatgtatgaatatagtagaag

SEQ ID NO: 9254634 - DNA, 22 bp, Homo sapiens
cctttgccatgacatggcacaa

SEQ ID NO: 9254635 - DNA, 22 bp, Homo sapiens
cctttgcattctagatgtttag

SEQ ID NO: 9254636 - DNA, 19 bp, Homo sapiens
cctttgaatcaggacactt

SEQ ID NO: 9254637 - DNA, 22 bp, Homo sapiens
ttacaagtatttaagatgctgt

SEQ ID NO: 9254638 - DNA, 22 bp, Homo sapiens
ttacaagtatttaagatgctgt

SEQ ID NO: 9254639 - DNA, 22 bp, Homo sapiens
cctgtggcgggggccagtgcct

SEQ ID NO: 9254640 - DNA, 22 bp, Homo sapiens
cctgtggctctctttggaggtc

SEQ ID NO: 9254641 - DNA, 22 bp, Homo sapiens
ttacaagtttctggcttcatcc

SEQ ID NO: 9254642 - DNA, 22 bp, Homo sapiens
ttacaagtgtcaggtactggca

SEQ ID NO: 9254643 - DNA, 22 bp, Homo sapiens
ttacaatagttccttcttttgt

SEQ ID NO: 9254644 - DNA, 22 bp, Homo sapiens
ttacaatagttccttcttttgt

SEQ ID NO: 9254645 - DNA, 22 bp, Homo sapiens
ttacaataccacatcacctcat

SEQ ID NO: 9254646 - DNA, 22 bp, Homo sapiens
ttacaatagttccttcttttgt

SEQ ID NO: 9254647 - DNA, 22 bp, Homo sapiens
ttaatctcttagcaaattaatg

SEQ ID NO: 9254648 - DNA, 22 bp, Homo sapiens
ttaatcttatatgtaaaggtaa

SEQ ID NO: 9254649 - DNA, 22 bp, Homo sapiens
ttaatgcagctctaccacacag

SEQ ID NO: 9254650 - DNA, 21 bp, Homo sapiens
ttaatgctatgcagaaaatct

SEQ ID NO: 9254651 - DNA, 21 bp, Homo sapiens
cctgtggattttaaaattgga

SEQ ID NO: 9254652 - DNA, 22 bp, Homo sapiens
ttaatagatttgattttaaagg

SEQ ID NO: 9254653 - DNA, 22 bp, Homo sapiens
ttaatatacaattttacgggct

SEQ ID NO: 9254654 - DNA, 22 bp, Homo sapiens
ttaatatgttgaaatttattag

SEQ ID NO: 9254655 - DNA, 19 bp, Homo sapiens
ttaagctaagatactagta

SEQ ID NO: 9254656 - DNA, 22 bp, Homo sapiens
ttaagctaattagttccagcat

SEQ ID NO: 9254657 - DNA, 22 bp, Homo sapiens
tgttttctattacctgagattg

SEQ ID NO: 9254658 - DNA, 22 bp, Homo sapiens
tgttttctattacctgagattg

SEQ ID NO: 9254659 - DNA, 22 bp, Homo sapiens
tgttttctagaaacaatgccta

SEQ ID NO: 9254660 - DNA, 22 bp, Homo sapiens
tgttttctagaaacaatgccta

SEQ ID NO: 9254661 - DNA, 22 bp, Homo sapiens
ttaaaatagccagtgcccctct

SEQ ID NO: 9254662 - DNA, 22 bp, Homo sapiens
ttaaaatagccagtgcccctct

SEQ ID NO: 9254663 - DNA, 23 bp, Homo sapiens
ttaaaagtggagagagaagctgg

SEQ ID NO: 9254664 - DNA, 22 bp, Homo sapiens
ttaaaagtctgatgatttacat

SEQ ID NO: 9254665 - DNA, 22 bp, Homo sapiens
ttaaaagtctgatgatttacat

SEQ ID NO: 9254666 - DNA, 22 bp, Homo sapiens
ttaaaatgaatattgattagca

SEQ ID NO: 9254667 - DNA, 22 bp, Homo sapiens
ttaaaatctaaagcagttgtct

SEQ ID NO: 9254668 - DNA, 22 bp, Homo sapiens
ttaaaatagccagtgcccctct

SEQ ID NO: 9254669 - DNA, 22 bp, Homo sapiens
ttaaaatagccagtgcccctct

SEQ ID NO: 9254670 - DNA, 22 bp, Homo sapiens
ttaaaatgcagattatgactca

SEQ ID NO: 9254671 - DNA, 21 bp, Homo sapiens
ttaaaatgaggaagtggtggc

SEQ ID NO: 9254672 - DNA, 22 bp, Homo sapiens
ttaaaatgaatattgattagca

SEQ ID NO: 9254673 - DNA, 22 bp, Homo sapiens
ttaaaatgaatattgattagca

SEQ ID NO: 9254674 - DNA, 22 bp, Homo sapiens
ttaaaatgaatattgattagca

SEQ ID NO: 9254675 - DNA, 22 bp, Homo sapiens
tgtttctatctggatcaataga

SEQ ID NO: 9254676 - DNA, 22 bp, Homo sapiens
tgtttctagagaaaatatttac

SEQ ID NO: 9254677 - DNA, 22 bp, Homo sapiens
cctggggattctgacacggagt

SEQ ID NO: 9254678 - DNA, 22 bp, Homo sapiens
cctggggagccgcctgagcccc

SEQ ID NO: 9254679 - DNA, 22 bp, Homo sapiens
cctggggagagaaagcccagcc

SEQ ID NO: 9254680 - DNA, 21 bp, Homo sapiens
tgttttctaaagggcggatca

SEQ ID NO: 9254681 - DNA, 22 bp, Homo sapiens
tgttttcctcctggtttctgcc

SEQ ID NO: 9254682 - DNA, 21 bp, Homo sapiens
tgttttctaaagggcggatca

SEQ ID NO: 9254683 - DNA, 17 bp, Homo sapiens
tgttttcattcattgct

SEQ ID NO: 9254684 - DNA, 22 bp, Homo sapiens
tgttttcatttgatgtaacaaa

SEQ ID NO: 9254685 - DNA, 21 bp, Homo sapiens
tgttttccaccttgaggcaag

SEQ ID NO: 9254686 - DNA, 17 bp, Homo sapiens
tgttttcattcattgct

SEQ ID NO: 9254687 - DNA, 22 bp, Homo sapiens
tgttttcatggttatgtgtcta

SEQ ID NO: 9254688 - DNA, 22 bp, Homo sapiens
tgttttcatcacagaatgtaac

SEQ ID NO: 9254689 - DNA, 22 bp, Homo sapiens
tgtttcttatccaagtggtctg

SEQ ID NO: 9254690 - DNA, 20 bp, Homo sapiens
tgtttctgacggtaggagag

SEQ ID NO: 9254691 - DNA, 22 bp, Homo sapiens
tgtttcttctcacacaaactca

SEQ ID NO: 9254692 - DNA, 22 bp, Homo sapiens
tgtttcttctcacacaaactca

SEQ ID NO: 9254693 - DNA, 22 bp, Homo sapiens
tgtttcttctcacacaaactca

SEQ ID NO: 9254694 - DNA, 19 bp, Homo sapiens
tgtttcttcctccatctga

SEQ ID NO: 9254695 - DNA, 23 bp, Homo sapiens
cctgctcaggcgtgtgccctgct

SEQ ID NO: 9254696 - DNA, 22 bp, Homo sapiens
cctgctcagccccagctcaccc

SEQ ID NO: 9254697 - DNA, 22 bp, Homo sapiens
cctgctcagccccagctcaccc

SEQ ID NO: 9254698 - DNA, 22 bp, Homo sapiens
cctgctcagagcgtcttgtgtg

SEQ ID NO: 9254699 - DNA, 22 bp, Homo sapiens
tggttcctacgcacattgaatt

SEQ ID NO: 9254700 - DNA, 22 bp, Homo sapiens
tggttcattgagaagactgaag

SEQ ID NO: 9254701 - DNA, 22 bp, Homo sapiens
tggttcctcaagcgctggcggc

SEQ ID NO: 9254702 - DNA, 22 bp, Homo sapiens
tgttgcccaggttctctcctgc

SEQ ID NO: 9254703 - DNA, 22 bp, Homo sapiens
tgttgcccaggttctctcctgc

SEQ ID NO: 9254704 - DNA, 22 bp, Homo sapiens
tgttgctgacaagagaggagca

SEQ ID NO: 9254705 - DNA, 22 bp, Homo sapiens
tgttgctaaggggaatgagagc

SEQ ID NO: 9254706 - DNA, 20 bp, Homo sapiens
tgttgctctctcctgagttt

SEQ ID NO: 9254707 - DNA, 22 bp, Homo sapiens
tgttgcctggggaagctctgat

SEQ ID NO: 9254708 - DNA, 22 bp, Homo sapiens
tgttgattagtgtttagactta

SEQ ID NO: 9254709 - DNA, 22 bp, Homo sapiens
tgttgatttgtgggctgcaaaa

SEQ ID NO: 9254710 - DNA, 22 bp, Homo sapiens
tgttcccaagataagattatga

SEQ ID NO: 9254711 - DNA, 17 bp, Homo sapiens
tattgacctttgtatgt

SEQ ID NO: 9254712 - DNA, 22 bp, Homo sapiens
tattgaccagactgacacacat

SEQ ID NO: 9254713 - DNA, 22 bp, Homo sapiens
tattgacatttttatagcttga

SEQ ID NO: 9254714 - DNA, 22 bp, Homo sapiens
tattgagaccagtgcttgctta

SEQ ID NO: 9254715 - DNA, 22 bp, Homo sapiens
tattgagttacagaaaatactt

SEQ ID NO: 9254716 - DNA, 20 bp, Homo sapiens
tattgagtacctactgtata

SEQ ID NO: 9254717 - DNA, 22 bp, Homo sapiens
tattgaggtgcttagctggggg

SEQ ID NO: 9254718 - DNA, 22 bp, Homo sapiens
tattgatctggatatttagaca

SEQ ID NO: 9254719 - DNA, 22 bp, Homo sapiens
tattcacattctcaggcctggt

SEQ ID NO: 9254720 - DNA, 22 bp, Homo sapiens
tattcacatgtacatatgctca

SEQ ID NO: 9254721 - DNA, 22 bp, Homo sapiens
tattcacatgaaaacaaatttt

SEQ ID NO: 9254722 - DNA, 22 bp, Homo sapiens
tattcacatgaaaacaaatttt

SEQ ID NO: 9254723 - DNA, 22 bp, Homo sapiens
tattcacatgtacatatgctca

SEQ ID NO: 9254724 - DNA, 22 bp, Homo sapiens
tattcacaggctggagtgatgt

SEQ ID NO: 9254725 - DNA, 22 bp, Homo sapiens
tattcacaggctggagtgatgt

SEQ ID NO: 9254726 - DNA, 22 bp, Homo sapiens
tattcacagctgccgcactcag

SEQ ID NO: 9254727 - DNA, 22 bp, Homo sapiens
tattcacaaaatgaggtcctca

SEQ ID NO: 9254728 - DNA, 22 bp, Homo sapiens
tattcacaaaatgaggtcctca

SEQ ID NO: 9254729 - DNA, 22 bp, Homo sapiens
tattcacaggcacgaaatattg

SEQ ID NO: 9254730 - DNA, 22 bp, Homo sapiens
tattcacaggcacgaaatattg

SEQ ID NO: 9254731 - DNA, 22 bp, Homo sapiens
tattcaaagtaccttcattgcc

SEQ ID NO: 9254732 - DNA, 22 bp, Homo sapiens
tatgctttaacattaaacaaca

SEQ ID NO: 9254733 - DNA, 22 bp, Homo sapiens
tatgtgtttgacaccctgcaag

SEQ ID NO: 9254734 - DNA, 22 bp, Homo sapiens
tatgtgtttgacaccctgcaag

SEQ ID NO: 9254735 - DNA, 22 bp, Homo sapiens
tatgctaactgggggaaaagag

SEQ ID NO: 9254736 - DNA, 22 bp, Homo sapiens
tatgctaaatatgttcacattg

SEQ ID NO: 9254737 - DNA, 22 bp, Homo sapiens
tatgctaattgttagtcacatg

SEQ ID NO: 9254738 - DNA, 22 bp, Homo sapiens
tatgctaatgacactctagaaa

SEQ ID NO: 9254739 - DNA, 22 bp, Homo sapiens
tatgctaagataaacagagtta

SEQ ID NO: 9254740 - DNA, 22 bp, Homo sapiens
tatgctaagtgagaaaagacag

SEQ ID NO: 9254741 - DNA, 22 bp, Homo sapiens
tatgccactgctctccatccta

SEQ ID NO: 9254742 - DNA, 22 bp, Homo sapiens
tatgtttaaatgtatgtgtatg

SEQ ID NO: 9254743 - DNA, 22 bp, Homo sapiens
tatgtttaaatgtatgtgtatg

SEQ ID NO: 9254744 - DNA, 22 bp, Homo sapiens
tatgtttacgctggtagaatta

SEQ ID NO: 9254745 - DNA, 22 bp, Homo sapiens
tatgttgcaccaacctaataat

SEQ ID NO: 9254746 - DNA, 22 bp, Homo sapiens
tatgttgcaccaacctaataat

SEQ ID NO: 9254747 - DNA, 22 bp, Homo sapiens
tatgttctgtctgtacagattt

SEQ ID NO: 9254748 - DNA, 22 bp, Homo sapiens
tatgttctgactctacatggga

SEQ ID NO: 9254749 - DNA, 22 bp, Homo sapiens
tatgttctctgctctaggatgt

SEQ ID NO: 9254750 - DNA, 22 bp, Homo sapiens
tatgttctgactctacatggga

SEQ ID NO: 9254751 - DNA, 22 bp, Homo sapiens
tatgttcatgcttatgcagaat

SEQ ID NO: 9254752 - DNA, 22 bp, Homo sapiens
tatgttcatctggtgcatcagt

SEQ ID NO: 9254753 - DNA, 22 bp, Homo sapiens
tatgttattttcatacaacaga

SEQ ID NO: 9254754 - DNA, 22 bp, Homo sapiens
tatgttattttcatacaacaga

SEQ ID NO: 9254755 - DNA, 22 bp, Homo sapiens
tatgttcagaagaagaatgggg

SEQ ID NO: 9254756 - DNA, 22 bp, Homo sapiens
tatgttcatagaaatcatgacc

SEQ ID NO: 9254757 - DNA, 22 bp, Homo sapiens
tatgttaagtgggataatcaaa

SEQ ID NO: 9254758 - DNA, 22 bp, Homo sapiens
tatgttaagtgggataatcaaa

SEQ ID NO: 9254759 - DNA, 22 bp, Homo sapiens
tatgttacaaagtttttctaaa

SEQ ID NO: 9254760 - DNA, 22 bp, Homo sapiens
tatgttactcacatgttcttgc

SEQ ID NO: 9254761 - DNA, 22 bp, Homo sapiens
tatgttattttcatacaacaga

SEQ ID NO: 9254762 - DNA, 22 bp, Homo sapiens
tattttcatcttgtccttggat

SEQ ID NO: 9254763 - DNA, 22 bp, Homo sapiens
tattttcatcttgtccttggat

SEQ ID NO: 9254764 - DNA, 22 bp, Homo sapiens
tattttcatcttgtccttggat

SEQ ID NO: 9254765 - DNA, 22 bp, Homo sapiens
tattttcattctgtgtgactgt

SEQ ID NO: 9254766 - DNA, 22 bp, Homo sapiens
tattttcattctgtgtgactgt

SEQ ID NO: 9254767 - DNA, 22 bp, Homo sapiens
tattttcaccttctctggatat

SEQ ID NO: 9254768 - DNA, 22 bp, Homo sapiens
tattttcaccatgtatccctgt

SEQ ID NO: 9254769 - DNA, 22 bp, Homo sapiens
tatttgttgagttgttatgtct

SEQ ID NO: 9254770 - DNA, 22 bp, Homo sapiens
tatttgttgagttgttatgtct

SEQ ID NO: 9254771 - DNA, 22 bp, Homo sapiens
tatttgtatttcatgcagtaaa

SEQ ID NO: 9254772 - DNA, 22 bp, Homo sapiens
tatttgtatttcatgcagtaaa

SEQ ID NO: 9254773 - DNA, 23 bp, Homo sapiens
tatttgtctcttaccactgctgt

SEQ ID NO: 9254774 - DNA, 22 bp, Homo sapiens
tatttgtatttcatgcagtaaa

SEQ ID NO: 9254775 - DNA, 22 bp, Homo sapiens
tatttgtatgtgtgtacatata

SEQ ID NO: 9254776 - DNA, 22 bp, Homo sapiens
tatttgtatgtgtgtacatata

SEQ ID NO: 9254777 - DNA, 22 bp, Homo sapiens
tatttctaagctgtaagtctga

SEQ ID NO: 9254778 - DNA, 22 bp, Homo sapiens
tatttctaagctgtaagtctga

SEQ ID NO: 9254779 - DNA, 22 bp, Homo sapiens
tatttctaagagatatctgtac

SEQ ID NO: 9254780 - DNA, 22 bp, Homo sapiens
tatttctaagagatatctgtac

SEQ ID NO: 9254781 - DNA, 22 bp, Homo sapiens
tatttccttgagacggagtctc

SEQ ID NO: 9254782 - DNA, 22 bp, Homo sapiens
tatttcctgtggatacttttag

SEQ ID NO: 9254783 - DNA, 22 bp, Homo sapiens
tatttcctgcatggtgatgtaa

SEQ ID NO: 9254784 - DNA, 22 bp, Homo sapiens
tatttccatgttagaactaagt

SEQ ID NO: 9254785 - DNA, 23 bp, Homo sapiens
tattgcacacatagaaacataga

SEQ ID NO: 9254786 - DNA, 22 bp, Homo sapiens
tattgcagacaaaatgagctac

SEQ ID NO: 9254787 - DNA, 22 bp, Homo sapiens
tattgcatattgtacttgaatg

SEQ ID NO: 9254788 - DNA, 22 bp, Homo sapiens
tattgtacatggttatgcagga

SEQ ID NO: 9254789 - DNA, 22 bp, Homo sapiens
tattgtacatttcaaagtagct

SEQ ID NO: 9254790 - DNA, 22 bp, Homo sapiens
tatttcacataccacagagtgt

SEQ ID NO: 9254791 - DNA, 22 bp, Homo sapiens
tatttcacagcagctcatttaa

SEQ ID NO: 9254792 - DNA, 22 bp, Homo sapiens
tatttcaacgtatgaaaagctg

SEQ ID NO: 9254793 - DNA, 22 bp, Homo sapiens
tatttcaacgtatgaaaagctg

SEQ ID NO: 9254794 - DNA, 22 bp, Homo sapiens
tatttcaagaacttctatccat

SEQ ID NO: 9254795 - DNA, 22 bp, Homo sapiens
tatttcactcagtataccatag

SEQ ID NO: 9254796 - DNA, 22 bp, Homo sapiens
tatttcagcaagaagaatgtgg

SEQ ID NO: 9254797 - DNA, 22 bp, Homo sapiens
tagttaattctttaagaacaag

SEQ ID NO: 9254798 - DNA, 22 bp, Homo sapiens
tagttaatgtgaggcacctagt

SEQ ID NO: 9254799 - DNA, 22 bp, Homo sapiens
tagttaaagagatccacattcc

SEQ ID NO: 9254800 - DNA, 22 bp, Homo sapiens
tagttaaagccctaaattgata

SEQ ID NO: 9254801 - DNA, 22 bp, Homo sapiens
tagttaaagccctaaattgata

SEQ ID NO: 9254802 - DNA, 22 bp, Homo sapiens
tagttaaagccctaaattgata

SEQ ID NO: 9254803 - DNA, 22 bp, Homo sapiens
tagtgtttagtacatatgcata

SEQ ID NO: 9254804 - DNA, 20 bp, Homo sapiens
tatactaacatatatctgtt

SEQ ID NO: 9254805 - DNA, 22 bp, Homo sapiens
tatactctgagaaacgtgtcac

SEQ ID NO: 9254806 - DNA, 22 bp, Homo sapiens
tatagaagagacatgtgcatag

SEQ ID NO: 9254807 - DNA, 22 bp, Homo sapiens
tatagaagtaagcattgtgatg

SEQ ID NO: 9254808 - DNA, 22 bp, Homo sapiens
tatactttcctgcaactttgat

SEQ ID NO: 9254809 - DNA, 22 bp, Homo sapiens
tatactttcctgcaactttgat

SEQ ID NO: 9254810 - DNA, 22 bp, Homo sapiens
tatactttcctgcaactttgat

SEQ ID NO: 9254811 - DNA, 22 bp, Homo sapiens
tatacttatgctaaaaaatgtt

SEQ ID NO: 9254812 - DNA, 22 bp, Homo sapiens
tatagacttggcatgcatgttc

SEQ ID NO: 9254813 - DNA, 22 bp, Homo sapiens
tatagactagcagcagaattta

SEQ ID NO: 9254814 - DNA, 22 bp, Homo sapiens
tatatgcttgggaaatggtaga

SEQ ID NO: 9254815 - DNA, 22 bp, Homo sapiens
tatatggatagtgatcataaga

SEQ ID NO: 9254816 - DNA, 22 bp, Homo sapiens
tatattatcataaaaccattca

SEQ ID NO: 9254817 - DNA, 22 bp, Homo sapiens
tatattcaacaggctaatgtca

SEQ ID NO: 9254818 - DNA, 22 bp, Homo sapiens
tatattacctgcctgatctata

SEQ ID NO: 9254819 - DNA, 22 bp, Homo sapiens
tatattaacacccacttgcctc

SEQ ID NO: 9254820 - DNA, 22 bp, Homo sapiens
tatattaaatgaccagttttaa

SEQ ID NO: 9254821 - DNA, 22 bp, Homo sapiens
tatattaacacccacttgcctc

SEQ ID NO: 9254822 - DNA, 20 bp, Homo sapiens
tatatgtgtacatacacaca

SEQ ID NO: 9254823 - DNA, 22 bp, Homo sapiens
tatatgtttttctaattaggga

SEQ ID NO: 9254824 - DNA, 22 bp, Homo sapiens
tatattaaaccctctctgtagg

SEQ ID NO: 9254825 - DNA, 22 bp, Homo sapiens
tatattaaagtgctttgcagtg

SEQ ID NO: 9254826 - DNA, 22 bp, Homo sapiens
tatcaacattaatattttctgg

SEQ ID NO: 9254827 - DNA, 22 bp, Homo sapiens
tatcaacattaatattttctgg

SEQ ID NO: 9254828 - DNA, 22 bp, Homo sapiens
tatcaagagtctctacattaat

SEQ ID NO: 9254829 - DNA, 22 bp, Homo sapiens
tatcaagagtctctacattaat

SEQ ID NO: 9254830 - DNA, 22 bp, Homo sapiens
tatcaatacatgttatcagtgt

SEQ ID NO: 9254831 - DNA, 22 bp, Homo sapiens
tatcacaattcctatagtttgt

SEQ ID NO: 9254832 - DNA, 22 bp, Homo sapiens
tatctataagtactaacatggt

SEQ ID NO: 9254833 - DNA, 22 bp, Homo sapiens
tatctagatggattttagtgaa

SEQ ID NO: 9254834 - DNA, 22 bp, Homo sapiens
tatctgttggctcctagttgta

SEQ ID NO: 9254835 - DNA, 22 bp, Homo sapiens
tatctgttctgcttgattttga

SEQ ID NO: 9254836 - DNA, 19 bp, Homo sapiens
tatatttgttgaataaaaa

SEQ ID NO: 9254837 - DNA, 22 bp, Homo sapiens
tatcaaaaggagttgaaagggg

SEQ ID NO: 9254838 - DNA, 18 bp, Homo sapiens
tatatttcacacatattc

SEQ ID NO: 9254839 - DNA, 18 bp, Homo sapiens
tatatttcacacatattc

SEQ ID NO: 9254840 - DNA, 22 bp, Homo sapiens
tatatttaaatccaggttgaaa

SEQ ID NO: 9254841 - DNA, 22 bp, Homo sapiens
tatatttaaatccaggttgaaa

SEQ ID NO: 9254842 - DNA, 22 bp, Homo sapiens
tatcttcagctgaagcagagtc

SEQ ID NO: 9254843 - DNA, 20 bp, Homo sapiens
tatcttactttagtcatttg

SEQ ID NO: 9254844 - DNA, 22 bp, Homo sapiens
tatcttagggaattaactaaaa

SEQ ID NO: 9254845 - DNA, 22 bp, Homo sapiens
tatcttcaatttattcaaggag

SEQ ID NO: 9254846 - DNA, 22 bp, Homo sapiens
tatcttaaatgcatgatagaca

SEQ ID NO: 9254847 - DNA, 22 bp, Homo sapiens
tatctttctgtcctagattctg

SEQ ID NO: 9254848 - DNA, 22 bp, Homo sapiens
tatctttctgtcctagattctg

SEQ ID NO: 9254849 - DNA, 22 bp, Homo sapiens
tatctttagaggaagagaatct

SEQ ID NO: 9254850 - DNA, 22 bp, Homo sapiens
tatctttagaggaagagaatct

SEQ ID NO: 9254851 - DNA, 22 bp, Homo sapiens
tatctttagaggaagagaatct

SEQ ID NO: 9254852 - DNA, 22 bp, Homo sapiens
tatcttgcctttaactgctcat

SEQ ID NO: 9254853 - DNA, 22 bp, Homo sapiens
tatcttgagagacaacacagca

SEQ ID NO: 9254854 - DNA, 22 bp, Homo sapiens
tatctttaacttgcagtattta

SEQ ID NO: 9254855 - DNA, 22 bp, Homo sapiens
tatgcactggtactattcgtgt

SEQ ID NO: 9254856 - DNA, 22 bp, Homo sapiens
tatgcagtgagcactatttata

SEQ ID NO: 9254857 - DNA, 20 bp, Homo sapiens
tatgcagtatgtgtgtataa

SEQ ID NO: 9254858 - DNA, 22 bp, Homo sapiens
tatgagttcagttatcttaagt

SEQ ID NO: 9254859 - DNA, 22 bp, Homo sapiens
tatgagtttaaggctaaaatag

SEQ ID NO: 9254860 - DNA, 20 bp, Homo sapiens
tatgataattacaaaatagt

SEQ ID NO: 9254861 - DNA, 20 bp, Homo sapiens
tatgataattacaaaatagt

SEQ ID NO: 9254862 - DNA, 20 bp, Homo sapiens
tatgataattacaaaatagt

SEQ ID NO: 9254863 - DNA, 22 bp, Homo sapiens
tatgccactgctctccatccta

SEQ ID NO: 9254864 - DNA, 22 bp, Homo sapiens
tatgccactgctctccatccta

SEQ ID NO: 9254865 - DNA, 22 bp, Homo sapiens
tatgcatatgtgttcattggag

SEQ ID NO: 9254866 - DNA, 22 bp, Homo sapiens
tatgcatatagatgcacacaca

SEQ ID NO: 9254867 - DNA, 22 bp, Homo sapiens
tatgcataggtatctatactca

SEQ ID NO: 9254868 - DNA, 21 bp, Homo sapiens
tatgcagtttacttaggtatt

SEQ ID NO: 9254869 - DNA, 21 bp, Homo sapiens
tatgcagtttacttaggtatt

SEQ ID NO: 9254870 - DNA, 22 bp, Homo sapiens
tatgcagtgtacgatgtttagt

SEQ ID NO: 9254871 - DNA, 22 bp, Homo sapiens
tatgcagtggtatcattttaaa

SEQ ID NO: 9254872 - DNA, 22 bp, Homo sapiens
tagaagttcatgcgaattattt

SEQ ID NO: 9254873 - DNA, 22 bp, Homo sapiens
tagaataagttgatgatatatg

SEQ ID NO: 9254874 - DNA, 22 bp, Homo sapiens
tagaataagttgatgatatatg

SEQ ID NO: 9254875 - DNA, 23 bp, Homo sapiens
tagaatcctctgagatggaatag

SEQ ID NO: 9254876 - DNA, 22 bp, Homo sapiens
tagaatcatacctctaggaaca

SEQ ID NO: 9254877 - DNA, 22 bp, Homo sapiens
tactttctttcccaagaggtgg

SEQ ID NO: 9254878 - DNA, 22 bp, Homo sapiens
tactttcttgttcctttcataa

SEQ ID NO: 9254879 - DNA, 22 bp, Homo sapiens
tactttctttctgatccttatg

SEQ ID NO: 9254880 - DNA, 22 bp, Homo sapiens
tactttcttgttcctttcataa

SEQ ID NO: 9254881 - DNA, 22 bp, Homo sapiens
tagaagcaccactcatcacgtg

SEQ ID NO: 9254882 - DNA, 22 bp, Homo sapiens
tagaagcactgacagagtttga

SEQ ID NO: 9254883 - DNA, 22 bp, Homo sapiens
tagaagcagcaggactcatggt

SEQ ID NO: 9254884 - DNA, 22 bp, Homo sapiens
tactttctagctctccccagtt

SEQ ID NO: 9254885 - DNA, 22 bp, Homo sapiens
tactttctagctctccccagtt

SEQ ID NO: 9254886 - DNA, 22 bp, Homo sapiens
tactttcatgtctatacatatt

SEQ ID NO: 9254887 - DNA, 22 bp, Homo sapiens
tactttattgtaaatgctgatg

SEQ ID NO: 9254888 - DNA, 22 bp, Homo sapiens
tacttgcttggatttcaccaga

SEQ ID NO: 9254889 - DNA, 22 bp, Homo sapiens
tacttgctgttagtattttaca

SEQ ID NO: 9254890 - DNA, 22 bp, Homo sapiens
tacttgctgggtgtaattttct

SEQ ID NO: 9254891 - DNA, 23 bp, Homo sapiens
tagagcagggaaatctgtcagag

SEQ ID NO: 9254892 - DNA, 22 bp, Homo sapiens
tagagcagccttcagagcagtt

SEQ ID NO: 9254893 - DNA, 22 bp, Homo sapiens
tagagatggggtcttgctatga

SEQ ID NO: 9254894 - DNA, 22 bp, Homo sapiens
tagagatgccctagctgaagta

SEQ ID NO: 9254895 - DNA, 22 bp, Homo sapiens
tagagatgaattctgcagtctt

SEQ ID NO: 9254896 - DNA, 21 bp, Homo sapiens
tagagatgacgagctctagca

SEQ ID NO: 9254897 - DNA, 23 bp, Homo sapiens
tagaatctgtatttctgcagttc

SEQ ID NO: 9254898 - DNA, 22 bp, Homo sapiens
tagaatctggaaggggctattc

SEQ ID NO: 9254899 - DNA, 22 bp, Homo sapiens
tagagcagttggcagctgtatt

SEQ ID NO: 9254900 - DNA, 22 bp, Homo sapiens
tagagcagttggcagctgtatt

SEQ ID NO: 9254901 - DNA, 22 bp, Homo sapiens
tagagcagccttcagagcagtt

SEQ ID NO: 9254902 - DNA, 22 bp, Homo sapiens
tagagcatttagaggggcagga

SEQ ID NO: 9254903 - DNA, 22 bp, Homo sapiens
tagagctagcttcaaaatgcga

SEQ ID NO: 9254904 - DNA, 22 bp, Homo sapiens
tagagctatttagagcatttta

SEQ ID NO: 9254905 - DNA, 22 bp, Homo sapiens
tagagctgataatgaggccaag

SEQ ID NO: 9254906 - DNA, 22 bp, Homo sapiens
tagagctgataatgaggccaag

SEQ ID NO: 9254907 - DNA, 22 bp, Homo sapiens
tagaggagggctgttcttcagt

SEQ ID NO: 9254908 - DNA, 22 bp, Homo sapiens
tagagctgctggactgtaacag

SEQ ID NO: 9254909 - DNA, 22 bp, Homo sapiens
tagaggagagttgctggatgga

SEQ ID NO: 9254910 - DNA, 22 bp, Homo sapiens
tagaggagcggcgagctgagct

SEQ ID NO: 9254911 - DNA, 22 bp, Homo sapiens
tagatgaccttgtgttaggcaa

SEQ ID NO: 9254912 - DNA, 22 bp, Homo sapiens
tagatgaccttgtgttaggcaa

SEQ ID NO: 9254913 - DNA, 22 bp, Homo sapiens
tagatgatagggccagaatttg

SEQ ID NO: 9254914 - DNA, 22 bp, Homo sapiens
tagaggcaccctggaggagact

SEQ ID NO: 9254915 - DNA, 22 bp, Homo sapiens
tagatgattttcagtcaaagca

SEQ ID NO: 9254916 - DNA, 22 bp, Homo sapiens
tagatgctacaattttgtactc

SEQ ID NO: 9254917 - DNA, 22 bp, Homo sapiens
tagatgctgaaacatggaggcg

SEQ ID NO: 9254918 - DNA, 22 bp, Homo sapiens
tagatgctgtagaaatacttat

SEQ ID NO: 9254919 - DNA, 22 bp, Homo sapiens
tagatgtttgagaagtttatgt

SEQ ID NO: 9254920 - DNA, 22 bp, Homo sapiens
tagatgttttaactcttggtta

SEQ ID NO: 9254921 - DNA, 20 bp, Homo sapiens
tagatgtttcctgtcataaa

SEQ ID NO: 9254922 - DNA, 22 bp, Homo sapiens
tagatgtgagcccaggctgctt

SEQ ID NO: 9254923 - DNA, 22 bp, Homo sapiens
tagatttgtttccttctctcca

SEQ ID NO: 9254924 - DNA, 22 bp, Homo sapiens
tagattttaggagattttactg

SEQ ID NO: 9254925 - DNA, 22 bp, Homo sapiens
tagattttacttctgtcattac

SEQ ID NO: 9254926 - DNA, 22 bp, Homo sapiens
tagattttaggagattttactg

SEQ ID NO: 9254927 - DNA, 17 bp, Homo sapiens
tagcacagtgcctggta

SEQ ID NO: 9254928 - DNA, 22 bp, Homo sapiens
tagcacagtatttctcaactgg

SEQ ID NO: 9254929 - DNA, 22 bp, Homo sapiens
tagcacagtatttctcaactgg

SEQ ID NO: 9254930 - DNA, 17 bp, Homo sapiens
tagcacagtgcctggta

SEQ ID NO: 9254931 - DNA, 22 bp, Homo sapiens
tagcacaggtcttgttgccatt

SEQ ID NO: 9254932 - DNA, 22 bp, Homo sapiens
tagcacagagcttttaaacttc

SEQ ID NO: 9254933 - DNA, 22 bp, Homo sapiens
tagcacagagcttttaaacttc

SEQ ID NO: 9254934 - DNA, 18 bp, Homo sapiens
tagcacagagcaggatgt

SEQ ID NO: 9254935 - DNA, 22 bp, Homo sapiens
tagcacagcttcttgatgtcac

SEQ ID NO: 9254936 - DNA, 21 bp, Homo sapiens
tagcacagctgtagacagttt

SEQ ID NO: 9254937 - DNA, 22 bp, Homo sapiens
tagcacacgcattagcaaatca

SEQ ID NO: 9254938 - DNA, 18 bp, Homo sapiens
tagcacagagcaggatgt

SEQ ID NO: 9254939 - DNA, 22 bp, Homo sapiens
tagcacagacagaatggtcata

SEQ ID NO: 9254940 - DNA, 22 bp, Homo sapiens
tagcaaaaactgcagttacttt

SEQ ID NO: 9254941 - DNA, 22 bp, Homo sapiens
tagccaggcgaggtcagtgtcg

SEQ ID NO: 9254942 - DNA, 22 bp, Homo sapiens
tagccaggcgaggtcagtgtcg

SEQ ID NO: 9254943 - DNA, 22 bp, Homo sapiens
tagccaggcgaggtcagtgtcg

SEQ ID NO: 9254944 - DNA, 22 bp, Homo sapiens
tagccaggcctttgatcccggc

SEQ ID NO: 9254945 - DNA, 22 bp, Homo sapiens
tagccaggctgcagctgatccg

SEQ ID NO: 9254946 - DNA, 22 bp, Homo sapiens
tagccaggctgcagctgatccg

SEQ ID NO: 9254947 - DNA, 23 bp, Homo sapiens
tagccaggcccagcatggacacc

SEQ ID NO: 9254948 - DNA, 22 bp, Homo sapiens
tagccaggtcacactgtgtgtt

SEQ ID NO: 9254949 - DNA, 22 bp, Homo sapiens
tagccagggagacactgtggag

SEQ ID NO: 9254950 - DNA, 22 bp, Homo sapiens
tagccaggctgcagctgatccg

SEQ ID NO: 9254951 - DNA, 22 bp, Homo sapiens
tagcatttagaacaccttgaga

SEQ ID NO: 9254952 - DNA, 22 bp, Homo sapiens
tagcatttcactgatcttcact

SEQ ID NO: 9254953 - DNA, 22 bp, Homo sapiens
tagcatttcactgatcttcact

SEQ ID NO: 9254954 - DNA, 22 bp, Homo sapiens
tagccacatgcagactttcatg

SEQ ID NO: 9254955 - DNA, 22 bp, Homo sapiens
tagcacatctggcgcttatagg

SEQ ID NO: 9254956 - DNA, 22 bp, Homo sapiens
tagcacagttcctgactctttg

SEQ ID NO: 9254957 - DNA, 22 bp, Homo sapiens
tagcacataacttagaatagtt

SEQ ID NO: 9254958 - DNA, 22 bp, Homo sapiens
tagcacagttcctgactctttg

SEQ ID NO: 9254959 - DNA, 22 bp, Homo sapiens
tagcacagttcactatgataca

SEQ ID NO: 9254960 - DNA, 22 bp, Homo sapiens
tagcaccatacccggcagctcg

SEQ ID NO: 9254961 - DNA, 22 bp, Homo sapiens
tagcacctgtgcacaccaggca

SEQ ID NO: 9254962 - DNA, 22 bp, Homo sapiens
tagcagtgccctgtggaataag

SEQ ID NO: 9254963 - DNA, 22 bp, Homo sapiens
tagcagaaccagcagtcaattt

SEQ ID NO: 9254964 - DNA, 22 bp, Homo sapiens
tagcagggttttgaagagggtt

SEQ ID NO: 9254965 - DNA, 21 bp, Homo sapiens
tagcagaaacagttcaggcca

SEQ ID NO: 9254966 - DNA, 22 bp, Homo sapiens
tagcactatttttcactatcct

SEQ ID NO: 9254967 - DNA, 22 bp, Homo sapiens
tagcacctggtcaattcagtca

SEQ ID NO: 9254968 - DNA, 22 bp, Homo sapiens
tagcactacttaggtacagcca

SEQ ID NO: 9254969 - DNA, 22 bp, Homo sapiens
tagcactatcttgggatttgga

SEQ ID NO: 9254970 - DNA, 22 bp, Homo sapiens
tagcactatttttcactatcct

SEQ ID NO: 9254971 - DNA, 22 bp, Homo sapiens
tagcactatatgttagctatta

SEQ ID NO: 9254972 - DNA, 22 bp, Homo sapiens
taggctgacttgtttcataaag

SEQ ID NO: 9254973 - DNA, 22 bp, Homo sapiens
taggctgagcttgtagatcgta

SEQ ID NO: 9254974 - DNA, 22 bp, Homo sapiens
taggctgagctaagagagctta

SEQ ID NO: 9254975 - DNA, 22 bp, Homo sapiens
taggctgaggttgatgccaggg

SEQ ID NO: 9254976 - DNA, 22 bp, Homo sapiens
taggctgctcaccaggctcaga

SEQ ID NO: 9254977 - DNA, 22 bp, Homo sapiens
taggctggaacttaggcagagg

SEQ ID NO: 9254978 - DNA, 22 bp, Homo sapiens
taggctggaacttaggcagagg

SEQ ID NO: 9254979 - DNA, 22 bp, Homo sapiens
taggctggaggaagcagtgcct

SEQ ID NO: 9254980 - DNA, 22 bp, Homo sapiens
taggctgggaagaaagattctc

SEQ ID NO: 9254981 - DNA, 22 bp, Homo sapiens
taggctggaggaagcagtgcct

SEQ ID NO: 9254982 - DNA, 22 bp, Homo sapiens
taggctggaacttaggcagagg

SEQ ID NO: 9254983 - DNA, 22 bp, Homo sapiens
taggctggaacttaggcagagg

SEQ ID NO: 9254984 - DNA, 22 bp, Homo sapiens
taggctggaggaagcagtgcct

SEQ ID NO: 9254985 - DNA, 22 bp, Homo sapiens
taggtttactgaattagtggaa

SEQ ID NO: 9254986 - DNA, 22 bp, Homo sapiens
taggtgtgggctcaggaatgtg

SEQ ID NO: 9254987 - DNA, 22 bp, Homo sapiens
taggctgggaagaaagattctc

SEQ ID NO: 9254988 - DNA, 22 bp, Homo sapiens
taggctgggagcctgaggctag

SEQ ID NO: 9254989 - DNA, 22 bp, Homo sapiens
taggctgggagcctgaggctag

SEQ ID NO: 9254990 - DNA, 22 bp, Homo sapiens
taggttttcctaaaattctggt

SEQ ID NO: 9254991 - DNA, 22 bp, Homo sapiens
tagtaaaagtttagttgaaagt

SEQ ID NO: 9254992 - DNA, 22 bp, Homo sapiens
tagtaaacaggcaagggaccac

SEQ ID NO: 9254993 - DNA, 22 bp, Homo sapiens
tagtagcagggggtacctctca

SEQ ID NO: 9254994 - DNA, 22 bp, Homo sapiens
tagtagcaaaactcatctcttt

SEQ ID NO: 9254995 - DNA, 22 bp, Homo sapiens
tagtacttatctctgtcattgt

SEQ ID NO: 9254996 - DNA, 22 bp, Homo sapiens
tagtagaatccaaaccaacagt

SEQ ID NO: 9254997 - DNA, 22 bp, Homo sapiens
tagtacagttttggcacatgga

SEQ ID NO: 9254998 - DNA, 22 bp, Homo sapiens
tagtatagattgaagcagatca

SEQ ID NO: 9254999 - DNA, 22 bp, Homo sapiens
tagtatatctttagtacatagt

SEQ ID NO: 9255000 - DNA, 22 bp, Homo sapiens
tagtatatctttagtacatagt

SEQ ID NO: 9255001 - DNA, 22 bp, Homo sapiens
tagtcacctttggcacctgcaa

SEQ ID NO: 9255002 - DNA, 22 bp, Homo sapiens
tagtcacatgatcacaggatcg

SEQ ID NO: 9255003 - DNA, 22 bp, Homo sapiens
tagtcacagtacaggataaaga

SEQ ID NO: 9255004 - DNA, 22 bp, Homo sapiens
tagtcacaaccttcaagttgtc

SEQ ID NO: 9255005 - DNA, 22 bp, Homo sapiens
tagtcacacaattgtgtacatt

SEQ ID NO: 9255006 - DNA, 22 bp, Homo sapiens
tagtcacacaattgtgtacatt

SEQ ID NO: 9255007 - DNA, 22 bp, Homo sapiens
tagtcacaggaagtttcaatgt

SEQ ID NO: 9255008 - DNA, 22 bp, Homo sapiens
tagtattttagaaaaccatgaa

SEQ ID NO: 9255009 - DNA, 22 bp, Homo sapiens
tagtcaactagtgagcatatgg

SEQ ID NO: 9255010 - DNA, 22 bp, Homo sapiens
tagtcacaaccttcaagttgtc

SEQ ID NO: 9255011 - DNA, 20 bp, Homo sapiens
tagtatttgcataaggatag

SEQ ID NO: 9255012 - DNA, 22 bp, Homo sapiens
tagtatttgcagatttgtgtca

SEQ ID NO: 9255013 - DNA, 22 bp, Homo sapiens
tagtatttataatcatgcttaa

SEQ ID NO: 9255014 - DNA, 22 bp, Homo sapiens
tagtatttaatcacttttgtct

SEQ ID NO: 9255015 - DNA, 22 bp, Homo sapiens
tagtatctttctatatttccca

SEQ ID NO: 9255016 - DNA, 22 bp, Homo sapiens
tagtccattttcacactgctga

SEQ ID NO: 9255017 - DNA, 22 bp, Homo sapiens
tagtcccattttgaggtatttg

SEQ ID NO: 9255018 - DNA, 22 bp, Homo sapiens
tagtcctgaccttgccaccagc

SEQ ID NO: 9255019 - DNA, 22 bp, Homo sapiens
tagtccttacttactagaataa

SEQ ID NO: 9255020 - DNA, 22 bp, Homo sapiens
tagtccttggtaaaattctatg

SEQ ID NO: 9255021 - DNA, 22 bp, Homo sapiens
tagtcctttatcaaacatttat

SEQ ID NO: 9255022 - DNA, 22 bp, Homo sapiens
tagtccagccttgggtgtagcc

SEQ ID NO: 9255023 - DNA, 22 bp, Homo sapiens
tagtggggcctgggagggttcc

SEQ ID NO: 9255024 - DNA, 22 bp, Homo sapiens
tagtggggcctgggagggttcc

SEQ ID NO: 9255025 - DNA, 22 bp, Homo sapiens
tagtggggaaggaggacaagaa

SEQ ID NO: 9255026 - DNA, 19 bp, Homo sapiens
tagtggagtgacaagttct

SEQ ID NO: 9255027 - DNA, 22 bp, Homo sapiens
taggacaggtgaggggctgtgg

SEQ ID NO: 9255028 - DNA, 22 bp, Homo sapiens
taggctgaaaggagaggtgaag

SEQ ID NO: 9255029 - DNA, 23 bp, Homo sapiens
taggctctgtaggtagagatggg

SEQ ID NO: 9255030 - DNA, 22 bp, Homo sapiens
taggctcacatagcactaagtg

SEQ ID NO: 9255031 - DNA, 22 bp, Homo sapiens
taggaattatgatgctatcaag

SEQ ID NO: 9255032 - DNA, 22 bp, Homo sapiens
taggaaggcctgtcactacttg

SEQ ID NO: 9255033 - DNA, 22 bp, Homo sapiens
taggaatccagatctagactgt

SEQ ID NO: 9255034 - DNA, 22 bp, Homo sapiens
taggaaatgctccattgcataa

SEQ ID NO: 9255035 - DNA, 18 bp, Homo sapiens
taggaagcttaatgtttt

SEQ ID NO: 9255036 - DNA, 22 bp, Homo sapiens
taggaagctctttgttttgtga

SEQ ID NO: 9255037 - DNA, 22 bp, Homo sapiens
taggaagctgagcagcattcct

SEQ ID NO: 9255038 - DNA, 22 bp, Homo sapiens
taggaagcctaaattaagtggt

SEQ ID NO: 9255039 - DNA, 22 bp, Homo sapiens
taggaagctatgggagatgtga

SEQ ID NO: 9255040 - DNA, 22 bp, Homo sapiens
tagcccagagagccaggggctt

SEQ ID NO: 9255041 - DNA, 22 bp, Homo sapiens
tagcccagagagccaggggctt

SEQ ID NO: 9255042 - DNA, 22 bp, Homo sapiens
tagcccagagtcccaattccag

SEQ ID NO: 9255043 - DNA, 22 bp, Homo sapiens
tagcccagaaagcaaatgtctc

SEQ ID NO: 9255044 - DNA, 22 bp, Homo sapiens
tagccatttttattaatgctgg

SEQ ID NO: 9255045 - DNA, 22 bp, Homo sapiens
tagccattgacttaaagcttat

SEQ ID NO: 9255046 - DNA, 22 bp, Homo sapiens
tagcccagagtcccaattccag

SEQ ID NO: 9255047 - DNA, 22 bp, Homo sapiens
tagcccagcatgagcagagctg

SEQ ID NO: 9255048 - DNA, 22 bp, Homo sapiens
taggaaactcaaagggaagtgg

SEQ ID NO: 9255049 - DNA, 22 bp, Homo sapiens
taggaaactctcagctggtcat

SEQ ID NO: 9255050 - DNA, 22 bp, Homo sapiens
taggaaatattgatttcagtca

SEQ ID NO: 9255051 - DNA, 22 bp, Homo sapiens
tactgaatggggcagtaagaaa

SEQ ID NO: 9255052 - DNA, 22 bp, Homo sapiens
taccttgtgagatgtcagtgag

SEQ ID NO: 9255053 - DNA, 22 bp, Homo sapiens
taccttttgcttattatgacac

SEQ ID NO: 9255054 - DNA, 22 bp, Homo sapiens
tacctttgatctggaattttaa

SEQ ID NO: 9255055 - DNA, 22 bp, Homo sapiens
tacgcgaagaaggacctgatgg

SEQ ID NO: 9255056 - DNA, 22 bp, Homo sapiens
tactaaatgattaagcaggaat

SEQ ID NO: 9255057 - DNA, 22 bp, Homo sapiens
tacctgagcccagtgcagcata

SEQ ID NO: 9255058 - DNA, 22 bp, Homo sapiens
tacctgagcccagtgcagcata

SEQ ID NO: 9255059 - DNA, 22 bp, Homo sapiens
tacctgagttatattaataatt

SEQ ID NO: 9255060 - DNA, 22 bp, Homo sapiens
tacctgcagcgggaatccatta

SEQ ID NO: 9255061 - DNA, 22 bp, Homo sapiens
tacctgcacagccagccatgtg

SEQ ID NO: 9255062 - DNA, 22 bp, Homo sapiens
tacccagcttcaagtcaggact

SEQ ID NO: 9255063 - DNA, 22 bp, Homo sapiens
tacccagcccatgcctacctca

SEQ ID NO: 9255064 - DNA, 22 bp, Homo sapiens
tacccagcaatccctagaggtt

SEQ ID NO: 9255065 - DNA, 22 bp, Homo sapiens
tacccaaggccctttcaatttc

SEQ ID NO: 9255066 - DNA, 22 bp, Homo sapiens
taccattttgaaacatttcatc

SEQ ID NO: 9255067 - DNA, 19 bp, Homo sapiens
tacattccacacaatctct

SEQ ID NO: 9255068 - DNA, 19 bp, Homo sapiens
tacattccacacaatctct

SEQ ID NO: 9255069 - DNA, 22 bp, Homo sapiens
tacattccacaagcattgcttt

SEQ ID NO: 9255070 - DNA, 22 bp, Homo sapiens
tacattccaaaggaaactggct

SEQ ID NO: 9255071 - DNA, 22 bp, Homo sapiens
taccttctctagatctttattc

SEQ ID NO: 9255072 - DNA, 20 bp, Homo sapiens
taccttgaacctccacctgg

SEQ ID NO: 9255073 - DNA, 22 bp, Homo sapiens
tacctggaatttatatagctat

SEQ ID NO: 9255074 - DNA, 22 bp, Homo sapiens
tacctgtcaaaagacatggaga

SEQ ID NO: 9255075 - DNA, 22 bp, Homo sapiens
tactgcctgggggagacagctg

SEQ ID NO: 9255076 - DNA, 23 bp, Homo sapiens
tactgcctggggccagagagcgg

SEQ ID NO: 9255077 - DNA, 22 bp, Homo sapiens
tactgctagatgaaaatgtagg

SEQ ID NO: 9255078 - DNA, 22 bp, Homo sapiens
tactgcttcacccttgagtctt

SEQ ID NO: 9255079 - DNA, 22 bp, Homo sapiens
tactgcttgttagctgtatttg

SEQ ID NO: 9255080 - DNA, 20 bp, Homo sapiens
tactggaaatttctccacct

SEQ ID NO: 9255081 - DNA, 22 bp, Homo sapiens
tactggcaatttcatatggtgc

SEQ ID NO: 9255082 - DNA, 20 bp, Homo sapiens
tactgggcaagcccacagac

SEQ ID NO: 9255083 - DNA, 20 bp, Homo sapiens
tactgcaggaatcagctagc

SEQ ID NO: 9255084 - DNA, 22 bp, Homo sapiens
tactgtaatcagggcttaggta

SEQ ID NO: 9255085 - DNA, 22 bp, Homo sapiens
tacttacatttctgtaatcggc

SEQ ID NO: 9255086 - DNA, 22 bp, Homo sapiens
tacttagagcgataatttatac

SEQ ID NO: 9255087 - DNA, 22 bp, Homo sapiens
tacttattggttcagaagttta

SEQ ID NO: 9255088 - DNA, 22 bp, Homo sapiens
tacttctagcctgccccttgtg

SEQ ID NO: 9255089 - DNA, 22 bp, Homo sapiens
tacttctgccttagagaacact

SEQ ID NO: 9255090 - DNA, 22 bp, Homo sapiens
tacttccaggcggacaaagccc

SEQ ID NO: 9255091 - DNA, 22 bp, Homo sapiens
tacttccagcaatctgcatatt

SEQ ID NO: 9255092 - DNA, 22 bp, Homo sapiens
tacttccaggcggacaaagccc

SEQ ID NO: 9255093 - DNA, 22 bp, Homo sapiens
tacttcctgtttccatgtctgt

SEQ ID NO: 9255094 - DNA, 22 bp, Homo sapiens
tacttcccactggggtctacca

SEQ ID NO: 9255095 - DNA, 22 bp, Homo sapiens
tacttccatgtccttagagtcc

SEQ ID NO: 9255096 - DNA, 22 bp, Homo sapiens
tacttcctgtttccatgtctgt

SEQ ID NO: 9255097 - DNA, 22 bp, Homo sapiens
tacttcattcctttgtaaaatg

SEQ ID NO: 9255098 - DNA, 22 bp, Homo sapiens
tacttcattattctagttttga

SEQ ID NO: 9255099 - DNA, 22 bp, Homo sapiens
tacattaacttacgtccacatg

SEQ ID NO: 9255100 - DNA, 22 bp, Homo sapiens
tacatgtttggtaaatgatggc

SEQ ID NO: 9255101 - DNA, 22 bp, Homo sapiens
tacatgtctacatgcatttttg

SEQ ID NO: 9255102 - DNA, 22 bp, Homo sapiens
tacatgtctacagccatgtctg

SEQ ID NO: 9255103 - DNA, 22 bp, Homo sapiens
tacatgtattgatttctcttct

SEQ ID NO: 9255104 - DNA, 22 bp, Homo sapiens
tacatacagtggatgctttagg

SEQ ID NO: 9255105 - DNA, 22 bp, Homo sapiens
tacatacagccaagtatgaagt

SEQ ID NO: 9255106 - DNA, 22 bp, Homo sapiens
tacatacagccaagtatgaagt

SEQ ID NO: 9255107 - DNA, 22 bp, Homo sapiens
tacatacagtggatgctttagg

SEQ ID NO: 9255108 - DNA, 22 bp, Homo sapiens
tacatacatattcatacaggtg

SEQ ID NO: 9255109 - DNA, 22 bp, Homo sapiens
tacatacatattcatacaggtg

SEQ ID NO: 9255110 - DNA, 22 bp, Homo sapiens
tacatacagagatgctagttaa

SEQ ID NO: 9255111 - DNA, 22 bp, Homo sapiens
tacatacagagatgctagttaa

SEQ ID NO: 9255112 - DNA, 22 bp, Homo sapiens
tacatacaagcattcaatttta

SEQ ID NO: 9255113 - DNA, 22 bp, Homo sapiens
tacatacaagcattcaatttta

SEQ ID NO: 9255114 - DNA, 22 bp, Homo sapiens
tacatacacaaatatactgttt

SEQ ID NO: 9255115 - DNA, 22 bp, Homo sapiens
tacatacacaaatatactgttt

SEQ ID NO: 9255116 - DNA, 22 bp, Homo sapiens
tacatacacaaatatactgttt

SEQ ID NO: 9255117 - DNA, 22 bp, Homo sapiens
tacatacacaaatatactgttt

SEQ ID NO: 9255118 - DNA, 22 bp, Homo sapiens
tacatacacaaatatactgttt

SEQ ID NO: 9255119 - DNA, 22 bp, Homo sapiens
tacatacaagcattcaatttta

SEQ ID NO: 9255120 - DNA, 22 bp, Homo sapiens
tacatacaagcattcaatttta

SEQ ID NO: 9255121 - DNA, 22 bp, Homo sapiens
tacatacaagatgtgtttaaaa

SEQ ID NO: 9255122 - DNA, 22 bp, Homo sapiens
tacattcatggtgacttgtatg

SEQ ID NO: 9255123 - DNA, 15 bp, Homo sapiens
tacattcatttccac

SEQ ID NO: 9255124 - DNA, 22 bp, Homo sapiens
tacattcagagaaagtttccat

SEQ ID NO: 9255125 - DNA, 22 bp, Homo sapiens
tacattaaggatatggacatga

SEQ ID NO: 9255126 - DNA, 22 bp, Homo sapiens
tacattatttcatcagtcatct

SEQ ID NO: 9255127 - DNA, 22 bp, Homo sapiens
tacattatcttgttatctttca

SEQ ID NO: 9255128 - DNA, 22 bp, Homo sapiens
tacattatcttgttatctttca

SEQ ID NO: 9255129 - DNA, 22 bp, Homo sapiens
tacattcaacatgtcactatgt

SEQ ID NO: 9255130 - DNA, 22 bp, Homo sapiens
tacattcacagttgttcatctc

SEQ ID NO: 9255131 - DNA, 22 bp, Homo sapiens
tacattcaacatgtcactatgt

SEQ ID NO: 9255132 - DNA, 22 bp, Homo sapiens
tacattcaacatgtcactatgt

SEQ ID NO: 9255133 - DNA, 20 bp, Homo sapiens
tacattcaaaacaaactctg

SEQ ID NO: 9255134 - DNA, 22 bp, Homo sapiens
tacagtttttattcatgacaag

SEQ ID NO: 9255135 - DNA, 22 bp, Homo sapiens
tacataatgagctagttaagtt

SEQ ID NO: 9255136 - DNA, 22 bp, Homo sapiens
tacataattaatctttaagttc

SEQ ID NO: 9255137 - DNA, 22 bp, Homo sapiens
tacagcttttgcagctgttttg

SEQ ID NO: 9255138 - DNA, 22 bp, Homo sapiens
tacagcttatccagcttgatag

SEQ ID NO: 9255139 - DNA, 22 bp, Homo sapiens
tacagcttaaaagatgcattta

SEQ ID NO: 9255140 - DNA, 22 bp, Homo sapiens
tacactacacgaaggcattgca

SEQ ID NO: 9255141 - DNA, 22 bp, Homo sapiens
tacagcttgacccataatgtct

SEQ ID NO: 9255142 - DNA, 22 bp, Homo sapiens
tacagcttcagtgtgccccagt

SEQ ID NO: 9255143 - DNA, 22 bp, Homo sapiens
tacagcttgatgagagcgcgag

SEQ ID NO: 9255144 - DNA, 22 bp, Homo sapiens
tacagcttgacccataatgtct

SEQ ID NO: 9255145 - DNA, 18 bp, Homo sapiens
tacagcttgagttgactg

SEQ ID NO: 9255146 - DNA, 22 bp, Homo sapiens
tacagctttagcaaattaccta

SEQ ID NO: 9255147 - DNA, 22 bp, Homo sapiens
tacagcttgatgtttgtgtgtt

SEQ ID NO: 9255148 - DNA, 22 bp, Homo sapiens
tacagctttatacccatcaaaa

SEQ ID NO: 9255149 - DNA, 22 bp, Homo sapiens
tacagcttttcatatttgtgtt

SEQ ID NO: 9255150 - DNA, 22 bp, Homo sapiens
tacagctttgggaaggccccat

SEQ ID NO: 9255151 - DNA, 22 bp, Homo sapiens
taatgccttatgtcaaatgtaa

SEQ ID NO: 9255152 - DNA, 22 bp, Homo sapiens
taatgcctttctgtactatatg

SEQ ID NO: 9255153 - DNA, 20 bp, Homo sapiens
taatgcctcatgatactaga

SEQ ID NO: 9255154 - DNA, 22 bp, Homo sapiens
taatgcctagattattctgttt

SEQ ID NO: 9255155 - DNA, 22 bp, Homo sapiens
taatgctcaccctgcatcaggc

SEQ ID NO: 9255156 - DNA, 22 bp, Homo sapiens
taatgcttaattttcacaagcc

SEQ ID NO: 9255157 - DNA, 22 bp, Homo sapiens
taatgcttaattttcacaagcc

SEQ ID NO: 9255158 - DNA, 22 bp, Homo sapiens
taatgcttcctatatagcactc

SEQ ID NO: 9255159 - DNA, 22 bp, Homo sapiens
taatgcttctgttaggatcttc

SEQ ID NO: 9255160 - DNA, 22 bp, Homo sapiens
taatgctttgtcagcctaaggg

SEQ ID NO: 9255161 - DNA, 22 bp, Homo sapiens
taatgctttgttttgatctaac

SEQ ID NO: 9255162 - DNA, 22 bp, Homo sapiens
taatgcttttccttcaaataag

SEQ ID NO: 9255163 - DNA, 22 bp, Homo sapiens
taatttcaccgttgctagaaat

SEQ ID NO: 9255164 - DNA, 22 bp, Homo sapiens
taatggattaacgtccctgtcg

SEQ ID NO: 9255165 - DNA, 22 bp, Homo sapiens
taatggagatttagcacttacg

SEQ ID NO: 9255166 - DNA, 22 bp, Homo sapiens
taatggaagttaaatatggtat

SEQ ID NO: 9255167 - DNA, 22 bp, Homo sapiens
taatttcacagttcaacgcaca

SEQ ID NO: 9255168 - DNA, 22 bp, Homo sapiens
taatttcaatagcttgcataat

SEQ ID NO: 9255169 - DNA, 22 bp, Homo sapiens
taatgaataaacttgagagtca

SEQ ID NO: 9255170 - DNA, 22 bp, Homo sapiens
taatgaactctttactttggga

SEQ ID NO: 9255171 - DNA, 22 bp, Homo sapiens
taatgaacatgcatcgtgtgta

SEQ ID NO: 9255172 - DNA, 22 bp, Homo sapiens
taatgaacatcttaatctgaaa

SEQ ID NO: 9255173 - DNA, 19 bp, Homo sapiens
taataagcaatatggaagt

SEQ ID NO: 9255174 - DNA, 22 bp, Homo sapiens
taatgactgtaccaaggcttca

SEQ ID NO: 9255175 - DNA, 22 bp, Homo sapiens
taatgacttgaaggacccatgg

SEQ ID NO: 9255176 - DNA, 22 bp, Homo sapiens
taatgactgccgtctctcttca

SEQ ID NO: 9255177 - DNA, 22 bp, Homo sapiens
taatgcaacgtgagataattaa

SEQ ID NO: 9255178 - DNA, 22 bp, Homo sapiens
taatgcaacgtgagataattaa

SEQ ID NO: 9255179 - DNA, 18 bp, Homo sapiens
taatgataagccttgaag

SEQ ID NO: 9255180 - DNA, 22 bp, Homo sapiens
taatgccaatttaatgatccat

SEQ ID NO: 9255181 - DNA, 22 bp, Homo sapiens
taatgcatgtaatgggctgata

SEQ ID NO: 9255182 - DNA, 22 bp, Homo sapiens
taatgccacggcagggaacagc

SEQ ID NO: 9255183 - DNA, 23 bp, Homo sapiens
taatgccagccctgcagttaagc

SEQ ID NO: 9255184 - DNA, 22 bp, Homo sapiens
taatgcaatttagcaaagtttt

SEQ ID NO: 9255185 - DNA, 22 bp, Homo sapiens
taatgcacgttaacatttgaga

SEQ ID NO: 9255186 - DNA, 19 bp, Homo sapiens
taatgcacttaacacatgg

SEQ ID NO: 9255187 - DNA, 22 bp, Homo sapiens
taatgcacatttattttacctt

SEQ ID NO: 9255188 - DNA, 22 bp, Homo sapiens
taatgcacatagaagtacttag

SEQ ID NO: 9255189 - DNA, 22 bp, Homo sapiens
taatgcacatagaagtacttag

SEQ ID NO: 9255190 - DNA, 22 bp, Homo sapiens
taagtgttggtaattacaatga

SEQ ID NO: 9255191 - DNA, 22 bp, Homo sapiens
taagtgttggtaattacaatga

SEQ ID NO: 9255192 - DNA, 22 bp, Homo sapiens
taagttaaccctgttaatagat

SEQ ID NO: 9255193 - DNA, 22 bp, Homo sapiens
taagtgtttctccagtgtcttt

SEQ ID NO: 9255194 - DNA, 22 bp, Homo sapiens
taagttagtcctttttaaaagt

SEQ ID NO: 9255195 - DNA, 18 bp, Homo sapiens
taagcaatgacattgcaa

SEQ ID NO: 9255196 - DNA, 22 bp, Homo sapiens
taagcaatctgtagttggaatc

SEQ ID NO: 9255197 - DNA, 22 bp, Homo sapiens
taagcaatctaaaagccttacc

SEQ ID NO: 9255198 - DNA, 20 bp, Homo sapiens
taagcacatgaacagtcctc

SEQ ID NO: 9255199 - DNA, 22 bp, Homo sapiens
taagcaatgagataatcatggg

SEQ ID NO: 9255200 - DNA, 22 bp, Homo sapiens
taagcaatgctgtagttcagtc

SEQ ID NO: 9255201 - DNA, 22 bp, Homo sapiens
taagcataactaaaaatgattt

SEQ ID NO: 9255202 - DNA, 22 bp, Homo sapiens
taagcagtttttcttgtattaa

SEQ ID NO: 9255203 - DNA, 22 bp, Homo sapiens
taagcataactaaaaatgattt

SEQ ID NO: 9255204 - DNA, 22 bp, Homo sapiens
taagcataagatacatgagaca

SEQ ID NO: 9255205 - DNA, 22 bp, Homo sapiens
taagcagtttttcttgtattaa

SEQ ID NO: 9255206 - DNA, 22 bp, Homo sapiens
taataaatgaaagtgctggcat

SEQ ID NO: 9255207 - DNA, 22 bp, Homo sapiens
taataaatgaaagtgctggcat

SEQ ID NO: 9255208 - DNA, 22 bp, Homo sapiens
taataacaattgtaggacatga

SEQ ID NO: 9255209 - DNA, 22 bp, Homo sapiens
taataacaattgtaggacatga

SEQ ID NO: 9255210 - DNA, 22 bp, Homo sapiens
taataacaattgtaggacatga

SEQ ID NO: 9255211 - DNA, 22 bp, Homo sapiens
taataaatgaaagtgctggcat

SEQ ID NO: 9255212 - DNA, 22 bp, Homo sapiens
taataaatgaaagtgctggcat

SEQ ID NO: 9255213 - DNA, 22 bp, Homo sapiens
taataaatgaaagtgctggcat

SEQ ID NO: 9255214 - DNA, 22 bp, Homo sapiens
taagttttctggaataacttgg

SEQ ID NO: 9255215 - DNA, 22 bp, Homo sapiens
taagttttaagcaatctgataa

SEQ ID NO: 9255216 - DNA, 22 bp, Homo sapiens
taagtttctccaaagcacagaa

SEQ ID NO: 9255217 - DNA, 22 bp, Homo sapiens
taagtttaccactttcagaatt

SEQ ID NO: 9255218 - DNA, 22 bp, Homo sapiens
taagtttaaatgtacatgaagc

SEQ ID NO: 9255219 - DNA, 22 bp, Homo sapiens
tacacataggtctgaataaaaa

SEQ ID NO: 9255220 - DNA, 22 bp, Homo sapiens
tacacatatgtgtgtatatgtg

SEQ ID NO: 9255221 - DNA, 22 bp, Homo sapiens
tacacaaaggcactctgttgtt

SEQ ID NO: 9255222 - DNA, 22 bp, Homo sapiens
tacaattactcagctctgctgt

SEQ ID NO: 9255223 - DNA, 22 bp, Homo sapiens
tacacattacataatactatct

SEQ ID NO: 9255224 - DNA, 22 bp, Homo sapiens
tacacattacataatactatct

SEQ ID NO: 9255225 - DNA, 22 bp, Homo sapiens
tacacatgtttggcaagtatgt

SEQ ID NO: 9255226 - DNA, 22 bp, Homo sapiens
tacacatgctcagattcctgtg

SEQ ID NO: 9255227 - DNA, 22 bp, Homo sapiens
tacacatgcatgtactccagga

SEQ ID NO: 9255228 - DNA, 22 bp, Homo sapiens
tacactaagaacaaagatctgt

SEQ ID NO: 9255229 - DNA, 22 bp, Homo sapiens
tacacccttctcctgagtgtgt

SEQ ID NO: 9255230 - DNA, 22 bp, Homo sapiens
tacaccattcccaggtggattt

SEQ ID NO: 9255231 - DNA, 22 bp, Homo sapiens
tacacccacattgagcatggga

SEQ ID NO: 9255232 - DNA, 22 bp, Homo sapiens
tacacccacatgcctaggaggg

SEQ ID NO: 9255233 - DNA, 18 bp, Homo sapiens
taatttgcacagttgcaa

SEQ ID NO: 9255234 - DNA, 22 bp, Homo sapiens
taattttaactgtgctgtttgg

SEQ ID NO: 9255235 - DNA, 22 bp, Homo sapiens
taattttacttcctgagcacct

SEQ ID NO: 9255236 - DNA, 22 bp, Homo sapiens
taattttacttcctgagcacct

SEQ ID NO: 9255237 - DNA, 22 bp, Homo sapiens
taattttaactgtgctgtttgg

SEQ ID NO: 9255238 - DNA, 22 bp, Homo sapiens
taattttaatagtatgtggcat

SEQ ID NO: 9255239 - DNA, 22 bp, Homo sapiens
taattttatgacagtgtatttt

SEQ ID NO: 9255240 - DNA, 22 bp, Homo sapiens
taattttatgacagtgtatttt

SEQ ID NO: 9255241 - DNA, 22 bp, Homo sapiens
taattttgtccccctgcacata

SEQ ID NO: 9255242 - DNA, 22 bp, Homo sapiens
taattttgtcacagtgacatgc

SEQ ID NO: 9255243 - DNA, 22 bp, Homo sapiens
taattttgtattgccattgtag

SEQ ID NO: 9255244 - DNA, 22 bp, Homo sapiens
taattttgtcacagtgacatgc

SEQ ID NO: 9255245 - DNA, 22 bp, Homo sapiens
taattttgctgtgaccattgaa

SEQ ID NO: 9255246 - DNA, 22 bp, Homo sapiens
taattttgtattgccattgtag

SEQ ID NO: 9255247 - DNA, 22 bp, Homo sapiens
taatttttccacgtacactggg

SEQ ID NO: 9255248 - DNA, 22 bp, Homo sapiens
taatttttccacgtacactggg

SEQ ID NO: 9255249 - DNA, 22 bp, Homo sapiens
taatttttccacgtacactggg

SEQ ID NO: 9255250 - DNA, 22 bp, Homo sapiens
tacaagctgaccctgaagatga

SEQ ID NO: 9255251 - DNA, 20 bp, Homo sapiens
tacaatattcccactttgct

SEQ ID NO: 9255252 - DNA, 22 bp, Homo sapiens
tacaatatgtggccttttgtga

SEQ ID NO: 9255253 - DNA, 22 bp, Homo sapiens
tacaatcaggataataatagtg

SEQ ID NO: 9255254 - DNA, 22 bp, Homo sapiens
tacaatgagctgtacatctcca

SEQ ID NO: 9255255 - DNA, 22 bp, Homo sapiens
tacaatgagctgtacatctcca

SEQ ID NO: 9255256 - DNA, 23 bp, Homo sapiens
tacaatgcaaacttggcccatgg

SEQ ID NO: 9255257 - DNA, 21 bp, Homo sapiens
tacaatgcacaggagagcctc

SEQ ID NO: 9255258 - DNA, 22 bp, Homo sapiens
tacaatgcagtgacctccttta

SEQ ID NO: 9255259 - DNA, 22 bp, Homo sapiens
tacaatgcaaaatactgtctgc

SEQ ID NO: 9255260 - DNA, 22 bp, Homo sapiens
tacaatgctgtgcatgtaatgg

SEQ ID NO: 9255261 - DNA, 22 bp, Homo sapiens
tacaatgcattcgttgtctcgg

SEQ ID NO: 9255262 - DNA, 22 bp, Homo sapiens
tacaatgcattcatttttgagg

SEQ ID NO: 9255263 - DNA, 22 bp, Homo sapiens
tacaatgctgtttgtttctact

SEQ ID NO: 9255264 - DNA, 22 bp, Homo sapiens
taagaaatttagttatagaatg

SEQ ID NO: 9255265 - DNA, 22 bp, Homo sapiens
taagaaatttagttatagaatg

SEQ ID NO: 9255266 - DNA, 22 bp, Homo sapiens
taagaaatttagttatagaatg

SEQ ID NO: 9255267 - DNA, 22 bp, Homo sapiens
taacttctgcacagaaaatttg

SEQ ID NO: 9255268 - DNA, 22 bp, Homo sapiens
taacttctgaatagcaatagta

SEQ ID NO: 9255269 - DNA, 22 bp, Homo sapiens
taacttctggaaatgcatctgc

SEQ ID NO: 9255270 - DNA, 22 bp, Homo sapiens
taacttcagcgagttctcttaa

SEQ ID NO: 9255271 - DNA, 22 bp, Homo sapiens
taacttctctgctatcatagga

SEQ ID NO: 9255272 - DNA, 22 bp, Homo sapiens
taactgttgtgcgggtctctgg

SEQ ID NO: 9255273 - DNA, 22 bp, Homo sapiens
taactgtgtgaacgtgatcatt

SEQ ID NO: 9255274 - DNA, 22 bp, Homo sapiens
taagatgaggtaggtaagactt

SEQ ID NO: 9255275 - DNA, 22 bp, Homo sapiens
taagatgactacttaccactga

SEQ ID NO: 9255276 - DNA, 22 bp, Homo sapiens
taagataatccattataatgtt

SEQ ID NO: 9255277 - DNA, 22 bp, Homo sapiens
taagataatccattataatgtt

SEQ ID NO: 9255278 - DNA, 22 bp, Homo sapiens
taagataatccattataatgtt

SEQ ID NO: 9255279 - DNA, 22 bp, Homo sapiens
taagatatggtaggaagtttgg

SEQ ID NO: 9255280 - DNA, 22 bp, Homo sapiens
taagatagaactctgaggctac

SEQ ID NO: 9255281 - DNA, 22 bp, Homo sapiens
taagagtatctattaagtactt

SEQ ID NO: 9255282 - DNA, 22 bp, Homo sapiens
taagaggcaaaagatactcaga

SEQ ID NO: 9255283 - DNA, 22 bp, Homo sapiens
taagaggcattagagacatagc

SEQ ID NO: 9255284 - DNA, 22 bp, Homo sapiens
taagagtaagtgattaagaaga

SEQ ID NO: 9255285 - DNA, 22 bp, Homo sapiens
taagaggcattagagacatagc

SEQ ID NO: 9255286 - DNA, 22 bp, Homo sapiens
taagaggcagcattcctcgcct

SEQ ID NO: 9255287 - DNA, 22 bp, Homo sapiens
taagataataccatgggccagg

SEQ ID NO: 9255288 - DNA, 22 bp, Homo sapiens
taagataataagtatgtctatg

SEQ ID NO: 9255289 - DNA, 22 bp, Homo sapiens
taagataataagtatgtctatg

SEQ ID NO: 9255290 - DNA, 22 bp, Homo sapiens
taagataataagtatgtctatg

SEQ ID NO: 9255291 - DNA, 22 bp, Homo sapiens
taagataagtgggttgagatgg

SEQ ID NO: 9255292 - DNA, 22 bp, Homo sapiens
taagataagtgggttgagatgg

SEQ ID NO: 9255293 - DNA, 22 bp, Homo sapiens
taagataaggaacattctgtga

SEQ ID NO: 9255294 - DNA, 22 bp, Homo sapiens
taagataaggaacattctgtga

SEQ ID NO: 9255295 - DNA, 22 bp, Homo sapiens
taagataaggagagtgctagta

SEQ ID NO: 9255296 - DNA, 22 bp, Homo sapiens
taacaaactggaaattgacatt

SEQ ID NO: 9255297 - DNA, 21 bp, Homo sapiens
taacaaagacttctggtcagg

SEQ ID NO: 9255298 - DNA, 22 bp, Homo sapiens
taacaaactggaaattgacatt

SEQ ID NO: 9255299 - DNA, 22 bp, Homo sapiens
taaatttttgttaacagcctct

SEQ ID NO: 9255300 - DNA, 21 bp, Homo sapiens
taacaaagacttctggtcagg

SEQ ID NO: 9255301 - DNA, 22 bp, Homo sapiens
taaatttttgttaacagcctct

SEQ ID NO: 9255302 - DNA, 22 bp, Homo sapiens
taacaatgcaaaatgaatttag

SEQ ID NO: 9255303 - DNA, 22 bp, Homo sapiens
taacaatgattagtgactacag

SEQ ID NO: 9255304 - DNA, 22 bp, Homo sapiens
taacaatggttttgctgataat

SEQ ID NO: 9255305 - DNA, 22 bp, Homo sapiens
taacaatggagttttgagaaag

SEQ ID NO: 9255306 - DNA, 23 bp, Homo sapiens
taacaatggactcctcttagcta

SEQ ID NO: 9255307 - DNA, 22 bp, Homo sapiens
taacaatggagttttgagaaag

SEQ ID NO: 9255308 - DNA, 22 bp, Homo sapiens
taacaatggagttttgagaaag

SEQ ID NO: 9255309 - DNA, 22 bp, Homo sapiens
taacaatgggaaggactgatga

SEQ ID NO: 9255310 - DNA, 22 bp, Homo sapiens
taacacagacagccactagtaa

SEQ ID NO: 9255311 - DNA, 22 bp, Homo sapiens
taacaatgcaaaatgaatttag

SEQ ID NO: 9255312 - DNA, 22 bp, Homo sapiens
taacaatttgcttcatttgttt

SEQ ID NO: 9255313 - DNA, 22 bp, Homo sapiens
taacacatatttcaagagtagt

SEQ ID NO: 9255314 - DNA, 22 bp, Homo sapiens
taacacagtgtctaccattatt

SEQ ID NO: 9255315 - DNA, 22 bp, Homo sapiens
taacacagtgtcctcagaaaca

SEQ ID NO: 9255316 - DNA, 22 bp, Homo sapiens
taacacagttctctgttgcaca

SEQ ID NO: 9255317 - DNA, 22 bp, Homo sapiens
taacacatggttctgtcaggaa

SEQ ID NO: 9255318 - DNA, 22 bp, Homo sapiens
taaacagagatgcctgggtctg

SEQ ID NO: 9255319 - DNA, 22 bp, Homo sapiens
taaacagagagtgcagttatag

SEQ ID NO: 9255320 - DNA, 22 bp, Homo sapiens
taaacagagtgctagttcacgg

SEQ ID NO: 9255321 - DNA, 16 bp, Homo sapiens
taaacagcagacagtt

SEQ ID NO: 9255322 - DNA, 22 bp, Homo sapiens
taaacagcctcccctttcactc

SEQ ID NO: 9255323 - DNA, 22 bp, Homo sapiens
taaacagcctaaaactttcttt

SEQ ID NO: 9255324 - DNA, 23 bp, Homo sapiens
gttttcaacacaataaatgtaac

SEQ ID NO: 9255325 - DNA, 22 bp, Homo sapiens
gttttcaaggggatttaactga

SEQ ID NO: 9255326 - DNA, 22 bp, Homo sapiens
gttttcaattataagatggctt

SEQ ID NO: 9255327 - DNA, 22 bp, Homo sapiens
gttttcagccaggagcacattt

SEQ ID NO: 9255328 - DNA, 21 bp, Homo sapiens
gttttcatgatagagtctgta

SEQ ID NO: 9255329 - DNA, 22 bp, Homo sapiens
taaacatggctgtttcagttat

SEQ ID NO: 9255330 - DNA, 22 bp, Homo sapiens
taaacatctgtagccttcagtc

SEQ ID NO: 9255331 - DNA, 22 bp, Homo sapiens
taaacatggattctgatcacag

SEQ ID NO: 9255332 - DNA, 22 bp, Homo sapiens
taaacagctactgtgtcaaagg

SEQ ID NO: 9255333 - DNA, 22 bp, Homo sapiens
taaacatctgaatcctgcttcc

SEQ ID NO: 9255334 - DNA, 22 bp, Homo sapiens
gttttattggaacacagccatg

SEQ ID NO: 9255335 - DNA, 22 bp, Homo sapiens
gttttattggaacacagccatg

SEQ ID NO: 9255336 - DNA, 22 bp, Homo sapiens
gttttattggaacacagccatg

SEQ ID NO: 9255337 - DNA, 22 bp, Homo sapiens
gttttattggaacacagccatg

SEQ ID NO: 9255338 - DNA, 22 bp, Homo sapiens
gttttatttccatgagagaccg

SEQ ID NO: 9255339 - DNA, 22 bp, Homo sapiens
gttttatttccatgagagaccg

SEQ ID NO: 9255340 - DNA, 22 bp, Homo sapiens
gttttatttccatgagagaccg

SEQ ID NO: 9255341 - DNA, 22 bp, Homo sapiens
gttttatttccatgagagaccg

SEQ ID NO: 9255342 - DNA, 22 bp, Homo sapiens
gttttatttccatgagagaccg

SEQ ID NO: 9255343 - DNA, 22 bp, Homo sapiens
gttttatttccatgagagaccg

SEQ ID NO: 9255344 - DNA, 23 bp, Homo sapiens
gttttcaacacaataaatgtaac

SEQ ID NO: 9255345 - DNA, 23 bp, Homo sapiens
gttttcaacacaataaatgtaac

SEQ ID NO: 9255346 - DNA, 20 bp, Homo sapiens
gttttatgccagttctgtgt

SEQ ID NO: 9255347 - DNA, 22 bp, Homo sapiens
gttttattggaacacagccatg

SEQ ID NO: 9255348 - DNA, 22 bp, Homo sapiens
gttttatgagacctcaggaata

SEQ ID NO: 9255349 - DNA, 22 bp, Homo sapiens
gttttataggctgttgctatat

SEQ ID NO: 9255350 - DNA, 22 bp, Homo sapiens
taaagacaaacccactagggtt

SEQ ID NO: 9255351 - DNA, 22 bp, Homo sapiens
taaagaataatacccatggagc

SEQ ID NO: 9255352 - DNA, 22 bp, Homo sapiens
taaagacaaatgacattacggc

SEQ ID NO: 9255353 - DNA, 22 bp, Homo sapiens
taaagaacacagggaatagcac

SEQ ID NO: 9255354 - DNA, 21 bp, Homo sapiens
taaagaagatgaatgtgatca

SEQ ID NO: 9255355 - DNA, 22 bp, Homo sapiens
taaagacaatttcgagctgtag

SEQ ID NO: 9255356 - DNA, 22 bp, Homo sapiens
taaagacaataggaaagttgtt

SEQ ID NO: 9255357 - DNA, 22 bp, Homo sapiens
taaagacaataggaaagttgtt

SEQ ID NO: 9255358 - DNA, 22 bp, Homo sapiens
taaagtgtgcatggtcaaatat

SEQ ID NO: 9255359 - DNA, 22 bp, Homo sapiens
taaagacacccagggagggact

SEQ ID NO: 9255360 - DNA, 22 bp, Homo sapiens
taaagtgtggacagtatctata

SEQ ID NO: 9255361 - DNA, 22 bp, Homo sapiens
taaagtgttgtacaaatgtatg

SEQ ID NO: 9255362 - DNA, 22 bp, Homo sapiens
taaagtgtgtgggttctaaatt

SEQ ID NO: 9255363 - DNA, 22 bp, Homo sapiens
taaagtgtgtatatacatatgg

SEQ ID NO: 9255364 - DNA, 22 bp, Homo sapiens
taaagtgtgtatatacatatgg

SEQ ID NO: 9255365 - DNA, 21 bp, Homo sapiens
taaataataagttgctgagat

SEQ ID NO: 9255366 - DNA, 21 bp, Homo sapiens
taaataataagttgctgagat

SEQ ID NO: 9255367 - DNA, 21 bp, Homo sapiens
taaataataagttgctgagat

SEQ ID NO: 9255368 - DNA, 22 bp, Homo sapiens
taaataagttcttcattgtttg

SEQ ID NO: 9255369 - DNA, 22 bp, Homo sapiens
taaagtttgtagcaattgatat

SEQ ID NO: 9255370 - DNA, 22 bp, Homo sapiens
taaagtttgtagcaattgatat

SEQ ID NO: 9255371 - DNA, 22 bp, Homo sapiens
taaagtttggcagacaataaca

SEQ ID NO: 9255372 - DNA, 22 bp, Homo sapiens
taaagtttggcagacaataaca

SEQ ID NO: 9255373 - DNA, 22 bp, Homo sapiens
taaagtttggcagacaataaca

SEQ ID NO: 9255374 - DNA, 22 bp, Homo sapiens
taaagttggacctgattttatt

SEQ ID NO: 9255375 - DNA, 22 bp, Homo sapiens
taaagtttatttgaacatctct

SEQ ID NO: 9255376 - DNA, 22 bp, Homo sapiens
taaagtttattggcaccaccat

SEQ ID NO: 9255377 - DNA, 20 bp, Homo sapiens
gttaggaggttggacatgga

SEQ ID NO: 9255378 - DNA, 22 bp, Homo sapiens
gttaggtagaagtttactttga

SEQ ID NO: 9255379 - DNA, 22 bp, Homo sapiens
gttagcaatgcccaggaatgca

SEQ ID NO: 9255380 - DNA, 22 bp, Homo sapiens
gttagagggctgccttttgttt

SEQ ID NO: 9255381 - DNA, 22 bp, Homo sapiens
gttagaggttcagtcgctataa

SEQ ID NO: 9255382 - DNA, 18 bp, Homo sapiens
gttagcttcctgttgccc

SEQ ID NO: 9255383 - DNA, 22 bp, Homo sapiens
gttagcatgacttagaatcagg

SEQ ID NO: 9255384 - DNA, 22 bp, Homo sapiens
gttagcatttgtttaatatcag

SEQ ID NO: 9255385 - DNA, 22 bp, Homo sapiens
gttagcatgattcctgctcatt

SEQ ID NO: 9255386 - DNA, 22 bp, Homo sapiens
gttacaaaggtcataaaagtgt

SEQ ID NO: 9255387 - DNA, 22 bp, Homo sapiens
gttacaaaggtcataaaagtgt

SEQ ID NO: 9255388 - DNA, 22 bp, Homo sapiens
gttagaataaaaggtcagagag

SEQ ID NO: 9255389 - DNA, 22 bp, Homo sapiens
gttccaaatttggatctttagg

SEQ ID NO: 9255390 - DNA, 22 bp, Homo sapiens
gttataaaggtgataatggtca

SEQ ID NO: 9255391 - DNA, 22 bp, Homo sapiens
gttataaaggtgataatggtca

SEQ ID NO: 9255392 - DNA, 22 bp, Homo sapiens
gttataaatacctaataggatt

SEQ ID NO: 9255393 - DNA, 22 bp, Homo sapiens
gttataaatacctaataggatt

SEQ ID NO: 9255394 - DNA, 22 bp, Homo sapiens
gttataaatacctaataggatt

SEQ ID NO: 9255395 - DNA, 22 bp, Homo sapiens
gttataaaatgcacagttgttt

SEQ ID NO: 9255396 - DNA, 22 bp, Homo sapiens
gttataaaatgcacagttgttt

SEQ ID NO: 9255397 - DNA, 22 bp, Homo sapiens
gttataaaatgcacagttgttt

SEQ ID NO: 9255398 - DNA, 22 bp, Homo sapiens
gttataaaatgcacagttgttt

SEQ ID NO: 9255399 - DNA, 22 bp, Homo sapiens
gttagtgcttattaaatagtat

SEQ ID NO: 9255400 - DNA, 22 bp, Homo sapiens
gtgtgtgtgcatctcttttatt

SEQ ID NO: 9255401 - DNA, 22 bp, Homo sapiens
gtgtgtgtgcatctcttttatt

SEQ ID NO: 9255402 - DNA, 22 bp, Homo sapiens
gtgtgtgtgcctgcacacacac

SEQ ID NO: 9255403 - DNA, 22 bp, Homo sapiens
gtgtgtgtgtaaaaatccagag

SEQ ID NO: 9255404 - DNA, 22 bp, Homo sapiens
gtgtgtgttcaataaatttaag

SEQ ID NO: 9255405 - DNA, 22 bp, Homo sapiens
gtgtgtgttcaataaatttaag

SEQ ID NO: 9255406 - DNA, 23 bp, Homo sapiens
gtgtgttcccggagtagctcccg

SEQ ID NO: 9255407 - DNA, 22 bp, Homo sapiens
gtgtgttcccgtttccttcact

SEQ ID NO: 9255408 - DNA, 22 bp, Homo sapiens
gtgttacatatatacccacacc

SEQ ID NO: 9255409 - DNA, 22 bp, Homo sapiens
gtgttaatggctatgaactgat

SEQ ID NO: 9255410 - DNA, 22 bp, Homo sapiens
gtgttaatggtagaatctgagt

SEQ ID NO: 9255411 - DNA, 22 bp, Homo sapiens
gtgctttccatcctccctgctg

SEQ ID NO: 9255412 - DNA, 22 bp, Homo sapiens
gtgctttccatcctccctgctg

SEQ ID NO: 9255413 - DNA, 22 bp, Homo sapiens
gtgcttttaacttttgaaagga

SEQ ID NO: 9255414 - DNA, 22 bp, Homo sapiens
gtgcttttaattctggtgagta

SEQ ID NO: 9255415 - DNA, 22 bp, Homo sapiens
gtgctttaaagacagttatgct

SEQ ID NO: 9255416 - DNA, 22 bp, Homo sapiens
gtgtgtgtatctgcctatcaca

SEQ ID NO: 9255417 - DNA, 22 bp, Homo sapiens
gtgcttttccttatttggtgct

SEQ ID NO: 9255418 - DNA, 22 bp, Homo sapiens
gtgtgtgtgcatataacatata

SEQ ID NO: 9255419 - DNA, 22 bp, Homo sapiens
gtgtgtgtctccgcggccgtag

SEQ ID NO: 9255420 - DNA, 22 bp, Homo sapiens
gtgtgtgtctccgcggccgtag

SEQ ID NO: 9255421 - DNA, 22 bp, Homo sapiens
gtttagaattctaactttaagg

SEQ ID NO: 9255422 - DNA, 22 bp, Homo sapiens
gtttagatttcatgaagacact

SEQ ID NO: 9255423 - DNA, 22 bp, Homo sapiens
gtttagatgagattttagaaca

SEQ ID NO: 9255424 - DNA, 22 bp, Homo sapiens
gtttagaatggcaaaattaagt

SEQ ID NO: 9255425 - DNA, 22 bp, Homo sapiens
gtttagaatgaaacttttgagc

SEQ ID NO: 9255426 - DNA, 22 bp, Homo sapiens
gtttagcaataaaaacacatga

SEQ ID NO: 9255427 - DNA, 20 bp, Homo sapiens
gtttagcatggcagtgaaag

SEQ ID NO: 9255428 - DNA, 22 bp, Homo sapiens
gtttataaattctgcttttgtt

SEQ ID NO: 9255429 - DNA, 22 bp, Homo sapiens
gtttagaagccaagatttgggt

SEQ ID NO: 9255430 - DNA, 21 bp, Homo sapiens
gtttagaagtagtctggctca

SEQ ID NO: 9255431 - DNA, 22 bp, Homo sapiens
gtttagaaaatagtgaagcaag

SEQ ID NO: 9255432 - DNA, 22 bp, Homo sapiens
gtttagaacacggaaatactga

SEQ ID NO: 9255433 - DNA, 22 bp, Homo sapiens
gtttacattgctgtttgtgtct

SEQ ID NO: 9255434 - DNA, 22 bp, Homo sapiens
gtttacaaatattttaaatggt

SEQ ID NO: 9255435 - DNA, 22 bp, Homo sapiens
gtttacaaatattttaaatggt

SEQ ID NO: 9255436 - DNA, 22 bp, Homo sapiens
gttccacaaaatgtacccagtt

SEQ ID NO: 9255437 - DNA, 22 bp, Homo sapiens
gttccttgtaatttgttaagga

SEQ ID NO: 9255438 - DNA, 22 bp, Homo sapiens
gttccttgggaacaacgctgaa

SEQ ID NO: 9255439 - DNA, 22 bp, Homo sapiens
gttccttgtatttcagacatga

SEQ ID NO: 9255440 - DNA, 22 bp, Homo sapiens
gttccttgtatttcagacatga

SEQ ID NO: 9255441 - DNA, 22 bp, Homo sapiens
gtttaattttaggttgtcaagc

SEQ ID NO: 9255442 - DNA, 22 bp, Homo sapiens
gtttaattttaggttgtcaagc

SEQ ID NO: 9255443 - DNA, 22 bp, Homo sapiens
gttccttgggaacaacgctgaa

SEQ ID NO: 9255444 - DNA, 22 bp, Homo sapiens
gttccttggaagaacttgaggt

SEQ ID NO: 9255445 - DNA, 22 bp, Homo sapiens
gttccttggaagaacttgaggt

SEQ ID NO: 9255446 - DNA, 23 bp, Homo sapiens
gttccttcatgtggtcattggtt

SEQ ID NO: 9255447 - DNA, 22 bp, Homo sapiens
gttcctgggcctgcattcacca

SEQ ID NO: 9255448 - DNA, 22 bp, Homo sapiens
gtttctcacaaggctgcaatcc

SEQ ID NO: 9255449 - DNA, 22 bp, Homo sapiens
gtttctcaacatgctttctaac

SEQ ID NO: 9255450 - DNA, 22 bp, Homo sapiens
gtttctcaacatgctttctaac

SEQ ID NO: 9255451 - DNA, 22 bp, Homo sapiens
gtttctcaacatgctttctaac

SEQ ID NO: 9255452 - DNA, 22 bp, Homo sapiens
gtttctcaaattatttcagctt

SEQ ID NO: 9255453 - DNA, 22 bp, Homo sapiens
gtttcctttttctgccctcaat

SEQ ID NO: 9255454 - DNA, 22 bp, Homo sapiens
gtttcctttttctgccctcaat

SEQ ID NO: 9255455 - DNA, 22 bp, Homo sapiens
gtttccttttggaattagagct

SEQ ID NO: 9255456 - DNA, 22 bp, Homo sapiens
gtttcgtcaggcttattctatc

SEQ ID NO: 9255457 - DNA, 22 bp, Homo sapiens
gtttataaggcccaatatttct

SEQ ID NO: 9255458 - DNA, 22 bp, Homo sapiens
gtttataatccaactctgctcc

SEQ ID NO: 9255459 - DNA, 22 bp, Homo sapiens
gtttatatgaacttcataccca

SEQ ID NO: 9255460 - DNA, 22 bp, Homo sapiens
gtttccttttggaattagagct

SEQ ID NO: 9255461 - DNA, 22 bp, Homo sapiens
gtttccttttggaattagagct

SEQ ID NO: 9255462 - DNA, 22 bp, Homo sapiens
gtttcctttgccagtaaatggg

SEQ ID NO: 9255463 - DNA, 22 bp, Homo sapiens
gtttcctttctattgccttgat

SEQ ID NO: 9255464 - DNA, 22 bp, Homo sapiens
gtttcctacactgtagtattat

SEQ ID NO: 9255465 - DNA, 22 bp, Homo sapiens
gtttcctagatcagtgttctta

SEQ ID NO: 9255466 - DNA, 22 bp, Homo sapiens
gtttcctaccagtggttccaga

SEQ ID NO: 9255467 - DNA, 22 bp, Homo sapiens
gtttcctaggcttatacagctg

SEQ ID NO: 9255468 - DNA, 22 bp, Homo sapiens
gttttacacacctatgaaagac

SEQ ID NO: 9255469 - DNA, 22 bp, Homo sapiens
gttttacaaggttaatcagcag

SEQ ID NO: 9255470 - DNA, 23 bp, Homo sapiens
gttttacaggtgagaaaatggag

SEQ ID NO: 9255471 - DNA, 22 bp, Homo sapiens
gtttctgttgctcagataatgc

SEQ ID NO: 9255472 - DNA, 22 bp, Homo sapiens
gtttcttaaatgtagcaggacc

SEQ ID NO: 9255473 - DNA, 22 bp, Homo sapiens
gtttctgattctagaggcaggc

SEQ ID NO: 9255474 - DNA, 22 bp, Homo sapiens
gtttctgattctagaggcaggc

SEQ ID NO: 9255475 - DNA, 20 bp, Homo sapiens
gtttctgattcagtaggtct

SEQ ID NO: 9255476 - DNA, 22 bp, Homo sapiens
gtttctcttaacacataaagta

SEQ ID NO: 9255477 - DNA, 22 bp, Homo sapiens
gtttctctttgaagcctggctg

SEQ ID NO: 9255478 - DNA, 22 bp, Homo sapiens
gtttctgagcacttttattgca

SEQ ID NO: 9255479 - DNA, 22 bp, Homo sapiens
gtttctctgtctgttacattgg

SEQ ID NO: 9255480 - DNA, 22 bp, Homo sapiens
gtttctctgtctgttacattgg

SEQ ID NO: 9255481 - DNA, 22 bp, Homo sapiens
gtttctctgtacctctgtccca

SEQ ID NO: 9255482 - DNA, 22 bp, Homo sapiens
gtttctctgtacctctgtccca

SEQ ID NO: 9255483 - DNA, 22 bp, Homo sapiens
gtttctcatcagtttctgatat

SEQ ID NO: 9255484 - DNA, 22 bp, Homo sapiens
gtttctcctctgtgtcttgttt

SEQ ID NO: 9255485 - DNA, 22 bp, Homo sapiens
gtttctcctctgtgtcttgttt

SEQ ID NO: 9255486 - DNA, 22 bp, Homo sapiens
tccgggggtggtagatttcctt

SEQ ID NO: 9255487 - DNA, 19 bp, Homo sapiens
tcctcagtgacaacctcag

SEQ ID NO: 9255488 - DNA, 22 bp, Homo sapiens
tcctcatctcggaacctgccac

SEQ ID NO: 9255489 - DNA, 22 bp, Homo sapiens
tcctcatagactgactgcttgc

SEQ ID NO: 9255490 - DNA, 22 bp, Homo sapiens
tcctcatacatatctcagtctt

SEQ ID NO: 9255491 - DNA, 22 bp, Homo sapiens
tccgctggagagggggctgcca

SEQ ID NO: 9255492 - DNA, 22 bp, Homo sapiens
tccgggagctgaacgtcttgcg

SEQ ID NO: 9255493 - DNA, 22 bp, Homo sapiens
tccgggaggcagaggttgcagt

SEQ ID NO: 9255494 - DNA, 22 bp, Homo sapiens
tccgagttgaagtaggatagcg

SEQ ID NO: 9255495 - DNA, 22 bp, Homo sapiens
tccgataagcaattcttgtgct

SEQ ID NO: 9255496 - DNA, 22 bp, Homo sapiens
tcctccaagcagaggccctgaa

SEQ ID NO: 9255497 - DNA, 22 bp, Homo sapiens
tcctcatctgtaccttggggta

SEQ ID NO: 9255498 - DNA, 20 bp, Homo sapiens
tcctccagaagggcagggtg

SEQ ID NO: 9255499 - DNA, 20 bp, Homo sapiens
tcctccagaagggcagggtg

SEQ ID NO: 9255500 - DNA, 22 bp, Homo sapiens
tcctccagaaactgaggcagaa

SEQ ID NO: 9255501 - DNA, 22 bp, Homo sapiens
tcctccacgatggcacacctgg

SEQ ID NO: 9255502 - DNA, 22 bp, Homo sapiens
tcctccaggcacctcactggct

SEQ ID NO: 9255503 - DNA, 22 bp, Homo sapiens
tcctccaggataaaatgtgttg

SEQ ID NO: 9255504 - DNA, 22 bp, Homo sapiens
tcctccaggcacctcactggct

SEQ ID NO: 9255505 - DNA, 22 bp, Homo sapiens
tcctccagctgtatcctgcctg

SEQ ID NO: 9255506 - DNA, 22 bp, Homo sapiens
tcctccagcttctcttttgggg

SEQ ID NO: 9255507 - DNA, 22 bp, Homo sapiens
tcctccagctactaggcaaata

SEQ ID NO: 9255508 - DNA, 22 bp, Homo sapiens
tcctccagccctctaggaaaat

SEQ ID NO: 9255509 - DNA, 22 bp, Homo sapiens
tcctccagaccacttctgtgcg

SEQ ID NO: 9255510 - DNA, 22 bp, Homo sapiens
tcctccagagatttgagttatt

SEQ ID NO: 9255511 - DNA, 23 bp, Homo sapiens
tcctccagaggccctccttggcc

SEQ ID NO: 9255512 - DNA, 22 bp, Homo sapiens
tcctccagcaggactgaggccc

SEQ ID NO: 9255513 - DNA, 22 bp, Homo sapiens
tcctcccttgactcctgctttt

SEQ ID NO: 9255514 - DNA, 22 bp, Homo sapiens
tcctcctcacgctgttgcttgt

SEQ ID NO: 9255515 - DNA, 23 bp, Homo sapiens
tcctcctgacacagcctgagtga

SEQ ID NO: 9255516 - DNA, 23 bp, Homo sapiens
tcctcctgacacagcctgagtga

SEQ ID NO: 9255517 - DNA, 22 bp, Homo sapiens
tcctcctcctcacagtcacctg

SEQ ID NO: 9255518 - DNA, 22 bp, Homo sapiens
tcctcctgcctttgcttcttgt

SEQ ID NO: 9255519 - DNA, 23 bp, Homo sapiens
tcctcctgagtgagagtgccagc

SEQ ID NO: 9255520 - DNA, 22 bp, Homo sapiens
tcctccagtggcccagtccttc

SEQ ID NO: 9255521 - DNA, 22 bp, Homo sapiens
tcctccaggtctagggtggctt

SEQ ID NO: 9255522 - DNA, 22 bp, Homo sapiens
tcctccagtcttggtgaggttg

SEQ ID NO: 9255523 - DNA, 22 bp, Homo sapiens
tcctccaggtctagggtggctt

SEQ ID NO: 9255524 - DNA, 22 bp, Homo sapiens
tcctccagggggatcttcagcc

SEQ ID NO: 9255525 - DNA, 22 bp, Homo sapiens
tcctccagttccttggtttcag

SEQ ID NO: 9255526 - DNA, 22 bp, Homo sapiens
tcctccctaaatcctagactgt

SEQ ID NO: 9255527 - DNA, 22 bp, Homo sapiens
tcctcccctcagggcaacggat

SEQ ID NO: 9255528 - DNA, 22 bp, Homo sapiens
tcctccagtggtactggccaat

SEQ ID NO: 9255529 - DNA, 22 bp, Homo sapiens
tcctccagtgtctggggccttg

SEQ ID NO: 9255530 - DNA, 22 bp, Homo sapiens
tcctccagtgtctggggccttg

SEQ ID NO: 9255531 - DNA, 22 bp, Homo sapiens
tcctccctgcactcagtgaagt

SEQ ID NO: 9255532 - DNA, 22 bp, Homo sapiens
tcctcccttgactcctgctttt

SEQ ID NO: 9255533 - DNA, 22 bp, Homo sapiens
tcctccctgtaccattcctctg

SEQ ID NO: 9255534 - DNA, 22 bp, Homo sapiens
tcctccctgagtggggacagct

SEQ ID NO: 9255535 - DNA, 23 bp, Homo sapiens
tcctccctgacttctacagcaca

SEQ ID NO: 9255536 - DNA, 22 bp, Homo sapiens
tcctccctaactcatgatgagt

SEQ ID NO: 9255537 - DNA, 23 bp, Homo sapiens
tcctccctgacttctacagcaca

SEQ ID NO: 9255538 - DNA, 22 bp, Homo sapiens
tccctgcagacgtcctgcgggt

SEQ ID NO: 9255539 - DNA, 22 bp, Homo sapiens
tccctgcacagccgagccatgc

SEQ ID NO: 9255540 - DNA, 22 bp, Homo sapiens
tccctgcagtaggcagccctcc

SEQ ID NO: 9255541 - DNA, 22 bp, Homo sapiens
tccctgcagcaggtgatcaatg

SEQ ID NO: 9255542 - DNA, 22 bp, Homo sapiens
tccctgcagcccctgagccttc

SEQ ID NO: 9255543 - DNA, 22 bp, Homo sapiens
tccctgcagacgtcctgcgggt

SEQ ID NO: 9255544 - DNA, 22 bp, Homo sapiens
tccctgcagcccctgagccttc

SEQ ID NO: 9255545 - DNA, 22 bp, Homo sapiens
tccctgccaatgattggagcaa

SEQ ID NO: 9255546 - DNA, 22 bp, Homo sapiens
tccctgccagtcctggtctgaa

SEQ ID NO: 9255547 - DNA, 22 bp, Homo sapiens
tccctgccagtcctggtctgaa

SEQ ID NO: 9255548 - DNA, 22 bp, Homo sapiens
tccctgccctcagtgcacccgg

SEQ ID NO: 9255549 - DNA, 22 bp, Homo sapiens
tccctgccctcagtgcacccgg

SEQ ID NO: 9255550 - DNA, 22 bp, Homo sapiens
tccctgggccacagctgtgagc

SEQ ID NO: 9255551 - DNA, 22 bp, Homo sapiens
tccctgggcacaatctgctggc

SEQ ID NO: 9255552 - DNA, 22 bp, Homo sapiens
tccctgggcatcacgttgcttc

SEQ ID NO: 9255553 - DNA, 22 bp, Homo sapiens
tccctgggcacaatctgctggc

SEQ ID NO: 9255554 - DNA, 23 bp, Homo sapiens
tccctgagctggagagactgcac

SEQ ID NO: 9255555 - DNA, 22 bp, Homo sapiens
tccctgaggaaggggtgtggtg

SEQ ID NO: 9255556 - DNA, 22 bp, Homo sapiens
tccctgagtgggctggtagtat

SEQ ID NO: 9255557 - DNA, 19 bp, Homo sapiens
tccctgagttccagcccag

SEQ ID NO: 9255558 - DNA, 22 bp, Homo sapiens
tccctgagtgtatgtggtgaac

SEQ ID NO: 9255559 - DNA, 22 bp, Homo sapiens
tcccaggatgtttatggctggt

SEQ ID NO: 9255560 - DNA, 22 bp, Homo sapiens
tcccaggattttaggctctcag

SEQ ID NO: 9255561 - DNA, 22 bp, Homo sapiens
tccctgtctcccttgagactag

SEQ ID NO: 9255562 - DNA, 22 bp, Homo sapiens
tccctgtcctgggcaatcccag

SEQ ID NO: 9255563 - DNA, 20 bp, Homo sapiens
tccctggggccctacttcct

SEQ ID NO: 9255564 - DNA, 22 bp, Homo sapiens
tccctgtggatatctgcagctg

SEQ ID NO: 9255565 - DNA, 21 bp, Homo sapiens
tccctgtgagcagctcttcct

SEQ ID NO: 9255566 - DNA, 22 bp, Homo sapiens
tccctggggaagggcaagcaag

SEQ ID NO: 9255567 - DNA, 22 bp, Homo sapiens
tccctggggatgttggcctgcc

SEQ ID NO: 9255568 - DNA, 22 bp, Homo sapiens
tccctgggcctatcttagctcc

SEQ ID NO: 9255569 - DNA, 22 bp, Homo sapiens
tccctgggcctatcttagctcc

SEQ ID NO: 9255570 - DNA, 22 bp, Homo sapiens
tccctgggcctcctgctatgca

SEQ ID NO: 9255571 - DNA, 23 bp, Homo sapiens
tccctgtgtacagcctgcatgag

SEQ ID NO: 9255572 - DNA, 22 bp, Homo sapiens
tccctgtgggcagaggctgcct

SEQ ID NO: 9255573 - DNA, 22 bp, Homo sapiens
tccctgtgggatgaggactctg

SEQ ID NO: 9255574 - DNA, 22 bp, Homo sapiens
tcccttcaataattcaacatta

SEQ ID NO: 9255575 - DNA, 22 bp, Homo sapiens
tcccttgagagttggccaattg

SEQ ID NO: 9255576 - DNA, 22 bp, Homo sapiens
tcccttctggcagcagtgtgag

SEQ ID NO: 9255577 - DNA, 22 bp, Homo sapiens
tcccttggaaagtagcctcaca

SEQ ID NO: 9255578 - DNA, 22 bp, Homo sapiens
tcccttggttaaatatgtagga

SEQ ID NO: 9255579 - DNA, 22 bp, Homo sapiens
tcccttctggcagcagtgtgag

SEQ ID NO: 9255580 - DNA, 22 bp, Homo sapiens
tcccttctggcagcagtgtgag

SEQ ID NO: 9255581 - DNA, 22 bp, Homo sapiens
tccactgcagcttctgatggaa

SEQ ID NO: 9255582 - DNA, 22 bp, Homo sapiens
tccactgcagcttctgatggaa

SEQ ID NO: 9255583 - DNA, 22 bp, Homo sapiens
tccagaaaaagtaatttatttg

SEQ ID NO: 9255584 - DNA, 22 bp, Homo sapiens
tccagaaaattcagaaattgtt

SEQ ID NO: 9255585 - DNA, 22 bp, Homo sapiens
tccacttcatccagggtcacca

SEQ ID NO: 9255586 - DNA, 22 bp, Homo sapiens
tccacttctattgggtcttggt

SEQ ID NO: 9255587 - DNA, 22 bp, Homo sapiens
tccacgtgagcttcgtgtgcag

SEQ ID NO: 9255588 - DNA, 22 bp, Homo sapiens
tccacgctgtgtgaccttgggc

SEQ ID NO: 9255589 - DNA, 22 bp, Homo sapiens
tccactgacaggtgaatggata

SEQ ID NO: 9255590 - DNA, 21 bp, Homo sapiens
tccactcgtattctgttggca

SEQ ID NO: 9255591 - DNA, 22 bp, Homo sapiens
tccacattctctgttacagata

SEQ ID NO: 9255592 - DNA, 22 bp, Homo sapiens
tccaccagagccttcccatgct

SEQ ID NO: 9255593 - DNA, 22 bp, Homo sapiens
tccaccagcttcttcaccagct

SEQ ID NO: 9255594 - DNA, 22 bp, Homo sapiens
tccaccagccaggcccaggctg

SEQ ID NO: 9255595 - DNA, 22 bp, Homo sapiens
tccaccaggctccatgttcagt

SEQ ID NO: 9255596 - DNA, 20 bp, Homo sapiens
tccaccaggaagggtaggga

SEQ ID NO: 9255597 - DNA, 22 bp, Homo sapiens
tccaccatgtaacaagctctgt

SEQ ID NO: 9255598 - DNA, 22 bp, Homo sapiens
tccaccatgtaacaagctctgt

SEQ ID NO: 9255599 - DNA, 22 bp, Homo sapiens
tccacagcacaaagccagtgtg

SEQ ID NO: 9255600 - DNA, 22 bp, Homo sapiens
tccacagcacaaagccagtgtg

SEQ ID NO: 9255601 - DNA, 22 bp, Homo sapiens
tccacagattaaaaacatactt

SEQ ID NO: 9255602 - DNA, 22 bp, Homo sapiens
tccacaggcaagtctcttggca

SEQ ID NO: 9255603 - DNA, 22 bp, Homo sapiens
tccacagggatgttgagttctt

SEQ ID NO: 9255604 - DNA, 22 bp, Homo sapiens
tcattaatttgcttagacttat

SEQ ID NO: 9255605 - DNA, 22 bp, Homo sapiens
tcattaatcccggggtccaggg

SEQ ID NO: 9255606 - DNA, 22 bp, Homo sapiens
tccacagaatgtaagatccaca

SEQ ID NO: 9255607 - DNA, 22 bp, Homo sapiens
tccacagaccagtatctgcagc

SEQ ID NO: 9255608 - DNA, 22 bp, Homo sapiens
tcatggctggaagctcagttag

SEQ ID NO: 9255609 - DNA, 22 bp, Homo sapiens
tcatgtgtcctagttcatataa

SEQ ID NO: 9255610 - DNA, 22 bp, Homo sapiens
tcatgtgtcctagttcatataa

SEQ ID NO: 9255611 - DNA, 22 bp, Homo sapiens
tcatgtgtctgccagtgtttat

SEQ ID NO: 9255612 - DNA, 22 bp, Homo sapiens
tcatgtttggagtttgctcact

SEQ ID NO: 9255613 - DNA, 22 bp, Homo sapiens
tcatgtttgttggaaatgtggc

SEQ ID NO: 9255614 - DNA, 22 bp, Homo sapiens
tcatgtttgccctaagaaaaag

SEQ ID NO: 9255615 - DNA, 22 bp, Homo sapiens
tcatgttgaattatcgttccca

SEQ ID NO: 9255616 - DNA, 22 bp, Homo sapiens
tcatgttttagctgcaaaatga

SEQ ID NO: 9255617 - DNA, 22 bp, Homo sapiens
tcatgttttagtaaagtgaagg

SEQ ID NO: 9255618 - DNA, 22 bp, Homo sapiens
tccagccctcagccaagtggaa

SEQ ID NO: 9255619 - DNA, 22 bp, Homo sapiens
tccagcccgggggcaggtgacc

SEQ ID NO: 9255620 - DNA, 20 bp, Homo sapiens
tccagcccctgcatgttgct

SEQ ID NO: 9255621 - DNA, 22 bp, Homo sapiens
tccagcccgactgggcctgccg

SEQ ID NO: 9255622 - DNA, 22 bp, Homo sapiens
tccagcccgactgggcctgccg

SEQ ID NO: 9255623 - DNA, 17 bp, Homo sapiens
tccagccctgcccgacg

SEQ ID NO: 9255624 - DNA, 22 bp, Homo sapiens
tccagccctgcttcctgcctca

SEQ ID NO: 9255625 - DNA, 22 bp, Homo sapiens
tccagccctcctgggatcacag

SEQ ID NO: 9255626 - DNA, 22 bp, Homo sapiens
tccagccactcagcagggattg

SEQ ID NO: 9255627 - DNA, 20 bp, Homo sapiens
tccagccacttccgctggtc

SEQ ID NO: 9255628 - DNA, 22 bp, Homo sapiens
tccagcccaggctggagtgtag

SEQ ID NO: 9255629 - DNA, 20 bp, Homo sapiens
tccagcccaggtcctgcctg

SEQ ID NO: 9255630 - DNA, 22 bp, Homo sapiens
tccagaaatgcaagccaggtgt

SEQ ID NO: 9255631 - DNA, 22 bp, Homo sapiens
tccagccaccaccttgattgcc

SEQ ID NO: 9255632 - DNA, 22 bp, Homo sapiens
tccagccactcagcagggattg

SEQ ID NO: 9255633 - DNA, 19 bp, Homo sapiens
tccagcccctctgtgtgtg

SEQ ID NO: 9255634 - DNA, 21 bp, Homo sapiens
tccagcctttccctcacttcc

SEQ ID NO: 9255635 - DNA, 19 bp, Homo sapiens
tccagcctgctgtttctct

SEQ ID NO: 9255636 - DNA, 19 bp, Homo sapiens
tccagcctgctgtttctct

SEQ ID NO: 9255637 - DNA, 20 bp, Homo sapiens
tccagccctgcttctctctt

SEQ ID NO: 9255638 - DNA, 22 bp, Homo sapiens
tccagccctgtggcttccaccc

SEQ ID NO: 9255639 - DNA, 23 bp, Homo sapiens
tccagcctcttgctctcacatgc

SEQ ID NO: 9255640 - DNA, 23 bp, Homo sapiens
tccagcctcttgctctcacatgc

SEQ ID NO: 9255641 - DNA, 20 bp, Homo sapiens
tccaggagaactgggagccg

SEQ ID NO: 9255642 - DNA, 22 bp, Homo sapiens
tccaggagctcatccacgtcaa

SEQ ID NO: 9255643 - DNA, 23 bp, Homo sapiens
tccaggagcatgctggctggcga

SEQ ID NO: 9255644 - DNA, 23 bp, Homo sapiens
tccaggagcatgctggctggcga

SEQ ID NO: 9255645 - DNA, 22 bp, Homo sapiens
tccaggaggactgagggggctg

SEQ ID NO: 9255646 - DNA, 22 bp, Homo sapiens
tccaggagctcatccacgtcaa

SEQ ID NO: 9255647 - DNA, 22 bp, Homo sapiens
tccaggaggactgagggggctg

SEQ ID NO: 9255648 - DNA, 22 bp, Homo sapiens
tccaggaggaggaaggctgcca

SEQ ID NO: 9255649 - DNA, 18 bp, Homo sapiens
tccaggactctgcgtggc

SEQ ID NO: 9255650 - DNA, 22 bp, Homo sapiens
tccaggactagcatttctgata

SEQ ID NO: 9255651 - DNA, 22 bp, Homo sapiens
tccaggacagcggcaggcagat

SEQ ID NO: 9255652 - DNA, 22 bp, Homo sapiens
tccaggaggaggaaggctgcca

SEQ ID NO: 9255653 - DNA, 22 bp, Homo sapiens
tccaggaggcagggctgtgccc

SEQ ID NO: 9255654 - DNA, 22 bp, Homo sapiens
tccaggaggcagggctgtgccc

SEQ ID NO: 9255655 - DNA, 22 bp, Homo sapiens
tccaggaggcagggctgtgccc

SEQ ID NO: 9255656 - DNA, 22 bp, Homo sapiens
tccagggagagccgctgctcca

SEQ ID NO: 9255657 - DNA, 22 bp, Homo sapiens
tccagggagatactggctgcca

SEQ ID NO: 9255658 - DNA, 22 bp, Homo sapiens
tccagggagatggcagaggctg

SEQ ID NO: 9255659 - DNA, 22 bp, Homo sapiens
tccagggagatggcagaggctg

SEQ ID NO: 9255660 - DNA, 22 bp, Homo sapiens
tccagggagcaagtcaggccgg

SEQ ID NO: 9255661 - DNA, 22 bp, Homo sapiens
tccagggacctccctgagagct

SEQ ID NO: 9255662 - DNA, 20 bp, Homo sapiens
tccagtggcctgaatctgga

SEQ ID NO: 9255663 - DNA, 22 bp, Homo sapiens
tccagtggcaggcggtgaggtc

SEQ ID NO: 9255664 - DNA, 22 bp, Homo sapiens
tccagtctggtatgaatcctag

SEQ ID NO: 9255665 - DNA, 22 bp, Homo sapiens
tccagtcttcttgcagctacat

SEQ ID NO: 9255666 - DNA, 23 bp, Homo sapiens
tccagtctcctgaaaggcagcgt

SEQ ID NO: 9255667 - DNA, 22 bp, Homo sapiens
tccagggagcaagtcaggccgg

SEQ ID NO: 9255668 - DNA, 22 bp, Homo sapiens
tccagggagttggctggatagt

SEQ ID NO: 9255669 - DNA, 22 bp, Homo sapiens
tccagggagcaagtcaggccgg

SEQ ID NO: 9255670 - DNA, 22 bp, Homo sapiens
tccagggatctttagagtcttt

SEQ ID NO: 9255671 - DNA, 22 bp, Homo sapiens
tccagggatctttagagtcttt

SEQ ID NO: 9255672 - DNA, 22 bp, Homo sapiens
tccagggatgccagccatgttg

SEQ ID NO: 9255673 - DNA, 22 bp, Homo sapiens
tccagggatggtaatgagcagt

SEQ ID NO: 9255674 - DNA, 20 bp, Homo sapiens
tccagggcaaactcatcacc

SEQ ID NO: 9255675 - DNA, 20 bp, Homo sapiens
tccagggcaaactcatcacc

SEQ ID NO: 9255676 - DNA, 20 bp, Homo sapiens
tccagggcaactagagtgtg

SEQ ID NO: 9255677 - DNA, 20 bp, Homo sapiens
tccagggcaactagagtgtg

SEQ ID NO: 9255678 - DNA, 22 bp, Homo sapiens
tccagggcaccagcgtccccct

SEQ ID NO: 9255679 - DNA, 22 bp, Homo sapiens
tccagggcaccagcgtccccct

SEQ ID NO: 9255680 - DNA, 20 bp, Homo sapiens
tccagggcaactagagtgtg

SEQ ID NO: 9255681 - DNA, 22 bp, Homo sapiens
tccagtcaggctgaattcaagg

SEQ ID NO: 9255682 - DNA, 22 bp, Homo sapiens
tccagggcagccgcgggtgcgc

SEQ ID NO: 9255683 - DNA, 22 bp, Homo sapiens
tccagggcagccgcgggtgcgc

SEQ ID NO: 9255684 - DNA, 22 bp, Homo sapiens
tcccagaatcctcactctatca

SEQ ID NO: 9255685 - DNA, 22 bp, Homo sapiens
tcccagaatctccagtgctaca

SEQ ID NO: 9255686 - DNA, 22 bp, Homo sapiens
tcccagaatctccagtgctaca

SEQ ID NO: 9255687 - DNA, 22 bp, Homo sapiens
tcccagaatctttggaagagca

SEQ ID NO: 9255688 - DNA, 22 bp, Homo sapiens
tcccagacaatcattggccacc

SEQ ID NO: 9255689 - DNA, 22 bp, Homo sapiens
tcccagagaaagtcaaggtctt

SEQ ID NO: 9255690 - DNA, 22 bp, Homo sapiens
tcccagaagtccagccatgggc

SEQ ID NO: 9255691 - DNA, 22 bp, Homo sapiens
tcccagaaccctgccaggtcct

SEQ ID NO: 9255692 - DNA, 22 bp, Homo sapiens
tcccagaagagatgccacttga

SEQ ID NO: 9255693 - DNA, 22 bp, Homo sapiens
tcccagagtattagcaattgct

SEQ ID NO: 9255694 - DNA, 22 bp, Homo sapiens
tcccagagtcagaggtggggcc

SEQ ID NO: 9255695 - DNA, 22 bp, Homo sapiens
tcccagagtattagcaattgct

SEQ ID NO: 9255696 - DNA, 19 bp, Homo sapiens
tcccagagtctagaggttg

SEQ ID NO: 9255697 - DNA, 22 bp, Homo sapiens
tcccagagtcagaggtggggcc

SEQ ID NO: 9255698 - DNA, 19 bp, Homo sapiens
tcccagagtctagaggttg

SEQ ID NO: 9255699 - DNA, 22 bp, Homo sapiens
tcccagagtcttctcctgtaat

SEQ ID NO: 9255700 - DNA, 21 bp, Homo sapiens
tcccagagtgcttgggactgc

SEQ ID NO: 9255701 - DNA, 21 bp, Homo sapiens
tcccagagtgcttgggactgc

SEQ ID NO: 9255702 - DNA, 22 bp, Homo sapiens
tcccagagtgagccaggggcag

SEQ ID NO: 9255703 - DNA, 22 bp, Homo sapiens
tcccagagtgtgggcatcaagg

SEQ ID NO: 9255704 - DNA, 22 bp, Homo sapiens
tcccagagtgtgggcatcaagg

SEQ ID NO: 9255705 - DNA, 22 bp, Homo sapiens
tccagttctaggtcactctctg

SEQ ID NO: 9255706 - DNA, 22 bp, Homo sapiens
tcccactgtgaatccaaggcct

SEQ ID NO: 9255707 - DNA, 22 bp, Homo sapiens
tcccactgtgcctgttgtaatc

SEQ ID NO: 9255708 - DNA, 22 bp, Homo sapiens
tcccagaaaaaggaggctatga

SEQ ID NO: 9255709 - DNA, 22 bp, Homo sapiens
tcccagaaaaaggaggctatga

SEQ ID NO: 9255710 - DNA, 22 bp, Homo sapiens
tcccactggacgtctgtgctgg

SEQ ID NO: 9255711 - DNA, 22 bp, Homo sapiens
tcccagcagtcagagctatgtg

SEQ ID NO: 9255712 - DNA, 22 bp, Homo sapiens
tcccagcctttcttttctgctg

SEQ ID NO: 9255713 - DNA, 22 bp, Homo sapiens
tcccagcagggccgaccagcct

SEQ ID NO: 9255714 - DNA, 22 bp, Homo sapiens
tcccagcagatgagctgaccta

SEQ ID NO: 9255715 - DNA, 22 bp, Homo sapiens
tcccagcagcatagctcagaat

SEQ ID NO: 9255716 - DNA, 22 bp, Homo sapiens
tcccagcagcatagctcagaat

SEQ ID NO: 9255717 - DNA, 22 bp, Homo sapiens
tcccagcagagccagcaagccg

SEQ ID NO: 9255718 - DNA, 22 bp, Homo sapiens
tcccagattcctgctcttatat

SEQ ID NO: 9255719 - DNA, 22 bp, Homo sapiens
tcccagagtttcctgtgtccca

SEQ ID NO: 9255720 - DNA, 22 bp, Homo sapiens
tcccagagttcaatgggaaggt

SEQ ID NO: 9255721 - DNA, 22 bp, Homo sapiens
tcccagagttcaatgggaaggt

SEQ ID NO: 9255722 - DNA, 22 bp, Homo sapiens
tcccagattgttgatggcttaa

SEQ ID NO: 9255723 - DNA, 17 bp, Homo sapiens
tcccaggaacagggaat

SEQ ID NO: 9255724 - DNA, 22 bp, Homo sapiens
tcccaggaaaacactcgaggac

SEQ ID NO: 9255725 - DNA, 19 bp, Homo sapiens
tcccaggaagcaaatgtca

SEQ ID NO: 9255726 - DNA, 19 bp, Homo sapiens
tcccaggaaccttttattt

SEQ ID NO: 9255727 - DNA, 22 bp, Homo sapiens
tcccaggaagatcccagggacc

SEQ ID NO: 9255728 - DNA, 22 bp, Homo sapiens
tcccaggaaggattcggcattt

SEQ ID NO: 9255729 - DNA, 22 bp, Homo sapiens
tcccaggatctgagggcagaga

SEQ ID NO: 9255730 - DNA, 22 bp, Homo sapiens
tcccaggatctgagggcagaga

SEQ ID NO: 9255731 - DNA, 22 bp, Homo sapiens
tcccaggatgaagacagtgttg

SEQ ID NO: 9255732 - DNA, 22 bp, Homo sapiens
tcccaggatgaagacagtgttg

SEQ ID NO: 9255733 - DNA, 22 bp, Homo sapiens
tcccaggatgtgcgtgccgccg

SEQ ID NO: 9255734 - DNA, 22 bp, Homo sapiens
tcccaggatgttggcggcaggt

SEQ ID NO: 9255735 - DNA, 22 bp, Homo sapiens
tcccaggatgttggcggcaggt

SEQ ID NO: 9255736 - DNA, 22 bp, Homo sapiens
tcccaggaaaacactcgaggac

SEQ ID NO: 9255737 - DNA, 22 bp, Homo sapiens
tcccagcttagatttgctcatt

SEQ ID NO: 9255738 - DNA, 21 bp, Homo sapiens
tcccagctgggtcagtgctgc

SEQ ID NO: 9255739 - DNA, 21 bp, Homo sapiens
tcccagctgggtcagtgctgc

SEQ ID NO: 9255740 - DNA, 22 bp, Homo sapiens
tcccagctgtgtggaggagatg

SEQ ID NO: 9255741 - DNA, 22 bp, Homo sapiens
tcccagctactctagaggctga

SEQ ID NO: 9255742 - DNA, 22 bp, Homo sapiens
tcccagctcacatatggtaact

SEQ ID NO: 9255743 - DNA, 22 bp, Homo sapiens
tcccagctgagattgagcaagg

SEQ ID NO: 9255744 - DNA, 22 bp, Homo sapiens
tcccagctgagattgagcaagg

SEQ ID NO: 9255745 - DNA, 21 bp, Homo sapiens
tcccagctgggtcagtgctgc

SEQ ID NO: 9255746 - DNA, 22 bp, Homo sapiens
tcccagctgctgagatagtgct

SEQ ID NO: 9255747 - DNA, 17 bp, Homo sapiens
tcacatcacacaagcaa

SEQ ID NO: 9255748 - DNA, 22 bp, Homo sapiens
tcacagcctggtcactctgccc

SEQ ID NO: 9255749 - DNA, 22 bp, Homo sapiens
tcacagcatttttagaaagatt

SEQ ID NO: 9255750 - DNA, 22 bp, Homo sapiens
tcacagctaagcttggtcactg

SEQ ID NO: 9255751 - DNA, 22 bp, Homo sapiens
tcacatctaattccatttctgc

SEQ ID NO: 9255752 - DNA, 20 bp, Homo sapiens
tcacatcctctcccaacatg

SEQ ID NO: 9255753 - DNA, 20 bp, Homo sapiens
tcacatcctctcccaacatg

SEQ ID NO: 9255754 - DNA, 20 bp, Homo sapiens
tcacatcctctcccaacatg

SEQ ID NO: 9255755 - DNA, 19 bp, Homo sapiens
tcacagcatctgtctgaac

SEQ ID NO: 9255756 - DNA, 22 bp, Homo sapiens
tcacagcagggtaacaggaaga

SEQ ID NO: 9255757 - DNA, 22 bp, Homo sapiens
tcacagcattgtcacaaggctg

SEQ ID NO: 9255758 - DNA, 22 bp, Homo sapiens
tcacagcattcgcaatggacag

SEQ ID NO: 9255759 - DNA, 22 bp, Homo sapiens
tcacagcagaatttaggaggca

SEQ ID NO: 9255760 - DNA, 22 bp, Homo sapiens
tcacagcaccctgaggtgctgg

SEQ ID NO: 9255761 - DNA, 22 bp, Homo sapiens
tcacagcaccctgaggtgctgg

SEQ ID NO: 9255762 - DNA, 22 bp, Homo sapiens
tcacagcaccaggatctctcca

SEQ ID NO: 9255763 - DNA, 22 bp, Homo sapiens
tcacagcaacactggggcagac

SEQ ID NO: 9255764 - DNA, 22 bp, Homo sapiens
tcacagcaaccctgaggcgagt

SEQ ID NO: 9255765 - DNA, 22 bp, Homo sapiens
tcacagcaaccctgaggcgagt

SEQ ID NO: 9255766 - DNA, 22 bp, Homo sapiens
tcacagcaaatgctgcttctca

SEQ ID NO: 9255767 - DNA, 21 bp, Homo sapiens
tcacagagccacagaattggt

SEQ ID NO: 9255768 - DNA, 22 bp, Homo sapiens
tcacagagcacgtatcatgcct

SEQ ID NO: 9255769 - DNA, 22 bp, Homo sapiens
tcacagagttaaaagtttcttt

SEQ ID NO: 9255770 - DNA, 22 bp, Homo sapiens
tcacagagttaaaagtttcttt

SEQ ID NO: 9255771 - DNA, 20 bp, Homo sapiens
tcacagagtagccttgtctg

SEQ ID NO: 9255772 - DNA, 22 bp, Homo sapiens
tcacagcaaaagtgtgcagagc

SEQ ID NO: 9255773 - DNA, 22 bp, Homo sapiens
tcacagcaaaagtgtgcagagc

SEQ ID NO: 9255774 - DNA, 22 bp, Homo sapiens
tcacagagagtgacttgttgct

SEQ ID NO: 9255775 - DNA, 22 bp, Homo sapiens
tcacagacactgggttattgca

SEQ ID NO: 9255776 - DNA, 22 bp, Homo sapiens
tcacagaatctctgataagtct

SEQ ID NO: 9255777 - DNA, 22 bp, Homo sapiens
tcacagaatttttgcttccagt

SEQ ID NO: 9255778 - DNA, 22 bp, Homo sapiens
tcacacagtggtaaaaccctga

SEQ ID NO: 9255779 - DNA, 22 bp, Homo sapiens
tcacacagtgagaaagtgcgga

SEQ ID NO: 9255780 - DNA, 22 bp, Homo sapiens
tcacacagggttctggtctcat

SEQ ID NO: 9255781 - DNA, 22 bp, Homo sapiens
tcacacatactcatgtgtgagt

SEQ ID NO: 9255782 - DNA, 22 bp, Homo sapiens
tcacacatctcaggtgtttaat

SEQ ID NO: 9255783 - DNA, 22 bp, Homo sapiens
tcacacatgagtaaatacaggg

SEQ ID NO: 9255784 - DNA, 21 bp, Homo sapiens
tcacacacgtttccaagggca

SEQ ID NO: 9255785 - DNA, 22 bp, Homo sapiens
tcacacacatttgctgtctgat

SEQ ID NO: 9255786 - DNA, 22 bp, Homo sapiens
tcacaattgagatcctcccacc

SEQ ID NO: 9255787 - DNA, 23 bp, Homo sapiens
tcaattgatgatgttctcttttg

SEQ ID NO: 9255788 - DNA, 22 bp, Homo sapiens
tcaattcttattggtgttctgc

SEQ ID NO: 9255789 - DNA, 22 bp, Homo sapiens
tcaattcttattggtgttctgc

SEQ ID NO: 9255790 - DNA, 22 bp, Homo sapiens
tcacacacatggatagtatttt

SEQ ID NO: 9255791 - DNA, 22 bp, Homo sapiens
tcacacacatggatagtatttt

SEQ ID NO: 9255792 - DNA, 22 bp, Homo sapiens
tcacacacataatctaagatta

SEQ ID NO: 9255793 - DNA, 22 bp, Homo sapiens
tcacacacataatctaagatta

SEQ ID NO: 9255794 - DNA, 22 bp, Homo sapiens
tcacacagggtcggaaagagtg

SEQ ID NO: 9255795 - DNA, 22 bp, Homo sapiens
tcacacagggtcggaaagagtg

SEQ ID NO: 9255796 - DNA, 23 bp, Homo sapiens
tcacacagctggtcaggtacaga

SEQ ID NO: 9255797 - DNA, 23 bp, Homo sapiens
tcacacagctggtcaggtacaga

SEQ ID NO: 9255798 - DNA, 22 bp, Homo sapiens
tcaattcaacacatgcacattg

SEQ ID NO: 9255799 - DNA, 22 bp, Homo sapiens
tcaattcaattgcatttctgtg

SEQ ID NO: 9255800 - DNA, 22 bp, Homo sapiens
tcaattctggtcctcaggaact

SEQ ID NO: 9255801 - DNA, 22 bp, Homo sapiens
tcaattctgcctctaaatattt

SEQ ID NO: 9255802 - DNA, 22 bp, Homo sapiens
tcaattctgcatacatttcact

SEQ ID NO: 9255803 - DNA, 22 bp, Homo sapiens
tcaattctagagccttacattg

SEQ ID NO: 9255804 - DNA, 22 bp, Homo sapiens
tcaattctagagccttacattg

SEQ ID NO: 9255805 - DNA, 22 bp, Homo sapiens
tcaattatgccattgcaatatt

SEQ ID NO: 9255806 - DNA, 22 bp, Homo sapiens
tcaattacagcaatgactgtac

SEQ ID NO: 9255807 - DNA, 22 bp, Homo sapiens
tcaatgtttgttcatgaaaata

SEQ ID NO: 9255808 - DNA, 22 bp, Homo sapiens
tcaatgttcaagtatgacaatg

SEQ ID NO: 9255809 - DNA, 22 bp, Homo sapiens
tcaatgtctgtctatctattta

SEQ ID NO: 9255810 - DNA, 22 bp, Homo sapiens
tcaatgtccgggccccattcca

SEQ ID NO: 9255811 - DNA, 22 bp, Homo sapiens
tcaaaagaaacaccatgttcct

SEQ ID NO: 9255812 - DNA, 22 bp, Homo sapiens
tcaaaagtttcacatagagata

SEQ ID NO: 9255813 - DNA, 22 bp, Homo sapiens
tcaaaagtttcacatagagata

SEQ ID NO: 9255814 - DNA, 22 bp, Homo sapiens
tcaaaagtttcacatagagata

SEQ ID NO: 9255815 - DNA, 22 bp, Homo sapiens
tcaaaagtggcctgtaaaatct

SEQ ID NO: 9255816 - DNA, 22 bp, Homo sapiens
tcaaaattctagggagaatggt

SEQ ID NO: 9255817 - DNA, 22 bp, Homo sapiens
tcaaaatttcagcactagccct

SEQ ID NO: 9255818 - DNA, 22 bp, Homo sapiens
tcaaaattttatttctcaagga

SEQ ID NO: 9255819 - DNA, 18 bp, Homo sapiens
tcaaaatatttctgtgga

SEQ ID NO: 9255820 - DNA, 22 bp, Homo sapiens
tcaaaatcaaagatacttgaaa

SEQ ID NO: 9255821 - DNA, 22 bp, Homo sapiens
tcaaaatcaaagatacttgaaa

SEQ ID NO: 9255822 - DNA, 22 bp, Homo sapiens
tcaaacataaaactaaatcgag

SEQ ID NO: 9255823 - DNA, 22 bp, Homo sapiens
tcaaacataggcacacattcag

SEQ ID NO: 9255824 - DNA, 22 bp, Homo sapiens
tcaaacagaggaacaattgttt

SEQ ID NO: 9255825 - DNA, 22 bp, Homo sapiens
tcaatgcaacctccacctcccg

SEQ ID NO: 9255826 - DNA, 22 bp, Homo sapiens
tcaatgcacacaggacttggtg

SEQ ID NO: 9255827 - DNA, 22 bp, Homo sapiens
tcaatgcaacttccacctccca

SEQ ID NO: 9255828 - DNA, 22 bp, Homo sapiens
tcaatgcataggaggtggcaga

SEQ ID NO: 9255829 - DNA, 22 bp, Homo sapiens
tcaatacatacaatgtatagtg

SEQ ID NO: 9255830 - DNA, 22 bp, Homo sapiens
tcagaacatatattttgtgatg

SEQ ID NO: 9255831 - DNA, 23 bp, Homo sapiens
tcagaacagttcttggtgcatag

SEQ ID NO: 9255832 - DNA, 22 bp, Homo sapiens
tcagaacagtgcctggcactaa

SEQ ID NO: 9255833 - DNA, 22 bp, Homo sapiens
tcagaacagttcttaatattgc

SEQ ID NO: 9255834 - DNA, 22 bp, Homo sapiens
tcactgtatgtctttttttgat

SEQ ID NO: 9255835 - DNA, 22 bp, Homo sapiens
tcactgtccctgtcctcttatc

SEQ ID NO: 9255836 - DNA, 18 bp, Homo sapiens
tcactgggtgtatgtggc

SEQ ID NO: 9255837 - DNA, 22 bp, Homo sapiens
tcactgggtaggacatgctgat

SEQ ID NO: 9255838 - DNA, 22 bp, Homo sapiens
tcactgggtaggacatgctgat

SEQ ID NO: 9255839 - DNA, 18 bp, Homo sapiens
tcactgggtgtatgtggc

SEQ ID NO: 9255840 - DNA, 22 bp, Homo sapiens
tcactggggcctttggtcagga

SEQ ID NO: 9255841 - DNA, 22 bp, Homo sapiens
tcactggggcctttggtcagga

SEQ ID NO: 9255842 - DNA, 22 bp, Homo sapiens
tcactggggcccacatcaacat

SEQ ID NO: 9255843 - DNA, 22 bp, Homo sapiens
tcactggggcctttggtcagga

SEQ ID NO: 9255844 - DNA, 22 bp, Homo sapiens
tcactgtagagtctgtttccac

SEQ ID NO: 9255845 - DNA, 18 bp, Homo sapiens
tcactgggagaagatatt

SEQ ID NO: 9255846 - DNA, 18 bp, Homo sapiens
tcactgggagaagatatt

SEQ ID NO: 9255847 - DNA, 22 bp, Homo sapiens
tcactgggagagctgacaagga

SEQ ID NO: 9255848 - DNA, 22 bp, Homo sapiens
tcactggcaacttgtgctccct

SEQ ID NO: 9255849 - DNA, 22 bp, Homo sapiens
tcactggggccatgtgagggac

SEQ ID NO: 9255850 - DNA, 22 bp, Homo sapiens
tcactggggccatgtgagggac

SEQ ID NO: 9255851 - DNA, 22 bp, Homo sapiens
tcactggggccatgtgagggac

SEQ ID NO: 9255852 - DNA, 22 bp, Homo sapiens
tcactggggagcactgacatgt

SEQ ID NO: 9255853 - DNA, 22 bp, Homo sapiens
tcactggggagcactgacatgt

SEQ ID NO: 9255854 - DNA, 17 bp, Homo sapiens
tcactgggcctgctccc

SEQ ID NO: 9255855 - DNA, 22 bp, Homo sapiens
tcactgggagatgtgggaaggg

SEQ ID NO: 9255856 - DNA, 22 bp, Homo sapiens
tcactgggcatcggagctgaaa

SEQ ID NO: 9255857 - DNA, 17 bp, Homo sapiens
tcactgggcctgctccc

SEQ ID NO: 9255858 - DNA, 22 bp, Homo sapiens
tcactgggccctgaggtgggac

SEQ ID NO: 9255859 - DNA, 22 bp, Homo sapiens
tcactgctttcaaaaattattg

SEQ ID NO: 9255860 - DNA, 22 bp, Homo sapiens
tcactgcttcttggagaatgtc

SEQ ID NO: 9255861 - DNA, 22 bp, Homo sapiens
tcactggaaatgcacagctgta

SEQ ID NO: 9255862 - DNA, 22 bp, Homo sapiens
tcactgctttgtttacaactat

SEQ ID NO: 9255863 - DNA, 22 bp, Homo sapiens
tcactgctttgagccactgagc

SEQ ID NO: 9255864 - DNA, 22 bp, Homo sapiens
tcactaatgagctaaggaaaag

SEQ ID NO: 9255865 - DNA, 22 bp, Homo sapiens
tcactaatgattttgaaagaag

SEQ ID NO: 9255866 - DNA, 22 bp, Homo sapiens
tcaccgaggctggagtgcagtg

SEQ ID NO: 9255867 - DNA, 22 bp, Homo sapiens
tcaccgaggctggagtgcagtg

SEQ ID NO: 9255868 - DNA, 22 bp, Homo sapiens
tcaccgaggctggagtgcagtg

SEQ ID NO: 9255869 - DNA, 22 bp, Homo sapiens
tcaccgaggctggagtgcagtg

SEQ ID NO: 9255870 - DNA, 22 bp, Homo sapiens
tcaccgaggctggagtgcagtg

SEQ ID NO: 9255871 - DNA, 22 bp, Homo sapiens
tcacccaggtccaggctctggc

SEQ ID NO: 9255872 - DNA, 22 bp, Homo sapiens
tcaccttgtgatccgcccacct

SEQ ID NO: 9255873 - DNA, 22 bp, Homo sapiens
tcaccttgtgatctccctgcct

SEQ ID NO: 9255874 - DNA, 22 bp, Homo sapiens
tcacgtgagggacctgtgtctg

SEQ ID NO: 9255875 - DNA, 21 bp, Homo sapiens
tcacgtggtcacatgagcttt

SEQ ID NO: 9255876 - DNA, 22 bp, Homo sapiens
tcacctctctggccgtctacct

SEQ ID NO: 9255877 - DNA, 22 bp, Homo sapiens
tcacccaggtaatagcagtttg

SEQ ID NO: 9255878 - DNA, 22 bp, Homo sapiens
tcacccagggtgtttggtgtct

SEQ ID NO: 9255879 - DNA, 22 bp, Homo sapiens
tcacccaggtaatagcagtttg

SEQ ID NO: 9255880 - DNA, 22 bp, Homo sapiens
tcacccaggtaatagcagtttg

SEQ ID NO: 9255881 - DNA, 22 bp, Homo sapiens
tcacccaggctggtgcgcagtg

SEQ ID NO: 9255882 - DNA, 22 bp, Homo sapiens
tcacccaggctggtgcgcagtg

SEQ ID NO: 9255883 - DNA, 22 bp, Homo sapiens
tcacccagggactgtgatggaa

SEQ ID NO: 9255884 - DNA, 22 bp, Homo sapiens
tcacccagggactgtgatggaa

SEQ ID NO: 9255885 - DNA, 22 bp, Homo sapiens
tcacatgccctacctaatctta

SEQ ID NO: 9255886 - DNA, 22 bp, Homo sapiens
tcacatgccacagatgaggcaa

SEQ ID NO: 9255887 - DNA, 22 bp, Homo sapiens
tcagaagcatgtggggagcctg

SEQ ID NO: 9255888 - DNA, 22 bp, Homo sapiens
tcagaagcaggagtgtgcacaa

SEQ ID NO: 9255889 - DNA, 22 bp, Homo sapiens
tcagaagcagatatttcaaaat

SEQ ID NO: 9255890 - DNA, 22 bp, Homo sapiens
tcagaagcaggagtgtgcacaa

SEQ ID NO: 9255891 - DNA, 22 bp, Homo sapiens
tcagaagcaggagtgtgcacaa

SEQ ID NO: 9255892 - DNA, 22 bp, Homo sapiens
tcagaagcaggagtgtgcacaa

SEQ ID NO: 9255893 - DNA, 22 bp, Homo sapiens
tcagaagcatccatttcaccac

SEQ ID NO: 9255894 - DNA, 22 bp, Homo sapiens
tcagagaattctcagatgactc

SEQ ID NO: 9255895 - DNA, 22 bp, Homo sapiens
tcagagaatgtccttcttcatt

SEQ ID NO: 9255896 - DNA, 22 bp, Homo sapiens
tcagagaatccgtaagtcacaa

SEQ ID NO: 9255897 - DNA, 23 bp, Homo sapiens
tcagagaatggtatgcttttcct

SEQ ID NO: 9255898 - DNA, 22 bp, Homo sapiens
tcagagaatgtccttcttcatt

SEQ ID NO: 9255899 - DNA, 21 bp, Homo sapiens
tcagagaatggcctactctca

SEQ ID NO: 9255900 - DNA, 22 bp, Homo sapiens
tcagaagcaaacatcactctag

SEQ ID NO: 9255901 - DNA, 22 bp, Homo sapiens
tcagaagcaaacatcactctag

SEQ ID NO: 9255902 - DNA, 22 bp, Homo sapiens
tcagaagcaagcttctacttct

SEQ ID NO: 9255903 - DNA, 22 bp, Homo sapiens
tcagaagcagaaaataggtggg

SEQ ID NO: 9255904 - DNA, 22 bp, Homo sapiens
tcagaagagctggtgctgcctg

SEQ ID NO: 9255905 - DNA, 22 bp, Homo sapiens
tcagaagactactaggacacat

SEQ ID NO: 9255906 - DNA, 22 bp, Homo sapiens
tcagaacatttgggactttggg

SEQ ID NO: 9255907 - DNA, 22 bp, Homo sapiens
tcagaacattgacattcttatt

SEQ ID NO: 9255908 - DNA, 22 bp, Homo sapiens
tcagaacattctcattgactgc

SEQ ID NO: 9255909 - DNA, 22 bp, Homo sapiens
tcagaacattgacattcttatt

SEQ ID NO: 9255910 - DNA, 22 bp, Homo sapiens
tcagaacattacattttgagct

SEQ ID NO: 9255911 - DNA, 22 bp, Homo sapiens
tcagaacattaaggatttgaag

SEQ ID NO: 9255912 - DNA, 22 bp, Homo sapiens
tcagaacatgtttgagtaagac

SEQ ID NO: 9255913 - DNA, 22 bp, Homo sapiens
tcagaacatgaaggttaatttg

SEQ ID NO: 9255914 - DNA, 21 bp, Homo sapiens
tcagaggcactgagagcaatg

SEQ ID NO: 9255915 - DNA, 22 bp, Homo sapiens
tcagaggctcatctgccttgca

SEQ ID NO: 9255916 - DNA, 22 bp, Homo sapiens
tcagaggactaccttctccagt

SEQ ID NO: 9255917 - DNA, 22 bp, Homo sapiens
tcagaggactaccttctccagt

SEQ ID NO: 9255918 - DNA, 22 bp, Homo sapiens
tcagaggactaccttctccagt

SEQ ID NO: 9255919 - DNA, 22 bp, Homo sapiens
tcagaggacgcactagggttgt

SEQ ID NO: 9255920 - DNA, 22 bp, Homo sapiens
tcagaggagaagttgggaaaat

SEQ ID NO: 9255921 - DNA, 22 bp, Homo sapiens
tcagaggagaccaaggggaata

SEQ ID NO: 9255922 - DNA, 18 bp, Homo sapiens
tcagaggagatacctaaa

SEQ ID NO: 9255923 - DNA, 22 bp, Homo sapiens
tcagaggattgcctcagcgagc

SEQ ID NO: 9255924 - DNA, 18 bp, Homo sapiens
tcagaggagatacctaaa

SEQ ID NO: 9255925 - DNA, 19 bp, Homo sapiens
tcagaggatttggctatga

SEQ ID NO: 9255926 - DNA, 22 bp, Homo sapiens
tcagaggattggacttttatgt

SEQ ID NO: 9255927 - DNA, 18 bp, Homo sapiens
tcagagagaatagtaatt

SEQ ID NO: 9255928 - DNA, 22 bp, Homo sapiens
tcagagaggattttaataagtg

SEQ ID NO: 9255929 - DNA, 22 bp, Homo sapiens
tcagaggaataatgctgcattt

SEQ ID NO: 9255930 - DNA, 22 bp, Homo sapiens
tcagaggaatttgcttttcatg

SEQ ID NO: 9255931 - DNA, 22 bp, Homo sapiens
tcagaggacaagctccctggtg

SEQ ID NO: 9255932 - DNA, 22 bp, Homo sapiens
tcagaggacagcagctaaataa

SEQ ID NO: 9255933 - DNA, 22 bp, Homo sapiens
tcagaggaccttactgagaacc

SEQ ID NO: 9255934 - DNA, 22 bp, Homo sapiens
tcagaggacagcagctaaataa

SEQ ID NO: 9255935 - DNA, 22 bp, Homo sapiens
tcagaggtggtaaaggacagca

SEQ ID NO: 9255936 - DNA, 22 bp, Homo sapiens
tcagaggcttgaagcccaagcc

SEQ ID NO: 9255937 - DNA, 22 bp, Homo sapiens
tcagaggctggaagagcctcct

SEQ ID NO: 9255938 - DNA, 22 bp, Homo sapiens
tcagaggcttctgctcacctca

SEQ ID NO: 9255939 - DNA, 22 bp, Homo sapiens
tcagccagggcagagcaggtga

SEQ ID NO: 9255940 - DNA, 22 bp, Homo sapiens
tcagccagtatttgagtgctca

SEQ ID NO: 9255941 - DNA, 22 bp, Homo sapiens
tcagccagtatttgagtgctca

SEQ ID NO: 9255942 - DNA, 22 bp, Homo sapiens
tcagccagggctctggcctcag

SEQ ID NO: 9255943 - DNA, 22 bp, Homo sapiens
tcagcctccgaaagtgctggga

SEQ ID NO: 9255944 - DNA, 22 bp, Homo sapiens
tcagcctcattttctgctctgt

SEQ ID NO: 9255945 - DNA, 22 bp, Homo sapiens
tcagcctctctgagtccagacc

SEQ ID NO: 9255946 - DNA, 23 bp, Homo sapiens
tcagcctcttaggacttctcacc

SEQ ID NO: 9255947 - DNA, 22 bp, Homo sapiens
tcagcctcctaatttcctgtga

SEQ ID NO: 9255948 - DNA, 22 bp, Homo sapiens
tcagcctcattttctgctctgt

SEQ ID NO: 9255949 - DNA, 22 bp, Homo sapiens
tcagcctcaggtgttcagattt

SEQ ID NO: 9255950 - DNA, 22 bp, Homo sapiens
tcagcccttcctggagctttta

SEQ ID NO: 9255951 - DNA, 22 bp, Homo sapiens
tcagcttggacagcttggttga

SEQ ID NO: 9255952 - DNA, 22 bp, Homo sapiens
tcagcttgctaaaagggcatct

SEQ ID NO: 9255953 - DNA, 22 bp, Homo sapiens
tcagctttcctgcagctaaggg

SEQ ID NO: 9255954 - DNA, 22 bp, Homo sapiens
tcagctttctatgttgctaaac

SEQ ID NO: 9255955 - DNA, 22 bp, Homo sapiens
tcagcttcctctgtggttccag

SEQ ID NO: 9255956 - DNA, 22 bp, Homo sapiens
tcagcttccctatctgaccata

SEQ ID NO: 9255957 - DNA, 22 bp, Homo sapiens
tcagctgtaggtatggatgtcc

SEQ ID NO: 9255958 - DNA, 23 bp, Homo sapiens
tcagcctcttaggacttctcacc

SEQ ID NO: 9255959 - DNA, 22 bp, Homo sapiens
tcagcctgcgtcatggtgacac

SEQ ID NO: 9255960 - DNA, 23 bp, Homo sapiens
tcagcctcttaggacttctcacc

SEQ ID NO: 9255961 - DNA, 23 bp, Homo sapiens
tcagcttcattgtcttctatggc

SEQ ID NO: 9255962 - DNA, 22 bp, Homo sapiens
tcagcttcaaatttggtgaagt

SEQ ID NO: 9255963 - DNA, 22 bp, Homo sapiens
tcaggaaagtgttctcagagga

SEQ ID NO: 9255964 - DNA, 22 bp, Homo sapiens
tcaggaaattaaacacttgaaa

SEQ ID NO: 9255965 - DNA, 22 bp, Homo sapiens
tcaggaaatggaattcttgtgt

SEQ ID NO: 9255966 - DNA, 22 bp, Homo sapiens
tcaggagcagcatgggtgagag

SEQ ID NO: 9255967 - DNA, 22 bp, Homo sapiens
tcaggagatggtctttataggc

SEQ ID NO: 9255968 - DNA, 22 bp, Homo sapiens
tcaggagctgtgaatacaaagg

SEQ ID NO: 9255969 - DNA, 22 bp, Homo sapiens
tcaggagctgcactgggcccac

SEQ ID NO: 9255970 - DNA, 22 bp, Homo sapiens
tcaggcaggctcagaggaaaac

SEQ ID NO: 9255971 - DNA, 22 bp, Homo sapiens
tcaggcaggtggctggctatgg

SEQ ID NO: 9255972 - DNA, 21 bp, Homo sapiens
tcaggcaggtcccactgaaca

SEQ ID NO: 9255973 - DNA, 22 bp, Homo sapiens
tcaggcaggttggctgcaggtc

SEQ ID NO: 9255974 - DNA, 22 bp, Homo sapiens
tcaggcaggttggctgcaggtc

SEQ ID NO: 9255975 - DNA, 22 bp, Homo sapiens
tcaggcaggtggctggctatgg

SEQ ID NO: 9255976 - DNA, 21 bp, Homo sapiens
tcaggcaggcgcagagggaag

SEQ ID NO: 9255977 - DNA, 22 bp, Homo sapiens
tcaggcaggacaattatttagg

SEQ ID NO: 9255978 - DNA, 22 bp, Homo sapiens
tcaggcaggaagcccctgcaca

SEQ ID NO: 9255979 - DNA, 22 bp, Homo sapiens
tcaggcagcattaaacttcagc

SEQ ID NO: 9255980 - DNA, 22 bp, Homo sapiens
tcaggcagcattaaacttcagc

SEQ ID NO: 9255981 - DNA, 22 bp, Homo sapiens
tcaggcagagttaatttgctcc

SEQ ID NO: 9255982 - DNA, 22 bp, Homo sapiens
tcaggagggtgacaggccctgg

SEQ ID NO: 9255983 - DNA, 22 bp, Homo sapiens
tcaggcaccccttgagtagggg

SEQ ID NO: 9255984 - DNA, 22 bp, Homo sapiens
tcagtggaactgtctgggtgag

SEQ ID NO: 9255985 - DNA, 22 bp, Homo sapiens
tcagtgcttttgtcacatggtc

SEQ ID NO: 9255986 - DNA, 19 bp, Homo sapiens
tcagtggagaaaggggaag

SEQ ID NO: 9255987 - DNA, 22 bp, Homo sapiens
tcagtggagagcttccaggatt

SEQ ID NO: 9255988 - DNA, 22 bp, Homo sapiens
tcagtgcttttgtcacatggtc

SEQ ID NO: 9255989 - DNA, 22 bp, Homo sapiens
tcagtgcttcggcgagcaccta

SEQ ID NO: 9255990 - DNA, 22 bp, Homo sapiens
tcagtgcttgcctctggaggag

SEQ ID NO: 9255991 - DNA, 22 bp, Homo sapiens
tcagtgcttgcctctggaggag

SEQ ID NO: 9255992 - DNA, 22 bp, Homo sapiens
tcagtgcttgacagctctggga

SEQ ID NO: 9255993 - DNA, 22 bp, Homo sapiens
tcagtggattggatgagatctg

SEQ ID NO: 9255994 - DNA, 22 bp, Homo sapiens
tcagtggattgtagaaggctta

SEQ ID NO: 9255995 - DNA, 22 bp, Homo sapiens
tcagtggatatttctgtggctg

SEQ ID NO: 9255996 - DNA, 22 bp, Homo sapiens
tcagtggattgacatgaaaaag

SEQ ID NO: 9255997 - DNA, 19 bp, Homo sapiens
tcagtggatgaacatgttt

SEQ ID NO: 9255998 - DNA, 22 bp, Homo sapiens
tcagtggagctaagcatgagat

SEQ ID NO: 9255999 - DNA, 22 bp, Homo sapiens
tcagtggagtatggatgaagtc

SEQ ID NO: 9256000 - DNA, 22 bp, Homo sapiens
tcagttactcaacagaggtgga

SEQ ID NO: 9256001 - DNA, 22 bp, Homo sapiens
tcagttacctgacagtggttat

SEQ ID NO: 9256002 - DNA, 22 bp, Homo sapiens
tcagtttcttctttagataaaa

SEQ ID NO: 9256003 - DNA, 22 bp, Homo sapiens
tcagtttctaaatcttaccaat

SEQ ID NO: 9256004 - DNA, 23 bp, Homo sapiens
tcagtttgtataatccatatgca

SEQ ID NO: 9256005 - DNA, 22 bp, Homo sapiens
tcagtttctttactcatagaat

SEQ ID NO: 9256006 - DNA, 19 bp, Homo sapiens
tcagttttagtcatcagtt

SEQ ID NO: 9256007 - DNA, 22 bp, Homo sapiens
tcagttttcaatttcatcagag

SEQ ID NO: 9256008 - DNA, 22 bp, Homo sapiens
tcataaaaatagactctaaagt

SEQ ID NO: 9256009 - DNA, 22 bp, Homo sapiens
tcataaaaatagactctaaagt

SEQ ID NO: 9256010 - DNA, 22 bp, Homo sapiens
tcataaaacacaccaggtagtt

SEQ ID NO: 9256011 - DNA, 19 bp, Homo sapiens
tcataaaaatggtaaccca

SEQ ID NO: 9256012 - DNA, 22 bp, Homo sapiens
tcataaaacacaccaggtagtt

SEQ ID NO: 9256013 - DNA, 23 bp, Homo sapiens
tcagttttggctgttcagtgttg

SEQ ID NO: 9256014 - DNA, 22 bp, Homo sapiens
tcatccaaggagaccttgcaga

SEQ ID NO: 9256015 - DNA, 22 bp, Homo sapiens
tcatcaaaggattgcatgattt

SEQ ID NO: 9256016 - DNA, 22 bp, Homo sapiens
tcataaaatgctcctgatattg

SEQ ID NO: 9256017 - DNA, 22 bp, Homo sapiens
tcataaaatgctcctgatattg

SEQ ID NO: 9256018 - DNA, 22 bp, Homo sapiens
tcataaaagtactcatgttcat

SEQ ID NO: 9256019 - DNA, 22 bp, Homo sapiens
tcataaaacacaccaggtagtt

SEQ ID NO: 9256020 - DNA, 20 bp, Homo sapiens
tcataaagaggaaataaata

SEQ ID NO: 9256021 - DNA, 22 bp, Homo sapiens
tcataaacaaaacagtttatgc

SEQ ID NO: 9256022 - DNA, 22 bp, Homo sapiens
tcataaactcactagtttatgt

SEQ ID NO: 9256023 - DNA, 20 bp, Homo sapiens
tcataaagaggaaataaata

SEQ ID NO: 9256024 - DNA, 22 bp, Homo sapiens
tcataaaatgctcctgatattg

SEQ ID NO: 9256025 - DNA, 22 bp, Homo sapiens
tcatccttttgcatgggaaggc

SEQ ID NO: 9256026 - DNA, 22 bp, Homo sapiens
tcatccttttgcatgggaaggc

SEQ ID NO: 9256027 - DNA, 22 bp, Homo sapiens
tcatctaagagtcttacattta

SEQ ID NO: 9256028 - DNA, 22 bp, Homo sapiens
tcatctaattttggaacagaga

SEQ ID NO: 9256029 - DNA, 22 bp, Homo sapiens
tcatccagtatgactggtgtct

SEQ ID NO: 9256030 - DNA, 22 bp, Homo sapiens
tcaggtccagctcctgtgcctc

SEQ ID NO: 9256031 - DNA, 22 bp, Homo sapiens
tcagggttgtgaaggaaagggg

SEQ ID NO: 9256032 - DNA, 22 bp, Homo sapiens
tcagggttgtggtggaattcag

SEQ ID NO: 9256033 - DNA, 21 bp, Homo sapiens
tcagggttcaaaggaactgat

SEQ ID NO: 9256034 - DNA, 19 bp, Homo sapiens
tcagggggctgataggagg

SEQ ID NO: 9256035 - DNA, 22 bp, Homo sapiens
tcaggggacttaggagagaagt

SEQ ID NO: 9256036 - DNA, 22 bp, Homo sapiens
tcaggggaaatctctcagcgaa

SEQ ID NO: 9256037 - DNA, 22 bp, Homo sapiens
tcaggggcagccggggaagcca

SEQ ID NO: 9256038 - DNA, 22 bp, Homo sapiens
tcaggggcagctgtgctttgtg

SEQ ID NO: 9256039 - DNA, 22 bp, Homo sapiens
tcaggggcccttccctcagcag

SEQ ID NO: 9256040 - DNA, 22 bp, Homo sapiens
tcaggggctgtgcatttcccag

SEQ ID NO: 9256041 - DNA, 22 bp, Homo sapiens
tcaggggcttgaggtgcatgtc

SEQ ID NO: 9256042 - DNA, 21 bp, Homo sapiens
tcaggggctgtgttttccatc

SEQ ID NO: 9256043 - DNA, 22 bp, Homo sapiens
tcaggggcttgaggtgcatgtc

SEQ ID NO: 9256044 - DNA, 22 bp, Homo sapiens
tcagggcactgtcacctgatat

SEQ ID NO: 9256045 - DNA, 22 bp, Homo sapiens
tcagggcacgtttctgcaatgc

SEQ ID NO: 9256046 - DNA, 22 bp, Homo sapiens
tcagggcacattctgcagtggc

SEQ ID NO: 9256047 - DNA, 22 bp, Homo sapiens
tcagggcacattctgcagtggc

SEQ ID NO: 9256048 - DNA, 22 bp, Homo sapiens
tcagggcaagattggttaataa

SEQ ID NO: 9256049 - DNA, 22 bp, Homo sapiens
tcagggagagcctgtctgacgt

SEQ ID NO: 9256050 - DNA, 22 bp, Homo sapiens
tcagggcaaaagggaaaccatt

SEQ ID NO: 9256051 - DNA, 22 bp, Homo sapiens
tcagggacttacaaaccagaag

SEQ ID NO: 9256052 - DNA, 22 bp, Homo sapiens
tcaggctgaggtcatctgcatc

SEQ ID NO: 9256053 - DNA, 22 bp, Homo sapiens
tcaggctgaggtcatctgcatc

SEQ ID NO: 9256054 - DNA, 22 bp, Homo sapiens
tcaggctgagaaaatctggacc

SEQ ID NO: 9256055 - DNA, 22 bp, Homo sapiens
tcaggctgagaaaatctggacc

SEQ ID NO: 9256056 - DNA, 22 bp, Homo sapiens
tcaggctgaccaggttttgctc

SEQ ID NO: 9256057 - DNA, 22 bp, Homo sapiens
tcaggctgaccaggttttgctc

SEQ ID NO: 9256058 - DNA, 22 bp, Homo sapiens
tcaggctgaaaggactccagtt

SEQ ID NO: 9256059 - DNA, 22 bp, Homo sapiens
tcaggctctgagctgatgctaa

SEQ ID NO: 9256060 - DNA, 22 bp, Homo sapiens
tcaggctctgagctgatgctaa

SEQ ID NO: 9256061 - DNA, 18 bp, Homo sapiens
tcaggctctctggctaga

SEQ ID NO: 9256062 - DNA, 22 bp, Homo sapiens
tcaggctgaatcatcctagctt

SEQ ID NO: 9256063 - DNA, 22 bp, Homo sapiens
tcaggctgaatcatcctagctt

SEQ ID NO: 9256064 - DNA, 22 bp, Homo sapiens
tcaggctgaatcatcctagctt

SEQ ID NO: 9256065 - DNA, 22 bp, Homo sapiens
tcaggctgaaaggactccagtt

SEQ ID NO: 9256066 - DNA, 22 bp, Homo sapiens
tcaggctgaaaggactccagtt

SEQ ID NO: 9256067 - DNA, 22 bp, Homo sapiens
tcaggctgaaggaggcctatct

SEQ ID NO: 9256068 - DNA, 22 bp, Homo sapiens
tcaggctgaaggaggcctatct

SEQ ID NO: 9256069 - DNA, 22 bp, Homo sapiens
tcaggcctttgaacttggagtg

SEQ ID NO: 9256070 - DNA, 22 bp, Homo sapiens
tcaggctacactcttttcatgg

SEQ ID NO: 9256071 - DNA, 22 bp, Homo sapiens
tcaggctcaggaatgtgtttat

SEQ ID NO: 9256072 - DNA, 22 bp, Homo sapiens
gccaagggggcagtgcatgggt

SEQ ID NO: 9256073 - DNA, 22 bp, Homo sapiens
gccagagcagaatagagtggcc

SEQ ID NO: 9256074 - DNA, 18 bp, Homo sapiens
gccagagcatatctccag

SEQ ID NO: 9256075 - DNA, 22 bp, Homo sapiens
gccagagccacttttgggtgat

SEQ ID NO: 9256076 - DNA, 22 bp, Homo sapiens
gcatttttcatccctcttgggt

SEQ ID NO: 9256077 - DNA, 22 bp, Homo sapiens
gcattttataaagagttatttg

SEQ ID NO: 9256078 - DNA, 22 bp, Homo sapiens
gcatttttctaatcattggcat

SEQ ID NO: 9256079 - DNA, 22 bp, Homo sapiens
gcattttataaagagttatttg

SEQ ID NO: 9256080 - DNA, 22 bp, Homo sapiens
gcattttagaatattggagcaa

SEQ ID NO: 9256081 - DNA, 22 bp, Homo sapiens
gcattttaataagattcatagg

SEQ ID NO: 9256082 - DNA, 18 bp, Homo sapiens
gcattttaatctgaggca

SEQ ID NO: 9256083 - DNA, 22 bp, Homo sapiens
gcattttaatgaggtttatgag

SEQ ID NO: 9256084 - DNA, 22 bp, Homo sapiens
gccaaggcctctgcaggatgag

SEQ ID NO: 9256085 - DNA, 22 bp, Homo sapiens
gccaaggcctgcagcacctcat

SEQ ID NO: 9256086 - DNA, 22 bp, Homo sapiens
gccaagctcaccttctgatgga

SEQ ID NO: 9256087 - DNA, 22 bp, Homo sapiens
gccaagcctgtagacacaagct

SEQ ID NO: 9256088 - DNA, 22 bp, Homo sapiens
gcatttttgatcccactaggat

SEQ ID NO: 9256089 - DNA, 22 bp, Homo sapiens
gcatttttctctcctataggag

SEQ ID NO: 9256090 - DNA, 22 bp, Homo sapiens
gccagcagggcggagccatcta

SEQ ID NO: 9256091 - DNA, 22 bp, Homo sapiens
gccagaggcccaaggacagctg

SEQ ID NO: 9256092 - DNA, 22 bp, Homo sapiens
gccagaggcccaaggacagctg

SEQ ID NO: 9256093 - DNA, 22 bp, Homo sapiens
gccagaggcccaaggacagctg

SEQ ID NO: 9256094 - DNA, 22 bp, Homo sapiens
gccagcagggcccaaatgctgg

SEQ ID NO: 9256095 - DNA, 22 bp, Homo sapiens
gccagcagtatgtcctggcagt

SEQ ID NO: 9256096 - DNA, 22 bp, Homo sapiens
gccagcaggttgtcaaggagct

SEQ ID NO: 9256097 - DNA, 22 bp, Homo sapiens
gccagcaggttgtcaaggagct

SEQ ID NO: 9256098 - DNA, 23 bp, Homo sapiens
gccagaggaacgcagagctttct

SEQ ID NO: 9256099 - DNA, 23 bp, Homo sapiens
gccagaggaacgcagagctttct

SEQ ID NO: 9256100 - DNA, 23 bp, Homo sapiens
gccagaggaacgcagagctttct

SEQ ID NO: 9256101 - DNA, 22 bp, Homo sapiens
gccagaggcccaaggacagctg

SEQ ID NO: 9256102 - DNA, 22 bp, Homo sapiens
gccagaggaacgctgcgcgccc

SEQ ID NO: 9256103 - DNA, 23 bp, Homo sapiens
gccagagctgcctgcccttgctg

SEQ ID NO: 9256104 - DNA, 23 bp, Homo sapiens
gccagaggaacgcagagctttct

SEQ ID NO: 9256105 - DNA, 22 bp, Homo sapiens
gccagcagtccagtccttagtg

SEQ ID NO: 9256106 - DNA, 22 bp, Homo sapiens
gccagcagtatgtcctggcagt

SEQ ID NO: 9256107 - DNA, 22 bp, Homo sapiens
gccagcagtcctgctgtgtgcc

SEQ ID NO: 9256108 - DNA, 22 bp, Homo sapiens
gccagcagtcctgctgtgtgcc

SEQ ID NO: 9256109 - DNA, 22 bp, Homo sapiens
gccagccccttagggctctccc

SEQ ID NO: 9256110 - DNA, 22 bp, Homo sapiens
gccagcccattaacccctgtcc

SEQ ID NO: 9256111 - DNA, 22 bp, Homo sapiens
gccagccccagacatcctatcg

SEQ ID NO: 9256112 - DNA, 22 bp, Homo sapiens
gccagcccctccatcctgttca

SEQ ID NO: 9256113 - DNA, 22 bp, Homo sapiens
gccagccataggccagcactgg

SEQ ID NO: 9256114 - DNA, 22 bp, Homo sapiens
gccagcccattaacccctgtcc

SEQ ID NO: 9256115 - DNA, 22 bp, Homo sapiens
gcagggctccactgtggccaag

SEQ ID NO: 9256116 - DNA, 22 bp, Homo sapiens
gcagggctccactgtggccaag

SEQ ID NO: 9256117 - DNA, 22 bp, Homo sapiens
gcagggctcattgccaggcatt

SEQ ID NO: 9256118 - DNA, 22 bp, Homo sapiens
gcagggctcaacaggacacccc

SEQ ID NO: 9256119 - DNA, 22 bp, Homo sapiens
gcagggctcaacaggacacccc

SEQ ID NO: 9256120 - DNA, 22 bp, Homo sapiens
gcagggctcagccgctcccacc

SEQ ID NO: 9256121 - DNA, 22 bp, Homo sapiens
gcagggctcattctagtacaat

SEQ ID NO: 9256122 - DNA, 22 bp, Homo sapiens
gcagggctcattgccaggcatt

SEQ ID NO: 9256123 - DNA, 22 bp, Homo sapiens
gcagtcagtaaggcagccagaa

SEQ ID NO: 9256124 - DNA, 22 bp, Homo sapiens
gcagggctctgctgtagtccta

SEQ ID NO: 9256125 - DNA, 22 bp, Homo sapiens
gcagtcctcctgcctcagcctc

SEQ ID NO: 9256126 - DNA, 22 bp, Homo sapiens
gcagtcctcatcctttagcagt

SEQ ID NO: 9256127 - DNA, 22 bp, Homo sapiens
gcagtcctctcattggcctcct

SEQ ID NO: 9256128 - DNA, 22 bp, Homo sapiens
gcagtcctcgtaaaggtcgaag

SEQ ID NO: 9256129 - DNA, 22 bp, Homo sapiens
gcagtcctgggattctgtcctt

SEQ ID NO: 9256130 - DNA, 22 bp, Homo sapiens
gcagtcctgtagcgactttttt

SEQ ID NO: 9256131 - DNA, 22 bp, Homo sapiens
gcagtcctctcattggcctcct

SEQ ID NO: 9256132 - DNA, 22 bp, Homo sapiens
gcagtcctggaggaaggtgtga

SEQ ID NO: 9256133 - DNA, 22 bp, Homo sapiens
gcagtcctagggtgctctgcag

SEQ ID NO: 9256134 - DNA, 22 bp, Homo sapiens
gcagtcccatatctttaacata

SEQ ID NO: 9256135 - DNA, 22 bp, Homo sapiens
gcagtccaaagtggctctcacc

SEQ ID NO: 9256136 - DNA, 22 bp, Homo sapiens
gcagtgaaaaagtgcaccctgt

SEQ ID NO: 9256137 - DNA, 22 bp, Homo sapiens
gcagtgaaaaagtgcaccctgt

SEQ ID NO: 9256138 - DNA, 18 bp, Homo sapiens
gcagtgaagaaagagctt

SEQ ID NO: 9256139 - DNA, 22 bp, Homo sapiens
gcagtgaacataacacagaagg

SEQ ID NO: 9256140 - DNA, 18 bp, Homo sapiens
gcagtgaagaaagagctt

SEQ ID NO: 9256141 - DNA, 22 bp, Homo sapiens
gcagtgaagatggcaggttggg

SEQ ID NO: 9256142 - DNA, 22 bp, Homo sapiens
gcagtgaacataacacagaagg

SEQ ID NO: 9256143 - DNA, 22 bp, Homo sapiens
gcagtgaaacaataggatcaaa

SEQ ID NO: 9256144 - DNA, 20 bp, Homo sapiens
gcagtctgtcacagagcatg

SEQ ID NO: 9256145 - DNA, 18 bp, Homo sapiens
gcagtctctctggtcttc

SEQ ID NO: 9256146 - DNA, 22 bp, Homo sapiens
gcagtctctcaggatttaagct

SEQ ID NO: 9256147 - DNA, 22 bp, Homo sapiens
gcagtctccatatacatttaca

SEQ ID NO: 9256148 - DNA, 22 bp, Homo sapiens
gcagtctccatatacatttaca

SEQ ID NO: 9256149 - DNA, 22 bp, Homo sapiens
gcagtctctcaggatttaagct

SEQ ID NO: 9256150 - DNA, 22 bp, Homo sapiens
gcagtccttaggagaggaagta

SEQ ID NO: 9256151 - DNA, 22 bp, Homo sapiens
gcatccctctgaggggccaggc

SEQ ID NO: 9256152 - DNA, 22 bp, Homo sapiens
gcatctaatccagtccagcatc

SEQ ID NO: 9256153 - DNA, 22 bp, Homo sapiens
gcatccagaggtagccactgtg

SEQ ID NO: 9256154 - DNA, 22 bp, Homo sapiens
gcatccagtcttggctcctgga

SEQ ID NO: 9256155 - DNA, 22 bp, Homo sapiens
gcataaatgtgcacacacatgt

SEQ ID NO: 9256156 - DNA, 19 bp, Homo sapiens
gcataaatacactattgtc

SEQ ID NO: 9256157 - DNA, 22 bp, Homo sapiens
gcagtgaagcagtccttgttga

SEQ ID NO: 9256158 - DNA, 19 bp, Homo sapiens
gcatttctctttacagcca

SEQ ID NO: 9256159 - DNA, 22 bp, Homo sapiens
gcatttctgtgcatacacatga

SEQ ID NO: 9256160 - DNA, 22 bp, Homo sapiens
gcatttcttcctggtgtgagcc

SEQ ID NO: 9256161 - DNA, 22 bp, Homo sapiens
gcatcttcacacaaagccagtg

SEQ ID NO: 9256162 - DNA, 22 bp, Homo sapiens
gcatgaaatgagcgaatataat

SEQ ID NO: 9256163 - DNA, 22 bp, Homo sapiens
gcatgaggggggttaggaagtt

SEQ ID NO: 9256164 - DNA, 22 bp, Homo sapiens
gcatgaggggggttaggaagtt

SEQ ID NO: 9256165 - DNA, 22 bp, Homo sapiens
gccagtctgctcccacaagttc

SEQ ID NO: 9256166 - DNA, 22 bp, Homo sapiens
gccagtggagcacatggtgaag

SEQ ID NO: 9256167 - DNA, 20 bp, Homo sapiens
gcccactctaatccactgtc

SEQ ID NO: 9256168 - DNA, 22 bp, Homo sapiens
gcccactctggagcctgttccc

SEQ ID NO: 9256169 - DNA, 22 bp, Homo sapiens
gcccacagtacgaggctcaggc

SEQ ID NO: 9256170 - DNA, 22 bp, Homo sapiens
gcccacaggtcctacctctttc

SEQ ID NO: 9256171 - DNA, 22 bp, Homo sapiens
gccagtggcttgccaggcagga

SEQ ID NO: 9256172 - DNA, 22 bp, Homo sapiens
gccagtggccctctggagaagg

SEQ ID NO: 9256173 - DNA, 22 bp, Homo sapiens
gccagtggcatgcggcagggac

SEQ ID NO: 9256174 - DNA, 22 bp, Homo sapiens
gccagtggcatgcggcagggac

SEQ ID NO: 9256175 - DNA, 22 bp, Homo sapiens
gcccagagtgagtcctgggccc

SEQ ID NO: 9256176 - DNA, 22 bp, Homo sapiens
gcccagagtgagtcctgggccc

SEQ ID NO: 9256177 - DNA, 18 bp, Homo sapiens
gcccagaggtctgggccc

SEQ ID NO: 9256178 - DNA, 23 bp, Homo sapiens
gcccagagaggctcaccaggaat

SEQ ID NO: 9256179 - DNA, 21 bp, Homo sapiens
gcccagagggagccaagccca

SEQ ID NO: 9256180 - DNA, 22 bp, Homo sapiens
gcccagagggaagaggtgtcat

SEQ ID NO: 9256181 - DNA, 22 bp, Homo sapiens
gcccagaacagtgtcacatgtc

SEQ ID NO: 9256182 - DNA, 22 bp, Homo sapiens
gcccagaaagactgcctaacag

SEQ ID NO: 9256183 - DNA, 22 bp, Homo sapiens
gcccactgagtgactccctcag

SEQ ID NO: 9256184 - DNA, 22 bp, Homo sapiens
gcccactttctgccagctcacc

SEQ ID NO: 9256185 - DNA, 22 bp, Homo sapiens
gcccactggctggagtgctggt

SEQ ID NO: 9256186 - DNA, 21 bp, Homo sapiens
gcccagaagactggctctgcc

SEQ ID NO: 9256187 - DNA, 22 bp, Homo sapiens
gcccagaagtgactcagcactg

SEQ ID NO: 9256188 - DNA, 22 bp, Homo sapiens
gcccagaagttgaggctgcagt

SEQ ID NO: 9256189 - DNA, 22 bp, Homo sapiens
gcccagaagttgaggctgcagt

SEQ ID NO: 9256190 - DNA, 22 bp, Homo sapiens
gcccagagagatgaagtgatgg

SEQ ID NO: 9256191 - DNA, 22 bp, Homo sapiens
gcccagagagatgaagtgatgg

SEQ ID NO: 9256192 - DNA, 22 bp, Homo sapiens
gcccagagagatgctgtagacc

SEQ ID NO: 9256193 - DNA, 22 bp, Homo sapiens
gccaggactcttcctagaaggt

SEQ ID NO: 9256194 - DNA, 22 bp, Homo sapiens
gccaggacctcccagagctttc

SEQ ID NO: 9256195 - DNA, 22 bp, Homo sapiens
gccaggagaaaaggcgaatgat

SEQ ID NO: 9256196 - DNA, 22 bp, Homo sapiens
gccagccccttagggctctccc

SEQ ID NO: 9256197 - DNA, 19 bp, Homo sapiens
gccaggacatcctcctgct

SEQ ID NO: 9256198 - DNA, 22 bp, Homo sapiens
gccaggaggctgctgtgtaggc

SEQ ID NO: 9256199 - DNA, 22 bp, Homo sapiens
gccaggagtgtgtggctatgtt

SEQ ID NO: 9256200 - DNA, 22 bp, Homo sapiens
gccaggagagctccttcaggtt

SEQ ID NO: 9256201 - DNA, 22 bp, Homo sapiens
gccaggagactccattcatttg

SEQ ID NO: 9256202 - DNA, 22 bp, Homo sapiens
gccaggagaatgctagcagagg

SEQ ID NO: 9256203 - DNA, 22 bp, Homo sapiens
gccaggtgtcctcacagtgagg

SEQ ID NO: 9256204 - DNA, 22 bp, Homo sapiens
gccaggtgtcctcacagtgagg

SEQ ID NO: 9256205 - DNA, 22 bp, Homo sapiens
gccaggtgggagacagacagca

SEQ ID NO: 9256206 - DNA, 22 bp, Homo sapiens
gccaggtggtctggctccagag

SEQ ID NO: 9256207 - DNA, 22 bp, Homo sapiens
gccaggtgtagtggccacacct

SEQ ID NO: 9256208 - DNA, 22 bp, Homo sapiens
gccaggtgggagacagacagca

SEQ ID NO: 9256209 - DNA, 22 bp, Homo sapiens
gccaggatgactatacaacagc

SEQ ID NO: 9256210 - DNA, 22 bp, Homo sapiens
gccaggagttcagatgcatgtt

SEQ ID NO: 9256211 - DNA, 22 bp, Homo sapiens
gccaggagttcagatgcatgtt

SEQ ID NO: 9256212 - DNA, 23 bp, Homo sapiens
gccaggcacatggtggacacgca

SEQ ID NO: 9256213 - DNA, 22 bp, Homo sapiens
gccctgagccaccaatgccatt

SEQ ID NO: 9256214 - DNA, 22 bp, Homo sapiens
gccctgagaggcaatgactctt

SEQ ID NO: 9256215 - DNA, 22 bp, Homo sapiens
gccctgagaggcaatgactctt

SEQ ID NO: 9256216 - DNA, 22 bp, Homo sapiens
gccctgagcctatgagcctctc

SEQ ID NO: 9256217 - DNA, 22 bp, Homo sapiens
gccctgaggatttgcatttcct

SEQ ID NO: 9256218 - DNA, 22 bp, Homo sapiens
gccctgaggcaaaagaacagtc

SEQ ID NO: 9256219 - DNA, 22 bp, Homo sapiens
gcctcagctcccagcccaggct

SEQ ID NO: 9256220 - DNA, 22 bp, Homo sapiens
gcctcagctgttgcaggggccc

SEQ ID NO: 9256221 - DNA, 22 bp, Homo sapiens
gcctcagccggcggacgccagg

SEQ ID NO: 9256222 - DNA, 20 bp, Homo sapiens
gcctcagccaacccatgggg

SEQ ID NO: 9256223 - DNA, 22 bp, Homo sapiens
gcctaacttggctttgttcacc

SEQ ID NO: 9256224 - DNA, 22 bp, Homo sapiens
gccctgaggggtggtgtctgta

SEQ ID NO: 9256225 - DNA, 22 bp, Homo sapiens
gccctgaggcaaaagaacagtc

SEQ ID NO: 9256226 - DNA, 22 bp, Homo sapiens
gcccagggcttcaaagagagaa

SEQ ID NO: 9256227 - DNA, 22 bp, Homo sapiens
gcccagggcttcaaagagagaa

SEQ ID NO: 9256228 - DNA, 22 bp, Homo sapiens
gcccaggggagtagtcaattta

SEQ ID NO: 9256229 - DNA, 22 bp, Homo sapiens
gcccaggggagtagtcaattta

SEQ ID NO: 9256230 - DNA, 22 bp, Homo sapiens
gcccaggggcagcgcatagtgg

SEQ ID NO: 9256231 - DNA, 22 bp, Homo sapiens
gcccaggggcagcgcatagtgg

SEQ ID NO: 9256232 - DNA, 22 bp, Homo sapiens
gcccaggggcagcgcatagtgg

SEQ ID NO: 9256233 - DNA, 22 bp, Homo sapiens
gcccatggacacccaagtgcca

SEQ ID NO: 9256234 - DNA, 22 bp, Homo sapiens
gcccagggcgatggtcggggcc

SEQ ID NO: 9256235 - DNA, 22 bp, Homo sapiens
gcccagggctgcaagtggacgc

SEQ ID NO: 9256236 - DNA, 22 bp, Homo sapiens
gcccagggctgcaagtggacgc

SEQ ID NO: 9256237 - DNA, 23 bp, Homo sapiens
gcccagggactgggaatcagtgg

SEQ ID NO: 9256238 - DNA, 23 bp, Homo sapiens
gcccagggactgggaatcagtgg

SEQ ID NO: 9256239 - DNA, 22 bp, Homo sapiens
gcccagggcagggcaagagtga

SEQ ID NO: 9256240 - DNA, 22 bp, Homo sapiens
gcccagggcagggcaagagtga

SEQ ID NO: 9256241 - DNA, 22 bp, Homo sapiens
gcccagggcagggcaagagtga

SEQ ID NO: 9256242 - DNA, 22 bp, Homo sapiens
gcccagggcagggcaagagtga

SEQ ID NO: 9256243 - DNA, 22 bp, Homo sapiens
gcccagagttcaaggctgcagt

SEQ ID NO: 9256244 - DNA, 22 bp, Homo sapiens
gcccagagttcaaggctgcagt

SEQ ID NO: 9256245 - DNA, 22 bp, Homo sapiens
gcccagagttcaaggctgcagt

SEQ ID NO: 9256246 - DNA, 22 bp, Homo sapiens
gcccagcaaggaccaagggccg

SEQ ID NO: 9256247 - DNA, 22 bp, Homo sapiens
gcccaggctggagtgcagtggt

SEQ ID NO: 9256248 - DNA, 21 bp, Homo sapiens
gcagcatgagaaagccccaaa

SEQ ID NO: 9256249 - DNA, 22 bp, Homo sapiens
gcagcatgttgaaagggccaca

SEQ ID NO: 9256250 - DNA, 22 bp, Homo sapiens
gcagcagtgcgggcagctacag

SEQ ID NO: 9256251 - DNA, 19 bp, Homo sapiens
gcagcagtggaaggaaaaa

SEQ ID NO: 9256252 - DNA, 22 bp, Homo sapiens
gcagcagtgctttggaatcctg

SEQ ID NO: 9256253 - DNA, 22 bp, Homo sapiens
gcagcaggtgtgcttttaatga

SEQ ID NO: 9256254 - DNA, 22 bp, Homo sapiens
gcagcagtaggaaataacacag

SEQ ID NO: 9256255 - DNA, 22 bp, Homo sapiens
gcagcagtggtctgtagaagga

SEQ ID NO: 9256256 - DNA, 21 bp, Homo sapiens
gcagcagtgttctagaatact

SEQ ID NO: 9256257 - DNA, 20 bp, Homo sapiens
gcagctgcccccagtccctg

SEQ ID NO: 9256258 - DNA, 18 bp, Homo sapiens
gcagctgcagttgtagct

SEQ ID NO: 9256259 - DNA, 22 bp, Homo sapiens
gcagctgccagtccccttccag

SEQ ID NO: 9256260 - DNA, 22 bp, Homo sapiens
gcagctgcaggcaggcttgctg

SEQ ID NO: 9256261 - DNA, 22 bp, Homo sapiens
gcagctgcaggtggtcccatgc

SEQ ID NO: 9256262 - DNA, 22 bp, Homo sapiens
gcagctgcaggtggtcccatgc

SEQ ID NO: 9256263 - DNA, 22 bp, Homo sapiens
gcagctgccgtgagctcacgcc

SEQ ID NO: 9256264 - DNA, 22 bp, Homo sapiens
gcagctgccccgactgtgagtc

SEQ ID NO: 9256265 - DNA, 23 bp, Homo sapiens
gcagccaagagaccagggcaggc

SEQ ID NO: 9256266 - DNA, 22 bp, Homo sapiens
gcagccaagaccccaagaactg

SEQ ID NO: 9256267 - DNA, 22 bp, Homo sapiens
gcagctgatggaagtcctattg

SEQ ID NO: 9256268 - DNA, 22 bp, Homo sapiens
gcagccacagaggagggatgca

SEQ ID NO: 9256269 - DNA, 22 bp, Homo sapiens
gcagctgcaagcacttctggca

SEQ ID NO: 9256270 - DNA, 22 bp, Homo sapiens
gcagctgcaataggcatcaagc

SEQ ID NO: 9256271 - DNA, 22 bp, Homo sapiens
gcagctgcagaccctcagtgct

SEQ ID NO: 9256272 - DNA, 22 bp, Homo sapiens
gcagcagctcagccgggcactg

SEQ ID NO: 9256273 - DNA, 22 bp, Homo sapiens
gcagcagctcagttctgggagg

SEQ ID NO: 9256274 - DNA, 22 bp, Homo sapiens
gcagcagctccctatccaggct

SEQ ID NO: 9256275 - DNA, 22 bp, Homo sapiens
gcagcagctgacagtgggtgcc

SEQ ID NO: 9256276 - DNA, 22 bp, Homo sapiens
gcagcagctctgaatgggcccc

SEQ ID NO: 9256277 - DNA, 23 bp, Homo sapiens
gcagaggagcaagctggacacca

SEQ ID NO: 9256278 - DNA, 22 bp, Homo sapiens
gcagaggagcaagttgctacag

SEQ ID NO: 9256279 - DNA, 22 bp, Homo sapiens
gcagaggagcaagttgctacag

SEQ ID NO: 9256280 - DNA, 22 bp, Homo sapiens
gcagaggaggacccaggaatta

SEQ ID NO: 9256281 - DNA, 22 bp, Homo sapiens
gcagaggaggacccaggaatta

SEQ ID NO: 9256282 - DNA, 22 bp, Homo sapiens
gcagaggaggacccaggaatta

SEQ ID NO: 9256283 - DNA, 22 bp, Homo sapiens
gcagcaggagagtttgtcctgc

SEQ ID NO: 9256284 - DNA, 22 bp, Homo sapiens
gcagcaggagagtttgtcctgc

SEQ ID NO: 9256285 - DNA, 22 bp, Homo sapiens
gcagcaggagagtttgtcctgc

SEQ ID NO: 9256286 - DNA, 22 bp, Homo sapiens
gcagcaggcacggtctcgacat

SEQ ID NO: 9256287 - DNA, 22 bp, Homo sapiens
gcagcaggcacggtctcgacat

SEQ ID NO: 9256288 - DNA, 22 bp, Homo sapiens
gcagcaggatggccaattgcca

SEQ ID NO: 9256289 - DNA, 22 bp, Homo sapiens
gcagcaggatggccaattgcca

SEQ ID NO: 9256290 - DNA, 22 bp, Homo sapiens
gcagcaggtctgtcaatgtcat

SEQ ID NO: 9256291 - DNA, 22 bp, Homo sapiens
gcagcaggcacttaccgttgct

SEQ ID NO: 9256292 - DNA, 22 bp, Homo sapiens
gcagcaggcacggtctcgacat

SEQ ID NO: 9256293 - DNA, 22 bp, Homo sapiens
gcaggagtgacatggatgtgga

SEQ ID NO: 9256294 - DNA, 22 bp, Homo sapiens
gcaggagtatgcagctatggtt

SEQ ID NO: 9256295 - DNA, 22 bp, Homo sapiens
gcaggagtcactgacttggtcc

SEQ ID NO: 9256296 - DNA, 22 bp, Homo sapiens
gcaggagtgtatttgcatgtaa

SEQ ID NO: 9256297 - DNA, 22 bp, Homo sapiens
gcaggagtgtggtgggacatcc

SEQ ID NO: 9256298 - DNA, 22 bp, Homo sapiens
gcaggagtgtggtgggacatcc

SEQ ID NO: 9256299 - DNA, 22 bp, Homo sapiens
gcaggagtgacatggatgtgga

SEQ ID NO: 9256300 - DNA, 22 bp, Homo sapiens
gcaggagtggagaccatgggga

SEQ ID NO: 9256301 - DNA, 22 bp, Homo sapiens
gcaggagttaggcgtcgtggat

SEQ ID NO: 9256302 - DNA, 22 bp, Homo sapiens
gcaggagttaggcgtcgtggat

SEQ ID NO: 9256303 - DNA, 22 bp, Homo sapiens
gcaggaggatcacttgagccca

SEQ ID NO: 9256304 - DNA, 22 bp, Homo sapiens
gcaggagctttgcttactgctg

SEQ ID NO: 9256305 - DNA, 22 bp, Homo sapiens
gcaggagctttgcttactgctg

SEQ ID NO: 9256306 - DNA, 22 bp, Homo sapiens
gcaggagctgctctcctgacga

SEQ ID NO: 9256307 - DNA, 22 bp, Homo sapiens
gcaggagctggaaagtgatgtt

SEQ ID NO: 9256308 - DNA, 22 bp, Homo sapiens
gcagctggccctgacacgcaga

SEQ ID NO: 9256309 - DNA, 22 bp, Homo sapiens
gcagctggacccacacggctta

SEQ ID NO: 9256310 - DNA, 22 bp, Homo sapiens
gcagctgcctattcagggcttg

SEQ ID NO: 9256311 - DNA, 22 bp, Homo sapiens
gcagctgcctattcagggcttg

SEQ ID NO: 9256312 - DNA, 22 bp, Homo sapiens
gcagctggacccacacggctta

SEQ ID NO: 9256313 - DNA, 22 bp, Homo sapiens
gcagctggacccacacggctta

SEQ ID NO: 9256314 - DNA, 22 bp, Homo sapiens
gcagctggagcatcttctcatc

SEQ ID NO: 9256315 - DNA, 22 bp, Homo sapiens
gcagctggagccagccagacac

SEQ ID NO: 9256316 - DNA, 22 bp, Homo sapiens
gcagctggagcatcttctcatc

SEQ ID NO: 9256317 - DNA, 22 bp, Homo sapiens
gcagctggagccagccagacac

SEQ ID NO: 9256318 - DNA, 22 bp, Homo sapiens
gcagggctaatggggcaagtag

SEQ ID NO: 9256319 - DNA, 22 bp, Homo sapiens
gcagggctaatggggcaagtag

SEQ ID NO: 9256320 - DNA, 22 bp, Homo sapiens
gcagggctaatggggcaagtag

SEQ ID NO: 9256321 - DNA, 22 bp, Homo sapiens
gcagggctaatggggcaagtag

SEQ ID NO: 9256322 - DNA, 22 bp, Homo sapiens
gcagggctaggtcttctagggc

SEQ ID NO: 9256323 - DNA, 22 bp, Homo sapiens
gcagggctattggaaggagatg

SEQ ID NO: 9256324 - DNA, 22 bp, Homo sapiens
gcagggctattggaaggagatg

SEQ ID NO: 9256325 - DNA, 22 bp, Homo sapiens
gcagggctattggaaggagatg

SEQ ID NO: 9256326 - DNA, 22 bp, Homo sapiens
gcagggctattggaaggagatg

SEQ ID NO: 9256327 - DNA, 22 bp, Homo sapiens
gcagggctcaacaggacacccc

SEQ ID NO: 9256328 - DNA, 22 bp, Homo sapiens
gcagggctagatatttgcaagt

SEQ ID NO: 9256329 - DNA, 22 bp, Homo sapiens
gcagggctagatatttgcaagt

SEQ ID NO: 9256330 - DNA, 22 bp, Homo sapiens
gcagggctaggtcttctagggc

SEQ ID NO: 9256331 - DNA, 22 bp, Homo sapiens
gcaggctgatgactggagttgg

SEQ ID NO: 9256332 - DNA, 22 bp, Homo sapiens
gcaggctgatgactggagttgg

SEQ ID NO: 9256333 - DNA, 22 bp, Homo sapiens
gcaggctgatgactggagttgg

SEQ ID NO: 9256334 - DNA, 22 bp, Homo sapiens
gcaggctgatagaggattccat

SEQ ID NO: 9256335 - DNA, 22 bp, Homo sapiens
gcaggctgatagaggattccat

SEQ ID NO: 9256336 - DNA, 22 bp, Homo sapiens
gcaggctgatagaggattccat

SEQ ID NO: 9256337 - DNA, 22 bp, Homo sapiens
gcaggctgaaactcggggtcta

SEQ ID NO: 9256338 - DNA, 22 bp, Homo sapiens
gcaggctgaaactcggggtcta

SEQ ID NO: 9256339 - DNA, 22 bp, Homo sapiens
gcaggctgagagtccaagaagg

SEQ ID NO: 9256340 - DNA, 22 bp, Homo sapiens
gcaggctgagtattaccctagt

SEQ ID NO: 9256341 - DNA, 22 bp, Homo sapiens
gcaggctgagttgggaaaccaa

SEQ ID NO: 9256342 - DNA, 22 bp, Homo sapiens
gcaggctgagtattaccctagt

SEQ ID NO: 9256343 - DNA, 22 bp, Homo sapiens
gcacaggcacagagggccactg

SEQ ID NO: 9256344 - DNA, 22 bp, Homo sapiens
gcacaggcacagagggccactg

SEQ ID NO: 9256345 - DNA, 22 bp, Homo sapiens
gcacctgggcaaggattcagag

SEQ ID NO: 9256346 - DNA, 21 bp, Homo sapiens
gcactcagtcactactcaaga

SEQ ID NO: 9256347 - DNA, 22 bp, Homo sapiens
gcacctgggacccagaggcacc

SEQ ID NO: 9256348 - DNA, 18 bp, Homo sapiens
gcactctgactgcagagc

SEQ ID NO: 9256349 - DNA, 22 bp, Homo sapiens
gcactctgtttctcctgtcagc

SEQ ID NO: 9256350 - DNA, 22 bp, Homo sapiens
gcactggaaatacctagatgaa

SEQ ID NO: 9256351 - DNA, 22 bp, Homo sapiens
gcactggagatacagagatgaa

SEQ ID NO: 9256352 - DNA, 22 bp, Homo sapiens
gcactgggaagaatgagcctgt

SEQ ID NO: 9256353 - DNA, 22 bp, Homo sapiens
gcactgggaatgagggcagctt

SEQ ID NO: 9256354 - DNA, 22 bp, Homo sapiens
gcactgggaagaatgagcctgt

SEQ ID NO: 9256355 - DNA, 22 bp, Homo sapiens
gcactgcaggtgggtggagagg

SEQ ID NO: 9256356 - DNA, 22 bp, Homo sapiens
gcactgcatctactggcaagta

SEQ ID NO: 9256357 - DNA, 22 bp, Homo sapiens
gcactgcagcctcagatggtgg

SEQ ID NO: 9256358 - DNA, 22 bp, Homo sapiens
gcactgatgcaaaaatcactca

SEQ ID NO: 9256359 - DNA, 22 bp, Homo sapiens
gcactgccatcaatgcatgaca

SEQ ID NO: 9256360 - DNA, 22 bp, Homo sapiens
gcactgcctatgcaaatgtact

SEQ ID NO: 9256361 - DNA, 22 bp, Homo sapiens
gcactgggagtctgtgggggtt

SEQ ID NO: 9256362 - DNA, 16 bp, Homo sapiens
gcactgggatgtcttc

SEQ ID NO: 9256363 - DNA, 22 bp, Homo sapiens
gcactgggctccaggaaggagg

SEQ ID NO: 9256364 - DNA, 23 bp, Homo sapiens
gcactgggctctcagcaaggtgt

SEQ ID NO: 9256365 - DNA, 22 bp, Homo sapiens
gcactgtgatcaaggctaagca

SEQ ID NO: 9256366 - DNA, 22 bp, Homo sapiens
gcactgtgctagaagccagggg

SEQ ID NO: 9256367 - DNA, 22 bp, Homo sapiens
gcactgggagctgcctgccggt

SEQ ID NO: 9256368 - DNA, 22 bp, Homo sapiens
gcactgggaatgtgagcagctg

SEQ ID NO: 9256369 - DNA, 22 bp, Homo sapiens
gcactgggaatgctgatgggct

SEQ ID NO: 9256370 - DNA, 18 bp, Homo sapiens
gcacttcacagggatagt

SEQ ID NO: 9256371 - DNA, 22 bp, Homo sapiens
gcacttcacatgccttttcctg

SEQ ID NO: 9256372 - DNA, 22 bp, Homo sapiens
gcactgtgctagaagccagggg

SEQ ID NO: 9256373 - DNA, 22 bp, Homo sapiens
gcagaggagcaagctggacacc

SEQ ID NO: 9256374 - DNA, 23 bp, Homo sapiens
gcagaggagcaagctggacacca

SEQ ID NO: 9256375 - DNA, 22 bp, Homo sapiens
gcagaggacagggatttagatt

SEQ ID NO: 9256376 - DNA, 22 bp, Homo sapiens
gcagaggagatgaagatacttt

SEQ ID NO: 9256377 - DNA, 22 bp, Homo sapiens
gcagaggactcaatcaaggtat

SEQ ID NO: 9256378 - DNA, 22 bp, Homo sapiens
gcagagctctgttcttatctcc

SEQ ID NO: 9256379 - DNA, 22 bp, Homo sapiens
gcagagctctgttcttatctcc

SEQ ID NO: 9256380 - DNA, 22 bp, Homo sapiens
gcagagctgagcggctgcccgg

SEQ ID NO: 9256381 - DNA, 22 bp, Homo sapiens
gcagaggacacaggagggcaag

SEQ ID NO: 9256382 - DNA, 21 bp, Homo sapiens
gcagaggaatggtatacataa

SEQ ID NO: 9256383 - DNA, 22 bp, Homo sapiens
gcagaggacacaggagggcaag

SEQ ID NO: 9256384 - DNA, 22 bp, Homo sapiens
gcaaatgagttgtaacataaaa

SEQ ID NO: 9256385 - DNA, 22 bp, Homo sapiens
gcaagatgttaacatagggaga

SEQ ID NO: 9256386 - DNA, 22 bp, Homo sapiens
gcaagagttttttctctcttga

SEQ ID NO: 9256387 - DNA, 22 bp, Homo sapiens
gcaagagacttttatgtctgcc

SEQ ID NO: 9256388 - DNA, 22 bp, Homo sapiens
gcaagcaagcaggtagagctga

SEQ ID NO: 9256389 - DNA, 22 bp, Homo sapiens
gcaagcaatggacggtgacttt

SEQ ID NO: 9256390 - DNA, 22 bp, Homo sapiens
gcaagattccttgagcctagtt

SEQ ID NO: 9256391 - DNA, 22 bp, Homo sapiens
gcaagattagaatcaactgtga

SEQ ID NO: 9256392 - DNA, 22 bp, Homo sapiens
gcaagattccgctctagagcct

SEQ ID NO: 9256393 - DNA, 22 bp, Homo sapiens
gcaagatttacagacaacttcg

SEQ ID NO: 9256394 - DNA, 22 bp, Homo sapiens
gcaagatttcttttaggtgaag

SEQ ID NO: 9256395 - DNA, 22 bp, Homo sapiens
gcaagattgtgtggctgaagta

SEQ ID NO: 9256396 - DNA, 22 bp, Homo sapiens
gaggggctggggttgactccaa

SEQ ID NO: 9256397 - DNA, 22 bp, Homo sapiens
gaggggctgggcagtccctgga

SEQ ID NO: 9256398 - DNA, 22 bp, Homo sapiens
gaggggctggggttgactccaa

SEQ ID NO: 9256399 - DNA, 22 bp, Homo sapiens
gaggggctgggtagggcaaccc

SEQ ID NO: 9256400 - DNA, 22 bp, Homo sapiens
gaggggcttgaggccctgatgg

SEQ ID NO: 9256401 - DNA, 22 bp, Homo sapiens
gagggggaaagtccctggagtc

SEQ ID NO: 9256402 - DNA, 22 bp, Homo sapiens
gaggggctgtggagctctctgg

SEQ ID NO: 9256403 - DNA, 22 bp, Homo sapiens
gaggggtgggctggaagttata

SEQ ID NO: 9256404 - DNA, 22 bp, Homo sapiens
gaggggtggccctggcgtgtac

SEQ ID NO: 9256405 - DNA, 22 bp, Homo sapiens
gaggggtgtggagccatcagtt

SEQ ID NO: 9256406 - DNA, 18 bp, Homo sapiens
gcacagctaggagggtcc

SEQ ID NO: 9256407 - DNA, 22 bp, Homo sapiens
gcacagctcgagctcaggaggg

SEQ ID NO: 9256408 - DNA, 22 bp, Homo sapiens
gcacagctcgagctcaggaggg

SEQ ID NO: 9256409 - DNA, 22 bp, Homo sapiens
gcacaggcaatagatacagcta

SEQ ID NO: 9256410 - DNA, 22 bp, Homo sapiens
gcacaggcacagagggccactg

SEQ ID NO: 9256411 - DNA, 22 bp, Homo sapiens
gcaagcagttgtggcttctgag

SEQ ID NO: 9256412 - DNA, 22 bp, Homo sapiens
gcaagcagttgtggcttctgag

SEQ ID NO: 9256413 - DNA, 22 bp, Homo sapiens
gcaagcagacattcaggtaggt

SEQ ID NO: 9256414 - DNA, 22 bp, Homo sapiens
gcaagcagatctccggagggaa

SEQ ID NO: 9256415 - DNA, 22 bp, Homo sapiens
gcaagctatagaatataagggg

SEQ ID NO: 9256416 - DNA, 20 bp, Homo sapiens
gcaagcatgaagagtagaga

SEQ ID NO: 9256417 - DNA, 22 bp, Homo sapiens
gcaagctgcttaagctcattgt

SEQ ID NO: 9256418 - DNA, 22 bp, Homo sapiens
gcaagctgcttaagctcattgt

SEQ ID NO: 9256419 - DNA, 22 bp, Homo sapiens
gcaagctggctgttagaggatg

SEQ ID NO: 9256420 - DNA, 22 bp, Homo sapiens
gcacagcagtggcataaacaat

SEQ ID NO: 9256421 - DNA, 22 bp, Homo sapiens
gcacagcagctgggggccctgg

SEQ ID NO: 9256422 - DNA, 22 bp, Homo sapiens
gcaagctgtccttttgcatggc

SEQ ID NO: 9256423 - DNA, 22 bp, Homo sapiens
gcacagcatgaagagaggaagc

SEQ ID NO: 9256424 - DNA, 21 bp, Homo sapiens
gcacagcatgagtgttggcat

SEQ ID NO: 9256425 - DNA, 22 bp, Homo sapiens
gcgctcaggtgccaggcctgcg

SEQ ID NO: 9256426 - DNA, 22 bp, Homo sapiens
gcgctgcgcctcctcttccgca

SEQ ID NO: 9256427 - DNA, 22 bp, Homo sapiens
gcggcgcctaagccccgacctc

SEQ ID NO: 9256428 - DNA, 22 bp, Homo sapiens
gcggcggagacagcaggaagcc

SEQ ID NO: 9256429 - DNA, 22 bp, Homo sapiens
gcgagaaactaagtgccctttg

SEQ ID NO: 9256430 - DNA, 22 bp, Homo sapiens
gcgcgcctctgcccggtgttcc

SEQ ID NO: 9256431 - DNA, 22 bp, Homo sapiens
gcgcctattttcattatcaagg

SEQ ID NO: 9256432 - DNA, 22 bp, Homo sapiens
gcgcgctaccgccagggctgca

SEQ ID NO: 9256433 - DNA, 22 bp, Homo sapiens
gccttgaactcatgtatattga

SEQ ID NO: 9256434 - DNA, 22 bp, Homo sapiens
gccttgccaaggggcagcagag

SEQ ID NO: 9256435 - DNA, 22 bp, Homo sapiens
gccttttttgttgctctgtcac

SEQ ID NO: 9256436 - DNA, 22 bp, Homo sapiens
gccttttttgttgctctgtcac

SEQ ID NO: 9256437 - DNA, 22 bp, Homo sapiens
gcgacgctcgggctccgatgcc

SEQ ID NO: 9256438 - DNA, 22 bp, Homo sapiens
gccttctctgtgagctcctagg

SEQ ID NO: 9256439 - DNA, 22 bp, Homo sapiens
gccttctgcgctcgtgtctccg

SEQ ID NO: 9256440 - DNA, 22 bp, Homo sapiens
gccttctgatcgctggactgac

SEQ ID NO: 9256441 - DNA, 22 bp, Homo sapiens
gccttctgattgctggactgac

SEQ ID NO: 9256442 - DNA, 22 bp, Homo sapiens
gccttctgtgctcctggccttt

SEQ ID NO: 9256443 - DNA, 15 bp, Homo sapiens
gccttgaatgtgaat

SEQ ID NO: 9256444 - DNA, 19 bp, Homo sapiens
gccttgaagcaactcttgt

SEQ ID NO: 9256445 - DNA, 22 bp, Homo sapiens
gctcactgcaacctccacctcc

SEQ ID NO: 9256446 - DNA, 22 bp, Homo sapiens
gctcaccttcgtccagcagccg

SEQ ID NO: 9256447 - DNA, 22 bp, Homo sapiens
gctcacagtctgctgagtgcag

SEQ ID NO: 9256448 - DNA, 22 bp, Homo sapiens
gctcacagtacagtgctggctc

SEQ ID NO: 9256449 - DNA, 22 bp, Homo sapiens
gctcacaggggcagacgagttg

SEQ ID NO: 9256450 - DNA, 22 bp, Homo sapiens
gctcacagccggctggcagggg

SEQ ID NO: 9256451 - DNA, 22 bp, Homo sapiens
gctcacaggcagtgttgggaga

SEQ ID NO: 9256452 - DNA, 22 bp, Homo sapiens
gctcacagccggctggcagggg

SEQ ID NO: 9256453 - DNA, 22 bp, Homo sapiens
gctcaagagagatgcagttctt

SEQ ID NO: 9256454 - DNA, 22 bp, Homo sapiens
gctcaagccttctgcccacctc

SEQ ID NO: 9256455 - DNA, 22 bp, Homo sapiens
gctcaaggcaggcagacatgag

SEQ ID NO: 9256456 - DNA, 22 bp, Homo sapiens
gctcaagggatgggagtgggtg

SEQ ID NO: 9256457 - DNA, 22 bp, Homo sapiens
gctcaaggcaggcagacatgag

SEQ ID NO: 9256458 - DNA, 22 bp, Homo sapiens
gctatgaatatccatgatcagc

SEQ ID NO: 9256459 - DNA, 22 bp, Homo sapiens
gctatgaacatgagaatgcaaa

SEQ ID NO: 9256460 - DNA, 22 bp, Homo sapiens
gcgggggcggcgcagacctcag

SEQ ID NO: 9256461 - DNA, 22 bp, Homo sapiens
gcctggtgctatgagggccagc

SEQ ID NO: 9256462 - DNA, 22 bp, Homo sapiens
gcctggtggacactgggcatca

SEQ ID NO: 9256463 - DNA, 22 bp, Homo sapiens
gcctggtggtatcctggcaaga

SEQ ID NO: 9256464 - DNA, 22 bp, Homo sapiens
gcctggtgtccagaggcgagtg

SEQ ID NO: 9256465 - DNA, 22 bp, Homo sapiens
gcctggtggtgtgctcaagtgg

SEQ ID NO: 9256466 - DNA, 22 bp, Homo sapiens
gcctggtggtgtgctcaagtgg

SEQ ID NO: 9256467 - DNA, 22 bp, Homo sapiens
gcctggtggtatcctggcaaga

SEQ ID NO: 9256468 - DNA, 22 bp, Homo sapiens
gccttattacctgcactttgaa

SEQ ID NO: 9256469 - DNA, 22 bp, Homo sapiens
gccttagcctgcacttcctgtt

SEQ ID NO: 9256470 - DNA, 22 bp, Homo sapiens
gccttcagccctgactggccag

SEQ ID NO: 9256471 - DNA, 18 bp, Homo sapiens
gccttcagactgcatgct

SEQ ID NO: 9256472 - DNA, 22 bp, Homo sapiens
gccttcagtagtatcctcatga

SEQ ID NO: 9256473 - DNA, 22 bp, Homo sapiens
gccttcagtaactgagacggaa

SEQ ID NO: 9256474 - DNA, 22 bp, Homo sapiens
gccttcaggtgctgccaggcta

SEQ ID NO: 9256475 - DNA, 22 bp, Homo sapiens
gccttcagtagtgtcagctgta

SEQ ID NO: 9256476 - DNA, 22 bp, Homo sapiens
gccttccacctaggcctctgct

SEQ ID NO: 9256477 - DNA, 22 bp, Homo sapiens
gccttcagtagtgtcagctgta

SEQ ID NO: 9256478 - DNA, 22 bp, Homo sapiens
gccttcaggagggttccagaca

SEQ ID NO: 9256479 - DNA, 22 bp, Homo sapiens
gccttcaggaaatcagtccttg

SEQ ID NO: 9256480 - DNA, 22 bp, Homo sapiens
gccttcagcggccgctcgctgc

SEQ ID NO: 9256481 - DNA, 23 bp, Homo sapiens
gccttcagctcgggaaggctccc

SEQ ID NO: 9256482 - DNA, 22 bp, Homo sapiens
gcctggtgaaaggcagagagcg

SEQ ID NO: 9256483 - DNA, 22 bp, Homo sapiens
gcctggtgaaaggcagagagcg

SEQ ID NO: 9256484 - DNA, 22 bp, Homo sapiens
gcctggtctctttcatgtcagt

SEQ ID NO: 9256485 - DNA, 22 bp, Homo sapiens
gcctggtctctttcatgtcagt

SEQ ID NO: 9256486 - DNA, 22 bp, Homo sapiens
gcctggtgaaaggcagagagcg

SEQ ID NO: 9256487 - DNA, 23 bp, Homo sapiens
gcctgggttgtaactagtgcatc

SEQ ID NO: 9256488 - DNA, 22 bp, Homo sapiens
gcctgggtgtcgatcactagtg

SEQ ID NO: 9256489 - DNA, 22 bp, Homo sapiens
gcctgggttccatgatctccag

SEQ ID NO: 9256490 - DNA, 22 bp, Homo sapiens
gcctgggtccactgatcatgct

SEQ ID NO: 9256491 - DNA, 22 bp, Homo sapiens
gcctgggtccactgatcatgct

SEQ ID NO: 9256492 - DNA, 22 bp, Homo sapiens
gcctgggtgaatttgatcctaa

SEQ ID NO: 9256493 - DNA, 22 bp, Homo sapiens
gcctggggtcccttgttggcac

SEQ ID NO: 9256494 - DNA, 22 bp, Homo sapiens
gcctggggggcatgtcataata

SEQ ID NO: 9256495 - DNA, 22 bp, Homo sapiens
gcctggggtctctgactcacag

SEQ ID NO: 9256496 - DNA, 22 bp, Homo sapiens
gcctggggtctctgactcacag

SEQ ID NO: 9256497 - DNA, 22 bp, Homo sapiens
gcctggggccagcttgggctga

SEQ ID NO: 9256498 - DNA, 22 bp, Homo sapiens
gcctggggcatgcagctgatac

SEQ ID NO: 9256499 - DNA, 22 bp, Homo sapiens
gcctggggcatgcagctgatac

SEQ ID NO: 9256500 - DNA, 22 bp, Homo sapiens
gcctcaggcctatagctgctgt

SEQ ID NO: 9256501 - DNA, 22 bp, Homo sapiens
gcctcaggcctatagctgctgt

SEQ ID NO: 9256502 - DNA, 22 bp, Homo sapiens
gcctcagggataggatgagcat

SEQ ID NO: 9256503 - DNA, 22 bp, Homo sapiens
gcctcagggataggatgagcat

SEQ ID NO: 9256504 - DNA, 22 bp, Homo sapiens
gcctcagggataggatgagcat

SEQ ID NO: 9256505 - DNA, 22 bp, Homo sapiens
gcctcagggataggatgagcat

SEQ ID NO: 9256506 - DNA, 22 bp, Homo sapiens
gcctggctgctagccagaggca

SEQ ID NO: 9256507 - DNA, 22 bp, Homo sapiens
gcctggctggtcactgcctggc

SEQ ID NO: 9256508 - DNA, 22 bp, Homo sapiens
gcctggcttcccttggagcatt

SEQ ID NO: 9256509 - DNA, 22 bp, Homo sapiens
gcctggggaacttgatcctgtc

SEQ ID NO: 9256510 - DNA, 22 bp, Homo sapiens
gcctggggaacttgatcctgtc

SEQ ID NO: 9256511 - DNA, 22 bp, Homo sapiens
gcctggcttgccagccctggcg

SEQ ID NO: 9256512 - DNA, 22 bp, Homo sapiens
gctgccagtgtggcatgatgca

SEQ ID NO: 9256513 - DNA, 20 bp, Homo sapiens
gctgccagtgcctgatgctt

SEQ ID NO: 9256514 - DNA, 22 bp, Homo sapiens
gctgccagtagttggagctcca

SEQ ID NO: 9256515 - DNA, 22 bp, Homo sapiens
gctgccagctcactctcctgag

SEQ ID NO: 9256516 - DNA, 19 bp, Homo sapiens
gctgccaggacagttactg

SEQ ID NO: 9256517 - DNA, 22 bp, Homo sapiens
gctgccagggaggtggtggagg

SEQ ID NO: 9256518 - DNA, 23 bp, Homo sapiens
gctgcagctgtggatgttctcag

SEQ ID NO: 9256519 - DNA, 22 bp, Homo sapiens
gctgcagctgtaggacacaatt

SEQ ID NO: 9256520 - DNA, 22 bp, Homo sapiens
gctgcagactgggaggcaggtg

SEQ ID NO: 9256521 - DNA, 22 bp, Homo sapiens
gctgcaggagattttgagagtc

SEQ ID NO: 9256522 - DNA, 22 bp, Homo sapiens
gctgcagctttaggatccagtg

SEQ ID NO: 9256523 - DNA, 22 bp, Homo sapiens
gctgcaggagctggagctgtgg

SEQ ID NO: 9256524 - DNA, 22 bp, Homo sapiens
gctgcaggagctggagctgtgg

SEQ ID NO: 9256525 - DNA, 22 bp, Homo sapiens
gctgccacttggtcatgtcatg

SEQ ID NO: 9256526 - DNA, 22 bp, Homo sapiens
gctgccacttggtcatgtcatg

SEQ ID NO: 9256527 - DNA, 22 bp, Homo sapiens
gctgccactctgagcttgcttc

SEQ ID NO: 9256528 - DNA, 22 bp, Homo sapiens
gctgcaggatgaggctctgctc

SEQ ID NO: 9256529 - DNA, 22 bp, Homo sapiens
gctgcagggggtgggcgtctcc

SEQ ID NO: 9256530 - DNA, 22 bp, Homo sapiens
gctgcaggttgggcaacagagt

SEQ ID NO: 9256531 - DNA, 22 bp, Homo sapiens
gctgcagaatttccttctcatt

SEQ ID NO: 9256532 - DNA, 22 bp, Homo sapiens
gctgcaactgttgctctctgca

SEQ ID NO: 9256533 - DNA, 22 bp, Homo sapiens
gctgattttgagaagcacagtc

SEQ ID NO: 9256534 - DNA, 22 bp, Homo sapiens
gctgatgtttagttgatgttac

SEQ ID NO: 9256535 - DNA, 22 bp, Homo sapiens
gctgatccttttatgtctagct

SEQ ID NO: 9256536 - DNA, 22 bp, Homo sapiens
gctgatgtgatgtcagaagagg

SEQ ID NO: 9256537 - DNA, 22 bp, Homo sapiens
gctgatggcttgctggctgaca

SEQ ID NO: 9256538 - DNA, 22 bp, Homo sapiens
gctgaagggagtgctgagtctg

SEQ ID NO: 9256539 - DNA, 22 bp, Homo sapiens
gctgaaggtctctggagaggtc

SEQ ID NO: 9256540 - DNA, 22 bp, Homo sapiens
gctgaaggtatgagttttatct

SEQ ID NO: 9256541 - DNA, 22 bp, Homo sapiens
gctgaaggtgtgtggagagagg

SEQ ID NO: 9256542 - DNA, 22 bp, Homo sapiens
gctgaagttgcctattttaata

SEQ ID NO: 9256543 - DNA, 22 bp, Homo sapiens
gctgaagttttgcagagagtaa

SEQ ID NO: 9256544 - DNA, 22 bp, Homo sapiens
gctgaaggcccggaggacaggg

SEQ ID NO: 9256545 - DNA, 22 bp, Homo sapiens
gctgaaggcccggaggacaggg

SEQ ID NO: 9256546 - DNA, 22 bp, Homo sapiens
gctgaagctgcagcaggaggaa

SEQ ID NO: 9256547 - DNA, 22 bp, Homo sapiens
gctgaagctgcagcaggaggaa

SEQ ID NO: 9256548 - DNA, 20 bp, Homo sapiens
gctgaagattcccatgcaag

SEQ ID NO: 9256549 - DNA, 22 bp, Homo sapiens
gctgaagataagtgaagaggct

SEQ ID NO: 9256550 - DNA, 22 bp, Homo sapiens
gctgaagataagtgaagaggct

SEQ ID NO: 9256551 - DNA, 22 bp, Homo sapiens
gctgaagcccacgtggcttgta

SEQ ID NO: 9256552 - DNA, 22 bp, Homo sapiens
gctgaagatttttgctagcccc

SEQ ID NO: 9256553 - DNA, 22 bp, Homo sapiens
gctgaagctgacacatagtgct

SEQ ID NO: 9256554 - DNA, 17 bp, Homo sapiens
gctctgccccagcctct

SEQ ID NO: 9256555 - DNA, 22 bp, Homo sapiens
gctctcagggtgatggcatact

SEQ ID NO: 9256556 - DNA, 22 bp, Homo sapiens
gctctccaaaccctgtggcttt

SEQ ID NO: 9256557 - DNA, 22 bp, Homo sapiens
gctctccactgaccacggggca

SEQ ID NO: 9256558 - DNA, 17 bp, Homo sapiens
gctctggcacaggattg

SEQ ID NO: 9256559 - DNA, 22 bp, Homo sapiens
gctctggcagctgatattagga

SEQ ID NO: 9256560 - DNA, 22 bp, Homo sapiens
gctctggctactccaccctgtt

SEQ ID NO: 9256561 - DNA, 21 bp, Homo sapiens
gctctggcctactgttccctc

SEQ ID NO: 9256562 - DNA, 22 bp, Homo sapiens
gctctggccagaccctcagtgg

SEQ ID NO: 9256563 - DNA, 22 bp, Homo sapiens
gctctggcccaaaccctttcta

SEQ ID NO: 9256564 - DNA, 22 bp, Homo sapiens
gctctggctactgtggctaccg

SEQ ID NO: 9256565 - DNA, 22 bp, Homo sapiens
gctgaagagcaaggctgggtct

SEQ ID NO: 9256566 - DNA, 22 bp, Homo sapiens
gctgaagagagatgcgtccagc

SEQ ID NO: 9256567 - DNA, 22 bp, Homo sapiens
gctgaagagaggccttgagcac

SEQ ID NO: 9256568 - DNA, 23 bp, Homo sapiens
gctgaagagcaaaccaggcaaaa

SEQ ID NO: 9256569 - DNA, 22 bp, Homo sapiens
gctcaggcctccagaggggcaa

SEQ ID NO: 9256570 - DNA, 18 bp, Homo sapiens
gctcaggccctagtcagt

SEQ ID NO: 9256571 - DNA, 22 bp, Homo sapiens
gctcagggaactttttgcaggc

SEQ ID NO: 9256572 - DNA, 22 bp, Homo sapiens
gctcctggtctggagcttcaag

SEQ ID NO: 9256573 - DNA, 22 bp, Homo sapiens
gctcctggtgctgtagagattt

SEQ ID NO: 9256574 - DNA, 22 bp, Homo sapiens
gctcctggtgctgtagagattt

SEQ ID NO: 9256575 - DNA, 21 bp, Homo sapiens
gctcctggtgctgcgtggcgc

SEQ ID NO: 9256576 - DNA, 21 bp, Homo sapiens
gctcctggtgctgcgtggcgc

SEQ ID NO: 9256577 - DNA, 18 bp, Homo sapiens
gctcctggttggaaagaa

SEQ ID NO: 9256578 - DNA, 22 bp, Homo sapiens
gctctcagaagtaacttgtcca

SEQ ID NO: 9256579 - DNA, 21 bp, Homo sapiens
gctctcagctgcctgctggtt

SEQ ID NO: 9256580 - DNA, 22 bp, Homo sapiens
gctgtgagggcttctgaggcat

SEQ ID NO: 9256581 - DNA, 22 bp, Homo sapiens
gctgtgagggcttctgaggcat

SEQ ID NO: 9256582 - DNA, 22 bp, Homo sapiens
gctgtgagggtctagtgaggtg

SEQ ID NO: 9256583 - DNA, 22 bp, Homo sapiens
gctgtgagggcttctgaggcat

SEQ ID NO: 9256584 - DNA, 22 bp, Homo sapiens
gctgtgagtgagctgcctaggc

SEQ ID NO: 9256585 - DNA, 22 bp, Homo sapiens
gctgtgagtgagctgcctaggc

SEQ ID NO: 9256586 - DNA, 22 bp, Homo sapiens
gctgtgagccgctgctgagcat

SEQ ID NO: 9256587 - DNA, 22 bp, Homo sapiens
gctgtgagctgcctgtgtcaca

SEQ ID NO: 9256588 - DNA, 22 bp, Homo sapiens
gctgtgagcactgctgggtgga

SEQ ID NO: 9256589 - DNA, 22 bp, Homo sapiens
gctgtgagccgctgctgagcat

SEQ ID NO: 9256590 - DNA, 22 bp, Homo sapiens
gctgtgagaaacagggagtgtc

SEQ ID NO: 9256591 - DNA, 22 bp, Homo sapiens
gctgtcttgctcactcttgcag

SEQ ID NO: 9256592 - DNA, 22 bp, Homo sapiens
gcttccagtcctcagaggctgg

SEQ ID NO: 9256593 - DNA, 22 bp, Homo sapiens
gcttccagtgactttggtcgtg

SEQ ID NO: 9256594 - DNA, 22 bp, Homo sapiens
gcttccagtaagttgctgccat

SEQ ID NO: 9256595 - DNA, 22 bp, Homo sapiens
gcttccatgttgctgctggtca

SEQ ID NO: 9256596 - DNA, 22 bp, Homo sapiens
gcttccatctatgtcttcatca

SEQ ID NO: 9256597 - DNA, 23 bp, Homo sapiens
gcttccattctagtttgctgtgc

SEQ ID NO: 9256598 - DNA, 22 bp, Homo sapiens
gcttccacctactaaatgccac

SEQ ID NO: 9256599 - DNA, 22 bp, Homo sapiens
gctgtgcagtctttggtgtgcc

SEQ ID NO: 9256600 - DNA, 22 bp, Homo sapiens
gctgtgcagccaagtgcctctg

SEQ ID NO: 9256601 - DNA, 22 bp, Homo sapiens
gctgggttttcttccgggccta

SEQ ID NO: 9256602 - DNA, 22 bp, Homo sapiens
gctgggtttccagcaggcagga

SEQ ID NO: 9256603 - DNA, 22 bp, Homo sapiens
gctgggttttcttccgggccta

SEQ ID NO: 9256604 - DNA, 22 bp, Homo sapiens
gctgggtttccagcaggcagga

SEQ ID NO: 9256605 - DNA, 22 bp, Homo sapiens
gctgggtgtcacggggctcgtg

SEQ ID NO: 9256606 - DNA, 22 bp, Homo sapiens
gctggtcagagagaaaggaggc

SEQ ID NO: 9256607 - DNA, 22 bp, Homo sapiens
gctgtctgttcgagcgtgtgtt

SEQ ID NO: 9256608 - DNA, 22 bp, Homo sapiens
gctgtcttcacttcctggtttc

SEQ ID NO: 9256609 - DNA, 22 bp, Homo sapiens
gctggtcactctgggagctgct

SEQ ID NO: 9256610 - DNA, 22 bp, Homo sapiens
gctggtagacctcactgcactc

SEQ ID NO: 9256611 - DNA, 22 bp, Homo sapiens
gctgggtcctatgctggtagag

SEQ ID NO: 9256612 - DNA, 22 bp, Homo sapiens
gctgggtcccaagcctggggag

SEQ ID NO: 9256613 - DNA, 22 bp, Homo sapiens
gctgggtctggatgctcaggtg

SEQ ID NO: 9256614 - DNA, 22 bp, Homo sapiens
gctgggtggatcggaggctctg

SEQ ID NO: 9256615 - DNA, 22 bp, Homo sapiens
gctgggtcagaatctccctgtg

SEQ ID NO: 9256616 - DNA, 22 bp, Homo sapiens
gctgggtattttaagaaaggaa

SEQ ID NO: 9256617 - DNA, 22 bp, Homo sapiens
gctgggtccatggtcctcgggt

SEQ ID NO: 9256618 - DNA, 16 bp, Homo sapiens
gctgggagggagaggt

SEQ ID NO: 9256619 - DNA, 22 bp, Homo sapiens
gctgggaggcagcacctttagc

SEQ ID NO: 9256620 - DNA, 16 bp, Homo sapiens
gctgggagggagaggt

SEQ ID NO: 9256621 - DNA, 22 bp, Homo sapiens
gctgggagtcgcgtctgtggcc

SEQ ID NO: 9256622 - DNA, 22 bp, Homo sapiens
gctggcagagacaagaagacta

SEQ ID NO: 9256623 - DNA, 22 bp, Homo sapiens
gctggctcaagtgtgcttccca

SEQ ID NO: 9256624 - DNA, 22 bp, Homo sapiens
gctggctccaaaagcaggggct

SEQ ID NO: 9256625 - DNA, 22 bp, Homo sapiens
gctggcagactgggggcagaac

SEQ ID NO: 9256626 - DNA, 22 bp, Homo sapiens
gctggcagactgggggcagaac

SEQ ID NO: 9256627 - DNA, 22 bp, Homo sapiens
gctggcagacttcctctggaac

SEQ ID NO: 9256628 - DNA, 22 bp, Homo sapiens
gctggcagaagagctggttcaa

SEQ ID NO: 9256629 - DNA, 22 bp, Homo sapiens
gctggcagaagagctggttcaa

SEQ ID NO: 9256630 - DNA, 22 bp, Homo sapiens
gctgccatggtccaggctccag

SEQ ID NO: 9256631 - DNA, 22 bp, Homo sapiens
gctgccatgccacagcactcac

SEQ ID NO: 9256632 - DNA, 22 bp, Homo sapiens
gctggcacctgcaccaagcagg

SEQ ID NO: 9256633 - DNA, 22 bp, Homo sapiens
gctgggagaggccctgaagtga

SEQ ID NO: 9256634 - DNA, 22 bp, Homo sapiens
gctgggagcaaagccatgcata

SEQ ID NO: 9256635 - DNA, 22 bp, Homo sapiens
gctgggaggatctctccctgtc

SEQ ID NO: 9256636 - DNA, 22 bp, Homo sapiens
gctgggaggatctctccctgtc

SEQ ID NO: 9256637 - DNA, 22 bp, Homo sapiens
gctgggaggatctctccctgtc

SEQ ID NO: 9256638 - DNA, 22 bp, Homo sapiens
gctgggaggatctctccctgtc

SEQ ID NO: 9256639 - DNA, 22 bp, Homo sapiens
gctgggagacagacttggaacc

SEQ ID NO: 9256640 - DNA, 22 bp, Homo sapiens
gctgggagacagacttggaacc

SEQ ID NO: 9256641 - DNA, 22 bp, Homo sapiens
gctgggagaggccctgaagtga

SEQ ID NO: 9256642 - DNA, 22 bp, Homo sapiens
gctgggagaggcagctttcgga

SEQ ID NO: 9256643 - DNA, 22 bp, Homo sapiens
gctgggaagtggcagagctgga

SEQ ID NO: 9256644 - DNA, 22 bp, Homo sapiens
gctgggaagaacaggagagaat

SEQ ID NO: 9256645 - DNA, 22 bp, Homo sapiens
gctgggacggctcagtaagaag

SEQ ID NO: 9256646 - DNA, 22 bp, Homo sapiens
gctgggacaggcttggccctgt

SEQ ID NO: 9256647 - DNA, 22 bp, Homo sapiens
gctgggacaggcttggccctgt

SEQ ID NO: 9256648 - DNA, 22 bp, Homo sapiens
gctgggacaacaggtgagcacc

SEQ ID NO: 9256649 - DNA, 22 bp, Homo sapiens
gctggctgcacaggggctcact

SEQ ID NO: 9256650 - DNA, 22 bp, Homo sapiens
gctggctgcacaggggctcact

SEQ ID NO: 9256651 - DNA, 22 bp, Homo sapiens
gctggctctgcacccaggcctc

SEQ ID NO: 9256652 - DNA, 22 bp, Homo sapiens
gctggctctgccccacctgttc

SEQ ID NO: 9256653 - DNA, 22 bp, Homo sapiens
gctggctcgggaagcaggggat

SEQ ID NO: 9256654 - DNA, 22 bp, Homo sapiens
gctggctcctctgtcctcacgg

SEQ ID NO: 9256655 - DNA, 21 bp, Homo sapiens
gctggctctctgacgtgcttt

SEQ ID NO: 9256656 - DNA, 22 bp, Homo sapiens
ggaacattggcattttaaggct

SEQ ID NO: 9256657 - DNA, 22 bp, Homo sapiens
ggaacattctagagtgttgtga

SEQ ID NO: 9256658 - DNA, 21 bp, Homo sapiens
ggaacattgttaatagtctct

SEQ ID NO: 9256659 - DNA, 22 bp, Homo sapiens
ggaacatactgtgtagactttg

SEQ ID NO: 9256660 - DNA, 22 bp, Homo sapiens
ggaacatactgtgtagactttg

SEQ ID NO: 9256661 - DNA, 22 bp, Homo sapiens
ggaaccttagtgttcttttacc

SEQ ID NO: 9256662 - DNA, 22 bp, Homo sapiens
ggaacccatgattatggttagg

SEQ ID NO: 9256663 - DNA, 22 bp, Homo sapiens
ggaacattttttaaggcagaaa

SEQ ID NO: 9256664 - DNA, 15 bp, Homo sapiens
ggaacatttctgttt

SEQ ID NO: 9256665 - DNA, 22 bp, Homo sapiens
ggaacatttaaattcttatttg

SEQ ID NO: 9256666 - DNA, 22 bp, Homo sapiens
ggaacatttcctggcagagagg

SEQ ID NO: 9256667 - DNA, 21 bp, Homo sapiens
ggaagcagtggcggcaactcc

SEQ ID NO: 9256668 - DNA, 22 bp, Homo sapiens
ggaagcaggaggctggggtaaa

SEQ ID NO: 9256669 - DNA, 22 bp, Homo sapiens
ggaagcaggaggctggggtaaa

SEQ ID NO: 9256670 - DNA, 22 bp, Homo sapiens
ggaagccagaaagtgagaatat

SEQ ID NO: 9256671 - DNA, 22 bp, Homo sapiens
ggaagccacccagctttgatag

SEQ ID NO: 9256672 - DNA, 22 bp, Homo sapiens
ggaagccaaggtggcctctatt

SEQ ID NO: 9256673 - DNA, 22 bp, Homo sapiens
ggaagccagagtgctgggcagg

SEQ ID NO: 9256674 - DNA, 20 bp, Homo sapiens
ggaagccagcatccttgagg

SEQ ID NO: 9256675 - DNA, 22 bp, Homo sapiens
ggaagccaggccaatgagaaca

SEQ ID NO: 9256676 - DNA, 20 bp, Homo sapiens
ggaagccagggtgcagggga

SEQ ID NO: 9256677 - DNA, 22 bp, Homo sapiens
ggaagccaggctgggggatctg

SEQ ID NO: 9256678 - DNA, 22 bp, Homo sapiens
ggaagccatgagggacagttct

SEQ ID NO: 9256679 - DNA, 22 bp, Homo sapiens
ggaagccagttgcttggtgtgg

SEQ ID NO: 9256680 - DNA, 21 bp, Homo sapiens
ggaagctgtgtccatgctcct

SEQ ID NO: 9256681 - DNA, 22 bp, Homo sapiens
ggaagctgttgtgagtgcagca

SEQ ID NO: 9256682 - DNA, 21 bp, Homo sapiens
ggacaccagtcacactggatt

SEQ ID NO: 9256683 - DNA, 22 bp, Homo sapiens
ggaaggaagaggaccgagctgg

SEQ ID NO: 9256684 - DNA, 22 bp, Homo sapiens
ggaaggaacaaaccctgtgtgg

SEQ ID NO: 9256685 - DNA, 22 bp, Homo sapiens
ggaaggaaattggggcagttgt

SEQ ID NO: 9256686 - DNA, 22 bp, Homo sapiens
ggaaggaaattggggcagttgt

SEQ ID NO: 9256687 - DNA, 22 bp, Homo sapiens
gcttcccctccaagcactgcct

SEQ ID NO: 9256688 - DNA, 22 bp, Homo sapiens
gcttcctagcattagccattgc

SEQ ID NO: 9256689 - DNA, 22 bp, Homo sapiens
gcttcctagatctgtggtactc

SEQ ID NO: 9256690 - DNA, 22 bp, Homo sapiens
gcttcctacatgtgtctgcgag

SEQ ID NO: 9256691 - DNA, 22 bp, Homo sapiens
gcttcctaaatgcacagggcag

SEQ ID NO: 9256692 - DNA, 17 bp, Homo sapiens
gcttcctcatgcagttc

SEQ ID NO: 9256693 - DNA, 22 bp, Homo sapiens
gcttcctgagaaacaatctgat

SEQ ID NO: 9256694 - DNA, 22 bp, Homo sapiens
gcttcctgagacaacattgagt

SEQ ID NO: 9256695 - DNA, 22 bp, Homo sapiens
gcttcctccctgctgctcacta

SEQ ID NO: 9256696 - DNA, 22 bp, Homo sapiens
gcttcctccctgctgctcacta

SEQ ID NO: 9256697 - DNA, 22 bp, Homo sapiens
gcttcctcctggaggtcactca

SEQ ID NO: 9256698 - DNA, 22 bp, Homo sapiens
ggaaatattttgtctaatttgt

SEQ ID NO: 9256699 - DNA, 22 bp, Homo sapiens
ggaaagtggtggtggaaagagg

SEQ ID NO: 9256700 - DNA, 22 bp, Homo sapiens
ggaaagtccttctaaagccaga

SEQ ID NO: 9256701 - DNA, 17 bp, Homo sapiens
ggaaaggtagagtaatc

SEQ ID NO: 9256702 - DNA, 22 bp, Homo sapiens
ggaaaggggcctggatcttttg

SEQ ID NO: 9256703 - DNA, 22 bp, Homo sapiens
ggaaagggcatggccttttcac

SEQ ID NO: 9256704 - DNA, 22 bp, Homo sapiens
gcttcctggaacaactgttgct

SEQ ID NO: 9256705 - DNA, 22 bp, Homo sapiens
gcttcctggaacaactgttgct

SEQ ID NO: 9256706 - DNA, 22 bp, Homo sapiens
ggaaagctcagatcttgttgga

SEQ ID NO: 9256707 - DNA, 22 bp, Homo sapiens
gcttcctgagtacaccctcatc

SEQ ID NO: 9256708 - DNA, 22 bp, Homo sapiens
gcttcctgatattcatactgtt

SEQ ID NO: 9256709 - DNA, 22 bp, Homo sapiens
ggaaaggagatattggagagtg

SEQ ID NO: 9256710 - DNA, 22 bp, Homo sapiens
ggaaagggcagaggccttggag

SEQ ID NO: 9256711 - DNA, 22 bp, Homo sapiens
ggaaagggagttttgcttatga

SEQ ID NO: 9256712 - DNA, 22 bp, Homo sapiens
ggaaaggctaacagtcatggaa

SEQ ID NO: 9256713 - DNA, 22 bp, Homo sapiens
ggaaaggagatgaataggatta

SEQ ID NO: 9256714 - DNA, 22 bp, Homo sapiens
ggaaaggagatattggagagtg

SEQ ID NO: 9256715 - DNA, 22 bp, Homo sapiens
ggaaaggagatgaataggatta

SEQ ID NO: 9256716 - DNA, 21 bp, Homo sapiens
ggacagaggagaaggcaccct

SEQ ID NO: 9256717 - DNA, 22 bp, Homo sapiens
ggacccaggtagggaggaagat

SEQ ID NO: 9256718 - DNA, 22 bp, Homo sapiens
ggaccccagagataccagtttt

SEQ ID NO: 9256719 - DNA, 18 bp, Homo sapiens
ggacccagggcctcaccc

SEQ ID NO: 9256720 - DNA, 22 bp, Homo sapiens
ggacccagctctgagaccctgc

SEQ ID NO: 9256721 - DNA, 22 bp, Homo sapiens
ggaccctgggctctgggcctat

SEQ ID NO: 9256722 - DNA, 22 bp, Homo sapiens
ggacctgccagaactcaggcta

SEQ ID NO: 9256723 - DNA, 22 bp, Homo sapiens
ggacctgaacataaaacgaggc

SEQ ID NO: 9256724 - DNA, 22 bp, Homo sapiens
ggacagagccctggtggcctaa

SEQ ID NO: 9256725 - DNA, 22 bp, Homo sapiens
ggacagagccctggtggcctaa

SEQ ID NO: 9256726 - DNA, 22 bp, Homo sapiens
ggacagagccctggtggcctaa

SEQ ID NO: 9256727 - DNA, 22 bp, Homo sapiens
ggacagagcagacgagcagcgg

SEQ ID NO: 9256728 - DNA, 22 bp, Homo sapiens
ggacagagcagacgagcagcgg

SEQ ID NO: 9256729 - DNA, 22 bp, Homo sapiens
ggacactgtataagttagagta

SEQ ID NO: 9256730 - DNA, 23 bp, Homo sapiens
ggacactgtgcagatgctagtgc

SEQ ID NO: 9256731 - DNA, 22 bp, Homo sapiens
ggacactgttcatggggagggg

SEQ ID NO: 9256732 - DNA, 22 bp, Homo sapiens
ggacactgtataagttagagta

SEQ ID NO: 9256733 - DNA, 20 bp, Homo sapiens
ggacactgtagatttcaaac

SEQ ID NO: 9256734 - DNA, 22 bp, Homo sapiens
ggacactggccacatttcaaaa

SEQ ID NO: 9256735 - DNA, 22 bp, Homo sapiens
ggacactgttcatggggagggg

SEQ ID NO: 9256736 - DNA, 23 bp, Homo sapiens
ggacactgctataaaggatctgc

SEQ ID NO: 9256737 - DNA, 23 bp, Homo sapiens
ggacactgctataaaggatctgc

SEQ ID NO: 9256738 - DNA, 23 bp, Homo sapiens
ggacactgctataaaggatctgc

SEQ ID NO: 9256739 - DNA, 21 bp, Homo sapiens
ggacactgataatcttgttgc

SEQ ID NO: 9256740 - DNA, 22 bp, Homo sapiens
ggacactgaagaatctcagatg

SEQ ID NO: 9256741 - DNA, 21 bp, Homo sapiens
ggacactgataatcttgttgc

SEQ ID NO: 9256742 - DNA, 22 bp, Homo sapiens
ggagagagatgccgccttgctc

SEQ ID NO: 9256743 - DNA, 22 bp, Homo sapiens
ggactgaggcccacttgaggga

SEQ ID NO: 9256744 - DNA, 22 bp, Homo sapiens
ggagagaggagcccactgctgt

SEQ ID NO: 9256745 - DNA, 22 bp, Homo sapiens
ggagagctggtatatgaagaca

SEQ ID NO: 9256746 - DNA, 22 bp, Homo sapiens
ggagagctggtagctggctcca

SEQ ID NO: 9256747 - DNA, 22 bp, Homo sapiens
ggagagctggtagctggctcca

SEQ ID NO: 9256748 - DNA, 22 bp, Homo sapiens
ggactgaggacatgtgaggcat

SEQ ID NO: 9256749 - DNA, 22 bp, Homo sapiens
ggactgaggacatgtgaggcat

SEQ ID NO: 9256750 - DNA, 22 bp, Homo sapiens
ggacctggcaatttgcatctct

SEQ ID NO: 9256751 - DNA, 19 bp, Homo sapiens
ggacctggcaatctgcatt

SEQ ID NO: 9256752 - DNA, 22 bp, Homo sapiens
ggacggggagctggaaagggga

SEQ ID NO: 9256753 - DNA, 20 bp, Homo sapiens
ggactacaatttgcagtgtg

SEQ ID NO: 9256754 - DNA, 22 bp, Homo sapiens
ggagaggaaatgccagcacttc

SEQ ID NO: 9256755 - DNA, 22 bp, Homo sapiens
ggagaggaaatgccagcacttc

SEQ ID NO: 9256756 - DNA, 22 bp, Homo sapiens
ggagaggaaatgccagcacttc

SEQ ID NO: 9256757 - DNA, 22 bp, Homo sapiens
ggagagcttggagtgcgatttt

SEQ ID NO: 9256758 - DNA, 22 bp, Homo sapiens
ggagaggagattgtggcatttt

SEQ ID NO: 9256759 - DNA, 22 bp, Homo sapiens
ggagaggagctattgggggctc

SEQ ID NO: 9256760 - DNA, 22 bp, Homo sapiens
ggagaggacatggctcccacag

SEQ ID NO: 9256761 - DNA, 22 bp, Homo sapiens
ggagaggagctattgggggctc

SEQ ID NO: 9256762 - DNA, 19 bp, Homo sapiens
ggagaggctggagggatgc

SEQ ID NO: 9256763 - DNA, 22 bp, Homo sapiens
ggagaggcttccagagtcgtgc

SEQ ID NO: 9256764 - DNA, 22 bp, Homo sapiens
ggagaggcttccagagtcgtgc

SEQ ID NO: 9256765 - DNA, 22 bp, Homo sapiens
ggctccctgcctgtcctcagtc

SEQ ID NO: 9256766 - DNA, 22 bp, Homo sapiens
ggctccctgcctgtcctcagtc

SEQ ID NO: 9256767 - DNA, 22 bp, Homo sapiens
ggctccctgcaacctccgcctc

SEQ ID NO: 9256768 - DNA, 22 bp, Homo sapiens
ggctccctcaccaccatcacat

SEQ ID NO: 9256769 - DNA, 22 bp, Homo sapiens
ggctccagggagtggagagaag

SEQ ID NO: 9256770 - DNA, 22 bp, Homo sapiens
ggctccatccaaggccttctag

SEQ ID NO: 9256771 - DNA, 22 bp, Homo sapiens
ggctccagtttgtgccttcagc

SEQ ID NO: 9256772 - DNA, 22 bp, Homo sapiens
ggctccaggctcctatttcact

SEQ ID NO: 9256773 - DNA, 22 bp, Homo sapiens
ggctccagggagtggagagaag

SEQ ID NO: 9256774 - DNA, 22 bp, Homo sapiens
ggctaggcgggcacatggtgga

SEQ ID NO: 9256775 - DNA, 23 bp, Homo sapiens
ggctccaggcctgacgggcgcgg

SEQ ID NO: 9256776 - DNA, 22 bp, Homo sapiens
ggcgtgggcgaggtgctctatc

SEQ ID NO: 9256777 - DNA, 22 bp, Homo sapiens
ggcgtggcagtcaggaaaaggt

SEQ ID NO: 9256778 - DNA, 22 bp, Homo sapiens
ggcgtgggaagtggggcttctg

SEQ ID NO: 9256779 - DNA, 22 bp, Homo sapiens
ggcgtttcaccatgttgaccag

SEQ ID NO: 9256780 - DNA, 22 bp, Homo sapiens
ggctagagtggaactggagcgg

SEQ ID NO: 9256781 - DNA, 22 bp, Homo sapiens
ggctagagtggaactggagcgg

SEQ ID NO: 9256782 - DNA, 22 bp, Homo sapiens
ggctaggcaggctcagagccta

SEQ ID NO: 9256783 - DNA, 22 bp, Homo sapiens
ggctaggcaggctcagagccta

SEQ ID NO: 9256784 - DNA, 23 bp, Homo sapiens
ggctagagtggaggggaactgca

SEQ ID NO: 9256785 - DNA, 23 bp, Homo sapiens
ggctagagtggaggggaactgca

SEQ ID NO: 9256786 - DNA, 22 bp, Homo sapiens
ggctagagtggaactggagcgg

SEQ ID NO: 9256787 - DNA, 17 bp, Homo sapiens
ggctctgggtgtcacat

SEQ ID NO: 9256788 - DNA, 22 bp, Homo sapiens
ggctctggtgtgaagcagcctc

SEQ ID NO: 9256789 - DNA, 22 bp, Homo sapiens
ggctctggttgaccatgatggc

SEQ ID NO: 9256790 - DNA, 22 bp, Homo sapiens
ggctctgtaaagtgacacctgc

SEQ ID NO: 9256791 - DNA, 23 bp, Homo sapiens
ggctctgtgctgggcctgcagga

SEQ ID NO: 9256792 - DNA, 23 bp, Homo sapiens
ggctctgtgctgggcctgcagga

SEQ ID NO: 9256793 - DNA, 23 bp, Homo sapiens
ggctctgtgctaattgctgaaaa

SEQ ID NO: 9256794 - DNA, 22 bp, Homo sapiens
ggctgagccatgggcactgcag

SEQ ID NO: 9256795 - DNA, 22 bp, Homo sapiens
ggctgagccactgcgcctggct

SEQ ID NO: 9256796 - DNA, 22 bp, Homo sapiens
ggctgagccatgggcactgcag

SEQ ID NO: 9256797 - DNA, 22 bp, Homo sapiens
ggctcttctacttcagatgggg

SEQ ID NO: 9256798 - DNA, 22 bp, Homo sapiens
ggctgagcactttaggcaggag

SEQ ID NO: 9256799 - DNA, 22 bp, Homo sapiens
ggctcttcacacagtgatgtca

SEQ ID NO: 9256800 - DNA, 22 bp, Homo sapiens
ggctctggggaagctctcttca

SEQ ID NO: 9256801 - DNA, 22 bp, Homo sapiens
ggctcctgagaatgggccatca

SEQ ID NO: 9256802 - DNA, 22 bp, Homo sapiens
ggctcctctctggccgctcccg

SEQ ID NO: 9256803 - DNA, 22 bp, Homo sapiens
ggctccctgttctattccctgg

SEQ ID NO: 9256804 - DNA, 22 bp, Homo sapiens
ggctccctgggtgctcctgctc

SEQ ID NO: 9256805 - DNA, 22 bp, Homo sapiens
ggctcctgaggaccaggcacag

SEQ ID NO: 9256806 - DNA, 22 bp, Homo sapiens
ggctggtctcagtgctgggttc

SEQ ID NO: 9256807 - DNA, 22 bp, Homo sapiens
ggctggtctccaacccccgatc

SEQ ID NO: 9256808 - DNA, 22 bp, Homo sapiens
ggctggtgagttcagagaaccc

SEQ ID NO: 9256809 - DNA, 22 bp, Homo sapiens
ggctggtggggaaagaggacca

SEQ ID NO: 9256810 - DNA, 22 bp, Homo sapiens
ggctggtcctttctctgtccta

SEQ ID NO: 9256811 - DNA, 22 bp, Homo sapiens
ggctggtcccgggtcctccggc

SEQ ID NO: 9256812 - DNA, 21 bp, Homo sapiens
ggctggtcgcgtgcatgtctc

SEQ ID NO: 9256813 - DNA, 22 bp, Homo sapiens
ggctggtcaggaaactaggctc

SEQ ID NO: 9256814 - DNA, 22 bp, Homo sapiens
ggctggtcacaccactgcaggg

SEQ ID NO: 9256815 - DNA, 22 bp, Homo sapiens
ggctgggttctgagaaagagta

SEQ ID NO: 9256816 - DNA, 22 bp, Homo sapiens
ggctgtgagcaggcagaatgct

SEQ ID NO: 9256817 - DNA, 22 bp, Homo sapiens
ggctgtgcagggcagagtctca

SEQ ID NO: 9256818 - DNA, 17 bp, Homo sapiens
ggctgtgccaggtgaga

SEQ ID NO: 9256819 - DNA, 22 bp, Homo sapiens
ggctgtgccctcacatggggca

SEQ ID NO: 9256820 - DNA, 19 bp, Homo sapiens
ggctggagaaaggaatcag

SEQ ID NO: 9256821 - DNA, 22 bp, Homo sapiens
ggctggagaagggtggttgaca

SEQ ID NO: 9256822 - DNA, 19 bp, Homo sapiens
ggctggagaaaggaatcag

SEQ ID NO: 9256823 - DNA, 19 bp, Homo sapiens
ggctggagaaaggaatcag

SEQ ID NO: 9256824 - DNA, 22 bp, Homo sapiens
ggctggacatgagcttggcagt

SEQ ID NO: 9256825 - DNA, 22 bp, Homo sapiens
ggctggactttctgctgggctc

SEQ ID NO: 9256826 - DNA, 22 bp, Homo sapiens
ggctggagaagggtggttgaca

SEQ ID NO: 9256827 - DNA, 22 bp, Homo sapiens
ggctgggtacagggcagtgtgc

SEQ ID NO: 9256828 - DNA, 21 bp, Homo sapiens
ggctgggtcatgcagctggcc

SEQ ID NO: 9256829 - DNA, 22 bp, Homo sapiens
ggctgggtcccagctgggagga

SEQ ID NO: 9256830 - DNA, 19 bp, Homo sapiens
ggctgggtctggcaggttc

SEQ ID NO: 9256831 - DNA, 22 bp, Homo sapiens
ggctgggtcccagctgggagga

SEQ ID NO: 9256832 - DNA, 19 bp, Homo sapiens
ggctgggtctggcaggttc

SEQ ID NO: 9256833 - DNA, 22 bp, Homo sapiens
ggctgagggtatagctgtccca

SEQ ID NO: 9256834 - DNA, 22 bp, Homo sapiens
ggctgagggtcccagaccctaa

SEQ ID NO: 9256835 - DNA, 22 bp, Homo sapiens
ggctgagggtatagctgtccca

SEQ ID NO: 9256836 - DNA, 22 bp, Homo sapiens
ggctgaggggcccagaggaaca

SEQ ID NO: 9256837 - DNA, 22 bp, Homo sapiens
ggctgagggtatagctgtccca

SEQ ID NO: 9256838 - DNA, 22 bp, Homo sapiens
ggctgaggggcccagaggaaca

SEQ ID NO: 9256839 - DNA, 22 bp, Homo sapiens
ggctgaggggcccagaggaaca

SEQ ID NO: 9256840 - DNA, 22 bp, Homo sapiens
ggctgagggccagggctagtct

SEQ ID NO: 9256841 - DNA, 22 bp, Homo sapiens
ggctgagggccagggctagtct

SEQ ID NO: 9256842 - DNA, 22 bp, Homo sapiens
ggctgagggccagggctagtct

SEQ ID NO: 9256843 - DNA, 22 bp, Homo sapiens
ggctgagggccagggctagtct

SEQ ID NO: 9256844 - DNA, 22 bp, Homo sapiens
ggctgagggccagggctagtct

SEQ ID NO: 9256845 - DNA, 22 bp, Homo sapiens
ggctgagggttaagatcagaca

SEQ ID NO: 9256846 - DNA, 22 bp, Homo sapiens
ggctgagggttaagatcagaca

SEQ ID NO: 9256847 - DNA, 22 bp, Homo sapiens
ggctgagggtcccagaccctaa

SEQ ID NO: 9256848 - DNA, 22 bp, Homo sapiens
ggctgagggttaagatcagaca

SEQ ID NO: 9256849 - DNA, 22 bp, Homo sapiens
ggctgagggtcccagaccctaa

SEQ ID NO: 9256850 - DNA, 22 bp, Homo sapiens
ggctgaggtgtggggaactata

SEQ ID NO: 9256851 - DNA, 22 bp, Homo sapiens
ggctgaggtgtggggaactata

SEQ ID NO: 9256852 - DNA, 18 bp, Homo sapiens
ggctgaggttgactagaa

SEQ ID NO: 9256853 - DNA, 18 bp, Homo sapiens
ggctgaggttgactagaa

SEQ ID NO: 9256854 - DNA, 18 bp, Homo sapiens
ggctgaggttgactagaa

SEQ ID NO: 9256855 - DNA, 18 bp, Homo sapiens
ggctgaggttgactagaa

SEQ ID NO: 9256856 - DNA, 18 bp, Homo sapiens
ggctgaggttgactagaa

SEQ ID NO: 9256857 - DNA, 18 bp, Homo sapiens
ggctgaggttgactagaa

SEQ ID NO: 9256858 - DNA, 22 bp, Homo sapiens
ggctgagtctgtgacccatgcg

SEQ ID NO: 9256859 - DNA, 22 bp, Homo sapiens
ggctgagtggaggtagccctgt

SEQ ID NO: 9256860 - DNA, 22 bp, Homo sapiens
ggctgagtggctgggtctagtt

SEQ ID NO: 9256861 - DNA, 22 bp, Homo sapiens
ggctgagtggctgggtctagtt

SEQ ID NO: 9256862 - DNA, 22 bp, Homo sapiens
ggctgcttgctgtttcttggat

SEQ ID NO: 9256863 - DNA, 18 bp, Homo sapiens
ggctgcttaaggagatcc

SEQ ID NO: 9256864 - DNA, 22 bp, Homo sapiens
ggctgctgtttcagagactgtt

SEQ ID NO: 9256865 - DNA, 20 bp, Homo sapiens
ggctgctgtgggcagagagg

SEQ ID NO: 9256866 - DNA, 20 bp, Homo sapiens
ggctgctgtgggcagagagg

SEQ ID NO: 9256867 - DNA, 22 bp, Homo sapiens
ggctgctggggacgtgggagag

SEQ ID NO: 9256868 - DNA, 22 bp, Homo sapiens
ggctgctgggtcatgatgcaga

SEQ ID NO: 9256869 - DNA, 21 bp, Homo sapiens
ggctgctgggggttggcacag

SEQ ID NO: 9256870 - DNA, 21 bp, Homo sapiens
ggctgctgggggttggcacag

SEQ ID NO: 9256871 - DNA, 22 bp, Homo sapiens
ggctgagttgagaggattactt

SEQ ID NO: 9256872 - DNA, 22 bp, Homo sapiens
ggctgagttctcttgctgaatc

SEQ ID NO: 9256873 - DNA, 22 bp, Homo sapiens
ggctgagttctcttgctgaatc

SEQ ID NO: 9256874 - DNA, 22 bp, Homo sapiens
ggctgctggggacgtgggagag

SEQ ID NO: 9256875 - DNA, 22 bp, Homo sapiens
ggctggaaggtagaagatgagg

SEQ ID NO: 9256876 - DNA, 22 bp, Homo sapiens
ggctgctttatcggctgctgaa

SEQ ID NO: 9256877 - DNA, 22 bp, Homo sapiens
ggctggaatgcaactgtgtgtt

SEQ ID NO: 9256878 - DNA, 22 bp, Homo sapiens
ggctggaatgtgtggatgtgat

SEQ ID NO: 9256879 - DNA, 21 bp, Homo sapiens
ggctggacatcccaggagact

SEQ ID NO: 9256880 - DNA, 23 bp, Homo sapiens
gggaagtggggatttgaagtcat

SEQ ID NO: 9256881 - DNA, 22 bp, Homo sapiens
gggaagtgtggtttctttacag

SEQ ID NO: 9256882 - DNA, 17 bp, Homo sapiens
gggaagtggagaaagct

SEQ ID NO: 9256883 - DNA, 23 bp, Homo sapiens
gggaagtggggatttgaagtcat

SEQ ID NO: 9256884 - DNA, 22 bp, Homo sapiens
gggaatgagagtcagcccagga

SEQ ID NO: 9256885 - DNA, 22 bp, Homo sapiens
gggaagtcgggttgagcactta

SEQ ID NO: 9256886 - DNA, 22 bp, Homo sapiens
gggagctgacctgcaggttccc

SEQ ID NO: 9256887 - DNA, 22 bp, Homo sapiens
gggagctgagctggaagagaat

SEQ ID NO: 9256888 - DNA, 22 bp, Homo sapiens
gggagctggagctggaagactc

SEQ ID NO: 9256889 - DNA, 22 bp, Homo sapiens
gggagctgagggacctctgtgg

SEQ ID NO: 9256890 - DNA, 22 bp, Homo sapiens
gggaagggagggacctcagtct

SEQ ID NO: 9256891 - DNA, 22 bp, Homo sapiens
ggctttcaacacaggctttcct

SEQ ID NO: 9256892 - DNA, 22 bp, Homo sapiens
ggctgtgcctcaaggctactca

SEQ ID NO: 9256893 - DNA, 20 bp, Homo sapiens
ggctgtgcccttccgtggcc

SEQ ID NO: 9256894 - DNA, 22 bp, Homo sapiens
gggcactgctggaggctccctg

SEQ ID NO: 9256895 - DNA, 22 bp, Homo sapiens
gggcactgctggaggctccctg

SEQ ID NO: 9256896 - DNA, 22 bp, Homo sapiens
gggcactgctggaggctccctg

SEQ ID NO: 9256897 - DNA, 22 bp, Homo sapiens
gggcactgagtggatgatgcag

SEQ ID NO: 9256898 - DNA, 22 bp, Homo sapiens
gggcactgacagggtcccaact

SEQ ID NO: 9256899 - DNA, 22 bp, Homo sapiens
gggcactgaatgccaagctagg

SEQ ID NO: 9256900 - DNA, 22 bp, Homo sapiens
gggcactgagaattttccactt

SEQ ID NO: 9256901 - DNA, 22 bp, Homo sapiens
gggcactgagggcccacaggat

SEQ ID NO: 9256902 - DNA, 22 bp, Homo sapiens
gggcactggaggccaaggagct

SEQ ID NO: 9256903 - DNA, 22 bp, Homo sapiens
gggcactggaggccaaggagct

SEQ ID NO: 9256904 - DNA, 22 bp, Homo sapiens
gggcactggcagtcggggacgc

SEQ ID NO: 9256905 - DNA, 22 bp, Homo sapiens
gggcactgctttgctctgtcac

SEQ ID NO: 9256906 - DNA, 22 bp, Homo sapiens
gggcactgctttgctctgtcac

SEQ ID NO: 9256907 - DNA, 22 bp, Homo sapiens
gggcactggaaggctctcaggc

SEQ ID NO: 9256908 - DNA, 22 bp, Homo sapiens
gggcactggaaggctctcaggc

SEQ ID NO: 9256909 - DNA, 22 bp, Homo sapiens
gggcacagtctaaagttgggcc

SEQ ID NO: 9256910 - DNA, 22 bp, Homo sapiens
gggcacagtactccaatcaact

SEQ ID NO: 9256911 - DNA, 22 bp, Homo sapiens
gggcacagtctaaagttgggcc

SEQ ID NO: 9256912 - DNA, 21 bp, Homo sapiens
gggcactgaaagggaatagca

SEQ ID NO: 9256913 - DNA, 22 bp, Homo sapiens
gggcactgaacaccctcttcgc

SEQ ID NO: 9256914 - DNA, 22 bp, Homo sapiens
gggcagtgaatattggtgggaa

SEQ ID NO: 9256915 - DNA, 22 bp, Homo sapiens
gggcagtgacaaaggggatgaa

SEQ ID NO: 9256916 - DNA, 18 bp, Homo sapiens
gggcactggggactggag

SEQ ID NO: 9256917 - DNA, 22 bp, Homo sapiens
gggcactggccgcccatccctg

SEQ ID NO: 9256918 - DNA, 18 bp, Homo sapiens
gggcactggggactggag

SEQ ID NO: 9256919 - DNA, 22 bp, Homo sapiens
gggcactgggtcttctccacgc

SEQ ID NO: 9256920 - DNA, 22 bp, Homo sapiens
gggcaggttattggagtaggga

SEQ ID NO: 9256921 - DNA, 23 bp, Homo sapiens
gggcaggtttttataggcttcag

SEQ ID NO: 9256922 - DNA, 23 bp, Homo sapiens
gggcaggtttttataggcttcag

SEQ ID NO: 9256923 - DNA, 22 bp, Homo sapiens
gggagggatctgctaggcaatg

SEQ ID NO: 9256924 - DNA, 22 bp, Homo sapiens
gggagggatctgctaggcaatg

SEQ ID NO: 9256925 - DNA, 22 bp, Homo sapiens
gggagggatctgctaggcaatg

SEQ ID NO: 9256926 - DNA, 22 bp, Homo sapiens
gggagggaggtgctggttcacg

SEQ ID NO: 9256927 - DNA, 22 bp, Homo sapiens
gggagggaggtgctggttcacg

SEQ ID NO: 9256928 - DNA, 16 bp, Homo sapiens
gggagggagttggtgg

SEQ ID NO: 9256929 - DNA, 22 bp, Homo sapiens
gggagggagaggacagttctat

SEQ ID NO: 9256930 - DNA, 22 bp, Homo sapiens
gggagggagaggacagttctat

SEQ ID NO: 9256931 - DNA, 22 bp, Homo sapiens
gggagggagaggacagttctat

SEQ ID NO: 9256932 - DNA, 22 bp, Homo sapiens
gggagggaggtgatgcttggct

SEQ ID NO: 9256933 - DNA, 22 bp, Homo sapiens
gggagggaggtgatgcttggct

SEQ ID NO: 9256934 - DNA, 22 bp, Homo sapiens
gggagggaggtgatgcttggct

SEQ ID NO: 9256935 - DNA, 22 bp, Homo sapiens
gggagctggagctggaagactc

SEQ ID NO: 9256936 - DNA, 22 bp, Homo sapiens
gggagctggagctggaagactc

SEQ ID NO: 9256937 - DNA, 22 bp, Homo sapiens
gggagggacacaaagagttccc

SEQ ID NO: 9256938 - DNA, 22 bp, Homo sapiens
gggagggacacaaagagttccc

SEQ ID NO: 9256939 - DNA, 22 bp, Homo sapiens
gggagggacacaaagagttccc

SEQ ID NO: 9256940 - DNA, 22 bp, Homo sapiens
gggaggtgattaggaccatgta

SEQ ID NO: 9256941 - DNA, 22 bp, Homo sapiens
gggaggtgttccagtgttggta

SEQ ID NO: 9256942 - DNA, 22 bp, Homo sapiens
gggaggttctgttcgcacttga

SEQ ID NO: 9256943 - DNA, 22 bp, Homo sapiens
gggaggtgatggcaagcagcgg

SEQ ID NO: 9256944 - DNA, 22 bp, Homo sapiens
gggagggattagttctgcctgg

SEQ ID NO: 9256945 - DNA, 22 bp, Homo sapiens
gggagggattagttctgcctgg

SEQ ID NO: 9256946 - DNA, 22 bp, Homo sapiens
gggagggattagttctgcctgg

SEQ ID NO: 9256947 - DNA, 21 bp, Homo sapiens
gggagggatggaaatgatgtt

SEQ ID NO: 9256948 - DNA, 21 bp, Homo sapiens
gggagggatggaaatgatgtt

SEQ ID NO: 9256949 - DNA, 21 bp, Homo sapiens
gggagggatggaaatgatgtt

SEQ ID NO: 9256950 - DNA, 22 bp, Homo sapiens
ggcagggtggccctccagtgag

SEQ ID NO: 9256951 - DNA, 17 bp, Homo sapiens
ggcagggtgctgggtat

SEQ ID NO: 9256952 - DNA, 22 bp, Homo sapiens
ggcagggtgcctggctcctgtt

SEQ ID NO: 9256953 - DNA, 22 bp, Homo sapiens
ggcaggtgaggcatgtgcctgg

SEQ ID NO: 9256954 - DNA, 22 bp, Homo sapiens
ggcagtgggtggatctcaggga

SEQ ID NO: 9256955 - DNA, 22 bp, Homo sapiens
ggcagtgggttccccaaggcac

SEQ ID NO: 9256956 - DNA, 22 bp, Homo sapiens
ggcagtgggttccccaaggcac

SEQ ID NO: 9256957 - DNA, 22 bp, Homo sapiens
ggcaggtgacctggcctcccag

SEQ ID NO: 9256958 - DNA, 22 bp, Homo sapiens
ggcaggtgacggggatgagtat

SEQ ID NO: 9256959 - DNA, 22 bp, Homo sapiens
ggcaggtagcctagaggaggtt

SEQ ID NO: 9256960 - DNA, 17 bp, Homo sapiens
ggcaggtgacagacacc

SEQ ID NO: 9256961 - DNA, 22 bp, Homo sapiens
ggcaggggtgaggccactctga

SEQ ID NO: 9256962 - DNA, 22 bp, Homo sapiens
ggcagggtctggactgaaagct

SEQ ID NO: 9256963 - DNA, 22 bp, Homo sapiens
ggcagggtgcctggctcctgtt

SEQ ID NO: 9256964 - DNA, 22 bp, Homo sapiens
ggcaggaggaagagttagcacc

SEQ ID NO: 9256965 - DNA, 22 bp, Homo sapiens
ggcaggagctctccagtttgcc

SEQ ID NO: 9256966 - DNA, 22 bp, Homo sapiens
ggcaggagctctccagtttgcc

SEQ ID NO: 9256967 - DNA, 22 bp, Homo sapiens
ggcaggagataaaatattagtt

SEQ ID NO: 9256968 - DNA, 22 bp, Homo sapiens
ggcaggagataaaatattagtt

SEQ ID NO: 9256969 - DNA, 22 bp, Homo sapiens
ggcaggagaatggcgtgaactc

SEQ ID NO: 9256970 - DNA, 22 bp, Homo sapiens
ggcaggagctcaggttggttcc

SEQ ID NO: 9256971 - DNA, 18 bp, Homo sapiens
ggcaggagcaagaatagg

SEQ ID NO: 9256972 - DNA, 22 bp, Homo sapiens
ggcatgagaggtcctggggatt

SEQ ID NO: 9256973 - DNA, 22 bp, Homo sapiens
ggcatgagaggtcctggggatt

SEQ ID NO: 9256974 - DNA, 22 bp, Homo sapiens
ggcatctgtccatctctccagc

SEQ ID NO: 9256975 - DNA, 22 bp, Homo sapiens
ggcatctggatctgcttctccc

SEQ ID NO: 9256976 - DNA, 22 bp, Homo sapiens
ggcatctgtccatctctccagc

SEQ ID NO: 9256977 - DNA, 22 bp, Homo sapiens
ggcatctggatctgcttctccc

SEQ ID NO: 9256978 - DNA, 22 bp, Homo sapiens
ggcatgagaggtcctggggatt

SEQ ID NO: 9256979 - DNA, 20 bp, Homo sapiens
ggcatgagatgtgagggagg

SEQ ID NO: 9256980 - DNA, 20 bp, Homo sapiens
ggcatgagatgtgagggagg

SEQ ID NO: 9256981 - DNA, 21 bp, Homo sapiens
ggcatgagggcagtgagcaga

SEQ ID NO: 9256982 - DNA, 22 bp, Homo sapiens
ggcatgagtaacgtgagtgagg

SEQ ID NO: 9256983 - DNA, 22 bp, Homo sapiens
ggcatgagtaacgtgagtgagg

SEQ ID NO: 9256984 - DNA, 22 bp, Homo sapiens
ggcatccaaataccaagatgta

SEQ ID NO: 9256985 - DNA, 22 bp, Homo sapiens
ggcagtggttagaaacatgagc

SEQ ID NO: 9256986 - DNA, 22 bp, Homo sapiens
ggcagtggtgggaggctcgctc

SEQ ID NO: 9256987 - DNA, 22 bp, Homo sapiens
ggccaggaacttttgggatggg

SEQ ID NO: 9256988 - DNA, 22 bp, Homo sapiens
ggccagcttctctgctgcctgt

SEQ ID NO: 9256989 - DNA, 22 bp, Homo sapiens
ggcatgcttctgagatgtctcc

SEQ ID NO: 9256990 - DNA, 22 bp, Homo sapiens
ggcatgcttgccatgggccagt

SEQ ID NO: 9256991 - DNA, 23 bp, Homo sapiens
ggcatgcaatggacagagctgga

SEQ ID NO: 9256992 - DNA, 22 bp, Homo sapiens
ggcatgagtggcagtgggcagt

SEQ ID NO: 9256993 - DNA, 22 bp, Homo sapiens
ggcatgagtggcagtgggcagt

SEQ ID NO: 9256994 - DNA, 22 bp, Homo sapiens
ggcctggaagaggacagagaaa

SEQ ID NO: 9256995 - DNA, 22 bp, Homo sapiens
ggcctggaaggacagcgtgatg

SEQ ID NO: 9256996 - DNA, 22 bp, Homo sapiens
ggcctggaaggacagcgtgatg

SEQ ID NO: 9256997 - DNA, 22 bp, Homo sapiens
ggcctggaatgctttcctacca

SEQ ID NO: 9256998 - DNA, 22 bp, Homo sapiens
ggcctggaaggacagcgtgatg

SEQ ID NO: 9256999 - DNA, 22 bp, Homo sapiens
ggcctggacacctgaggtctta

SEQ ID NO: 9257000 - DNA, 22 bp, Homo sapiens
ggcctggacacctgaggtctta

SEQ ID NO: 9257001 - DNA, 22 bp, Homo sapiens
ggcctgcctcacagtcagcacc

SEQ ID NO: 9257002 - DNA, 22 bp, Homo sapiens
ggcctcagaaatagagtaaaat

SEQ ID NO: 9257003 - DNA, 22 bp, Homo sapiens
ggcgggtgtaagtaggacagcg

SEQ ID NO: 9257004 - DNA, 19 bp, Homo sapiens
ggcctggctatccctgctg

SEQ ID NO: 9257005 - DNA, 22 bp, Homo sapiens
ggcctggcctccagatgtgggc

SEQ ID NO: 9257006 - DNA, 19 bp, Homo sapiens
ggcctggatttagggctcc

SEQ ID NO: 9257007 - DNA, 22 bp, Homo sapiens
ggcctggagcagagactaggga

SEQ ID NO: 9257008 - DNA, 22 bp, Homo sapiens
ggcctggagcagagactaggga

SEQ ID NO: 9257009 - DNA, 22 bp, Homo sapiens
ggcctggagtcagggaaagcaa

SEQ ID NO: 9257010 - DNA, 19 bp, Homo sapiens
ggcctggatttagggctcc

SEQ ID NO: 9257011 - DNA, 21 bp, Homo sapiens
ggcctaggggcagatggtgct

SEQ ID NO: 9257012 - DNA, 22 bp, Homo sapiens
ggcctagggcttggtcatggca

SEQ ID NO: 9257013 - DNA, 23 bp, Homo sapiens
ggcctatgggcaggcaaggaagc

SEQ ID NO: 9257014 - DNA, 22 bp, Homo sapiens
ggccgtgctccaaagtcatcgt

SEQ ID NO: 9257015 - DNA, 22 bp, Homo sapiens
ggcctaggaaggggatgtaact

SEQ ID NO: 9257016 - DNA, 22 bp, Homo sapiens
ggcctaggattctgcatttcta

SEQ ID NO: 9257017 - DNA, 22 bp, Homo sapiens
ggccctgggacacaacaccgaa

SEQ ID NO: 9257018 - DNA, 22 bp, Homo sapiens
ggccctgggatgctcagcagtg

SEQ ID NO: 9257019 - DNA, 22 bp, Homo sapiens
ggccctgggatgctcagcagtg

SEQ ID NO: 9257020 - DNA, 22 bp, Homo sapiens
ggccctgggatgctcagcagtg

SEQ ID NO: 9257021 - DNA, 21 bp, Homo sapiens
ggccctggttacgcctcctct

SEQ ID NO: 9257022 - DNA, 19 bp, Homo sapiens
ggccaggctgactgtggtc

SEQ ID NO: 9257023 - DNA, 22 bp, Homo sapiens
ggccctggcagccacgaaagcc

SEQ ID NO: 9257024 - DNA, 22 bp, Homo sapiens
ggccaggaggcaggggctcaat

SEQ ID NO: 9257025 - DNA, 22 bp, Homo sapiens
ggccaggcactgtgtgagatat

SEQ ID NO: 9257026 - DNA, 22 bp, Homo sapiens
ggccaggccaagagggttggaa

SEQ ID NO: 9257027 - DNA, 22 bp, Homo sapiens
ggccaggcgatgacccctccac

SEQ ID NO: 9257028 - DNA, 22 bp, Homo sapiens
ggccaggcactgtgtgagatat

SEQ ID NO: 9257029 - DNA, 22 bp, Homo sapiens
ggccaggccaagagggttggaa

SEQ ID NO: 9257030 - DNA, 22 bp, Homo sapiens
ggccaggaagggaagatcagca

SEQ ID NO: 9257031 - DNA, 22 bp, Homo sapiens
ggccaggagaggagggcactga

SEQ ID NO: 9257032 - DNA, 22 bp, Homo sapiens
ggccaggagaggagggcactga

SEQ ID NO: 9257033 - DNA, 22 bp, Homo sapiens
ggccaggagcaagccaggctct

SEQ ID NO: 9257034 - DNA, 22 bp, Homo sapiens
ggccaggagcaagccaggctct

SEQ ID NO: 9257035 - DNA, 22 bp, Homo sapiens
ggccaggagaggagggcactga

SEQ ID NO: 9257036 - DNA, 22 bp, Homo sapiens
ggccaggaggcaggggctcaat

SEQ ID NO: 9257037 - DNA, 22 bp, Homo sapiens
ggccaggagctgcacagggctc

SEQ ID NO: 9257038 - DNA, 22 bp, Homo sapiens
ggatggagatgaccatggtgac

SEQ ID NO: 9257039 - DNA, 22 bp, Homo sapiens
ggatggagatgaccatggtgac

SEQ ID NO: 9257040 - DNA, 22 bp, Homo sapiens
ggatggagatgaccatggtgac

SEQ ID NO: 9257041 - DNA, 22 bp, Homo sapiens
ggatggagatgaccatggtgac

SEQ ID NO: 9257042 - DNA, 22 bp, Homo sapiens
ggatggagatgaccatggtgac

SEQ ID NO: 9257043 - DNA, 22 bp, Homo sapiens
ggatggaggttctcagatgctc

SEQ ID NO: 9257044 - DNA, 22 bp, Homo sapiens
ggatggcagtctgcatgagaaa

SEQ ID NO: 9257045 - DNA, 22 bp, Homo sapiens
ggattagaggtgatgattataa

SEQ ID NO: 9257046 - DNA, 20 bp, Homo sapiens
ggattctgactgtgaagagg

SEQ ID NO: 9257047 - DNA, 22 bp, Homo sapiens
ggatgggaacttggtagggcat

SEQ ID NO: 9257048 - DNA, 22 bp, Homo sapiens
ggatggccttcttgctcaggaa

SEQ ID NO: 9257049 - DNA, 22 bp, Homo sapiens
ggatgcaggggcagcagagcct

SEQ ID NO: 9257050 - DNA, 22 bp, Homo sapiens
ggatgcaggagttgaagaagga

SEQ ID NO: 9257051 - DNA, 22 bp, Homo sapiens
ggatgcaggacggcatggatgt

SEQ ID NO: 9257052 - DNA, 22 bp, Homo sapiens
ggatgcaggaacacagcgacct

SEQ ID NO: 9257053 - DNA, 22 bp, Homo sapiens
ggatgcaggacggcatggatgt

SEQ ID NO: 9257054 - DNA, 22 bp, Homo sapiens
ggatgcaggaacacagcgacct

SEQ ID NO: 9257055 - DNA, 22 bp, Homo sapiens
ggatgaggtagatgaacaaggg

SEQ ID NO: 9257056 - DNA, 22 bp, Homo sapiens
ggatgaggtagatgaacaaggg

SEQ ID NO: 9257057 - DNA, 22 bp, Homo sapiens
ggatgctgctatcaggcttcga

SEQ ID NO: 9257058 - DNA, 22 bp, Homo sapiens
ggatgctgactttggagcatgg

SEQ ID NO: 9257059 - DNA, 22 bp, Homo sapiens
ggatgctgggagacagcaggca

SEQ ID NO: 9257060 - DNA, 22 bp, Homo sapiens
ggatgctggggaccaatctctg

SEQ ID NO: 9257061 - DNA, 22 bp, Homo sapiens
ggatgctgtctaagctgaggac

SEQ ID NO: 9257062 - DNA, 22 bp, Homo sapiens
ggatggagatgaccatggtgac

SEQ ID NO: 9257063 - DNA, 22 bp, Homo sapiens
ggagcagagctcttcatctgca

SEQ ID NO: 9257064 - DNA, 22 bp, Homo sapiens
ggagcagagctcttcatctgca

SEQ ID NO: 9257065 - DNA, 22 bp, Homo sapiens
ggagcagagcatttcacagcct

SEQ ID NO: 9257066 - DNA, 22 bp, Homo sapiens
ggagcagacataaccttacaga

SEQ ID NO: 9257067 - DNA, 22 bp, Homo sapiens
ggagcagagcatttcacagcct

SEQ ID NO: 9257068 - DNA, 22 bp, Homo sapiens
ggagcagagctgggcttggctg

SEQ ID NO: 9257069 - DNA, 17 bp, Homo sapiens
ggagcagatccaccatt

SEQ ID NO: 9257070 - DNA, 22 bp, Homo sapiens
ggagttggaggctccagggaac

SEQ ID NO: 9257071 - DNA, 22 bp, Homo sapiens
ggatgacaaggaaagcaaacca

SEQ ID NO: 9257072 - DNA, 22 bp, Homo sapiens
ggatgaggaagattactgagaa

SEQ ID NO: 9257073 - DNA, 19 bp, Homo sapiens
ggatgagggtcaggcatag

SEQ ID NO: 9257074 - DNA, 22 bp, Homo sapiens
ggagcacagccttgccagtacc

SEQ ID NO: 9257075 - DNA, 22 bp, Homo sapiens
ggagcaagtcccaggcactagt

SEQ ID NO: 9257076 - DNA, 22 bp, Homo sapiens
ggagcaccctgctcagccaagc

SEQ ID NO: 9257077 - DNA, 22 bp, Homo sapiens
ggagcaccctgctcagccaagc

SEQ ID NO: 9257078 - DNA, 22 bp, Homo sapiens
ggagcaccctgctcagccaagc

SEQ ID NO: 9257079 - DNA, 22 bp, Homo sapiens
ggagcaccaaagtaactagcac

SEQ ID NO: 9257080 - DNA, 22 bp, Homo sapiens
ggagatttatagcacacttcag

SEQ ID NO: 9257081 - DNA, 22 bp, Homo sapiens
ggagatgtagtgtcactggact

SEQ ID NO: 9257082 - DNA, 21 bp, Homo sapiens
ggagatgttgtgcaggagggt

SEQ ID NO: 9257083 - DNA, 22 bp, Homo sapiens
ggagatggtggaagctggtgca

SEQ ID NO: 9257084 - DNA, 22 bp, Homo sapiens
ggagatggtggaagctggtgca

SEQ ID NO: 9257085 - DNA, 22 bp, Homo sapiens
ggagatggtggaagctggtgca

SEQ ID NO: 9257086 - DNA, 22 bp, Homo sapiens
ggagatggtggaagctggtgca

SEQ ID NO: 9257087 - DNA, 22 bp, Homo sapiens
ggagatggctctgcaaggtcta

SEQ ID NO: 9257088 - DNA, 22 bp, Homo sapiens
ggagatggccacgtcactcagt

SEQ ID NO: 9257089 - DNA, 22 bp, Homo sapiens
ggagatggccacgtcactcagt

SEQ ID NO: 9257090 - DNA, 22 bp, Homo sapiens
ggagatggctctgcaaggtcta

SEQ ID NO: 9257091 - DNA, 22 bp, Homo sapiens
ggagatggctctgcaaggtcta

SEQ ID NO: 9257092 - DNA, 22 bp, Homo sapiens
ggagatggctggcaggtagatg

SEQ ID NO: 9257093 - DNA, 22 bp, Homo sapiens
ggagaggcttggcccagcctgg

SEQ ID NO: 9257094 - DNA, 22 bp, Homo sapiens
ggagatggagtggattcagcag

SEQ ID NO: 9257095 - DNA, 22 bp, Homo sapiens
ggagatggcaagaagttattag

SEQ ID NO: 9257096 - DNA, 22 bp, Homo sapiens
ggagatggccaaaaacacaaat

SEQ ID NO: 9257097 - DNA, 22 bp, Homo sapiens
ggagatggtctgttctcatatt

SEQ ID NO: 9257098 - DNA, 21 bp, Homo sapiens
ggagatgggtatcgcctgggc

SEQ ID NO: 9257099 - DNA, 22 bp, Homo sapiens
ggagatggtctgttctcatatt

SEQ ID NO: 9257100 - DNA, 22 bp, Homo sapiens
ggagatgggggattttacagcg

SEQ ID NO: 9257101 - DNA, 22 bp, Homo sapiens
ggagatggctggcaggtagatg

SEQ ID NO: 9257102 - DNA, 22 bp, Homo sapiens
ggagatggctggcaggtagatg

SEQ ID NO: 9257103 - DNA, 22 bp, Homo sapiens
ggagatggctggcaggtagatg

SEQ ID NO: 9257104 - DNA, 22 bp, Homo sapiens
ggagatggctggcaggtagatg

SEQ ID NO: 9257105 - DNA, 22 bp, Homo sapiens
ggcagccaggagggtgtagttt

SEQ ID NO: 9257106 - DNA, 22 bp, Homo sapiens
ggcagccagcaatgagaagttt

SEQ ID NO: 9257107 - DNA, 22 bp, Homo sapiens
ggcagccatgctccaggtgcag

SEQ ID NO: 9257108 - DNA, 22 bp, Homo sapiens
ggcagccatggacactggctag

SEQ ID NO: 9257109 - DNA, 22 bp, Homo sapiens
ggcagccatggacactggctag

SEQ ID NO: 9257110 - DNA, 22 bp, Homo sapiens
ggcagccatgcacgctgcctgg

SEQ ID NO: 9257111 - DNA, 22 bp, Homo sapiens
ggcagccatgcacgctgcctgg

SEQ ID NO: 9257112 - DNA, 22 bp, Homo sapiens
ggcagccatgcacgctgcctgg

SEQ ID NO: 9257113 - DNA, 22 bp, Homo sapiens
ggcagccatactcagacctggg

SEQ ID NO: 9257114 - DNA, 22 bp, Homo sapiens
ggcagccatactcagacctggg

SEQ ID NO: 9257115 - DNA, 22 bp, Homo sapiens
ggcagcagggctgtctccctac

SEQ ID NO: 9257116 - DNA, 22 bp, Homo sapiens
ggcagcagggctgtctccctac

SEQ ID NO: 9257117 - DNA, 22 bp, Homo sapiens
ggcagcagggtagccatttctc

SEQ ID NO: 9257118 - DNA, 22 bp, Homo sapiens
ggcagcagggctgtctccctac

SEQ ID NO: 9257119 - DNA, 22 bp, Homo sapiens
ggcagcaggcgacttccctatt

SEQ ID NO: 9257120 - DNA, 20 bp, Homo sapiens
ggcagcaggagtttcctctt

SEQ ID NO: 9257121 - DNA, 22 bp, Homo sapiens
ggcagcagggtctagattgatg

SEQ ID NO: 9257122 - DNA, 22 bp, Homo sapiens
ggcagcagggtctagattgatg

SEQ ID NO: 9257123 - DNA, 22 bp, Homo sapiens
ggcagcagggtctagattgatg

SEQ ID NO: 9257124 - DNA, 22 bp, Homo sapiens
ggcagcagtaggagctaatctt

SEQ ID NO: 9257125 - DNA, 22 bp, Homo sapiens
ggcagcttcggacggcttataa

SEQ ID NO: 9257126 - DNA, 22 bp, Homo sapiens
ggcaggagaatggcgtgaactc

SEQ ID NO: 9257127 - DNA, 17 bp, Homo sapiens
ggcagctgtgtgcatgc

SEQ ID NO: 9257128 - DNA, 22 bp, Homo sapiens
ggcagccatggacactggctag

SEQ ID NO: 9257129 - DNA, 22 bp, Homo sapiens
ggcagctgttggctctctagga

SEQ ID NO: 9257130 - DNA, 22 bp, Homo sapiens
ggattttagagtacctaagtgt

SEQ ID NO: 9257131 - DNA, 22 bp, Homo sapiens
ggatttgggcttgcagcagagc

SEQ ID NO: 9257132 - DNA, 21 bp, Homo sapiens
ggattttaaaaactgcacctg

SEQ ID NO: 9257133 - DNA, 22 bp, Homo sapiens
ggcactgggtgagggtcactgg

SEQ ID NO: 9257134 - DNA, 22 bp, Homo sapiens
ggcactgggtgagggtcactgg

SEQ ID NO: 9257135 - DNA, 18 bp, Homo sapiens
ggcactggtgatgcagag

SEQ ID NO: 9257136 - DNA, 21 bp, Homo sapiens
ggcagaagtagcatggacggg

SEQ ID NO: 9257137 - DNA, 21 bp, Homo sapiens
ggcagaagtagcatggacggg

SEQ ID NO: 9257138 - DNA, 22 bp, Homo sapiens
ggcagcaggagccatctggtag

SEQ ID NO: 9257139 - DNA, 22 bp, Homo sapiens
ggcagcaggagccatctggtag

SEQ ID NO: 9257140 - DNA, 22 bp, Homo sapiens
ggcagcagcaaggttggagctg

SEQ ID NO: 9257141 - DNA, 22 bp, Homo sapiens
ggcagaaggcaattagagactg

SEQ ID NO: 9257142 - DNA, 22 bp, Homo sapiens
ggcagaagaaaggctaagtctc

SEQ ID NO: 9257143 - DNA, 22 bp, Homo sapiens
ggcagaaggcctcccagctcct

SEQ ID NO: 9257144 - DNA, 19 bp, Homo sapiens
ggcagaaggtgtaggggga

SEQ ID NO: 9257145 - DNA, 22 bp, Homo sapiens
gtagagcaggacttgagatgtt

SEQ ID NO: 9257146 - DNA, 23 bp, Homo sapiens
gtaatgatgggaatttacttaga

SEQ ID NO: 9257147 - DNA, 22 bp, Homo sapiens
gtagatgagctcacatgacctt

SEQ ID NO: 9257148 - DNA, 22 bp, Homo sapiens
gtagatgagctcacatgacctt

SEQ ID NO: 9257149 - DNA, 22 bp, Homo sapiens
gtagcccacctggggagggcga

SEQ ID NO: 9257150 - DNA, 22 bp, Homo sapiens
gtagcccacctggggagggcga

SEQ ID NO: 9257151 - DNA, 22 bp, Homo sapiens
gtagcattctgagttcgcagag

SEQ ID NO: 9257152 - DNA, 22 bp, Homo sapiens
gtagcagaatcagtgctacaga

SEQ ID NO: 9257153 - DNA, 17 bp, Homo sapiens
gtcaacaggatttcttt

SEQ ID NO: 9257154 - DNA, 22 bp, Homo sapiens
gtcaagcagaagataatttaaa

SEQ ID NO: 9257155 - DNA, 22 bp, Homo sapiens
gtcaataattttatggagagaa

SEQ ID NO: 9257156 - DNA, 22 bp, Homo sapiens
gtcaataattgatagatattgg

SEQ ID NO: 9257157 - DNA, 22 bp, Homo sapiens
gtcaataattgatagatattgg

SEQ ID NO: 9257158 - DNA, 22 bp, Homo sapiens
gtcaagtttatccgctcattca

SEQ ID NO: 9257159 - DNA, 22 bp, Homo sapiens
gtcaagttaagataaggtcatg

SEQ ID NO: 9257160 - DNA, 22 bp, Homo sapiens
gtagctgatattagcaatgagt

SEQ ID NO: 9257161 - DNA, 22 bp, Homo sapiens
gtagctatttatgatactcatg

SEQ ID NO: 9257162 - DNA, 22 bp, Homo sapiens
gtagctctgtttaaagttcttt

SEQ ID NO: 9257163 - DNA, 22 bp, Homo sapiens
gtagctgatcctgaggacaggg

SEQ ID NO: 9257164 - DNA, 22 bp, Homo sapiens
gtagcttattagggataatagt

SEQ ID NO: 9257165 - DNA, 22 bp, Homo sapiens
gtagctgtctcggtcaggagtt

SEQ ID NO: 9257166 - DNA, 22 bp, Homo sapiens
gtaggaagctctgaggctagtt

SEQ ID NO: 9257167 - DNA, 22 bp, Homo sapiens
gtaggaaagggagtgaagggaa

SEQ ID NO: 9257168 - DNA, 22 bp, Homo sapiens
gtaatagtctcaaactcctgga

SEQ ID NO: 9257169 - DNA, 22 bp, Homo sapiens
gtaataagaaacagcaattatt

SEQ ID NO: 9257170 - DNA, 22 bp, Homo sapiens
gtaatgaatagatggtggcagg

SEQ ID NO: 9257171 - DNA, 22 bp, Homo sapiens
gtaacactagctctgtcacttt

SEQ ID NO: 9257172 - DNA, 22 bp, Homo sapiens
gtaacagtttgggttccaattg

SEQ ID NO: 9257173 - DNA, 17 bp, Homo sapiens
gtaaggcttgcagatgc

SEQ ID NO: 9257174 - DNA, 22 bp, Homo sapiens
gtaagtaataagtgctcaataa

SEQ ID NO: 9257175 - DNA, 22 bp, Homo sapiens
ggtgggcagctcttggcaggca

SEQ ID NO: 9257176 - DNA, 22 bp, Homo sapiens
ggtgggcagctcttggcaggca

SEQ ID NO: 9257177 - DNA, 22 bp, Homo sapiens
ggtgggcagctcttggcaggca

SEQ ID NO: 9257178 - DNA, 22 bp, Homo sapiens
gtaaatattccctcggttccta

SEQ ID NO: 9257179 - DNA, 22 bp, Homo sapiens
gtaaatattccctcggttccta

SEQ ID NO: 9257180 - DNA, 22 bp, Homo sapiens
gtaaatattccctcggttccta

SEQ ID NO: 9257181 - DNA, 22 bp, Homo sapiens
gtaaatattccctcggttccta

SEQ ID NO: 9257182 - DNA, 22 bp, Homo sapiens
gtaaatattccctcggttccta

SEQ ID NO: 9257183 - DNA, 22 bp, Homo sapiens
ggtgggcacccgagactggatc

SEQ ID NO: 9257184 - DNA, 22 bp, Homo sapiens
ggtgggcacccgagactggatc

SEQ ID NO: 9257185 - DNA, 22 bp, Homo sapiens
ggtgggcacattcagtctctgt

SEQ ID NO: 9257186 - DNA, 22 bp, Homo sapiens
ggtgggcacattcagtctctgt

SEQ ID NO: 9257187 - DNA, 22 bp, Homo sapiens
ggtgggcacattcagtctctgt

SEQ ID NO: 9257188 - DNA, 22 bp, Homo sapiens
gtaaatgccacttaatgtaaag

SEQ ID NO: 9257189 - DNA, 22 bp, Homo sapiens
gtaaattatttcaagatcatct

SEQ ID NO: 9257190 - DNA, 22 bp, Homo sapiens
gtaaattatttcaagatcatct

SEQ ID NO: 9257191 - DNA, 22 bp, Homo sapiens
gtaaatttcccgggccatttaa

SEQ ID NO: 9257192 - DNA, 22 bp, Homo sapiens
gtaacaaaggataacttggttt

SEQ ID NO: 9257193 - DNA, 22 bp, Homo sapiens
gtaacaaaggataacttggttt

SEQ ID NO: 9257194 - DNA, 22 bp, Homo sapiens
gtcctcagagtgggcaggtcct

SEQ ID NO: 9257195 - DNA, 22 bp, Homo sapiens
gtcctcagggaatgtggcgggt

SEQ ID NO: 9257196 - DNA, 22 bp, Homo sapiens
gtcctcagtaagagggcctctg

SEQ ID NO: 9257197 - DNA, 22 bp, Homo sapiens
gtcctctccaggaggctctgat

SEQ ID NO: 9257198 - DNA, 22 bp, Homo sapiens
gtcctcagtcagtttggtgggg

SEQ ID NO: 9257199 - DNA, 22 bp, Homo sapiens
gtcctctgagggggctgcacgc

SEQ ID NO: 9257200 - DNA, 22 bp, Homo sapiens
gtcctctgcttcatgccctgat

SEQ ID NO: 9257201 - DNA, 22 bp, Homo sapiens
gtcctctgcttcatgccctgat

SEQ ID NO: 9257202 - DNA, 23 bp, Homo sapiens
gtctcccatagcgctcccaggct

SEQ ID NO: 9257203 - DNA, 22 bp, Homo sapiens
gtctcctccatggagatggtat

SEQ ID NO: 9257204 - DNA, 22 bp, Homo sapiens
gtctcctatagctgcactgaat

SEQ ID NO: 9257205 - DNA, 22 bp, Homo sapiens
gtctcccatgtccctgtccagt

SEQ ID NO: 9257206 - DNA, 22 bp, Homo sapiens
gtcacaaatcccctcagcaact

SEQ ID NO: 9257207 - DNA, 22 bp, Homo sapiens
gtcaccagcaccaatgccacat

SEQ ID NO: 9257208 - DNA, 21 bp, Homo sapiens
gtcagggattcaagtgctcac

SEQ ID NO: 9257209 - DNA, 22 bp, Homo sapiens
gtcacatgccagtgcacacagg

SEQ ID NO: 9257210 - DNA, 22 bp, Homo sapiens
gtcaccagcaccaatgccacat

SEQ ID NO: 9257211 - DNA, 22 bp, Homo sapiens
gtcaggtcttggaagataggct

SEQ ID NO: 9257212 - DNA, 22 bp, Homo sapiens
gtcaggggatgtgctggtggcc

SEQ ID NO: 9257213 - DNA, 22 bp, Homo sapiens
gtcagtaggaacctagggtcaa

SEQ ID NO: 9257214 - DNA, 22 bp, Homo sapiens
gtcagtcatattgtacagatat

SEQ ID NO: 9257215 - DNA, 22 bp, Homo sapiens
gtcagtggtagggctagttcag

SEQ ID NO: 9257216 - DNA, 22 bp, Homo sapiens
gtcagtgtcttaacagagatta

SEQ ID NO: 9257217 - DNA, 20 bp, Homo sapiens
gtcagtgtcttcagtagtga

SEQ ID NO: 9257218 - DNA, 22 bp, Homo sapiens
gtcagtgtgagataatcttgga

SEQ ID NO: 9257219 - DNA, 22 bp, Homo sapiens
gtcagttcattagcacttccaa

SEQ ID NO: 9257220 - DNA, 22 bp, Homo sapiens
gtcattcaactgcacattaggt

SEQ ID NO: 9257221 - DNA, 22 bp, Homo sapiens
gtcattcctatccatttgatac

SEQ ID NO: 9257222 - DNA, 22 bp, Homo sapiens
gtcattgagtcgtcagagtctt

SEQ ID NO: 9257223 - DNA, 22 bp, Homo sapiens
gtcattcagagatgcaggtaga

SEQ ID NO: 9257224 - DNA, 22 bp, Homo sapiens
gtcataaaaggaccacctattg

SEQ ID NO: 9257225 - DNA, 22 bp, Homo sapiens
gtcattcaaactgtatcacttg

SEQ ID NO: 9257226 - DNA, 22 bp, Homo sapiens
gtgctggggagataggaagaga

SEQ ID NO: 9257227 - DNA, 22 bp, Homo sapiens
gtgctggggagataggaagaga

SEQ ID NO: 9257228 - DNA, 22 bp, Homo sapiens
gtgctggggagataggaagaga

SEQ ID NO: 9257229 - DNA, 22 bp, Homo sapiens
gtgctgggggtttctgtaggtc

SEQ ID NO: 9257230 - DNA, 22 bp, Homo sapiens
gtgctgggggtttctgtaggtc

SEQ ID NO: 9257231 - DNA, 22 bp, Homo sapiens
gtgctgggccctgagaccaggg

SEQ ID NO: 9257232 - DNA, 22 bp, Homo sapiens
gtgcttgggggaagtaacagac

SEQ ID NO: 9257233 - DNA, 23 bp, Homo sapiens
gtgcttgaaagatgcagaattaa

SEQ ID NO: 9257234 - DNA, 22 bp, Homo sapiens
gtgctgggtgctgcagacaggt

SEQ ID NO: 9257235 - DNA, 22 bp, Homo sapiens
gtgctgggggtttctgtaggtc

SEQ ID NO: 9257236 - DNA, 22 bp, Homo sapiens
gtgccctgtctcttgtctccag

SEQ ID NO: 9257237 - DNA, 22 bp, Homo sapiens
gtgccctggtccccagcatata

SEQ ID NO: 9257238 - DNA, 22 bp, Homo sapiens
gtgccctggctcacagtgtctc

SEQ ID NO: 9257239 - DNA, 22 bp, Homo sapiens
gtgcctctcattggctgagccc

SEQ ID NO: 9257240 - DNA, 22 bp, Homo sapiens
gtgcctccttaaattctgcacc

SEQ ID NO: 9257241 - DNA, 22 bp, Homo sapiens
gtgcctctgagctctgctacag

SEQ ID NO: 9257242 - DNA, 22 bp, Homo sapiens
gtgcctcagcaccgcctgcagc

SEQ ID NO: 9257243 - DNA, 22 bp, Homo sapiens
gtgcctcagcaccgcctgcagc

SEQ ID NO: 9257244 - DNA, 22 bp, Homo sapiens
gtgccgcgacgcagtcggtgcc

SEQ ID NO: 9257245 - DNA, 22 bp, Homo sapiens
gtgcctccatcagtgcctccaa

SEQ ID NO: 9257246 - DNA, 22 bp, Homo sapiens
gtgccctgatgcaattgtctca

SEQ ID NO: 9257247 - DNA, 22 bp, Homo sapiens
gtgccctgcatgccccgggtat

SEQ ID NO: 9257248 - DNA, 22 bp, Homo sapiens
gtgcccaggggccagctgccgg

SEQ ID NO: 9257249 - DNA, 22 bp, Homo sapiens
gtgccctgagcttatgcattct

SEQ ID NO: 9257250 - DNA, 22 bp, Homo sapiens
gtgcccaggggccagctgccgg

SEQ ID NO: 9257251 - DNA, 22 bp, Homo sapiens
gtgcaaattccactggaaagct

SEQ ID NO: 9257252 - DNA, 22 bp, Homo sapiens
gtgcaaggtacatccttgatgt

SEQ ID NO: 9257253 - DNA, 22 bp, Homo sapiens
gtgcaataaataaatagattgt

SEQ ID NO: 9257254 - DNA, 23 bp, Homo sapiens
gtgatttcagggaacagaatcag

SEQ ID NO: 9257255 - DNA, 22 bp, Homo sapiens
gtgatttcaaatatagagtgag

SEQ ID NO: 9257256 - DNA, 22 bp, Homo sapiens
gtgatttctaatcatctgaatg

SEQ ID NO: 9257257 - DNA, 22 bp, Homo sapiens
gtgattttgagacctatatagt

SEQ ID NO: 9257258 - DNA, 22 bp, Homo sapiens
gtgattttgagacctatatagt

SEQ ID NO: 9257259 - DNA, 22 bp, Homo sapiens
gtgcaaaaataattgtggtttt

SEQ ID NO: 9257260 - DNA, 22 bp, Homo sapiens
gtgcaaaagcaattgcagtttt

SEQ ID NO: 9257261 - DNA, 22 bp, Homo sapiens
gtgcaaaagcaattgcagtttt

SEQ ID NO: 9257262 - DNA, 22 bp, Homo sapiens
gtgcaaaagcagttggattttt

SEQ ID NO: 9257263 - DNA, 22 bp, Homo sapiens
gtgcaaaaggcattgtggtttt

SEQ ID NO: 9257264 - DNA, 22 bp, Homo sapiens
gtgcaaaagcagttgtggtttt

SEQ ID NO: 9257265 - DNA, 22 bp, Homo sapiens
gtgcaaaagtaaatgtggtttt

SEQ ID NO: 9257266 - DNA, 22 bp, Homo sapiens
gtgcaaaagtaactgtggtttt

SEQ ID NO: 9257267 - DNA, 22 bp, Homo sapiens
gtgaggtggtacaatattaact

SEQ ID NO: 9257268 - DNA, 22 bp, Homo sapiens
gtgataaaatagaaacagtggt

SEQ ID NO: 9257269 - DNA, 22 bp, Homo sapiens
gtgataaaggggaggaagtgtg

SEQ ID NO: 9257270 - DNA, 22 bp, Homo sapiens
gtgataaaatagaaacagtggt

SEQ ID NO: 9257271 - DNA, 22 bp, Homo sapiens
gtgagtgtcagtcaaaggtttt

SEQ ID NO: 9257272 - DNA, 22 bp, Homo sapiens
gtgatacaggtgttctggatat

SEQ ID NO: 9257273 - DNA, 22 bp, Homo sapiens
gtgataattgcagagaaaggag

SEQ ID NO: 9257274 - DNA, 22 bp, Homo sapiens
gtgatatttttaaagattaagg

SEQ ID NO: 9257275 - DNA, 22 bp, Homo sapiens
gtgatgtcagcaagaataggaa

SEQ ID NO: 9257276 - DNA, 22 bp, Homo sapiens
gtgatggagtcaaggctagaac

SEQ ID NO: 9257277 - DNA, 22 bp, Homo sapiens
gtgatgggtaactgtttaggga

SEQ ID NO: 9257278 - DNA, 22 bp, Homo sapiens
gtgaggccgcacgccccggagt

SEQ ID NO: 9257279 - DNA, 22 bp, Homo sapiens
gtgaggtcctaatagacatcga

SEQ ID NO: 9257280 - DNA, 22 bp, Homo sapiens
gtgaggtccatgttaatgggtt

SEQ ID NO: 9257281 - DNA, 22 bp, Homo sapiens
gtgaggtccagtaacttgtcca

SEQ ID NO: 9257282 - DNA, 22 bp, Homo sapiens
gtgaggtcatatagcgaactcc

SEQ ID NO: 9257283 - DNA, 22 bp, Homo sapiens
gtgaggtcaccggccgttgcca

SEQ ID NO: 9257284 - DNA, 22 bp, Homo sapiens
gtgaggtgagtagtgagaagcc

SEQ ID NO: 9257285 - DNA, 22 bp, Homo sapiens
gtgaggtgggctggccagagac

SEQ ID NO: 9257286 - DNA, 22 bp, Homo sapiens
gtgaggtgactagcaggtgggg

SEQ ID NO: 9257287 - DNA, 22 bp, Homo sapiens
gtgaggtctttgggaggtgatt

SEQ ID NO: 9257288 - DNA, 22 bp, Homo sapiens
gtgaggtcctccctgctgggag

SEQ ID NO: 9257289 - DNA, 19 bp, Homo sapiens
gtgaggtctttccttttgt

SEQ ID NO: 9257290 - DNA, 22 bp, Homo sapiens
gtgaggtcctgagaggcttgtg

SEQ ID NO: 9257291 - DNA, 22 bp, Homo sapiens
gtcttctgttctgtgaggcttc

SEQ ID NO: 9257292 - DNA, 22 bp, Homo sapiens
gtcttctgttctgtgaggcttc

SEQ ID NO: 9257293 - DNA, 22 bp, Homo sapiens
gtcttcttttcagtctgcttgt

SEQ ID NO: 9257294 - DNA, 22 bp, Homo sapiens
gtcttcttttcagtctgcttgt

SEQ ID NO: 9257295 - DNA, 22 bp, Homo sapiens
gtcttattatgaggttagactt

SEQ ID NO: 9257296 - DNA, 22 bp, Homo sapiens
gtcttattaaaatgcagtttct

SEQ ID NO: 9257297 - DNA, 22 bp, Homo sapiens
gtcttattaaaaatctaatccc

SEQ ID NO: 9257298 - DNA, 22 bp, Homo sapiens
gtcttattgcgtatgtatacaa

SEQ ID NO: 9257299 - DNA, 22 bp, Homo sapiens
gtcttatttaaagagatcatac

SEQ ID NO: 9257300 - DNA, 22 bp, Homo sapiens
gtcttatttaaagagatcatac

SEQ ID NO: 9257301 - DNA, 22 bp, Homo sapiens
gtcttatagtacaatttgaagt

SEQ ID NO: 9257302 - DNA, 22 bp, Homo sapiens
gtcttattttctgtctactaaa

SEQ ID NO: 9257303 - DNA, 21 bp, Homo sapiens
gtcttcaaaggcagtgggcag

SEQ ID NO: 9257304 - DNA, 22 bp, Homo sapiens
gtcttatttaaggacaagaaga

SEQ ID NO: 9257305 - DNA, 22 bp, Homo sapiens
gtcttatttaaggcttatacaa

SEQ ID NO: 9257306 - DNA, 22 bp, Homo sapiens
gtcttcaggacccggaattttg

SEQ ID NO: 9257307 - DNA, 22 bp, Homo sapiens
gtcttcaggacctggaattttg

SEQ ID NO: 9257308 - DNA, 22 bp, Homo sapiens
gtctcctgctagcaagcaccac

SEQ ID NO: 9257309 - DNA, 22 bp, Homo sapiens
gtctcctgctagcaagcaccac

SEQ ID NO: 9257310 - DNA, 22 bp, Homo sapiens
gtctcctggaaatatgcccata

SEQ ID NO: 9257311 - DNA, 22 bp, Homo sapiens
gtctcctgcccccggtgcttgg

SEQ ID NO: 9257312 - DNA, 22 bp, Homo sapiens
gtctcctgcccccggtgcttgg

SEQ ID NO: 9257313 - DNA, 22 bp, Homo sapiens
gtctcctgcccccggtgcttgg

SEQ ID NO: 9257314 - DNA, 22 bp, Homo sapiens
gtctcctggcctccagtttctc

SEQ ID NO: 9257315 - DNA, 22 bp, Homo sapiens
gtctcctggcctccagtttctc

SEQ ID NO: 9257316 - DNA, 22 bp, Homo sapiens
gtctcctggctgcagctaagac

SEQ ID NO: 9257317 - DNA, 22 bp, Homo sapiens
gtctcctgaggcatccattgaa

SEQ ID NO: 9257318 - DNA, 22 bp, Homo sapiens
gtctcctgaggcatccattgaa

SEQ ID NO: 9257319 - DNA, 22 bp, Homo sapiens
gtctcctgaggcatccattgaa

SEQ ID NO: 9257320 - DNA, 22 bp, Homo sapiens
gtctcctgccacactcagtccc

SEQ ID NO: 9257321 - DNA, 22 bp, Homo sapiens
gtctcctgagccttgactgcaa

SEQ ID NO: 9257322 - DNA, 22 bp, Homo sapiens
gtctcctgagccttgactgcaa

SEQ ID NO: 9257323 - DNA, 22 bp, Homo sapiens
gtctcctgagactgcagtcacc

SEQ ID NO: 9257324 - DNA, 22 bp, Homo sapiens
gtctggggtactttcatctgat

SEQ ID NO: 9257325 - DNA, 22 bp, Homo sapiens
gtctggggtactttcatctgat

SEQ ID NO: 9257326 - DNA, 22 bp, Homo sapiens
gtctccttgtggatctcaagga

SEQ ID NO: 9257327 - DNA, 22 bp, Homo sapiens
gtctcctgtcctgcaggatgga

SEQ ID NO: 9257328 - DNA, 22 bp, Homo sapiens
gtctcctggcttttgtcccagt

SEQ ID NO: 9257329 - DNA, 22 bp, Homo sapiens
gtctcctgtcctgcaggatgga

SEQ ID NO: 9257330 - DNA, 22 bp, Homo sapiens
gtctcctgtcctgcaggatgga

SEQ ID NO: 9257331 - DNA, 22 bp, Homo sapiens
gtctccttgtggatctcaagga

SEQ ID NO: 9257332 - DNA, 22 bp, Homo sapiens
ggtacagggcttcctggacaag

SEQ ID NO: 9257333 - DNA, 19 bp, Homo sapiens
ggtagaagggaagtgtttt

SEQ ID NO: 9257334 - DNA, 22 bp, Homo sapiens
ggtacagggcttcctggacaag

SEQ ID NO: 9257335 - DNA, 22 bp, Homo sapiens
ggtaacaaccctacaaatccac

SEQ ID NO: 9257336 - DNA, 22 bp, Homo sapiens
ggtaacttagctcatggctgtg

SEQ ID NO: 9257337 - DNA, 22 bp, Homo sapiens
ggtaacttgagtgtgttgttca

SEQ ID NO: 9257338 - DNA, 22 bp, Homo sapiens
gggtccagcgacagcaggctca

SEQ ID NO: 9257339 - DNA, 22 bp, Homo sapiens
ggtaaaatgcagattcttagcc

SEQ ID NO: 9257340 - DNA, 22 bp, Homo sapiens
ggtaaactaaccattttaattt

SEQ ID NO: 9257341 - DNA, 22 bp, Homo sapiens
gggtccagatggtgagagttaa

SEQ ID NO: 9257342 - DNA, 22 bp, Homo sapiens
gggtccagcgacagcaggctca

SEQ ID NO: 9257343 - DNA, 23 bp, Homo sapiens
gggtccagccaattccaaggaaa

SEQ ID NO: 9257344 - DNA, 22 bp, Homo sapiens
gggtccagacactccagaggaa

SEQ ID NO: 9257345 - DNA, 22 bp, Homo sapiens
gggtccagaatgagaatgggct

SEQ ID NO: 9257346 - DNA, 22 bp, Homo sapiens
gggtcagggctgcctgggctca

SEQ ID NO: 9257347 - DNA, 22 bp, Homo sapiens
gggtccacctgagcagcagcct

SEQ ID NO: 9257348 - DNA, 22 bp, Homo sapiens
gggtccagagttgaagaggtta

SEQ ID NO: 9257349 - DNA, 23 bp, Homo sapiens
gggtccagagacaggcatgggtg

SEQ ID NO: 9257350 - DNA, 23 bp, Homo sapiens
gggtccagagacaggcatgggtg

SEQ ID NO: 9257351 - DNA, 22 bp, Homo sapiens
gggtcaggcctcaaggtgggct

SEQ ID NO: 9257352 - DNA, 22 bp, Homo sapiens
gggtcaggcctcaaggtgggct

SEQ ID NO: 9257353 - DNA, 22 bp, Homo sapiens
gggtcagggctgcctgggctca

SEQ ID NO: 9257354 - DNA, 22 bp, Homo sapiens
gggtcaggctcagcagggcagc

SEQ ID NO: 9257355 - DNA, 22 bp, Homo sapiens
gggtcaggctcagcagggcagc

SEQ ID NO: 9257356 - DNA, 22 bp, Homo sapiens
ggtcagccttggatttggtagc

SEQ ID NO: 9257357 - DNA, 22 bp, Homo sapiens
ggtcagccttggatttggtagc

SEQ ID NO: 9257358 - DNA, 22 bp, Homo sapiens
ggtcagcccctgctcaaggccg

SEQ ID NO: 9257359 - DNA, 22 bp, Homo sapiens
ggtcagccttggatttggtagc

SEQ ID NO: 9257360 - DNA, 22 bp, Homo sapiens
ggtcaggatccaagtctgtgct

SEQ ID NO: 9257361 - DNA, 22 bp, Homo sapiens
ggtcaggatccaagtctgtgct

SEQ ID NO: 9257362 - DNA, 21 bp, Homo sapiens
ggtcaggcatgtgccctgagc

SEQ ID NO: 9257363 - DNA, 22 bp, Homo sapiens
ggtcaggagcccttggccccct

SEQ ID NO: 9257364 - DNA, 22 bp, Homo sapiens
ggtcagcccctgctcaaggccg

SEQ ID NO: 9257365 - DNA, 22 bp, Homo sapiens
ggtagggatgggatttggaagt

SEQ ID NO: 9257366 - DNA, 21 bp, Homo sapiens
ggtagggaaggttcgctggtg

SEQ ID NO: 9257367 - DNA, 22 bp, Homo sapiens
ggtagggaaggtctcccacatt

SEQ ID NO: 9257368 - DNA, 22 bp, Homo sapiens
ggtagggaaggctctgcgggga

SEQ ID NO: 9257369 - DNA, 22 bp, Homo sapiens
ggtagcatctttggatgttatt

SEQ ID NO: 9257370 - DNA, 22 bp, Homo sapiens
ggtagcagggctgtgagtcaga

SEQ ID NO: 9257371 - DNA, 20 bp, Homo sapiens
ggtagcagctgctgtcatcc

SEQ ID NO: 9257372 - DNA, 22 bp, Homo sapiens
ggtagactgagctccttgagga

SEQ ID NO: 9257373 - DNA, 22 bp, Homo sapiens
ggtagcaagcgcttgccctgcg

SEQ ID NO: 9257374 - DNA, 22 bp, Homo sapiens
ggtagcgttatcaatttgagtg

SEQ ID NO: 9257375 - DNA, 20 bp, Homo sapiens
ggtagctgctgcagttggta

SEQ ID NO: 9257376 - DNA, 22 bp, Homo sapiens
ggtaggagtattttgcagcagt

SEQ ID NO: 9257377 - DNA, 22 bp, Homo sapiens
ggtaggagtgaagacttaagat

SEQ ID NO: 9257378 - DNA, 22 bp, Homo sapiens
ggtaggcagatcactgtctatg

SEQ ID NO: 9257379 - DNA, 22 bp, Homo sapiens
ggtaggcactggtgggaagaga

SEQ ID NO: 9257380 - DNA, 22 bp, Homo sapiens
ggtcagggggatctgtgaggta

SEQ ID NO: 9257381 - DNA, 22 bp, Homo sapiens
ggtcagggggatctgtgaggta

SEQ ID NO: 9257382 - DNA, 18 bp, Homo sapiens
ggtcaggggcggagagaa

SEQ ID NO: 9257383 - DNA, 18 bp, Homo sapiens
ggtcaggggcggagagaa

SEQ ID NO: 9257384 - DNA, 22 bp, Homo sapiens
ggtcagggctcttccagtggct

SEQ ID NO: 9257385 - DNA, 22 bp, Homo sapiens
ggtcagggctcttccagtggct

SEQ ID NO: 9257386 - DNA, 22 bp, Homo sapiens
ggtccaggatcaaggcatcacc

SEQ ID NO: 9257387 - DNA, 22 bp, Homo sapiens
ggtgcagtggtgtggcaaaggg

SEQ ID NO: 9257388 - DNA, 20 bp, Homo sapiens
ggtgcaggtaacgctgtgct

SEQ ID NO: 9257389 - DNA, 20 bp, Homo sapiens
ggtgcaggtaacgctgtgct

SEQ ID NO: 9257390 - DNA, 22 bp, Homo sapiens
ggtgaataagctgaacacttgg

SEQ ID NO: 9257391 - DNA, 22 bp, Homo sapiens
ggtgaagggccttaggagacag

SEQ ID NO: 9257392 - DNA, 22 bp, Homo sapiens
ggtgaaggcacaagagggcaag

SEQ ID NO: 9257393 - DNA, 22 bp, Homo sapiens
ggtgaagggccttaggagacag

SEQ ID NO: 9257394 - DNA, 22 bp, Homo sapiens
ggtgaaggcacaagagggcaag

SEQ ID NO: 9257395 - DNA, 22 bp, Homo sapiens
ggtgaaggcacaagagggcaag

SEQ ID NO: 9257396 - DNA, 22 bp, Homo sapiens
ggtgaaggtcagagcaggaaaa

SEQ ID NO: 9257397 - DNA, 22 bp, Homo sapiens
ggtgaagggtgtcatggcattt

SEQ ID NO: 9257398 - DNA, 22 bp, Homo sapiens
ggtgaaggtggaacgcagagca

SEQ ID NO: 9257399 - DNA, 22 bp, Homo sapiens
ggtgaaggtggaacgcagagca

SEQ ID NO: 9257400 - DNA, 22 bp, Homo sapiens
ggtctgtgctctggagcctctg

SEQ ID NO: 9257401 - DNA, 22 bp, Homo sapiens
ggtcccagaattggttagcaca

SEQ ID NO: 9257402 - DNA, 22 bp, Homo sapiens
ggtccatgataggaagttccga

SEQ ID NO: 9257403 - DNA, 22 bp, Homo sapiens
ggtgaaatatttttgatatgtt

SEQ ID NO: 9257404 - DNA, 22 bp, Homo sapiens
ggtgaaatatttttgatatgtt

SEQ ID NO: 9257405 - DNA, 22 bp, Homo sapiens
ggtgaaattccttgtggaaagt

SEQ ID NO: 9257406 - DNA, 22 bp, Homo sapiens
ggtgaaatgtagtcttgtgaga

SEQ ID NO: 9257407 - DNA, 22 bp, Homo sapiens
ggtgaaattccttgtggaaagt

SEQ ID NO: 9257408 - DNA, 22 bp, Homo sapiens
ggtgccagtgggtctcaggata

SEQ ID NO: 9257409 - DNA, 22 bp, Homo sapiens
ggtgccaggctgtagtcagggt

SEQ ID NO: 9257410 - DNA, 22 bp, Homo sapiens
ggtgccaggctcccagctcagg

SEQ ID NO: 9257411 - DNA, 22 bp, Homo sapiens
ggtgccagcctagtgcagtggt

SEQ ID NO: 9257412 - DNA, 22 bp, Homo sapiens
ggtgccagcctagtgcagtggt

SEQ ID NO: 9257413 - DNA, 20 bp, Homo sapiens
ggtgcgaggccagagcagac

SEQ ID NO: 9257414 - DNA, 22 bp, Homo sapiens
ggtgctcaagagggcatcctct

SEQ ID NO: 9257415 - DNA, 22 bp, Homo sapiens
ggtgcccagagccaggaatgag

SEQ ID NO: 9257416 - DNA, 22 bp, Homo sapiens
ggtgggagagctctgtctccag

SEQ ID NO: 9257417 - DNA, 22 bp, Homo sapiens
ggtgggagagctctgtctccag

SEQ ID NO: 9257418 - DNA, 22 bp, Homo sapiens
ggtgggaggcaggctgctccca

SEQ ID NO: 9257419 - DNA, 22 bp, Homo sapiens
ggtgggaggcaggctgctccca

SEQ ID NO: 9257420 - DNA, 22 bp, Homo sapiens
ggtgggagggctgcgttcctct

SEQ ID NO: 9257421 - DNA, 16 bp, Homo sapiens
ggtgggaggtgaggtg

SEQ ID NO: 9257422 - DNA, 22 bp, Homo sapiens
ggtgggagggctgcgttcctct

SEQ ID NO: 9257423 - DNA, 16 bp, Homo sapiens
ggtgggaggtgaggtg

SEQ ID NO: 9257424 - DNA, 22 bp, Homo sapiens
ggtgggatgcctctggagaagt

SEQ ID NO: 9257425 - DNA, 22 bp, Homo sapiens
ggtgggatgcctctggagaagt

SEQ ID NO: 9257426 - DNA, 22 bp, Homo sapiens
ggtgggatgcctctggagaagt

SEQ ID NO: 9257427 - DNA, 21 bp, Homo sapiens
ggtgggcacaggagagcagag

SEQ ID NO: 9257428 - DNA, 21 bp, Homo sapiens
ggtgggcacaggagagcagag

SEQ ID NO: 9257429 - DNA, 22 bp, Homo sapiens
ggtgggcaacatttggcctgag

SEQ ID NO: 9257430 - DNA, 22 bp, Homo sapiens
ggtgggcaacatttggcctgag

SEQ ID NO: 9257431 - DNA, 22 bp, Homo sapiens
ggtgggcaacatttggcctgag

SEQ ID NO: 9257432 - DNA, 22 bp, Homo sapiens
gggtcagcgatttcaggggcag

SEQ ID NO: 9257433 - DNA, 22 bp, Homo sapiens
gggtcagctgctgggggctgac

SEQ ID NO: 9257434 - DNA, 22 bp, Homo sapiens
gggtcaaatgataattgcttct

SEQ ID NO: 9257435 - DNA, 22 bp, Homo sapiens
gggggcgggagacagcagtgac

SEQ ID NO: 9257436 - DNA, 21 bp, Homo sapiens
gggtataaaatggtatctcat

SEQ ID NO: 9257437 - DNA, 22 bp, Homo sapiens
gggtatgagatataggtgaata

SEQ ID NO: 9257438 - DNA, 22 bp, Homo sapiens
gggtatgatagggaggtgaaat

SEQ ID NO: 9257439 - DNA, 22 bp, Homo sapiens
gggggccatcttcaaggatgtg

SEQ ID NO: 9257440 - DNA, 22 bp, Homo sapiens
gggggccttgttagtggatgga

SEQ ID NO: 9257441 - DNA, 22 bp, Homo sapiens
gggggccttattcatctgccag

SEQ ID NO: 9257442 - DNA, 22 bp, Homo sapiens
gggggccttgttagtggatgga

SEQ ID NO: 9257443 - DNA, 22 bp, Homo sapiens
gggggagagacgagcggctctg

SEQ ID NO: 9257444 - DNA, 22 bp, Homo sapiens
gggggagctacaggtcccttgg

SEQ ID NO: 9257445 - DNA, 22 bp, Homo sapiens
gggggcagtaaggatatggaaa

SEQ ID NO: 9257446 - DNA, 22 bp, Homo sapiens
gggggccagtcatctcccaaga

SEQ ID NO: 9257447 - DNA, 20 bp, Homo sapiens
gggggccagcagcagacgcc

SEQ ID NO: 9257448 - DNA, 22 bp, Homo sapiens
ggggcaggaggtgttctctttt

SEQ ID NO: 9257449 - DNA, 22 bp, Homo sapiens
ggggcttttgcacgtgggaggc

SEQ ID NO: 9257450 - DNA, 22 bp, Homo sapiens
ggggcagctcccgagggcagga

SEQ ID NO: 9257451 - DNA, 22 bp, Homo sapiens
ggggcaggagcccttcttcagc

SEQ ID NO: 9257452 - DNA, 22 bp, Homo sapiens
ggggcaggagcccttcttcagc

SEQ ID NO: 9257453 - DNA, 22 bp, Homo sapiens
ggggcaggagcccttcttcagc

SEQ ID NO: 9257454 - DNA, 22 bp, Homo sapiens
gggggaagactgggctagtgat

SEQ ID NO: 9257455 - DNA, 22 bp, Homo sapiens
gggggaagactgggctagtgat

SEQ ID NO: 9257456 - DNA, 22 bp, Homo sapiens
gggggaagactgggctagtgat

SEQ ID NO: 9257457 - DNA, 22 bp, Homo sapiens
gggggaagaaagaacatggcat

SEQ ID NO: 9257458 - DNA, 22 bp, Homo sapiens
gggggaagaaagaacatggcat

SEQ ID NO: 9257459 - DNA, 22 bp, Homo sapiens
gggggactaactggatcctgga

SEQ ID NO: 9257460 - DNA, 22 bp, Homo sapiens
gggggaagtaattataaaccaa

SEQ ID NO: 9257461 - DNA, 22 bp, Homo sapiens
gggggaagaggcatgaagtcct

SEQ ID NO: 9257462 - DNA, 21 bp, Homo sapiens
gggggaagaggagttgctagt

SEQ ID NO: 9257463 - DNA, 22 bp, Homo sapiens
gggctgggaatggctaagtatg

SEQ ID NO: 9257464 - DNA, 22 bp, Homo sapiens
gggctgggaatggctaagtatg

SEQ ID NO: 9257465 - DNA, 22 bp, Homo sapiens
gggctgggatggcttgaagatt

SEQ ID NO: 9257466 - DNA, 22 bp, Homo sapiens
gggctgggatggcttgaagatt

SEQ ID NO: 9257467 - DNA, 22 bp, Homo sapiens
gggctgggatggcttgaagatt

SEQ ID NO: 9257468 - DNA, 22 bp, Homo sapiens
gggctgggattgcttgctgtga

SEQ ID NO: 9257469 - DNA, 22 bp, Homo sapiens
gggctgggaatggctaagtatg

SEQ ID NO: 9257470 - DNA, 22 bp, Homo sapiens
gggctggctctgtctagaaagg

SEQ ID NO: 9257471 - DNA, 22 bp, Homo sapiens
gggctgggcatggtgttccctc

SEQ ID NO: 9257472 - DNA, 22 bp, Homo sapiens
gggctggggctcaataatttgt

SEQ ID NO: 9257473 - DNA, 16 bp, Homo sapiens
gggctgggggattctg

SEQ ID NO: 9257474 - DNA, 22 bp, Homo sapiens
gggctggggctcaataatttgt

SEQ ID NO: 9257475 - DNA, 22 bp, Homo sapiens
gggctgggattgcttgctgtga

SEQ ID NO: 9257476 - DNA, 22 bp, Homo sapiens
gggctgggcatggtgttccctc

SEQ ID NO: 9257477 - DNA, 22 bp, Homo sapiens
ggggatggaggcgtgtggtcct

SEQ ID NO: 9257478 - DNA, 22 bp, Homo sapiens
ggggatggaggcgtgtggtcct

SEQ ID NO: 9257479 - DNA, 22 bp, Homo sapiens
ggggatggaggcgtgtggtcct

SEQ ID NO: 9257480 - DNA, 22 bp, Homo sapiens
ggggatggaggcgtgtggtcct

SEQ ID NO: 9257481 - DNA, 22 bp, Homo sapiens
ggggatggaatgtagtagtgat

SEQ ID NO: 9257482 - DNA, 22 bp, Homo sapiens
ggggatggaatgtagtagtgat

SEQ ID NO: 9257483 - DNA, 22 bp, Homo sapiens
ggggatggaatgtagtagtgat

SEQ ID NO: 9257484 - DNA, 22 bp, Homo sapiens
ggggatggaatgtagtagtgat

SEQ ID NO: 9257485 - DNA, 22 bp, Homo sapiens
ggggatggattccgggtccctg

SEQ ID NO: 9257486 - DNA, 22 bp, Homo sapiens
ggggatggattccgggtccctg

SEQ ID NO: 9257487 - DNA, 22 bp, Homo sapiens
ggggatggtagaccggtgacgt

SEQ ID NO: 9257488 - DNA, 22 bp, Homo sapiens
ggggatggtagaccggtgacgt

SEQ ID NO: 9257489 - DNA, 22 bp, Homo sapiens
ggggatggtgggaaggcaatct

SEQ ID NO: 9257490 - DNA, 22 bp, Homo sapiens
ggggcagaaagcccacagagtg

SEQ ID NO: 9257491 - DNA, 22 bp, Homo sapiens
ggggcagctcccgagggcagga

SEQ ID NO: 9257492 - DNA, 22 bp, Homo sapiens
ggggcagctcccgagggcagga

SEQ ID NO: 9257493 - DNA, 22 bp, Homo sapiens
ggggatggtgggaaggcaatct

SEQ ID NO: 9257494 - DNA, 22 bp, Homo sapiens
ggggatggtggcatttgtaaaa

SEQ ID NO: 9257495 - DNA, 22 bp, Homo sapiens
ggggcacctcctcttggcaatt

SEQ ID NO: 9257496 - DNA, 22 bp, Homo sapiens
ggggcacttccaggctgaggct

SEQ ID NO: 9257497 - DNA, 22 bp, Homo sapiens
gggctggctcccaggtgttgaa

SEQ ID NO: 9257498 - DNA, 22 bp, Homo sapiens
gggctcctgcctcctggcacct

SEQ ID NO: 9257499 - DNA, 20 bp, Homo sapiens
gggctccagctgtgattctt

SEQ ID NO: 9257500 - DNA, 22 bp, Homo sapiens
gggctccaggcaggcaggaaat

SEQ ID NO: 9257501 - DNA, 23 bp, Homo sapiens
gggctccagtctctgctcagttg

SEQ ID NO: 9257502 - DNA, 22 bp, Homo sapiens
gggctccagggcccgagtcgtc

SEQ ID NO: 9257503 - DNA, 22 bp, Homo sapiens
gggctccagttgtccccaggat

SEQ ID NO: 9257504 - DNA, 23 bp, Homo sapiens
gggctccagtctctgctcagttg

SEQ ID NO: 9257505 - DNA, 22 bp, Homo sapiens
gggctccagtttggccaggaag

SEQ ID NO: 9257506 - DNA, 22 bp, Homo sapiens
gggctccagtttggccaggaag

SEQ ID NO: 9257507 - DNA, 22 bp, Homo sapiens
gggctccacgcacgcgagaggt

SEQ ID NO: 9257508 - DNA, 22 bp, Homo sapiens
gggctccacagcagtgagtgga

SEQ ID NO: 9257509 - DNA, 22 bp, Homo sapiens
gggctccacagcagtgagtgga

SEQ ID NO: 9257510 - DNA, 22 bp, Homo sapiens
gggctccacagcagtgagtgga

SEQ ID NO: 9257511 - DNA, 22 bp, Homo sapiens
gggctccacgcacgcgagaggt

SEQ ID NO: 9257512 - DNA, 21 bp, Homo sapiens
gggctccagagatgtagcttc

SEQ ID NO: 9257513 - DNA, 22 bp, Homo sapiens
gggctccagccaggtgtcccca

SEQ ID NO: 9257514 - DNA, 22 bp, Homo sapiens
gggctccagcagaggcagccgg

SEQ ID NO: 9257515 - DNA, 21 bp, Homo sapiens
gggcctggctgcgcaggacgg

SEQ ID NO: 9257516 - DNA, 21 bp, Homo sapiens
gggcctggctgcgcaggacgg

SEQ ID NO: 9257517 - DNA, 22 bp, Homo sapiens
gggcctgggaacttgcatttag

SEQ ID NO: 9257518 - DNA, 22 bp, Homo sapiens
gggcctggggacaccaccatga

SEQ ID NO: 9257519 - DNA, 22 bp, Homo sapiens
gggcctgggaacttgcatttag

SEQ ID NO: 9257520 - DNA, 22 bp, Homo sapiens
gggcctggggacaccaccatga

SEQ ID NO: 9257521 - DNA, 22 bp, Homo sapiens
gggcctggggtgacgtacccct

SEQ ID NO: 9257522 - DNA, 22 bp, Homo sapiens
gggctccaaggaggccagcctg

SEQ ID NO: 9257523 - DNA, 22 bp, Homo sapiens
gggcctggtgcttctgactcct

SEQ ID NO: 9257524 - DNA, 22 bp, Homo sapiens
gggcctgctccccatcgctgct

SEQ ID NO: 9257525 - DNA, 22 bp, Homo sapiens
gggcctggcatgcagccccgtt

SEQ ID NO: 9257526 - DNA, 22 bp, Homo sapiens
gggcctgagactgagggtgagg

SEQ ID NO: 9257527 - DNA, 22 bp, Homo sapiens
gggcctgccaggctttcagcat

SEQ ID NO: 9257528 - DNA, 22 bp, Homo sapiens
gggcctgccattgctgccccag

SEQ ID NO: 9257529 - DNA, 22 bp, Homo sapiens
gggcctgcaggttctgagaggc

SEQ ID NO: 9257530 - DNA, 22 bp, Homo sapiens
gggcctgaaaccttcagggctt

SEQ ID NO: 9257531 - DNA, 22 bp, Homo sapiens
gggcatgagagggcagctggca

SEQ ID NO: 9257532 - DNA, 22 bp, Homo sapiens
gggcatgagagggcagctggca

SEQ ID NO: 9257533 - DNA, 20 bp, Homo sapiens
gggcatctttgctcctgttt

SEQ ID NO: 9257534 - DNA, 22 bp, Homo sapiens
gggcatcttgtagccttcactt

SEQ ID NO: 9257535 - DNA, 22 bp, Homo sapiens
gggcatgacttttggagtggga

SEQ ID NO: 9257536 - DNA, 21 bp, Homo sapiens
gggcatcctttcccaccctgc

SEQ ID NO: 9257537 - DNA, 22 bp, Homo sapiens
gggcatctggtggagcctcagg

SEQ ID NO: 9257538 - DNA, 22 bp, Homo sapiens
gggcatctggtggagcctcagg

SEQ ID NO: 9257539 - DNA, 22 bp, Homo sapiens
gggcatcttctgtagccatctc

SEQ ID NO: 9257540 - DNA, 21 bp, Homo sapiens
ttttttcttgcgtgaggcctg

SEQ ID NO: 9257541 - DNA, 21 bp, Homo sapiens
ttttttcttgcgtgaggcctg

SEQ ID NO: 9257542 - DNA, 22 bp, Homo sapiens
ttttttccttcatgacttaaga

SEQ ID NO: 9257543 - DNA, 21 bp, Homo sapiens
ttttttcttgcgtgaggcctg

SEQ ID NO: 9257544 - DNA, 22 bp, Homo sapiens
ttttttgtagcaagcgcagata

SEQ ID NO: 9257545 - DNA, 22 bp, Homo sapiens
tttggctctagtaaatataacc

SEQ ID NO: 9257546 - DNA, 22 bp, Homo sapiens
tttggccttgtgttctctccat

SEQ ID NO: 9257547 - DNA, 22 bp, Homo sapiens
tttgggcaggcttttccctaga

SEQ ID NO: 9257548 - DNA, 22 bp, Homo sapiens
tttgggctggtttgccatgccc

SEQ ID NO: 9257549 - DNA, 22 bp, Homo sapiens
tttggggagacatggccagctg

SEQ ID NO: 9257550 - DNA, 22 bp, Homo sapiens
tttggggctcagcaggctgttt

SEQ ID NO: 9257551 - DNA, 22 bp, Homo sapiens
tttgtcctctccatgtacaata

SEQ ID NO: 9257552 - DNA, 22 bp, Homo sapiens
tttggtaaaatgaactagcttt

SEQ ID NO: 9257553 - DNA, 22 bp, Homo sapiens
tttggtaacagtttttggcact

SEQ ID NO: 9257554 - DNA, 22 bp, Homo sapiens
tttggtaaccttgcattcttta

SEQ ID NO: 9257555 - DNA, 22 bp, Homo sapiens
tttgtcatgtccttaactgtct

SEQ ID NO: 9257556 - DNA, 22 bp, Homo sapiens
tttgcatttgttcaagtattga

SEQ ID NO: 9257557 - DNA, 22 bp, Homo sapiens
tttgcattgcattaagtattct

SEQ ID NO: 9257558 - DNA, 22 bp, Homo sapiens
tttgcattgtaatatttagttc

SEQ ID NO: 9257559 - DNA, 22 bp, Homo sapiens
tttgcattgtaatatttagttc

SEQ ID NO: 9257560 - DNA, 22 bp, Homo sapiens
tttgcttcacaagtatggttct

SEQ ID NO: 9257561 - DNA, 22 bp, Homo sapiens
tttgcttaaagttctttctggt

SEQ ID NO: 9257562 - DNA, 22 bp, Homo sapiens
tttgctgtgaatccattactgt

SEQ ID NO: 9257563 - DNA, 22 bp, Homo sapiens
tttgctgtgggatatccatgtg

SEQ ID NO: 9257564 - DNA, 20 bp, Homo sapiens
tttgctgtgggtgtaagaat

SEQ ID NO: 9257565 - DNA, 22 bp, Homo sapiens
tttgctgagttgaagtttgagg

SEQ ID NO: 9257566 - DNA, 22 bp, Homo sapiens
tttgctgatattttgctgatac

SEQ ID NO: 9257567 - DNA, 22 bp, Homo sapiens
tttgctgagttttctcctaaga

SEQ ID NO: 9257568 - DNA, 22 bp, Homo sapiens
tttgctcttgctggaaaagttg

SEQ ID NO: 9257569 - DNA, 22 bp, Homo sapiens
tttgctgaccccattctgagtc

SEQ ID NO: 9257570 - DNA, 22 bp, Homo sapiens
tttgcattatatttatagaaga

SEQ ID NO: 9257571 - DNA, 22 bp, Homo sapiens
tttgcattacttgactttagtt

SEQ ID NO: 9257572 - DNA, 22 bp, Homo sapiens
tttgcattagtttagatttcaa

SEQ ID NO: 9257573 - DNA, 22 bp, Homo sapiens
tttgcattagtttagatttcaa

SEQ ID NO: 9257574 - DNA, 20 bp, Homo sapiens
tttgagaccagtctgcccaa

SEQ ID NO: 9257575 - DNA, 20 bp, Homo sapiens
tttgagaccagtctgcccaa

SEQ ID NO: 9257576 - DNA, 20 bp, Homo sapiens
tttgagaccagtctgcccaa

SEQ ID NO: 9257577 - DNA, 22 bp, Homo sapiens
tttgaacaagagcttcacatta

SEQ ID NO: 9257578 - DNA, 23 bp, Homo sapiens
tttgaacatttctagattacata

SEQ ID NO: 9257579 - DNA, 22 bp, Homo sapiens
tttgaacatgctgcatgataat

SEQ ID NO: 9257580 - DNA, 22 bp, Homo sapiens
tttgaacatgctgcatgataat

SEQ ID NO: 9257581 - DNA, 22 bp, Homo sapiens
tttgaagaccttatctctaaat

SEQ ID NO: 9257582 - DNA, 22 bp, Homo sapiens
tttgaagactactgggagtgaa

SEQ ID NO: 9257583 - DNA, 22 bp, Homo sapiens
tttgaagacatttgaatacttt

SEQ ID NO: 9257584 - DNA, 22 bp, Homo sapiens
tttgaagactactgggagtgaa

SEQ ID NO: 9257585 - DNA, 22 bp, Homo sapiens
tttgaagaagctgacctatttt

SEQ ID NO: 9257586 - DNA, 22 bp, Homo sapiens
tttgaagacatattgttacata

SEQ ID NO: 9257587 - DNA, 22 bp, Homo sapiens
tttgaagacagatcaatataag

SEQ ID NO: 9257588 - DNA, 22 bp, Homo sapiens
tttgacagggtgatgaggtggt

SEQ ID NO: 9257589 - DNA, 22 bp, Homo sapiens
tttgacagtgatgatatataca

SEQ ID NO: 9257590 - DNA, 22 bp, Homo sapiens
tttgacagtgatgatatataca

SEQ ID NO: 9257591 - DNA, 20 bp, Homo sapiens
tttgacatatacagttcagg

SEQ ID NO: 9257592 - DNA, 22 bp, Homo sapiens
tttgacagtgctgctaaaatgc

SEQ ID NO: 9257593 - DNA, 22 bp, Homo sapiens
tttgacagtgttggggcaggct

SEQ ID NO: 9257594 - DNA, 22 bp, Homo sapiens
tttgacattgaaagcagaatcg

SEQ ID NO: 9257595 - DNA, 22 bp, Homo sapiens
tttgacattaaggaacatatat

SEQ ID NO: 9257596 - DNA, 22 bp, Homo sapiens
tttgacattaaggaacatatat

SEQ ID NO: 9257597 - DNA, 22 bp, Homo sapiens
tttgacattaaggaacatatat

SEQ ID NO: 9257598 - DNA, 22 bp, Homo sapiens
tttgacatgtgcttataacttt

SEQ ID NO: 9257599 - DNA, 22 bp, Homo sapiens
tttctagagtgggcatgtctta

SEQ ID NO: 9257600 - DNA, 22 bp, Homo sapiens
tttctagatcaaacttttatat

SEQ ID NO: 9257601 - DNA, 22 bp, Homo sapiens
tttctagagtgggcatgtctta

SEQ ID NO: 9257602 - DNA, 22 bp, Homo sapiens
tttctagatgcggggcttgtgc

SEQ ID NO: 9257603 - DNA, 22 bp, Homo sapiens
tttctagatgcggggcttgtgc

SEQ ID NO: 9257604 - DNA, 22 bp, Homo sapiens
tttctagctgtaggaagctgag

SEQ ID NO: 9257605 - DNA, 17 bp, Homo sapiens
tttctagattatcctct

SEQ ID NO: 9257606 - DNA, 17 bp, Homo sapiens
tttctagattatcctct

SEQ ID NO: 9257607 - DNA, 22 bp, Homo sapiens
tttctagtcagccatatctagt

SEQ ID NO: 9257608 - DNA, 22 bp, Homo sapiens
tttctagtctcgatctcttaat

SEQ ID NO: 9257609 - DNA, 22 bp, Homo sapiens
tttctagtatataactagatct

SEQ ID NO: 9257610 - DNA, 22 bp, Homo sapiens
tttctagtaaaagctaattacc

SEQ ID NO: 9257611 - DNA, 22 bp, Homo sapiens
tttctagtaaaagctaattacc

SEQ ID NO: 9257612 - DNA, 22 bp, Homo sapiens
tttctagtctcgatctcttaat

SEQ ID NO: 9257613 - DNA, 22 bp, Homo sapiens
tttctagtggttaagatttaca

SEQ ID NO: 9257614 - DNA, 22 bp, Homo sapiens
tttctataactggactggattg

SEQ ID NO: 9257615 - DNA, 22 bp, Homo sapiens
tttctatatcttacctattgta

SEQ ID NO: 9257616 - DNA, 22 bp, Homo sapiens
tttctatatcttacctattgta

SEQ ID NO: 9257617 - DNA, 22 bp, Homo sapiens
tttctattgatctaataaacat

SEQ ID NO: 9257618 - DNA, 22 bp, Homo sapiens
tttctattgatctaataaacat

SEQ ID NO: 9257619 - DNA, 20 bp, Homo sapiens
tttctatggggccagcacat

SEQ ID NO: 9257620 - DNA, 22 bp, Homo sapiens
tttctatatgaggagctaaagt

SEQ ID NO: 9257621 - DNA, 22 bp, Homo sapiens
tttctatatgaggagctaaagt

SEQ ID NO: 9257622 - DNA, 21 bp, Homo sapiens
tttgaaagtgggtgattcttt

SEQ ID NO: 9257623 - DNA, 23 bp, Homo sapiens
tttgaaagtatcaactcgcctga

SEQ ID NO: 9257624 - DNA, 22 bp, Homo sapiens
tttctattggcgtcactgttgt

SEQ ID NO: 9257625 - DNA, 22 bp, Homo sapiens
tttctattggcgtcactgttgt

SEQ ID NO: 9257626 - DNA, 21 bp, Homo sapiens
tttgaaagtgggtgattcttt

SEQ ID NO: 9257627 - DNA, 22 bp, Homo sapiens
tttgaaagttcttctgacacta

SEQ ID NO: 9257628 - DNA, 22 bp, Homo sapiens
ttttattggtaatgataaaagt

SEQ ID NO: 9257629 - DNA, 22 bp, Homo sapiens
ttttattgggagtcctctactg

SEQ ID NO: 9257630 - DNA, 22 bp, Homo sapiens
ttttattggtaatgataaaagt

SEQ ID NO: 9257631 - DNA, 22 bp, Homo sapiens
ttttattggtaatgataaaagt

SEQ ID NO: 9257632 - DNA, 22 bp, Homo sapiens
ttttattggtaatgataaaagt

SEQ ID NO: 9257633 - DNA, 22 bp, Homo sapiens
ttttattggtaatgataaaagt

SEQ ID NO: 9257634 - DNA, 22 bp, Homo sapiens
ttttattggtaatgataaaagt

SEQ ID NO: 9257635 - DNA, 22 bp, Homo sapiens
ttttattgggagtcctctactg

SEQ ID NO: 9257636 - DNA, 22 bp, Homo sapiens
ttttattgggagtcctctactg

SEQ ID NO: 9257637 - DNA, 22 bp, Homo sapiens
ttttattgggagtcctctactg

SEQ ID NO: 9257638 - DNA, 22 bp, Homo sapiens
ttttattgggagtcctctactg

SEQ ID NO: 9257639 - DNA, 22 bp, Homo sapiens
ttttagaaatactgatttagtg

SEQ ID NO: 9257640 - DNA, 22 bp, Homo sapiens
ttttagaaggaatgctatggtg

SEQ ID NO: 9257641 - DNA, 22 bp, Homo sapiens
ttttactttggatacagtactt

SEQ ID NO: 9257642 - DNA, 22 bp, Homo sapiens
ttttagaaatactgatttagtg

SEQ ID NO: 9257643 - DNA, 22 bp, Homo sapiens
ttttagaaagatccctggcagg

SEQ ID NO: 9257644 - DNA, 22 bp, Homo sapiens
ttttacattgggaaatgcctct

SEQ ID NO: 9257645 - DNA, 22 bp, Homo sapiens
ttttacctgaaccacacagtat

SEQ ID NO: 9257646 - DNA, 22 bp, Homo sapiens
ttttaccactgggtgacatgga

SEQ ID NO: 9257647 - DNA, 22 bp, Homo sapiens
ttttacttcattcctgacttca

SEQ ID NO: 9257648 - DNA, 22 bp, Homo sapiens
ttttcaagggcagggaaatcat

SEQ ID NO: 9257649 - DNA, 22 bp, Homo sapiens
ttttcaattttgaggcagtggt

SEQ ID NO: 9257650 - DNA, 22 bp, Homo sapiens
ttttcaaagactggaggctgat

SEQ ID NO: 9257651 - DNA, 16 bp, Homo sapiens
ttttattgtgacagcc

SEQ ID NO: 9257652 - DNA, 16 bp, Homo sapiens
ttttattgtgacagcc

SEQ ID NO: 9257653 - DNA, 16 bp, Homo sapiens
ttttattgtgacagcc

SEQ ID NO: 9257654 - DNA, 16 bp, Homo sapiens
ttttattgtgacagcc

SEQ ID NO: 9257655 - DNA, 22 bp, Homo sapiens
ttttattgtctgtattgcctat

SEQ ID NO: 9257656 - DNA, 22 bp, Homo sapiens
ttttattgtctgtattgcctat

SEQ ID NO: 9257657 - DNA, 22 bp, Homo sapiens
ttttattgtcaatgaagacaga

SEQ ID NO: 9257658 - DNA, 22 bp, Homo sapiens
ttttattgtcaatgaagacaga

SEQ ID NO: 9257659 - DNA, 22 bp, Homo sapiens
ttttattgtcaatgaagacaga

SEQ ID NO: 9257660 - DNA, 22 bp, Homo sapiens
ttttattgtcaatgaagacaga

SEQ ID NO: 9257661 - DNA, 22 bp, Homo sapiens
ttttattgtctgtattgcctat

SEQ ID NO: 9257662 - DNA, 22 bp, Homo sapiens
ttttattgtctgtattgcctat

SEQ ID NO: 9257663 - DNA, 22 bp, Homo sapiens
ttttattgtctcccagttctgg

SEQ ID NO: 9257664 - DNA, 22 bp, Homo sapiens
ttttattgtctcccagttctgg

SEQ ID NO: 9257665 - DNA, 22 bp, Homo sapiens
ttttattgtctcccagttctgg

SEQ ID NO: 9257666 - DNA, 22 bp, Homo sapiens
ttttattgtctcccagttctgg

SEQ ID NO: 9257667 - DNA, 22 bp, Homo sapiens
ttttaattttgcaaatctggtg

SEQ ID NO: 9257668 - DNA, 22 bp, Homo sapiens
ttttaattttgcaaatctggtg

SEQ ID NO: 9257669 - DNA, 22 bp, Homo sapiens
ttttaattttagcccttctggt

SEQ ID NO: 9257670 - DNA, 23 bp, Homo sapiens
ttttaatttggacataagaagat

SEQ ID NO: 9257671 - DNA, 23 bp, Homo sapiens
ttttaatttggacataagaagat

SEQ ID NO: 9257672 - DNA, 22 bp, Homo sapiens
ttttacacctcagatgagcaga

SEQ ID NO: 9257673 - DNA, 22 bp, Homo sapiens
ttttacacctgttaactctaag

SEQ ID NO: 9257674 - DNA, 21 bp, Homo sapiens
ttttacagatgaggggaaggg

SEQ ID NO: 9257675 - DNA, 22 bp, Homo sapiens
ttttacaggtcataggtatagt

SEQ ID NO: 9257676 - DNA, 22 bp, Homo sapiens
tttgtgcaggtataggcggaga

SEQ ID NO: 9257677 - DNA, 22 bp, Homo sapiens
tttgtgcagctaagaaaatggc

SEQ ID NO: 9257678 - DNA, 22 bp, Homo sapiens
tttgtgcagtggttaagaccat

SEQ ID NO: 9257679 - DNA, 22 bp, Homo sapiens
tttgtgcaggtgtgtcagatcg

SEQ ID NO: 9257680 - DNA, 22 bp, Homo sapiens
tttgtgcaggtgtgtcagatcg

SEQ ID NO: 9257681 - DNA, 22 bp, Homo sapiens
tttgtgcattcaagtaggagcc

SEQ ID NO: 9257682 - DNA, 22 bp, Homo sapiens
tttgtgcatgggtatggccaat

SEQ ID NO: 9257683 - DNA, 22 bp, Homo sapiens
tttgtgcatgggtatggccaat

SEQ ID NO: 9257684 - DNA, 22 bp, Homo sapiens
tttgtgcataaagggctatagt

SEQ ID NO: 9257685 - DNA, 22 bp, Homo sapiens
tttgtgcataaagggctatagt

SEQ ID NO: 9257686 - DNA, 22 bp, Homo sapiens
tttgtgattaattttcaacctc

SEQ ID NO: 9257687 - DNA, 22 bp, Homo sapiens
tttgtgcaagacatgctaagag

SEQ ID NO: 9257688 - DNA, 22 bp, Homo sapiens
tttgtgcaagacatgctaagag

SEQ ID NO: 9257689 - DNA, 22 bp, Homo sapiens
tttgtgcaagagggccacctta

SEQ ID NO: 9257690 - DNA, 22 bp, Homo sapiens
tttgtgcaatttatgtactata

SEQ ID NO: 9257691 - DNA, 22 bp, Homo sapiens
tttgtgcacttctgtagctgcc

SEQ ID NO: 9257692 - DNA, 22 bp, Homo sapiens
tttgtgcagataggagacaatc

SEQ ID NO: 9257693 - DNA, 23 bp, Homo sapiens
tttgtgcagaagacaaagtggcc

SEQ ID NO: 9257694 - DNA, 22 bp, Homo sapiens
tttgtgcacattgcttttctat

SEQ ID NO: 9257695 - DNA, 22 bp, Homo sapiens
tttgtgcagatgtatatttgtg

SEQ ID NO: 9257696 - DNA, 19 bp, Homo sapiens
tttgtgcagcaacattaat

SEQ ID NO: 9257697 - DNA, 22 bp, Homo sapiens
tttgtgcagatgtatatttgtg

SEQ ID NO: 9257698 - DNA, 22 bp, Homo sapiens
tttgtcttatccaatctctcag

SEQ ID NO: 9257699 - DNA, 22 bp, Homo sapiens
tttgtcttccccctttaatcag

SEQ ID NO: 9257700 - DNA, 22 bp, Homo sapiens
tttgtcttaaatcttgttactg

SEQ ID NO: 9257701 - DNA, 19 bp, Homo sapiens
tttgtctctgaataatatt

SEQ ID NO: 9257702 - DNA, 20 bp, Homo sapiens
tttgtctgttaagtgtttct

SEQ ID NO: 9257703 - DNA, 22 bp, Homo sapiens
tttgtccttgaatcaattcaca

SEQ ID NO: 9257704 - DNA, 22 bp, Homo sapiens
ttttgtctaagaactttgcaaa

SEQ ID NO: 9257705 - DNA, 22 bp, Homo sapiens
ttttgtctaagaactttgcaaa

SEQ ID NO: 9257706 - DNA, 22 bp, Homo sapiens
ttttgtctaagaactttgcaaa

SEQ ID NO: 9257707 - DNA, 19 bp, Homo sapiens
ttttgtcttcccttagttt

SEQ ID NO: 9257708 - DNA, 22 bp, Homo sapiens
ttttgtgacagaaagattaagt

SEQ ID NO: 9257709 - DNA, 22 bp, Homo sapiens
ttttgtgagatgcgtatgaatg

SEQ ID NO: 9257710 - DNA, 22 bp, Homo sapiens
ttttgtgaatagtttatctaag

SEQ ID NO: 9257711 - DNA, 22 bp, Homo sapiens
ttttgtaatttcctgacgacta

SEQ ID NO: 9257712 - DNA, 22 bp, Homo sapiens
ttttgtaagaaactgccaagcc

SEQ ID NO: 9257713 - DNA, 22 bp, Homo sapiens
ttttgtgttgtaatgtcagcta

SEQ ID NO: 9257714 - DNA, 22 bp, Homo sapiens
ttttgtgttgccatgttaagca

SEQ ID NO: 9257715 - DNA, 17 bp, Homo sapiens
ttttgttcatcttcaaa

SEQ ID NO: 9257716 - DNA, 17 bp, Homo sapiens
ttttgttcatcttcaaa

SEQ ID NO: 9257717 - DNA, 22 bp, Homo sapiens
ttttgtgttgccatgttaagca

SEQ ID NO: 9257718 - DNA, 22 bp, Homo sapiens
ttttgtgttgccatgttaagca

SEQ ID NO: 9257719 - DNA, 22 bp, Homo sapiens
ttttgtgtccttcacatcatgt

SEQ ID NO: 9257720 - DNA, 22 bp, Homo sapiens
ttttgtgtccttcacatcatgt

SEQ ID NO: 9257721 - DNA, 22 bp, Homo sapiens
ttttgtgagcccataaatgcca

SEQ ID NO: 9257722 - DNA, 19 bp, Homo sapiens
ttttgtgtagctgctggtt

SEQ ID NO: 9257723 - DNA, 22 bp, Homo sapiens
ttttgtgagctgagaaatgtat

SEQ ID NO: 9257724 - DNA, 22 bp, Homo sapiens
tttttgtgaaatctccagacat

SEQ ID NO: 9257725 - DNA, 22 bp, Homo sapiens
tttttgtctattcactgattca

SEQ ID NO: 9257726 - DNA, 22 bp, Homo sapiens
tttttgtggtgcagactaaagc

SEQ ID NO: 9257727 - DNA, 22 bp, Homo sapiens
tttttgtggtgtgagtggacat

SEQ ID NO: 9257728 - DNA, 22 bp, Homo sapiens
tttttgtgtatcctgctccatg

SEQ ID NO: 9257729 - DNA, 22 bp, Homo sapiens
tttttgtggtatattgcaacaa

SEQ ID NO: 9257730 - DNA, 22 bp, Homo sapiens
tttttgtgatatgacactgtat

SEQ ID NO: 9257731 - DNA, 22 bp, Homo sapiens
tttttgttctgattatactggt

SEQ ID NO: 9257732 - DNA, 22 bp, Homo sapiens
tttttgttctgattatactggt

SEQ ID NO: 9257733 - DNA, 22 bp, Homo sapiens
ttttttacagaatcattaatca

SEQ ID NO: 9257734 - DNA, 22 bp, Homo sapiens
ttttttacagaatcattaatca

SEQ ID NO: 9257735 - DNA, 22 bp, Homo sapiens
tttttgttgcagagaggccact

SEQ ID NO: 9257736 - DNA, 22 bp, Homo sapiens
tttttgttcccagagaatttgt

SEQ ID NO: 9257737 - DNA, 22 bp, Homo sapiens
tttttgtgtgagcagggtgtta

SEQ ID NO: 9257738 - DNA, 22 bp, Homo sapiens
ttttttatatcaactgaagtct

SEQ ID NO: 9257739 - DNA, 22 bp, Homo sapiens
ttttttatatcaactgaagtct

SEQ ID NO: 9257740 - DNA, 22 bp, Homo sapiens
ttttttatatcaactgaagtct

SEQ ID NO: 9257741 - DNA, 22 bp, Homo sapiens
ttttttatatcaactgaagtct

SEQ ID NO: 9257742 - DNA, 22 bp, Homo sapiens
ttttttatagcaatgaacccac

SEQ ID NO: 9257743 - DNA, 22 bp, Homo sapiens
ttttttatctatggtagtacca

SEQ ID NO: 9257744 - DNA, 22 bp, Homo sapiens
ttttttatctatggtagtacca

SEQ ID NO: 9257745 - DNA, 22 bp, Homo sapiens
ttttttccagcttctagaggcc

SEQ ID NO: 9257746 - DNA, 22 bp, Homo sapiens
ttttcctagtaggcctattaga

SEQ ID NO: 9257747 - DNA, 22 bp, Homo sapiens
ttttcctactgataaacagtta

SEQ ID NO: 9257748 - DNA, 22 bp, Homo sapiens
ttttcctatatgcaaagaatgc

SEQ ID NO: 9257749 - DNA, 19 bp, Homo sapiens
ttttcccaccctttagaat

SEQ ID NO: 9257750 - DNA, 22 bp, Homo sapiens
ttttccttcacctcttgagcct

SEQ ID NO: 9257751 - DNA, 22 bp, Homo sapiens
ttttccttcacctcttgagcct

SEQ ID NO: 9257752 - DNA, 22 bp, Homo sapiens
ttttccttcatatcccttatgt

SEQ ID NO: 9257753 - DNA, 22 bp, Homo sapiens
ttttccttagcttctctgcgag

SEQ ID NO: 9257754 - DNA, 22 bp, Homo sapiens
ttttccttaacagagggagaaa

SEQ ID NO: 9257755 - DNA, 22 bp, Homo sapiens
ttttcctctgagctttgaataa

SEQ ID NO: 9257756 - DNA, 22 bp, Homo sapiens
ttttcctctgtatgcgtgagat

SEQ ID NO: 9257757 - DNA, 22 bp, Homo sapiens
ttttcctctgagctttgaataa

SEQ ID NO: 9257758 - DNA, 22 bp, Homo sapiens
ttttcctctgcagagcagttag

SEQ ID NO: 9257759 - DNA, 21 bp, Homo sapiens
ttttggtcctggcttaggagc

SEQ ID NO: 9257760 - DNA, 19 bp, Homo sapiens
ttttccttctatatgtttc

SEQ ID NO: 9257761 - DNA, 22 bp, Homo sapiens
ttttggggagaacggttgctat

SEQ ID NO: 9257762 - DNA, 22 bp, Homo sapiens
ttttgggtggaagctgttatgg

SEQ ID NO: 9257763 - DNA, 18 bp, Homo sapiens
ttttccttccaccttgaa

SEQ ID NO: 9257764 - DNA, 19 bp, Homo sapiens
ttttccttctatatgtttc

SEQ ID NO: 9257765 - DNA, 22 bp, Homo sapiens
ttttccttctagagcagatttc

SEQ ID NO: 9257766 - DNA, 22 bp, Homo sapiens
ttgtttaaaagaaatcatagaa

SEQ ID NO: 9257767 - DNA, 22 bp, Homo sapiens
ttgtttaaaagaaatcatagaa

SEQ ID NO: 9257768 - DNA, 22 bp, Homo sapiens
ttgttgctgctcaacctctata

SEQ ID NO: 9257769 - DNA, 22 bp, Homo sapiens
ttgttgctcttgttgccacatg

SEQ ID NO: 9257770 - DNA, 22 bp, Homo sapiens
ttgttggtgaatagggtggaat

SEQ ID NO: 9257771 - DNA, 22 bp, Homo sapiens
ttgttcttccatcatccctcag

SEQ ID NO: 9257772 - DNA, 23 bp, Homo sapiens
ttgttcttggatcttcctgaagc

SEQ ID NO: 9257773 - DNA, 22 bp, Homo sapiens
ttgttctttatcctggaagcct

SEQ ID NO: 9257774 - DNA, 22 bp, Homo sapiens
ttgttcttgtctttgccttcac

SEQ ID NO: 9257775 - DNA, 22 bp, Homo sapiens
tttaaattatagttaatgtctg

SEQ ID NO: 9257776 - DNA, 22 bp, Homo sapiens
tttaacatgttcaagaaacata

SEQ ID NO: 9257777 - DNA, 22 bp, Homo sapiens
tttaacatgttcaagaaacata

SEQ ID NO: 9257778 - DNA, 22 bp, Homo sapiens
tttaacatgtgaattttggaag

SEQ ID NO: 9257779 - DNA, 22 bp, Homo sapiens
tttaacatgtgaattttggaag

SEQ ID NO: 9257780 - DNA, 22 bp, Homo sapiens
tttaacttagaagagatatcct

SEQ ID NO: 9257781 - DNA, 22 bp, Homo sapiens
tttaagaagttatgttataaat

SEQ ID NO: 9257782 - DNA, 22 bp, Homo sapiens
tttaacatgttcaagaaacata

SEQ ID NO: 9257783 - DNA, 22 bp, Homo sapiens
tttaaccagaaaggtactcatc

SEQ ID NO: 9257784 - DNA, 22 bp, Homo sapiens
tttacagagaatgtacataaag

SEQ ID NO: 9257785 - DNA, 22 bp, Homo sapiens
tttacagagaatgtacataaag

SEQ ID NO: 9257786 - DNA, 22 bp, Homo sapiens
tttacagaatgttgaatttggg

SEQ ID NO: 9257787 - DNA, 22 bp, Homo sapiens
tttacagatgaggaaactgaga

SEQ ID NO: 9257788 - DNA, 22 bp, Homo sapiens
tttacagatgtggaaagtgagc

SEQ ID NO: 9257789 - DNA, 22 bp, Homo sapiens
tttacacattattttcagtgtg

SEQ ID NO: 9257790 - DNA, 22 bp, Homo sapiens
tttacaccattagaagctactt

SEQ ID NO: 9257791 - DNA, 22 bp, Homo sapiens
tttacactcctggaaatgatat

SEQ ID NO: 9257792 - DNA, 22 bp, Homo sapiens
tttacactgtgaaacaggtatc

SEQ ID NO: 9257793 - DNA, 22 bp, Homo sapiens
tttacactgacagcacataagg

SEQ ID NO: 9257794 - DNA, 22 bp, Homo sapiens
tttacactgacagcacataagg

SEQ ID NO: 9257795 - DNA, 19 bp, Homo sapiens
tttacaagttctttgtatg

SEQ ID NO: 9257796 - DNA, 22 bp, Homo sapiens
tttacaagtcagggactgttct

SEQ ID NO: 9257797 - DNA, 22 bp, Homo sapiens
tttacaagtcagggactgttct

SEQ ID NO: 9257798 - DNA, 22 bp, Homo sapiens
tttacaagtctgttgatcccaa

SEQ ID NO: 9257799 - DNA, 22 bp, Homo sapiens
tttacaagtttacagaatgatg

SEQ ID NO: 9257800 - DNA, 22 bp, Homo sapiens
tttacacattattttcagtgtg

SEQ ID NO: 9257801 - DNA, 22 bp, Homo sapiens
tttaagacttaggaaagaggat

SEQ ID NO: 9257802 - DNA, 22 bp, Homo sapiens
tttaagagcatttgcaatttat

SEQ ID NO: 9257803 - DNA, 22 bp, Homo sapiens
tttaagacttagatttattggg

SEQ ID NO: 9257804 - DNA, 22 bp, Homo sapiens
tttaagactcttgtagtacaca

SEQ ID NO: 9257805 - DNA, 22 bp, Homo sapiens
tttaagacccacagggaagttg

SEQ ID NO: 9257806 - DNA, 22 bp, Homo sapiens
tttaagacagtgcaagctgaat

SEQ ID NO: 9257807 - DNA, 22 bp, Homo sapiens
tttaagaagttatgttataaat

SEQ ID NO: 9257808 - DNA, 22 bp, Homo sapiens
tttaagatcatttgtattatcc

SEQ ID NO: 9257809 - DNA, 22 bp, Homo sapiens
tttaagatcatttgtattatcc

SEQ ID NO: 9257810 - DNA, 22 bp, Homo sapiens
tttaagagctagtatgtcattt

SEQ ID NO: 9257811 - DNA, 22 bp, Homo sapiens
tttaagagttaaactttgacct

SEQ ID NO: 9257812 - DNA, 22 bp, Homo sapiens
tttaagagcctgtacaaatatt

SEQ ID NO: 9257813 - DNA, 22 bp, Homo sapiens
tttaagagctagtatgtcattt

SEQ ID NO: 9257814 - DNA, 22 bp, Homo sapiens
tttatctttggatcttcagaaa

SEQ ID NO: 9257815 - DNA, 22 bp, Homo sapiens
tttatctttaggactttgcaga

SEQ ID NO: 9257816 - DNA, 22 bp, Homo sapiens
tttatgacaagcattactgatt

SEQ ID NO: 9257817 - DNA, 22 bp, Homo sapiens
tttatgaactacagatataact

SEQ ID NO: 9257818 - DNA, 22 bp, Homo sapiens
tttatgaactacagatataact

SEQ ID NO: 9257819 - DNA, 21 bp, Homo sapiens
tttatgtacttcatagagtag

SEQ ID NO: 9257820 - DNA, 22 bp, Homo sapiens
tttatgacttctaatctgaagc

SEQ ID NO: 9257821 - DNA, 22 bp, Homo sapiens
tttatgacattacaatatcaag

SEQ ID NO: 9257822 - DNA, 22 bp, Homo sapiens
tttatgacccaagaagatacca

SEQ ID NO: 9257823 - DNA, 22 bp, Homo sapiens
tttattgccctgtagtacagga

SEQ ID NO: 9257824 - DNA, 22 bp, Homo sapiens
tttattgccctgtagtacagga

SEQ ID NO: 9257825 - DNA, 22 bp, Homo sapiens
tttattgcatacacaaatgtca

SEQ ID NO: 9257826 - DNA, 22 bp, Homo sapiens
tttatgtttgacaatgatctgg

SEQ ID NO: 9257827 - DNA, 22 bp, Homo sapiens
tttatgtttgacaatgatctgg

SEQ ID NO: 9257828 - DNA, 22 bp, Homo sapiens
tttatgttcctcttgagctttc

SEQ ID NO: 9257829 - DNA, 22 bp, Homo sapiens
tttatgtttgacaatgatctgg

SEQ ID NO: 9257830 - DNA, 21 bp, Homo sapiens
tttatgtacttcatagagtag

SEQ ID NO: 9257831 - DNA, 22 bp, Homo sapiens
tttattgtcttcgtggtgccta

SEQ ID NO: 9257832 - DNA, 22 bp, Homo sapiens
tttattgtcttcgtggtgccta

SEQ ID NO: 9257833 - DNA, 22 bp, Homo sapiens
tttattgtgttgaaactgaatt

SEQ ID NO: 9257834 - DNA, 22 bp, Homo sapiens
tttattgtcaatctattcccag

SEQ ID NO: 9257835 - DNA, 22 bp, Homo sapiens
tttattgtctatgaactgcttg

SEQ ID NO: 9257836 - DNA, 22 bp, Homo sapiens
tttattgtctatgaactgcttg

SEQ ID NO: 9257837 - DNA, 22 bp, Homo sapiens
tttattgctgagaaggattcca

SEQ ID NO: 9257838 - DNA, 22 bp, Homo sapiens
tttattgctggccacctgtagc

SEQ ID NO: 9257839 - DNA, 22 bp, Homo sapiens
tttattgccctgtagtacagga

SEQ ID NO: 9257840 - DNA, 22 bp, Homo sapiens
tttattgctagcccttggtcca

SEQ ID NO: 9257841 - DNA, 22 bp, Homo sapiens
tttattgctcagcagttagttg

SEQ ID NO: 9257842 - DNA, 22 bp, Homo sapiens
tttattgctgtgttagggacag

SEQ ID NO: 9257843 - DNA, 22 bp, Homo sapiens
tttatctttaggactttgcaga

SEQ ID NO: 9257844 - DNA, 22 bp, Homo sapiens
tttatctgttgtacatttatgc

SEQ ID NO: 9257845 - DNA, 22 bp, Homo sapiens
tttatctgttgtacctgcattg

SEQ ID NO: 9257846 - DNA, 22 bp, Homo sapiens
tttatctgtatatctcaagtgt

SEQ ID NO: 9257847 - DNA, 22 bp, Homo sapiens
tttatctggactgtgatataaa

SEQ ID NO: 9257848 - DNA, 22 bp, Homo sapiens
tttagtgtagcattcagagtca

SEQ ID NO: 9257849 - DNA, 22 bp, Homo sapiens
tttagtgtaagcataaagaaca

SEQ ID NO: 9257850 - DNA, 22 bp, Homo sapiens
tttagtgctttgctattcatgg

SEQ ID NO: 9257851 - DNA, 22 bp, Homo sapiens
tttaggatattaatgttcagag

SEQ ID NO: 9257852 - DNA, 22 bp, Homo sapiens
tttaggatctctcttgttacat

SEQ ID NO: 9257853 - DNA, 22 bp, Homo sapiens
tttaggaagatctgaaggaaga

SEQ ID NO: 9257854 - DNA, 21 bp, Homo sapiens
tttaggaagtttaaggcaggt

SEQ ID NO: 9257855 - DNA, 22 bp, Homo sapiens
tttaggaagtttcagataggaa

SEQ ID NO: 9257856 - DNA, 22 bp, Homo sapiens
tttagctttacctcatagattt

SEQ ID NO: 9257857 - DNA, 22 bp, Homo sapiens
tttagctttgaaggatatggtt

SEQ ID NO: 9257858 - DNA, 22 bp, Homo sapiens
tttagctttgaaggatatggtt

SEQ ID NO: 9257859 - DNA, 22 bp, Homo sapiens
tttagctttacctcatagattt

SEQ ID NO: 9257860 - DNA, 22 bp, Homo sapiens
tttagcttgttggaacaattga

SEQ ID NO: 9257861 - DNA, 22 bp, Homo sapiens
tttagcttgttggaacaattga

SEQ ID NO: 9257862 - DNA, 22 bp, Homo sapiens
tttagcttaaatggagaaagag

SEQ ID NO: 9257863 - DNA, 23 bp, Homo sapiens
tttagcttataaatgcttttgaa

SEQ ID NO: 9257864 - DNA, 22 bp, Homo sapiens
tttagcttcagttctagcttct

SEQ ID NO: 9257865 - DNA, 22 bp, Homo sapiens
tttagcttgaatcttgtttaaa

SEQ ID NO: 9257866 - DNA, 22 bp, Homo sapiens
tttagcttgaaagttttggagg

SEQ ID NO: 9257867 - DNA, 22 bp, Homo sapiens
tttagcttcttcagcttgttca

SEQ ID NO: 9257868 - DNA, 23 bp, Homo sapiens
tttagcttccctttagttagggg

SEQ ID NO: 9257869 - DNA, 22 bp, Homo sapiens
tttagcttcatttggcgtgatt

SEQ ID NO: 9257870 - DNA, 22 bp, Homo sapiens
tttagcattaagcttttcaaat

SEQ ID NO: 9257871 - DNA, 22 bp, Homo sapiens
tttagcattaagcttttcaaat

SEQ ID NO: 9257872 - DNA, 21 bp, Homo sapiens
tttagcatttacatatttcca

SEQ ID NO: 9257873 - DNA, 22 bp, Homo sapiens
tttagcattactaaaatgaaaa

SEQ ID NO: 9257874 - DNA, 22 bp, Homo sapiens
tttagcatcgaagtaaatttag

SEQ ID NO: 9257875 - DNA, 22 bp, Homo sapiens
tttacagcttctatactatgtg

SEQ ID NO: 9257876 - DNA, 23 bp, Homo sapiens
tttagcatgaagcagctggagaa

SEQ ID NO: 9257877 - DNA, 22 bp, Homo sapiens
tttagcatcgaagtaaatttag

SEQ ID NO: 9257878 - DNA, 22 bp, Homo sapiens
tttcacatgtggaatgccaggt

SEQ ID NO: 9257879 - DNA, 20 bp, Homo sapiens
tttcacatctgtccctttaa

SEQ ID NO: 9257880 - DNA, 22 bp, Homo sapiens
tttcacaatcaaatggtgaaat

SEQ ID NO: 9257881 - DNA, 22 bp, Homo sapiens
tttcacatcagaggtagattag

SEQ ID NO: 9257882 - DNA, 22 bp, Homo sapiens
tttcacaggattctgatgtagt

SEQ ID NO: 9257883 - DNA, 22 bp, Homo sapiens
tttcagtttttgctcgatgtat

SEQ ID NO: 9257884 - DNA, 22 bp, Homo sapiens
tttcacattagatatgtcattt

SEQ ID NO: 9257885 - DNA, 22 bp, Homo sapiens
tttcacattagatatgtcattt

SEQ ID NO: 9257886 - DNA, 22 bp, Homo sapiens
tttcacattcttctgaatctac

SEQ ID NO: 9257887 - DNA, 22 bp, Homo sapiens
tttcacattggcttctatttct

SEQ ID NO: 9257888 - DNA, 22 bp, Homo sapiens
tttcacaacgttgtggtgagag

SEQ ID NO: 9257889 - DNA, 22 bp, Homo sapiens
tttcacaacgttgtggtgagag

SEQ ID NO: 9257890 - DNA, 18 bp, Homo sapiens
tttcacaacctccagagg

SEQ ID NO: 9257891 - DNA, 22 bp, Homo sapiens
tttcaatgacacaaaagagaaa

SEQ ID NO: 9257892 - DNA, 22 bp, Homo sapiens
tttcaagcataactgggaagag

SEQ ID NO: 9257893 - DNA, 22 bp, Homo sapiens
tttcaagcataactgggaagag

SEQ ID NO: 9257894 - DNA, 22 bp, Homo sapiens
tttcaagctcttcagtgttatt

SEQ ID NO: 9257895 - DNA, 22 bp, Homo sapiens
tttcaagctgtggtaactgaga

SEQ ID NO: 9257896 - DNA, 22 bp, Homo sapiens
tttcaagtcagtagctaatcat

SEQ ID NO: 9257897 - DNA, 22 bp, Homo sapiens
tttatttataagccacttgctg

SEQ ID NO: 9257898 - DNA, 21 bp, Homo sapiens
tttatttatataggacacatg

SEQ ID NO: 9257899 - DNA, 22 bp, Homo sapiens
tttccttgcacattggtttcca

SEQ ID NO: 9257900 - DNA, 22 bp, Homo sapiens
tttccttcttagcggtgttctt

SEQ ID NO: 9257901 - DNA, 22 bp, Homo sapiens
tttccttgcacattggtttcca

SEQ ID NO: 9257902 - DNA, 22 bp, Homo sapiens
tttccttgcacattggtttcca

SEQ ID NO: 9257903 - DNA, 22 bp, Homo sapiens
tttcctttctggtttggtcata

SEQ ID NO: 9257904 - DNA, 22 bp, Homo sapiens
tttcctttgagggtcctacact

SEQ ID NO: 9257905 - DNA, 22 bp, Homo sapiens
tttcctttgagggtcctacact

SEQ ID NO: 9257906 - DNA, 22 bp, Homo sapiens
tttcccaattgagaggttctgt

SEQ ID NO: 9257907 - DNA, 22 bp, Homo sapiens
tttcccaagtgtaaacatggca

SEQ ID NO: 9257908 - DNA, 22 bp, Homo sapiens
tttcccaagaaaaataattgga

SEQ ID NO: 9257909 - DNA, 22 bp, Homo sapiens
tttccatatttaatcaaaataa

SEQ ID NO: 9257910 - DNA, 22 bp, Homo sapiens
tttccatatttaatcaaaataa

SEQ ID NO: 9257911 - DNA, 22 bp, Homo sapiens
tttcggaataaatacgaacatc

SEQ ID NO: 9257912 - DNA, 22 bp, Homo sapiens
tttctaaaatagattttatggt

SEQ ID NO: 9257913 - DNA, 22 bp, Homo sapiens
tttctaacgtagacagggaggt

SEQ ID NO: 9257914 - DNA, 22 bp, Homo sapiens
tttctaagacatttgtcatctt

SEQ ID NO: 9257915 - DNA, 22 bp, Homo sapiens
tttctaagaatattgctcttaa

SEQ ID NO: 9257916 - DNA, 22 bp, Homo sapiens
tttctaagcttagtatgaggca

SEQ ID NO: 9257917 - DNA, 22 bp, Homo sapiens
tttctaagcttagtatgaggca

SEQ ID NO: 9257918 - DNA, 22 bp, Homo sapiens
tttcatcttatttgtctacatc

SEQ ID NO: 9257919 - DNA, 22 bp, Homo sapiens
tttcatcttatttgtctacatc

SEQ ID NO: 9257920 - DNA, 17 bp, Homo sapiens
tttcatctgggaccacc

SEQ ID NO: 9257921 - DNA, 22 bp, Homo sapiens
tttcatctgtgctgccaagact

SEQ ID NO: 9257922 - DNA, 22 bp, Homo sapiens
tttcatctgtgctgccaagact

SEQ ID NO: 9257923 - DNA, 22 bp, Homo sapiens
tttccagagctgagaaggcttg

SEQ ID NO: 9257924 - DNA, 22 bp, Homo sapiens
tttccagtgagcaaatgtagaa

SEQ ID NO: 9257925 - DNA, 22 bp, Homo sapiens
tttcatatgggcattggcaata

SEQ ID NO: 9257926 - DNA, 22 bp, Homo sapiens
tttcatattattccttgagtct

SEQ ID NO: 9257927 - DNA, 22 bp, Homo sapiens
tttcatattattccttgagtct

SEQ ID NO: 9257928 - DNA, 22 bp, Homo sapiens
tttcatagccttctaatgagtt

SEQ ID NO: 9257929 - DNA, 22 bp, Homo sapiens
tttcatagctgaaaatgttgaa

SEQ ID NO: 9257930 - DNA, 22 bp, Homo sapiens
tttcatctaacactacataggg

SEQ ID NO: 9257931 - DNA, 22 bp, Homo sapiens
tttcatctatttgctttgtgaa

SEQ ID NO: 9257932 - DNA, 22 bp, Homo sapiens
tttcatctaacactacataggg

SEQ ID NO: 9257933 - DNA, 22 bp, Homo sapiens
tttcatctaacactacataggg

SEQ ID NO: 9257934 - DNA, 22 bp, Homo sapiens
tttcatctctctaaaagacagt

SEQ ID NO: 9257935 - DNA, 22 bp, Homo sapiens
tttcatctctctaaaagacagt

SEQ ID NO: 9257936 - DNA, 22 bp, Homo sapiens
tttcatctctctaaaagacagt

SEQ ID NO: 9257937 - DNA, 22 bp, Homo sapiens
tttcataatactgtacatgaaa

SEQ ID NO: 9257938 - DNA, 22 bp, Homo sapiens
tttcataatactgtacatgaaa

SEQ ID NO: 9257939 - DNA, 22 bp, Homo sapiens
tttcataacctcaagctacagt

SEQ ID NO: 9257940 - DNA, 22 bp, Homo sapiens
tttcataatatccagagatttt

SEQ ID NO: 9257941 - DNA, 22 bp, Homo sapiens
tttcataatgtcacagtcaaaa

SEQ ID NO: 9257942 - DNA, 22 bp, Homo sapiens
tttcataatatccagagatttt

SEQ ID NO: 9257943 - DNA, 22 bp, Homo sapiens
ttgcattttggttgtaaatatg

SEQ ID NO: 9257944 - DNA, 22 bp, Homo sapiens
ttgcatttgagaaagttctcct

SEQ ID NO: 9257945 - DNA, 22 bp, Homo sapiens
ttgcatttttagatgcttctgt

SEQ ID NO: 9257946 - DNA, 22 bp, Homo sapiens
ttgcatttttagatgcttctgt

SEQ ID NO: 9257947 - DNA, 22 bp, Homo sapiens
ttgccacagtagcaaaaggttc

SEQ ID NO: 9257948 - DNA, 22 bp, Homo sapiens
ttgccacacaagtaaagaaaca

SEQ ID NO: 9257949 - DNA, 22 bp, Homo sapiens
ttgccatcccttacctcagtca

SEQ ID NO: 9257950 - DNA, 22 bp, Homo sapiens
ttgcatttgagaaagttctcct

SEQ ID NO: 9257951 - DNA, 22 bp, Homo sapiens
ttgcatttgatcttgggttctc

SEQ ID NO: 9257952 - DNA, 22 bp, Homo sapiens
ttgcatttcactttcagtaggc

SEQ ID NO: 9257953 - DNA, 22 bp, Homo sapiens
ttgagtcagtaattccatttct

SEQ ID NO: 9257954 - DNA, 22 bp, Homo sapiens
ttgaggtctttgagcaaacgca

SEQ ID NO: 9257955 - DNA, 20 bp, Homo sapiens
ttgaggtcaaggactaggcc

SEQ ID NO: 9257956 - DNA, 22 bp, Homo sapiens
ttgaggtcaaagaagtgagtgg

SEQ ID NO: 9257957 - DNA, 22 bp, Homo sapiens
ttgaggtcaaagaagtgagtgg

SEQ ID NO: 9257958 - DNA, 22 bp, Homo sapiens
ttgaggtattgatattttatga

SEQ ID NO: 9257959 - DNA, 22 bp, Homo sapiens
ttgaggtcccaaacccactgag

SEQ ID NO: 9257960 - DNA, 22 bp, Homo sapiens
ttgaggtccagtctccacccac

SEQ ID NO: 9257961 - DNA, 22 bp, Homo sapiens
ttgaggtccaggtgtgggcagg

SEQ ID NO: 9257962 - DNA, 22 bp, Homo sapiens
ttgaggtcatctgaagtactag

SEQ ID NO: 9257963 - DNA, 22 bp, Homo sapiens
ttgaggtcatatatatttggca

SEQ ID NO: 9257964 - DNA, 22 bp, Homo sapiens
ttgaggtcaattctgtttcctg

SEQ ID NO: 9257965 - DNA, 22 bp, Homo sapiens
ttgaggtcaagtaaccactgga

SEQ ID NO: 9257966 - DNA, 22 bp, Homo sapiens
ttgaggtctctacagaagagtg

SEQ ID NO: 9257967 - DNA, 22 bp, Homo sapiens
ttgaggtctctacagaagagtg

SEQ ID NO: 9257968 - DNA, 22 bp, Homo sapiens
ttgaggtctgagactgtgcagg

SEQ ID NO: 9257969 - DNA, 22 bp, Homo sapiens
ttgaggtccccagtacccactg

SEQ ID NO: 9257970 - DNA, 22 bp, Homo sapiens
ttgaggtccaggtgtgggcagg

SEQ ID NO: 9257971 - DNA, 23 bp, Homo sapiens
ttgaggtcggctctctgagcctg

SEQ ID NO: 9257972 - DNA, 22 bp, Homo sapiens
ttgaggtccctgccttgccttc

SEQ ID NO: 9257973 - DNA, 22 bp, Homo sapiens
ttgaggtcttcaggatcaggct

SEQ ID NO: 9257974 - DNA, 22 bp, Homo sapiens
ttgaggtcttgagtactgggga

SEQ ID NO: 9257975 - DNA, 22 bp, Homo sapiens
ttgaggtcttcattcttgggca

SEQ ID NO: 9257976 - DNA, 22 bp, Homo sapiens
ttgaggtcttcagctgacacct

SEQ ID NO: 9257977 - DNA, 22 bp, Homo sapiens
ttgaggtctgtgtaggcagcaa

SEQ ID NO: 9257978 - DNA, 22 bp, Homo sapiens
ttgaggtctgtgataaaagtca

SEQ ID NO: 9257979 - DNA, 22 bp, Homo sapiens
ttgaggtctggcagtagcgttg

SEQ ID NO: 9257980 - DNA, 22 bp, Homo sapiens
ttgctaatcatatttcatcact

SEQ ID NO: 9257981 - DNA, 22 bp, Homo sapiens
ttgctataaatggtttcatatt

SEQ ID NO: 9257982 - DNA, 22 bp, Homo sapiens
ttgctactgttctttgctagag

SEQ ID NO: 9257983 - DNA, 20 bp, Homo sapiens
ttgctagcttttgtgtcact

SEQ ID NO: 9257984 - DNA, 22 bp, Homo sapiens
ttgctaaaggattttgtattta

SEQ ID NO: 9257985 - DNA, 22 bp, Homo sapiens
ttgctaaaggattttgtattta

SEQ ID NO: 9257986 - DNA, 22 bp, Homo sapiens
ttgctaaatccctataatattc

SEQ ID NO: 9257987 - DNA, 22 bp, Homo sapiens
ttgctaaatgtgttatatctgt

SEQ ID NO: 9257988 - DNA, 22 bp, Homo sapiens
ttgctaaatgtgttatatctgt

SEQ ID NO: 9257989 - DNA, 22 bp, Homo sapiens
ttgctaaatttattttcgaaca

SEQ ID NO: 9257990 - DNA, 22 bp, Homo sapiens
ttgctaatagaagatttgggaa

SEQ ID NO: 9257991 - DNA, 22 bp, Homo sapiens
ttgctaataaagtttttatgtg

SEQ ID NO: 9257992 - DNA, 22 bp, Homo sapiens
ttgctcaggcttagagctacta

SEQ ID NO: 9257993 - DNA, 22 bp, Homo sapiens
ttgctcagcactggagccagct

SEQ ID NO: 9257994 - DNA, 22 bp, Homo sapiens
ttgcctgctacggtcttcactg

SEQ ID NO: 9257995 - DNA, 22 bp, Homo sapiens
ttgcctcaagattttttattga

SEQ ID NO: 9257996 - DNA, 22 bp, Homo sapiens
ttgcctcaagattttttattga

SEQ ID NO: 9257997 - DNA, 22 bp, Homo sapiens
ttgcctgtttgagagctgtgtt

SEQ ID NO: 9257998 - DNA, 22 bp, Homo sapiens
ttgcctgtgtcagcaggtggaa

SEQ ID NO: 9257999 - DNA, 22 bp, Homo sapiens
ttgcctgtgaacgctgagtcct

SEQ ID NO: 9258000 - DNA, 22 bp, Homo sapiens
ttgcctgtgaggattctggttg

SEQ ID NO: 9258001 - DNA, 22 bp, Homo sapiens
ttgcctttaagtataactgctg

SEQ ID NO: 9258002 - DNA, 22 bp, Homo sapiens
ttgcctttgacggtgcagcagt

SEQ ID NO: 9258003 - DNA, 22 bp, Homo sapiens
ttgcgcgcggctaggtctcggt

SEQ ID NO: 9258004 - DNA, 22 bp, Homo sapiens
ttggaagaaatatcaatagtgt

SEQ ID NO: 9258005 - DNA, 22 bp, Homo sapiens
ttggaagacaatgctgattctc

SEQ ID NO: 9258006 - DNA, 22 bp, Homo sapiens
ttggaagacagtgaaacagcac

SEQ ID NO: 9258007 - DNA, 22 bp, Homo sapiens
ttggaagacagccgtctttatt

SEQ ID NO: 9258008 - DNA, 22 bp, Homo sapiens
ttggaacatgccggggtccagg

SEQ ID NO: 9258009 - DNA, 22 bp, Homo sapiens
ttgctttatgtgtatgacttga

SEQ ID NO: 9258010 - DNA, 22 bp, Homo sapiens
ttgctttattcacatctatatt

SEQ ID NO: 9258011 - DNA, 22 bp, Homo sapiens
ttgctttattcacatctatatt

SEQ ID NO: 9258012 - DNA, 22 bp, Homo sapiens
ttggaacagaaacagacaaata

SEQ ID NO: 9258013 - DNA, 23 bp, Homo sapiens
ttggaacacagtaaatgcacaat

SEQ ID NO: 9258014 - DNA, 22 bp, Homo sapiens
ttgctttaggtatagaatccat

SEQ ID NO: 9258015 - DNA, 22 bp, Homo sapiens
ttgctttagggcaaatatttca

SEQ ID NO: 9258016 - DNA, 22 bp, Homo sapiens
ttgctttaatgagattttgcca

SEQ ID NO: 9258017 - DNA, 22 bp, Homo sapiens
ttgctttactttgccattcgtt

SEQ ID NO: 9258018 - DNA, 22 bp, Homo sapiens
ttgctttacaaaaattgatggt

SEQ ID NO: 9258019 - DNA, 22 bp, Homo sapiens
ttgcttcttagatattcctctc

SEQ ID NO: 9258020 - DNA, 23 bp, Homo sapiens
ttgcttctgtgcaattcagtact

SEQ ID NO: 9258021 - DNA, 23 bp, Homo sapiens
ttgcttctgtgcaattcagtact

SEQ ID NO: 9258022 - DNA, 22 bp, Homo sapiens
ttggaattcaagttgtagctta

SEQ ID NO: 9258023 - DNA, 22 bp, Homo sapiens
ttggaattaatatttgtataca

SEQ ID NO: 9258024 - DNA, 22 bp, Homo sapiens
ttggaggcaatgggaaggaggc

SEQ ID NO: 9258025 - DNA, 21 bp, Homo sapiens
ttggatgtatttatgttttag

SEQ ID NO: 9258026 - DNA, 22 bp, Homo sapiens
ttggcagaaatgtggctgggag

SEQ ID NO: 9258027 - DNA, 22 bp, Homo sapiens
ttggcacagaaaaactcactgt

SEQ ID NO: 9258028 - DNA, 22 bp, Homo sapiens
ttggcaattagttatatctgca

SEQ ID NO: 9258029 - DNA, 22 bp, Homo sapiens
ttggcaatgatctcaatcttct

SEQ ID NO: 9258030 - DNA, 21 bp, Homo sapiens
ttggcctgatatcttggagca

SEQ ID NO: 9258031 - DNA, 22 bp, Homo sapiens
ttggccttaacctctctgtgcc

SEQ ID NO: 9258032 - DNA, 22 bp, Homo sapiens
ttggccttccctacctgggcca

SEQ ID NO: 9258033 - DNA, 22 bp, Homo sapiens
ttggcctccacattttccaggt

SEQ ID NO: 9258034 - DNA, 22 bp, Homo sapiens
ttggcctcatggacagctcatc

SEQ ID NO: 9258035 - DNA, 22 bp, Homo sapiens
ttggccctgaggaggcagctgc

SEQ ID NO: 9258036 - DNA, 22 bp, Homo sapiens
ttggcagaggtctcgttgtggc

SEQ ID NO: 9258037 - DNA, 22 bp, Homo sapiens
ttggcccagggtcagcggcgct

SEQ ID NO: 9258038 - DNA, 22 bp, Homo sapiens
ttggcagcagagtgtggtgctc

SEQ ID NO: 9258039 - DNA, 22 bp, Homo sapiens
ttggctcagctgggactgttga

SEQ ID NO: 9258040 - DNA, 22 bp, Homo sapiens
ttggctcagctgggactgttga

SEQ ID NO: 9258041 - DNA, 22 bp, Homo sapiens
ttggctcagcatcttggtgcca

SEQ ID NO: 9258042 - DNA, 22 bp, Homo sapiens
ttggctcagcatcttggtgcca

SEQ ID NO: 9258043 - DNA, 22 bp, Homo sapiens
ttggctcaggacccctgtgact

SEQ ID NO: 9258044 - DNA, 22 bp, Homo sapiens
ttggctcaggacccctgtgact

SEQ ID NO: 9258045 - DNA, 22 bp, Homo sapiens
ttggctcaggctttcattgtaa

SEQ ID NO: 9258046 - DNA, 20 bp, Homo sapiens
ttggctcagatttttatggg

SEQ ID NO: 9258047 - DNA, 20 bp, Homo sapiens
ttggctcagatttttatggg

SEQ ID NO: 9258048 - DNA, 22 bp, Homo sapiens
ttggctcacctgtctacccaga

SEQ ID NO: 9258049 - DNA, 22 bp, Homo sapiens
ttggctcacctgtctacccaga

SEQ ID NO: 9258050 - DNA, 22 bp, Homo sapiens
ttggctcacctggagcctgttg

SEQ ID NO: 9258051 - DNA, 22 bp, Homo sapiens
ttggctcacctggagcctgttg

SEQ ID NO: 9258052 - DNA, 22 bp, Homo sapiens
ttggctcacatgattatggagg

SEQ ID NO: 9258053 - DNA, 22 bp, Homo sapiens
ttggctcacatgattatggagg

SEQ ID NO: 9258054 - DNA, 22 bp, Homo sapiens
ttggcctttattctgtacttct

SEQ ID NO: 9258055 - DNA, 22 bp, Homo sapiens
ttggcctttaaactggactttc

SEQ ID NO: 9258056 - DNA, 22 bp, Homo sapiens
ttggctcacaaggacggttgct

SEQ ID NO: 9258057 - DNA, 22 bp, Homo sapiens
ttggctcacaaggacggttgct

SEQ ID NO: 9258058 - DNA, 22 bp, Homo sapiens
ttggctcaaaacttagattcca

SEQ ID NO: 9258059 - DNA, 22 bp, Homo sapiens
ttggctcaaaacttagattcca

SEQ ID NO: 9258060 - DNA, 22 bp, Homo sapiens
ttggctcatgctgttttgtgca

SEQ ID NO: 9258061 - DNA, 22 bp, Homo sapiens
ttggctcattaaagatgataat

SEQ ID NO: 9258062 - DNA, 20 bp, Homo sapiens
ttggctcatgcaacacctac

SEQ ID NO: 9258063 - DNA, 20 bp, Homo sapiens
ttggctcatgcaacacctac

SEQ ID NO: 9258064 - DNA, 22 bp, Homo sapiens
ttggctcattaaagatgataat

SEQ ID NO: 9258065 - DNA, 22 bp, Homo sapiens
ttggctcatgctgttttgtgca

SEQ ID NO: 9258066 - DNA, 22 bp, Homo sapiens
ttggctcaggctttcattgtaa

SEQ ID NO: 9258067 - DNA, 22 bp, Homo sapiens
ttggctcagtgtgagggagatg

SEQ ID NO: 9258068 - DNA, 22 bp, Homo sapiens
ttggctcagtgtgagggagatg

SEQ ID NO: 9258069 - DNA, 22 bp, Homo sapiens
ttggctggtttcaagaaggcat

SEQ ID NO: 9258070 - DNA, 22 bp, Homo sapiens
ttggctggtaagccaaatgaaa

SEQ ID NO: 9258071 - DNA, 22 bp, Homo sapiens
ttggggcacctccccagcattt

SEQ ID NO: 9258072 - DNA, 22 bp, Homo sapiens
ttggggagttaatgccaaagat

SEQ ID NO: 9258073 - DNA, 22 bp, Homo sapiens
ttggggagaaatgaaatgaagt

SEQ ID NO: 9258074 - DNA, 22 bp, Homo sapiens
ttggggaggttgccacattcca

SEQ ID NO: 9258075 - DNA, 22 bp, Homo sapiens
ttgggctggcagaggtggtctt

SEQ ID NO: 9258076 - DNA, 22 bp, Homo sapiens
ttgggcttgacaagctgtcaag

SEQ ID NO: 9258077 - DNA, 22 bp, Homo sapiens
ttgggctgaggagggcgtggcc

SEQ ID NO: 9258078 - DNA, 22 bp, Homo sapiens
ttgggctgatctgtggaagaag

SEQ ID NO: 9258079 - DNA, 22 bp, Homo sapiens
ttgggctgaagtagagggcaga

SEQ ID NO: 9258080 - DNA, 22 bp, Homo sapiens
ttgggctgaggagggcgtggcc

SEQ ID NO: 9258081 - DNA, 22 bp, Homo sapiens
ttgggctgaagtagagggcaga

SEQ ID NO: 9258082 - DNA, 22 bp, Homo sapiens
ttgggctcaggagtttgagacc

SEQ ID NO: 9258083 - DNA, 23 bp, Homo sapiens
ttgggctcagtggcaggaagagt

SEQ ID NO: 9258084 - DNA, 22 bp, Homo sapiens
ttgggctgaaccctgcagctga

SEQ ID NO: 9258085 - DNA, 22 bp, Homo sapiens
ttgggctgaaccctgcagctga

SEQ ID NO: 9258086 - DNA, 22 bp, Homo sapiens
ttgggctcctgttgatcctgtc

SEQ ID NO: 9258087 - DNA, 22 bp, Homo sapiens
ttggcttcctgcacttgagttt

SEQ ID NO: 9258088 - DNA, 22 bp, Homo sapiens
ttggcttcccagagcttacgct

SEQ ID NO: 9258089 - DNA, 22 bp, Homo sapiens
ttgggaaacagtatagctaaca

SEQ ID NO: 9258090 - DNA, 22 bp, Homo sapiens
ttgggaaatatggattgttatt

SEQ ID NO: 9258091 - DNA, 22 bp, Homo sapiens
ttgggaaatatggattgttatt

SEQ ID NO: 9258092 - DNA, 22 bp, Homo sapiens
ttggctttagacctgagactgt

SEQ ID NO: 9258093 - DNA, 22 bp, Homo sapiens
ttgttatttacaacaatcctat

SEQ ID NO: 9258094 - DNA, 22 bp, Homo sapiens
ttgtggcagaccatgagtctaa

SEQ ID NO: 9258095 - DNA, 22 bp, Homo sapiens
ttgttcataaagacagttcaga

SEQ ID NO: 9258096 - DNA, 22 bp, Homo sapiens
ttgtgctgctgacttaagatat

SEQ ID NO: 9258097 - DNA, 22 bp, Homo sapiens
ttgtggaagccctatgagagac

SEQ ID NO: 9258098 - DNA, 22 bp, Homo sapiens
ttgtggaaatacagactccaag

SEQ ID NO: 9258099 - DNA, 22 bp, Homo sapiens
ttgtgctcctgtgagaatctag

SEQ ID NO: 9258100 - DNA, 22 bp, Homo sapiens
ttgtgctcctatgagaatctaa

SEQ ID NO: 9258101 - DNA, 22 bp, Homo sapiens
ttgtatttcctataacctttct

SEQ ID NO: 9258102 - DNA, 22 bp, Homo sapiens
ttgtgatactgagcttggcatt

SEQ ID NO: 9258103 - DNA, 22 bp, Homo sapiens
ttgtgcaatagttttctcatga

SEQ ID NO: 9258104 - DNA, 22 bp, Homo sapiens
ttgtgcaatggtgtttaggttt

SEQ ID NO: 9258105 - DNA, 22 bp, Homo sapiens
ttgtgcaatcccctcattttat

SEQ ID NO: 9258106 - DNA, 22 bp, Homo sapiens
ttgtgcatattaggtacatgct

SEQ ID NO: 9258107 - DNA, 22 bp, Homo sapiens
ttgtgcatatagagttagatgg

SEQ ID NO: 9258108 - DNA, 22 bp, Homo sapiens
ttgtgcagagttgcctttattt

SEQ ID NO: 9258109 - DNA, 22 bp, Homo sapiens
ttgtgcatttctctgagtgtgt

SEQ ID NO: 9258110 - DNA, 22 bp, Homo sapiens
ttgtgcatttctctgagtgtgt

SEQ ID NO: 9258111 - DNA, 22 bp, Homo sapiens
ttgtgccataaccaccctgact

SEQ ID NO: 9258112 - DNA, 22 bp, Homo sapiens
ttgtgcctggcttgtattcaca

SEQ ID NO: 9258113 - DNA, 22 bp, Homo sapiens
ttgtgctaagtgctatgaaggc

SEQ ID NO: 9258114 - DNA, 22 bp, Homo sapiens
ttgtgctaagtgctatgaaggc

SEQ ID NO: 9258115 - DNA, 22 bp, Homo sapiens
ttgtgctagaaccagtacagaa

SEQ ID NO: 9258116 - DNA, 20 bp, Homo sapiens
ttggggcatccaccgaatgg

SEQ ID NO: 9258117 - DNA, 22 bp, Homo sapiens
ttggggctctgaaaaagatgta

SEQ ID NO: 9258118 - DNA, 22 bp, Homo sapiens
ttggggggttgaggagtagata

SEQ ID NO: 9258119 - DNA, 22 bp, Homo sapiens
ttggggtaaaatgtcgtaagag

SEQ ID NO: 9258120 - DNA, 22 bp, Homo sapiens
ttggggtacgcaggtctgggag

SEQ ID NO: 9258121 - DNA, 22 bp, Homo sapiens
ttggggtaagtttgtcaagctg

SEQ ID NO: 9258122 - DNA, 22 bp, Homo sapiens
ttggggtaaggaaatatggctt

SEQ ID NO: 9258123 - DNA, 22 bp, Homo sapiens
ttgtagaaaattctcttggata

SEQ ID NO: 9258124 - DNA, 22 bp, Homo sapiens
ttgtagaacatgcagcacaatg

SEQ ID NO: 9258125 - DNA, 22 bp, Homo sapiens
ttgtagaatcattatttctagt

SEQ ID NO: 9258126 - DNA, 22 bp, Homo sapiens
ttgtattaattgaaatgaatgc

SEQ ID NO: 9258127 - DNA, 22 bp, Homo sapiens
ttgtattaattgaaatgaatgc

SEQ ID NO: 9258128 - DNA, 22 bp, Homo sapiens
ttgtattagtaagtcagctgct

SEQ ID NO: 9258129 - DNA, 22 bp, Homo sapiens
ttgtattaggccctagggagtt

SEQ ID NO: 9258130 - DNA, 22 bp, Homo sapiens
ttgtattagctgtaaattttct

SEQ ID NO: 9258131 - DNA, 22 bp, Homo sapiens
ttgtatttcctataacctttct

SEQ ID NO: 9258132 - DNA, 23 bp, Homo sapiens
ttgtatctctggaaattcttcaa

SEQ ID NO: 9258133 - DNA, 22 bp, Homo sapiens
ttgtatgagtatggtgtatagg

SEQ ID NO: 9258134 - DNA, 22 bp, Homo sapiens
ttgtatgatcaaaagaaatgta

SEQ ID NO: 9258135 - DNA, 22 bp, Homo sapiens
ttgtataagaagttggcagata

SEQ ID NO: 9258136 - DNA, 22 bp, Homo sapiens
ttgtataagaagttggcagata

SEQ ID NO: 9258137 - DNA, 22 bp, Homo sapiens
ttgtatagcccagagagtgaga

SEQ ID NO: 9258138 - DNA, 22 bp, Homo sapiens
ttccaatggaatcatgtcttga

SEQ ID NO: 9258139 - DNA, 22 bp, Homo sapiens
ttccataaaggtgatagtatac

SEQ ID NO: 9258140 - DNA, 22 bp, Homo sapiens
ttccaaggcaacagcctaggct

SEQ ID NO: 9258141 - DNA, 22 bp, Homo sapiens
ttccaagagctttaattgttga

SEQ ID NO: 9258142 - DNA, 22 bp, Homo sapiens
ttccatgcctctatttagaatt

SEQ ID NO: 9258143 - DNA, 18 bp, Homo sapiens
ttccatgattcctttcac

SEQ ID NO: 9258144 - DNA, 22 bp, Homo sapiens
ttccatattgtactctttggag

SEQ ID NO: 9258145 - DNA, 22 bp, Homo sapiens
ttccatctgctaggtaaatgaa

SEQ ID NO: 9258146 - DNA, 22 bp, Homo sapiens
ttcccagaatgaatggatggag

SEQ ID NO: 9258147 - DNA, 22 bp, Homo sapiens
ttcccagaattgttgggaactg

SEQ ID NO: 9258148 - DNA, 22 bp, Homo sapiens
ttcccagactccacactgaggc

SEQ ID NO: 9258149 - DNA, 22 bp, Homo sapiens
ttcccagacctgtaggatcaga

SEQ ID NO: 9258150 - DNA, 22 bp, Homo sapiens
ttcccagacctgtaggatcaga

SEQ ID NO: 9258151 - DNA, 22 bp, Homo sapiens
ttccattggtaaaatgagagtg

SEQ ID NO: 9258152 - DNA, 22 bp, Homo sapiens
ttccattgagtacctggagaca

SEQ ID NO: 9258153 - DNA, 19 bp, Homo sapiens
ttcccagagccatgagtga

SEQ ID NO: 9258154 - DNA, 19 bp, Homo sapiens
ttcccagagccatgagtga

SEQ ID NO: 9258155 - DNA, 19 bp, Homo sapiens
ttcccagagccatgagtga

SEQ ID NO: 9258156 - DNA, 22 bp, Homo sapiens
ttcccagaggagatttgcttat

SEQ ID NO: 9258157 - DNA, 22 bp, Homo sapiens
ttcccagagataagacgtctta

SEQ ID NO: 9258158 - DNA, 22 bp, Homo sapiens
ttcccagagaaggatgaaaaag

SEQ ID NO: 9258159 - DNA, 22 bp, Homo sapiens
ttcccagactccacactgaggc

SEQ ID NO: 9258160 - DNA, 22 bp, Homo sapiens
ttcccagaggcaaagtctggat

SEQ ID NO: 9258161 - DNA, 22 bp, Homo sapiens
ttcccagattggagggcagggg

SEQ ID NO: 9258162 - DNA, 22 bp, Homo sapiens
ttcccatttgtggtagtgaatt

SEQ ID NO: 9258163 - DNA, 22 bp, Homo sapiens
ttcccaggtaattctgaggcag

SEQ ID NO: 9258164 - DNA, 22 bp, Homo sapiens
ttccccttgataatgcagtaag

SEQ ID NO: 9258165 - DNA, 22 bp, Homo sapiens
ttcccctgtcacagtggttctc

SEQ ID NO: 9258166 - DNA, 22 bp, Homo sapiens
ttcccctgtcacagtggttctc

SEQ ID NO: 9258167 - DNA, 22 bp, Homo sapiens
ttccccagggaagctcctgcgc

SEQ ID NO: 9258168 - DNA, 22 bp, Homo sapiens
ttccccaggctggagtgcagtg

SEQ ID NO: 9258169 - DNA, 22 bp, Homo sapiens
ttccccaggggctcctgccttt

SEQ ID NO: 9258170 - DNA, 22 bp, Homo sapiens
ttccccagtaacatacatgtga

SEQ ID NO: 9258171 - DNA, 22 bp, Homo sapiens
ttccccaggtgattctcatggc

SEQ ID NO: 9258172 - DNA, 22 bp, Homo sapiens
ttcagaactgtctgtccttttc

SEQ ID NO: 9258173 - DNA, 22 bp, Homo sapiens
ttcagaatatttgttttacatg

SEQ ID NO: 9258174 - DNA, 22 bp, Homo sapiens
ttcagaatatccgtttaagttt

SEQ ID NO: 9258175 - DNA, 22 bp, Homo sapiens
ttcagaatattattttaaaggc

SEQ ID NO: 9258176 - DNA, 22 bp, Homo sapiens
ttcagaagtagctaagcagtca

SEQ ID NO: 9258177 - DNA, 21 bp, Homo sapiens
ttcagaagttgagggcaggtt

SEQ ID NO: 9258178 - DNA, 22 bp, Homo sapiens
ttcactgtgaactcatattcag

SEQ ID NO: 9258179 - DNA, 22 bp, Homo sapiens
ttcactgtgatggtgcagaggc

SEQ ID NO: 9258180 - DNA, 20 bp, Homo sapiens
ttcagaaataaggaatgagg

SEQ ID NO: 9258181 - DNA, 22 bp, Homo sapiens
ttcagaaatccctcttctaccc

SEQ ID NO: 9258182 - DNA, 20 bp, Homo sapiens
ttcagaaataaggaatgagg

SEQ ID NO: 9258183 - DNA, 22 bp, Homo sapiens
ttcagaacaaccatggttagat

SEQ ID NO: 9258184 - DNA, 22 bp, Homo sapiens
ttcagaaatgaatattggtatt

SEQ ID NO: 9258185 - DNA, 22 bp, Homo sapiens
ttcagaaatcgagtttcatgtc

SEQ ID NO: 9258186 - DNA, 22 bp, Homo sapiens
ttcactgtactgactgtcttat

SEQ ID NO: 9258187 - DNA, 22 bp, Homo sapiens
ttcaatatctctaagaatgagg

SEQ ID NO: 9258188 - DNA, 22 bp, Homo sapiens
ttcaatatctctaagaatgagg

SEQ ID NO: 9258189 - DNA, 22 bp, Homo sapiens
ttcaatatgatattagctgtgg

SEQ ID NO: 9258190 - DNA, 22 bp, Homo sapiens
ttcaatatctctaagaatgagg

SEQ ID NO: 9258191 - DNA, 22 bp, Homo sapiens
ttcaatatctctaagaatgagg

SEQ ID NO: 9258192 - DNA, 22 bp, Homo sapiens
ttcaagtactgtagatttcagg

SEQ ID NO: 9258193 - DNA, 22 bp, Homo sapiens
ttcaaggtatggtagctggtca

SEQ ID NO: 9258194 - DNA, 22 bp, Homo sapiens
ttcatagagcagctcactgaat

SEQ ID NO: 9258195 - DNA, 22 bp, Homo sapiens
ttcatagagcagctcactgaat

SEQ ID NO: 9258196 - DNA, 22 bp, Homo sapiens
ttcatactgtgtttccaagttt

SEQ ID NO: 9258197 - DNA, 22 bp, Homo sapiens
ttcatacatttttactaacagc

SEQ ID NO: 9258198 - DNA, 22 bp, Homo sapiens
ttcagacaataagagtcatctc

SEQ ID NO: 9258199 - DNA, 22 bp, Homo sapiens
ttcagaatgctatttctgaaat

SEQ ID NO: 9258200 - DNA, 22 bp, Homo sapiens
ttcagaatgacttatgtaaggc

SEQ ID NO: 9258201 - DNA, 22 bp, Homo sapiens
ttcatagtgcttaatttgataa

SEQ ID NO: 9258202 - DNA, 22 bp, Homo sapiens
ttcatagtgtttccttccagtg

SEQ ID NO: 9258203 - DNA, 22 bp, Homo sapiens
ttcatagtgtttccttccagtg

SEQ ID NO: 9258204 - DNA, 22 bp, Homo sapiens
ttcatagtgtttccttccagtg

SEQ ID NO: 9258205 - DNA, 22 bp, Homo sapiens
ttcatagtgacatgcattctgg

SEQ ID NO: 9258206 - DNA, 22 bp, Homo sapiens
ttcatatatatgcactacgtac

SEQ ID NO: 9258207 - DNA, 22 bp, Homo sapiens
ttcatatgcagattaacaaata

SEQ ID NO: 9258208 - DNA, 22 bp, Homo sapiens
ttcatattcaaatactctgctt

SEQ ID NO: 9258209 - DNA, 22 bp, Homo sapiens
ttcatattttctgcttgctcac

SEQ ID NO: 9258210 - DNA, 22 bp, Homo sapiens
ttcatcaatgtgtttaataatg

SEQ ID NO: 9258211 - DNA, 22 bp, Homo sapiens
ttcatatttgaaacagaagtta

SEQ ID NO: 9258212 - DNA, 22 bp, Homo sapiens
ttcatatttgaaacagaagtta

SEQ ID NO: 9258213 - DNA, 20 bp, Homo sapiens
ttagttgagtagctcctgaa

SEQ ID NO: 9258214 - DNA, 22 bp, Homo sapiens
ttataattctggcataggctgt

SEQ ID NO: 9258215 - DNA, 22 bp, Homo sapiens
ttataagagtatatagtgtact

SEQ ID NO: 9258216 - DNA, 22 bp, Homo sapiens
ttataagagtatatagtgtact

SEQ ID NO: 9258217 - DNA, 23 bp, Homo sapiens
ttataagaagcatcacaggaaga

SEQ ID NO: 9258218 - DNA, 22 bp, Homo sapiens
ttataagactgtagtgagtatt

SEQ ID NO: 9258219 - DNA, 22 bp, Homo sapiens
ttataactttggatatgacaag

SEQ ID NO: 9258220 - DNA, 22 bp, Homo sapiens
ttatacagcattgctagtgatg

SEQ ID NO: 9258221 - DNA, 22 bp, Homo sapiens
ttataattctggcataggctgt

SEQ ID NO: 9258222 - DNA, 22 bp, Homo sapiens
ttataattctggcataggctgt

SEQ ID NO: 9258223 - DNA, 22 bp, Homo sapiens
ttataattgcttattagaccca

SEQ ID NO: 9258224 - DNA, 23 bp, Homo sapiens
ttatgcaagcttcctggtctcag

SEQ ID NO: 9258225 - DNA, 20 bp, Homo sapiens
ttatgcaagcatcaatattg

SEQ ID NO: 9258226 - DNA, 20 bp, Homo sapiens
ttatgtgtacctgtgctccc

SEQ ID NO: 9258227 - DNA, 22 bp, Homo sapiens
ttatgttatgaatggatgatct

SEQ ID NO: 9258228 - DNA, 22 bp, Homo sapiens
ttatgtgtgtacatgcatatgt

SEQ ID NO: 9258229 - DNA, 22 bp, Homo sapiens
ttatggaatggagaaagtctgc

SEQ ID NO: 9258230 - DNA, 22 bp, Homo sapiens
ttatggagactttcagaagcgg

SEQ ID NO: 9258231 - DNA, 22 bp, Homo sapiens
ttatggagcagacagctggtca

SEQ ID NO: 9258232 - DNA, 22 bp, Homo sapiens
ttatggagtgcttacctgccag

SEQ ID NO: 9258233 - DNA, 23 bp, Homo sapiens
ttatggagtgccagacatttggc

SEQ ID NO: 9258234 - DNA, 22 bp, Homo sapiens
ttatggaatacttatgctgcag

SEQ ID NO: 9258235 - DNA, 22 bp, Homo sapiens
ttatggaatggagaaagtctgc

SEQ ID NO: 9258236 - DNA, 22 bp, Homo sapiens
ttatggaatttgcaaaaggtta

SEQ ID NO: 9258237 - DNA, 22 bp, Homo sapiens
ttatggaaaatacaattataag

SEQ ID NO: 9258238 - DNA, 22 bp, Homo sapiens
ttatggaaatgaaattttattg

SEQ ID NO: 9258239 - DNA, 22 bp, Homo sapiens
ttatggaaatgaaattttattg

SEQ ID NO: 9258240 - DNA, 22 bp, Homo sapiens
ttatggaaaatacaattataag

SEQ ID NO: 9258241 - DNA, 22 bp, Homo sapiens
ttatggaataacctttctgaaa

SEQ ID NO: 9258242 - DNA, 22 bp, Homo sapiens
ttatggaagtgcaaattgtgtg

SEQ ID NO: 9258243 - DNA, 22 bp, Homo sapiens
ttatgcttcctgattggactct

SEQ ID NO: 9258244 - DNA, 23 bp, Homo sapiens
ttatgctttggcactcttgttag

SEQ ID NO: 9258245 - DNA, 23 bp, Homo sapiens
ttatgctttggcactcttgttag

SEQ ID NO: 9258246 - DNA, 22 bp, Homo sapiens
ttatgcttttagaatttagcat

SEQ ID NO: 9258247 - DNA, 22 bp, Homo sapiens
ttatggaaaactccagagagta

SEQ ID NO: 9258248 - DNA, 22 bp, Homo sapiens
ttatgcatgagataaaaattgg

SEQ ID NO: 9258249 - DNA, 22 bp, Homo sapiens
ttatgcatgagataaaaattgg

SEQ ID NO: 9258250 - DNA, 21 bp, Homo sapiens
tcctcctggccaggcggcccc

SEQ ID NO: 9258251 - DNA, 21 bp, Homo sapiens
tcctcctgtagagggtcctgg

SEQ ID NO: 9258252 - DNA, 22 bp, Homo sapiens
tcctcctgtctaccagttcctg

SEQ ID NO: 9258253 - DNA, 22 bp, Homo sapiens
tcctcctgtttctcaggcctgg

SEQ ID NO: 9258254 - DNA, 19 bp, Homo sapiens
tcctccttacttcctcttg

SEQ ID NO: 9258255 - DNA, 22 bp, Homo sapiens
tcctcctgtttctcaggcctgg

SEQ ID NO: 9258256 - DNA, 20 bp, Homo sapiens
tcctccttgcagagcccaga

SEQ ID NO: 9258257 - DNA, 22 bp, Homo sapiens
tcctctgctcagcattcctcac

SEQ ID NO: 9258258 - DNA, 22 bp, Homo sapiens
tcctctccagcaaactggctat

SEQ ID NO: 9258259 - DNA, 22 bp, Homo sapiens
tcctccttgttttgtctctgct

SEQ ID NO: 9258260 - DNA, 22 bp, Homo sapiens
tcctctggatataagcctcacc

SEQ ID NO: 9258261 - DNA, 22 bp, Homo sapiens
tcctctggcccagctgcctctg

SEQ ID NO: 9258262 - DNA, 22 bp, Homo sapiens
ttagtggtactcagggagggaa

SEQ ID NO: 9258263 - DNA, 22 bp, Homo sapiens
ttagtgcttctgtccaaatata

SEQ ID NO: 9258264 - DNA, 22 bp, Homo sapiens
ttagtgtccttatgtcacaagc

SEQ ID NO: 9258265 - DNA, 17 bp, Homo sapiens
ttagtgtatctgttttg

SEQ ID NO: 9258266 - DNA, 22 bp, Homo sapiens
ttagtgtctggctatatttaaa

SEQ ID NO: 9258267 - DNA, 22 bp, Homo sapiens
ttagtgtctcacctaaaatctg

SEQ ID NO: 9258268 - DNA, 22 bp, Homo sapiens
ttagtgtcttcttcatcctctg

SEQ ID NO: 9258269 - DNA, 22 bp, Homo sapiens
ttagtgttagggcctgttacct

SEQ ID NO: 9258270 - DNA, 22 bp, Homo sapiens
ttagtgtttaaaggtttcagag

SEQ ID NO: 9258271 - DNA, 22 bp, Homo sapiens
ttagttaaaattctgctgacat

SEQ ID NO: 9258272 - DNA, 22 bp, Homo sapiens
ttagttaattgactatgttgca

SEQ ID NO: 9258273 - DNA, 22 bp, Homo sapiens
ttattttgtagctctgatcttt

SEQ ID NO: 9258274 - DNA, 23 bp, Homo sapiens
ttcaaaactggaaaatcagatgc

SEQ ID NO: 9258275 - DNA, 22 bp, Homo sapiens
ttcaaaacagctagatattgga

SEQ ID NO: 9258276 - DNA, 23 bp, Homo sapiens
ttcaaaactggaaaatcagatgc

SEQ ID NO: 9258277 - DNA, 22 bp, Homo sapiens
ttcaaaagtaatcagtattaga

SEQ ID NO: 9258278 - DNA, 22 bp, Homo sapiens
ttcaaaagtaatcagtattaga

SEQ ID NO: 9258279 - DNA, 22 bp, Homo sapiens
ttcaaaatccgggaggcgcccc

SEQ ID NO: 9258280 - DNA, 22 bp, Homo sapiens
ttcaaaagactcagatgtagcg

SEQ ID NO: 9258281 - DNA, 22 bp, Homo sapiens
ttcaaaatgcacaaagggctag

SEQ ID NO: 9258282 - DNA, 22 bp, Homo sapiens
ttattttgccacaggtgacctt

SEQ ID NO: 9258283 - DNA, 22 bp, Homo sapiens
ttattttctcctcagaaagtgg

SEQ ID NO: 9258284 - DNA, 22 bp, Homo sapiens
ttattttctcctcagaaagtgg

SEQ ID NO: 9258285 - DNA, 22 bp, Homo sapiens
ttattttaccttcctctgagct

SEQ ID NO: 9258286 - DNA, 22 bp, Homo sapiens
ttattttaccttcctctgagct

SEQ ID NO: 9258287 - DNA, 22 bp, Homo sapiens
ttattttaccttcctctgagct

SEQ ID NO: 9258288 - DNA, 22 bp, Homo sapiens
ttattttcagctaggaaagcca

SEQ ID NO: 9258289 - DNA, 22 bp, Homo sapiens
ttcaagcagggattggtgatgg

SEQ ID NO: 9258290 - DNA, 22 bp, Homo sapiens
ttcaagcagagatatttcaaga

SEQ ID NO: 9258291 - DNA, 22 bp, Homo sapiens
ttcaagatgtcttcacaatagt

SEQ ID NO: 9258292 - DNA, 22 bp, Homo sapiens
ttcaagatgtcttcacaatagt

SEQ ID NO: 9258293 - DNA, 22 bp, Homo sapiens
ttcaagcaccaaattagtaggc

SEQ ID NO: 9258294 - DNA, 22 bp, Homo sapiens
ttcaagcagggattggtgatgg

SEQ ID NO: 9258295 - DNA, 22 bp, Homo sapiens
ttcaagatccagcacaacagtg

SEQ ID NO: 9258296 - DNA, 22 bp, Homo sapiens
ttcaagatccagcacaacagtg

SEQ ID NO: 9258297 - DNA, 22 bp, Homo sapiens
ttcaagatggctgcaaatactt

SEQ ID NO: 9258298 - DNA, 22 bp, Homo sapiens
ttcaagactccaagaaattagt

SEQ ID NO: 9258299 - DNA, 22 bp, Homo sapiens
ttcaagaatcttcctgaccact

SEQ ID NO: 9258300 - DNA, 22 bp, Homo sapiens
ttcaagataataggaatgaaaa

SEQ ID NO: 9258301 - DNA, 22 bp, Homo sapiens
ttcaagaaggtacatttacatc

SEQ ID NO: 9258302 - DNA, 22 bp, Homo sapiens
ttcaaacaactcatttatgcaa

SEQ ID NO: 9258303 - DNA, 21 bp, Homo sapiens
ttcaaaatggtgtgtttgtct

SEQ ID NO: 9258304 - DNA, 22 bp, Homo sapiens
ttcaaaattgttctaagctctg

SEQ ID NO: 9258305 - DNA, 22 bp, Homo sapiens
ttatttaatgtgatctgaagag

SEQ ID NO: 9258306 - DNA, 22 bp, Homo sapiens
ttatttaatgtgatctgaagag

SEQ ID NO: 9258307 - DNA, 22 bp, Homo sapiens
ttatttaattttctcactcaga

SEQ ID NO: 9258308 - DNA, 22 bp, Homo sapiens
ttatttacaactcttctcttcc

SEQ ID NO: 9258309 - DNA, 22 bp, Homo sapiens
ttatttacaactcttctcttcc

SEQ ID NO: 9258310 - DNA, 22 bp, Homo sapiens
ttatttgtggcatatgagacga

SEQ ID NO: 9258311 - DNA, 22 bp, Homo sapiens
ttatttgtggcatatgagacga

SEQ ID NO: 9258312 - DNA, 22 bp, Homo sapiens
ttatttatggcactgttggtgg

SEQ ID NO: 9258313 - DNA, 22 bp, Homo sapiens
ttatttatatctctgcagttta

SEQ ID NO: 9258314 - DNA, 22 bp, Homo sapiens
ttatttaaaagtggtaagattc

SEQ ID NO: 9258315 - DNA, 22 bp, Homo sapiens
ttattgtttgggtataatttga

SEQ ID NO: 9258316 - DNA, 22 bp, Homo sapiens
ttattgtttgggtataatttga

SEQ ID NO: 9258317 - DNA, 22 bp, Homo sapiens
ttattgtttgggtataatttga

SEQ ID NO: 9258318 - DNA, 22 bp, Homo sapiens
ttattgtttgggtataatttga

SEQ ID NO: 9258319 - DNA, 22 bp, Homo sapiens
ttatttaaaagtggtaagattc

SEQ ID NO: 9258320 - DNA, 22 bp, Homo sapiens
ttatttaaaagtggtaagattc

SEQ ID NO: 9258321 - DNA, 22 bp, Homo sapiens
ttatttaaaagtggtaagattc

SEQ ID NO: 9258322 - DNA, 22 bp, Homo sapiens
ttatttaaaagtggtaagattc

SEQ ID NO: 9258323 - DNA, 22 bp, Homo sapiens
ttatttaaaatgtaggttggga

SEQ ID NO: 9258324 - DNA, 22 bp, Homo sapiens
ttattaaaatgcggatttggct

SEQ ID NO: 9258325 - DNA, 22 bp, Homo sapiens
ttatgttttatggctatatcat

SEQ ID NO: 9258326 - DNA, 22 bp, Homo sapiens
ttattgttagtgagactgtaga

SEQ ID NO: 9258327 - DNA, 22 bp, Homo sapiens
ttattgttagtgagactgtaga

SEQ ID NO: 9258328 - DNA, 22 bp, Homo sapiens
ttatgttatgctatttcagata

SEQ ID NO: 9258329 - DNA, 22 bp, Homo sapiens
ttatgttttaagtgtgtatctt

SEQ ID NO: 9258330 - DNA, 22 bp, Homo sapiens
ttatgtttgagtatatgactca

SEQ ID NO: 9258331 - DNA, 22 bp, Homo sapiens
ttatgttttatggctatatcat

SEQ ID NO: 9258332 - DNA, 22 bp, Homo sapiens
ttctccagtcactgacttcgag

SEQ ID NO: 9258333 - DNA, 21 bp, Homo sapiens
ttctccagggggagctctctc

SEQ ID NO: 9258334 - DNA, 22 bp, Homo sapiens
ttctccatttaacttccttatg

SEQ ID NO: 9258335 - DNA, 22 bp, Homo sapiens
ttctccagtttctcccttcagt

SEQ ID NO: 9258336 - DNA, 22 bp, Homo sapiens
ttctcccagaccaaaggcagca

SEQ ID NO: 9258337 - DNA, 22 bp, Homo sapiens
ttctcccactccgtgcttcagt

SEQ ID NO: 9258338 - DNA, 22 bp, Homo sapiens
ttctcccactccgtgcttcagt

SEQ ID NO: 9258339 - DNA, 22 bp, Homo sapiens
ttctccgctaagttctctgcag

SEQ ID NO: 9258340 - DNA, 21 bp, Homo sapiens
ttctcctccaagttgctcctg

SEQ ID NO: 9258341 - DNA, 22 bp, Homo sapiens
ttctcctcagcaaggcagcttt

SEQ ID NO: 9258342 - DNA, 22 bp, Homo sapiens
ttctcctctgttggccttccct

SEQ ID NO: 9258343 - DNA, 22 bp, Homo sapiens
ttctcctctgttggccttccct

SEQ ID NO: 9258344 - DNA, 22 bp, Homo sapiens
ttctcctctacatagactgtgc

SEQ ID NO: 9258345 - DNA, 22 bp, Homo sapiens
ttctcttattctggatatgcag

SEQ ID NO: 9258346 - DNA, 22 bp, Homo sapiens
ttctcttacattttctcagcct

SEQ ID NO: 9258347 - DNA, 22 bp, Homo sapiens
ttctctgttttcccctcgatgt

SEQ ID NO: 9258348 - DNA, 22 bp, Homo sapiens
ttctctgttttcccctcgatgt

SEQ ID NO: 9258349 - DNA, 22 bp, Homo sapiens
ttctctggtttgctgtttctga

SEQ ID NO: 9258350 - DNA, 22 bp, Homo sapiens
ttctctgtagttgcctggtgga

SEQ ID NO: 9258351 - DNA, 22 bp, Homo sapiens
ttctctgtagttgcctggtgga

SEQ ID NO: 9258352 - DNA, 22 bp, Homo sapiens
ttctctgtgagggtgctggatt

SEQ ID NO: 9258353 - DNA, 22 bp, Homo sapiens
ttctctgtgagggtgctggatt

SEQ ID NO: 9258354 - DNA, 19 bp, Homo sapiens
ttctctgtgctagactctg

SEQ ID NO: 9258355 - DNA, 19 bp, Homo sapiens
ttctctgtgctagactctg

SEQ ID NO: 9258356 - DNA, 22 bp, Homo sapiens
ttctcttctgttcagtgcccaa

SEQ ID NO: 9258357 - DNA, 17 bp, Homo sapiens
ttctcttcctggatagt

SEQ ID NO: 9258358 - DNA, 23 bp, Homo sapiens
ttctctttagatttacattactc

SEQ ID NO: 9258359 - DNA, 23 bp, Homo sapiens
ttctctttagatttacattactc

SEQ ID NO: 9258360 - DNA, 22 bp, Homo sapiens
ttctcttgtgccaagttgttgc

SEQ ID NO: 9258361 - DNA, 22 bp, Homo sapiens
ttctcttcccactttctgtatt

SEQ ID NO: 9258362 - DNA, 22 bp, Homo sapiens
ttctcttcccactttctgtatt

SEQ ID NO: 9258363 - DNA, 22 bp, Homo sapiens
ttctcttcccactttctgtatt

SEQ ID NO: 9258364 - DNA, 22 bp, Homo sapiens
ttctcttcccactttctgtatt

SEQ ID NO: 9258365 - DNA, 22 bp, Homo sapiens
ttctgaggaggagcaaaaactc

SEQ ID NO: 9258366 - DNA, 22 bp, Homo sapiens
ttctgaggcatagaggatgaga

SEQ ID NO: 9258367 - DNA, 22 bp, Homo sapiens
ttctgaggccattaccaataaa

SEQ ID NO: 9258368 - DNA, 22 bp, Homo sapiens
ttctgagctgcaacactaacat

SEQ ID NO: 9258369 - DNA, 22 bp, Homo sapiens
ttctctttatgtatttagtggg

SEQ ID NO: 9258370 - DNA, 22 bp, Homo sapiens
ttctctttgacattattcaggt

SEQ ID NO: 9258371 - DNA, 22 bp, Homo sapiens
ttctgaggtccatgcagtactg

SEQ ID NO: 9258372 - DNA, 22 bp, Homo sapiens
ttctgagggctaatgtactgta

SEQ ID NO: 9258373 - DNA, 22 bp, Homo sapiens
ttctgatactggaatcgatgcc

SEQ ID NO: 9258374 - DNA, 22 bp, Homo sapiens
ttctgaggtccatgcagtactg

SEQ ID NO: 9258375 - DNA, 22 bp, Homo sapiens
ttctgatgcatgggtctctgtt

SEQ ID NO: 9258376 - DNA, 22 bp, Homo sapiens
ttctgatggtggaatgcttcag

SEQ ID NO: 9258377 - DNA, 22 bp, Homo sapiens
ttctgatgatggcggctggagc

SEQ ID NO: 9258378 - DNA, 22 bp, Homo sapiens
ttctgatgatggcggctggagc

SEQ ID NO: 9258379 - DNA, 22 bp, Homo sapiens
ttctgcctgatgtagtcatacc

SEQ ID NO: 9258380 - DNA, 20 bp, Homo sapiens
ttctgcctagggttagcctg

SEQ ID NO: 9258381 - DNA, 22 bp, Homo sapiens
ttctggaggagaaagggtgggc

SEQ ID NO: 9258382 - DNA, 23 bp, Homo sapiens
ttctgcatgtttcagagctggga

SEQ ID NO: 9258383 - DNA, 22 bp, Homo sapiens
ttctgcattcaaattatgtgag

SEQ ID NO: 9258384 - DNA, 22 bp, Homo sapiens
ttctgcagcatgaggctggagc

SEQ ID NO: 9258385 - DNA, 22 bp, Homo sapiens
ttctgcagatcaacttgactgc

SEQ ID NO: 9258386 - DNA, 22 bp, Homo sapiens
ttctgcactaaatatcaaatat

SEQ ID NO: 9258387 - DNA, 22 bp, Homo sapiens
ttctgcactaaatatcaaatat

SEQ ID NO: 9258388 - DNA, 22 bp, Homo sapiens
ttctgcatttaaaatattacta

SEQ ID NO: 9258389 - DNA, 22 bp, Homo sapiens
ttctgccaaaggctttgttttg

SEQ ID NO: 9258390 - DNA, 22 bp, Homo sapiens
ttccctgaagacctcatgtgac

SEQ ID NO: 9258391 - DNA, 22 bp, Homo sapiens
ttccctgatcacgtgtcaggag

SEQ ID NO: 9258392 - DNA, 22 bp, Homo sapiens
ttccttgtttcaagccatccac

SEQ ID NO: 9258393 - DNA, 22 bp, Homo sapiens
ttccttgttgaaaatgtctgca

SEQ ID NO: 9258394 - DNA, 22 bp, Homo sapiens
ttcgcattcagctttgccactg

SEQ ID NO: 9258395 - DNA, 22 bp, Homo sapiens
ttcctttagtgtcatatacttt

SEQ ID NO: 9258396 - DNA, 22 bp, Homo sapiens
ttcctttagtgtcatatacttt

SEQ ID NO: 9258397 - DNA, 22 bp, Homo sapiens
ttccctcctatgcccactgaaa

SEQ ID NO: 9258398 - DNA, 22 bp, Homo sapiens
ttccctctccaggagccctgag

SEQ ID NO: 9258399 - DNA, 22 bp, Homo sapiens
ttccctcccccagcctggcagg

SEQ ID NO: 9258400 - DNA, 22 bp, Homo sapiens
ttccctccctggctgccatttc

SEQ ID NO: 9258401 - DNA, 22 bp, Homo sapiens
ttccctccgaacctcagtgctg

SEQ ID NO: 9258402 - DNA, 22 bp, Homo sapiens
ttctaaaaccaattctgcttct

SEQ ID NO: 9258403 - DNA, 22 bp, Homo sapiens
ttctaaaataagtttatctggt

SEQ ID NO: 9258404 - DNA, 22 bp, Homo sapiens
ttctaaaataagtttatctggt

SEQ ID NO: 9258405 - DNA, 22 bp, Homo sapiens
ttctaaaataagtttatctggt

SEQ ID NO: 9258406 - DNA, 22 bp, Homo sapiens
ttctaaattttggaagatgcag

SEQ ID NO: 9258407 - DNA, 22 bp, Homo sapiens
ttctaactctgttatgtgtttc

SEQ ID NO: 9258408 - DNA, 22 bp, Homo sapiens
ttctaactctacactagctttg

SEQ ID NO: 9258409 - DNA, 22 bp, Homo sapiens
ttctaaagtgcaatctgacaga

SEQ ID NO: 9258410 - DNA, 22 bp, Homo sapiens
ttctaaagtgcaatctgacaga

SEQ ID NO: 9258411 - DNA, 22 bp, Homo sapiens
ttctaaatggggatcctttctg

SEQ ID NO: 9258412 - DNA, 22 bp, Homo sapiens
ttctaaatggggatcctttctg

SEQ ID NO: 9258413 - DNA, 18 bp, Homo sapiens
ttctaaattctgttttta

SEQ ID NO: 9258414 - DNA, 18 bp, Homo sapiens
ttctaaattctgttttta

SEQ ID NO: 9258415 - DNA, 22 bp, Homo sapiens
ttctaaattttggaagatgcag

SEQ ID NO: 9258416 - DNA, 19 bp, Homo sapiens
ttctcagagcttgcagcac

SEQ ID NO: 9258417 - DNA, 22 bp, Homo sapiens
ttctcagaggagtcgggagctg

SEQ ID NO: 9258418 - DNA, 22 bp, Homo sapiens
ttctcagagctcactgtagtaa

SEQ ID NO: 9258419 - DNA, 22 bp, Homo sapiens
ttctcagaattgactgggagca

SEQ ID NO: 9258420 - DNA, 22 bp, Homo sapiens
ttctcagacttccagcaccagc

SEQ ID NO: 9258421 - DNA, 22 bp, Homo sapiens
ttctcagagcactgctgacaaa

SEQ ID NO: 9258422 - DNA, 18 bp, Homo sapiens
ttctcagactttggaagt

SEQ ID NO: 9258423 - DNA, 22 bp, Homo sapiens
ttctcagatatttactgagcat

SEQ ID NO: 9258424 - DNA, 22 bp, Homo sapiens
ttctcagatatttgtatggaac

SEQ ID NO: 9258425 - DNA, 22 bp, Homo sapiens
ttctcagagtgaccaagtcttt

SEQ ID NO: 9258426 - DNA, 21 bp, Homo sapiens
ttctcagagtctattacagtt

SEQ ID NO: 9258427 - DNA, 22 bp, Homo sapiens
ttctcagaggctgctaagtgca

SEQ ID NO: 9258428 - DNA, 22 bp, Homo sapiens
ttctccagagtttctctcactg

SEQ ID NO: 9258429 - DNA, 22 bp, Homo sapiens
ttctccagcctattggcctatc

SEQ ID NO: 9258430 - DNA, 19 bp, Homo sapiens
ttctccagcctgacctgag

SEQ ID NO: 9258431 - DNA, 19 bp, Homo sapiens
ttctccagcctgacctgag

SEQ ID NO: 9258432 - DNA, 19 bp, Homo sapiens
ttctccagggacttaggga

SEQ ID NO: 9258433 - DNA, 22 bp, Homo sapiens
ttctccaggggagggttctcca

SEQ ID NO: 9258434 - DNA, 22 bp, Homo sapiens
ttctccaggcttgggccaggtc

SEQ ID NO: 9258435 - DNA, 19 bp, Homo sapiens
ttctccaggctgcagaggg

SEQ ID NO: 9258436 - DNA, 21 bp, Homo sapiens
ttctccaggcaaccatttcag

SEQ ID NO: 9258437 - DNA, 22 bp, Homo sapiens
ttctcacaggatttcttttagt

SEQ ID NO: 9258438 - DNA, 22 bp, Homo sapiens
ttctcacaggctggaatgatga

SEQ ID NO: 9258439 - DNA, 22 bp, Homo sapiens
ttctcagaattgactgggagca

SEQ ID NO: 9258440 - DNA, 22 bp, Homo sapiens
ttctcagaaaagcaagctttct

SEQ ID NO: 9258441 - DNA, 22 bp, Homo sapiens
ttctcagaaaatgtagagaaaa

SEQ ID NO: 9258442 - DNA, 22 bp, Homo sapiens
ttctcacagtacctaacatgta

SEQ ID NO: 9258443 - DNA, 19 bp, Homo sapiens
ttctatgattaacatgaga

SEQ ID NO: 9258444 - DNA, 22 bp, Homo sapiens
ttctcaaggacaaaatgacatg

SEQ ID NO: 9258445 - DNA, 22 bp, Homo sapiens
ttctatgaaggtaagatgtacg

SEQ ID NO: 9258446 - DNA, 22 bp, Homo sapiens
ttcttctgaaacataatcaata

SEQ ID NO: 9258447 - DNA, 20 bp, Homo sapiens
ttcttctctagttatcttca

SEQ ID NO: 9258448 - DNA, 22 bp, Homo sapiens
ttcttctgtgaggtgtgtgcct

SEQ ID NO: 9258449 - DNA, 22 bp, Homo sapiens
ttcttctgttggcagagcatac

SEQ ID NO: 9258450 - DNA, 22 bp, Homo sapiens
ttcttctgagagaaaaagctca

SEQ ID NO: 9258451 - DNA, 22 bp, Homo sapiens
ttcttcttcaagtgctgcattc

SEQ ID NO: 9258452 - DNA, 22 bp, Homo sapiens
ttctttcttagcaatctatggt

SEQ ID NO: 9258453 - DNA, 22 bp, Homo sapiens
ttctttctcagtgggcagatac

SEQ ID NO: 9258454 - DNA, 22 bp, Homo sapiens
ttctttctcactctttaggaag

SEQ ID NO: 9258455 - DNA, 22 bp, Homo sapiens
ttctttctcactctttaggaag

SEQ ID NO: 9258456 - DNA, 22 bp, Homo sapiens
ttctttctttgtagtcctgaac

SEQ ID NO: 9258457 - DNA, 22 bp, Homo sapiens
ttctttgagttagtacagtcca

SEQ ID NO: 9258458 - DNA, 22 bp, Homo sapiens
ttctttcttggggaacacactc

SEQ ID NO: 9258459 - DNA, 22 bp, Homo sapiens
ttctttcttggggaacacactc

SEQ ID NO: 9258460 - DNA, 22 bp, Homo sapiens
ttctgggacatctggacagttt

SEQ ID NO: 9258461 - DNA, 22 bp, Homo sapiens
ttctgggacatctggacagttt

SEQ ID NO: 9258462 - DNA, 22 bp, Homo sapiens
ttctgggacatctggacagttt

SEQ ID NO: 9258463 - DNA, 22 bp, Homo sapiens
ttctgggacattgcaggtattc

SEQ ID NO: 9258464 - DNA, 22 bp, Homo sapiens
ttctgggaacaaagtggagtgg

SEQ ID NO: 9258465 - DNA, 20 bp, Homo sapiens
ttctgggaattgggtagctg

SEQ ID NO: 9258466 - DNA, 22 bp, Homo sapiens
ttcttccttggtttcctggata

SEQ ID NO: 9258467 - DNA, 23 bp, Homo sapiens
ttcttctcaattagttgattcag

SEQ ID NO: 9258468 - DNA, 22 bp, Homo sapiens
ttcttctcctaaggagagtcct

SEQ ID NO: 9258469 - DNA, 22 bp, Homo sapiens
ttctgggcacacaggccctggt

SEQ ID NO: 9258470 - DNA, 19 bp, Homo sapiens
ttctgggaggggctgactg

SEQ ID NO: 9258471 - DNA, 22 bp, Homo sapiens
ttctgggaggctggctgtcata

SEQ ID NO: 9258472 - DNA, 22 bp, Homo sapiens
ttctttttatcttcccataaga

SEQ ID NO: 9258473 - DNA, 22 bp, Homo sapiens
ttgaaaacagcgtagattcaca

SEQ ID NO: 9258474 - DNA, 22 bp, Homo sapiens
ttgaaaaaattggtagaggatg

SEQ ID NO: 9258475 - DNA, 22 bp, Homo sapiens
ttgaaacataaaatatttcctg

SEQ ID NO: 9258476 - DNA, 22 bp, Homo sapiens
ttgaaacagtagctcatagacc

SEQ ID NO: 9258477 - DNA, 22 bp, Homo sapiens
ttgaaacagtagctcatagacc

SEQ ID NO: 9258478 - DNA, 22 bp, Homo sapiens
ttgaaacagtagctcatagacc

SEQ ID NO: 9258479 - DNA, 22 bp, Homo sapiens
ttgaaacagacaagtaaatgtc

SEQ ID NO: 9258480 - DNA, 22 bp, Homo sapiens
ttgaaaatggtaagcatgatat

SEQ ID NO: 9258481 - DNA, 20 bp, Homo sapiens
ttgaaaatgcattgtgcagt

SEQ ID NO: 9258482 - DNA, 20 bp, Homo sapiens
ttgaaaatgcattgtgcagt

SEQ ID NO: 9258483 - DNA, 22 bp, Homo sapiens
ttgaaaatatcacaggagcagc

SEQ ID NO: 9258484 - DNA, 22 bp, Homo sapiens
ttgacatcaaatagatatcttt

SEQ ID NO: 9258485 - DNA, 22 bp, Homo sapiens
ttgaccactgaatggttctgaa

SEQ ID NO: 9258486 - DNA, 22 bp, Homo sapiens
ttgaccatacctccaggcagtt

SEQ ID NO: 9258487 - DNA, 22 bp, Homo sapiens
ttgaaaggaatacagaggccta

SEQ ID NO: 9258488 - DNA, 23 bp, Homo sapiens
ttgacagtaggtggttttcattg

SEQ ID NO: 9258489 - DNA, 19 bp, Homo sapiens
ttgaaagattagctttcta

SEQ ID NO: 9258490 - DNA, 19 bp, Homo sapiens
ttgaaagattagctttcta

SEQ ID NO: 9258491 - DNA, 22 bp, Homo sapiens
ttgaaactcatcttagtgatgt

SEQ ID NO: 9258492 - DNA, 22 bp, Homo sapiens
ttgaaacattctcctattgatt

SEQ ID NO: 9258493 - DNA, 22 bp, Homo sapiens
ttgaaactttagtaaactaagg

SEQ ID NO: 9258494 - DNA, 22 bp, Homo sapiens
ttgaaactgggaagcagggggt

SEQ ID NO: 9258495 - DNA, 22 bp, Homo sapiens
ttgaaagacattatttatatat

SEQ ID NO: 9258496 - DNA, 22 bp, Homo sapiens
ttgaaagaactcttcagagata

SEQ ID NO: 9258497 - DNA, 22 bp, Homo sapiens
ttgaggcccggcaggccgagcg

SEQ ID NO: 9258498 - DNA, 22 bp, Homo sapiens
ttgaggccccatggatgagaac

SEQ ID NO: 9258499 - DNA, 22 bp, Homo sapiens
ttgaggccccatggatgagaac

SEQ ID NO: 9258500 - DNA, 22 bp, Homo sapiens
ttgaggcctgctggaaggtgtt

SEQ ID NO: 9258501 - DNA, 22 bp, Homo sapiens
ttgaggccccatggatgagaac

SEQ ID NO: 9258502 - DNA, 22 bp, Homo sapiens
ttgagggaacatgagaatcatc

SEQ ID NO: 9258503 - DNA, 22 bp, Homo sapiens
ttgagggacagaggtgctgtct

SEQ ID NO: 9258504 - DNA, 22 bp, Homo sapiens
ttgagaggatggattagacaaa

SEQ ID NO: 9258505 - DNA, 22 bp, Homo sapiens
ttgagagtgccaagcatcctcc

SEQ ID NO: 9258506 - DNA, 22 bp, Homo sapiens
ttgagggtctggatctgctgct

SEQ ID NO: 9258507 - DNA, 19 bp, Homo sapiens
ttgaggggccaggggagat

SEQ ID NO: 9258508 - DNA, 18 bp, Homo sapiens
ttgagggaggggcagagt

SEQ ID NO: 9258509 - DNA, 18 bp, Homo sapiens
ttgagggaggggcagagt

SEQ ID NO: 9258510 - DNA, 22 bp, Homo sapiens
ttgagggtctggatctgctgct

SEQ ID NO: 9258511 - DNA, 22 bp, Homo sapiens
ttgaggtaataaacagccattc

SEQ ID NO: 9258512 - DNA, 22 bp, Homo sapiens
ttgaggtagttctattgtgagt

SEQ ID NO: 9258513 - DNA, 22 bp, Homo sapiens
ttgaggtatattcacatatatc

SEQ ID NO: 9258514 - DNA, 19 bp, Homo sapiens
ttgagaaagttgatttggg

SEQ ID NO: 9258515 - DNA, 22 bp, Homo sapiens
ttgagaaggtggtcatttgcaa

SEQ ID NO: 9258516 - DNA, 22 bp, Homo sapiens
ttgagaatgatgagattcttcc

SEQ ID NO: 9258517 - DNA, 22 bp, Homo sapiens
ttgagaagaggctttgtaggaa

SEQ ID NO: 9258518 - DNA, 19 bp, Homo sapiens
ttgagaattatctgagtca

SEQ ID NO: 9258519 - DNA, 22 bp, Homo sapiens
ttgagaatgtgttttgctaagt

SEQ ID NO: 9258520 - DNA, 22 bp, Homo sapiens
agcatagatacattgagccaca

SEQ ID NO: 9258521 - DNA, 22 bp, Homo sapiens
agcatataaatggacatatttg

SEQ ID NO: 9258522 - DNA, 22 bp, Homo sapiens
agccacagtctgtagccagctt

SEQ ID NO: 9258523 - DNA, 22 bp, Homo sapiens
agccacagtctgtagccagctt

SEQ ID NO: 9258524 - DNA, 22 bp, Homo sapiens
agccacagtctgtagccagctt

SEQ ID NO: 9258525 - DNA, 22 bp, Homo sapiens
agccacaggaaacagagacagc

SEQ ID NO: 9258526 - DNA, 22 bp, Homo sapiens
agccacagtgcaagagagaaaa

SEQ ID NO: 9258527 - DNA, 22 bp, Homo sapiens
agccacagtgggctaccagctc

SEQ ID NO: 9258528 - DNA, 22 bp, Homo sapiens
agccacagtgggctaccagctc

SEQ ID NO: 9258529 - DNA, 22 bp, Homo sapiens
agccaccaccactgaaaggtta

SEQ ID NO: 9258530 - DNA, 22 bp, Homo sapiens
agccaccaccactgaaaggtta

SEQ ID NO: 9258531 - DNA, 22 bp, Homo sapiens
agccactccttcagcgtctgct

SEQ ID NO: 9258532 - DNA, 22 bp, Homo sapiens
cagaataccctatagacagaat

SEQ ID NO: 9258533 - DNA, 22 bp, Homo sapiens
cagaaatatttattgagtgaca

SEQ ID NO: 9258534 - DNA, 22 bp, Homo sapiens
cagaaatatcagttgaaagtgc

SEQ ID NO: 9258535 - DNA, 22 bp, Homo sapiens
cagaaatatcacctggactcta

SEQ ID NO: 9258536 - DNA, 22 bp, Homo sapiens
cagaaatatcagttgaaagtgc

SEQ ID NO: 9258537 - DNA, 22 bp, Homo sapiens
agccactggcctgggcagctct

SEQ ID NO: 9258538 - DNA, 19 bp, Homo sapiens
cagaaatagcgaagtgtaa

SEQ ID NO: 9258539 - DNA, 22 bp, Homo sapiens
cagacagtggacttgataaagg

SEQ ID NO: 9258540 - DNA, 22 bp, Homo sapiens
cagacaggtagggacagaacat

SEQ ID NO: 9258541 - DNA, 22 bp, Homo sapiens
cagacaggtagggacagaacat

SEQ ID NO: 9258542 - DNA, 22 bp, Homo sapiens
cagacatgatgtaagcagaggc

SEQ ID NO: 9258543 - DNA, 22 bp, Homo sapiens
agccagacatggctcctgctcc

SEQ ID NO: 9258544 - DNA, 22 bp, Homo sapiens
agccagacatggctcctgctcc

SEQ ID NO: 9258545 - DNA, 20 bp, Homo sapiens
agccagaagaaggctggaga

SEQ ID NO: 9258546 - DNA, 22 bp, Homo sapiens
agccagagaacagcaggaaatg

SEQ ID NO: 9258547 - DNA, 22 bp, Homo sapiens
cagacagggtgggtttctgggc

SEQ ID NO: 9258548 - DNA, 22 bp, Homo sapiens
cagacagggttttggtctttgg

SEQ ID NO: 9258549 - DNA, 22 bp, Homo sapiens
agccagagagccccaggttcta

SEQ ID NO: 9258550 - DNA, 22 bp, Homo sapiens
agccagagactttacctgtgca

SEQ ID NO: 9258551 - DNA, 22 bp, Homo sapiens
cagacaggaagttcagaagaaa

SEQ ID NO: 9258552 - DNA, 22 bp, Homo sapiens
agccactgtgagaggaccaggg

SEQ ID NO: 9258553 - DNA, 19 bp, Homo sapiens
agccagaactagtgtttct

SEQ ID NO: 9258554 - DNA, 22 bp, Homo sapiens
agccactgtgtgaccagctgtc

SEQ ID NO: 9258555 - DNA, 22 bp, Homo sapiens
agccactgtgcaggagcagtgt

SEQ ID NO: 9258556 - DNA, 22 bp, Homo sapiens
cagaatcagtgacacatgtata

SEQ ID NO: 9258557 - DNA, 22 bp, Homo sapiens
cagaatgagtagcatcttcacc

SEQ ID NO: 9258558 - DNA, 22 bp, Homo sapiens
cagaatgagataacccagattg

SEQ ID NO: 9258559 - DNA, 22 bp, Homo sapiens
agcccagcactgggggcccagc

SEQ ID NO: 9258560 - DNA, 22 bp, Homo sapiens
agcccagcagaaagtccagcct

SEQ ID NO: 9258561 - DNA, 23 bp, Homo sapiens
agcccagcagagaacctaggtcc

SEQ ID NO: 9258562 - DNA, 23 bp, Homo sapiens
agcccagcagagaacctaggtcc

SEQ ID NO: 9258563 - DNA, 22 bp, Homo sapiens
agcccaaggcttccctgctggc

SEQ ID NO: 9258564 - DNA, 22 bp, Homo sapiens
agcccagagacaatgctcagta

SEQ ID NO: 9258565 - DNA, 22 bp, Homo sapiens
agcccagaggctgggcgtgcat

SEQ ID NO: 9258566 - DNA, 22 bp, Homo sapiens
cagagaaagaagcccattcatt

SEQ ID NO: 9258567 - DNA, 22 bp, Homo sapiens
cagagaaactcagatagctgat

SEQ ID NO: 9258568 - DNA, 22 bp, Homo sapiens
cagagaaaaaatcctgctctca

SEQ ID NO: 9258569 - DNA, 22 bp, Homo sapiens
cagagaaaaaatcctgctctca

SEQ ID NO: 9258570 - DNA, 22 bp, Homo sapiens
cagagaaactcagatagctgat

SEQ ID NO: 9258571 - DNA, 22 bp, Homo sapiens
cagactttctggaagctaaaaa

SEQ ID NO: 9258572 - DNA, 22 bp, Homo sapiens
cagactttcaaggagtgaaggc

SEQ ID NO: 9258573 - DNA, 22 bp, Homo sapiens
cagacttttgggaggtctgtgg

SEQ ID NO: 9258574 - DNA, 22 bp, Homo sapiens
cagagaaagaagcccattcatt

SEQ ID NO: 9258575 - DNA, 22 bp, Homo sapiens
cagagaaagacttgcccttagt

SEQ ID NO: 9258576 - DNA, 22 bp, Homo sapiens
cagagaaagggtgaattccttc

SEQ ID NO: 9258577 - DNA, 22 bp, Homo sapiens
cagagaaagggtgaattccttc

SEQ ID NO: 9258578 - DNA, 22 bp, Homo sapiens
cagagaaagggtgaattccttc

SEQ ID NO: 9258579 - DNA, 22 bp, Homo sapiens
agcccaagctatgaggtgacct

SEQ ID NO: 9258580 - DNA, 21 bp, Homo sapiens
cagaggcaggctctgtgtgtg

SEQ ID NO: 9258581 - DNA, 22 bp, Homo sapiens
cagaggagttcagtacacagcc

SEQ ID NO: 9258582 - DNA, 21 bp, Homo sapiens
cagaggcaggtcctgggacgg

SEQ ID NO: 9258583 - DNA, 21 bp, Homo sapiens
cagaggcaggtcctgggacgg

SEQ ID NO: 9258584 - DNA, 22 bp, Homo sapiens
cagaggcagtggggttgctcct

SEQ ID NO: 9258585 - DNA, 22 bp, Homo sapiens
cagaggcatactcccagtcttg

SEQ ID NO: 9258586 - DNA, 22 bp, Homo sapiens
cagaggcagtggggttgctcct

SEQ ID NO: 9258587 - DNA, 22 bp, Homo sapiens
cagaggcattactgaaaaggtg

SEQ ID NO: 9258588 - DNA, 20 bp, Homo sapiens
cagaggcattttcagactct

SEQ ID NO: 9258589 - DNA, 22 bp, Homo sapiens
agcccaggcagagggatgcttg

SEQ ID NO: 9258590 - DNA, 23 bp, Homo sapiens
cagaggcatcggattcaacatca

SEQ ID NO: 9258591 - DNA, 23 bp, Homo sapiens
cagaggcatcggattcaacatca

SEQ ID NO: 9258592 - DNA, 22 bp, Homo sapiens
agcccaggctggagtgcagtgg

SEQ ID NO: 9258593 - DNA, 20 bp, Homo sapiens
agcccaggcctgtgtgagtc

SEQ ID NO: 9258594 - DNA, 22 bp, Homo sapiens
agcccaggctggagtgcagtgg

SEQ ID NO: 9258595 - DNA, 22 bp, Homo sapiens
agcccaggctggagtgcagtgg

SEQ ID NO: 9258596 - DNA, 22 bp, Homo sapiens
agcccagggaaccaggaagtgg

SEQ ID NO: 9258597 - DNA, 22 bp, Homo sapiens
cagagggaccagaacatactgt

SEQ ID NO: 9258598 - DNA, 22 bp, Homo sapiens
cagagggagccctccaggagca

SEQ ID NO: 9258599 - DNA, 22 bp, Homo sapiens
agcccagggaaccaggaagtgg

SEQ ID NO: 9258600 - DNA, 22 bp, Homo sapiens
agcccagggaaccaggaagtgg

SEQ ID NO: 9258601 - DNA, 22 bp, Homo sapiens
cagaggctgacaaaatattgct

SEQ ID NO: 9258602 - DNA, 22 bp, Homo sapiens
agctcagagataatcaagagac

SEQ ID NO: 9258603 - DNA, 22 bp, Homo sapiens
agctcagagataatcaagagac

SEQ ID NO: 9258604 - DNA, 21 bp, Homo sapiens
agctcagccgggcacagtggc

SEQ ID NO: 9258605 - DNA, 22 bp, Homo sapiens
cagctcaggctctccatgctcc

SEQ ID NO: 9258606 - DNA, 22 bp, Homo sapiens
cagctcaggctctccatgctcc

SEQ ID NO: 9258607 - DNA, 22 bp, Homo sapiens
cagctcaggcactggcgcggga

SEQ ID NO: 9258608 - DNA, 22 bp, Homo sapiens
cagctcaggcactggcgcggga

SEQ ID NO: 9258609 - DNA, 19 bp, Homo sapiens
cagctcaggactcagcccc

SEQ ID NO: 9258610 - DNA, 19 bp, Homo sapiens
cagctcaggactcagcccc

SEQ ID NO: 9258611 - DNA, 22 bp, Homo sapiens
agctcaggcaactctgggcccc

SEQ ID NO: 9258612 - DNA, 22 bp, Homo sapiens
agctcaggcaactctgggcccc

SEQ ID NO: 9258613 - DNA, 22 bp, Homo sapiens
cagctcaggaaggaaggccggc

SEQ ID NO: 9258614 - DNA, 22 bp, Homo sapiens
cagctcaggaaggaaggccggc

SEQ ID NO: 9258615 - DNA, 22 bp, Homo sapiens
cagctcaggaaggaaggccggc

SEQ ID NO: 9258616 - DNA, 20 bp, Homo sapiens
agctcctgagggttactttc

SEQ ID NO: 9258617 - DNA, 22 bp, Homo sapiens
agctcctgagtagctttactca

SEQ ID NO: 9258618 - DNA, 20 bp, Homo sapiens
agctcctgagggttactttc

SEQ ID NO: 9258619 - DNA, 23 bp, Homo sapiens
agctcctgaggccagcctctcct

SEQ ID NO: 9258620 - DNA, 22 bp, Homo sapiens
agctcctgatacatgcaggaat

SEQ ID NO: 9258621 - DNA, 22 bp, Homo sapiens
agctcctgatacatgcaggaat

SEQ ID NO: 9258622 - DNA, 22 bp, Homo sapiens
cagctctgagactgaggctatg

SEQ ID NO: 9258623 - DNA, 18 bp, Homo sapiens
agctcctgaactctgtgg

SEQ ID NO: 9258624 - DNA, 18 bp, Homo sapiens
agctcctgaactctgtgg

SEQ ID NO: 9258625 - DNA, 22 bp, Homo sapiens
agctcctgaaaatccagactgg

SEQ ID NO: 9258626 - DNA, 22 bp, Homo sapiens
agctcctgaaaagcgcttgctt

SEQ ID NO: 9258627 - DNA, 22 bp, Homo sapiens
cagctcagtgatgccttcacag

SEQ ID NO: 9258628 - DNA, 22 bp, Homo sapiens
cagctcagtgatgccttcacag

SEQ ID NO: 9258629 - DNA, 22 bp, Homo sapiens
cagctcagtttcaataccaggt

SEQ ID NO: 9258630 - DNA, 22 bp, Homo sapiens
cagctcagtcttgaagcactgg

SEQ ID NO: 9258631 - DNA, 22 bp, Homo sapiens
cagctcagtctggagagatgca

SEQ ID NO: 9258632 - DNA, 20 bp, Homo sapiens
cagcatagcggctcacatcc

SEQ ID NO: 9258633 - DNA, 22 bp, Homo sapiens
cagcagttatgagtagaatagt

SEQ ID NO: 9258634 - DNA, 22 bp, Homo sapiens
cagcagtgtctccagcatcaca

SEQ ID NO: 9258635 - DNA, 22 bp, Homo sapiens
cagcagtgtgcaggtgtgctgg

SEQ ID NO: 9258636 - DNA, 22 bp, Homo sapiens
cagcagtgtctccagcatcaca

SEQ ID NO: 9258637 - DNA, 22 bp, Homo sapiens
cagcagggttaagtgactcacc

SEQ ID NO: 9258638 - DNA, 22 bp, Homo sapiens
cagcaggggtgtcattgtagtt

SEQ ID NO: 9258639 - DNA, 22 bp, Homo sapiens
cagcagggtaggttgtatcagt

SEQ ID NO: 9258640 - DNA, 22 bp, Homo sapiens
cagcaggggaactgtgggccag

SEQ ID NO: 9258641 - DNA, 22 bp, Homo sapiens
cagcagggggcagcgcagatca

SEQ ID NO: 9258642 - DNA, 22 bp, Homo sapiens
cagccctgcacgctgcctccgc

SEQ ID NO: 9258643 - DNA, 22 bp, Homo sapiens
cagccctgagagaaccatctat

SEQ ID NO: 9258644 - DNA, 22 bp, Homo sapiens
agcctggcactgaggcagggcg

SEQ ID NO: 9258645 - DNA, 23 bp, Homo sapiens
agcctggcacctgcagatcggag

SEQ ID NO: 9258646 - DNA, 22 bp, Homo sapiens
cagcagggcccccgggtgcgcc

SEQ ID NO: 9258647 - DNA, 22 bp, Homo sapiens
cagcaggggaactgtgggccag

SEQ ID NO: 9258648 - DNA, 22 bp, Homo sapiens
cagcagggcccccgggtgcgcc

SEQ ID NO: 9258649 - DNA, 22 bp, Homo sapiens
cagcagggcccccgggtgcgcc

SEQ ID NO: 9258650 - DNA, 23 bp, Homo sapiens
agcctggcacctgcagatcggag

SEQ ID NO: 9258651 - DNA, 22 bp, Homo sapiens
agcctggattcgtgcatccaca

SEQ ID NO: 9258652 - DNA, 22 bp, Homo sapiens
agcctggatcctaggctcagct

SEQ ID NO: 9258653 - DNA, 22 bp, Homo sapiens
agcctggatcctaggctcagct

SEQ ID NO: 9258654 - DNA, 22 bp, Homo sapiens
agcctggattcgtgcatccaca

SEQ ID NO: 9258655 - DNA, 22 bp, Homo sapiens
agcctggatcctaggctcagct

SEQ ID NO: 9258656 - DNA, 22 bp, Homo sapiens
agcctggagttcccaggagaag

SEQ ID NO: 9258657 - DNA, 22 bp, Homo sapiens
agcctggatccatgtggctacc

SEQ ID NO: 9258658 - DNA, 22 bp, Homo sapiens
agcctggaggtaatgaggaaac

SEQ ID NO: 9258659 - DNA, 22 bp, Homo sapiens
cagcagctcaggctgcttccca

SEQ ID NO: 9258660 - DNA, 22 bp, Homo sapiens
cagcagctcagtctctcagtag

SEQ ID NO: 9258661 - DNA, 22 bp, Homo sapiens
cagcagctcccatccgctgagc

SEQ ID NO: 9258662 - DNA, 22 bp, Homo sapiens
cagcagctcagtctctcagtag

SEQ ID NO: 9258663 - DNA, 22 bp, Homo sapiens
cagcagctcagtctctcagtag

SEQ ID NO: 9258664 - DNA, 22 bp, Homo sapiens
cagcagctcactcaggtggctc

SEQ ID NO: 9258665 - DNA, 22 bp, Homo sapiens
agcctgagctgcctgccgcctc

SEQ ID NO: 9258666 - DNA, 22 bp, Homo sapiens
cagcagcattgctctggattcc

SEQ ID NO: 9258667 - DNA, 22 bp, Homo sapiens
agcctgagagccaagctgtgca

SEQ ID NO: 9258668 - DNA, 22 bp, Homo sapiens
agcctgagccccatccagctga

SEQ ID NO: 9258669 - DNA, 22 bp, Homo sapiens
agcctgagccccatccagctga

SEQ ID NO: 9258670 - DNA, 23 bp, Homo sapiens
agcctcttttctcctgccctgca

SEQ ID NO: 9258671 - DNA, 22 bp, Homo sapiens
agcctctgggggagctgggagc

SEQ ID NO: 9258672 - DNA, 22 bp, Homo sapiens
agcctctgtcaagcttttcaaa

SEQ ID NO: 9258673 - DNA, 22 bp, Homo sapiens
agcctctgtcaagcttttcaaa

SEQ ID NO: 9258674 - DNA, 22 bp, Homo sapiens
agcctctgatggctcccaagga

SEQ ID NO: 9258675 - DNA, 22 bp, Homo sapiens
agcctctgcacgggcacgggtg

SEQ ID NO: 9258676 - DNA, 22 bp, Homo sapiens
agcctctgctggccctggcact

SEQ ID NO: 9258677 - DNA, 22 bp, Homo sapiens
cagaggtcaggttggacattat

SEQ ID NO: 9258678 - DNA, 22 bp, Homo sapiens
cagaggtattttgataaacgcc

SEQ ID NO: 9258679 - DNA, 22 bp, Homo sapiens
cagaggtcaagatctgaagtga

SEQ ID NO: 9258680 - DNA, 22 bp, Homo sapiens
cagaggtattgcaaaagcctag

SEQ ID NO: 9258681 - DNA, 22 bp, Homo sapiens
cagagggccccctggccacagt

SEQ ID NO: 9258682 - DNA, 22 bp, Homo sapiens
cagagggatcatcttcctgaag

SEQ ID NO: 9258683 - DNA, 22 bp, Homo sapiens
cagagggcactcggagtgacat

SEQ ID NO: 9258684 - DNA, 22 bp, Homo sapiens
cagagggcactcggagtgacat

SEQ ID NO: 9258685 - DNA, 21 bp, Homo sapiens
cagaggtcatcctgaggacaa

SEQ ID NO: 9258686 - DNA, 22 bp, Homo sapiens
cagaggtctgacactgaatggt

SEQ ID NO: 9258687 - DNA, 22 bp, Homo sapiens
caacagagagaccagaaacagg

SEQ ID NO: 9258688 - DNA, 22 bp, Homo sapiens
caacagaaggtgtactactgaa

SEQ ID NO: 9258689 - DNA, 22 bp, Homo sapiens
caacagctttagaaacactttc

SEQ ID NO: 9258690 - DNA, 22 bp, Homo sapiens
caacagctgatctttgatgaag

SEQ ID NO: 9258691 - DNA, 22 bp, Homo sapiens
caacagctcagacacgggacct

SEQ ID NO: 9258692 - DNA, 23 bp, Homo sapiens
caacagctgttagatatgggctt

SEQ ID NO: 9258693 - DNA, 22 bp, Homo sapiens
caacagctggaggcttggcccg

SEQ ID NO: 9258694 - DNA, 22 bp, Homo sapiens
caaatattccaggtacatccct

SEQ ID NO: 9258695 - DNA, 22 bp, Homo sapiens
caaatatctttggcaaagagaa

SEQ ID NO: 9258696 - DNA, 22 bp, Homo sapiens
caaatatctttggcaaagagaa

SEQ ID NO: 9258697 - DNA, 22 bp, Homo sapiens
caaattaccctcaacatctaga

SEQ ID NO: 9258698 - DNA, 20 bp, Homo sapiens
caacactgcccattgtttgc

SEQ ID NO: 9258699 - DNA, 16 bp, Homo sapiens
agcaccagatcatatc

SEQ ID NO: 9258700 - DNA, 22 bp, Homo sapiens
agcaccagagctatgggcctgc

SEQ ID NO: 9258701 - DNA, 22 bp, Homo sapiens
agcaccagagctatgggcctgc

SEQ ID NO: 9258702 - DNA, 22 bp, Homo sapiens
agcaccagagctatgggcctgc

SEQ ID NO: 9258703 - DNA, 22 bp, Homo sapiens
agcacattttatttaagaaaat

SEQ ID NO: 9258704 - DNA, 22 bp, Homo sapiens
agcacattgatttattttggag

SEQ ID NO: 9258705 - DNA, 22 bp, Homo sapiens
agcaccaggaaagaaggggcca

SEQ ID NO: 9258706 - DNA, 23 bp, Homo sapiens
agcaccaggaacagtgtggtcct

SEQ ID NO: 9258707 - DNA, 22 bp, Homo sapiens
agcaccaggatattgttggaga

SEQ ID NO: 9258708 - DNA, 22 bp, Homo sapiens
agcaccaggcaccaaagggcct

SEQ ID NO: 9258709 - DNA, 22 bp, Homo sapiens
agcaccagctcaaggtgcacct

SEQ ID NO: 9258710 - DNA, 22 bp, Homo sapiens
agcaccagcgtgggggccgttg

SEQ ID NO: 9258711 - DNA, 22 bp, Homo sapiens
agcaccagcaactatgggctgc

SEQ ID NO: 9258712 - DNA, 22 bp, Homo sapiens
agcaccagcaactatgggctgc

SEQ ID NO: 9258713 - DNA, 22 bp, Homo sapiens
caagacctcaaaatgagagggg

SEQ ID NO: 9258714 - DNA, 22 bp, Homo sapiens
caagacattgattttgtacaga

SEQ ID NO: 9258715 - DNA, 22 bp, Homo sapiens
agcaccaggctgttggaagccc

SEQ ID NO: 9258716 - DNA, 22 bp, Homo sapiens
agcaccaggtcgctggcacgct

SEQ ID NO: 9258717 - DNA, 22 bp, Homo sapiens
agcaccaggcagtatatcaaag

SEQ ID NO: 9258718 - DNA, 22 bp, Homo sapiens
agcaccaggccatggggtccct

SEQ ID NO: 9258719 - DNA, 22 bp, Homo sapiens
caacttggctctctggctatcc

SEQ ID NO: 9258720 - DNA, 22 bp, Homo sapiens
agcacatgacttttagtcgagt

SEQ ID NO: 9258721 - DNA, 22 bp, Homo sapiens
agcacatattcagttcatacaa

SEQ ID NO: 9258722 - DNA, 22 bp, Homo sapiens
agcacatgcacagtgctacact

SEQ ID NO: 9258723 - DNA, 22 bp, Homo sapiens
caaatagacttcaatctcttga

SEQ ID NO: 9258724 - DNA, 22 bp, Homo sapiens
agcacatgcacagtgctacact

SEQ ID NO: 9258725 - DNA, 22 bp, Homo sapiens
caaatagtatgagcaatgattc

SEQ ID NO: 9258726 - DNA, 22 bp, Homo sapiens
caaatagtgaaacagatggggg

SEQ ID NO: 9258727 - DNA, 22 bp, Homo sapiens
caaatagattgttcaatcctga

SEQ ID NO: 9258728 - DNA, 22 bp, Homo sapiens
caaatagattgttcaatcctga

SEQ ID NO: 9258729 - DNA, 22 bp, Homo sapiens
caaatagattgttcaatcctga

SEQ ID NO: 9258730 - DNA, 22 bp, Homo sapiens
caaatagattgttcaatcctga

SEQ ID NO: 9258731 - DNA, 22 bp, Homo sapiens
agcacagtaaagcagtgtcaca

SEQ ID NO: 9258732 - DNA, 22 bp, Homo sapiens
agcacaggtgaaacagtcaggt

SEQ ID NO: 9258733 - DNA, 22 bp, Homo sapiens
agcacaggtgaaacagtcaggt

SEQ ID NO: 9258734 - DNA, 22 bp, Homo sapiens
agcacaggtgaaacagtcaggt

SEQ ID NO: 9258735 - DNA, 22 bp, Homo sapiens
agcacagtgctctggacagagt

SEQ ID NO: 9258736 - DNA, 22 bp, Homo sapiens
agcaaagcagtggctaagctga

SEQ ID NO: 9258737 - DNA, 22 bp, Homo sapiens
agcaaagatgtccggggcaagc

SEQ ID NO: 9258738 - DNA, 22 bp, Homo sapiens
agcaaagcaccatatggcagtt

SEQ ID NO: 9258739 - DNA, 22 bp, Homo sapiens
agcaaagctaccaattattgag

SEQ ID NO: 9258740 - DNA, 21 bp, Homo sapiens
agcacagctttaagccatgtg

SEQ ID NO: 9258741 - DNA, 22 bp, Homo sapiens
agcacaggtacggagatgctac

SEQ ID NO: 9258742 - DNA, 22 bp, Homo sapiens
agcaaactaattgcagttctgg

SEQ ID NO: 9258743 - DNA, 22 bp, Homo sapiens
agcaaagacagggacgaccaag

SEQ ID NO: 9258744 - DNA, 22 bp, Homo sapiens
agcaaagaaatggaggctcaga

SEQ ID NO: 9258745 - DNA, 22 bp, Homo sapiens
agcaaagaagacacaggcttca

SEQ ID NO: 9258746 - DNA, 22 bp, Homo sapiens
agcaaagaagacacaggcttca

SEQ ID NO: 9258747 - DNA, 22 bp, Homo sapiens
agcagctcccctcatgctccac

SEQ ID NO: 9258748 - DNA, 22 bp, Homo sapiens
agcagctccctcctcagccacc

SEQ ID NO: 9258749 - DNA, 22 bp, Homo sapiens
agcagctgagccccagctgtga

SEQ ID NO: 9258750 - DNA, 22 bp, Homo sapiens
agcagccagaaagggcagtcga

SEQ ID NO: 9258751 - DNA, 22 bp, Homo sapiens
agcagccagaaatccagaggtg

SEQ ID NO: 9258752 - DNA, 22 bp, Homo sapiens
agcagccacacgcctccttctc

SEQ ID NO: 9258753 - DNA, 22 bp, Homo sapiens
agcagccacccagctgctcatt

SEQ ID NO: 9258754 - DNA, 22 bp, Homo sapiens
agcagccacagtctgggacagg

SEQ ID NO: 9258755 - DNA, 22 bp, Homo sapiens
agcagccaaggtaacctgtgct

SEQ ID NO: 9258756 - DNA, 22 bp, Homo sapiens
cacaaggactggatggagtggg

SEQ ID NO: 9258757 - DNA, 22 bp, Homo sapiens
cacaaggaggtcctgaggaagc

SEQ ID NO: 9258758 - DNA, 22 bp, Homo sapiens
cacaagatggtcacataagtgc

SEQ ID NO: 9258759 - DNA, 22 bp, Homo sapiens
cacaagatggtttccagatgct

SEQ ID NO: 9258760 - DNA, 22 bp, Homo sapiens
cacaagatggtcacataagtgc

SEQ ID NO: 9258761 - DNA, 22 bp, Homo sapiens
agcagcagggacaaaggaacag

SEQ ID NO: 9258762 - DNA, 22 bp, Homo sapiens
agcagcagggcatgtcttactc

SEQ ID NO: 9258763 - DNA, 22 bp, Homo sapiens
agcagcaggcttaaggaaaagt

SEQ ID NO: 9258764 - DNA, 22 bp, Homo sapiens
agcagcaggcttaaggaaaagt

SEQ ID NO: 9258765 - DNA, 22 bp, Homo sapiens
caatttttgtacttatagtact

SEQ ID NO: 9258766 - DNA, 22 bp, Homo sapiens
caatttttgtacttatagtact

SEQ ID NO: 9258767 - DNA, 22 bp, Homo sapiens
cacaagagagtgcgcgttgcaa

SEQ ID NO: 9258768 - DNA, 22 bp, Homo sapiens
caattttttccatgctcttaca

SEQ ID NO: 9258769 - DNA, 22 bp, Homo sapiens
caattttttccatgctcttaca

SEQ ID NO: 9258770 - DNA, 22 bp, Homo sapiens
cacaagaaataagctgcctttc

SEQ ID NO: 9258771 - DNA, 22 bp, Homo sapiens
caagagctagactttgtcagga

SEQ ID NO: 9258772 - DNA, 22 bp, Homo sapiens
caagatttagcctgctgcctgt

SEQ ID NO: 9258773 - DNA, 22 bp, Homo sapiens
caagatttatattttcacacaa

SEQ ID NO: 9258774 - DNA, 22 bp, Homo sapiens
caagagcatttagttagctggt

SEQ ID NO: 9258775 - DNA, 22 bp, Homo sapiens
caagagacttatgtggaaacct

SEQ ID NO: 9258776 - DNA, 17 bp, Homo sapiens
caagagagatgactgga

SEQ ID NO: 9258777 - DNA, 17 bp, Homo sapiens
caagagagatgactgga

SEQ ID NO: 9258778 - DNA, 22 bp, Homo sapiens
caagcaatattttagaaaggta

SEQ ID NO: 9258779 - DNA, 22 bp, Homo sapiens
caagcaatgccctggtatatta

SEQ ID NO: 9258780 - DNA, 22 bp, Homo sapiens
caagcaatgctatactcattat

SEQ ID NO: 9258781 - DNA, 22 bp, Homo sapiens
caagcaatgctatactcattat

SEQ ID NO: 9258782 - DNA, 22 bp, Homo sapiens
caagcagacagtaggcctagaa

SEQ ID NO: 9258783 - DNA, 22 bp, Homo sapiens
caagatttgggggcacggaatc

SEQ ID NO: 9258784 - DNA, 19 bp, Homo sapiens
caagatttgttcacacatg

SEQ ID NO: 9258785 - DNA, 19 bp, Homo sapiens
caagatttgttcacacatg

SEQ ID NO: 9258786 - DNA, 22 bp, Homo sapiens
caagatttccaaccctgggtaa

SEQ ID NO: 9258787 - DNA, 22 bp, Homo sapiens
caagatttgacttcgtggtttg

SEQ ID NO: 9258788 - DNA, 22 bp, Homo sapiens
caagatttggcaactttgtcat

SEQ ID NO: 9258789 - DNA, 20 bp, Homo sapiens
agcagcagatgttggaggtg

SEQ ID NO: 9258790 - DNA, 22 bp, Homo sapiens
caagcagagactagatagctgt

SEQ ID NO: 9258791 - DNA, 22 bp, Homo sapiens
agcagcaggctgtgtggactga

SEQ ID NO: 9258792 - DNA, 22 bp, Homo sapiens
agcagcaggctgtgtggactga

SEQ ID NO: 9258793 - DNA, 22 bp, Homo sapiens
agcagcaggctagggaactgct

SEQ ID NO: 9258794 - DNA, 22 bp, Homo sapiens
agcaggagtttgatgcttttat

SEQ ID NO: 9258795 - DNA, 22 bp, Homo sapiens
cacacactgacaccttatcttg

SEQ ID NO: 9258796 - DNA, 22 bp, Homo sapiens
cacacacagttttgtattctgt

SEQ ID NO: 9258797 - DNA, 22 bp, Homo sapiens
cacacacagttttgtattctgt

SEQ ID NO: 9258798 - DNA, 22 bp, Homo sapiens
agcaggcaccagggctcgtcct

SEQ ID NO: 9258799 - DNA, 22 bp, Homo sapiens
agcaggcacgctccctgcgcga

SEQ ID NO: 9258800 - DNA, 17 bp, Homo sapiens
agcaggcacgtcagcac

SEQ ID NO: 9258801 - DNA, 21 bp, Homo sapiens
agcaggcaaaggtgaagtctt

SEQ ID NO: 9258802 - DNA, 22 bp, Homo sapiens
agcagctgcagggagggtctgc

SEQ ID NO: 9258803 - DNA, 22 bp, Homo sapiens
agcagctgcagagggctccccc

SEQ ID NO: 9258804 - DNA, 22 bp, Homo sapiens
agcagctgatggggaaggagtt

SEQ ID NO: 9258805 - DNA, 22 bp, Homo sapiens
agcagctgatcaaagcacttat

SEQ ID NO: 9258806 - DNA, 22 bp, Homo sapiens
cacaattttcctttaagtgtat

SEQ ID NO: 9258807 - DNA, 22 bp, Homo sapiens
agcagctgccactggaatagga

SEQ ID NO: 9258808 - DNA, 21 bp, Homo sapiens
agcagctgcagtttctatctg

SEQ ID NO: 9258809 - DNA, 22 bp, Homo sapiens
agcaggctccttccttctctgg

SEQ ID NO: 9258810 - DNA, 22 bp, Homo sapiens
agcaggctccttccttctctgg

SEQ ID NO: 9258811 - DNA, 22 bp, Homo sapiens
agcaggctgatgggcatgcttg

SEQ ID NO: 9258812 - DNA, 22 bp, Homo sapiens
cacagtttctgaacactttgca

SEQ ID NO: 9258813 - DNA, 22 bp, Homo sapiens
agcaggcaggcccagcggctgg

SEQ ID NO: 9258814 - DNA, 22 bp, Homo sapiens
agcaggcaggaggctactaagg

SEQ ID NO: 9258815 - DNA, 22 bp, Homo sapiens
cacagtcccgtgcttaccatgt

SEQ ID NO: 9258816 - DNA, 22 bp, Homo sapiens
cacagtgtttgatttaggggcc

SEQ ID NO: 9258817 - DNA, 22 bp, Homo sapiens
cacagtcctgccagagggcctt

SEQ ID NO: 9258818 - DNA, 19 bp, Homo sapiens
cacagtcctatgtttatca

SEQ ID NO: 9258819 - DNA, 22 bp, Homo sapiens
agcaggcactatgccaggatct

SEQ ID NO: 9258820 - DNA, 22 bp, Homo sapiens
agcaggcaggaaggcagcactg

SEQ ID NO: 9258821 - DNA, 22 bp, Homo sapiens
agcaggcaggaaggcagcactg

SEQ ID NO: 9258822 - DNA, 22 bp, Homo sapiens
agcaggggtctctgctaatgaa

SEQ ID NO: 9258823 - DNA, 22 bp, Homo sapiens
agcaggggtggaaggtagcttt

SEQ ID NO: 9258824 - DNA, 22 bp, Homo sapiens
agcagggtcctgaggtgagtca

SEQ ID NO: 9258825 - DNA, 22 bp, Homo sapiens
agcagggttccaggagttgcag

SEQ ID NO: 9258826 - DNA, 22 bp, Homo sapiens
cacccaggctggagtgcagtgg

SEQ ID NO: 9258827 - DNA, 22 bp, Homo sapiens
cacccaggctggagtgcagtga

SEQ ID NO: 9258828 - DNA, 22 bp, Homo sapiens
cacccaggctggagtgcagtga

SEQ ID NO: 9258829 - DNA, 22 bp, Homo sapiens
cacccaggctggagtgcagtga

SEQ ID NO: 9258830 - DNA, 22 bp, Homo sapiens
cacccaggctggagtgcagggg

SEQ ID NO: 9258831 - DNA, 22 bp, Homo sapiens
cacccaggctggagtgcagggg

SEQ ID NO: 9258832 - DNA, 22 bp, Homo sapiens
cacccaggctggagagcagtgg

SEQ ID NO: 9258833 - DNA, 22 bp, Homo sapiens
cacccaggctggaatgcagtgg

SEQ ID NO: 9258834 - DNA, 22 bp, Homo sapiens
caccaggtggaaatgtcacagc

SEQ ID NO: 9258835 - DNA, 22 bp, Homo sapiens
caccaggtggaaatgtcacagc

SEQ ID NO: 9258836 - DNA, 22 bp, Homo sapiens
cacccaggctggagtgcagggg

SEQ ID NO: 9258837 - DNA, 22 bp, Homo sapiens
cacccaggctggagagcagtgg

SEQ ID NO: 9258838 - DNA, 22 bp, Homo sapiens
cacccaggctggagagcagtgg

SEQ ID NO: 9258839 - DNA, 22 bp, Homo sapiens
agcaggggtaacagaaggaaag

SEQ ID NO: 9258840 - DNA, 22 bp, Homo sapiens
agcaggggtaacagaaggaaag

SEQ ID NO: 9258841 - DNA, 22 bp, Homo sapiens
agcagggggccacagtcacagc

SEQ ID NO: 9258842 - DNA, 22 bp, Homo sapiens
agcagggggccacagtcacagc

SEQ ID NO: 9258843 - DNA, 22 bp, Homo sapiens
agcagggggagttagactagat

SEQ ID NO: 9258844 - DNA, 22 bp, Homo sapiens
agcagggggagttagactagat

SEQ ID NO: 9258845 - DNA, 22 bp, Homo sapiens
agcagggggcatccttgccctt

SEQ ID NO: 9258846 - DNA, 22 bp, Homo sapiens
agcaggggctcctccacagcca

SEQ ID NO: 9258847 - DNA, 22 bp, Homo sapiens
agcaggggctcctccacagcca

SEQ ID NO: 9258848 - DNA, 22 bp, Homo sapiens
agcaggggcagggttttgtgct

SEQ ID NO: 9258849 - DNA, 22 bp, Homo sapiens
agcaggggcagggttttgtgct

SEQ ID NO: 9258850 - DNA, 22 bp, Homo sapiens
agcaggctgccttccaaagcct

SEQ ID NO: 9258851 - DNA, 22 bp, Homo sapiens
cactgctcgctgcagcatggcc

SEQ ID NO: 9258852 - DNA, 22 bp, Homo sapiens
cactgcttagttggtaaatgtg

SEQ ID NO: 9258853 - DNA, 22 bp, Homo sapiens
cactgcttcagtcagagaaatt

SEQ ID NO: 9258854 - DNA, 22 bp, Homo sapiens
cactgctacctctgcctcccgg

SEQ ID NO: 9258855 - DNA, 22 bp, Homo sapiens
cactgctacctctgcctcccgg

SEQ ID NO: 9258856 - DNA, 22 bp, Homo sapiens
cactgctatgatgatgatattt

SEQ ID NO: 9258857 - DNA, 22 bp, Homo sapiens
cactgctattattagacaatgt

SEQ ID NO: 9258858 - DNA, 22 bp, Homo sapiens
cactgctacctctgcctcccgg

SEQ ID NO: 9258859 - DNA, 20 bp, Homo sapiens
agcatacatcataagaaacc

SEQ ID NO: 9258860 - DNA, 20 bp, Homo sapiens
agcatacatcataagaaacc

SEQ ID NO: 9258861 - DNA, 22 bp, Homo sapiens
agcatacaggtctgaaacagct

SEQ ID NO: 9258862 - DNA, 22 bp, Homo sapiens
agcatacaggtctgaaacagct

SEQ ID NO: 9258863 - DNA, 22 bp, Homo sapiens
cactgcttgattgacatgcacg

SEQ ID NO: 9258864 - DNA, 22 bp, Homo sapiens
cactgcttgcagtatgagtgga

SEQ ID NO: 9258865 - DNA, 22 bp, Homo sapiens
cactgcttgcagtatgagtgga

SEQ ID NO: 9258866 - DNA, 22 bp, Homo sapiens
agcatacaccctaaactgctta

SEQ ID NO: 9258867 - DNA, 22 bp, Homo sapiens
cacctctttgatttgaggcaag

SEQ ID NO: 9258868 - DNA, 20 bp, Homo sapiens
cacctctgaaagtttccagc

SEQ ID NO: 9258869 - DNA, 22 bp, Homo sapiens
cacctcaggcagcaaagtctca

SEQ ID NO: 9258870 - DNA, 22 bp, Homo sapiens
cactgcctgtgagctgtgtgcc

SEQ ID NO: 9258871 - DNA, 22 bp, Homo sapiens
cactgcctgtgagctgtgtgcc

SEQ ID NO: 9258872 - DNA, 22 bp, Homo sapiens
cacccaggctggagtgcattgg

SEQ ID NO: 9258873 - DNA, 22 bp, Homo sapiens
cacccaggctggagtgcagtgg

SEQ ID NO: 9258874 - DNA, 22 bp, Homo sapiens
cacccaggctggagtgcagtgg

SEQ ID NO: 9258875 - DNA, 22 bp, Homo sapiens
cacccaggctggattgcagtgg

SEQ ID NO: 9258876 - DNA, 22 bp, Homo sapiens
cacctagccttcttgtgcctct

SEQ ID NO: 9258877 - DNA, 22 bp, Homo sapiens
cacctagggcatccctgcccca

SEQ ID NO: 9258878 - DNA, 22 bp, Homo sapiens
caccgcggagtgatggagaaac

SEQ ID NO: 9258879 - DNA, 22 bp, Homo sapiens
agaggaggatttgtaaaggtct

SEQ ID NO: 9258880 - DNA, 22 bp, Homo sapiens
agaggaggatttgtaaaggtct

SEQ ID NO: 9258881 - DNA, 22 bp, Homo sapiens
agaggaggaagagctttaaaat

SEQ ID NO: 9258882 - DNA, 20 bp, Homo sapiens
agaggaggattattttattc

SEQ ID NO: 9258883 - DNA, 22 bp, Homo sapiens
agaggagaatccgtttccttgc

SEQ ID NO: 9258884 - DNA, 22 bp, Homo sapiens
agaggagctgggaggccctcgt

SEQ ID NO: 9258885 - DNA, 22 bp, Homo sapiens
agaggaggctctgggatcgtcc

SEQ ID NO: 9258886 - DNA, 22 bp, Homo sapiens
agaggaggctgggtccagataa

SEQ ID NO: 9258887 - DNA, 22 bp, Homo sapiens
attataggcttgagccaccgtg

SEQ ID NO: 9258888 - DNA, 22 bp, Homo sapiens
agaggaggccaggcccacacct

SEQ ID NO: 9258889 - DNA, 22 bp, Homo sapiens
agaggaggctctgggatcgtcc

SEQ ID NO: 9258890 - DNA, 22 bp, Homo sapiens
agaggaggcagcttaactcagt

SEQ ID NO: 9258891 - DNA, 22 bp, Homo sapiens
agaggaggcagcttaactcagt

SEQ ID NO: 9258892 - DNA, 22 bp, Homo sapiens
attattcaaattcccactatac

SEQ ID NO: 9258893 - DNA, 22 bp, Homo sapiens
attattatggttgctcttttcc

SEQ ID NO: 9258894 - DNA, 22 bp, Homo sapiens
attattatggttgctcttttcc

SEQ ID NO: 9258895 - DNA, 21 bp, Homo sapiens
attattatttctgtgtccagc

SEQ ID NO: 9258896 - DNA, 22 bp, Homo sapiens
attattattgttgatgttaggg

SEQ ID NO: 9258897 - DNA, 22 bp, Homo sapiens
attattattgttgatgttaggg

SEQ ID NO: 9258898 - DNA, 21 bp, Homo sapiens
attattatttctgtgtccagc

SEQ ID NO: 9258899 - DNA, 22 bp, Homo sapiens
attattattttagagagaggcc

SEQ ID NO: 9258900 - DNA, 22 bp, Homo sapiens
attattagacttatatggtagt

SEQ ID NO: 9258901 - DNA, 23 bp, Homo sapiens
attattaaggacatggactttgt

SEQ ID NO: 9258902 - DNA, 22 bp, Homo sapiens
attataggcttgagccaccgtg

SEQ ID NO: 9258903 - DNA, 21 bp, Homo sapiens
attattataaagaccacaggg

SEQ ID NO: 9258904 - DNA, 22 bp, Homo sapiens
attattatatagggaaagtccc

SEQ ID NO: 9258905 - DNA, 22 bp, Homo sapiens
attattatatagggaaagtccc

SEQ ID NO: 9258906 - DNA, 22 bp, Homo sapiens
attattataaagtgcatgacct

SEQ ID NO: 9258907 - DNA, 22 bp, Homo sapiens
attattagattcttaattgtaa

SEQ ID NO: 9258908 - DNA, 22 bp, Homo sapiens
attattaggtgctctctgacaa

SEQ ID NO: 9258909 - DNA, 22 bp, Homo sapiens
attattagtgatgttgttactg

SEQ ID NO: 9258910 - DNA, 22 bp, Homo sapiens
atgtttatggagcaggtattag

SEQ ID NO: 9258911 - DNA, 22 bp, Homo sapiens
agaggacaggttttccatgggc

SEQ ID NO: 9258912 - DNA, 22 bp, Homo sapiens
agaggacaggttttccatgggc

SEQ ID NO: 9258913 - DNA, 22 bp, Homo sapiens
agagctgtttggacatctgagt

SEQ ID NO: 9258914 - DNA, 22 bp, Homo sapiens
agagctgtttgtctagagagtg

SEQ ID NO: 9258915 - DNA, 22 bp, Homo sapiens
agagctgtgctttgcaccacgt

SEQ ID NO: 9258916 - DNA, 22 bp, Homo sapiens
agagctgtggatagtcctggat

SEQ ID NO: 9258917 - DNA, 22 bp, Homo sapiens
agagctgtggatagtcctggat

SEQ ID NO: 9258918 - DNA, 22 bp, Homo sapiens
agagctgtcagcgttttggcca

SEQ ID NO: 9258919 - DNA, 22 bp, Homo sapiens
agagctgtgaaaatgaggtttg

SEQ ID NO: 9258920 - DNA, 22 bp, Homo sapiens
agagctgtgctttgcaccacgt

SEQ ID NO: 9258921 - DNA, 22 bp, Homo sapiens
agagctgtcacatagagccaga

SEQ ID NO: 9258922 - DNA, 22 bp, Homo sapiens
agagctgtatccccttaccagt

SEQ ID NO: 9258923 - DNA, 22 bp, Homo sapiens
agagctgtagcttcctagagcc

SEQ ID NO: 9258924 - DNA, 22 bp, Homo sapiens
agagctgtagcttcctagagcc

SEQ ID NO: 9258925 - DNA, 22 bp, Homo sapiens
agagctgtatccccttaccagt

SEQ ID NO: 9258926 - DNA, 22 bp, Homo sapiens
agagctgttcaacgtagcaatg

SEQ ID NO: 9258927 - DNA, 22 bp, Homo sapiens
agagctgttcagcagccaggtt

SEQ ID NO: 9258928 - DNA, 22 bp, Homo sapiens
agagctgttcagcagccaggtt

SEQ ID NO: 9258929 - DNA, 22 bp, Homo sapiens
agagctgtttattgatgtcaca

SEQ ID NO: 9258930 - DNA, 22 bp, Homo sapiens
agagctgtttggacatctgagt

SEQ ID NO: 9258931 - DNA, 22 bp, Homo sapiens
agagctgtgttaagaacaggcc

SEQ ID NO: 9258932 - DNA, 22 bp, Homo sapiens
agagctgtgtcctgtgcactag

SEQ ID NO: 9258933 - DNA, 22 bp, Homo sapiens
agagctgttcaacgtagcaatg

SEQ ID NO: 9258934 - DNA, 22 bp, Homo sapiens
agagctgtgtttagtagttacg

SEQ ID NO: 9258935 - DNA, 22 bp, Homo sapiens
agagctgttaattttgcactgg

SEQ ID NO: 9258936 - DNA, 22 bp, Homo sapiens
agagctggtttactcaggaatt

SEQ ID NO: 9258937 - DNA, 22 bp, Homo sapiens
agagctggtttactcaggaatt

SEQ ID NO: 9258938 - DNA, 22 bp, Homo sapiens
agagctggtgcatattcagaaa

SEQ ID NO: 9258939 - DNA, 22 bp, Homo sapiens
agagctggtgcatattcagaaa

SEQ ID NO: 9258940 - DNA, 21 bp, Homo sapiens
agagctggtaggtaggtaggt

SEQ ID NO: 9258941 - DNA, 21 bp, Homo sapiens
agagctggtaggtaggtaggt

SEQ ID NO: 9258942 - DNA, 22 bp, Homo sapiens
agagctgggacttggactcaat

SEQ ID NO: 9258943 - DNA, 22 bp, Homo sapiens
atgtgtatatttattgtagttt

SEQ ID NO: 9258944 - DNA, 22 bp, Homo sapiens
agaggcaggaagagctgatttt

SEQ ID NO: 9258945 - DNA, 22 bp, Homo sapiens
agaggcaggaggttgacttgag

SEQ ID NO: 9258946 - DNA, 22 bp, Homo sapiens
agaggcaggaagagctgatttt

SEQ ID NO: 9258947 - DNA, 22 bp, Homo sapiens
agaggcaggaagagctgatttt

SEQ ID NO: 9258948 - DNA, 22 bp, Homo sapiens
agaggcagcagtcatactacag

SEQ ID NO: 9258949 - DNA, 22 bp, Homo sapiens
agaggcagccgtatttcaaagg

SEQ ID NO: 9258950 - DNA, 22 bp, Homo sapiens
agaggcagcagtcatactacag

SEQ ID NO: 9258951 - DNA, 17 bp, Homo sapiens
agaggcagatacttgga

SEQ ID NO: 9258952 - DNA, 17 bp, Homo sapiens
agaggcagatacttgga

SEQ ID NO: 9258953 - DNA, 20 bp, Homo sapiens
attcatgtctttataaaagc

SEQ ID NO: 9258954 - DNA, 22 bp, Homo sapiens
attcagggaggaaaggggcctc

SEQ ID NO: 9258955 - DNA, 20 bp, Homo sapiens
attcatgtctttataaaagc

SEQ ID NO: 9258956 - DNA, 22 bp, Homo sapiens
attcattccaggtcagtcagac

SEQ ID NO: 9258957 - DNA, 22 bp, Homo sapiens
agaggctaggaccatgtatcat

SEQ ID NO: 9258958 - DNA, 22 bp, Homo sapiens
agaggctccaccttctctgtcc

SEQ ID NO: 9258959 - DNA, 22 bp, Homo sapiens
agaggctcctcggtgcctcgtg

SEQ ID NO: 9258960 - DNA, 22 bp, Homo sapiens
attcatttgctattgtgtatgg

SEQ ID NO: 9258961 - DNA, 22 bp, Homo sapiens
attcatttaggtattcacttac

SEQ ID NO: 9258962 - DNA, 22 bp, Homo sapiens
attcatttgctattgtgtatgg

SEQ ID NO: 9258963 - DNA, 22 bp, Homo sapiens
attcatttagagggattaagca

SEQ ID NO: 9258964 - DNA, 22 bp, Homo sapiens
attcatttaggtattcacttac

SEQ ID NO: 9258965 - DNA, 22 bp, Homo sapiens
attccattgtgtaaggatatcg

SEQ ID NO: 9258966 - DNA, 22 bp, Homo sapiens
attccattgtatgtgtagacta

SEQ ID NO: 9258967 - DNA, 22 bp, Homo sapiens
attccattgtatgtgtagacta

SEQ ID NO: 9258968 - DNA, 22 bp, Homo sapiens
attcccacagctggtataaata

SEQ ID NO: 9258969 - DNA, 22 bp, Homo sapiens
attgcagtgttgcctggggcct

SEQ ID NO: 9258970 - DNA, 22 bp, Homo sapiens
attgcattgcagctagattttg

SEQ ID NO: 9258971 - DNA, 22 bp, Homo sapiens
attgcattcattgacatatgag

SEQ ID NO: 9258972 - DNA, 22 bp, Homo sapiens
attgcagtgtgtgttccatgag

SEQ ID NO: 9258973 - DNA, 22 bp, Homo sapiens
attccagatgttactgaaaggc

SEQ ID NO: 9258974 - DNA, 22 bp, Homo sapiens
attccattacagatcttttcct

SEQ ID NO: 9258975 - DNA, 22 bp, Homo sapiens
attccattcttgcttttgatct

SEQ ID NO: 9258976 - DNA, 22 bp, Homo sapiens
attccattcttgcttttgatct

SEQ ID NO: 9258977 - DNA, 22 bp, Homo sapiens
attccattgtgtaaggatatcg

SEQ ID NO: 9258978 - DNA, 22 bp, Homo sapiens
agagggagaaaagaatcagttg

SEQ ID NO: 9258979 - DNA, 22 bp, Homo sapiens
agagggaatgtgattgcaccat

SEQ ID NO: 9258980 - DNA, 22 bp, Homo sapiens
agagggagaaaagaatcagttg

SEQ ID NO: 9258981 - DNA, 22 bp, Homo sapiens
attccagagaggttctggaggt

SEQ ID NO: 9258982 - DNA, 22 bp, Homo sapiens
agaggctgtgcagagggagtgc

SEQ ID NO: 9258983 - DNA, 22 bp, Homo sapiens
agagggaaatccaggagtgctt

SEQ ID NO: 9258984 - DNA, 22 bp, Homo sapiens
atttctcatgtacaaaaacact

SEQ ID NO: 9258985 - DNA, 22 bp, Homo sapiens
atttccttcagtgtttaatact

SEQ ID NO: 9258986 - DNA, 22 bp, Homo sapiens
atttccttcatcagcctatcct

SEQ ID NO: 9258987 - DNA, 22 bp, Homo sapiens
atttctctcattgttagctagg

SEQ ID NO: 9258988 - DNA, 22 bp, Homo sapiens
atttctctcattgttagctagg

SEQ ID NO: 9258989 - DNA, 22 bp, Homo sapiens
atttctctcattgttagctagg

SEQ ID NO: 9258990 - DNA, 22 bp, Homo sapiens
atttctctaagcatccgtttgc

SEQ ID NO: 9258991 - DNA, 22 bp, Homo sapiens
atttctctaagcatccgtttgc

SEQ ID NO: 9258992 - DNA, 22 bp, Homo sapiens
atttctccttgttgcaatgcag

SEQ ID NO: 9258993 - DNA, 22 bp, Homo sapiens
atttctcctccagatggtggtt

SEQ ID NO: 9258994 - DNA, 22 bp, Homo sapiens
atttgcttttactatgttaaaa

SEQ ID NO: 9258995 - DNA, 22 bp, Homo sapiens
atttctctgcctcagcttctgc

SEQ ID NO: 9258996 - DNA, 22 bp, Homo sapiens
atttctctgcctcagcttctgc

SEQ ID NO: 9258997 - DNA, 22 bp, Homo sapiens
atttctctgcctcagcttctgc

SEQ ID NO: 9258998 - DNA, 18 bp, Homo sapiens
atttctctggggtgattc

SEQ ID NO: 9258999 - DNA, 22 bp, Homo sapiens
atttctctgcagtgttcggaat

SEQ ID NO: 9259000 - DNA, 22 bp, Homo sapiens
agatactgattctcaatggctc

SEQ ID NO: 9259001 - DNA, 22 bp, Homo sapiens
agatactgaaatccaatggcca

SEQ ID NO: 9259002 - DNA, 22 bp, Homo sapiens
agatactatggaattttatgag

SEQ ID NO: 9259003 - DNA, 22 bp, Homo sapiens
agataggccattaagaaggata

SEQ ID NO: 9259004 - DNA, 22 bp, Homo sapiens
agatactaaaaggggaagctcc

SEQ ID NO: 9259005 - DNA, 22 bp, Homo sapiens
agatactaagcatttccagcac

SEQ ID NO: 9259006 - DNA, 22 bp, Homo sapiens
agatacattgttctaagcattg

SEQ ID NO: 9259007 - DNA, 22 bp, Homo sapiens
atttcctatacagttgtccata

SEQ ID NO: 9259008 - DNA, 22 bp, Homo sapiens
atttcctaggtgctcgagtgct

SEQ ID NO: 9259009 - DNA, 22 bp, Homo sapiens
atttcctatggatacaggcaga

SEQ ID NO: 9259010 - DNA, 22 bp, Homo sapiens
atttcctatttcttgtccccta

SEQ ID NO: 9259011 - DNA, 22 bp, Homo sapiens
atttcctatagatatggtgagt

SEQ ID NO: 9259012 - DNA, 22 bp, Homo sapiens
atttcctatcctggtcttaaaa

SEQ ID NO: 9259013 - DNA, 22 bp, Homo sapiens
atttcctatagatatggtgagt

SEQ ID NO: 9259014 - DNA, 22 bp, Homo sapiens
atttgctttgggacagcttaaa

SEQ ID NO: 9259015 - DNA, 22 bp, Homo sapiens
atttgttcagcattgaatttgg

SEQ ID NO: 9259016 - DNA, 22 bp, Homo sapiens
atttgttcatgggttgttatgc

SEQ ID NO: 9259017 - DNA, 22 bp, Homo sapiens
atttgtgccaaattatttctaa

SEQ ID NO: 9259018 - DNA, 22 bp, Homo sapiens
atttgtttatcgtcgattgtag

SEQ ID NO: 9259019 - DNA, 22 bp, Homo sapiens
atttgtttatcgtcgattgtag

SEQ ID NO: 9259020 - DNA, 20 bp, Homo sapiens
atttgtttctactctctgac

SEQ ID NO: 9259021 - DNA, 20 bp, Homo sapiens
atttgtttctactctctgac

SEQ ID NO: 9259022 - DNA, 22 bp, Homo sapiens
atttgtttcagggccttggtat

SEQ ID NO: 9259023 - DNA, 22 bp, Homo sapiens
atttgtttcagggccttggtat

SEQ ID NO: 9259024 - DNA, 22 bp, Homo sapiens
caaaagtaatcgtggcttttgc

SEQ ID NO: 9259025 - DNA, 22 bp, Homo sapiens
caaaagtaattatggtttttgc

SEQ ID NO: 9259026 - DNA, 22 bp, Homo sapiens
caaaagtaatggcggtttttac

SEQ ID NO: 9259027 - DNA, 22 bp, Homo sapiens
caaaagtagtgaagttgtacat

SEQ ID NO: 9259028 - DNA, 22 bp, Homo sapiens
caaaagtaattgcggtttttgc

SEQ ID NO: 9259029 - DNA, 22 bp, Homo sapiens
caaaagtaattgtggtttttgc

SEQ ID NO: 9259030 - DNA, 22 bp, Homo sapiens
caaaagtaattgtggttttcac

SEQ ID NO: 9259031 - DNA, 17 bp, Homo sapiens
agagttttaagaaattt

SEQ ID NO: 9259032 - DNA, 22 bp, Homo sapiens
agagtttgttgaatttacttgg

SEQ ID NO: 9259033 - DNA, 23 bp, Homo sapiens
agagtttgtttctaatgagtgag

SEQ ID NO: 9259034 - DNA, 22 bp, Homo sapiens
agagtttgttgaatttacttgg

SEQ ID NO: 9259035 - DNA, 22 bp, Homo sapiens
agagtttgtgggcttttcctcc

SEQ ID NO: 9259036 - DNA, 22 bp, Homo sapiens
agagtttgtgtcctttatcagg

SEQ ID NO: 9259037 - DNA, 22 bp, Homo sapiens
agataaaatgattttctggatc

SEQ ID NO: 9259038 - DNA, 22 bp, Homo sapiens
agagttttatggctttaattct

SEQ ID NO: 9259039 - DNA, 22 bp, Homo sapiens
agataaaatgattttctggatc

SEQ ID NO: 9259040 - DNA, 22 bp, Homo sapiens
agagtttggtgaagcaatttga

SEQ ID NO: 9259041 - DNA, 22 bp, Homo sapiens
agagtttgtactttaccctgag

SEQ ID NO: 9259042 - DNA, 22 bp, Homo sapiens
agagtttgtagtggtgaatgta

SEQ ID NO: 9259043 - DNA, 22 bp, Homo sapiens
agagtttggtgaagcaatttga

SEQ ID NO: 9259044 - DNA, 22 bp, Homo sapiens
agagtttgtatttttcagtgaa

SEQ ID NO: 9259045 - DNA, 22 bp, Homo sapiens
agagtttgtatttttcagtgaa

SEQ ID NO: 9259046 - DNA, 22 bp, Homo sapiens
agagtttgtgggcttttcctcc

SEQ ID NO: 9259047 - DNA, 22 bp, Homo sapiens
agagtttggaggtgttcctgga

SEQ ID NO: 9259048 - DNA, 22 bp, Homo sapiens
agagtttggattttaggacatc

SEQ ID NO: 9259049 - DNA, 22 bp, Homo sapiens
agagtttgggtgggacagcttg

SEQ ID NO: 9259050 - DNA, 20 bp, Homo sapiens
agagtttggggtcattttgg

SEQ ID NO: 9259051 - DNA, 22 bp, Homo sapiens
agagtttggggtatgattgttt

SEQ ID NO: 9259052 - DNA, 22 bp, Homo sapiens
agagtttgaagttatctttgac

SEQ ID NO: 9259053 - DNA, 22 bp, Homo sapiens
agagtttgaattttgaaaagat

SEQ ID NO: 9259054 - DNA, 22 bp, Homo sapiens
agagtttggagagggtgaggca

SEQ ID NO: 9259055 - DNA, 22 bp, Homo sapiens
agagtttggagagggtgaggca

SEQ ID NO: 9259056 - DNA, 22 bp, Homo sapiens
agagtttggaggtgttcctgga

SEQ ID NO: 9259057 - DNA, 22 bp, Homo sapiens
atttattgaagcttattacgtt

SEQ ID NO: 9259058 - DNA, 22 bp, Homo sapiens
atttattgaagcttattacgtt

SEQ ID NO: 9259059 - DNA, 22 bp, Homo sapiens
atttattgaagcttattacgtt

SEQ ID NO: 9259060 - DNA, 22 bp, Homo sapiens
atttcacagctgctgttcaggt

SEQ ID NO: 9259061 - DNA, 22 bp, Homo sapiens
atttcactctccctgccactta

SEQ ID NO: 9259062 - DNA, 22 bp, Homo sapiens
atttcacattaatttgatgctc

SEQ ID NO: 9259063 - DNA, 22 bp, Homo sapiens
atttcacagctgtcagtgttac

SEQ ID NO: 9259064 - DNA, 17 bp, Homo sapiens
atttcacttagcatgag

SEQ ID NO: 9259065 - DNA, 17 bp, Homo sapiens
atttcacttagcatgag

SEQ ID NO: 9259066 - DNA, 22 bp, Homo sapiens
atttcacttagtgtaatgtctt

SEQ ID NO: 9259067 - DNA, 22 bp, Homo sapiens
agatacatagctgtgagcacac

SEQ ID NO: 9259068 - DNA, 22 bp, Homo sapiens
agatacatagctgtgagcacac

SEQ ID NO: 9259069 - DNA, 22 bp, Homo sapiens
agatacatatagaaaacatcaa

SEQ ID NO: 9259070 - DNA, 22 bp, Homo sapiens
agatacattagtagttacttgt

SEQ ID NO: 9259071 - DNA, 22 bp, Homo sapiens
agatacatgtcaagagacttat

SEQ ID NO: 9259072 - DNA, 22 bp, Homo sapiens
agatacattgagtttcctcctg

SEQ ID NO: 9259073 - DNA, 22 bp, Homo sapiens
agatacatcatttataccttca

SEQ ID NO: 9259074 - DNA, 22 bp, Homo sapiens
agatacatcttgaacttctaga

SEQ ID NO: 9259075 - DNA, 22 bp, Homo sapiens
agagtttaccactatttttggt

SEQ ID NO: 9259076 - DNA, 22 bp, Homo sapiens
agagtttagggctgagagcttg

SEQ ID NO: 9259077 - DNA, 22 bp, Homo sapiens
agagtttgaagttatctttgac

SEQ ID NO: 9259078 - DNA, 22 bp, Homo sapiens
agagtggggacagggcctgtcc

SEQ ID NO: 9259079 - DNA, 22 bp, Homo sapiens
agagtgggtgatctctgttgtc

SEQ ID NO: 9259080 - DNA, 22 bp, Homo sapiens
agaggtgacataggagaggctc

SEQ ID NO: 9259081 - DNA, 22 bp, Homo sapiens
agaggtgacataggagaggctc

SEQ ID NO: 9259082 - DNA, 22 bp, Homo sapiens
agagttctgaaattatctttac

SEQ ID NO: 9259083 - DNA, 22 bp, Homo sapiens
agagttctgctcttctcagtga

SEQ ID NO: 9259084 - DNA, 22 bp, Homo sapiens
agagttctgaattttattctct

SEQ ID NO: 9259085 - DNA, 22 bp, Homo sapiens
agagttctgtctgccacacgaa

SEQ ID NO: 9259086 - DNA, 22 bp, Homo sapiens
attgcatttgtcattgttgagg

SEQ ID NO: 9259087 - DNA, 22 bp, Homo sapiens
attgccacctgttgctatggag

SEQ ID NO: 9259088 - DNA, 22 bp, Homo sapiens
attgcatttgtcattgttgagg

SEQ ID NO: 9259089 - DNA, 22 bp, Homo sapiens
attgcattgcagctagattttg

SEQ ID NO: 9259090 - DNA, 22 bp, Homo sapiens
attgctaatgtgcgaatgtgta

SEQ ID NO: 9259091 - DNA, 22 bp, Homo sapiens
attgctaggaacaggttgcacc

SEQ ID NO: 9259092 - DNA, 22 bp, Homo sapiens
attgctgaaagtattttatgac

SEQ ID NO: 9259093 - DNA, 22 bp, Homo sapiens
attgctgaaatgaaaggatatg

SEQ ID NO: 9259094 - DNA, 22 bp, Homo sapiens
attgctgaaatgaaaggatatg

SEQ ID NO: 9259095 - DNA, 22 bp, Homo sapiens
attgctgaacttataaatgaat

SEQ ID NO: 9259096 - DNA, 22 bp, Homo sapiens
attgctgaatctaaggcttcca

SEQ ID NO: 9259097 - DNA, 22 bp, Homo sapiens
attgctgactcaataattgaag

SEQ ID NO: 9259098 - DNA, 22 bp, Homo sapiens
attgctgactttaatattatat

SEQ ID NO: 9259099 - DNA, 22 bp, Homo sapiens
agaggtatgtgtcagtgcttat

SEQ ID NO: 9259100 - DNA, 22 bp, Homo sapiens
agaggtattaggtaattcagta

SEQ ID NO: 9259101 - DNA, 22 bp, Homo sapiens
agaggtattagatttgcatagg

SEQ ID NO: 9259102 - DNA, 22 bp, Homo sapiens
agacagaccatggctattcaga

SEQ ID NO: 9259103 - DNA, 22 bp, Homo sapiens
agacagacattctagagccacc

SEQ ID NO: 9259104 - DNA, 17 bp, Homo sapiens
agacagacctctgcatc

SEQ ID NO: 9259105 - DNA, 17 bp, Homo sapiens
agacagacctctgcatc

SEQ ID NO: 9259106 - DNA, 22 bp, Homo sapiens
agacagacgtagtgtgagagta

SEQ ID NO: 9259107 - DNA, 22 bp, Homo sapiens
atgcacatgtggctttatgtat

SEQ ID NO: 9259108 - DNA, 22 bp, Homo sapiens
atgcacctgaactccatcagct

SEQ ID NO: 9259109 - DNA, 22 bp, Homo sapiens
atgcactacttggctttactga

SEQ ID NO: 9259110 - DNA, 22 bp, Homo sapiens
atgcactatgatgagctagtct

SEQ ID NO: 9259111 - DNA, 22 bp, Homo sapiens
atgcactgggtgaggaaggaga

SEQ ID NO: 9259112 - DNA, 22 bp, Homo sapiens
atgcacatcttacagatgcaga

SEQ ID NO: 9259113 - DNA, 22 bp, Homo sapiens
atgacaaattcagaccatagca

SEQ ID NO: 9259114 - DNA, 22 bp, Homo sapiens
atgacaaacccaggatgtaaca

SEQ ID NO: 9259115 - DNA, 22 bp, Homo sapiens
atgacaaaggctgaaagggaaa

SEQ ID NO: 9259116 - DNA, 23 bp, Homo sapiens
atgacaaacaggacatcttgtgc

SEQ ID NO: 9259117 - DNA, 22 bp, Homo sapiens
atgacaaaattcacaggtgtga

SEQ ID NO: 9259118 - DNA, 23 bp, Homo sapiens
atgacaaacaggacatcttgtgc

SEQ ID NO: 9259119 - DNA, 23 bp, Homo sapiens
atgacaaacaggacatcttgtgc

SEQ ID NO: 9259120 - DNA, 22 bp, Homo sapiens
atgacaaaataaatggtctctg

SEQ ID NO: 9259121 - DNA, 22 bp, Homo sapiens
atgacaaaatgaatgcagctag

SEQ ID NO: 9259122 - DNA, 22 bp, Homo sapiens
atgacaaaagaagacatgaggt

SEQ ID NO: 9259123 - DNA, 22 bp, Homo sapiens
agacaggatgcatactcttggt

SEQ ID NO: 9259124 - DNA, 22 bp, Homo sapiens
agacaggatgcatactcttggt

SEQ ID NO: 9259125 - DNA, 20 bp, Homo sapiens
agacaggagcccccattcag

SEQ ID NO: 9259126 - DNA, 22 bp, Homo sapiens
agacaggagagggaactgccgg

SEQ ID NO: 9259127 - DNA, 22 bp, Homo sapiens
agacaggagagggaactgccgg

SEQ ID NO: 9259128 - DNA, 22 bp, Homo sapiens
agacaggacacaagctgcataa

SEQ ID NO: 9259129 - DNA, 22 bp, Homo sapiens
agacaggacacaagctgcataa

SEQ ID NO: 9259130 - DNA, 22 bp, Homo sapiens
agacaggacacaagctgcataa

SEQ ID NO: 9259131 - DNA, 22 bp, Homo sapiens
agacaggacacaagctgcataa

SEQ ID NO: 9259132 - DNA, 22 bp, Homo sapiens
agacagctgttccttcatgttt

SEQ ID NO: 9259133 - DNA, 22 bp, Homo sapiens
agacagctgctcgcagagctat

SEQ ID NO: 9259134 - DNA, 22 bp, Homo sapiens
agacatatggtgaaacatttta

SEQ ID NO: 9259135 - DNA, 22 bp, Homo sapiens
agacatattggcttgctttaat

SEQ ID NO: 9259136 - DNA, 22 bp, Homo sapiens
agacatttattcacacatttat

SEQ ID NO: 9259137 - DNA, 22 bp, Homo sapiens
agacatttattcacacatttat

SEQ ID NO: 9259138 - DNA, 22 bp, Homo sapiens
agacatttattcacacatttat

SEQ ID NO: 9259139 - DNA, 22 bp, Homo sapiens
agacatttggaagatacacata

SEQ ID NO: 9259140 - DNA, 22 bp, Homo sapiens
agacattttaacatctgggttt

SEQ ID NO: 9259141 - DNA, 22 bp, Homo sapiens
agacatttggagccaactttcc

SEQ ID NO: 9259142 - DNA, 22 bp, Homo sapiens
agacatttggagccaactttcc

SEQ ID NO: 9259143 - DNA, 22 bp, Homo sapiens
agacatttggagccaactttcc

SEQ ID NO: 9259144 - DNA, 22 bp, Homo sapiens
agacagcatggagctgataaca

SEQ ID NO: 9259145 - DNA, 22 bp, Homo sapiens
agacagcatgatacatgatgct

SEQ ID NO: 9259146 - DNA, 22 bp, Homo sapiens
agacagctctgggttccacact

SEQ ID NO: 9259147 - DNA, 22 bp, Homo sapiens
agacagcagggagcaggattca

SEQ ID NO: 9259148 - DNA, 22 bp, Homo sapiens
agacagactggtttgaattggt

SEQ ID NO: 9259149 - DNA, 22 bp, Homo sapiens
agacagacttgaaaatgttctt

SEQ ID NO: 9259150 - DNA, 22 bp, Homo sapiens
atctcagatctacagatctaca

SEQ ID NO: 9259151 - DNA, 22 bp, Homo sapiens
atctcagagaaatttgaatgca

SEQ ID NO: 9259152 - DNA, 22 bp, Homo sapiens
atctcagaaacatatctaatcc

SEQ ID NO: 9259153 - DNA, 22 bp, Homo sapiens
atctcagaaacatatctaatcc

SEQ ID NO: 9259154 - DNA, 22 bp, Homo sapiens
agaagtgagtgtgactcagcag

SEQ ID NO: 9259155 - DNA, 22 bp, Homo sapiens
agaagtgccatactgtggtcca

SEQ ID NO: 9259156 - DNA, 22 bp, Homo sapiens
agaagtgctccagtgagttggg

SEQ ID NO: 9259157 - DNA, 22 bp, Homo sapiens
agaagtgccgaaaggaagacag

SEQ ID NO: 9259158 - DNA, 23 bp, Homo sapiens
atgaaactcaagccagatccaag

SEQ ID NO: 9259159 - DNA, 22 bp, Homo sapiens
atctttgttgctctcatttctg

SEQ ID NO: 9259160 - DNA, 22 bp, Homo sapiens
atgaaactctaacttaacaagt

SEQ ID NO: 9259161 - DNA, 22 bp, Homo sapiens
agaagtttggtcctataaactc

SEQ ID NO: 9259162 - DNA, 22 bp, Homo sapiens
agaagttaccacatacttctct

SEQ ID NO: 9259163 - DNA, 22 bp, Homo sapiens
agaagtggtgtgtggccgagct

SEQ ID NO: 9259164 - DNA, 18 bp, Homo sapiens
agacaaacttcttctgcc

SEQ ID NO: 9259165 - DNA, 18 bp, Homo sapiens
agaattgctgcttcttct

SEQ ID NO: 9259166 - DNA, 22 bp, Homo sapiens
agaattcttggtggttagaata

SEQ ID NO: 9259167 - DNA, 22 bp, Homo sapiens
atgaacaataatcatgtctatg

SEQ ID NO: 9259168 - DNA, 22 bp, Homo sapiens
agacaaattgggacattgtgtt

SEQ ID NO: 9259169 - DNA, 22 bp, Homo sapiens
agacaaattgggacattgtgtt

SEQ ID NO: 9259170 - DNA, 22 bp, Homo sapiens
agacaaatgaacaaatatgtga

SEQ ID NO: 9259171 - DNA, 22 bp, Homo sapiens
agacaaataactttttatgtcc

SEQ ID NO: 9259172 - DNA, 22 bp, Homo sapiens
agacaaataactttttatgtcc

SEQ ID NO: 9259173 - DNA, 22 bp, Homo sapiens
atgaaattttaattatacctct

SEQ ID NO: 9259174 - DNA, 22 bp, Homo sapiens
atgaaatttgctgctaagttcc

SEQ ID NO: 9259175 - DNA, 20 bp, Homo sapiens
atgaaattcctgttttctga

SEQ ID NO: 9259176 - DNA, 22 bp, Homo sapiens
atgaaatttgaccaattattta

SEQ ID NO: 9259177 - DNA, 22 bp, Homo sapiens
atgaaagatgatttaaagtact

SEQ ID NO: 9259178 - DNA, 22 bp, Homo sapiens
atgaaagatgatttaaagtact

SEQ ID NO: 9259179 - DNA, 22 bp, Homo sapiens
atgaaactgaaggacaaccaga

SEQ ID NO: 9259180 - DNA, 22 bp, Homo sapiens
atgaaagtgtttaagtttatgt

SEQ ID NO: 9259181 - DNA, 22 bp, Homo sapiens
atgaaagtgaaggtttactaag

SEQ ID NO: 9259182 - DNA, 22 bp, Homo sapiens
atgggtaggatttactcagatg

SEQ ID NO: 9259183 - DNA, 22 bp, Homo sapiens
agagcagtgctgaagagtaggg

SEQ ID NO: 9259184 - DNA, 22 bp, Homo sapiens
agagcagcctgtgatgatgcac

SEQ ID NO: 9259185 - DNA, 22 bp, Homo sapiens
agagcatccatttttgtcacat

SEQ ID NO: 9259186 - DNA, 22 bp, Homo sapiens
agagcatcctggttttatgaag

SEQ ID NO: 9259187 - DNA, 22 bp, Homo sapiens
agagccacggcaggcctaggaa

SEQ ID NO: 9259188 - DNA, 22 bp, Homo sapiens
agagccagagacctgggttcac

SEQ ID NO: 9259189 - DNA, 22 bp, Homo sapiens
agagccagagacctgggttcac

SEQ ID NO: 9259190 - DNA, 22 bp, Homo sapiens
agagccagatggagccgtgtgt

SEQ ID NO: 9259191 - DNA, 22 bp, Homo sapiens
agagccagaccattgccgtgca

SEQ ID NO: 9259192 - DNA, 19 bp, Homo sapiens
agagccagacagcatagga

SEQ ID NO: 9259193 - DNA, 22 bp, Homo sapiens
agagccagaccattgccgtgca

SEQ ID NO: 9259194 - DNA, 22 bp, Homo sapiens
atgggggcctgaacaggcaaaa

SEQ ID NO: 9259195 - DNA, 22 bp, Homo sapiens
atgggggcggctgaagcccagg

SEQ ID NO: 9259196 - DNA, 22 bp, Homo sapiens
atggggtgagactaggattaaa

SEQ ID NO: 9259197 - DNA, 22 bp, Homo sapiens
atggggtgcatgcagattggga

SEQ ID NO: 9259198 - DNA, 22 bp, Homo sapiens
atgggggaaagtacgagcatgg

SEQ ID NO: 9259199 - DNA, 22 bp, Homo sapiens
agagatggccttaggtgggaat

SEQ ID NO: 9259200 - DNA, 22 bp, Homo sapiens
agagatggccttaggtgggaat

SEQ ID NO: 9259201 - DNA, 22 bp, Homo sapiens
agagatggatgttattatgggt

SEQ ID NO: 9259202 - DNA, 22 bp, Homo sapiens
agagatggagagcactggggct

SEQ ID NO: 9259203 - DNA, 22 bp, Homo sapiens
atgtcaaacacaacaccagtgg

SEQ ID NO: 9259204 - DNA, 22 bp, Homo sapiens
atgtcaaatcagttttatcaga

SEQ ID NO: 9259205 - DNA, 22 bp, Homo sapiens
agagcctgggcagctcctctgg

SEQ ID NO: 9259206 - DNA, 22 bp, Homo sapiens
agagcctgggcagctcctctgg

SEQ ID NO: 9259207 - DNA, 22 bp, Homo sapiens
agagcctggggattggcaaggg

SEQ ID NO: 9259208 - DNA, 22 bp, Homo sapiens
agagcctggggattggcaaggg

SEQ ID NO: 9259209 - DNA, 22 bp, Homo sapiens
agagcctgggaatttgcatgtt

SEQ ID NO: 9259210 - DNA, 22 bp, Homo sapiens
agagccagcaactctagccctg

SEQ ID NO: 9259211 - DNA, 22 bp, Homo sapiens
agagccagcaactctagccctg

SEQ ID NO: 9259212 - DNA, 22 bp, Homo sapiens
atgtatttgcgtatggacatac

SEQ ID NO: 9259213 - DNA, 22 bp, Homo sapiens
atgtatttgcgtatggacatac

SEQ ID NO: 9259214 - DNA, 22 bp, Homo sapiens
atgtgggccgtgcgggtgtcct

SEQ ID NO: 9259215 - DNA, 22 bp, Homo sapiens
atgtgggccgtgcgggtgtcct

SEQ ID NO: 9259216 - DNA, 22 bp, Homo sapiens
atgtgggagatttcaggaggtg

SEQ ID NO: 9259217 - DNA, 22 bp, Homo sapiens
atgtggggacaaaatgatggcc

SEQ ID NO: 9259218 - DNA, 22 bp, Homo sapiens
atgtgtaaaaagtgcttaatat

SEQ ID NO: 9259219 - DNA, 22 bp, Homo sapiens
atgtgtaaaaggcatgttttat

SEQ ID NO: 9259220 - DNA, 22 bp, Homo sapiens
atgtgtacacacatatatgtat

SEQ ID NO: 9259221 - DNA, 22 bp, Homo sapiens
atgtgtaatgtggtattttaat

SEQ ID NO: 9259222 - DNA, 22 bp, Homo sapiens
agagcctgtctgcctttctacc

SEQ ID NO: 9259223 - DNA, 22 bp, Homo sapiens
agagcctgtacttttctgtgaa

SEQ ID NO: 9259224 - DNA, 22 bp, Homo sapiens
agagcctgtcaattgtaaagag

SEQ ID NO: 9259225 - DNA, 22 bp, Homo sapiens
agagcctggttcaaattttacc

SEQ ID NO: 9259226 - DNA, 22 bp, Homo sapiens
agagcctggtctgagataggac

SEQ ID NO: 9259227 - DNA, 22 bp, Homo sapiens
agagcctgtgattgtcatcacc

SEQ ID NO: 9259228 - DNA, 22 bp, Homo sapiens
agagcctgtctgcctttctacc

SEQ ID NO: 9259229 - DNA, 22 bp, Homo sapiens
agagcctgtgattgtcatcacc

SEQ ID NO: 9259230 - DNA, 22 bp, Homo sapiens
agagcctgtgattgtcatcacc

SEQ ID NO: 9259231 - DNA, 22 bp, Homo sapiens
agagcctgtgggagatgcagct

SEQ ID NO: 9259232 - DNA, 22 bp, Homo sapiens
agagcctgtgattgtcatcacc

SEQ ID NO: 9259233 - DNA, 22 bp, Homo sapiens
agagcctgtgggagatgcagct

SEQ ID NO: 9259234 - DNA, 22 bp, Homo sapiens
agaccaggtctttatggctcca

SEQ ID NO: 9259235 - DNA, 22 bp, Homo sapiens
agaccagggtcccacagagtct

SEQ ID NO: 9259236 - DNA, 22 bp, Homo sapiens
agaccagctgcctcccagggcc

SEQ ID NO: 9259237 - DNA, 22 bp, Homo sapiens
agaccaggaaggcctacagata

SEQ ID NO: 9259238 - DNA, 22 bp, Homo sapiens
agacccagaaagcagctgcatt

SEQ ID NO: 9259239 - DNA, 22 bp, Homo sapiens
agacattttacattcttccatt

SEQ ID NO: 9259240 - DNA, 22 bp, Homo sapiens
agacattttacattcttccatt

SEQ ID NO: 9259241 - DNA, 23 bp, Homo sapiens
agacattttaataaggacttttt

SEQ ID NO: 9259242 - DNA, 22 bp, Homo sapiens
agacattttgcaatgggtagct

SEQ ID NO: 9259243 - DNA, 22 bp, Homo sapiens
agaccacagtcaggctcctggt

SEQ ID NO: 9259244 - DNA, 22 bp, Homo sapiens
agaccacaggcatgcacagagc

SEQ ID NO: 9259245 - DNA, 23 bp, Homo sapiens
agacccagagactggctctgctc

SEQ ID NO: 9259246 - DNA, 22 bp, Homo sapiens
agagaagagcaatgataaattt

SEQ ID NO: 9259247 - DNA, 21 bp, Homo sapiens
agagaagaggactttctcaca

SEQ ID NO: 9259248 - DNA, 22 bp, Homo sapiens
agagatgaagggcattccccag

SEQ ID NO: 9259249 - DNA, 22 bp, Homo sapiens
atggctcagcccatggaagaaa

SEQ ID NO: 9259250 - DNA, 22 bp, Homo sapiens
atggctcagcccatggaagaaa

SEQ ID NO: 9259251 - DNA, 17 bp, Homo sapiens
atggctcacctgtgggc

SEQ ID NO: 9259252 - DNA, 17 bp, Homo sapiens
atggctcacctgtgggc

SEQ ID NO: 9259253 - DNA, 22 bp, Homo sapiens
atggctaaacctgaactggtct

SEQ ID NO: 9259254 - DNA, 22 bp, Homo sapiens
agagactgatggagctcactct

SEQ ID NO: 9259255 - DNA, 22 bp, Homo sapiens
agagacctttgttattctagga

SEQ ID NO: 9259256 - DNA, 22 bp, Homo sapiens
agagactaagaagttttaactt

SEQ ID NO: 9259257 - DNA, 22 bp, Homo sapiens
agagaccttcctgactccagag

SEQ ID NO: 9259258 - DNA, 22 bp, Homo sapiens
agagacctttctcctgcctttc

SEQ ID NO: 9259259 - DNA, 22 bp, Homo sapiens
atggcctgggcccgcttcagat

SEQ ID NO: 9259260 - DNA, 22 bp, Homo sapiens
atggcctggccagagctctgct

SEQ ID NO: 9259261 - DNA, 22 bp, Homo sapiens
agagacagggttttgtcgtgtt

SEQ ID NO: 9259262 - DNA, 22 bp, Homo sapiens
agagacagggttttgtcgtgtt

SEQ ID NO: 9259263 - DNA, 22 bp, Homo sapiens
agagaaggaaagctgacatggg

SEQ ID NO: 9259264 - DNA, 22 bp, Homo sapiens
agagacagggttttgtcgtgtt

SEQ ID NO: 9259265 - DNA, 22 bp, Homo sapiens
agagacagaggcaatatagctt

SEQ ID NO: 9259266 - DNA, 22 bp, Homo sapiens
accagcagttatgaggccagga

SEQ ID NO: 9259267 - DNA, 21 bp, Homo sapiens
accagcattccacactgtccc

SEQ ID NO: 9259268 - DNA, 22 bp, Homo sapiens
accagagctggctctgagcacc

SEQ ID NO: 9259269 - DNA, 22 bp, Homo sapiens
acatttgtatgcgtttttactg

SEQ ID NO: 9259270 - DNA, 20 bp, Homo sapiens
aggcttggcttggcaggaac

SEQ ID NO: 9259271 - DNA, 22 bp, Homo sapiens
aggcttgtggattggagcgagt

SEQ ID NO: 9259272 - DNA, 22 bp, Homo sapiens
aggctttaagtggcctacagct

SEQ ID NO: 9259273 - DNA, 22 bp, Homo sapiens
aggctttaattatctacaggag

SEQ ID NO: 9259274 - DNA, 22 bp, Homo sapiens
agggagacaaaagcagctgcca

SEQ ID NO: 9259275 - DNA, 22 bp, Homo sapiens
agggagacacatgaggaagtca

SEQ ID NO: 9259276 - DNA, 22 bp, Homo sapiens
agggagacaaaagcagctgcca

SEQ ID NO: 9259277 - DNA, 19 bp, Homo sapiens
agggagaattccaagagga

SEQ ID NO: 9259278 - DNA, 19 bp, Homo sapiens
agggagaattccaagagga

SEQ ID NO: 9259279 - DNA, 18 bp, Homo sapiens
agggagagaccgcgggtc

SEQ ID NO: 9259280 - DNA, 22 bp, Homo sapiens
accagctcagaagccagaaaga

SEQ ID NO: 9259281 - DNA, 22 bp, Homo sapiens
accagctcagaagccagaaaga

SEQ ID NO: 9259282 - DNA, 22 bp, Homo sapiens
accagctcataattttcaaaac

SEQ ID NO: 9259283 - DNA, 22 bp, Homo sapiens
accagctcagagcaggctcctg

SEQ ID NO: 9259284 - DNA, 22 bp, Homo sapiens
accagctcagaagccagaaaga

SEQ ID NO: 9259285 - DNA, 22 bp, Homo sapiens
accagctcagagcaggctcctg

SEQ ID NO: 9259286 - DNA, 22 bp, Homo sapiens
accagcctggccaacatggtga

SEQ ID NO: 9259287 - DNA, 22 bp, Homo sapiens
accagcctgtctgagtcgtggg

SEQ ID NO: 9259288 - DNA, 22 bp, Homo sapiens
accagcctgtctgagtcgtggg

SEQ ID NO: 9259289 - DNA, 22 bp, Homo sapiens
accagcctggccaacatggcaa

SEQ ID NO: 9259290 - DNA, 17 bp, Homo sapiens
accagcctctcctgggg

SEQ ID NO: 9259291 - DNA, 22 bp, Homo sapiens
accagccctcaggtcagatact

SEQ ID NO: 9259292 - DNA, 22 bp, Homo sapiens
agggcagcagcggcccaggcct

SEQ ID NO: 9259293 - DNA, 22 bp, Homo sapiens
agggcagcacaaggcatggact

SEQ ID NO: 9259294 - DNA, 22 bp, Homo sapiens
agggcagcaatgcagctgctgc

SEQ ID NO: 9259295 - DNA, 22 bp, Homo sapiens
agggcagcacaaggcatggact

SEQ ID NO: 9259296 - DNA, 22 bp, Homo sapiens
agggcagatggaacttccccga

SEQ ID NO: 9259297 - DNA, 22 bp, Homo sapiens
agggcagcaatgcagctgctgc

SEQ ID NO: 9259298 - DNA, 22 bp, Homo sapiens
accagctccaggcccctgctga

SEQ ID NO: 9259299 - DNA, 22 bp, Homo sapiens
accagctcagagcaggctcctg

SEQ ID NO: 9259300 - DNA, 22 bp, Homo sapiens
accagctccaggcccctgctgg

SEQ ID NO: 9259301 - DNA, 22 bp, Homo sapiens
accagctccaggcccctgctga

SEQ ID NO: 9259302 - DNA, 22 bp, Homo sapiens
accagctctggacaggcatttc

SEQ ID NO: 9259303 - DNA, 22 bp, Homo sapiens
accagctctctagccctggtcc

SEQ ID NO: 9259304 - DNA, 22 bp, Homo sapiens
accagctccaggcccctgctgg

SEQ ID NO: 9259305 - DNA, 22 bp, Homo sapiens
accagctcttctgctctagttg

SEQ ID NO: 9259306 - DNA, 22 bp, Homo sapiens
accagctctggacaggcatttc

SEQ ID NO: 9259307 - DNA, 22 bp, Homo sapiens
acccaggctggagtgcagtgat

SEQ ID NO: 9259308 - DNA, 22 bp, Homo sapiens
agggctgctgaggaagccttgc

SEQ ID NO: 9259309 - DNA, 22 bp, Homo sapiens
agggctgctcctccttcaggcc

SEQ ID NO: 9259310 - DNA, 19 bp, Homo sapiens
agggctgctctggcctggg

SEQ ID NO: 9259311 - DNA, 22 bp, Homo sapiens
agggctgcctgactccagagcc

SEQ ID NO: 9259312 - DNA, 22 bp, Homo sapiens
agggctgcctgactccagagcc

SEQ ID NO: 9259313 - DNA, 22 bp, Homo sapiens
acccaggctggagtgcagtggg

SEQ ID NO: 9259314 - DNA, 22 bp, Homo sapiens
acccaggctggagtgcagtggc

SEQ ID NO: 9259315 - DNA, 22 bp, Homo sapiens
acccaggctggagtgcagtggt

SEQ ID NO: 9259316 - DNA, 22 bp, Homo sapiens
acccaggctggagtgcagtgtc

SEQ ID NO: 9259317 - DNA, 22 bp, Homo sapiens
acccaggctggcgtgcagtggc

SEQ ID NO: 9259318 - DNA, 22 bp, Homo sapiens
accctccactttatctgtcttt

SEQ ID NO: 9259319 - DNA, 22 bp, Homo sapiens
accctcagtaatcgtgcagttt

SEQ ID NO: 9259320 - DNA, 22 bp, Homo sapiens
agggggctcagtgactgaagtg

SEQ ID NO: 9259321 - DNA, 22 bp, Homo sapiens
agggggctcagcaggctctgga

SEQ ID NO: 9259322 - DNA, 22 bp, Homo sapiens
agggggcccttgcaggtgagcg

SEQ ID NO: 9259323 - DNA, 22 bp, Homo sapiens
agggggaggctgtgctgcgtct

SEQ ID NO: 9259324 - DNA, 22 bp, Homo sapiens
aggggcctggcactgagctggc

SEQ ID NO: 9259325 - DNA, 22 bp, Homo sapiens
aggggcctggacatggacgcgc

SEQ ID NO: 9259326 - DNA, 22 bp, Homo sapiens
aggggcctggacatggacgcgc

SEQ ID NO: 9259327 - DNA, 22 bp, Homo sapiens
acccagctaaccctaccctgga

SEQ ID NO: 9259328 - DNA, 20 bp, Homo sapiens
acccagctctgtgccctggg

SEQ ID NO: 9259329 - DNA, 20 bp, Homo sapiens
acccagctctgtgccctggg

SEQ ID NO: 9259330 - DNA, 22 bp, Homo sapiens
acccagctggatgcatggaggc

SEQ ID NO: 9259331 - DNA, 22 bp, Homo sapiens
acccagctgtttcccgtgtcat

SEQ ID NO: 9259332 - DNA, 22 bp, Homo sapiens
acccagctctttgatggtcttg

SEQ ID NO: 9259333 - DNA, 22 bp, Homo sapiens
acccaggacatgggcacccgtg

SEQ ID NO: 9259334 - DNA, 22 bp, Homo sapiens
acccaggacacagagatgaccc

SEQ ID NO: 9259335 - DNA, 22 bp, Homo sapiens
acccaggacaaaataaccaggt

SEQ ID NO: 9259336 - DNA, 22 bp, Homo sapiens
acccaggacacagagatgaccc

SEQ ID NO: 9259337 - DNA, 22 bp, Homo sapiens
acccaggaaaacatggtgcaga

SEQ ID NO: 9259338 - DNA, 22 bp, Homo sapiens
acccagctgtttcccgtgtcat

SEQ ID NO: 9259339 - DNA, 22 bp, Homo sapiens
acccaggaaaacatggtgcaga

SEQ ID NO: 9259340 - DNA, 22 bp, Homo sapiens
agggctgacagtgaggagtcaa

SEQ ID NO: 9259341 - DNA, 22 bp, Homo sapiens
agggctgacagtgaggagtcaa

SEQ ID NO: 9259342 - DNA, 22 bp, Homo sapiens
agggctgcccagtgtgagagct

SEQ ID NO: 9259343 - DNA, 22 bp, Homo sapiens
agggctgcccagtgtgagagct

SEQ ID NO: 9259344 - DNA, 22 bp, Homo sapiens
acccaggagacaggttgcagtg

SEQ ID NO: 9259345 - DNA, 22 bp, Homo sapiens
acccaggacttggcaacctcat

SEQ ID NO: 9259346 - DNA, 22 bp, Homo sapiens
acccaggactctcttccagtag

SEQ ID NO: 9259347 - DNA, 22 bp, Homo sapiens
acccaggagacggaggtgcagt

SEQ ID NO: 9259348 - DNA, 22 bp, Homo sapiens
acccaggagacggaggtgcagt

SEQ ID NO: 9259349 - DNA, 22 bp, Homo sapiens
acccaggagagagctataaaat

SEQ ID NO: 9259350 - DNA, 22 bp, Homo sapiens
acccaggagacggaggtgcagt

SEQ ID NO: 9259351 - DNA, 22 bp, Homo sapiens
acccaggagacaggttgcagtg

SEQ ID NO: 9259352 - DNA, 22 bp, Homo sapiens
acccaggagacaggttgcagtg

SEQ ID NO: 9259353 - DNA, 22 bp, Homo sapiens
acccagccacagcattgaggga

SEQ ID NO: 9259354 - DNA, 22 bp, Homo sapiens
acccagcctacaaagctcacct

SEQ ID NO: 9259355 - DNA, 22 bp, Homo sapiens
accaggctgtgaagtgagacta

SEQ ID NO: 9259356 - DNA, 22 bp, Homo sapiens
accaggctgtgaagtgagacta

SEQ ID NO: 9259357 - DNA, 22 bp, Homo sapiens
accaggctggagtgcagtggcg

SEQ ID NO: 9259358 - DNA, 22 bp, Homo sapiens
acccagagcagagcttggcttc

SEQ ID NO: 9259359 - DNA, 22 bp, Homo sapiens
accaggctggagtgcagtggcg

SEQ ID NO: 9259360 - DNA, 22 bp, Homo sapiens
accaggctggagtgcagtggcg

SEQ ID NO: 9259361 - DNA, 22 bp, Homo sapiens
accaggctggagtgcagtggcg

SEQ ID NO: 9259362 - DNA, 22 bp, Homo sapiens
accaggctgtgaagtgagacta

SEQ ID NO: 9259363 - DNA, 22 bp, Homo sapiens
accaggctctgccagtgtttac

SEQ ID NO: 9259364 - DNA, 22 bp, Homo sapiens
accaggctctgccagtgtttac

SEQ ID NO: 9259365 - DNA, 22 bp, Homo sapiens
accaggctggagtgcagtggcg

SEQ ID NO: 9259366 - DNA, 22 bp, Homo sapiens
accaggctggagtgcagtggcg

SEQ ID NO: 9259367 - DNA, 22 bp, Homo sapiens
accaggctccccttggatcctg

SEQ ID NO: 9259368 - DNA, 22 bp, Homo sapiens
accaggctccccttggatcctg

SEQ ID NO: 9259369 - DNA, 22 bp, Homo sapiens
accaggctccccttggatcctg

SEQ ID NO: 9259370 - DNA, 22 bp, Homo sapiens
aggcctgcagcaggagcaaacc

SEQ ID NO: 9259371 - DNA, 22 bp, Homo sapiens
aggctctgtttgctgtggtacc

SEQ ID NO: 9259372 - DNA, 22 bp, Homo sapiens
aggctgaaaacgagatggcaat

SEQ ID NO: 9259373 - DNA, 22 bp, Homo sapiens
aggctgaaaacgagatggcaat

SEQ ID NO: 9259374 - DNA, 22 bp, Homo sapiens
aggctctttgagactacctgga

SEQ ID NO: 9259375 - DNA, 22 bp, Homo sapiens
aggctgagactgtgcattagtg

SEQ ID NO: 9259376 - DNA, 22 bp, Homo sapiens
aggctgagactgtgcattagtg

SEQ ID NO: 9259377 - DNA, 22 bp, Homo sapiens
aggctgagactgtgcattagtg

SEQ ID NO: 9259378 - DNA, 22 bp, Homo sapiens
aggctgagaaagtgggaagatg

SEQ ID NO: 9259379 - DNA, 22 bp, Homo sapiens
aggctgagaaagtgggaagatg

SEQ ID NO: 9259380 - DNA, 22 bp, Homo sapiens
aggctgagaaagtgggaagatg

SEQ ID NO: 9259381 - DNA, 22 bp, Homo sapiens
aggctgagaaagtgggaagatg

SEQ ID NO: 9259382 - DNA, 22 bp, Homo sapiens
aggctgagaaagtgggaagatg

SEQ ID NO: 9259383 - DNA, 22 bp, Homo sapiens
aggctgagaaagtgggaagatg

SEQ ID NO: 9259384 - DNA, 20 bp, Homo sapiens
acattgattatgtttgtaga

SEQ ID NO: 9259385 - DNA, 18 bp, Homo sapiens
acattgatggctttaagc

SEQ ID NO: 9259386 - DNA, 22 bp, Homo sapiens
acattgatgatcccacttacag

SEQ ID NO: 9259387 - DNA, 22 bp, Homo sapiens
acattgatgaaaaggtatcatt

SEQ ID NO: 9259388 - DNA, 22 bp, Homo sapiens
acattgatcagcctcccatgca

SEQ ID NO: 9259389 - DNA, 22 bp, Homo sapiens
acattgcaataataattctctt

SEQ ID NO: 9259390 - DNA, 22 bp, Homo sapiens
acattgcaattaggtacctatg

SEQ ID NO: 9259391 - DNA, 22 bp, Homo sapiens
acattgcaataataattctctt

SEQ ID NO: 9259392 - DNA, 22 bp, Homo sapiens
acatttcatttgcagtatggat

SEQ ID NO: 9259393 - DNA, 22 bp, Homo sapiens
acatttcagaatcacacagctt

SEQ ID NO: 9259394 - DNA, 22 bp, Homo sapiens
acattgtataatgattatcaca

SEQ ID NO: 9259395 - DNA, 22 bp, Homo sapiens
acattgtagacttttcatatgt

SEQ ID NO: 9259396 - DNA, 22 bp, Homo sapiens
acattgtagacttttcatatgt

SEQ ID NO: 9259397 - DNA, 19 bp, Homo sapiens
acattggacatggatcttg

SEQ ID NO: 9259398 - DNA, 22 bp, Homo sapiens
acatttctatagtgcatctgtt

SEQ ID NO: 9259399 - DNA, 22 bp, Homo sapiens
acatttctagttgttcatctcc

SEQ ID NO: 9259400 - DNA, 22 bp, Homo sapiens
acatttctagttgttcatctcc

SEQ ID NO: 9259401 - DNA, 22 bp, Homo sapiens
acatttctagttgttcatctcc

SEQ ID NO: 9259402 - DNA, 22 bp, Homo sapiens
aggctgagctggtagtgagtac

SEQ ID NO: 9259403 - DNA, 22 bp, Homo sapiens
aggctgagctggtagtgagtac

SEQ ID NO: 9259404 - DNA, 22 bp, Homo sapiens
aggctgaggagggatgttgctt

SEQ ID NO: 9259405 - DNA, 22 bp, Homo sapiens
aggctgagctggtagtgagtac

SEQ ID NO: 9259406 - DNA, 22 bp, Homo sapiens
aggctgaggagggatgttgctt

SEQ ID NO: 9259407 - DNA, 22 bp, Homo sapiens
aggctgagctggtagtgagtac

SEQ ID NO: 9259408 - DNA, 22 bp, Homo sapiens
aggctgagctggtagtgagtac

SEQ ID NO: 9259409 - DNA, 22 bp, Homo sapiens
aggctgagctggtagtgagtac

SEQ ID NO: 9259410 - DNA, 22 bp, Homo sapiens
aggctgagctggtagtgagtac

SEQ ID NO: 9259411 - DNA, 22 bp, Homo sapiens
aggctgagctggtagtgagtac

SEQ ID NO: 9259412 - DNA, 18 bp, Homo sapiens
acatttctatgcttctgg

SEQ ID NO: 9259413 - DNA, 18 bp, Homo sapiens
acatttctatgcttctgg

SEQ ID NO: 9259414 - DNA, 18 bp, Homo sapiens
acatttctatgcttctgg

SEQ ID NO: 9259415 - DNA, 22 bp, Homo sapiens
aggctgagctggcccttgaaat

SEQ ID NO: 9259416 - DNA, 22 bp, Homo sapiens
aggctgagctggcccttgaaat

SEQ ID NO: 9259417 - DNA, 22 bp, Homo sapiens
aggctgagctgacctggtttgg

SEQ ID NO: 9259418 - DNA, 22 bp, Homo sapiens
aggctgagctggcccttgaaat

SEQ ID NO: 9259419 - DNA, 22 bp, Homo sapiens
aggctgagctggcccttgaaat

SEQ ID NO: 9259420 - DNA, 22 bp, Homo sapiens
aggctgaggagggatgttgctt

SEQ ID NO: 9259421 - DNA, 22 bp, Homo sapiens
aggctgaggagggatgttgctt

SEQ ID NO: 9259422 - DNA, 22 bp, Homo sapiens
acatttcttcctaattatccct

SEQ ID NO: 9259423 - DNA, 22 bp, Homo sapiens
acatttcttgatgcctctgtga

SEQ ID NO: 9259424 - DNA, 22 bp, Homo sapiens
acatttcttgatgcctctgtga

SEQ ID NO: 9259425 - DNA, 22 bp, Homo sapiens
acatttctttctattcagtagc

SEQ ID NO: 9259426 - DNA, 22 bp, Homo sapiens
acatttctttctattcagtagc

SEQ ID NO: 9259427 - DNA, 22 bp, Homo sapiens
acatttctttgctagacagcag

SEQ ID NO: 9259428 - DNA, 22 bp, Homo sapiens
acatttcttttcatctctatat

SEQ ID NO: 9259429 - DNA, 22 bp, Homo sapiens
acatttcttttcatctctatat

SEQ ID NO: 9259430 - DNA, 22 bp, Homo sapiens
acatttgacatttagtatcagc

SEQ ID NO: 9259431 - DNA, 22 bp, Homo sapiens
acatttgactctgttcatatta

SEQ ID NO: 9259432 - DNA, 22 bp, Homo sapiens
acatttgagatgccttttaggt

SEQ ID NO: 9259433 - DNA, 22 bp, Homo sapiens
acatttgacatttagtatcagc

SEQ ID NO: 9259434 - DNA, 22 bp, Homo sapiens
acatttgacatttagtatcagc

SEQ ID NO: 9259435 - DNA, 22 bp, Homo sapiens
acatttcttttcatctctatat

SEQ ID NO: 9259436 - DNA, 22 bp, Homo sapiens
acatttgaggatgttaagaatg

SEQ ID NO: 9259437 - DNA, 22 bp, Homo sapiens
acatttgaggatgttaagaatg

SEQ ID NO: 9259438 - DNA, 22 bp, Homo sapiens
acatttgggaccctctcttcac

SEQ ID NO: 9259439 - DNA, 22 bp, Homo sapiens
acatgcataagcctagccatca

SEQ ID NO: 9259440 - DNA, 22 bp, Homo sapiens
acatgcataagcctagccatca

SEQ ID NO: 9259441 - DNA, 22 bp, Homo sapiens
acatgcatacaagcacatgtag

SEQ ID NO: 9259442 - DNA, 22 bp, Homo sapiens
acatgctaaatctgagatgctt

SEQ ID NO: 9259443 - DNA, 22 bp, Homo sapiens
acatgctacacagagctcctcg

SEQ ID NO: 9259444 - DNA, 22 bp, Homo sapiens
acatgctacagtgaaggaggaa

SEQ ID NO: 9259445 - DNA, 22 bp, Homo sapiens
acatgctaatggagatgccaag

SEQ ID NO: 9259446 - DNA, 22 bp, Homo sapiens
acatgctaatggagatgccaag

SEQ ID NO: 9259447 - DNA, 22 bp, Homo sapiens
acatgctatgagagattacttc

SEQ ID NO: 9259448 - DNA, 22 bp, Homo sapiens
acatgctctcctaaggccctgt

SEQ ID NO: 9259449 - DNA, 22 bp, Homo sapiens
acatgctttatcggattgacac

SEQ ID NO: 9259450 - DNA, 22 bp, Homo sapiens
aggccaggcaacattctgaagt

SEQ ID NO: 9259451 - DNA, 22 bp, Homo sapiens
aggccaggcctttctccattcc

SEQ ID NO: 9259452 - DNA, 22 bp, Homo sapiens
acatgcttgtttttcacaacct

SEQ ID NO: 9259453 - DNA, 22 bp, Homo sapiens
acatgctttgcacttacatcat

SEQ ID NO: 9259454 - DNA, 22 bp, Homo sapiens
acatcacagagcccagataaag

SEQ ID NO: 9259455 - DNA, 22 bp, Homo sapiens
acatcacagagcccagataaag

SEQ ID NO: 9259456 - DNA, 22 bp, Homo sapiens
acatcacagagcccagataaag

SEQ ID NO: 9259457 - DNA, 22 bp, Homo sapiens
acatattttgaaagctttctaa

SEQ ID NO: 9259458 - DNA, 22 bp, Homo sapiens
acatcacacgccttccaggagg

SEQ ID NO: 9259459 - DNA, 22 bp, Homo sapiens
acatcagagggctcacatgatc

SEQ ID NO: 9259460 - DNA, 22 bp, Homo sapiens
acatcatgagagacttaaattg

SEQ ID NO: 9259461 - DNA, 22 bp, Homo sapiens
acatccactatccttgcttgtt

SEQ ID NO: 9259462 - DNA, 22 bp, Homo sapiens
acatccatcttatgagataggt

SEQ ID NO: 9259463 - DNA, 22 bp, Homo sapiens
acatcattttcttcagtgtttg

SEQ ID NO: 9259464 - DNA, 20 bp, Homo sapiens
aggcctgagagatgactggg

SEQ ID NO: 9259465 - DNA, 22 bp, Homo sapiens
aggcctcttgtcttcctcacat

SEQ ID NO: 9259466 - DNA, 22 bp, Homo sapiens
acatgtttgataaatatttggg

SEQ ID NO: 9259467 - DNA, 22 bp, Homo sapiens
aggccagggccagattagccac

SEQ ID NO: 9259468 - DNA, 22 bp, Homo sapiens
aggccaggggtgagcacttctg

SEQ ID NO: 9259469 - DNA, 22 bp, Homo sapiens
aggccaggggtgagcacttctg

SEQ ID NO: 9259470 - DNA, 22 bp, Homo sapiens
aggccaggcgagacacccggct

SEQ ID NO: 9259471 - DNA, 22 bp, Homo sapiens
acatgtgttttcctacttatga

SEQ ID NO: 9259472 - DNA, 22 bp, Homo sapiens
aggccagggtcccacactcgca

SEQ ID NO: 9259473 - DNA, 22 bp, Homo sapiens
acaggcagcaaaatcagcctca

SEQ ID NO: 9259474 - DNA, 22 bp, Homo sapiens
acaggcagcaaaatcagcctca

SEQ ID NO: 9259475 - DNA, 22 bp, Homo sapiens
acaggcagcactaatctctggt

SEQ ID NO: 9259476 - DNA, 22 bp, Homo sapiens
acaggcagcactaatctctggt

SEQ ID NO: 9259477 - DNA, 22 bp, Homo sapiens
acaggcagattaagggtaggca

SEQ ID NO: 9259478 - DNA, 22 bp, Homo sapiens
acaggcagattaagggtaggca

SEQ ID NO: 9259479 - DNA, 17 bp, Homo sapiens
acaggcagatcacctga

SEQ ID NO: 9259480 - DNA, 17 bp, Homo sapiens
acaggcagatcacctga

SEQ ID NO: 9259481 - DNA, 22 bp, Homo sapiens
acaggcaggcttcggccagagc

SEQ ID NO: 9259482 - DNA, 22 bp, Homo sapiens
acaggcaggagctccccattcc

SEQ ID NO: 9259483 - DNA, 22 bp, Homo sapiens
acaggcagcactaatctctggt

SEQ ID NO: 9259484 - DNA, 22 bp, Homo sapiens
acaggcagccctctccctggtt

SEQ ID NO: 9259485 - DNA, 22 bp, Homo sapiens
acaggcagccctctccctggtt

SEQ ID NO: 9259486 - DNA, 22 bp, Homo sapiens
acaggcagcgtcattgctgctc

SEQ ID NO: 9259487 - DNA, 22 bp, Homo sapiens
acagggaatggagggatcagta

SEQ ID NO: 9259488 - DNA, 22 bp, Homo sapiens
acaggcagggacctcttgagtt

SEQ ID NO: 9259489 - DNA, 22 bp, Homo sapiens
acaggcaggcttcggccagagc

SEQ ID NO: 9259490 - DNA, 22 bp, Homo sapiens
acaggcagggaccttggctaag

SEQ ID NO: 9259491 - DNA, 22 bp, Homo sapiens
acaggctgttggggtccagggt

SEQ ID NO: 9259492 - DNA, 22 bp, Homo sapiens
acagggaagctcaggggctctg

SEQ ID NO: 9259493 - DNA, 22 bp, Homo sapiens
acaggcagggaccttggctaag

SEQ ID NO: 9259494 - DNA, 22 bp, Homo sapiens
acaggctgttggggtccagggt

SEQ ID NO: 9259495 - DNA, 19 bp, Homo sapiens
acaggggcctttccagggt

SEQ ID NO: 9259496 - DNA, 19 bp, Homo sapiens
acaggggctagcggaagca

SEQ ID NO: 9259497 - DNA, 22 bp, Homo sapiens
aggacacactgcaagagcctgg

SEQ ID NO: 9259498 - DNA, 22 bp, Homo sapiens
aggacacactgcaagagcctgg

SEQ ID NO: 9259499 - DNA, 22 bp, Homo sapiens
acagggcttttaatcagtagtt

SEQ ID NO: 9259500 - DNA, 22 bp, Homo sapiens
acagggcttttaatcagtagtt

SEQ ID NO: 9259501 - DNA, 22 bp, Homo sapiens
acagggcttgtgacaactttaa

SEQ ID NO: 9259502 - DNA, 22 bp, Homo sapiens
acagggcttttaatcagtagtt

SEQ ID NO: 9259503 - DNA, 22 bp, Homo sapiens
acaggggcaggcaggacccttt

SEQ ID NO: 9259504 - DNA, 22 bp, Homo sapiens
acaggggcaagggctcacggcc

SEQ ID NO: 9259505 - DNA, 20 bp, Homo sapiens
acaggggcagcacaataatg

SEQ ID NO: 9259506 - DNA, 22 bp, Homo sapiens
aggaagaatgtttacatatcaa

SEQ ID NO: 9259507 - DNA, 22 bp, Homo sapiens
aggaagagcattcacatggtag

SEQ ID NO: 9259508 - DNA, 22 bp, Homo sapiens
acagggctatattcctcagagt

SEQ ID NO: 9259509 - DNA, 22 bp, Homo sapiens
aggaagagcattcacatggtag

SEQ ID NO: 9259510 - DNA, 22 bp, Homo sapiens
acagggctatattcctcagagt

SEQ ID NO: 9259511 - DNA, 22 bp, Homo sapiens
acagggctcccagcaggtctgt

SEQ ID NO: 9259512 - DNA, 19 bp, Homo sapiens
acagggcttggcctgacat

SEQ ID NO: 9259513 - DNA, 22 bp, Homo sapiens
aggaagaaatgtgacttcaaac

SEQ ID NO: 9259514 - DNA, 22 bp, Homo sapiens
aggaagaacagataatggacgc

SEQ ID NO: 9259515 - DNA, 22 bp, Homo sapiens
aggaagaacctaagaaagtctc

SEQ ID NO: 9259516 - DNA, 22 bp, Homo sapiens
aggaagaacctaagaaagtctc

SEQ ID NO: 9259517 - DNA, 18 bp, Homo sapiens
acagggagggcgctgggg

SEQ ID NO: 9259518 - DNA, 22 bp, Homo sapiens
agctgaaggctagaacagctgg

SEQ ID NO: 9259519 - DNA, 22 bp, Homo sapiens
agctgaagcagtcagttcagct

SEQ ID NO: 9259520 - DNA, 22 bp, Homo sapiens
agctctgggtcacggctgccga

SEQ ID NO: 9259521 - DNA, 22 bp, Homo sapiens
agctgaagttcagtccagagaa

SEQ ID NO: 9259522 - DNA, 22 bp, Homo sapiens
agctgaagtcctcgcggtgcta

SEQ ID NO: 9259523 - DNA, 22 bp, Homo sapiens
acagctggcaggggggcatgaa

SEQ ID NO: 9259524 - DNA, 22 bp, Homo sapiens
acagctggcaggggggcatgaa

SEQ ID NO: 9259525 - DNA, 22 bp, Homo sapiens
acagctggcaggggggcatgaa

SEQ ID NO: 9259526 - DNA, 22 bp, Homo sapiens
acagctggccgaggctcaggga

SEQ ID NO: 9259527 - DNA, 22 bp, Homo sapiens
acagctgggaactcacacagca

SEQ ID NO: 9259528 - DNA, 22 bp, Homo sapiens
acagctgggaatcagctgggga

SEQ ID NO: 9259529 - DNA, 22 bp, Homo sapiens
acagctgggaatcagctgggga

SEQ ID NO: 9259530 - DNA, 22 bp, Homo sapiens
acagctgggtgctgctcagagc

SEQ ID NO: 9259531 - DNA, 22 bp, Homo sapiens
acagctgtatccccagagctca

SEQ ID NO: 9259532 - DNA, 21 bp, Homo sapiens
acagctggtgcagggcgggga

SEQ ID NO: 9259533 - DNA, 22 bp, Homo sapiens
agctggaggggccagcaggtgt

SEQ ID NO: 9259534 - DNA, 23 bp, Homo sapiens
agctggaggctgtctactcccaa

SEQ ID NO: 9259535 - DNA, 22 bp, Homo sapiens
agctggaggggccagcaggtgt

SEQ ID NO: 9259536 - DNA, 22 bp, Homo sapiens
acaggagggacaccttcctgct

SEQ ID NO: 9259537 - DNA, 22 bp, Homo sapiens
acaggagtggagaggtgcctct

SEQ ID NO: 9259538 - DNA, 22 bp, Homo sapiens
acaggagtgaatctggcactta

SEQ ID NO: 9259539 - DNA, 22 bp, Homo sapiens
agctggcaccaaatatagtaaa

SEQ ID NO: 9259540 - DNA, 22 bp, Homo sapiens
agctggtgtgccagttccagtt

SEQ ID NO: 9259541 - DNA, 22 bp, Homo sapiens
agctggtgtcctcctggagctg

SEQ ID NO: 9259542 - DNA, 22 bp, Homo sapiens
agctggtgtcctcctggagctg

SEQ ID NO: 9259543 - DNA, 22 bp, Homo sapiens
agctggtgtcctcctggagctg

SEQ ID NO: 9259544 - DNA, 22 bp, Homo sapiens
agctggtgtgccagttccagtt

SEQ ID NO: 9259545 - DNA, 22 bp, Homo sapiens
agctggtgtcctcctggagctg

SEQ ID NO: 9259546 - DNA, 21 bp, Homo sapiens
agctggtgtcagagctctggg

SEQ ID NO: 9259547 - DNA, 21 bp, Homo sapiens
agctggtgtcagagctctggg

SEQ ID NO: 9259548 - DNA, 22 bp, Homo sapiens
agctggtggggaagctgcaggt

SEQ ID NO: 9259549 - DNA, 18 bp, Homo sapiens
agctggtggggagacagc

SEQ ID NO: 9259550 - DNA, 18 bp, Homo sapiens
agctggtggggagacagc

SEQ ID NO: 9259551 - DNA, 22 bp, Homo sapiens
agctggtggggaagctgcaggt

SEQ ID NO: 9259552 - DNA, 22 bp, Homo sapiens
agctggtggattatgctgtaca

SEQ ID NO: 9259553 - DNA, 22 bp, Homo sapiens
acaggatcgccctgttgcccag

SEQ ID NO: 9259554 - DNA, 21 bp, Homo sapiens
acaggataggacagtgttcct

SEQ ID NO: 9259555 - DNA, 22 bp, Homo sapiens
acaggagtttaagaaatatttc

SEQ ID NO: 9259556 - DNA, 22 bp, Homo sapiens
acaggagttaaggctgagttga

SEQ ID NO: 9259557 - DNA, 22 bp, Homo sapiens
acatattaactgcactacacta

SEQ ID NO: 9259558 - DNA, 22 bp, Homo sapiens
acatattaactgcactacacta

SEQ ID NO: 9259559 - DNA, 21 bp, Homo sapiens
aggcagctggaaggcctggct

SEQ ID NO: 9259560 - DNA, 22 bp, Homo sapiens
acatattggcttagctctgtga

SEQ ID NO: 9259561 - DNA, 22 bp, Homo sapiens
acatattgagctctaaaagtac

SEQ ID NO: 9259562 - DNA, 22 bp, Homo sapiens
acatattggcaaactggaggca

SEQ ID NO: 9259563 - DNA, 22 bp, Homo sapiens
acatattgagctctaaaagtac

SEQ ID NO: 9259564 - DNA, 22 bp, Homo sapiens
acatattaactgcactacacta

SEQ ID NO: 9259565 - DNA, 22 bp, Homo sapiens
acatatttccatgcagcatgtc

SEQ ID NO: 9259566 - DNA, 22 bp, Homo sapiens
acatatttccatgcagcatgtc

SEQ ID NO: 9259567 - DNA, 22 bp, Homo sapiens
aggcagctgccctctccttcct

SEQ ID NO: 9259568 - DNA, 22 bp, Homo sapiens
aggcagctgaggtctggcgccc

SEQ ID NO: 9259569 - DNA, 22 bp, Homo sapiens
acatagtaagtgctcagtaaat

SEQ ID NO: 9259570 - DNA, 22 bp, Homo sapiens
acatagcatgtttggacacatg

SEQ ID NO: 9259571 - DNA, 22 bp, Homo sapiens
acatagcataaagaatgactct

SEQ ID NO: 9259572 - DNA, 22 bp, Homo sapiens
acatagcttaaatgagaagata

SEQ ID NO: 9259573 - DNA, 19 bp, Homo sapiens
acatagctggctacactgt

SEQ ID NO: 9259574 - DNA, 22 bp, Homo sapiens
acatagctcagcataatcgtgg

SEQ ID NO: 9259575 - DNA, 22 bp, Homo sapiens
acatagatttaagagcaattag

SEQ ID NO: 9259576 - DNA, 21 bp, Homo sapiens
acatacattatctttttaaaa

SEQ ID NO: 9259577 - DNA, 21 bp, Homo sapiens
acatacattatctttttaaaa

SEQ ID NO: 9259578 - DNA, 21 bp, Homo sapiens
acatacattatctttttaaaa

SEQ ID NO: 9259579 - DNA, 22 bp, Homo sapiens
acatagaacttcccagtgagca

SEQ ID NO: 9259580 - DNA, 22 bp, Homo sapiens
acatagaaggaagagtagtagg

SEQ ID NO: 9259581 - DNA, 19 bp, Homo sapiens
aggatggagcaggcggtga

SEQ ID NO: 9259582 - DNA, 22 bp, Homo sapiens
acagtttataaaaataatgagg

SEQ ID NO: 9259583 - DNA, 22 bp, Homo sapiens
acagtttataaaaataatgagg

SEQ ID NO: 9259584 - DNA, 22 bp, Homo sapiens
acagtttatcgattcacctacc

SEQ ID NO: 9259585 - DNA, 20 bp, Homo sapiens
acagtttatccagttagcag

SEQ ID NO: 9259586 - DNA, 20 bp, Homo sapiens
aggatgcagggagtctgcag

SEQ ID NO: 9259587 - DNA, 22 bp, Homo sapiens
aggatgagattccagggtcaat

SEQ ID NO: 9259588 - DNA, 22 bp, Homo sapiens
aggatgagagatacatggagca

SEQ ID NO: 9259589 - DNA, 22 bp, Homo sapiens
aggcactgggtaattagtagct

SEQ ID NO: 9259590 - DNA, 20 bp, Homo sapiens
aggcactggggataggtaag

SEQ ID NO: 9259591 - DNA, 22 bp, Homo sapiens
aggcactgggggatgagcaagg

SEQ ID NO: 9259592 - DNA, 22 bp, Homo sapiens
aggcactgcttctaagtaggaa

SEQ ID NO: 9259593 - DNA, 18 bp, Homo sapiens
aggcactggaattaaggg

SEQ ID NO: 9259594 - DNA, 20 bp, Homo sapiens
aggcactggatttcttatat

SEQ ID NO: 9259595 - DNA, 22 bp, Homo sapiens
aggcactgggaatatgctgagg

SEQ ID NO: 9259596 - DNA, 22 bp, Homo sapiens
aggcactgggaatatgctgagg

SEQ ID NO: 9259597 - DNA, 17 bp, Homo sapiens
acagtttgattttagca

SEQ ID NO: 9259598 - DNA, 22 bp, Homo sapiens
aggcactgcttctaagtaggaa

SEQ ID NO: 9259599 - DNA, 22 bp, Homo sapiens
acagtttatggtgttttatata

SEQ ID NO: 9259600 - DNA, 22 bp, Homo sapiens
acagtttattgcacaggtaacc

SEQ ID NO: 9259601 - DNA, 17 bp, Homo sapiens
acagtctgcctgacagt

SEQ ID NO: 9259602 - DNA, 22 bp, Homo sapiens
acagtctgcttgtctccatggt

SEQ ID NO: 9259603 - DNA, 22 bp, Homo sapiens
acagtctgcttgtctccatggt

SEQ ID NO: 9259604 - DNA, 22 bp, Homo sapiens
acagtctgcaggcaagttctac

SEQ ID NO: 9259605 - DNA, 22 bp, Homo sapiens
acagtctgcatatgacctgtag

SEQ ID NO: 9259606 - DNA, 22 bp, Homo sapiens
acagtgtctcctggtacccagt

SEQ ID NO: 9259607 - DNA, 22 bp, Homo sapiens
acagtgtctgacacattgtagc

SEQ ID NO: 9259608 - DNA, 23 bp, Homo sapiens
acagtgtctgctgcaagatatct

SEQ ID NO: 9259609 - DNA, 22 bp, Homo sapiens
acagtgtggtttgagcactggg

SEQ ID NO: 9259610 - DNA, 22 bp, Homo sapiens
acagtctaggcctaggtcaaaa

SEQ ID NO: 9259611 - DNA, 22 bp, Homo sapiens
acagtctctgttgctgctgttt

SEQ ID NO: 9259612 - DNA, 22 bp, Homo sapiens
acagtctctccacactgcaggg

SEQ ID NO: 9259613 - DNA, 22 bp, Homo sapiens
acagtcctaagataattgtctc

SEQ ID NO: 9259614 - DNA, 22 bp, Homo sapiens
acagtcctagctgcaaagaagt

SEQ ID NO: 9259615 - DNA, 20 bp, Homo sapiens
acagtcctgcactggtgttt

SEQ ID NO: 9259616 - DNA, 23 bp, Homo sapiens
acagtcgtaggtatccttttcct

SEQ ID NO: 9259617 - DNA, 22 bp, Homo sapiens
acagtccttgtgtggaacatta

SEQ ID NO: 9259618 - DNA, 22 bp, Homo sapiens
acagtcaggccgagatgggcct

SEQ ID NO: 9259619 - DNA, 22 bp, Homo sapiens
acagtcaatcagaacagcatgt

SEQ ID NO: 9259620 - DNA, 22 bp, Homo sapiens
aggacacacttctgaggtcttt

SEQ ID NO: 9259621 - DNA, 22 bp, Homo sapiens
aggacacagctcttcagtaaga

SEQ ID NO: 9259622 - DNA, 22 bp, Homo sapiens
aggacacaggtaagccagtgga

SEQ ID NO: 9259623 - DNA, 22 bp, Homo sapiens
acagtaaatattaagcctgagt

SEQ ID NO: 9259624 - DNA, 22 bp, Homo sapiens
acagtaaataatgcatgttgat

SEQ ID NO: 9259625 - DNA, 22 bp, Homo sapiens
acagtaaataatgcatgttgat

SEQ ID NO: 9259626 - DNA, 16 bp, Homo sapiens
acagtaaagctggaca

SEQ ID NO: 9259627 - DNA, 22 bp, Homo sapiens
acagtaaagccttctggttgac

SEQ ID NO: 9259628 - DNA, 22 bp, Homo sapiens
acagtaaacaatgcagcaaatt

SEQ ID NO: 9259629 - DNA, 18 bp, Homo sapiens
acagtaaagaaaggaatt

SEQ ID NO: 9259630 - DNA, 18 bp, Homo sapiens
acagtaaagaaaggaatt

SEQ ID NO: 9259631 - DNA, 22 bp, Homo sapiens
acagtaaagccttctggttgac

SEQ ID NO: 9259632 - DNA, 22 bp, Homo sapiens
acagtaaaacatttttattagg

SEQ ID NO: 9259633 - DNA, 22 bp, Homo sapiens
acagtaaaattaagggcagtta

SEQ ID NO: 9259634 - DNA, 22 bp, Homo sapiens
acagtaaaaagccttagaattt

SEQ ID NO: 9259635 - DNA, 22 bp, Homo sapiens
acagtaaaaagccttagaattt

SEQ ID NO: 9259636 - DNA, 22 bp, Homo sapiens
acagtatgaatgcagaatgtag

SEQ ID NO: 9259637 - DNA, 22 bp, Homo sapiens
acagtatatatagtctaaaagc

SEQ ID NO: 9259638 - DNA, 22 bp, Homo sapiens
aggagcagaccgtagtcctgca

SEQ ID NO: 9259639 - DNA, 22 bp, Homo sapiens
aggagcagaccgtagtcctgca

SEQ ID NO: 9259640 - DNA, 22 bp, Homo sapiens
aggagcactgagccagcatggg

SEQ ID NO: 9259641 - DNA, 22 bp, Homo sapiens
aggagcagaactgttgtggagg

SEQ ID NO: 9259642 - DNA, 22 bp, Homo sapiens
aggagcaaggaagctacagttt

SEQ ID NO: 9259643 - DNA, 22 bp, Homo sapiens
aggagcaaatgatgagacagca

SEQ ID NO: 9259644 - DNA, 20 bp, Homo sapiens
atacacttgcccagcttgtg

SEQ ID NO: 9259645 - DNA, 22 bp, Homo sapiens
acttacaatcaaccaccttgga

SEQ ID NO: 9259646 - DNA, 22 bp, Homo sapiens
acttacaatcaaccaccttgga

SEQ ID NO: 9259647 - DNA, 22 bp, Homo sapiens
acttacaagctagggaagcttg

SEQ ID NO: 9259648 - DNA, 22 bp, Homo sapiens
acttaatggttcctaaaatgtg

SEQ ID NO: 9259649 - DNA, 22 bp, Homo sapiens
acttacaagttccctttctcag

SEQ ID NO: 9259650 - DNA, 22 bp, Homo sapiens
acttacaagctagggaagcttg

SEQ ID NO: 9259651 - DNA, 23 bp, Homo sapiens
acttaaatggttctttatctcag

SEQ ID NO: 9259652 - DNA, 21 bp, Homo sapiens
acttaaattccttgatattta

SEQ ID NO: 9259653 - DNA, 21 bp, Homo sapiens
acttaaattccttgatattta

SEQ ID NO: 9259654 - DNA, 22 bp, Homo sapiens
ataatgctgggagaaattgtta

SEQ ID NO: 9259655 - DNA, 22 bp, Homo sapiens
ataatgctgggagaaattgtta

SEQ ID NO: 9259656 - DNA, 22 bp, Homo sapiens
ataatgcatttagaataattca

SEQ ID NO: 9259657 - DNA, 22 bp, Homo sapiens
ataatgcatttagaataattca

SEQ ID NO: 9259658 - DNA, 22 bp, Homo sapiens
acttaaagttataatttgctaa

SEQ ID NO: 9259659 - DNA, 22 bp, Homo sapiens
atacagggacatccagtttttc

SEQ ID NO: 9259660 - DNA, 22 bp, Homo sapiens
atacagcttatgcatatatctc

SEQ ID NO: 9259661 - DNA, 22 bp, Homo sapiens
atacagctgccttctaactatg

SEQ ID NO: 9259662 - DNA, 22 bp, Homo sapiens
atacagcttacagttctaatgc

SEQ ID NO: 9259663 - DNA, 22 bp, Homo sapiens
atacagtaaccacattctatag

SEQ ID NO: 9259664 - DNA, 22 bp, Homo sapiens
actttatttcctattgcatcca

SEQ ID NO: 9259665 - DNA, 22 bp, Homo sapiens
actttatttcctattgcatcca

SEQ ID NO: 9259666 - DNA, 22 bp, Homo sapiens
actttatttcctattgcatcca

SEQ ID NO: 9259667 - DNA, 22 bp, Homo sapiens
atactgtagaggcatagctagt

SEQ ID NO: 9259668 - DNA, 22 bp, Homo sapiens
atactgtacgtcccagatagga

SEQ ID NO: 9259669 - DNA, 22 bp, Homo sapiens
atactgtaatacctaaatgaac

SEQ ID NO: 9259670 - DNA, 22 bp, Homo sapiens
atactgaattaggtaaagcata

SEQ ID NO: 9259671 - DNA, 22 bp, Homo sapiens
atactgaattaggtaaagcata

SEQ ID NO: 9259672 - DNA, 22 bp, Homo sapiens
atactgaaggcattcagataac

SEQ ID NO: 9259673 - DNA, 22 bp, Homo sapiens
acttctggtgtcatactgcatt

SEQ ID NO: 9259674 - DNA, 22 bp, Homo sapiens
acttctgtatgtcctgcattca

SEQ ID NO: 9259675 - DNA, 22 bp, Homo sapiens
acttctgtaaagggaagacagt

SEQ ID NO: 9259676 - DNA, 22 bp, Homo sapiens
acttcttcttcagctgggggat

SEQ ID NO: 9259677 - DNA, 22 bp, Homo sapiens
acttctgtcctccaagccacgt

SEQ ID NO: 9259678 - DNA, 22 bp, Homo sapiens
atacatgttcgtgtacatgttc

SEQ ID NO: 9259679 - DNA, 22 bp, Homo sapiens
atacatgttgagaaaatatctg

SEQ ID NO: 9259680 - DNA, 22 bp, Homo sapiens
acttcttgggaccctggcaccg

SEQ ID NO: 9259681 - DNA, 22 bp, Homo sapiens
atacatctatgcctttctgaca

SEQ ID NO: 9259682 - DNA, 22 bp, Homo sapiens
atacattagctcatatgattaa

SEQ ID NO: 9259683 - DNA, 22 bp, Homo sapiens
atacattagctcatatgattaa

SEQ ID NO: 9259684 - DNA, 22 bp, Homo sapiens
atacattagctcatatgattaa

SEQ ID NO: 9259685 - DNA, 22 bp, Homo sapiens
atacattagctcatatgattaa

SEQ ID NO: 9259686 - DNA, 22 bp, Homo sapiens
atacattagtgaacaaaagaga

SEQ ID NO: 9259687 - DNA, 22 bp, Homo sapiens
atacattagaatctggtactca

SEQ ID NO: 9259688 - DNA, 22 bp, Homo sapiens
atacattagaatctggtactca

SEQ ID NO: 9259689 - DNA, 22 bp, Homo sapiens
atacatgttgtaccatatgttt

SEQ ID NO: 9259690 - DNA, 19 bp, Homo sapiens
actgtcacataaaggaagg

SEQ ID NO: 9259691 - DNA, 22 bp, Homo sapiens
actgtcaaggaaacaaaattac

SEQ ID NO: 9259692 - DNA, 22 bp, Homo sapiens
actgtcactccaactgagtcgt

SEQ ID NO: 9259693 - DNA, 22 bp, Homo sapiens
actgtcaccatcagagcgggaa

SEQ ID NO: 9259694 - DNA, 22 bp, Homo sapiens
actgtcacctaaattttcattg

SEQ ID NO: 9259695 - DNA, 22 bp, Homo sapiens
actgtcacttgcaactgtgagg

SEQ ID NO: 9259696 - DNA, 22 bp, Homo sapiens
actgtcatcttgtaagcaatgt

SEQ ID NO: 9259697 - DNA, 22 bp, Homo sapiens
ataaaaactgacccatcctttg

SEQ ID NO: 9259698 - DNA, 22 bp, Homo sapiens
actgtcatcagaagatgaaaat

SEQ ID NO: 9259699 - DNA, 22 bp, Homo sapiens
actgtattctagtcatgtttgt

SEQ ID NO: 9259700 - DNA, 22 bp, Homo sapiens
actgtattggaaatatagcaaa

SEQ ID NO: 9259701 - DNA, 22 bp, Homo sapiens
actgtatatacagctcaaggaa

SEQ ID NO: 9259702 - DNA, 22 bp, Homo sapiens
actgtatattggacaaggaaaa

SEQ ID NO: 9259703 - DNA, 22 bp, Homo sapiens
actgtattcctactagaatcta

SEQ ID NO: 9259704 - DNA, 22 bp, Homo sapiens
actgtattcctactagaatcta

SEQ ID NO: 9259705 - DNA, 22 bp, Homo sapiens
actgtataaggcataggtaagc

SEQ ID NO: 9259706 - DNA, 22 bp, Homo sapiens
actgtatacttctgtatacaat

SEQ ID NO: 9259707 - DNA, 22 bp, Homo sapiens
actgtatacttctgtatacaat

SEQ ID NO: 9259708 - DNA, 22 bp, Homo sapiens
actgtatagatggagttgattt

SEQ ID NO: 9259709 - DNA, 22 bp, Homo sapiens
actgtattttgggtgtattttc

SEQ ID NO: 9259710 - DNA, 22 bp, Homo sapiens
actgtattttgtactttcgtgt

SEQ ID NO: 9259711 - DNA, 22 bp, Homo sapiens
actgtatttccaacagacaaat

SEQ ID NO: 9259712 - DNA, 22 bp, Homo sapiens
actgtatttggatataagatct

SEQ ID NO: 9259713 - DNA, 22 bp, Homo sapiens
actgtatttccaacagacaaat

SEQ ID NO: 9259714 - DNA, 22 bp, Homo sapiens
actgggaatctcaggaacatgg

SEQ ID NO: 9259715 - DNA, 22 bp, Homo sapiens
actgggaaggaaaggaatgtaa

SEQ ID NO: 9259716 - DNA, 22 bp, Homo sapiens
actgggactgtatgtgctggac

SEQ ID NO: 9259717 - DNA, 22 bp, Homo sapiens
actgggaagagagaattctgtc

SEQ ID NO: 9259718 - DNA, 22 bp, Homo sapiens
actgggaagacaagaaagatag

SEQ ID NO: 9259719 - DNA, 22 bp, Homo sapiens
actgtagaggcctggattgagg

SEQ ID NO: 9259720 - DNA, 22 bp, Homo sapiens
actgtacatgtaaacattgtca

SEQ ID NO: 9259721 - DNA, 22 bp, Homo sapiens
ataaaatttgctactgttaaat

SEQ ID NO: 9259722 - DNA, 22 bp, Homo sapiens
ataaaatttgctactgttaaat

SEQ ID NO: 9259723 - DNA, 22 bp, Homo sapiens
ataaacaagactggccaacttt

SEQ ID NO: 9259724 - DNA, 22 bp, Homo sapiens
ataaacaagactggccaacttt

SEQ ID NO: 9259725 - DNA, 22 bp, Homo sapiens
ataaaatggtaaacgaagctga

SEQ ID NO: 9259726 - DNA, 22 bp, Homo sapiens
ataaaatgtctccactgggctc

SEQ ID NO: 9259727 - DNA, 22 bp, Homo sapiens
ataaaatttgctactgttaaat

SEQ ID NO: 9259728 - DNA, 22 bp, Homo sapiens
ataaaatttgctactgttaaat

SEQ ID NO: 9259729 - DNA, 22 bp, Homo sapiens
ataaaatttgctactgttaaat

SEQ ID NO: 9259730 - DNA, 21 bp, Homo sapiens
actgtgataatgctttttctg

SEQ ID NO: 9259731 - DNA, 22 bp, Homo sapiens
actgtgagtgatttccttctgg

SEQ ID NO: 9259732 - DNA, 22 bp, Homo sapiens
actgtgatgttctctatcttgg

SEQ ID NO: 9259733 - DNA, 22 bp, Homo sapiens
ataatccattaattaatgacca

SEQ ID NO: 9259734 - DNA, 22 bp, Homo sapiens
ataatctgacaaagacttaagc

SEQ ID NO: 9259735 - DNA, 22 bp, Homo sapiens
ataatccattaattaatgacca

SEQ ID NO: 9259736 - DNA, 22 bp, Homo sapiens
ataatcttgtatttcctaaagt

SEQ ID NO: 9259737 - DNA, 22 bp, Homo sapiens
ataatctgtggatggttttgag

SEQ ID NO: 9259738 - DNA, 22 bp, Homo sapiens
ataatgcacctttgagtatggc

SEQ ID NO: 9259739 - DNA, 22 bp, Homo sapiens
ataatgcagcttttcaatggcc

SEQ ID NO: 9259740 - DNA, 22 bp, Homo sapiens
ataatgcacctttgagtatggc

SEQ ID NO: 9259741 - DNA, 23 bp, Homo sapiens
ataatgcaagtggtggtaatctg

SEQ ID NO: 9259742 - DNA, 22 bp, Homo sapiens
actgtgcaggtagatgcctggg

SEQ ID NO: 9259743 - DNA, 22 bp, Homo sapiens
actgtgcatgaaccgaaacaaa

SEQ ID NO: 9259744 - DNA, 22 bp, Homo sapiens
actgtgcacacaaaaatagatt

SEQ ID NO: 9259745 - DNA, 22 bp, Homo sapiens
actgtgccacaattcaccaggg

SEQ ID NO: 9259746 - DNA, 22 bp, Homo sapiens
ataaggttggtcttaactacct

SEQ ID NO: 9259747 - DNA, 22 bp, Homo sapiens
ataatccatgtctagagtaaag

SEQ ID NO: 9259748 - DNA, 22 bp, Homo sapiens
agaaagggttctctgaggtgct

SEQ ID NO: 9259749 - DNA, 22 bp, Homo sapiens
agaaaggtcacttagcctcagc

SEQ ID NO: 9259750 - DNA, 22 bp, Homo sapiens
agaaaggtcaaaatcgtgacat

SEQ ID NO: 9259751 - DNA, 22 bp, Homo sapiens
agaaagtacagatgagacactt

SEQ ID NO: 9259752 - DNA, 22 bp, Homo sapiens
agaaaggtggatgctctggaat

SEQ ID NO: 9259753 - DNA, 22 bp, Homo sapiens
agaaagggctattttgaggtag

SEQ ID NO: 9259754 - DNA, 22 bp, Homo sapiens
agaaagggtcactgaaagagga

SEQ ID NO: 9259755 - DNA, 22 bp, Homo sapiens
agaaagggttctctgaggtgct

SEQ ID NO: 9259756 - DNA, 22 bp, Homo sapiens
agaaagttagcagactcttggc

SEQ ID NO: 9259757 - DNA, 22 bp, Homo sapiens
agaaagttaaacagtgataaga

SEQ ID NO: 9259758 - DNA, 22 bp, Homo sapiens
agaacagcagttatggttcatt

SEQ ID NO: 9259759 - DNA, 22 bp, Homo sapiens
agaacagcagcacgtcaagctg

SEQ ID NO: 9259760 - DNA, 22 bp, Homo sapiens
agaaagtttgagaactgtagat

SEQ ID NO: 9259761 - DNA, 22 bp, Homo sapiens
agaacactgctagtataatcac

SEQ ID NO: 9259762 - DNA, 22 bp, Homo sapiens
agaacacatagagaagttttat

SEQ ID NO: 9259763 - DNA, 22 bp, Homo sapiens
agaacacatagagaagttttat

SEQ ID NO: 9259764 - DNA, 22 bp, Homo sapiens
atcgaataattgcattctataa

SEQ ID NO: 9259765 - DNA, 22 bp, Homo sapiens
atcctttataagacttgtattc

SEQ ID NO: 9259766 - DNA, 18 bp, Homo sapiens
atcctgggagcagacagc

SEQ ID NO: 9259767 - DNA, 22 bp, Homo sapiens
atcatcttaaggtatctcaagc

SEQ ID NO: 9259768 - DNA, 22 bp, Homo sapiens
atcatcttcgaaaaaagtcaga

SEQ ID NO: 9259769 - DNA, 19 bp, Homo sapiens
atcatcctgggtcatgcac

SEQ ID NO: 9259770 - DNA, 22 bp, Homo sapiens
atcatcctagaaggaagctagg

SEQ ID NO: 9259771 - DNA, 22 bp, Homo sapiens
atcatcctattgtgccccaggt

SEQ ID NO: 9259772 - DNA, 22 bp, Homo sapiens
atcatctgggttaatgtgctca

SEQ ID NO: 9259773 - DNA, 22 bp, Homo sapiens
atcatctgcacagatcctattt

SEQ ID NO: 9259774 - DNA, 22 bp, Homo sapiens
agaacaggaggaagccagctcc

SEQ ID NO: 9259775 - DNA, 22 bp, Homo sapiens
atctatttctgctaataacaat

SEQ ID NO: 9259776 - DNA, 21 bp, Homo sapiens
atctcacagcccagagaagcc

SEQ ID NO: 9259777 - DNA, 22 bp, Homo sapiens
atctaaaaggagctctttatct

SEQ ID NO: 9259778 - DNA, 22 bp, Homo sapiens
atctaaaatgtggttagttggt

SEQ ID NO: 9259779 - DNA, 22 bp, Homo sapiens
atctaaaatgtggttagttggt

SEQ ID NO: 9259780 - DNA, 22 bp, Homo sapiens
atctaaaccctactttctttct

SEQ ID NO: 9259781 - DNA, 22 bp, Homo sapiens
atcgtaaagccctatggcttca

SEQ ID NO: 9259782 - DNA, 22 bp, Homo sapiens
atcggggaaaagggaggctgtg

SEQ ID NO: 9259783 - DNA, 22 bp, Homo sapiens
atcgttaatcttgtgtgtcaac

SEQ ID NO: 9259784 - DNA, 22 bp, Homo sapiens
agaaaataaattgatggtggaa

SEQ ID NO: 9259785 - DNA, 22 bp, Homo sapiens
agaaaagttttctgagactgac

SEQ ID NO: 9259786 - DNA, 22 bp, Homo sapiens
agaaaagtttaaatcttggcac

SEQ ID NO: 9259787 - DNA, 22 bp, Homo sapiens
atattcatcgtgtagaaatact

SEQ ID NO: 9259788 - DNA, 22 bp, Homo sapiens
atattcattgaacacctactac

SEQ ID NO: 9259789 - DNA, 22 bp, Homo sapiens
atattccagttatatcaaatca

SEQ ID NO: 9259790 - DNA, 22 bp, Homo sapiens
atatttcagctttacttaggaa

SEQ ID NO: 9259791 - DNA, 20 bp, Homo sapiens
atatttcaggtagtgtgccc

SEQ ID NO: 9259792 - DNA, 22 bp, Homo sapiens
atatttcaggttttgcaggccg

SEQ ID NO: 9259793 - DNA, 22 bp, Homo sapiens
atatttcacgtaggttgttttc

SEQ ID NO: 9259794 - DNA, 21 bp, Homo sapiens
atatttcagatttccgtaatc

SEQ ID NO: 9259795 - DNA, 22 bp, Homo sapiens
atatttcacgtaggttgttttc

SEQ ID NO: 9259796 - DNA, 23 bp, Homo sapiens
atatttccaggttagtgaggtaa

SEQ ID NO: 9259797 - DNA, 22 bp, Homo sapiens
atatttcatggggttccatact

SEQ ID NO: 9259798 - DNA, 22 bp, Homo sapiens
agaaagctccccatgagatgat

SEQ ID NO: 9259799 - DNA, 22 bp, Homo sapiens
atattctgggttagatatgttt

SEQ ID NO: 9259800 - DNA, 22 bp, Homo sapiens
atattcttatccttttctctgt

SEQ ID NO: 9259801 - DNA, 22 bp, Homo sapiens
atattcttatccttttctctgt

SEQ ID NO: 9259802 - DNA, 22 bp, Homo sapiens
atattcttccaaaacatcattt

SEQ ID NO: 9259803 - DNA, 22 bp, Homo sapiens
atattcttccaaaacatcattt

SEQ ID NO: 9259804 - DNA, 22 bp, Homo sapiens
atattcttccaaaacatcattt

SEQ ID NO: 9259805 - DNA, 22 bp, Homo sapiens
atatttataagcaagcaggact

SEQ ID NO: 9259806 - DNA, 22 bp, Homo sapiens
atatttataaggcaggcaagta

SEQ ID NO: 9259807 - DNA, 22 bp, Homo sapiens
atatttataagcaagcaggact

SEQ ID NO: 9259808 - DNA, 22 bp, Homo sapiens
atatggaagttacctgacttca

SEQ ID NO: 9259809 - DNA, 22 bp, Homo sapiens
atatggaactattctgtgtaga

SEQ ID NO: 9259810 - DNA, 22 bp, Homo sapiens
atatggaagttacctgacttca

SEQ ID NO: 9259811 - DNA, 18 bp, Homo sapiens
atatggaatgcctggcta

SEQ ID NO: 9259812 - DNA, 22 bp, Homo sapiens
atatggaactattctgtgtaga

SEQ ID NO: 9259813 - DNA, 22 bp, Homo sapiens
atatggaaatagcaatatggtt

SEQ ID NO: 9259814 - DNA, 22 bp, Homo sapiens
atatggaatggtaatctacaat

SEQ ID NO: 9259815 - DNA, 22 bp, Homo sapiens
atatgcttgactctttcacatc

SEQ ID NO: 9259816 - DNA, 22 bp, Homo sapiens
atatgcttgggactgatacagt

SEQ ID NO: 9259817 - DNA, 22 bp, Homo sapiens
atatgcttccaagttattccac

SEQ ID NO: 9259818 - DNA, 22 bp, Homo sapiens
atatgcttatgatggttaattt

SEQ ID NO: 9259819 - DNA, 22 bp, Homo sapiens
atatgaaagtaagcatgtgtgt

SEQ ID NO: 9259820 - DNA, 22 bp, Homo sapiens
actttctcccacccacccgtct

SEQ ID NO: 9259821 - DNA, 19 bp, Homo sapiens
actttctccaggacctgtt

SEQ ID NO: 9259822 - DNA, 22 bp, Homo sapiens
actttctccagaaaaccaagga

SEQ ID NO: 9259823 - DNA, 22 bp, Homo sapiens
actttctcaggaattcacagac

SEQ ID NO: 9259824 - DNA, 22 bp, Homo sapiens
actttctattcccacagagata

SEQ ID NO: 9259825 - DNA, 22 bp, Homo sapiens
actttctattgtttagattctg

SEQ ID NO: 9259826 - DNA, 22 bp, Homo sapiens
actttctattcccacagagata

SEQ ID NO: 9259827 - DNA, 22 bp, Homo sapiens
actttctcaaatcagactttaa

SEQ ID NO: 9259828 - DNA, 22 bp, Homo sapiens
actttctaggtctcagtccttt

SEQ ID NO: 9259829 - DNA, 22 bp, Homo sapiens
actttctattcccacagagata

SEQ ID NO: 9259830 - DNA, 22 bp, Homo sapiens
actttctattcccacagagata

SEQ ID NO: 9259831 - DNA, 22 bp, Homo sapiens
actttccttatggatggggaaa

SEQ ID NO: 9259832 - DNA, 22 bp, Homo sapiens
actttcctggccctgtcctctg

SEQ ID NO: 9259833 - DNA, 22 bp, Homo sapiens
actttcctagacttcagtgaca

SEQ ID NO: 9259834 - DNA, 22 bp, Homo sapiens
actttcatttgtaataaacttc

SEQ ID NO: 9259835 - DNA, 22 bp, Homo sapiens
actttcatttgtaataaacttc

SEQ ID NO: 9259836 - DNA, 22 bp, Homo sapiens
actttcatttgtaataaacttc

SEQ ID NO: 9259837 - DNA, 22 bp, Homo sapiens
actttcatttgtaataaacttc

SEQ ID NO: 9259838 - DNA, 22 bp, Homo sapiens
actttcaagccctctagagaca

SEQ ID NO: 9259839 - DNA, 22 bp, Homo sapiens
actttcaagcaagaacactttg

SEQ ID NO: 9259840 - DNA, 22 bp, Homo sapiens
actttcaagccctctagagaca

SEQ ID NO: 9259841 - DNA, 22 bp, Homo sapiens
actttcaagaacttctttaatg

SEQ ID NO: 9259842 - DNA, 22 bp, Homo sapiens
actttcaacttggtgggagagc

SEQ ID NO: 9259843 - DNA, 22 bp, Homo sapiens
actgaggcgcagtccggctgtc

SEQ ID NO: 9259844 - DNA, 22 bp, Homo sapiens
actgaggcttaaagagattagg

SEQ ID NO: 9259845 - DNA, 22 bp, Homo sapiens
actgaggcttacaaaggtaaag

SEQ ID NO: 9259846 - DNA, 22 bp, Homo sapiens
actgagggagagtcttaggttg

SEQ ID NO: 9259847 - DNA, 22 bp, Homo sapiens
actgaggcagaagggtaagtgg

SEQ ID NO: 9259848 - DNA, 22 bp, Homo sapiens
actgaggattagcccaggctag

SEQ ID NO: 9259849 - DNA, 22 bp, Homo sapiens
agtgcatgccttcctgtggatg

SEQ ID NO: 9259850 - DNA, 22 bp, Homo sapiens
agtgcatgaaagcatacaaggc

SEQ ID NO: 9259851 - DNA, 22 bp, Homo sapiens
agtgcatatatgaagagtatga

SEQ ID NO: 9259852 - DNA, 23 bp, Homo sapiens
agtgcatgcttgacttagcaagc

SEQ ID NO: 9259853 - DNA, 22 bp, Homo sapiens
actgagctcttgactgggagtt

SEQ ID NO: 9259854 - DNA, 22 bp, Homo sapiens
actgagctctgatgagatttgg

SEQ ID NO: 9259855 - DNA, 20 bp, Homo sapiens
actgagctgcatggagagga

SEQ ID NO: 9259856 - DNA, 22 bp, Homo sapiens
actcttatagtattggttatta

SEQ ID NO: 9259857 - DNA, 22 bp, Homo sapiens
actcttatgggaacaaggatta

SEQ ID NO: 9259858 - DNA, 22 bp, Homo sapiens
actctgtgtgagtagagcctgt

SEQ ID NO: 9259859 - DNA, 22 bp, Homo sapiens
agtgcagtggttaggagccagg

SEQ ID NO: 9259860 - DNA, 22 bp, Homo sapiens
actcttattccctcagaaatat

SEQ ID NO: 9259861 - DNA, 22 bp, Homo sapiens
actcttattttgaagtaataat

SEQ ID NO: 9259862 - DNA, 18 bp, Homo sapiens
agtcttgttctgttgccc

SEQ ID NO: 9259863 - DNA, 22 bp, Homo sapiens
agtctttaatgatcatgtattt

SEQ ID NO: 9259864 - DNA, 22 bp, Homo sapiens
agtctttaatgatcatgtattt

SEQ ID NO: 9259865 - DNA, 22 bp, Homo sapiens
agtcttctttcatttactcagt

SEQ ID NO: 9259866 - DNA, 22 bp, Homo sapiens
agtcttctttgtgttctctcat

SEQ ID NO: 9259867 - DNA, 22 bp, Homo sapiens
agtcttcttgatcttttcagtg

SEQ ID NO: 9259868 - DNA, 22 bp, Homo sapiens
agtcttctttcatttactcagt

SEQ ID NO: 9259869 - DNA, 23 bp, Homo sapiens
actcgtggaattctctgcgatcg

SEQ ID NO: 9259870 - DNA, 23 bp, Homo sapiens
actcgtggaattctctgcgatcg

SEQ ID NO: 9259871 - DNA, 22 bp, Homo sapiens
agtcttctgggtgtttccagag

SEQ ID NO: 9259872 - DNA, 22 bp, Homo sapiens
agtcccagcttcccccatgcag

SEQ ID NO: 9259873 - DNA, 22 bp, Homo sapiens
agtcccagcttcccccatgcag

SEQ ID NO: 9259874 - DNA, 22 bp, Homo sapiens
agtcccaggcagccgagccggt

SEQ ID NO: 9259875 - DNA, 22 bp, Homo sapiens
agtcccaggcagccgagccggt

SEQ ID NO: 9259876 - DNA, 19 bp, Homo sapiens
agtcccaggcccgaaagag

SEQ ID NO: 9259877 - DNA, 21 bp, Homo sapiens
agtcccaggggtgagtgatgt

SEQ ID NO: 9259878 - DNA, 22 bp, Homo sapiens
agtcccagtgacttggccagaa

SEQ ID NO: 9259879 - DNA, 22 bp, Homo sapiens
agtcccagtgacttggccagaa

SEQ ID NO: 9259880 - DNA, 22 bp, Homo sapiens
agtcccagttcggttcttcctc

SEQ ID NO: 9259881 - DNA, 22 bp, Homo sapiens
agtcccagttcggttcttcctc

SEQ ID NO: 9259882 - DNA, 22 bp, Homo sapiens
agtcccagtgagatgagccacg

SEQ ID NO: 9259883 - DNA, 22 bp, Homo sapiens
agtcccagtgagatgaaccagg

SEQ ID NO: 9259884 - DNA, 22 bp, Homo sapiens
agtcccagtgagatgaaccagg

SEQ ID NO: 9259885 - DNA, 22 bp, Homo sapiens
agtcccagtgagatgagccacg

SEQ ID NO: 9259886 - DNA, 22 bp, Homo sapiens
actcctgtgggcatggcacccc

SEQ ID NO: 9259887 - DNA, 22 bp, Homo sapiens
actcctggtttgtgtcctggct

SEQ ID NO: 9259888 - DNA, 22 bp, Homo sapiens
actgcacttcagcctgggtgac

SEQ ID NO: 9259889 - DNA, 22 bp, Homo sapiens
agtggcagtggctgggcagagc

SEQ ID NO: 9259890 - DNA, 22 bp, Homo sapiens
agtggcagtggctgggcagagc

SEQ ID NO: 9259891 - DNA, 22 bp, Homo sapiens
agtggcagtagatgagctggtt

SEQ ID NO: 9259892 - DNA, 20 bp, Homo sapiens
agtgtacagacactagaaat

SEQ ID NO: 9259893 - DNA, 22 bp, Homo sapiens
agtgtacagttctatgaatttc

SEQ ID NO: 9259894 - DNA, 20 bp, Homo sapiens
agtgtacagacactagaaat

SEQ ID NO: 9259895 - DNA, 22 bp, Homo sapiens
agtgtacagttctatgaatttc

SEQ ID NO: 9259896 - DNA, 22 bp, Homo sapiens
agtgtacatgtttacagcatct

SEQ ID NO: 9259897 - DNA, 22 bp, Homo sapiens
agtgtagacataggtctggtct

SEQ ID NO: 9259898 - DNA, 22 bp, Homo sapiens
agtgtagggtggtcagagcaga

SEQ ID NO: 9259899 - DNA, 22 bp, Homo sapiens
agtgtacatcagaacatatcaa

SEQ ID NO: 9259900 - DNA, 22 bp, Homo sapiens
agtgtacatcagaacatatcaa

SEQ ID NO: 9259901 - DNA, 22 bp, Homo sapiens
agtgtacatgtacacattagta

SEQ ID NO: 9259902 - DNA, 22 bp, Homo sapiens
actgcacttcagcctgggtgtc

SEQ ID NO: 9259903 - DNA, 22 bp, Homo sapiens
actgcagactctacagttataa

SEQ ID NO: 9259904 - DNA, 22 bp, Homo sapiens
actgcagagcttttcagttgag

SEQ ID NO: 9259905 - DNA, 21 bp, Homo sapiens
agtggggtctctgtggaggcc

SEQ ID NO: 9259906 - DNA, 22 bp, Homo sapiens
actgcagcaaagcccgtgtctt

SEQ ID NO: 9259907 - DNA, 22 bp, Homo sapiens
actgcagaggtggggtgcagag

SEQ ID NO: 9259908 - DNA, 22 bp, Homo sapiens
agtgtttaatgccttttccagc

SEQ ID NO: 9259909 - DNA, 22 bp, Homo sapiens
agtgtttaaactgaagtgatga

SEQ ID NO: 9259910 - DNA, 22 bp, Homo sapiens
agtgttgtcaaacggctcagca

SEQ ID NO: 9259911 - DNA, 22 bp, Homo sapiens
agtgtttaaactgaagtgatga

SEQ ID NO: 9259912 - DNA, 22 bp, Homo sapiens
agtgttgtatgggatgactgct

SEQ ID NO: 9259913 - DNA, 23 bp, Homo sapiens
agtgttggttgggaagccaagca

SEQ ID NO: 9259914 - DNA, 22 bp, Homo sapiens
agtgttgcatgaggcagtacca

SEQ ID NO: 9259915 - DNA, 22 bp, Homo sapiens
agtgttggaccgaggtggagcc

SEQ ID NO: 9259916 - DNA, 22 bp, Homo sapiens
agtgttcttcttcaaagctctg

SEQ ID NO: 9259917 - DNA, 22 bp, Homo sapiens
agtgttcttcctatctgctgtt

SEQ ID NO: 9259918 - DNA, 22 bp, Homo sapiens
agtgttcttcctatctgctgtt

SEQ ID NO: 9259919 - DNA, 22 bp, Homo sapiens
agtgtttacattgaagcttgta

SEQ ID NO: 9259920 - DNA, 22 bp, Homo sapiens
actggctttgagggaatagcta

SEQ ID NO: 9259921 - DNA, 23 bp, Homo sapiens
actggctttgatccagatagatt

SEQ ID NO: 9259922 - DNA, 22 bp, Homo sapiens
agtgtttatattatggaaatat

SEQ ID NO: 9259923 - DNA, 18 bp, Homo sapiens
actggctttagcatcaga

SEQ ID NO: 9259924 - DNA, 21 bp, Homo sapiens
agtgtaggtcattagctgttg

SEQ ID NO: 9259925 - DNA, 22 bp, Homo sapiens
agtgtaggtgagggcctgggtt

SEQ ID NO: 9259926 - DNA, 23 bp, Homo sapiens
actgctttattcatgaggctctc

SEQ ID NO: 9259927 - DNA, 22 bp, Homo sapiens
actgctttatctgagaagtcct

SEQ ID NO: 9259928 - DNA, 22 bp, Homo sapiens
actgctttatctgagaagtcct

SEQ ID NO: 9259929 - DNA, 22 bp, Homo sapiens
actgcttttagaaatctataga

SEQ ID NO: 9259930 - DNA, 22 bp, Homo sapiens
actgcttttctaagattctgtg

SEQ ID NO: 9259931 - DNA, 16 bp, Homo sapiens
actgcttttcataaga

SEQ ID NO: 9259932 - DNA, 22 bp, Homo sapiens
actgcttttagaaatctataga

SEQ ID NO: 9259933 - DNA, 22 bp, Homo sapiens
actgctttgctctgcccccagg

SEQ ID NO: 9259934 - DNA, 22 bp, Homo sapiens
actgctttatctgagaagtcct

SEQ ID NO: 9259935 - DNA, 22 bp, Homo sapiens
actgcttttcagagtctgcctg

SEQ ID NO: 9259936 - DNA, 22 bp, Homo sapiens
actggaaaattcaaatggggtc

SEQ ID NO: 9259937 - DNA, 22 bp, Homo sapiens
actgcttttgatctcttctgta

SEQ ID NO: 9259938 - DNA, 22 bp, Homo sapiens
actgcttttgatctcttctgta

SEQ ID NO: 9259939 - DNA, 21 bp, Homo sapiens
actggaagtgggtcaggaagt

SEQ ID NO: 9259940 - DNA, 22 bp, Homo sapiens
actggaaattgagaggtcactg

SEQ ID NO: 9259941 - DNA, 22 bp, Homo sapiens
agtgtgtgaccttttaatttaa

SEQ ID NO: 9259942 - DNA, 22 bp, Homo sapiens
acctgaaaccaacttgtgtact

SEQ ID NO: 9259943 - DNA, 22 bp, Homo sapiens
acctctttgaacctcagtgtga

SEQ ID NO: 9259944 - DNA, 22 bp, Homo sapiens
accctccaggctgcagctcctg

SEQ ID NO: 9259945 - DNA, 22 bp, Homo sapiens
accctcccatttccatgtagca

SEQ ID NO: 9259946 - DNA, 22 bp, Homo sapiens
accctcccatttccatgtagca

SEQ ID NO: 9259947 - DNA, 19 bp, Homo sapiens
accctctcagtgcctgagg

SEQ ID NO: 9259948 - DNA, 22 bp, Homo sapiens
accctccccaagaggtcgtgcc

SEQ ID NO: 9259949 - DNA, 22 bp, Homo sapiens
accctccccaagaggtcgtgcc

SEQ ID NO: 9259950 - DNA, 19 bp, Homo sapiens
accctctcagtgcctgagg

SEQ ID NO: 9259951 - DNA, 19 bp, Homo sapiens
accctctccccactgggtc

SEQ ID NO: 9259952 - DNA, 19 bp, Homo sapiens
accctctccccactgggtc

SEQ ID NO: 9259953 - DNA, 19 bp, Homo sapiens
accctctctgtagaaagat

SEQ ID NO: 9259954 - DNA, 22 bp, Homo sapiens
acctgagggcccaaacttggta

SEQ ID NO: 9259955 - DNA, 22 bp, Homo sapiens
acctgaggctgttagtctaggt

SEQ ID NO: 9259956 - DNA, 22 bp, Homo sapiens
acctgaggcctccccagcagac

SEQ ID NO: 9259957 - DNA, 22 bp, Homo sapiens
acctgaggcctccccagcagac

SEQ ID NO: 9259958 - DNA, 22 bp, Homo sapiens
acctgagcctagggaggttgag

SEQ ID NO: 9259959 - DNA, 22 bp, Homo sapiens
acctgagcatgccaggagagtg

SEQ ID NO: 9259960 - DNA, 22 bp, Homo sapiens
acctgagacctaatctgactgt

SEQ ID NO: 9259961 - DNA, 22 bp, Homo sapiens
acctgcagtggccactcctaat

SEQ ID NO: 9259962 - DNA, 22 bp, Homo sapiens
acctgcagccacttctctcctt

SEQ ID NO: 9259963 - DNA, 22 bp, Homo sapiens
acctgcagctaaagatgtaggg

SEQ ID NO: 9259964 - DNA, 22 bp, Homo sapiens
acctgcaggcacaggtgtgcgc

SEQ ID NO: 9259965 - DNA, 22 bp, Homo sapiens
acctgcagctgagaaaatgact

SEQ ID NO: 9259966 - DNA, 19 bp, Homo sapiens
acctgcagtaataattcct

SEQ ID NO: 9259967 - DNA, 22 bp, Homo sapiens
acctgcagtggccactcctaat

SEQ ID NO: 9259968 - DNA, 22 bp, Homo sapiens
acctgcagtggccactcctaat

SEQ ID NO: 9259969 - DNA, 22 bp, Homo sapiens
acctgcaggtgtttccacactt

SEQ ID NO: 9259970 - DNA, 22 bp, Homo sapiens
acctgcaggggtgctctctggg

SEQ ID NO: 9259971 - DNA, 22 bp, Homo sapiens
acctgcaggggtgctctctggg

SEQ ID NO: 9259972 - DNA, 22 bp, Homo sapiens
aggtcctgtcttatctctgtaa

SEQ ID NO: 9259973 - DNA, 22 bp, Homo sapiens
aggtcctgtcttatctctgtaa

SEQ ID NO: 9259974 - DNA, 22 bp, Homo sapiens
aggtccagttttcagttctcat

SEQ ID NO: 9259975 - DNA, 22 bp, Homo sapiens
aggtctcttgctgtctctgggc

SEQ ID NO: 9259976 - DNA, 22 bp, Homo sapiens
acctggagtcatttgaggagta

SEQ ID NO: 9259977 - DNA, 22 bp, Homo sapiens
aggtggctatgaggatgcagtc

SEQ ID NO: 9259978 - DNA, 18 bp, Homo sapiens
aggtggcctgggagcttt

SEQ ID NO: 9259979 - DNA, 18 bp, Homo sapiens
aggtggcctgggagcttt

SEQ ID NO: 9259980 - DNA, 22 bp, Homo sapiens
aggtggcatttacaccatggga

SEQ ID NO: 9259981 - DNA, 22 bp, Homo sapiens
aggtggagatcagggactaagg

SEQ ID NO: 9259982 - DNA, 22 bp, Homo sapiens
acctggcacacactggggagtg

SEQ ID NO: 9259983 - DNA, 22 bp, Homo sapiens
agtaaaattaatggatcagaag

SEQ ID NO: 9259984 - DNA, 22 bp, Homo sapiens
agtaaacactgtctttatatat

SEQ ID NO: 9259985 - DNA, 22 bp, Homo sapiens
agtaaacacgtggggtttcttt

SEQ ID NO: 9259986 - DNA, 22 bp, Homo sapiens
agtaaaattgtattggaaaaca

SEQ ID NO: 9259987 - DNA, 22 bp, Homo sapiens
agtaaaattgtattggaaaaca

SEQ ID NO: 9259988 - DNA, 22 bp, Homo sapiens
agtaaacactgtctttatatat

SEQ ID NO: 9259989 - DNA, 20 bp, Homo sapiens
aggtggctcctgctgggggt

SEQ ID NO: 9259990 - DNA, 22 bp, Homo sapiens
acgcagaagggcctggcgtgcc

SEQ ID NO: 9259991 - DNA, 22 bp, Homo sapiens
acgcctgtaatcccagcacttt

SEQ ID NO: 9259992 - DNA, 22 bp, Homo sapiens
acgcccggtctccatagttttt

SEQ ID NO: 9259993 - DNA, 22 bp, Homo sapiens
acgcccagactcccatactttg

SEQ ID NO: 9259994 - DNA, 22 bp, Homo sapiens
acgcccagactcccatactttg

SEQ ID NO: 9259995 - DNA, 22 bp, Homo sapiens
acgcccagactcccatactttg

SEQ ID NO: 9259996 - DNA, 22 bp, Homo sapiens
aggttgaagagactttaaatta

SEQ ID NO: 9259997 - DNA, 22 bp, Homo sapiens
aggttgaaataggttatctaag

SEQ ID NO: 9259998 - DNA, 22 bp, Homo sapiens
aggttcttttggccaacctcat

SEQ ID NO: 9259999 - DNA, 22 bp, Homo sapiens
acggcttcttgactgtgggttg

SEQ ID NO: 9260000 - DNA, 22 bp, Homo sapiens
acggcaggctcagagctggaat

SEQ ID NO: 9260001 - DNA, 22 bp, Homo sapiens
acgcctgtaatcccagcacttt

SEQ ID NO: 9260002 - DNA, 22 bp, Homo sapiens
agtattttcgccatcacaagaa

SEQ ID NO: 9260003 - DNA, 22 bp, Homo sapiens
agtcaaagatgaccgagttcct

SEQ ID NO: 9260004 - DNA, 22 bp, Homo sapiens
agtcaaagatgaccgagttcct

SEQ ID NO: 9260005 - DNA, 22 bp, Homo sapiens
agtcaaagatgaccgagttcct

SEQ ID NO: 9260006 - DNA, 22 bp, Homo sapiens
agtatttgatcagatgatagta

SEQ ID NO: 9260007 - DNA, 21 bp, Homo sapiens
agtatttcttcatgtccttgc

SEQ ID NO: 9260008 - DNA, 22 bp, Homo sapiens
agtatactccccatcctagaaa

SEQ ID NO: 9260009 - DNA, 22 bp, Homo sapiens
agtatactgaaagtaaatatga

SEQ ID NO: 9260010 - DNA, 22 bp, Homo sapiens
actagtctgccagggagaggca

SEQ ID NO: 9260011 - DNA, 22 bp, Homo sapiens
actagtcatttaggtgatatta

SEQ ID NO: 9260012 - DNA, 22 bp, Homo sapiens
actaggaaggcatatgggcaga

SEQ ID NO: 9260013 - DNA, 22 bp, Homo sapiens
actaggaaggcatatgggcaga

SEQ ID NO: 9260014 - DNA, 22 bp, Homo sapiens
actagggaaagttatgttcaca

SEQ ID NO: 9260015 - DNA, 22 bp, Homo sapiens
actagggaaagttatgttcaca

SEQ ID NO: 9260016 - DNA, 22 bp, Homo sapiens
agtcaacaaaaatgtggagcct

SEQ ID NO: 9260017 - DNA, 22 bp, Homo sapiens
agtcaaatgagtaaatatataa

SEQ ID NO: 9260018 - DNA, 23 bp, Homo sapiens
actcagctttgggagatgactca

SEQ ID NO: 9260019 - DNA, 22 bp, Homo sapiens
actcaggaatggggctgggact

SEQ ID NO: 9260020 - DNA, 22 bp, Homo sapiens
agtcccagctcagaaccactag

SEQ ID NO: 9260021 - DNA, 22 bp, Homo sapiens
agtcccagctcagaaccactag

SEQ ID NO: 9260022 - DNA, 22 bp, Homo sapiens
agtcccagctctgccacttact

SEQ ID NO: 9260023 - DNA, 22 bp, Homo sapiens
agtcccagctctgccacttact

SEQ ID NO: 9260024 - DNA, 22 bp, Homo sapiens
agtccaggcgggtatagaggct

SEQ ID NO: 9260025 - DNA, 22 bp, Homo sapiens
agagctgggtggacttgtagtt

SEQ ID NO: 9260026 - DNA, 22 bp, Homo sapiens
agagctgggtggtggtgactca

SEQ ID NO: 9260027 - DNA, 22 bp, Homo sapiens
agagctggggccagagtcaagg

SEQ ID NO: 9260028 - DNA, 22 bp, Homo sapiens
agagctgggtgaagtgccatca

SEQ ID NO: 9260029 - DNA, 22 bp, Homo sapiens
agagctgggtgaagtgccatca

SEQ ID NO: 9260030 - DNA, 22 bp, Homo sapiens
aattttattaactggatgtagc

SEQ ID NO: 9260031 - DNA, 22 bp, Homo sapiens
aattttattagaaggcaagggg

SEQ ID NO: 9260032 - DNA, 22 bp, Homo sapiens
aattttattagaaggcaagggg

SEQ ID NO: 9260033 - DNA, 22 bp, Homo sapiens
aattttcacagtgctgtgagat

SEQ ID NO: 9260034 - DNA, 22 bp, Homo sapiens
aattttattagaaggcaagggg

SEQ ID NO: 9260035 - DNA, 22 bp, Homo sapiens
aattttattagaaggcaagggg

SEQ ID NO: 9260036 - DNA, 22 bp, Homo sapiens
aattttccatccaaagtaacat

SEQ ID NO: 9260037 - DNA, 22 bp, Homo sapiens
aattttattaactggatgtagc

SEQ ID NO: 9260038 - DNA, 22 bp, Homo sapiens
aattttattaactggatgtagc

SEQ ID NO: 9260039 - DNA, 22 bp, Homo sapiens
aattttattaactggatgtagc

SEQ ID NO: 9260040 - DNA, 22 bp, Homo sapiens
aattttatgccttgcacgttgg

SEQ ID NO: 9260041 - DNA, 22 bp, Homo sapiens
aattttatgccttgcacgttgg

SEQ ID NO: 9260042 - DNA, 22 bp, Homo sapiens
agaggccatgctagaggcctgg

SEQ ID NO: 9260043 - DNA, 22 bp, Homo sapiens
agaggccatgctagaggcctgg

SEQ ID NO: 9260044 - DNA, 22 bp, Homo sapiens
agaggccatggggcatttttca

SEQ ID NO: 9260045 - DNA, 21 bp, Homo sapiens
agaggccctcggactgggcgt

SEQ ID NO: 9260046 - DNA, 22 bp, Homo sapiens
agaggccatctgctctgtgggg

SEQ ID NO: 9260047 - DNA, 22 bp, Homo sapiens
agaggccatctgctctgtgggg

SEQ ID NO: 9260048 - DNA, 22 bp, Homo sapiens
agaggccatgctagaggcctgg

SEQ ID NO: 9260049 - DNA, 22 bp, Homo sapiens
agaggccaggtccagagtttgt

SEQ ID NO: 9260050 - DNA, 20 bp, Homo sapiens
agaggccagttaggagtcta

SEQ ID NO: 9260051 - DNA, 20 bp, Homo sapiens
agaggccagttaggagtcta

SEQ ID NO: 9260052 - DNA, 22 bp, Homo sapiens
agaggccaggtccagagtttgt

SEQ ID NO: 9260053 - DNA, 22 bp, Homo sapiens
agaggccagtggctgtgctgtc

SEQ ID NO: 9260054 - DNA, 22 bp, Homo sapiens
aattttctgcctagcaaaaact

SEQ ID NO: 9260055 - DNA, 22 bp, Homo sapiens
aattttctgatgatgaagcacg

SEQ ID NO: 9260056 - DNA, 22 bp, Homo sapiens
acaaacagctaacatatgttaa

SEQ ID NO: 9260057 - DNA, 22 bp, Homo sapiens
acaaacagctaacatatgttaa

SEQ ID NO: 9260058 - DNA, 22 bp, Homo sapiens
acaaaccagcttaagcaagatg

SEQ ID NO: 9260059 - DNA, 22 bp, Homo sapiens
acaaaccagcttaagcaagatg

SEQ ID NO: 9260060 - DNA, 22 bp, Homo sapiens
acaaactaaaattctttattga

SEQ ID NO: 9260061 - DNA, 22 bp, Homo sapiens
acaaacagagttgaaaaatagg

SEQ ID NO: 9260062 - DNA, 22 bp, Homo sapiens
acaaacagctaacatatgttaa

SEQ ID NO: 9260063 - DNA, 22 bp, Homo sapiens
acaaacagagttgaaaaatagg

SEQ ID NO: 9260064 - DNA, 22 bp, Homo sapiens
acaaacagagttgaaaaatagg

SEQ ID NO: 9260065 - DNA, 22 bp, Homo sapiens
acaaactgaatgggttttctgt

SEQ ID NO: 9260066 - DNA, 21 bp, Homo sapiens
acaaactgaaatgagtttcct

SEQ ID NO: 9260067 - DNA, 22 bp, Homo sapiens
acaaatgactatttggtacagg

SEQ ID NO: 9260068 - DNA, 22 bp, Homo sapiens
acaaatgagaatgtagacagag

SEQ ID NO: 9260069 - DNA, 22 bp, Homo sapiens
acaaatgattttccaagccagt

SEQ ID NO: 9260070 - DNA, 22 bp, Homo sapiens
acaaatgattatcacagaggag

SEQ ID NO: 9260071 - DNA, 22 bp, Homo sapiens
acaatgttttgaaacatctagg

SEQ ID NO: 9260072 - DNA, 22 bp, Homo sapiens
acaatgtttttgttcaaagagt

SEQ ID NO: 9260073 - DNA, 22 bp, Homo sapiens
agatgggtaactggagtctgct

SEQ ID NO: 9260074 - DNA, 22 bp, Homo sapiens
acaatgctgttgagacattctt

SEQ ID NO: 9260075 - DNA, 22 bp, Homo sapiens
acaatgtagaggctgaaagcaa

SEQ ID NO: 9260076 - DNA, 22 bp, Homo sapiens
acaatggcatgctagcaaatgg

SEQ ID NO: 9260077 - DNA, 22 bp, Homo sapiens
agatggggctcagtgtggaggc

SEQ ID NO: 9260078 - DNA, 22 bp, Homo sapiens
agatggggctgaaagttccaat

SEQ ID NO: 9260079 - DNA, 22 bp, Homo sapiens
agatggggctcagtgtggaggc

SEQ ID NO: 9260080 - DNA, 22 bp, Homo sapiens
acaattactcaactttgctgct

SEQ ID NO: 9260081 - DNA, 22 bp, Homo sapiens
acaattagctgtgtgtctatct

SEQ ID NO: 9260082 - DNA, 22 bp, Homo sapiens
acaattagctgtgtgtctatct

SEQ ID NO: 9260083 - DNA, 22 bp, Homo sapiens
acaattagtgatcagtgatgcc

SEQ ID NO: 9260084 - DNA, 22 bp, Homo sapiens
acaattcaagatgagattcagg

SEQ ID NO: 9260085 - DNA, 22 bp, Homo sapiens
acaattctgatggtttcccagt

SEQ ID NO: 9260086 - DNA, 22 bp, Homo sapiens
acaattcctgagaatacttgtt

SEQ ID NO: 9260087 - DNA, 22 bp, Homo sapiens
acaattctctcatatcttatta

SEQ ID NO: 9260088 - DNA, 22 bp, Homo sapiens
agcaagcacacttcatgtgaac

SEQ ID NO: 9260089 - DNA, 22 bp, Homo sapiens
agcaagcagaattctgtcctct

SEQ ID NO: 9260090 - DNA, 22 bp, Homo sapiens
agcaagattttccttgaatgtt

SEQ ID NO: 9260091 - DNA, 22 bp, Homo sapiens
acaattctctcatatcttatta

SEQ ID NO: 9260092 - DNA, 22 bp, Homo sapiens
agcaagctgtcaagagagctga

SEQ ID NO: 9260093 - DNA, 22 bp, Homo sapiens
agcaaggaaactatggagagat

SEQ ID NO: 9260094 - DNA, 22 bp, Homo sapiens
agcaagctaacataggagattg

SEQ ID NO: 9260095 - DNA, 22 bp, Homo sapiens
agcaagctacctagatagtcta

SEQ ID NO: 9260096 - DNA, 22 bp, Homo sapiens
agcaagcattgctggttaggtc

SEQ ID NO: 9260097 - DNA, 22 bp, Homo sapiens
agcaagcagtgaagttgaatgt

SEQ ID NO: 9260098 - DNA, 18 bp, Homo sapiens
agcaagcagttttcatgt

SEQ ID NO: 9260099 - DNA, 22 bp, Homo sapiens
agcaaggattatcctgggaagg

SEQ ID NO: 9260100 - DNA, 22 bp, Homo sapiens
agcaaggcagctttcactgctt

SEQ ID NO: 9260101 - DNA, 22 bp, Homo sapiens
agcacaggtacggagatgctac

SEQ ID NO: 9260102 - DNA, 20 bp, Homo sapiens
agcaccagtgggggcagccc

SEQ ID NO: 9260103 - DNA, 21 bp, Homo sapiens
agcaccagttttatgccaggc

SEQ ID NO: 9260104 - DNA, 21 bp, Homo sapiens
agcaccagttttatgccaggc

SEQ ID NO: 9260105 - DNA, 22 bp, Homo sapiens
agcaccagtttcgtcgtgacaa

SEQ ID NO: 9260106 - DNA, 22 bp, Homo sapiens
acaagtctttttcatgtcttct

SEQ ID NO: 9260107 - DNA, 22 bp, Homo sapiens
acaagtgggtcctacataaagc

SEQ ID NO: 9260108 - DNA, 19 bp, Homo sapiens
agatggggaagagtgtgag

SEQ ID NO: 9260109 - DNA, 22 bp, Homo sapiens
agatggggctcagtgtggaggc

SEQ ID NO: 9260110 - DNA, 22 bp, Homo sapiens
agatggggctcagtgtggaggc

SEQ ID NO: 9260111 - DNA, 22 bp, Homo sapiens
agatggggcagaatggagccat

SEQ ID NO: 9260112 - DNA, 22 bp, Homo sapiens
agatggggcagaatggagccat

SEQ ID NO: 9260113 - DNA, 19 bp, Homo sapiens
agatggggaagagtgtgag

SEQ ID NO: 9260114 - DNA, 22 bp, Homo sapiens
acaaattctacaatcatatgat

SEQ ID NO: 9260115 - DNA, 22 bp, Homo sapiens
acaaattaccatggaatttggg

SEQ ID NO: 9260116 - DNA, 22 bp, Homo sapiens
acaaattaccatggaatttggg

SEQ ID NO: 9260117 - DNA, 22 bp, Homo sapiens
acaaattatagaaaattgagct

SEQ ID NO: 9260118 - DNA, 22 bp, Homo sapiens
acaaattctctaggcaaggaag

SEQ ID NO: 9260119 - DNA, 22 bp, Homo sapiens
acaaggaacaagcatgtagttt

SEQ ID NO: 9260120 - DNA, 22 bp, Homo sapiens
acaaatggaacaatgaagactg

SEQ ID NO: 9260121 - DNA, 22 bp, Homo sapiens
acaaatggaaggtgttctcttc

SEQ ID NO: 9260122 - DNA, 22 bp, Homo sapiens
acaaatggactctcatcttttg

SEQ ID NO: 9260123 - DNA, 22 bp, Homo sapiens
acaaatgtggacatggataatg

SEQ ID NO: 9260124 - DNA, 22 bp, Homo sapiens
acaaatgtgattgtttctgaaa

SEQ ID NO: 9260125 - DNA, 22 bp, Homo sapiens
acaaatgtgattgtttctgaaa

SEQ ID NO: 9260126 - DNA, 22 bp, Homo sapiens
aatgtcttcagtgtatacatgg

SEQ ID NO: 9260127 - DNA, 22 bp, Homo sapiens
aatgtgttgaataaattgtgcc

SEQ ID NO: 9260128 - DNA, 22 bp, Homo sapiens
aatgtgtttagttaatgagttg

SEQ ID NO: 9260129 - DNA, 22 bp, Homo sapiens
aatgtctctatatctcataaga

SEQ ID NO: 9260130 - DNA, 22 bp, Homo sapiens
aatgtctgaggctcatctgagg

SEQ ID NO: 9260131 - DNA, 22 bp, Homo sapiens
aatgtcattggtaaagattagg

SEQ ID NO: 9260132 - DNA, 22 bp, Homo sapiens
aatgtcattggtaaagattagg

SEQ ID NO: 9260133 - DNA, 22 bp, Homo sapiens
aatgtcattggtaaagattagg

SEQ ID NO: 9260134 - DNA, 22 bp, Homo sapiens
aatgtcatttaaaataattctg

SEQ ID NO: 9260135 - DNA, 22 bp, Homo sapiens
aatgtcattgtgagttaggctt

SEQ ID NO: 9260136 - DNA, 22 bp, Homo sapiens
aatgtcatttaaaataattctg

SEQ ID NO: 9260137 - DNA, 22 bp, Homo sapiens
aatgtcatttaaagacaaagaa

SEQ ID NO: 9260138 - DNA, 22 bp, Homo sapiens
aatgtcatttaggattatgttt

SEQ ID NO: 9260139 - DNA, 22 bp, Homo sapiens
aatgtcatttaaaataattctg

SEQ ID NO: 9260140 - DNA, 22 bp, Homo sapiens
aatgtcctaggcatgattttgt

SEQ ID NO: 9260141 - DNA, 17 bp, Homo sapiens
aatgtccttggaccaca

SEQ ID NO: 9260142 - DNA, 17 bp, Homo sapiens
aatgtccttggaccaca

SEQ ID NO: 9260143 - DNA, 22 bp, Homo sapiens
aatgtcatttttaaatgtgaga

SEQ ID NO: 9260144 - DNA, 22 bp, Homo sapiens
aatgtctatgatcctttaagtt

SEQ ID NO: 9260145 - DNA, 22 bp, Homo sapiens
agacagggtcttgatcagagct

SEQ ID NO: 9260146 - DNA, 22 bp, Homo sapiens
agacagggtgatcgcttgagcc

SEQ ID NO: 9260147 - DNA, 22 bp, Homo sapiens
agacagggtgatcgcttgagcc

SEQ ID NO: 9260148 - DNA, 22 bp, Homo sapiens
agacagggagggagcgcggctg

SEQ ID NO: 9260149 - DNA, 22 bp, Homo sapiens
agacagggtcttgatcagagct

SEQ ID NO: 9260150 - DNA, 22 bp, Homo sapiens
agacagggtcttgatcagagct

SEQ ID NO: 9260151 - DNA, 22 bp, Homo sapiens
agacagggccactcatcctcac

SEQ ID NO: 9260152 - DNA, 22 bp, Homo sapiens
aatgtcatagcaaagagagtga

SEQ ID NO: 9260153 - DNA, 22 bp, Homo sapiens
aatgtcatagcatttcttcaat

SEQ ID NO: 9260154 - DNA, 22 bp, Homo sapiens
aatgtcatagcatttcttcaat

SEQ ID NO: 9260155 - DNA, 22 bp, Homo sapiens
aatgtcattgagctccaatcct

SEQ ID NO: 9260156 - DNA, 22 bp, Homo sapiens
aatgtcattggtaaagattagg

SEQ ID NO: 9260157 - DNA, 21 bp, Homo sapiens
aatgtcattgaatggtgagac

SEQ ID NO: 9260158 - DNA, 22 bp, Homo sapiens
aatgtcatgggaatttattcat

SEQ ID NO: 9260159 - DNA, 22 bp, Homo sapiens
agaagtaggcagggctgtatca

SEQ ID NO: 9260160 - DNA, 22 bp, Homo sapiens
agaaggggcccaaggatgtcag

SEQ ID NO: 9260161 - DNA, 22 bp, Homo sapiens
agaaggggagaagctaccagga

SEQ ID NO: 9260162 - DNA, 22 bp, Homo sapiens
agaaggggagaagctaccagga

SEQ ID NO: 9260163 - DNA, 22 bp, Homo sapiens
agaagggccagctggacacctg

SEQ ID NO: 9260164 - DNA, 22 bp, Homo sapiens
aatgcaacctgctgatctgaca

SEQ ID NO: 9260165 - DNA, 22 bp, Homo sapiens
aatgcaaagtgaggtgagtggc

SEQ ID NO: 9260166 - DNA, 22 bp, Homo sapiens
aatgcaaacttcttgttacttg

SEQ ID NO: 9260167 - DNA, 22 bp, Homo sapiens
aatgcaaacttcttgttacttg

SEQ ID NO: 9260168 - DNA, 23 bp, Homo sapiens
agacagaggctgaggctggccgc

SEQ ID NO: 9260169 - DNA, 23 bp, Homo sapiens
agacagaggctgaggctggccgc

SEQ ID NO: 9260170 - DNA, 21 bp, Homo sapiens
agacagagtgcagtctacata

SEQ ID NO: 9260171 - DNA, 21 bp, Homo sapiens
agacagagtgcagtctacata

SEQ ID NO: 9260172 - DNA, 21 bp, Homo sapiens
agacagagtgcagtctacata

SEQ ID NO: 9260173 - DNA, 22 bp, Homo sapiens
agacaggctgctgtctgctagg

SEQ ID NO: 9260174 - DNA, 22 bp, Homo sapiens
agacaggccactctggtctggt

SEQ ID NO: 9260175 - DNA, 22 bp, Homo sapiens
agacagcacttttgtatggggg

SEQ ID NO: 9260176 - DNA, 19 bp, Homo sapiens
agacagagctcagtgggtt

SEQ ID NO: 9260177 - DNA, 19 bp, Homo sapiens
agacagagctcagtgggtt

SEQ ID NO: 9260178 - DNA, 19 bp, Homo sapiens
agacagagctcagtgggtt

SEQ ID NO: 9260179 - DNA, 19 bp, Homo sapiens
agacagagactgaaataga

SEQ ID NO: 9260180 - DNA, 22 bp, Homo sapiens
agacagagatactatgttgtca

SEQ ID NO: 9260181 - DNA, 22 bp, Homo sapiens
agacagagatactatgttgtca

SEQ ID NO: 9260182 - DNA, 22 bp, Homo sapiens
agacagagatactatgttgtca

SEQ ID NO: 9260183 - DNA, 22 bp, Homo sapiens
aatgcaatgcagcacctccttg

SEQ ID NO: 9260184 - DNA, 22 bp, Homo sapiens
aatgcaatacctttttatgctg

SEQ ID NO: 9260185 - DNA, 22 bp, Homo sapiens
aatgcaatgcagcacctccttg

SEQ ID NO: 9260186 - DNA, 21 bp, Homo sapiens
agacactggtttagcattcat

SEQ ID NO: 9260187 - DNA, 22 bp, Homo sapiens
aatgcaatgcagcacctccttg

SEQ ID NO: 9260188 - DNA, 23 bp, Homo sapiens
agacactgtaaagaattgcagtt

SEQ ID NO: 9260189 - DNA, 22 bp, Homo sapiens
aatgttgtgtttcagttcaaga

SEQ ID NO: 9260190 - DNA, 19 bp, Homo sapiens
aatgtttaagagaaaaagg

SEQ ID NO: 9260191 - DNA, 22 bp, Homo sapiens
aatgtttaatgttagtggtaat

SEQ ID NO: 9260192 - DNA, 22 bp, Homo sapiens
aattagctgtcaatgaggatct

SEQ ID NO: 9260193 - DNA, 20 bp, Homo sapiens
aattagcttaagtcaatcag

SEQ ID NO: 9260194 - DNA, 22 bp, Homo sapiens
aattagcttcagcttgtggggc

SEQ ID NO: 9260195 - DNA, 22 bp, Homo sapiens
aattagcttatgtgtacttttc

SEQ ID NO: 9260196 - DNA, 22 bp, Homo sapiens
aattacagtcggagcagcactg

SEQ ID NO: 9260197 - DNA, 22 bp, Homo sapiens
aattaccaggatttttcagtat

SEQ ID NO: 9260198 - DNA, 22 bp, Homo sapiens
aattagtattgcgattcattag

SEQ ID NO: 9260199 - DNA, 22 bp, Homo sapiens
aattagtattgcgattcattag

SEQ ID NO: 9260200 - DNA, 22 bp, Homo sapiens
aattagtaacctaattccatct

SEQ ID NO: 9260201 - DNA, 22 bp, Homo sapiens
aattaggcaaattaatttctct

SEQ ID NO: 9260202 - DNA, 22 bp, Homo sapiens
aattaggaaattcagccatttt

SEQ ID NO: 9260203 - DNA, 22 bp, Homo sapiens
aattagctttacctaggattgt

SEQ ID NO: 9260204 - DNA, 22 bp, Homo sapiens
aattagctttccgccatcacac

SEQ ID NO: 9260205 - DNA, 22 bp, Homo sapiens
aatgttgaggatatcagaaaat

SEQ ID NO: 9260206 - DNA, 22 bp, Homo sapiens
aatgttgccccaggacaaagga

SEQ ID NO: 9260207 - DNA, 22 bp, Homo sapiens
aatgttgcagagtgattgtcca

SEQ ID NO: 9260208 - DNA, 22 bp, Homo sapiens
aatgttcagtatctggtccacc

SEQ ID NO: 9260209 - DNA, 22 bp, Homo sapiens
aatgttcagtgcctttaaacat

SEQ ID NO: 9260210 - DNA, 22 bp, Homo sapiens
aatgttcattgattaaatgaat

SEQ ID NO: 9260211 - DNA, 22 bp, Homo sapiens
aatgttcattgttttccatatg

SEQ ID NO: 9260212 - DNA, 22 bp, Homo sapiens
aatgttatttctgcatagtagt

SEQ ID NO: 9260213 - DNA, 22 bp, Homo sapiens
aatgttattgtcctttccaaaa

SEQ ID NO: 9260214 - DNA, 22 bp, Homo sapiens
aatgttattgtcctttccaaaa

SEQ ID NO: 9260215 - DNA, 22 bp, Homo sapiens
aatttacacttcatttggaggg

SEQ ID NO: 9260216 - DNA, 22 bp, Homo sapiens
aatttacaggtgcactcgccat

SEQ ID NO: 9260217 - DNA, 22 bp, Homo sapiens
aatttacagttgctgatggtac

SEQ ID NO: 9260218 - DNA, 22 bp, Homo sapiens
agagctgggacttggactcaat

SEQ ID NO: 9260219 - DNA, 22 bp, Homo sapiens
agagctggggccagagtcaagg

SEQ ID NO: 9260220 - DNA, 22 bp, Homo sapiens
agagctggggccagagtcaagg

SEQ ID NO: 9260221 - DNA, 22 bp, Homo sapiens
agagctggggcataaatgccac

SEQ ID NO: 9260222 - DNA, 22 bp, Homo sapiens
aatttagattgataaacatgga

SEQ ID NO: 9260223 - DNA, 22 bp, Homo sapiens
aattatattgtggtgtgaatgt

SEQ ID NO: 9260224 - DNA, 22 bp, Homo sapiens
aattatattgaagttgaatgtc

SEQ ID NO: 9260225 - DNA, 22 bp, Homo sapiens
aattatattgtggtgtgaatgt

SEQ ID NO: 9260226 - DNA, 22 bp, Homo sapiens
aattggaaaaagacttaattgc

SEQ ID NO: 9260227 - DNA, 22 bp, Homo sapiens
aattatggtgtgtggttaaggg

SEQ ID NO: 9260228 - DNA, 22 bp, Homo sapiens
aattatggtggatcccagtggg

SEQ ID NO: 9260229 - DNA, 22 bp, Homo sapiens
aattatggaatttttagagaag

SEQ ID NO: 9260230 - DNA, 22 bp, Homo sapiens
aattatgcaaccaatgaccacg

SEQ ID NO: 9260231 - DNA, 22 bp, Homo sapiens
aattatggtatgttcaacaact

SEQ ID NO: 9260232 - DNA, 22 bp, Homo sapiens
aattatggtcactgttcctggg

SEQ ID NO: 9260233 - DNA, 22 bp, Homo sapiens
aattatatgttaatcttcaatt

SEQ ID NO: 9260234 - DNA, 22 bp, Homo sapiens
aattatatgttaatcttcaatt

SEQ ID NO: 9260235 - DNA, 20 bp, Homo sapiens
aattatataactccaacatt

SEQ ID NO: 9260236 - DNA, 22 bp, Homo sapiens
aattatatgttaatcttcaatt

SEQ ID NO: 9260237 - DNA, 22 bp, Homo sapiens
aattatacattgaacaatctag

SEQ ID NO: 9260238 - DNA, 22 bp, Homo sapiens
aattagtattgcgattcattag

SEQ ID NO: 9260239 - DNA, 22 bp, Homo sapiens
agccacagggggtgagggacaa

SEQ ID NO: 9260240 - DNA, 22 bp, Homo sapiens
agccacaggccatgagatacca

SEQ ID NO: 9260241 - DNA, 22 bp, Homo sapiens
agccacaggaaacagagacagc

SEQ ID NO: 9260242 - DNA, 22 bp, Homo sapiens
acagaacaacaaggtggaccag

SEQ ID NO: 9260243 - DNA, 22 bp, Homo sapiens
acagaacaagacctgcttattg

SEQ ID NO: 9260244 - DNA, 22 bp, Homo sapiens
agcagtggtgtgaggagggctc

SEQ ID NO: 9260245 - DNA, 22 bp, Homo sapiens
agcagtgggtggtttttgagca

SEQ ID NO: 9260246 - DNA, 22 bp, Homo sapiens
agcagtgggtgacagagctgag

SEQ ID NO: 9260247 - DNA, 22 bp, Homo sapiens
agcagtgggtgacagagctgag

SEQ ID NO: 9260248 - DNA, 22 bp, Homo sapiens
agcagtggctggatggtgtgct

SEQ ID NO: 9260249 - DNA, 22 bp, Homo sapiens
agcagtggctggatggtgtgct

SEQ ID NO: 9260250 - DNA, 22 bp, Homo sapiens
agcagtggctggatggtgtgct

SEQ ID NO: 9260251 - DNA, 22 bp, Homo sapiens
agcagtgggggagtgttagttt

SEQ ID NO: 9260252 - DNA, 22 bp, Homo sapiens
agcagtgggggagtgttagttt

SEQ ID NO: 9260253 - DNA, 22 bp, Homo sapiens
agcagtgggggagtgttagttt

SEQ ID NO: 9260254 - DNA, 22 bp, Homo sapiens
agcagtggctgacagacttacc

SEQ ID NO: 9260255 - DNA, 21 bp, Homo sapiens
acactgtgtcataatgcttaa

SEQ ID NO: 9260256 - DNA, 22 bp, Homo sapiens
acactgtgcttagatgctgaac

SEQ ID NO: 9260257 - DNA, 22 bp, Homo sapiens
acactgtgcatgcatatacaca

SEQ ID NO: 9260258 - DNA, 22 bp, Homo sapiens
acactgtgcatgcatatacaca

SEQ ID NO: 9260259 - DNA, 22 bp, Homo sapiens
agcagtgtgcttcgtttcatga

SEQ ID NO: 9260260 - DNA, 18 bp, Homo sapiens
agcagtgtggcaagcaga

SEQ ID NO: 9260261 - DNA, 20 bp, Homo sapiens
agcagtgtggggagactgtg

SEQ ID NO: 9260262 - DNA, 22 bp, Homo sapiens
agcagtggtgtgaggagggctc

SEQ ID NO: 9260263 - DNA, 22 bp, Homo sapiens
agcagtggtgtgaggagggctc

SEQ ID NO: 9260264 - DNA, 22 bp, Homo sapiens
agcagtgttggtgggagcatct

SEQ ID NO: 9260265 - DNA, 22 bp, Homo sapiens
agcagttaccaaggaacctggt

SEQ ID NO: 9260266 - DNA, 22 bp, Homo sapiens
acactgtctcatatgaggggac

SEQ ID NO: 9260267 - DNA, 22 bp, Homo sapiens
acactgtatgaaaacaggaaat

SEQ ID NO: 9260268 - DNA, 22 bp, Homo sapiens
acactgtctgggactcaggagt

SEQ ID NO: 9260269 - DNA, 23 bp, Homo sapiens
acactgtctcatggatagactgc

SEQ ID NO: 9260270 - DNA, 22 bp, Homo sapiens
agcagggccaacagtaaacacc

SEQ ID NO: 9260271 - DNA, 22 bp, Homo sapiens
acaccagggatatgaggaagga

SEQ ID NO: 9260272 - DNA, 22 bp, Homo sapiens
agcagggcagtgcttcagctct

SEQ ID NO: 9260273 - DNA, 23 bp, Homo sapiens
acacatttttcccgttctgaggt

SEQ ID NO: 9260274 - DNA, 22 bp, Homo sapiens
acaccaaagtagaattaatgta

SEQ ID NO: 9260275 - DNA, 22 bp, Homo sapiens
acacattttcaacactgtcaag

SEQ ID NO: 9260276 - DNA, 22 bp, Homo sapiens
agcaggaaagaaaaatctgtgt

SEQ ID NO: 9260277 - DNA, 22 bp, Homo sapiens
acacatttgggctcctacataa

SEQ ID NO: 9260278 - DNA, 22 bp, Homo sapiens
acacaggaagtcagcactgatg

SEQ ID NO: 9260279 - DNA, 22 bp, Homo sapiens
acacaggaagtcagcactgatg

SEQ ID NO: 9260280 - DNA, 21 bp, Homo sapiens
acacaggagtttcttctttct

SEQ ID NO: 9260281 - DNA, 22 bp, Homo sapiens
acacaggagatatgtaatggct

SEQ ID NO: 9260282 - DNA, 22 bp, Homo sapiens
acacagatttcactggaataga

SEQ ID NO: 9260283 - DNA, 22 bp, Homo sapiens
acacagattttacatgttatgc

SEQ ID NO: 9260284 - DNA, 22 bp, Homo sapiens
acacagattttacatgttatgc

SEQ ID NO: 9260285 - DNA, 22 bp, Homo sapiens
acacagatgggtagaaaacaga

SEQ ID NO: 9260286 - DNA, 22 bp, Homo sapiens
agcacctgctatgtgtcaggga

SEQ ID NO: 9260287 - DNA, 22 bp, Homo sapiens
acaattctgtggttgtctgtgg

SEQ ID NO: 9260288 - DNA, 22 bp, Homo sapiens
agcaccctggggaagcacaaag

SEQ ID NO: 9260289 - DNA, 22 bp, Homo sapiens
agcacccttcagcccagcctgg

SEQ ID NO: 9260290 - DNA, 22 bp, Homo sapiens
agcacctatagaagttgtgttc

SEQ ID NO: 9260291 - DNA, 22 bp, Homo sapiens
agcacctccttagctatgacca

SEQ ID NO: 9260292 - DNA, 22 bp, Homo sapiens
acacatatatttgcatatacac

SEQ ID NO: 9260293 - DNA, 22 bp, Homo sapiens
acacatatatttgcatatacac

SEQ ID NO: 9260294 - DNA, 22 bp, Homo sapiens
acacatatctaagatagatgac

SEQ ID NO: 9260295 - DNA, 22 bp, Homo sapiens
acacatatggttgctgcagtga

SEQ ID NO: 9260296 - DNA, 23 bp, Homo sapiens
agcaggaaaccgagggtgatgtt

SEQ ID NO: 9260297 - DNA, 20 bp, Homo sapiens
agcaggaaaagtgccagtct

SEQ ID NO: 9260298 - DNA, 21 bp, Homo sapiens
agcagctttggttgaagcaga

SEQ ID NO: 9260299 - DNA, 22 bp, Homo sapiens
acacatatgtatgcatcatgtg

SEQ ID NO: 9260300 - DNA, 22 bp, Homo sapiens
acacatatgtatgcatcatgtg

SEQ ID NO: 9260301 - DNA, 22 bp, Homo sapiens
acacatatgtatgcatcatgtg

SEQ ID NO: 9260302 - DNA, 22 bp, Homo sapiens
acacaggcaagagtgcaggtct

SEQ ID NO: 9260303 - DNA, 22 bp, Homo sapiens
acacaggcaatgtgagtgggag

SEQ ID NO: 9260304 - DNA, 22 bp, Homo sapiens
agcagcaggtgacctcgatgcc

SEQ ID NO: 9260305 - DNA, 22 bp, Homo sapiens
agcctgccaggcgctgcctgga

SEQ ID NO: 9260306 - DNA, 20 bp, Homo sapiens
agcctgccagctggcccaga

SEQ ID NO: 9260307 - DNA, 22 bp, Homo sapiens
agcctgccttgggctgcttgag

SEQ ID NO: 9260308 - DNA, 22 bp, Homo sapiens
agcctgccttgggctgcttgag

SEQ ID NO: 9260309 - DNA, 22 bp, Homo sapiens
acagattgggaactgtctcctt

SEQ ID NO: 9260310 - DNA, 22 bp, Homo sapiens
acagcaagacccctagcatggt

SEQ ID NO: 9260311 - DNA, 22 bp, Homo sapiens
acagcaagccagcttgtcactg

SEQ ID NO: 9260312 - DNA, 22 bp, Homo sapiens
acagcaagacccctagcatggt

SEQ ID NO: 9260313 - DNA, 23 bp, Homo sapiens
acagcaagaggaccagatgtgag

SEQ ID NO: 9260314 - DNA, 23 bp, Homo sapiens
acagcaagaggaccagatgtgag

SEQ ID NO: 9260315 - DNA, 21 bp, Homo sapiens
acagcaagccttcctttcagg

SEQ ID NO: 9260316 - DNA, 21 bp, Homo sapiens
acagcaagccttcacatgagt

SEQ ID NO: 9260317 - DNA, 21 bp, Homo sapiens
acagcaagccttcacatgagt

SEQ ID NO: 9260318 - DNA, 22 bp, Homo sapiens
acagcaataggaaatacttgca

SEQ ID NO: 9260319 - DNA, 22 bp, Homo sapiens
agctaggccatttgttcagtga

SEQ ID NO: 9260320 - DNA, 22 bp, Homo sapiens
agctaggggaccaaggtggccc

SEQ ID NO: 9260321 - DNA, 22 bp, Homo sapiens
agctaggggaccaaggtggccc

SEQ ID NO: 9260322 - DNA, 22 bp, Homo sapiens
agctaggggaccaaggtggccc

SEQ ID NO: 9260323 - DNA, 22 bp, Homo sapiens
agctagttcagagagatatgta

SEQ ID NO: 9260324 - DNA, 22 bp, Homo sapiens
agctatgaagccacttttaaca

SEQ ID NO: 9260325 - DNA, 22 bp, Homo sapiens
agctctggggcctgtcccacat

SEQ ID NO: 9260326 - DNA, 22 bp, Homo sapiens
agctctggggcctgtcccacat

SEQ ID NO: 9260327 - DNA, 22 bp, Homo sapiens
agctctggggtagggcccaaca

SEQ ID NO: 9260328 - DNA, 22 bp, Homo sapiens
agctctccatctatctgtgatg

SEQ ID NO: 9260329 - DNA, 22 bp, Homo sapiens
agctctcccaccttcttcttac

SEQ ID NO: 9260330 - DNA, 22 bp, Homo sapiens
agctctgggctgacatgctccc

SEQ ID NO: 9260331 - DNA, 19 bp, Homo sapiens
agctcctgttcagcagctc

SEQ ID NO: 9260332 - DNA, 22 bp, Homo sapiens
agctcctgttctgagagcagga

SEQ ID NO: 9260333 - DNA, 22 bp, Homo sapiens
agctcctgttctgagagcagga

SEQ ID NO: 9260334 - DNA, 22 bp, Homo sapiens
agctctccacacataggactag

SEQ ID NO: 9260335 - DNA, 22 bp, Homo sapiens
agctctcattactttacagatg

SEQ ID NO: 9260336 - DNA, 22 bp, Homo sapiens
agctctccacacataggactag

SEQ ID NO: 9260337 - DNA, 22 bp, Homo sapiens
agctctcaagataagaaagaac

SEQ ID NO: 9260338 - DNA, 22 bp, Homo sapiens
agctccttgaagggctctggga

SEQ ID NO: 9260339 - DNA, 22 bp, Homo sapiens
agctctatcacctgtcagttgc

SEQ ID NO: 9260340 - DNA, 22 bp, Homo sapiens
agctctaaatggaattttgcct

SEQ ID NO: 9260341 - DNA, 22 bp, Homo sapiens
agctcctgtgtgcccacctgct

SEQ ID NO: 9260342 - DNA, 22 bp, Homo sapiens
agctcctgtgtgcccacctgct

SEQ ID NO: 9260343 - DNA, 22 bp, Homo sapiens
acagcaggcatgaatgacactg

SEQ ID NO: 9260344 - DNA, 22 bp, Homo sapiens
acagcaggcatgaagaaatgtt

SEQ ID NO: 9260345 - DNA, 22 bp, Homo sapiens
acagcaggatttggcgatgttg

SEQ ID NO: 9260346 - DNA, 22 bp, Homo sapiens
acagcaggatttggcgatgttg

SEQ ID NO: 9260347 - DNA, 22 bp, Homo sapiens
acagcaggcacacaaggataga

SEQ ID NO: 9260348 - DNA, 22 bp, Homo sapiens
acagcagcgtgaagtgtgttat

SEQ ID NO: 9260349 - DNA, 22 bp, Homo sapiens
acagcagcgtgaagtgtgttat

SEQ ID NO: 9260350 - DNA, 22 bp, Homo sapiens
agctcaagagtagttcgagggg

SEQ ID NO: 9260351 - DNA, 22 bp, Homo sapiens
agctattgtgtgcccagcagga

SEQ ID NO: 9260352 - DNA, 22 bp, Homo sapiens
acagcagctaaaggtgtctcct

SEQ ID NO: 9260353 - DNA, 22 bp, Homo sapiens
acagcaggatttggcgatgttg

SEQ ID NO: 9260354 - DNA, 22 bp, Homo sapiens
agccacagtctgatgcctgaga

SEQ ID NO: 9260355 - DNA, 22 bp, Homo sapiens
agccacagtcaacctgtccata

SEQ ID NO: 9260356 - DNA, 22 bp, Homo sapiens
agccacagtcaacctgtccata

SEQ ID NO: 9260357 - DNA, 22 bp, Homo sapiens
agccacagtcaacctgtccata

SEQ ID NO: 9260358 - DNA, 22 bp, Homo sapiens
agccatgggctcccagtccttt

SEQ ID NO: 9260359 - DNA, 22 bp, Homo sapiens
agccatggcgccactagaggga

SEQ ID NO: 9260360 - DNA, 22 bp, Homo sapiens
agccatgcaccttactcttgct

SEQ ID NO: 9260361 - DNA, 22 bp, Homo sapiens
agcccagctgcctgcctgctgt

SEQ ID NO: 9260362 - DNA, 22 bp, Homo sapiens
agccattttcctgaaatataac

SEQ ID NO: 9260363 - DNA, 22 bp, Homo sapiens
agccattttggtaatgataaca

SEQ ID NO: 9260364 - DNA, 22 bp, Homo sapiens
agccatttggacttctggtagg

SEQ ID NO: 9260365 - DNA, 22 bp, Homo sapiens
agccattttcctgaaatataac

SEQ ID NO: 9260366 - DNA, 22 bp, Homo sapiens
agccattttggtaatgataaca

SEQ ID NO: 9260367 - DNA, 22 bp, Homo sapiens
acagagaggtaaaatatatagt

SEQ ID NO: 9260368 - DNA, 22 bp, Homo sapiens
acagagcagtaagaacacagct

SEQ ID NO: 9260369 - DNA, 22 bp, Homo sapiens
acagagcactgccctgtgccgc

SEQ ID NO: 9260370 - DNA, 22 bp, Homo sapiens
agcccagctgctatgtacctgg

SEQ ID NO: 9260371 - DNA, 22 bp, Homo sapiens
acagagagggagtgataaatcc

SEQ ID NO: 9260372 - DNA, 22 bp, Homo sapiens
acagaggtggacctcagcaggc

SEQ ID NO: 9260373 - DNA, 22 bp, Homo sapiens
agcccctctgtggctctgcctc

SEQ ID NO: 9260374 - DNA, 22 bp, Homo sapiens
agcccctgtaccctgagtgctt

SEQ ID NO: 9260375 - DNA, 23 bp, Homo sapiens
acagaggtccaaacagtataagc

SEQ ID NO: 9260376 - DNA, 22 bp, Homo sapiens
acagagttgtgtttgtacaacg

SEQ ID NO: 9260377 - DNA, 22 bp, Homo sapiens
acagataaaagttgtttaaaat

SEQ ID NO: 9260378 - DNA, 22 bp, Homo sapiens
acagataaaagttgtttaaaat

SEQ ID NO: 9260379 - DNA, 22 bp, Homo sapiens
agcctgagtgcttaggactgtt

SEQ ID NO: 9260380 - DNA, 22 bp, Homo sapiens
acagataaggcagttaagagtt

SEQ ID NO: 9260381 - DNA, 22 bp, Homo sapiens
acagagcatttgggacagagag

SEQ ID NO: 9260382 - DNA, 22 bp, Homo sapiens
agcccccaggagtctccacgcc

SEQ ID NO: 9260383 - DNA, 22 bp, Homo sapiens
agcccccagtctaaactgttgg

SEQ ID NO: 9260384 - DNA, 23 bp, Homo sapiens
agcccctcatggtgtctagacag

SEQ ID NO: 9260385 - DNA, 23 bp, Homo sapiens
agcccctcatatctgctttctct

SEQ ID NO: 9260386 - DNA, 22 bp, Homo sapiens
agcccctccagtggcataaaat

SEQ ID NO: 9260387 - DNA, 22 bp, Homo sapiens
agcccctctccgccctgagtcg

SEQ ID NO: 9260388 - DNA, 22 bp, Homo sapiens
agcccctctgtagctaatagta

SEQ ID NO: 9260389 - DNA, 22 bp, Homo sapiens
acagagcagttctggagctggc

SEQ ID NO: 9260390 - DNA, 22 bp, Homo sapiens
acagagcagtaagaacacagct

SEQ ID NO: 9260391 - DNA, 22 bp, Homo sapiens
acagagcagttctggagctggc

SEQ ID NO: 9260392 - DNA, 22 bp, Homo sapiens
acagagcatgatggaagatcga

SEQ ID NO: 9260393 - DNA, 22 bp, Homo sapiens
acagagcatgctcagtgtgtga

SEQ ID NO: 9260394 - DNA, 22 bp, Homo sapiens
acagagcatataaagtgctttg

SEQ ID NO: 9260395 - DNA, 22 bp, Homo sapiens
acagagcatataaagtgctttg

SEQ ID NO: 9260396 - DNA, 22 bp, Homo sapiens
aagccaggctgcacttgctggg

SEQ ID NO: 9260397 - DNA, 22 bp, Homo sapiens
aagccaggccattctctggttc

SEQ ID NO: 9260398 - DNA, 22 bp, Homo sapiens
aagccaggctgcacttgctggg

SEQ ID NO: 9260399 - DNA, 22 bp, Homo sapiens
aagccagggtttgtggatctat

SEQ ID NO: 9260400 - DNA, 22 bp, Homo sapiens
aagccaggtgtttaggccagcg

SEQ ID NO: 9260401 - DNA, 22 bp, Homo sapiens
aagccaggtgtttaggccagcg

SEQ ID NO: 9260402 - DNA, 22 bp, Homo sapiens
aagctcttctgtggatttgagt

SEQ ID NO: 9260403 - DNA, 22 bp, Homo sapiens
aagctgcagaccccctgtctca

SEQ ID NO: 9260404 - DNA, 22 bp, Homo sapiens
aagctgccacacggtgagtact

SEQ ID NO: 9260405 - DNA, 22 bp, Homo sapiens
aagctgccaatggtaagctgct

SEQ ID NO: 9260406 - DNA, 22 bp, Homo sapiens
aagctgccaatggtaagctgct

SEQ ID NO: 9260407 - DNA, 22 bp, Homo sapiens
aagctgccacacggtgagtact

SEQ ID NO: 9260408 - DNA, 22 bp, Homo sapiens
aagctgccaccagcccagggca

SEQ ID NO: 9260409 - DNA, 23 bp, Homo sapiens
aagctgccagtctgaagcctggg

SEQ ID NO: 9260410 - DNA, 22 bp, Homo sapiens
aagctgccagctgagctgaggc

SEQ ID NO: 9260411 - DNA, 22 bp, Homo sapiens
aagctgccagattcagtctgct

SEQ ID NO: 9260412 - DNA, 22 bp, Homo sapiens
aagctgccagctgagctgaggc

SEQ ID NO: 9260413 - DNA, 22 bp, Homo sapiens
acaggcaggttgagaaacattt

SEQ ID NO: 9260414 - DNA, 22 bp, Homo sapiens
acaggcagtgatttcctctggt

SEQ ID NO: 9260415 - DNA, 22 bp, Homo sapiens
acaggcagtgatttcctctggt

SEQ ID NO: 9260416 - DNA, 18 bp, Homo sapiens
aagctgccctcaggcagg

SEQ ID NO: 9260417 - DNA, 22 bp, Homo sapiens
aagctgcccaagactgaagcat

SEQ ID NO: 9260418 - DNA, 22 bp, Homo sapiens
aagctgccatagaacgagaggt

SEQ ID NO: 9260419 - DNA, 22 bp, Homo sapiens
aagctgcccaagactgaagcat

SEQ ID NO: 9260420 - DNA, 23 bp, Homo sapiens
aagctgccagtctgaagcctggg

SEQ ID NO: 9260421 - DNA, 22 bp, Homo sapiens
acaggcaggtcctgtcccagct

SEQ ID NO: 9260422 - DNA, 22 bp, Homo sapiens
acaggcaggtcctgtcccagct

SEQ ID NO: 9260423 - DNA, 22 bp, Homo sapiens
acagggcttagaacttggcctc

SEQ ID NO: 9260424 - DNA, 22 bp, Homo sapiens
acagtacctgctctcaagcaaa

SEQ ID NO: 9260425 - DNA, 22 bp, Homo sapiens
acagtacagtgcagaggaagat

SEQ ID NO: 9260426 - DNA, 22 bp, Homo sapiens
acagggctcgtcgggccctcgg

SEQ ID NO: 9260427 - DNA, 22 bp, Homo sapiens
acagggctccttgggctgacac

SEQ ID NO: 9260428 - DNA, 22 bp, Homo sapiens
acagggctcctaggtggtgtgc

SEQ ID NO: 9260429 - DNA, 22 bp, Homo sapiens
acagggctcccagcaggtctgt

SEQ ID NO: 9260430 - DNA, 22 bp, Homo sapiens
acagggctcccagcaggtctgt

SEQ ID NO: 9260431 - DNA, 23 bp, Homo sapiens
acagggctggcagctgcaagacc

SEQ ID NO: 9260432 - DNA, 22 bp, Homo sapiens
acagggctggcgttgggacaga

SEQ ID NO: 9260433 - DNA, 22 bp, Homo sapiens
aaggaaagagtatgcaccttgt

SEQ ID NO: 9260434 - DNA, 22 bp, Homo sapiens
aaggaaaggatgagcatgcatt

SEQ ID NO: 9260435 - DNA, 22 bp, Homo sapiens
aaggaagaagactctttactcc

SEQ ID NO: 9260436 - DNA, 22 bp, Homo sapiens
aaggcactagcaagctgcctgg

SEQ ID NO: 9260437 - DNA, 22 bp, Homo sapiens
aaggcactacgctgctggggcg

SEQ ID NO: 9260438 - DNA, 22 bp, Homo sapiens
aaggcagaaagggatgtgagtg

SEQ ID NO: 9260439 - DNA, 22 bp, Homo sapiens
aaggcagaaagggatgtgagtg

SEQ ID NO: 9260440 - DNA, 22 bp, Homo sapiens
aaggcagaaagggatgtgagtg

SEQ ID NO: 9260441 - DNA, 22 bp, Homo sapiens
aaggcagaaattcaactactgg

SEQ ID NO: 9260442 - DNA, 19 bp, Homo sapiens
aaggcagaagttggatatg

SEQ ID NO: 9260443 - DNA, 21 bp, Homo sapiens
aaggcagaagcatggaatgag

SEQ ID NO: 9260444 - DNA, 22 bp, Homo sapiens
acagtataccattgtgactttg

SEQ ID NO: 9260445 - DNA, 22 bp, Homo sapiens
aaggaaatctttgtaacatctt

SEQ ID NO: 9260446 - DNA, 22 bp, Homo sapiens
aaggaacactacaaggctggga

SEQ ID NO: 9260447 - DNA, 22 bp, Homo sapiens
acagtactgagtactgagttgg

SEQ ID NO: 9260448 - DNA, 22 bp, Homo sapiens
acagtagagtaaatggttagat

SEQ ID NO: 9260449 - DNA, 22 bp, Homo sapiens
acagtagaccctggataaacat

SEQ ID NO: 9260450 - DNA, 22 bp, Homo sapiens
acagtagctaatattgcattat

SEQ ID NO: 9260451 - DNA, 22 bp, Homo sapiens
acagtagtctcaggaataggca

SEQ ID NO: 9260452 - DNA, 22 bp, Homo sapiens
aaggcagccgtgtgactgcatg

SEQ ID NO: 9260453 - DNA, 22 bp, Homo sapiens
aaggcagcctctgccagccggg

SEQ ID NO: 9260454 - DNA, 22 bp, Homo sapiens
aaggcagatataaagactagag

SEQ ID NO: 9260455 - DNA, 22 bp, Homo sapiens
acagttctgtcctagacttcgt

SEQ ID NO: 9260456 - DNA, 22 bp, Homo sapiens
acagttctgcctgtttgagaag

SEQ ID NO: 9260457 - DNA, 22 bp, Homo sapiens
acagttctgcctgtttgagaag

SEQ ID NO: 9260458 - DNA, 21 bp, Homo sapiens
acagttctgccggcatctttc

SEQ ID NO: 9260459 - DNA, 21 bp, Homo sapiens
acagttctgccggcatctttc

SEQ ID NO: 9260460 - DNA, 22 bp, Homo sapiens
acagttctccagtgcctttgag

SEQ ID NO: 9260461 - DNA, 22 bp, Homo sapiens
acagttctagcttttacatttt

SEQ ID NO: 9260462 - DNA, 23 bp, Homo sapiens
acagttctctgatgggtttaaca

SEQ ID NO: 9260463 - DNA, 22 bp, Homo sapiens
acagttctgagctataattgct

SEQ ID NO: 9260464 - DNA, 19 bp, Homo sapiens
acagttctaatttctgtgg

SEQ ID NO: 9260465 - DNA, 19 bp, Homo sapiens
acagttctaatttctgtgg

SEQ ID NO: 9260466 - DNA, 22 bp, Homo sapiens
acagttctaaatcttggataat

SEQ ID NO: 9260467 - DNA, 22 bp, Homo sapiens
aaggcagtcaaagcagacttct

SEQ ID NO: 9260468 - DNA, 22 bp, Homo sapiens
aaggcagtggctggaaaacctg

SEQ ID NO: 9260469 - DNA, 22 bp, Homo sapiens
aaggcagtttgggccaccatct

SEQ ID NO: 9260470 - DNA, 22 bp, Homo sapiens
aaggcagttcactcacgcagcc

SEQ ID NO: 9260471 - DNA, 22 bp, Homo sapiens
aaggcagtactttatgtccata

SEQ ID NO: 9260472 - DNA, 22 bp, Homo sapiens
aaggcaggtattgatgccacag

SEQ ID NO: 9260473 - DNA, 22 bp, Homo sapiens
aaggcagtaggatcttccacag

SEQ ID NO: 9260474 - DNA, 22 bp, Homo sapiens
aaggcaggagctgtatcttatt

SEQ ID NO: 9260475 - DNA, 22 bp, Homo sapiens
aaggcaggatgcggacccatct

SEQ ID NO: 9260476 - DNA, 22 bp, Homo sapiens
aaggcaggatgggaaaagattt

SEQ ID NO: 9260477 - DNA, 22 bp, Homo sapiens
aaggcaggatgggaaaagattt

SEQ ID NO: 9260478 - DNA, 22 bp, Homo sapiens
aaggcagggaaagtggattagg

SEQ ID NO: 9260479 - DNA, 22 bp, Homo sapiens
accccaggtctccaggctctgg

SEQ ID NO: 9260480 - DNA, 22 bp, Homo sapiens
acccccaaacatgatcatggtg

SEQ ID NO: 9260481 - DNA, 22 bp, Homo sapiens
accccaggtcatctgagagtcc

SEQ ID NO: 9260482 - DNA, 22 bp, Homo sapiens
accccaggtccaggttacagag

SEQ ID NO: 9260483 - DNA, 22 bp, Homo sapiens
accccagggctgccagcctcct

SEQ ID NO: 9260484 - DNA, 22 bp, Homo sapiens
accccagggctgccagcctcct

SEQ ID NO: 9260485 - DNA, 22 bp, Homo sapiens
accccaggcccagggaagaggc

SEQ ID NO: 9260486 - DNA, 23 bp, Homo sapiens
accccaggcatcgcattcctctt

SEQ ID NO: 9260487 - DNA, 23 bp, Homo sapiens
accccaggcatcgcattcctctt

SEQ ID NO: 9260488 - DNA, 22 bp, Homo sapiens
aagtcacaaagtgctgtacatg

SEQ ID NO: 9260489 - DNA, 22 bp, Homo sapiens
aagtcacaagcatatatgcatt

SEQ ID NO: 9260490 - DNA, 22 bp, Homo sapiens
aagtcacaagcatatatgcatt

SEQ ID NO: 9260491 - DNA, 22 bp, Homo sapiens
aagtcaatcacatgcacactga

SEQ ID NO: 9260492 - DNA, 22 bp, Homo sapiens
accccaggagctgtgcctagtc

SEQ ID NO: 9260493 - DNA, 22 bp, Homo sapiens
aagtacatatatttatgattct

SEQ ID NO: 9260494 - DNA, 23 bp, Homo sapiens
aagtacatatatttagatagtga

SEQ ID NO: 9260495 - DNA, 22 bp, Homo sapiens
aagtacatgttgttcaaaagcc

SEQ ID NO: 9260496 - DNA, 22 bp, Homo sapiens
aagtacatggaggatagctgct

SEQ ID NO: 9260497 - DNA, 22 bp, Homo sapiens
aagggctgagaagtggggctgg

SEQ ID NO: 9260498 - DNA, 22 bp, Homo sapiens
aagggctgaatgaagggttgaa

SEQ ID NO: 9260499 - DNA, 22 bp, Homo sapiens
aagggctgaatgaagggttgaa

SEQ ID NO: 9260500 - DNA, 22 bp, Homo sapiens
aagggctgatctcactttcttt

SEQ ID NO: 9260501 - DNA, 22 bp, Homo sapiens
aagggctgagcacagtgagcca

SEQ ID NO: 9260502 - DNA, 22 bp, Homo sapiens
aagggctgagcacagtgagcca

SEQ ID NO: 9260503 - DNA, 22 bp, Homo sapiens
aagggctgagaagtggggctgg

SEQ ID NO: 9260504 - DNA, 22 bp, Homo sapiens
aagggctgagaagtggggctgg

SEQ ID NO: 9260505 - DNA, 22 bp, Homo sapiens
aagggctgagcacagtgagcca

SEQ ID NO: 9260506 - DNA, 22 bp, Homo sapiens
aaggtaggttaacctgcaggag

SEQ ID NO: 9260507 - DNA, 22 bp, Homo sapiens
aaggtgaagctcccgatgagaa

SEQ ID NO: 9260508 - DNA, 22 bp, Homo sapiens
aaggtgctcacgggctcaggga

SEQ ID NO: 9260509 - DNA, 22 bp, Homo sapiens
aaggtgctcgttatggccagtg

SEQ ID NO: 9260510 - DNA, 22 bp, Homo sapiens
aaggtgggtggatcacgaggtc

SEQ ID NO: 9260511 - DNA, 22 bp, Homo sapiens
aaggtgggtggatcacgaggtc

SEQ ID NO: 9260512 - DNA, 22 bp, Homo sapiens
aaggtgggcagatcacaaggtc

SEQ ID NO: 9260513 - DNA, 22 bp, Homo sapiens
accatctgagtagagagaagta

SEQ ID NO: 9260514 - DNA, 22 bp, Homo sapiens
accatcttttcctctgcctcct

SEQ ID NO: 9260515 - DNA, 22 bp, Homo sapiens
accatgggcagaatctttgcag

SEQ ID NO: 9260516 - DNA, 22 bp, Homo sapiens
accatgggtcagccacctcagc

SEQ ID NO: 9260517 - DNA, 22 bp, Homo sapiens
accatgggtcagccacctcagc

SEQ ID NO: 9260518 - DNA, 22 bp, Homo sapiens
accatggaccatagttcctatt

SEQ ID NO: 9260519 - DNA, 22 bp, Homo sapiens
accatgccagtggcagccagac

SEQ ID NO: 9260520 - DNA, 23 bp, Homo sapiens
aagtaacagggataatagcagtt

SEQ ID NO: 9260521 - DNA, 22 bp, Homo sapiens
accatgtcatttattggccaaa

SEQ ID NO: 9260522 - DNA, 22 bp, Homo sapiens
accatgtcatttattggccaaa

SEQ ID NO: 9260523 - DNA, 22 bp, Homo sapiens
accatgttagttactgggaatg

SEQ ID NO: 9260524 - DNA, 22 bp, Homo sapiens
aagggcctcctggggagcctgg

SEQ ID NO: 9260525 - DNA, 22 bp, Homo sapiens
aagggctgaaagaccttgggca

SEQ ID NO: 9260526 - DNA, 22 bp, Homo sapiens
aagggcaggaaaagatggatgt

SEQ ID NO: 9260527 - DNA, 22 bp, Homo sapiens
aagggagaaaacttgtggctta

SEQ ID NO: 9260528 - DNA, 22 bp, Homo sapiens
aagggagaaaacttgtggctta

SEQ ID NO: 9260529 - DNA, 22 bp, Homo sapiens
aagggaaatggccaggcagaga

SEQ ID NO: 9260530 - DNA, 22 bp, Homo sapiens
aagggaaatcctcagcccagga

SEQ ID NO: 9260531 - DNA, 22 bp, Homo sapiens
aagggaaaatagttgatgacca

SEQ ID NO: 9260532 - DNA, 22 bp, Homo sapiens
aagggaaactttcacaatgtcc

SEQ ID NO: 9260533 - DNA, 22 bp, Homo sapiens
aagggaaatcatatggtgcagt

SEQ ID NO: 9260534 - DNA, 22 bp, Homo sapiens
aagggaaatcatatggtgcagt

SEQ ID NO: 9260535 - DNA, 22 bp, Homo sapiens
aaggctcttggagtgaatgcag

SEQ ID NO: 9260536 - DNA, 22 bp, Homo sapiens
aaggctgaggagggcctgcagg

SEQ ID NO: 9260537 - DNA, 22 bp, Homo sapiens
aaggctgaggagggcctgcagg

SEQ ID NO: 9260538 - DNA, 22 bp, Homo sapiens
aaggctgaggctggagaattac

SEQ ID NO: 9260539 - DNA, 22 bp, Homo sapiens
aaggctgaggcagtgaggcaga

SEQ ID NO: 9260540 - DNA, 22 bp, Homo sapiens
aaggctgagggctgtacctggc

SEQ ID NO: 9260541 - DNA, 22 bp, Homo sapiens
aaggctgagggctgtacctggc

SEQ ID NO: 9260542 - DNA, 22 bp, Homo sapiens
aaggctgaggtagggcctaaaa

SEQ ID NO: 9260543 - DNA, 22 bp, Homo sapiens
aaggctgagtaaaacagagaac

SEQ ID NO: 9260544 - DNA, 22 bp, Homo sapiens
aaggctgagtaaaacagagaac

SEQ ID NO: 9260545 - DNA, 22 bp, Homo sapiens
aaggctgattagactgatagct

SEQ ID NO: 9260546 - DNA, 16 bp, Homo sapiens
aaggctgattttccct

SEQ ID NO: 9260547 - DNA, 16 bp, Homo sapiens
aaggctgattttccct

SEQ ID NO: 9260548 - DNA, 22 bp, Homo sapiens
aaggctgattagactgatagct

SEQ ID NO: 9260549 - DNA, 22 bp, Homo sapiens
aaggctgcctctgccagaggag

SEQ ID NO: 9260550 - DNA, 22 bp, Homo sapiens
aaggctgcttttaacatgcata

SEQ ID NO: 9260551 - DNA, 22 bp, Homo sapiens
aaggcttgtgtgttcagtgagg

SEQ ID NO: 9260552 - DNA, 22 bp, Homo sapiens
aaggcttgtagatttgggcttt

SEQ ID NO: 9260553 - DNA, 19 bp, Homo sapiens
aaggcttggctgagctggg

SEQ ID NO: 9260554 - DNA, 22 bp, Homo sapiens
aaggcttggagtaagcttggct

SEQ ID NO: 9260555 - DNA, 22 bp, Homo sapiens
aaggctgtgtcagaagctccct

SEQ ID NO: 9260556 - DNA, 22 bp, Homo sapiens
acatgtgtctaagaatgaaaga

SEQ ID NO: 9260557 - DNA, 22 bp, Homo sapiens
acatgtgtggacatgaatctac

SEQ ID NO: 9260558 - DNA, 22 bp, Homo sapiens
aaggctggggtgcagacggcct

SEQ ID NO: 9260559 - DNA, 22 bp, Homo sapiens
aaggctggtttccttgatgttt

SEQ ID NO: 9260560 - DNA, 22 bp, Homo sapiens
aaggctgggaaacatgcaggcc

SEQ ID NO: 9260561 - DNA, 22 bp, Homo sapiens
aaggctggggtgcagacggcct

SEQ ID NO: 9260562 - DNA, 22 bp, Homo sapiens
aatatatagaagtacccgttgt

SEQ ID NO: 9260563 - DNA, 22 bp, Homo sapiens
aatatatgactccactgcatga

SEQ ID NO: 9260564 - DNA, 22 bp, Homo sapiens
acttgattgtatgaagttattt

SEQ ID NO: 9260565 - DNA, 23 bp, Homo sapiens
acttgattattgttgatagattc

SEQ ID NO: 9260566 - DNA, 19 bp, Homo sapiens
aatattttagcctcttcct

SEQ ID NO: 9260567 - DNA, 23 bp, Homo sapiens
aatattcctgccattaatgactc

SEQ ID NO: 9260568 - DNA, 22 bp, Homo sapiens
aatatcaacagtgtccttctaa

SEQ ID NO: 9260569 - DNA, 22 bp, Homo sapiens
aatatatgtggtattgaccagc

SEQ ID NO: 9260570 - DNA, 22 bp, Homo sapiens
aatatatttgaatcaggaacaa

SEQ ID NO: 9260571 - DNA, 22 bp, Homo sapiens
acttgaataggaaagccacaaa

SEQ ID NO: 9260572 - DNA, 22 bp, Homo sapiens
acttgaataggtgtcaaggcca

SEQ ID NO: 9260573 - DNA, 22 bp, Homo sapiens
acttgaaaggaagctctaaaac

SEQ ID NO: 9260574 - DNA, 22 bp, Homo sapiens
acttgaaaccttggcaaacaat

SEQ ID NO: 9260575 - DNA, 22 bp, Homo sapiens
acttgaaacatctttaaatgta

SEQ ID NO: 9260576 - DNA, 19 bp, Homo sapiens
acttcttttcaacacagga

SEQ ID NO: 9260577 - DNA, 22 bp, Homo sapiens
aatacaatcaaattcactagca

SEQ ID NO: 9260578 - DNA, 22 bp, Homo sapiens
acttcctggattcccaagggct

SEQ ID NO: 9260579 - DNA, 22 bp, Homo sapiens
acttcctgctatgagcttctgt

SEQ ID NO: 9260580 - DNA, 22 bp, Homo sapiens
acttcttttcaaatcatgcaaa

SEQ ID NO: 9260581 - DNA, 19 bp, Homo sapiens
acttcttttcaacacagga

SEQ ID NO: 9260582 - DNA, 22 bp, Homo sapiens
aatatttttgaggccctgttat

SEQ ID NO: 9260583 - DNA, 22 bp, Homo sapiens
aatattttaggctttccaggct

SEQ ID NO: 9260584 - DNA, 19 bp, Homo sapiens
aatattttagcctcttcct

SEQ ID NO: 9260585 - DNA, 22 bp, Homo sapiens
aatcaacaggatgtgcattgta

SEQ ID NO: 9260586 - DNA, 22 bp, Homo sapiens
aatcaactgagccctggttctc

SEQ ID NO: 9260587 - DNA, 22 bp, Homo sapiens
aatcaaaacctacagaggtaat

SEQ ID NO: 9260588 - DNA, 22 bp, Homo sapiens
aatatttttgaggccctgttat

SEQ ID NO: 9260589 - DNA, 22 bp, Homo sapiens
acttggttggtctcaccctgtt

SEQ ID NO: 9260590 - DNA, 22 bp, Homo sapiens
aatcaagagctgactatatttt

SEQ ID NO: 9260591 - DNA, 22 bp, Homo sapiens
acttgtctttaatccgaatgta

SEQ ID NO: 9260592 - DNA, 22 bp, Homo sapiens
acttgtctggcagatcatgcaa

SEQ ID NO: 9260593 - DNA, 22 bp, Homo sapiens
acttgtctatggttacatccta

SEQ ID NO: 9260594 - DNA, 22 bp, Homo sapiens
acttgtctttgtaaaatagaaa

SEQ ID NO: 9260595 - DNA, 22 bp, Homo sapiens
acttgtctaccatgaatattta

SEQ ID NO: 9260596 - DNA, 22 bp, Homo sapiens
acttgttagatataaagtttgt

SEQ ID NO: 9260597 - DNA, 22 bp, Homo sapiens
acttgttagttttatctgcatg

SEQ ID NO: 9260598 - DNA, 22 bp, Homo sapiens
acttgttcattgagtacatatg

SEQ ID NO: 9260599 - DNA, 22 bp, Homo sapiens
acttgtttacaagcagttctga

SEQ ID NO: 9260600 - DNA, 22 bp, Homo sapiens
acttgtttacaagcagttctga

SEQ ID NO: 9260601 - DNA, 22 bp, Homo sapiens
acttgtgtaacacagaaagaac

SEQ ID NO: 9260602 - DNA, 22 bp, Homo sapiens
acttgttagttttatctgcatg

SEQ ID NO: 9260603 - DNA, 22 bp, Homo sapiens
aatcataattgtatacattcat

SEQ ID NO: 9260604 - DNA, 22 bp, Homo sapiens
aatccagctgtgtcacaggtga

SEQ ID NO: 9260605 - DNA, 22 bp, Homo sapiens
acttgtttcaactgtactctcc

SEQ ID NO: 9260606 - DNA, 22 bp, Homo sapiens
acttgtttcaactgtactctca

SEQ ID NO: 9260607 - DNA, 22 bp, Homo sapiens
acttgtttacaagcagttctga

SEQ ID NO: 9260608 - DNA, 19 bp, Homo sapiens
acttgttttggaggtgatg

SEQ ID NO: 9260609 - DNA, 22 bp, Homo sapiens
acttgttttatctgtcaataga

SEQ ID NO: 9260610 - DNA, 22 bp, Homo sapiens
acttgttttatctgtcaataga

SEQ ID NO: 9260611 - DNA, 22 bp, Homo sapiens
acttgtttggagccagctgtaa

SEQ ID NO: 9260612 - DNA, 22 bp, Homo sapiens
aatcctgaggcaaagagatgag

SEQ ID NO: 9260613 - DNA, 22 bp, Homo sapiens
aatccattaaaaacaagcgcat

SEQ ID NO: 9260614 - DNA, 22 bp, Homo sapiens
aatccatgcatgcaaggaaagg

SEQ ID NO: 9260615 - DNA, 22 bp, Homo sapiens
aatccatgttgatgtatatttt

SEQ ID NO: 9260616 - DNA, 22 bp, Homo sapiens
agaaaacataggagacaggaaa

SEQ ID NO: 9260617 - DNA, 22 bp, Homo sapiens
agaaaacataggagacaggaaa

SEQ ID NO: 9260618 - DNA, 22 bp, Homo sapiens
agaaaacataggagacaggaaa

SEQ ID NO: 9260619 - DNA, 22 bp, Homo sapiens
agaaaaatcttggcgcttgtct

SEQ ID NO: 9260620 - DNA, 22 bp, Homo sapiens
agaaaacactgccccctctctc

SEQ ID NO: 9260621 - DNA, 22 bp, Homo sapiens
agaaaactgcagagtagcctca

SEQ ID NO: 9260622 - DNA, 22 bp, Homo sapiens
agaaaactctacatctgtatgt

SEQ ID NO: 9260623 - DNA, 22 bp, Homo sapiens
agaaaactctacatctgtatgt

SEQ ID NO: 9260624 - DNA, 22 bp, Homo sapiens
agaaaacattacataggtgtgt

SEQ ID NO: 9260625 - DNA, 22 bp, Homo sapiens
agaaaacattacataggtgtgt

SEQ ID NO: 9260626 - DNA, 22 bp, Homo sapiens
aatgaacacagccctctacttt

SEQ ID NO: 9260627 - DNA, 22 bp, Homo sapiens
aatgaacacatgtggtcagttt

SEQ ID NO: 9260628 - DNA, 22 bp, Homo sapiens
aatgaacacatgtggtcagttt

SEQ ID NO: 9260629 - DNA, 22 bp, Homo sapiens
aatgaaactatatttagagagg

SEQ ID NO: 9260630 - DNA, 22 bp, Homo sapiens
agaaatactaggaatattcata

SEQ ID NO: 9260631 - DNA, 20 bp, Homo sapiens
agaaatacatgcatgcatga

SEQ ID NO: 9260632 - DNA, 22 bp, Homo sapiens
agaaataagagctttccttggg

SEQ ID NO: 9260633 - DNA, 22 bp, Homo sapiens
aatgaacagtgggtgaggtacc

SEQ ID NO: 9260634 - DNA, 22 bp, Homo sapiens
aatgaacatataaagagatctt

SEQ ID NO: 9260635 - DNA, 22 bp, Homo sapiens
aatgaacagtgggtgaggtacc

SEQ ID NO: 9260636 - DNA, 22 bp, Homo sapiens
aatgaacacttagcctttctat

SEQ ID NO: 9260637 - DNA, 22 bp, Homo sapiens
aatgaacaggtgaatgtcagat

SEQ ID NO: 9260638 - DNA, 22 bp, Homo sapiens
aatgaacatggacaagttaata

SEQ ID NO: 9260639 - DNA, 22 bp, Homo sapiens
aatgaacatataaagagatctt

SEQ ID NO: 9260640 - DNA, 22 bp, Homo sapiens
aatgaacccttcaagctctgat

SEQ ID NO: 9260641 - DNA, 22 bp, Homo sapiens
aatgaacatgggagtactaata

SEQ ID NO: 9260642 - DNA, 22 bp, Homo sapiens
aatgaacatggacaagttaata

SEQ ID NO: 9260643 - DNA, 22 bp, Homo sapiens
aatgacatggagcatcttttca

SEQ ID NO: 9260644 - DNA, 22 bp, Homo sapiens
aatgaccagcgcctgcagaggg

SEQ ID NO: 9260645 - DNA, 22 bp, Homo sapiens
aatgacctgggtgtcatttcat

SEQ ID NO: 9260646 - DNA, 22 bp, Homo sapiens
aatgactctgctgcagagacac

SEQ ID NO: 9260647 - DNA, 22 bp, Homo sapiens
aatgactaataagttttactgt

SEQ ID NO: 9260648 - DNA, 22 bp, Homo sapiens
agaaatactgtgagagcagcct

SEQ ID NO: 9260649 - DNA, 22 bp, Homo sapiens
aatgaatgtgattaacttcaag

SEQ ID NO: 9260650 - DNA, 22 bp, Homo sapiens
aatgagacacgtgaagcagatg

SEQ ID NO: 9260651 - DNA, 19 bp, Homo sapiens
aatgactgagtacattgtc

SEQ ID NO: 9260652 - DNA, 19 bp, Homo sapiens
aatgactgagtacattgtc

SEQ ID NO: 9260653 - DNA, 22 bp, Homo sapiens
aatgagatggaattcccgccta

SEQ ID NO: 9260654 - DNA, 22 bp, Homo sapiens
aatgagattccaatagctcctg

SEQ ID NO: 9260655 - DNA, 22 bp, Homo sapiens
aatgagctagacctgcttcctc

SEQ ID NO: 9260656 - DNA, 22 bp, Homo sapiens
aatgagggggatgggaaagtgt

SEQ ID NO: 9260657 - DNA, 18 bp, Homo sapiens
agaaggagctatgggcag

SEQ ID NO: 9260658 - DNA, 22 bp, Homo sapiens
agaagggaactcagagatgatt

SEQ ID NO: 9260659 - DNA, 18 bp, Homo sapiens
agaaggagctatgggcag

SEQ ID NO: 9260660 - DNA, 22 bp, Homo sapiens
aagtttaacttgaattctttct

SEQ ID NO: 9260661 - DNA, 22 bp, Homo sapiens
aagtttaacttgaattctttct

SEQ ID NO: 9260662 - DNA, 21 bp, Homo sapiens
aagttgtctcttttggttcct

SEQ ID NO: 9260663 - DNA, 22 bp, Homo sapiens
aagttgtatgtcttagaaagta

SEQ ID NO: 9260664 - DNA, 22 bp, Homo sapiens
aagttgttgttgaggtgggtaa

SEQ ID NO: 9260665 - DNA, 22 bp, Homo sapiens
aagtttaacttgaattctttct

SEQ ID NO: 9260666 - DNA, 23 bp, Homo sapiens
aagttgtttttggccagggaaag

SEQ ID NO: 9260667 - DNA, 22 bp, Homo sapiens
aagttctagaggttgatttggt

SEQ ID NO: 9260668 - DNA, 22 bp, Homo sapiens
aagtttactggggagatcacct

SEQ ID NO: 9260669 - DNA, 22 bp, Homo sapiens
aagtttagtgaaactctagggg

SEQ ID NO: 9260670 - DNA, 22 bp, Homo sapiens
aagtttatccctctcacagtta

SEQ ID NO: 9260671 - DNA, 22 bp, Homo sapiens
aataagaattgccagatttgaa

SEQ ID NO: 9260672 - DNA, 22 bp, Homo sapiens
aataagaatttacttgtcaaga

SEQ ID NO: 9260673 - DNA, 22 bp, Homo sapiens
aataagatcctgaagatatgtt

SEQ ID NO: 9260674 - DNA, 22 bp, Homo sapiens
aataagatcctgaagatatgtt

SEQ ID NO: 9260675 - DNA, 22 bp, Homo sapiens
aataagacacacaactgtcaag

SEQ ID NO: 9260676 - DNA, 22 bp, Homo sapiens
aagtttcaaatgttgattatgc

SEQ ID NO: 9260677 - DNA, 22 bp, Homo sapiens
aagtttatgttggtaagatatc

SEQ ID NO: 9260678 - DNA, 22 bp, Homo sapiens
aagtttcatgtggaggtagact

SEQ ID NO: 9260679 - DNA, 22 bp, Homo sapiens
aagtttcatgacttggttatta

SEQ ID NO: 9260680 - DNA, 23 bp, Homo sapiens
actgcctgtgccgatctctctca

SEQ ID NO: 9260681 - DNA, 22 bp, Homo sapiens
actgcctgtgtcccttcagtgc

SEQ ID NO: 9260682 - DNA, 23 bp, Homo sapiens
actgcctgtgccgatctctctca

SEQ ID NO: 9260683 - DNA, 22 bp, Homo sapiens
actgcctgtttggcatggcccc

SEQ ID NO: 9260684 - DNA, 22 bp, Homo sapiens
aataagattgacacaagtacct

SEQ ID NO: 9260685 - DNA, 22 bp, Homo sapiens
aataagatcttaaaggttatat

SEQ ID NO: 9260686 - DNA, 22 bp, Homo sapiens
aataagatcctgaagatatgtt

SEQ ID NO: 9260687 - DNA, 22 bp, Homo sapiens
aataatagttgcaaagtgttta

SEQ ID NO: 9260688 - DNA, 22 bp, Homo sapiens
aataatagttgcaaagtgttta

SEQ ID NO: 9260689 - DNA, 22 bp, Homo sapiens
aataattatttgagagcagacc

SEQ ID NO: 9260690 - DNA, 22 bp, Homo sapiens
aataattatttgagagcagacc

SEQ ID NO: 9260691 - DNA, 22 bp, Homo sapiens
aataattagtgggacagagaac

SEQ ID NO: 9260692 - DNA, 22 bp, Homo sapiens
aataattagtgggacagagaac

SEQ ID NO: 9260693 - DNA, 22 bp, Homo sapiens
aataattatttgagagcagacc

SEQ ID NO: 9260694 - DNA, 22 bp, Homo sapiens
aataatttccagccaactggaa

SEQ ID NO: 9260695 - DNA, 22 bp, Homo sapiens
aataatttccagccaactggaa

SEQ ID NO: 9260696 - DNA, 22 bp, Homo sapiens
aataatttccagccaactggaa

SEQ ID NO: 9260697 - DNA, 22 bp, Homo sapiens
aataattttagctcagagttgt

SEQ ID NO: 9260698 - DNA, 22 bp, Homo sapiens
aataattttagctcagagttgt

SEQ ID NO: 9260699 - DNA, 22 bp, Homo sapiens
aataattttagctcagagttgt

SEQ ID NO: 9260700 - DNA, 22 bp, Homo sapiens
aataattttgagagcctggaaa

SEQ ID NO: 9260701 - DNA, 22 bp, Homo sapiens
aataattttgagagcctggaaa

SEQ ID NO: 9260702 - DNA, 22 bp, Homo sapiens
aataattttgagagcctggaaa

SEQ ID NO: 9260703 - DNA, 22 bp, Homo sapiens
aatacaatcaaattcactagca

SEQ ID NO: 9260704 - DNA, 22 bp, Homo sapiens
aataatgtgtgctgcagtctta

SEQ ID NO: 9260705 - DNA, 19 bp, Homo sapiens
aataatgttcatgagattg

SEQ ID NO: 9260706 - DNA, 19 bp, Homo sapiens
aataatgttcatgagattg

SEQ ID NO: 9260707 - DNA, 22 bp, Homo sapiens
aataatgttgacgatagtctta

SEQ ID NO: 9260708 - DNA, 22 bp, Homo sapiens
aataattagtgggacagagaac

SEQ ID NO: 9260709 - DNA, 22 bp, Homo sapiens
aataattagtgggacagagaac

SEQ ID NO: 9260710 - DNA, 22 bp, Homo sapiens
aataattagtgggacagagaac

SEQ ID NO: 9260711 - DNA, 22 bp, Homo sapiens
aataattacccatctttttgta

SEQ ID NO: 9260712 - DNA, 22 bp, Homo sapiens
aataatgttgacgatagtctta

SEQ ID NO: 9260713 - DNA, 22 bp, Homo sapiens
aataattacccatctttttgta

SEQ ID NO: 9260714 - DNA, 22 bp, Homo sapiens
aataatgtttatttgtattctc

SEQ ID NO: 9260715 - DNA, 22 bp, Homo sapiens
aataatgtttatttgtattctc

SEQ ID NO: 9260716 - DNA, 22 bp, Homo sapiens
aagtggagctataggctcagat

SEQ ID NO: 9260717 - DNA, 22 bp, Homo sapiens
aagtggagccagggaaactgaa

SEQ ID NO: 9260718 - DNA, 22 bp, Homo sapiens
aagtggagagccctggaggtct

SEQ ID NO: 9260719 - DNA, 22 bp, Homo sapiens
aagtggagagccctggaggtct

SEQ ID NO: 9260720 - DNA, 21 bp, Homo sapiens
aagtggagaagaaaagctgga

SEQ ID NO: 9260721 - DNA, 22 bp, Homo sapiens
aagtcagagcaactgagacatt

SEQ ID NO: 9260722 - DNA, 22 bp, Homo sapiens
aagtcagcactccaggaagcca

SEQ ID NO: 9260723 - DNA, 22 bp, Homo sapiens
aagtcacagaacccattgtaac

SEQ ID NO: 9260724 - DNA, 22 bp, Homo sapiens
aagttactggcaagggctgcag

SEQ ID NO: 9260725 - DNA, 22 bp, Homo sapiens
aagttactttacctctttagct

SEQ ID NO: 9260726 - DNA, 22 bp, Homo sapiens
aagttacattttggtctaattg

SEQ ID NO: 9260727 - DNA, 22 bp, Homo sapiens
aagttactatgactcttctttt

SEQ ID NO: 9260728 - DNA, 22 bp, Homo sapiens
aagttatatcatctcattgacg

SEQ ID NO: 9260729 - DNA, 22 bp, Homo sapiens
aagttatgaaatttggacagct

SEQ ID NO: 9260730 - DNA, 22 bp, Homo sapiens
aagttattgcagcaatccaagt

SEQ ID NO: 9260731 - DNA, 22 bp, Homo sapiens
aagttattgcagcaatccaagt

SEQ ID NO: 9260732 - DNA, 22 bp, Homo sapiens
actaagacctaaaattgtgaat

SEQ ID NO: 9260733 - DNA, 22 bp, Homo sapiens
actaaggaatatgacaaactca

SEQ ID NO: 9260734 - DNA, 18 bp, Homo sapiens
actccccacaggctctgt

SEQ ID NO: 9260735 - DNA, 22 bp, Homo sapiens
actccccagactgccatgctgg

SEQ ID NO: 9260736 - DNA, 22 bp, Homo sapiens
actccccaaaactaaccatgca

SEQ ID NO: 9260737 - DNA, 22 bp, Homo sapiens
actcccactccagagtagaagc

SEQ ID NO: 9260738 - DNA, 22 bp, Homo sapiens
actcccactccagagtagaagc

SEQ ID NO: 9260739 - DNA, 22 bp, Homo sapiens
actcccagaacatgctcttctt

SEQ ID NO: 9260740 - DNA, 22 bp, Homo sapiens
actcccaggttgcctggcaggc

SEQ ID NO: 9260741 - DNA, 22 bp, Homo sapiens
actccagttctcttgtttataa

SEQ ID NO: 9260742 - DNA, 20 bp, Homo sapiens
actccaggtggcatgaggac

SEQ ID NO: 9260743 - DNA, 22 bp, Homo sapiens
aagttatttcctcgtgactgaa

SEQ ID NO: 9260744 - DNA, 22 bp, Homo sapiens
aagttcaagctctgcctaaaat

SEQ ID NO: 9260745 - DNA, 22 bp, Homo sapiens
aaagtcaatgatttctcctgga

SEQ ID NO: 9260746 - DNA, 20 bp, Homo sapiens
aaagtgtaagcatataatta

SEQ ID NO: 9260747 - DNA, 20 bp, Homo sapiens
aaagtgtaagcatataatta

SEQ ID NO: 9260748 - DNA, 22 bp, Homo sapiens
aaagtgggaacaatggagagtg

SEQ ID NO: 9260749 - DNA, 22 bp, Homo sapiens
aaagtcaaaatgctctcctgtc

SEQ ID NO: 9260750 - DNA, 22 bp, Homo sapiens
aaagtatttgtgatttttacca

SEQ ID NO: 9260751 - DNA, 22 bp, Homo sapiens
aaagtattcttgactgtttttc

SEQ ID NO: 9260752 - DNA, 22 bp, Homo sapiens
aaagtattcttgactgtttttc

SEQ ID NO: 9260753 - DNA, 22 bp, Homo sapiens
aaagtattcttgactgtttttc

SEQ ID NO: 9260754 - DNA, 22 bp, Homo sapiens
aaagtatgttgtggcttttaaa

SEQ ID NO: 9260755 - DNA, 22 bp, Homo sapiens
aaagtatatttacttactgtga

SEQ ID NO: 9260756 - DNA, 22 bp, Homo sapiens
aaagtatatttacttactgtga

SEQ ID NO: 9260757 - DNA, 22 bp, Homo sapiens
aaagtatatatgcactttagaa

SEQ ID NO: 9260758 - DNA, 22 bp, Homo sapiens
aactaaatctggcatttagagc

SEQ ID NO: 9260759 - DNA, 22 bp, Homo sapiens
aactaaatctggcatttagagc

SEQ ID NO: 9260760 - DNA, 22 bp, Homo sapiens
aactaaatctggcatttagagc

SEQ ID NO: 9260761 - DNA, 22 bp, Homo sapiens
aactaaatctggcatttagagc

SEQ ID NO: 9260762 - DNA, 22 bp, Homo sapiens
aactaaatctggcatttagagc

SEQ ID NO: 9260763 - DNA, 22 bp, Homo sapiens
aactaaaccatgacattatatt

SEQ ID NO: 9260764 - DNA, 22 bp, Homo sapiens
aactaaaagtgtgtctcttgta

SEQ ID NO: 9260765 - DNA, 18 bp, Homo sapiens
aactaaagatctttaagc

SEQ ID NO: 9260766 - DNA, 22 bp, Homo sapiens
aactaaaccatgacattatatt

SEQ ID NO: 9260767 - DNA, 22 bp, Homo sapiens
aactaaaactggtttgttctct

SEQ ID NO: 9260768 - DNA, 22 bp, Homo sapiens
aactaaaagtgtgtctcttgta

SEQ ID NO: 9260769 - DNA, 22 bp, Homo sapiens
aactaacagtcattaaaagaac

SEQ ID NO: 9260770 - DNA, 22 bp, Homo sapiens
aactaacagtcattaaaagaac

SEQ ID NO: 9260771 - DNA, 22 bp, Homo sapiens
aaagcttttgttttcgtaactg

SEQ ID NO: 9260772 - DNA, 22 bp, Homo sapiens
aaagggcagagttcactagaaa

SEQ ID NO: 9260773 - DNA, 22 bp, Homo sapiens
aaaggttattattactattgtc

SEQ ID NO: 9260774 - DNA, 22 bp, Homo sapiens
aaaggaagatgccaggactctg

SEQ ID NO: 9260775 - DNA, 22 bp, Homo sapiens
aaaggaagatgccaggactctg

SEQ ID NO: 9260776 - DNA, 22 bp, Homo sapiens
aaaggtttattgattctgctct

SEQ ID NO: 9260777 - DNA, 22 bp, Homo sapiens
aaaggtttattgctatggttgt

SEQ ID NO: 9260778 - DNA, 22 bp, Homo sapiens
aaaggtttccgagctttaattt

SEQ ID NO: 9260779 - DNA, 22 bp, Homo sapiens
aaaggtttatttgttgctcaca

SEQ ID NO: 9260780 - DNA, 22 bp, Homo sapiens
aaaggtttatttaatcagggag

SEQ ID NO: 9260781 - DNA, 22 bp, Homo sapiens
aaaggtttgaggtgggaagagg

SEQ ID NO: 9260782 - DNA, 22 bp, Homo sapiens
aaaggtttgcatggaatttacc

SEQ ID NO: 9260783 - DNA, 22 bp, Homo sapiens
aaaggttttatgttttccactt

SEQ ID NO: 9260784 - DNA, 22 bp, Homo sapiens
aaaggtttgccgacctctgctt

SEQ ID NO: 9260785 - DNA, 22 bp, Homo sapiens
aaaggttttcatcacagcaaga

SEQ ID NO: 9260786 - DNA, 22 bp, Homo sapiens
aaaggttttattctgagctctg

SEQ ID NO: 9260787 - DNA, 22 bp, Homo sapiens
aacagataagtatatctatgta

SEQ ID NO: 9260788 - DNA, 22 bp, Homo sapiens
aacagataagtatatctatgta

SEQ ID NO: 9260789 - DNA, 22 bp, Homo sapiens
aacagataagtatatctatgta

SEQ ID NO: 9260790 - DNA, 22 bp, Homo sapiens
aacagagtggagccaaactttg

SEQ ID NO: 9260791 - DNA, 22 bp, Homo sapiens
aaagccatgaatgttatagagg

SEQ ID NO: 9260792 - DNA, 22 bp, Homo sapiens
aaagccatgaatgttatagagg

SEQ ID NO: 9260793 - DNA, 22 bp, Homo sapiens
aacagatataggcagaactttg

SEQ ID NO: 9260794 - DNA, 22 bp, Homo sapiens
aacagatataggcagaactttg

SEQ ID NO: 9260795 - DNA, 22 bp, Homo sapiens
aacagcaatagcactattcatt

SEQ ID NO: 9260796 - DNA, 22 bp, Homo sapiens
aacagcagaaactgcaagctac

SEQ ID NO: 9260797 - DNA, 22 bp, Homo sapiens
aaagctttctagctatgttcta

SEQ ID NO: 9260798 - DNA, 22 bp, Homo sapiens
aaagcttgtgctgtagtattta

SEQ ID NO: 9260799 - DNA, 22 bp, Homo sapiens
aaagctttctagctatgttcta

SEQ ID NO: 9260800 - DNA, 22 bp, Homo sapiens
aaagcttagaggccagtggagg

SEQ ID NO: 9260801 - DNA, 22 bp, Homo sapiens
aaagcttaaggtaggtacagag

SEQ ID NO: 9260802 - DNA, 22 bp, Homo sapiens
aaagcttctaggcctattgctt

SEQ ID NO: 9260803 - DNA, 22 bp, Homo sapiens
aaagcttatttgtatgcatgtt

SEQ ID NO: 9260804 - DNA, 22 bp, Homo sapiens
aaagcttctattcacttacttg

SEQ ID NO: 9260805 - DNA, 22 bp, Homo sapiens
aaagcttctaggcctattgctt

SEQ ID NO: 9260806 - DNA, 22 bp, Homo sapiens
aaagcttaggatagggaatata

SEQ ID NO: 9260807 - DNA, 23 bp, Homo sapiens
aaagcttaactgggtaataaagc

SEQ ID NO: 9260808 - DNA, 22 bp, Homo sapiens
aaagctcttttccaagtattga

SEQ ID NO: 9260809 - DNA, 22 bp, Homo sapiens
aaagctgctgccaatcaggctt

SEQ ID NO: 9260810 - DNA, 22 bp, Homo sapiens
aaagctgctttaaacatctatg

SEQ ID NO: 9260811 - DNA, 22 bp, Homo sapiens
aaagccataagcctaatactaa

SEQ ID NO: 9260812 - DNA, 22 bp, Homo sapiens
aaagccatcagtaaaatgattt

SEQ ID NO: 9260813 - DNA, 22 bp, Homo sapiens
aaagccagtttctggaagtacc

SEQ ID NO: 9260814 - DNA, 22 bp, Homo sapiens
aaagccagttcttttatattgg

SEQ ID NO: 9260815 - DNA, 22 bp, Homo sapiens
aaagccagtggtatgagagaaa

SEQ ID NO: 9260816 - DNA, 22 bp, Homo sapiens
aaagccagttcttagagaaagc

SEQ ID NO: 9260817 - DNA, 22 bp, Homo sapiens
aaagccagttcttagagaaagc

SEQ ID NO: 9260818 - DNA, 22 bp, Homo sapiens
aaagatcaagtaggcatggcct

SEQ ID NO: 9260819 - DNA, 20 bp, Homo sapiens
aaagatactttttgtaatgg

SEQ ID NO: 9260820 - DNA, 22 bp, Homo sapiens
aaagatacttaatagttgtctg

SEQ ID NO: 9260821 - DNA, 22 bp, Homo sapiens
aaagccacgtggcctggggagc

SEQ ID NO: 9260822 - DNA, 22 bp, Homo sapiens
aaagccacgtggcctggggagc

SEQ ID NO: 9260823 - DNA, 22 bp, Homo sapiens
aaagccaggggagggattccca

SEQ ID NO: 9260824 - DNA, 22 bp, Homo sapiens
aaagccacagttctatgtctgc

SEQ ID NO: 9260825 - DNA, 22 bp, Homo sapiens
aaagatcagaggatagctgagt

SEQ ID NO: 9260826 - DNA, 22 bp, Homo sapiens
aaagatcacactgtggggcagt

SEQ ID NO: 9260827 - DNA, 22 bp, Homo sapiens
aaagatcaatagataaagctac

SEQ ID NO: 9260828 - DNA, 22 bp, Homo sapiens
aaattttagactcctgggtcta

SEQ ID NO: 9260829 - DNA, 22 bp, Homo sapiens
aaattgtgctcacactgatatt

SEQ ID NO: 9260830 - DNA, 22 bp, Homo sapiens
aaattttagactcctgggtcta

SEQ ID NO: 9260831 - DNA, 22 bp, Homo sapiens
aaattttagtaaggaagttgag

SEQ ID NO: 9260832 - DNA, 22 bp, Homo sapiens
aaattttgtattctagttctag

SEQ ID NO: 9260833 - DNA, 22 bp, Homo sapiens
aaattttctctctaagacttaa

SEQ ID NO: 9260834 - DNA, 21 bp, Homo sapiens
aaattttcttggctgtagtgt

SEQ ID NO: 9260835 - DNA, 22 bp, Homo sapiens
aaattttcagagcactagagaa

SEQ ID NO: 9260836 - DNA, 22 bp, Homo sapiens
aaattttagtaaggaagttgag

SEQ ID NO: 9260837 - DNA, 22 bp, Homo sapiens
aacaaacaaacattttgtcatc

SEQ ID NO: 9260838 - DNA, 22 bp, Homo sapiens
aacaaacaaacattttgtcatc

SEQ ID NO: 9260839 - DNA, 22 bp, Homo sapiens
aacaaacaaacattttgtcatc

SEQ ID NO: 9260840 - DNA, 22 bp, Homo sapiens
aacaaacaaacattttgtcatc

SEQ ID NO: 9260841 - DNA, 22 bp, Homo sapiens
aacaaacaaacattttgtcatc

SEQ ID NO: 9260842 - DNA, 22 bp, Homo sapiens
aaagagtttacaaattaggtaa

SEQ ID NO: 9260843 - DNA, 22 bp, Homo sapiens
aaagagtttccattgacatttc

SEQ ID NO: 9260844 - DNA, 22 bp, Homo sapiens
aaagataatgtttccttattct

SEQ ID NO: 9260845 - DNA, 22 bp, Homo sapiens
aaagataatgtttccttattct

SEQ ID NO: 9260846 - DNA, 22 bp, Homo sapiens
aacaaaacatttgtcttgtttc

SEQ ID NO: 9260847 - DNA, 22 bp, Homo sapiens
aaatagcataaaataggaagct

SEQ ID NO: 9260848 - DNA, 22 bp, Homo sapiens
aaatagctacatgatctctagg

SEQ ID NO: 9260849 - DNA, 22 bp, Homo sapiens
aaatagcattgtatttagctga

SEQ ID NO: 9260850 - DNA, 22 bp, Homo sapiens
aaatagcattgtatttagctga

SEQ ID NO: 9260851 - DNA, 22 bp, Homo sapiens
aaatagcagcctttagttaaca

SEQ ID NO: 9260852 - DNA, 22 bp, Homo sapiens
aaatagctgaaagttcctagat

SEQ ID NO: 9260853 - DNA, 22 bp, Homo sapiens
aaataggaatgtggtcctggga

SEQ ID NO: 9260854 - DNA, 22 bp, Homo sapiens
aaatagctgtatttaccctgta

SEQ ID NO: 9260855 - DNA, 22 bp, Homo sapiens
aaatcagagtggttggtcatcc

SEQ ID NO: 9260856 - DNA, 22 bp, Homo sapiens
aaatcagatgcttcctagttgg

SEQ ID NO: 9260857 - DNA, 22 bp, Homo sapiens
aaatcagattatttgattggca

SEQ ID NO: 9260858 - DNA, 22 bp, Homo sapiens
aaatcagatcttacacaattgt

SEQ ID NO: 9260859 - DNA, 23 bp, Homo sapiens
aaataggagtatctggatcatga

SEQ ID NO: 9260860 - DNA, 23 bp, Homo sapiens
aaataggagtatctggatcatga

SEQ ID NO: 9260861 - DNA, 22 bp, Homo sapiens
aaataggagcttaagcacttct

SEQ ID NO: 9260862 - DNA, 22 bp, Homo sapiens
aaatagagctgggttaaacttt

SEQ ID NO: 9260863 - DNA, 23 bp, Homo sapiens
aaatagagataggccagctttgc

SEQ ID NO: 9260864 - DNA, 22 bp, Homo sapiens
aaatagatttaacatccatccc

SEQ ID NO: 9260865 - DNA, 22 bp, Homo sapiens
aaatagattgctgaggcattac

SEQ ID NO: 9260866 - DNA, 22 bp, Homo sapiens
aaatagcagcctttagttaaca

SEQ ID NO: 9260867 - DNA, 22 bp, Homo sapiens
aaatagatttcctagcattgga

SEQ ID NO: 9260868 - DNA, 22 bp, Homo sapiens
aaatagatttctctgggtttgt

SEQ ID NO: 9260869 - DNA, 22 bp, Homo sapiens
aaataattatagcgagtctatc

SEQ ID NO: 9260870 - DNA, 22 bp, Homo sapiens
aaataattatagcgagtctatc

SEQ ID NO: 9260871 - DNA, 22 bp, Homo sapiens
aaataattatagcgagtctatc

SEQ ID NO: 9260872 - DNA, 22 bp, Homo sapiens
aaataattatagcgagtctatc

SEQ ID NO: 9260873 - DNA, 22 bp, Homo sapiens
aaataattgagttggtcaatat

SEQ ID NO: 9260874 - DNA, 22 bp, Homo sapiens
aaataattgagttggtcaatat

SEQ ID NO: 9260875 - DNA, 22 bp, Homo sapiens
aaataattgagttggtcaatat

SEQ ID NO: 9260876 - DNA, 22 bp, Homo sapiens
aaataattgagttggtcaatat

SEQ ID NO: 9260877 - DNA, 22 bp, Homo sapiens
aaatactgtagataatagagtt

SEQ ID NO: 9260878 - DNA, 22 bp, Homo sapiens
aaatactgtagataatagagtt

SEQ ID NO: 9260879 - DNA, 22 bp, Homo sapiens
aaatagacaggcttaaatagga

SEQ ID NO: 9260880 - DNA, 22 bp, Homo sapiens
aaatagacaggcttaaatagga

SEQ ID NO: 9260881 - DNA, 22 bp, Homo sapiens
aaatagacacttggacagacaa

SEQ ID NO: 9260882 - DNA, 22 bp, Homo sapiens
aaatagacaggcttaaatagga

SEQ ID NO: 9260883 - DNA, 22 bp, Homo sapiens
aaataagttaaactagaatgat

SEQ ID NO: 9260884 - DNA, 22 bp, Homo sapiens
aaataagtagtttagtgttgtg

SEQ ID NO: 9260885 - DNA, 22 bp, Homo sapiens
aaataagttagcagattccagt

SEQ ID NO: 9260886 - DNA, 22 bp, Homo sapiens
aaataatcaatttttgtagata

SEQ ID NO: 9260887 - DNA, 22 bp, Homo sapiens
aaataatgttaggcctttgctc

SEQ ID NO: 9260888 - DNA, 22 bp, Homo sapiens
aaataatgttaggcctttgctc

SEQ ID NO: 9260889 - DNA, 22 bp, Homo sapiens
aaataatcaatttttgtagata

SEQ ID NO: 9260890 - DNA, 22 bp, Homo sapiens
aaataactttctgtgtatagtc

SEQ ID NO: 9260891 - DNA, 22 bp, Homo sapiens
aaataagaggacagatgtttgg

SEQ ID NO: 9260892 - DNA, 22 bp, Homo sapiens
aaataagaaattcttctttgca

SEQ ID NO: 9260893 - DNA, 22 bp, Homo sapiens
aaataagaaattcttctttgca

SEQ ID NO: 9260894 - DNA, 22 bp, Homo sapiens
aaataagaggacagatgtttgg

SEQ ID NO: 9260895 - DNA, 22 bp, Homo sapiens
aaataagcacttaactgtatca

SEQ ID NO: 9260896 - DNA, 22 bp, Homo sapiens
aaataagcacttaactgtatca

SEQ ID NO: 9260897 - DNA, 22 bp, Homo sapiens
aaataacagtcagggacaacat

SEQ ID NO: 9260898 - DNA, 22 bp, Homo sapiens
aaataacagtcagggacaacat

SEQ ID NO: 9260899 - DNA, 22 bp, Homo sapiens
aaagttttatatgctgcagcga

SEQ ID NO: 9260900 - DNA, 22 bp, Homo sapiens
aaataacagtcagggacaacat

SEQ ID NO: 9260901 - DNA, 22 bp, Homo sapiens
aaagtgttttgatttagtggta

SEQ ID NO: 9260902 - DNA, 22 bp, Homo sapiens
aaagtgtttttgagctgtagtt

SEQ ID NO: 9260903 - DNA, 22 bp, Homo sapiens
aaagtgttgggattacaggcat

SEQ ID NO: 9260904 - DNA, 22 bp, Homo sapiens
aaagtgttgggattacaggcat

SEQ ID NO: 9260905 - DNA, 22 bp, Homo sapiens
aaagtgttgggattacaggtgt

SEQ ID NO: 9260906 - DNA, 22 bp, Homo sapiens
aaagtgtttacattgctataag

SEQ ID NO: 9260907 - DNA, 22 bp, Homo sapiens
aaagtgttatgagaactaagtg

SEQ ID NO: 9260908 - DNA, 22 bp, Homo sapiens
aaagtgtggagattgaactaaa

SEQ ID NO: 9260909 - DNA, 22 bp, Homo sapiens
aaagtgtagagtgcctcaaaat

SEQ ID NO: 9260910 - DNA, 22 bp, Homo sapiens
aaagtgttgggaagaaagtgca

SEQ ID NO: 9260911 - DNA, 22 bp, Homo sapiens
aaagtgttgattttatagtgca

SEQ ID NO: 9260912 - DNA, 22 bp, Homo sapiens
aaagtgttgattttatagtgca

SEQ ID NO: 9260913 - DNA, 22 bp, Homo sapiens
aaagtgttgatatgtgacatcc

SEQ ID NO: 9260914 - DNA, 22 bp, Homo sapiens
aaagtgttgatatgtgacatcc

SEQ ID NO: 9260915 - DNA, 22 bp, Homo sapiens
aaatctcaaaggcttagcatct

SEQ ID NO: 9260916 - DNA, 22 bp, Homo sapiens
aagcacagaaaaggagcatgga

SEQ ID NO: 9260917 - DNA, 22 bp, Homo sapiens
aaatctcaaaggcttagcatct

SEQ ID NO: 9260918 - DNA, 23 bp, Homo sapiens
aagcacagaatggtttaggagtt

SEQ ID NO: 9260919 - DNA, 22 bp, Homo sapiens
aagcacagactccctctgagtg

SEQ ID NO: 9260920 - DNA, 22 bp, Homo sapiens
aagcacagactccctctgagtg

SEQ ID NO: 9260921 - DNA, 22 bp, Homo sapiens
aagcacagagaggtaaagtaac

SEQ ID NO: 9260922 - DNA, 22 bp, Homo sapiens
aagcacagagatgggcacgcct

SEQ ID NO: 9260923 - DNA, 22 bp, Homo sapiens
aagcacagataaaacaggattc

SEQ ID NO: 9260924 - DNA, 22 bp, Homo sapiens
aaatcctaaaagtttgacttaa

SEQ ID NO: 9260925 - DNA, 22 bp, Homo sapiens
aaatcctttggaggacatgatg

SEQ ID NO: 9260926 - DNA, 22 bp, Homo sapiens
aagcacagattgctgcatccat

SEQ ID NO: 9260927 - DNA, 22 bp, Homo sapiens
aaatgcaggaaattatgctttt

SEQ ID NO: 9260928 - DNA, 22 bp, Homo sapiens
aaatgcagctgggcatgagagg

SEQ ID NO: 9260929 - DNA, 22 bp, Homo sapiens
aaatgcaccttgctgtgagact

SEQ ID NO: 9260930 - DNA, 22 bp, Homo sapiens
aaatgcaggtagtatttatttt

SEQ ID NO: 9260931 - DNA, 22 bp, Homo sapiens
aaatgcaggttcttgagccaag

SEQ ID NO: 9260932 - DNA, 21 bp, Homo sapiens
aaatgcaggctctttgttttc

SEQ ID NO: 9260933 - DNA, 22 bp, Homo sapiens
aaatgcaggttcttgagccaag

SEQ ID NO: 9260934 - DNA, 22 bp, Homo sapiens
aaatgcagtttcctgagaccca

SEQ ID NO: 9260935 - DNA, 22 bp, Homo sapiens
aaatgcatgagaaagtattctg

SEQ ID NO: 9260936 - DNA, 22 bp, Homo sapiens
aagcatcaacactatattgatg

SEQ ID NO: 9260937 - DNA, 22 bp, Homo sapiens
aaatgcatgagaaagtattctg

SEQ ID NO: 9260938 - DNA, 22 bp, Homo sapiens
aagcatgcaatctgtgataagg

SEQ ID NO: 9260939 - DNA, 22 bp, Homo sapiens
aagcatgcaatctgtgataagg

SEQ ID NO: 9260940 - DNA, 22 bp, Homo sapiens
aagcatcttaaaaagtatcaga

SEQ ID NO: 9260941 - DNA, 20 bp, Homo sapiens
aagcatctggatgtagcaat

SEQ ID NO: 9260942 - DNA, 22 bp, Homo sapiens
aagcatcaacctgtatgctgca

SEQ ID NO: 9260943 - DNA, 22 bp, Homo sapiens
aagcatctcacctgcccccacg

SEQ ID NO: 9260944 - DNA, 22 bp, Homo sapiens
aagcatctcctcatcatttggg

SEQ ID NO: 9260945 - DNA, 22 bp, Homo sapiens
aaatggcagcccagaggtaagg

SEQ ID NO: 9260946 - DNA, 20 bp, Homo sapiens
aagcatggtcaaaacttatg

SEQ ID NO: 9260947 - DNA, 22 bp, Homo sapiens
aaatgtacaacatccatatata

SEQ ID NO: 9260948 - DNA, 22 bp, Homo sapiens
aaatgtaagtctttgtttctta

SEQ ID NO: 9260949 - DNA, 22 bp, Homo sapiens
aaatgtaagtctttgtttctta

SEQ ID NO: 9260950 - DNA, 22 bp, Homo sapiens
aaatggcaggctctttgctagt

SEQ ID NO: 9260951 - DNA, 22 bp, Homo sapiens
aaatggcaggctctttgctagt

SEQ ID NO: 9260952 - DNA, 22 bp, Homo sapiens
aagctctttccactaaaccact

SEQ ID NO: 9260953 - DNA, 23 bp, Homo sapiens
aagctgaacttgtttgctgggag

SEQ ID NO: 9260954 - DNA, 22 bp, Homo sapiens
aaatgtaccttgatagtttggt

SEQ ID NO: 9260955 - DNA, 22 bp, Homo sapiens
aaatgtattgcataggatattt

SEQ ID NO: 9260956 - DNA, 22 bp, Homo sapiens
aaatgtatcctacttcctgagt

SEQ ID NO: 9260957 - DNA, 22 bp, Homo sapiens
aaatgtatcctacttcctgagt

SEQ ID NO: 9260958 - DNA, 21 bp, Homo sapiens
aaagttcatgctttaatattc

SEQ ID NO: 9260959 - DNA, 22 bp, Homo sapiens
aaagttcatggtgttatagaaa

SEQ ID NO: 9260960 - DNA, 22 bp, Homo sapiens
aaagttcatggtgttatagaaa

SEQ ID NO: 9260961 - DNA, 20 bp, Homo sapiens
aaagttcatgtttgcacttt

SEQ ID NO: 9260962 - DNA, 22 bp, Homo sapiens
aaactctagtaaaatgtattca

SEQ ID NO: 9260963 - DNA, 22 bp, Homo sapiens
aaagttcagtgccttctataca

SEQ ID NO: 9260964 - DNA, 22 bp, Homo sapiens
aaagttcagattagactcaaga

SEQ ID NO: 9260965 - DNA, 22 bp, Homo sapiens
aaagttcactgaccagcactgg

SEQ ID NO: 9260966 - DNA, 22 bp, Homo sapiens
aaagttactatcacaatgaaat

SEQ ID NO: 9260967 - DNA, 22 bp, Homo sapiens
aaagttagtttcttatatgtct

SEQ ID NO: 9260968 - DNA, 22 bp, Homo sapiens
aaagttacagtaattcagtgta

SEQ ID NO: 9260969 - DNA, 22 bp, Homo sapiens
aaagttacccaatctctatgaa

SEQ ID NO: 9260970 - DNA, 22 bp, Homo sapiens
aaaccttttcagctgaatggag

SEQ ID NO: 9260971 - DNA, 22 bp, Homo sapiens
aaacctttctgctctcagcgta

SEQ ID NO: 9260972 - DNA, 22 bp, Homo sapiens
aaacctttaccagactagcaag

SEQ ID NO: 9260973 - DNA, 22 bp, Homo sapiens
aaacctggacttgtaatgataa

SEQ ID NO: 9260974 - DNA, 22 bp, Homo sapiens
aaacctgaagtacgttacataa

SEQ ID NO: 9260975 - DNA, 22 bp, Homo sapiens
aaacctattggcaagaataata

SEQ ID NO: 9260976 - DNA, 22 bp, Homo sapiens
aaacccagggttttgtcttccc

SEQ ID NO: 9260977 - DNA, 22 bp, Homo sapiens
aaacattgtacattctgtagct

SEQ ID NO: 9260978 - DNA, 22 bp, Homo sapiens
aaacattgttatgataaattac

SEQ ID NO: 9260979 - DNA, 22 bp, Homo sapiens
aaaggtcttgtcttgacagagt

SEQ ID NO: 9260980 - DNA, 22 bp, Homo sapiens
aaaggtcttttttctaacacca

SEQ ID NO: 9260981 - DNA, 22 bp, Homo sapiens
aaacattgtaattttagcatgg

SEQ ID NO: 9260982 - DNA, 22 bp, Homo sapiens
aaaggtgcctcttacaaggctt

SEQ ID NO: 9260983 - DNA, 22 bp, Homo sapiens
aaacaatgtacatttataatgc

SEQ ID NO: 9260984 - DNA, 22 bp, Homo sapiens
aaacaatgtagattaccattta

SEQ ID NO: 9260985 - DNA, 22 bp, Homo sapiens
aaacaatgacaacacagctgcg

SEQ ID NO: 9260986 - DNA, 22 bp, Homo sapiens
aaacaatgagcttttacacact

SEQ ID NO: 9260987 - DNA, 22 bp, Homo sapiens
aaacaatgagcttttacacact

SEQ ID NO: 9260988 - DNA, 22 bp, Homo sapiens
aaacagtgactggtacataata

SEQ ID NO: 9260989 - DNA, 22 bp, Homo sapiens
aaacagcttgtaaggtgtaatt

SEQ ID NO: 9260990 - DNA, 22 bp, Homo sapiens
aaacagctgtcattgttttaaa

SEQ ID NO: 9260991 - DNA, 22 bp, Homo sapiens
aaacaatttccacctctcctga

SEQ ID NO: 9260992 - DNA, 22 bp, Homo sapiens
aaacaatgtagattaccattta

SEQ ID NO: 9260993 - DNA, 22 bp, Homo sapiens
aaaggtatgatactgtgacatg

SEQ ID NO: 9260994 - DNA, 22 bp, Homo sapiens
aaaggtcttaaggttaagcagg

SEQ ID NO: 9260995 - DNA, 22 bp, Homo sapiens
aaaggtaacagttataaccagg

SEQ ID NO: 9260996 - DNA, 22 bp, Homo sapiens
aaacagtttctaatcatggaga

SEQ ID NO: 9260997 - DNA, 22 bp, Homo sapiens
aaagggctgtcaaataagcaac

SEQ ID NO: 9260998 - DNA, 22 bp, Homo sapiens
aaacagtttataacatgatact

SEQ ID NO: 9260999 - DNA, 22 bp, Homo sapiens
aaacagtttataacatgatact

SEQ ID NO: 9261000 - DNA, 22 bp, Homo sapiens
aaacagtttcattttcatgacc

SEQ ID NO: 9261001 - DNA, 22 bp, Homo sapiens
aaacagtttcattttcatgacc

SEQ ID NO: 9261002 - DNA, 22 bp, Homo sapiens
aaacagtgtttttatgatttat

SEQ ID NO: 9261003 - DNA, 22 bp, Homo sapiens
aaacagtggccaattctggaga

SEQ ID NO: 9261004 - DNA, 21 bp, Homo sapiens
aaactgaccttgcctgagaca

SEQ ID NO: 9261005 - DNA, 21 bp, Homo sapiens
aaactgaccttgcctgagaca

SEQ ID NO: 9261006 - DNA, 21 bp, Homo sapiens
aaactgaccttgcctgagaca

SEQ ID NO: 9261007 - DNA, 22 bp, Homo sapiens
aaactgaattcaagtatccagt

SEQ ID NO: 9261008 - DNA, 22 bp, Homo sapiens
aaactgaggctcccgagggtgt

SEQ ID NO: 9261009 - DNA, 21 bp, Homo sapiens
aaactgaggcttcaagcagtg

SEQ ID NO: 9261010 - DNA, 21 bp, Homo sapiens
aaactgaggcttcaagcagtg

SEQ ID NO: 9261011 - DNA, 22 bp, Homo sapiens
aaactgaggagttagactaggg

SEQ ID NO: 9261012 - DNA, 22 bp, Homo sapiens
aaactgaggagttagactaggg

SEQ ID NO: 9261013 - DNA, 22 bp, Homo sapiens
aaactgaggagttagactaggg

SEQ ID NO: 9261014 - DNA, 22 bp, Homo sapiens
aaactgaggaacaaggaaggat

SEQ ID NO: 9261015 - DNA, 22 bp, Homo sapiens
aaactgagaccgaaaggggtag

SEQ ID NO: 9261016 - DNA, 22 bp, Homo sapiens
aaactcttggtcaacatgagga

SEQ ID NO: 9261017 - DNA, 22 bp, Homo sapiens
aaactctttccacgattacttt

SEQ ID NO: 9261018 - DNA, 22 bp, Homo sapiens
aaactcttcatatacatatgct

SEQ ID NO: 9261019 - DNA, 22 bp, Homo sapiens
aaactcttcatatacatatgct

SEQ ID NO: 9261020 - DNA, 22 bp, Homo sapiens
aaactctgttgagataatattt

SEQ ID NO: 9261021 - DNA, 22 bp, Homo sapiens
aaagacacaaatgtagaccaaa

SEQ ID NO: 9261022 - DNA, 22 bp, Homo sapiens
aaagacacaaatgtagaccaaa

SEQ ID NO: 9261023 - DNA, 22 bp, Homo sapiens
aaagaatactccttttgccttg

SEQ ID NO: 9261024 - DNA, 22 bp, Homo sapiens
aaagaatagcctttgtccaaat

SEQ ID NO: 9261025 - DNA, 21 bp, Homo sapiens
aaagaacaggcagatgttctt

SEQ ID NO: 9261026 - DNA, 22 bp, Homo sapiens
aaagaaggtagggctggtgact

SEQ ID NO: 9261027 - DNA, 22 bp, Homo sapiens
aaagaataccctgggtcataaa

SEQ ID NO: 9261028 - DNA, 22 bp, Homo sapiens
aaagaggggactgttaattcca

SEQ ID NO: 9261029 - DNA, 22 bp, Homo sapiens
aaagagggacaggcgcagacac

SEQ ID NO: 9261030 - DNA, 22 bp, Homo sapiens
aaagagttctatgatctttcca

SEQ ID NO: 9261031 - DNA, 22 bp, Homo sapiens
aaagagttaagagtcttaagct

SEQ ID NO: 9261032 - DNA, 22 bp, Homo sapiens
aaagagtctggcgttttaatgg

SEQ ID NO: 9261033 - DNA, 22 bp, Homo sapiens
aaagagttgaggcagttatcca

SEQ ID NO: 9261034 - DNA, 22 bp, Homo sapiens
aaagagttgaaaactaacagtg

SEQ ID NO: 9261035 - DNA, 22 bp, Homo sapiens
aaagagttgttgtataacagga

SEQ ID NO: 9261036 - DNA, 22 bp, Homo sapiens
aaagagttgttgtataacagga

SEQ ID NO: 9261037 - DNA, 22 bp, Homo sapiens
aaattaagagtaactctgtaga

SEQ ID NO: 9261038 - DNA, 22 bp, Homo sapiens
aaattaagggtgagaagagttg

SEQ ID NO: 9261039 - DNA, 22 bp, Homo sapiens
aaattaagggtgagaagagttg

SEQ ID NO: 9261040 - DNA, 22 bp, Homo sapiens
aaattaagagtaactctgtaga

SEQ ID NO: 9261041 - DNA, 22 bp, Homo sapiens
aaattagaccagggctcctgga

SEQ ID NO: 9261042 - DNA, 22 bp, Homo sapiens
aaattagaagtgctcaggaata

SEQ ID NO: 9261043 - DNA, 22 bp, Homo sapiens
aaattagaaatactttcaaagc

SEQ ID NO: 9261044 - DNA, 22 bp, Homo sapiens
aaattagaaatactttcaaagc

SEQ ID NO: 9261045 - DNA, 20 bp, Homo sapiens
aaattactgccacacatttc

SEQ ID NO: 9261046 - DNA, 22 bp, Homo sapiens
aaattagaagtgctcaggaata

SEQ ID NO: 9261047 - DNA, 22 bp, Homo sapiens
aaagaggctcaaggtgggccag

SEQ ID NO: 9261048 - DNA, 22 bp, Homo sapiens
aaagaggcaggtgttactggaa

SEQ ID NO: 9261049 - DNA, 22 bp, Homo sapiens
aaagaggcaatcaatgtagcaa

SEQ ID NO: 9261050 - DNA, 22 bp, Homo sapiens
aaagaggatggagtagtcagct

SEQ ID NO: 9261051 - DNA, 22 bp, Homo sapiens
aaagaggatggagtagtcagct

SEQ ID NO: 9261052 - DNA, 22 bp, Homo sapiens
aaagaggatggagtagtcagct

SEQ ID NO: 9261053 - DNA, 22 bp, Homo sapiens
aaagaggaaccaagagcacgtg

SEQ ID NO: 9261054 - DNA, 22 bp, Homo sapiens
aaagaggaaccaagagcacgtg

SEQ ID NO: 9261055 - DNA, 22 bp, Homo sapiens
aaatgcagcagctaattgaaaa

SEQ ID NO: 9261056 - DNA, 22 bp, Homo sapiens
aaatgcagcagctaattgaaaa

SEQ ID NO: 9261057 - DNA, 22 bp, Homo sapiens
aaagagcaccctcaatgtctga

SEQ ID NO: 9261058 - DNA, 22 bp, Homo sapiens
aaatgcagaatgatttcatcta

SEQ ID NO: 9261059 - DNA, 22 bp, Homo sapiens
aaatgcactgaatattccaaat

SEQ ID NO: 9261060 - DNA, 22 bp, Homo sapiens
aaatgcactgaacacatgttgt

SEQ ID NO: 9261061 - DNA, 22 bp, Homo sapiens
aaagacacaaatgtagaccaaa

SEQ ID NO: 9261062 - DNA, 22 bp, Homo sapiens
aaatgcacgctacccagctaga

SEQ ID NO: 9261063 - DNA, 22 bp, Homo sapiens
aaatgcagattgtcattcagga

SEQ ID NO: 9261064 - DNA, 22 bp, Homo sapiens
aaatgcagattgtcattcagga

SEQ ID NO: 9261065 - DNA, 22 bp, Homo sapiens
aaatgcagatccctgaatctca

SEQ ID NO: 9261066 - DNA, 22 bp, Homo sapiens
aaatgcagattcatgagcccca

SEQ ID NO: 9261067 - DNA, 22 bp, Homo sapiens
aaaagtactattttaacaaagt

SEQ ID NO: 9261068 - DNA, 22 bp, Homo sapiens
aaactcctgcatactcagaagc

SEQ ID NO: 9261069 - DNA, 22 bp, Homo sapiens
aaagacatggaactagagatgg

SEQ ID NO: 9261070 - DNA, 22 bp, Homo sapiens
aaaagtattggccaccatttct

SEQ ID NO: 9261071 - DNA, 22 bp, Homo sapiens
aaaagtatggtggtccttttta

SEQ ID NO: 9261072 - DNA, 22 bp, Homo sapiens
aaaagtattggccaccatttct

SEQ ID NO: 9261073 - DNA, 22 bp, Homo sapiens
aaaagtatggtggtccttttta

SEQ ID NO: 9261074 - DNA, 22 bp, Homo sapiens
aaacccagagactagaaagacc

SEQ ID NO: 9261075 - DNA, 22 bp, Homo sapiens
aaaagagagttgccagtctgta

SEQ ID NO: 9261076 - DNA, 22 bp, Homo sapiens
aaaagagagttgccagtctgta

SEQ ID NO: 9261077 - DNA, 22 bp, Homo sapiens
aaaagagagttgccagtctgta

SEQ ID NO: 9261078 - DNA, 22 bp, Homo sapiens
aaaagagaaagtggcaggcttt

SEQ ID NO: 9261079 - DNA, 22 bp, Homo sapiens
aaaagagaatcctgtacagaga

SEQ ID NO: 9261080 - DNA, 22 bp, Homo sapiens
aaaagagaatcctgtacagaga

SEQ ID NO: 9261081 - DNA, 22 bp, Homo sapiens
aaaagagagctgaggagctcca

SEQ ID NO: 9261082 - DNA, 22 bp, Homo sapiens
aaaagagaatcctgtacagaga

SEQ ID NO: 9261083 - DNA, 22 bp, Homo sapiens
aaactcagatgtggtgaagacc

SEQ ID NO: 9261084 - DNA, 22 bp, Homo sapiens
aaactcatgccattaatccttt

SEQ ID NO: 9261085 - DNA, 19 bp, Homo sapiens
aaactcatagactcatatt

SEQ ID NO: 9261086 - DNA, 22 bp, Homo sapiens
aaactcagaaggtacagaaggg

SEQ ID NO: 9261087 - DNA, 22 bp, Homo sapiens
aaagacattagcttagatgtca

SEQ ID NO: 9261088 - DNA, 22 bp, Homo sapiens
aaagacattagattaacgtaca

SEQ ID NO: 9261089 - DNA, 22 bp, Homo sapiens
aaagacattagattaacgtaca

SEQ ID NO: 9261090 - DNA, 22 bp, Homo sapiens
aaagacattagattaacgtaca

SEQ ID NO: 9261091 - DNA, 22 bp, Homo sapiens
aaagacattagattaacgtaca

SEQ ID NO: 9261092 - DNA, 22 bp, Homo sapiens
aaagacatggcaagagatgggg

SEQ ID NO: 9261093 - DNA, 22 bp, Homo sapiens
aaagacatggcaagagatgggg

SEQ ID NO: 9261094 - DNA, 22 bp, Homo sapiens
aaagacatggaactagagatgg

SEQ ID NO: 9261095 - DNA, 22 bp, Homo sapiens
aaagacatggaactagagatgg

SEQ ID NO: 9261096 - DNA, 23 bp, Homo sapiens
aaagacctaggatgagggagacg

SEQ ID NO: 9261097 - DNA, 22 bp, Homo sapiens
aaagacattagcttagatgtca

SEQ ID NO: 9261098 - DNA, 22 bp, Homo sapiens
aaagacattagcttagatgtca

SEQ ID NO: 9261099 - DNA, 22 bp, Homo sapiens
aaagacattgaagaaggactta

SEQ ID NO: 9261100 - DNA, 22 bp, Homo sapiens
aaaatcagtacactttattttg

SEQ ID NO: 9261101 - DNA, 22 bp, Homo sapiens
aaaatcagtacactttattttg

SEQ ID NO: 9261102 - DNA, 22 bp, Homo sapiens
aaaatcacacaagtagatgggg

SEQ ID NO: 9261103 - DNA, 22 bp, Homo sapiens
aaaatcctctaattctagaata

SEQ ID NO: 9261104 - DNA, 22 bp, Homo sapiens
aaacaaacaattagttgtgtgg

SEQ ID NO: 9261105 - DNA, 22 bp, Homo sapiens
aaacaaacaattagttgtgtgg

SEQ ID NO: 9261106 - DNA, 22 bp, Homo sapiens
aaacaaggtccttctgtgacat

SEQ ID NO: 9261107 - DNA, 22 bp, Homo sapiens
aaaattttgccctatccttcat

SEQ ID NO: 9261108 - DNA, 22 bp, Homo sapiens
aaaatctaagtagcgagtaagg

SEQ ID NO: 9261109 - DNA, 22 bp, Homo sapiens
aaacaatgaaatatttttatgg

SEQ ID NO: 9261110 - DNA, 22 bp, Homo sapiens
aaacaatccaggaacctgttta

SEQ ID NO: 9261111 - DNA, 22 bp, Homo sapiens
aaacaagtttgtagactagcca

SEQ ID NO: 9261112 - DNA, 22 bp, Homo sapiens
aaacaagtttagaataatgaat

SEQ ID NO: 9261113 - DNA, 22 bp, Homo sapiens
aaacaagtgtaaactagtctgt

SEQ ID NO: 9261114 - DNA, 22 bp, Homo sapiens
aaacaagtttagaataatgaat

SEQ ID NO: 9261115 - DNA, 22 bp, Homo sapiens
aaaatgaataagttaacccagg

SEQ ID NO: 9261116 - DNA, 22 bp, Homo sapiens
aaaatgaataagttaacccagg

SEQ ID NO: 9261117 - DNA, 22 bp, Homo sapiens
aaaaataggtcaaccgtgtatg

SEQ ID NO: 9261118 - DNA, 22 bp, Homo sapiens
aaaaataggtcaaccgtgtatg

SEQ ID NO: 9261119 - DNA, 22 bp, Homo sapiens
aaaaatagcttctcttgtccct

SEQ ID NO: 9261120 - DNA, 22 bp, Homo sapiens
aaaaatagaaggattgactgag

SEQ ID NO: 9261121 - DNA, 22 bp, Homo sapiens
aaaaatagaaggattgactgag

SEQ ID NO: 9261122 - DNA, 22 bp, Homo sapiens
aaaaatagcttctcttgtccct

SEQ ID NO: 9261123 - DNA, 22 bp, Homo sapiens
aaaatgacattccagtgatatt

SEQ ID NO: 9261124 - DNA, 22 bp, Homo sapiens
aaaaatagaaggattgactgag

SEQ ID NO: 9261125 - DNA, 22 bp, Homo sapiens
aaaaatagaaggattgactgag

SEQ ID NO: 9261126 - DNA, 22 bp, Homo sapiens
aaacactgtgggacatcttact

SEQ ID NO: 9261127 - DNA, 22 bp, Homo sapiens
aaaaatcacttttataggcagc

SEQ ID NO: 9261128 - DNA, 22 bp, Homo sapiens
aaaaatcacttttataggcagc

SEQ ID NO: 9261129 - DNA, 22 bp, Homo sapiens
aaacacttcctgtaacatgaca

SEQ ID NO: 9261130 - DNA, 22 bp, Homo sapiens
aaacagaaatttcctcatgctc

SEQ ID NO: 9261131 - DNA, 22 bp, Homo sapiens
aaacacttgcaaaatggttcct

SEQ ID NO: 9261132 - DNA, 22 bp, Homo sapiens
aaacactttagaaagggacttg

SEQ ID NO: 9261133 - DNA, 22 bp, Homo sapiens
aaaagacatctatttcaggcag

SEQ ID NO: 9261134 - DNA, 22 bp, Homo sapiens
aaaagacatctatttcaggcag

SEQ ID NO: 9261135 - DNA, 22 bp, Homo sapiens
aaaagagaaagtggcaggcttt

SEQ ID NO: 9261136 - DNA, 22 bp, Homo sapiens
aaaagacaggtgtctgcggccc

SEQ ID NO: 9261137 - DNA, 22 bp, Homo sapiens
aaaagacatatgtgggcattct

SEQ ID NO: 9261138 - DNA, 22 bp, Homo sapiens
aaaatcttgactgtttttagaa

SEQ ID NO: 9261139 - DNA, 22 bp, Homo sapiens
aaaatcttgactgtttttagaa

SEQ ID NO: 9261140 - DNA, 22 bp, Homo sapiens
aaaatcttgtgacttaggaagg

SEQ ID NO: 9261141 - DNA, 22 bp, Homo sapiens
aaaatcttgtgacttaggaagg

SEQ ID NO: 9261142 - DNA, 23 bp, Homo sapiens
aaaatcttctgcctatgaagaaa

SEQ ID NO: 9261143 - DNA, 23 bp, Homo sapiens
aaaatcttctgcctatgaagaaa

SEQ ID NO: 9261144 - DNA, 22 bp, Homo sapiens
aaaatgaagcaaaggcattcag

SEQ ID NO: 9261145 - DNA, 22 bp, Homo sapiens
aaaatgaacagaacaatgggga

SEQ ID NO: 9261146 - DNA, 22 bp, Homo sapiens
aaaatgaacagaacaatgggga

SEQ ID NO: 9261147 - DNA, 22 bp, Homo sapiens
aaaatcttgtgacttaggaagg

SEQ ID NO: 9261148 - DNA, 20 bp, Homo sapiens
aaaaacagtaatgctgaaga

SEQ ID NO: 9261149 - DNA, 22 bp, Homo sapiens
aaaaaccattgtcttcagtctc

SEQ ID NO: 9261150 - DNA, 22 bp, Homo sapiens
aaaaacctcaattacttttgca

SEQ ID NO: 9261151 - DNA, 22 bp, Homo sapiens
aaaaacctttcattgcaaatgt

SEQ ID NO: 9261152 - DNA, 22 bp, Homo sapiens
aaaatctggtaatttgaatgtg

SEQ ID NO: 9261153 - DNA, 22 bp, Homo sapiens
aaaatagttaacgttcagagta

SEQ ID NO: 9261154 - DNA, 22 bp, Homo sapiens
aaaatagttaacgttcagagta

SEQ ID NO: 9261155 - DNA, 22 bp, Homo sapiens
aaaaacacaagtggcttggtct

SEQ ID NO: 9261156 - DNA, 22 bp, Homo sapiens
aaaaaattccattctgtgcctt

SEQ ID NO: 9261157 - DNA, 22 bp, Homo sapiens
aaaaaattccattctgtgcctt

SEQ ID NO: 9261158 - DNA, 22 bp, Homo sapiens
aaaaacactgggctgggagtca

SEQ ID NO: 9261159 - DNA, 22 bp, Homo sapiens
aaaaacactgggctgggagtca

SEQ ID NO: 9261160 - DNA, 22 bp, Homo sapiens
aaaaacacaagtggcttggtct

SEQ ID NO: 9261161 - DNA, 20 bp, Homo sapiens
aaaaacagtaatgctgaaga

SEQ ID NO: 9261162 - DNA, 20 bp, Homo sapiens
aaaaacagtaatgctgaaga

SEQ ID NO: 9261163 - DNA, 22 bp, Homo sapiens
aaaaaattatcatagttcctga

SEQ ID NO: 9261164 - DNA, 22 bp, Homo sapiens
aaaaaatcagatctttggttaa

SEQ ID NO: 9261165 - DNA, 22 bp, Homo sapiens
aaaaaagattgatggtggatgc

SEQ ID NO: 9261166 - DNA, 22 bp, Homo sapiens
aacactctctgttggtaaggct

SEQ ID NO: 9261167 - DNA, 22 bp, Homo sapiens
aacactctctgttggtaaggct

SEQ ID NO: 9261168 - DNA, 22 bp, Homo sapiens
aacactgaaacattgattgaca

SEQ ID NO: 9261169 - DNA, 22 bp, Homo sapiens
aacactaatgggagaacaaccc

SEQ ID NO: 9261170 - DNA, 22 bp, Homo sapiens
aacaaagtgtacttccatactg

SEQ ID NO: 9261171 - DNA, 22 bp, Homo sapiens
aacaaagtcgttgcctagaaga

SEQ ID NO: 9261172 - DNA, 22 bp, Homo sapiens
aacaaatgacctgatttcttcc

SEQ ID NO: 9261173 - DNA, 22 bp, Homo sapiens
aacaaatcttaaagtaattcaa

SEQ ID NO: 9261174 - DNA, 22 bp, Homo sapiens
aacaaatggaacacaaatcttt

SEQ ID NO: 9261175 - DNA, 22 bp, Homo sapiens
aacaaatgataccagttctcaa

SEQ ID NO: 9261176 - DNA, 22 bp, Homo sapiens
aaggtattttctaatgtatact

SEQ ID NO: 9261177 - DNA, 20 bp, Homo sapiens
aaggtccaaactctgtgttc

SEQ ID NO: 9261178 - DNA, 22 bp, Homo sapiens
aacactgaaatgtcttaagatt

SEQ ID NO: 9261179 - DNA, 22 bp, Homo sapiens
aacactgaagccgttaaacctt

SEQ ID NO: 9261180 - DNA, 22 bp, Homo sapiens
aacactgaagtagtgaatactg

SEQ ID NO: 9261181 - DNA, 22 bp, Homo sapiens
aacactgagctattacggtgga

SEQ ID NO: 9261182 - DNA, 22 bp, Homo sapiens
aacactgacgacgtgaactaaa

SEQ ID NO: 9261183 - DNA, 22 bp, Homo sapiens
aacagcttgaggaatatcatca

SEQ ID NO: 9261184 - DNA, 22 bp, Homo sapiens
aacaggaatgaggagaaaaggt

SEQ ID NO: 9261185 - DNA, 22 bp, Homo sapiens
aagtccaaggtcaccattcaca

SEQ ID NO: 9261186 - DNA, 22 bp, Homo sapiens
aagtcattggtagcttgatagg

SEQ ID NO: 9261187 - DNA, 22 bp, Homo sapiens
aagtcattatctcttctaatct

SEQ ID NO: 9261188 - DNA, 22 bp, Homo sapiens
aagtcattctatttctctatgt

SEQ ID NO: 9261189 - DNA, 22 bp, Homo sapiens
aaggtcctgtagccacagagcc

SEQ ID NO: 9261190 - DNA, 22 bp, Homo sapiens
aacagcaggcaccaaggctatg

SEQ ID NO: 9261191 - DNA, 22 bp, Homo sapiens
aacagcagggggacctgctggt

SEQ ID NO: 9261192 - DNA, 22 bp, Homo sapiens
aacagcagggacttgaatggaa

SEQ ID NO: 9261193 - DNA, 22 bp, Homo sapiens
aacagcatcaccccataacatt

SEQ ID NO: 9261194 - DNA, 22 bp, Homo sapiens
aacagcatatttcatatattga

SEQ ID NO: 9261195 - DNA, 22 bp, Homo sapiens
aagctgaggcccatggcaaggt

SEQ ID NO: 9261196 - DNA, 22 bp, Homo sapiens
aagctgagccagtggcaagtgc

SEQ ID NO: 9261197 - DNA, 22 bp, Homo sapiens
aagctgagccagtggcaagtgc

SEQ ID NO: 9261198 - DNA, 22 bp, Homo sapiens
aagctgaggtcaagtagctagt

SEQ ID NO: 9261199 - DNA, 22 bp, Homo sapiens
aagctgaggcccatggcaaggt

SEQ ID NO: 9261200 - DNA, 22 bp, Homo sapiens
aagctgaggctcccctgaggga

SEQ ID NO: 9261201 - DNA, 22 bp, Homo sapiens
aagctgaggctcccctgaggga

SEQ ID NO: 9261202 - DNA, 22 bp, Homo sapiens
aaatgtgcatgagtcagaagtg

SEQ ID NO: 9261203 - DNA, 22 bp, Homo sapiens
aaatgtgctcatttataaaagt

SEQ ID NO: 9261204 - DNA, 19 bp, Homo sapiens
aaatgtgatggtacaattc

SEQ ID NO: 9261205 - DNA, 22 bp, Homo sapiens
aaatgtctatctggcatattcc

SEQ ID NO: 9261206 - DNA, 22 bp, Homo sapiens
aaatgtgatactgttcttttta

SEQ ID NO: 9261207 - DNA, 22 bp, Homo sapiens
aaatgtgggtaatgggactgga

SEQ ID NO: 9261208 - DNA, 22 bp, Homo sapiens
aaatgtgtatatgaaacatgat

SEQ ID NO: 9261209 - DNA, 22 bp, Homo sapiens
aaatgtgtcatattcaaagtca

SEQ ID NO: 9261210 - DNA, 22 bp, Homo sapiens
aaattctaaggtcacaatgttg

SEQ ID NO: 9261211 - DNA, 22 bp, Homo sapiens
aaattccattttgtgactattc

SEQ ID NO: 9261212 - DNA, 22 bp, Homo sapiens
aaattcacttgcctgcttagct

SEQ ID NO: 9261213 - DNA, 22 bp, Homo sapiens
aaattcactctgttcctcatgg

SEQ ID NO: 9261214 - DNA, 22 bp, Homo sapiens
aaatgttttgctcccatgtggt

SEQ ID NO: 9261215 - DNA, 22 bp, Homo sapiens
aaattcactctgttcctcatgg

SEQ ID NO: 9261216 - DNA, 22 bp, Homo sapiens
aaatgtgttcctttgctacaga

SEQ ID NO: 9261217 - DNA, 22 bp, Homo sapiens
aaatgttaggttgtactgagtc

SEQ ID NO: 9261218 - DNA, 22 bp, Homo sapiens
aaatgttcccaatatgaagctg

SEQ ID NO: 9261219 - DNA, 22 bp, Homo sapiens
aaatgttccgggtaaggagaaa

SEQ ID NO: 9261220 - DNA, 20 bp, Homo sapiens
aacaaactacaaaattatgt

SEQ ID NO: 9261221 - DNA, 22 bp, Homo sapiens
aacaaactcaaatggaagagtg

SEQ ID NO: 9261222 - DNA, 22 bp, Homo sapiens
aacaaagaagactggttatttt

SEQ ID NO: 9261223 - DNA, 22 bp, Homo sapiens
aacaaagaagactggttatttt

SEQ ID NO: 9261224 - DNA, 22 bp, Homo sapiens
aacaaaggccgttaataaccac

SEQ ID NO: 9261225 - DNA, 21 bp, Homo sapiens
aacaaagggatgctcatcttt

SEQ ID NO: 9261226 - DNA, 22 bp, Homo sapiens
aacaaagtagctgctgttctta

SEQ ID NO: 9261227 - DNA, 22 bp, Homo sapiens
aacaaagtacttttcagtgctt

SEQ ID NO: 9261228 - DNA, 22 bp, Homo sapiens
aacaaaccttccctatacgtct

SEQ ID NO: 9261229 - DNA, 20 bp, Homo sapiens
aacaaactacaaaattatgt

SEQ ID NO: 9261230 - DNA, 22 bp, Homo sapiens
aacaaacagttaagtgtggatg

SEQ ID NO: 9261231 - DNA, 22 bp, Homo sapiens
aacaaacagttaagtgtggatg

SEQ ID NO: 9261232 - DNA, 22 bp, Homo sapiens
aacaaacagttaagtgtggatg

SEQ ID NO: 9261233 - DNA, 22 bp, Homo sapiens
aacaaacattacctggtgctgg

SEQ ID NO: 9261234 - DNA, 22 bp, Homo sapiens
aacaaacattacctggtgctgg

SEQ ID NO: 9261235 - DNA, 22 bp, Homo sapiens
aacaaacattacctggtgctgg

SEQ ID NO: 9261236 - DNA, 22 bp, Homo sapiens
aaattgcattcaggatgcagga

SEQ ID NO: 9261237 - DNA, 22 bp, Homo sapiens
aaattgcaggtaggtgggtgat

SEQ ID NO: 9261238 - DNA, 22 bp, Homo sapiens
aaattgcattcttgtcttgata

SEQ ID NO: 9261239 - DNA, 22 bp, Homo sapiens
aaattttagaccaggcaaaact

SEQ ID NO: 9261240 - DNA, 22 bp, Homo sapiens
aaattcttcaggtaattttgat

SEQ ID NO: 9261241 - DNA, 22 bp, Homo sapiens
aaattctgtcctgaatgccatt

SEQ ID NO: 9261242 - DNA, 22 bp, Homo sapiens
aaattctggcctatcacagtga

SEQ ID NO: 9261243 - DNA, 22 bp, Homo sapiens
aaattctatgtcaatgtttatt

SEQ ID NO: 9261244 - DNA, 22 bp, Homo sapiens
aaattctctaaagaaaacatga

SEQ ID NO: 9261245 - DNA, 22 bp, Homo sapiens
aaattctatgtcaatgtttatt

SEQ ID NO: 9261246 - DNA, 22 bp, Homo sapiens
aaattgatgttcccagttgaaa

SEQ ID NO: 9261247 - DNA, 22 bp, Homo sapiens
aaattgcaaaagtacttttagg

SEQ ID NO: 9261248 - DNA, 22 bp, Homo sapiens
aaattgcaaaagtacttttagg

SEQ ID NO: 9261249 - DNA, 22 bp, Homo sapiens
aaattgcagatgctaaatgact

SEQ ID NO: 9261250 - DNA, 22 bp, Homo sapiens
aaattctttggcctactttgaa

SEQ ID NO: 9261251 - DNA, 22 bp, Homo sapiens
aaattctttcatggctaataag

SEQ ID NO: 9261252 - DNA, 22 bp, Homo sapiens
aaattctttcatggctaataag

SEQ ID NO: 9261253 - DNA, 22 bp, Homo sapiens
aaattctttcatggctaataag

SEQ ID NO: 9261254 - DNA, 22 bp, Homo sapiens
aaattgaatgattaagtggtga

SEQ ID NO: 9261255 - DNA, 22 bp, Homo sapiens
aacaggcttccaggagggacga

SEQ ID NO: 9261256 - DNA, 22 bp, Homo sapiens
aacaggctggccttgaagcagt

SEQ ID NO: 9261257 - DNA, 22 bp, Homo sapiens
aacagggacaaggatagagaaa

SEQ ID NO: 9261258 - DNA, 22 bp, Homo sapiens
aacaggccctgccatttatcca

SEQ ID NO: 9261259 - DNA, 22 bp, Homo sapiens
aacaggcaacagttgactctga

SEQ ID NO: 9261260 - DNA, 22 bp, Homo sapiens
aacaggcaaactgtgggatccc

SEQ ID NO: 9261261 - DNA, 23 bp, Homo sapiens
aacaggatgtgcttcatcttttg

SEQ ID NO: 9261262 - DNA, 18 bp, Homo sapiens
aacaggatcctccacttc

SEQ ID NO: 9261263 - DNA, 22 bp, Homo sapiens
aacaggatgtcatttctcatgt

SEQ ID NO: 9261264 - DNA, 22 bp, Homo sapiens
aacagtaaaaatcatttagttg

SEQ ID NO: 9261265 - DNA, 22 bp, Homo sapiens
aacagtaaaaatcatttagttg

SEQ ID NO: 9261266 - DNA, 18 bp, Homo sapiens
aacatgcattagaactgc

SEQ ID NO: 9261267 - DNA, 22 bp, Homo sapiens
aacatgcatgttatttatcagt

SEQ ID NO: 9261268 - DNA, 22 bp, Homo sapiens
aacatgctctgtttcttggatg

SEQ ID NO: 9261269 - DNA, 22 bp, Homo sapiens
aacatgctcttcctggctagtc

SEQ ID NO: 9261270 - DNA, 22 bp, Homo sapiens
aacatgctgcctttctacgagt

SEQ ID NO: 9261271 - DNA, 22 bp, Homo sapiens
aacatgctcttcctggctagtc

SEQ ID NO: 9261272 - DNA, 22 bp, Homo sapiens
aacatgctcttcctggctagtc

SEQ ID NO: 9261273 - DNA, 22 bp, Homo sapiens
aacatgctgggtgtttttgatg

SEQ ID NO: 9261274 - DNA, 22 bp, Homo sapiens
aaccaccattctctcctcttcc

SEQ ID NO: 9261275 - DNA, 22 bp, Homo sapiens
aaccaaggacagctagtgatgc

SEQ ID NO: 9261276 - DNA, 22 bp, Homo sapiens
aaccaacataggaatgcagaga

SEQ ID NO: 9261277 - DNA, 22 bp, Homo sapiens
aaccacagacccagactagaga

SEQ ID NO: 9261278 - DNA, 22 bp, Homo sapiens
aatagtgaacaggaacatgctt

SEQ ID NO: 9261279 - DNA, 22 bp, Homo sapiens
aatagtgtttgaagcatgatag

SEQ ID NO: 9261280 - DNA, 22 bp, Homo sapiens
aatagtgtatttttcaaaatta

SEQ ID NO: 9261281 - DNA, 22 bp, Homo sapiens
aatataaattcctgggcccagc

SEQ ID NO: 9261282 - DNA, 22 bp, Homo sapiens
aatagtttgaatttatcagatg

SEQ ID NO: 9261283 - DNA, 22 bp, Homo sapiens
aatagttttataggtgggatta

SEQ ID NO: 9261284 - DNA, 22 bp, Homo sapiens
aacatttttaagaccaagtgct

SEQ ID NO: 9261285 - DNA, 22 bp, Homo sapiens
aacatttttaagaccaagtgct

SEQ ID NO: 9261286 - DNA, 20 bp, Homo sapiens
aaccaacagaatcatgtctc

SEQ ID NO: 9261287 - DNA, 22 bp, Homo sapiens
aaccaacaggagtggggattgg

SEQ ID NO: 9261288 - DNA, 22 bp, Homo sapiens
aataacttcatgtaacatttaa

SEQ ID NO: 9261289 - DNA, 22 bp, Homo sapiens
aataacttcagttcttacatta

SEQ ID NO: 9261290 - DNA, 22 bp, Homo sapiens
aacatggctcatgagagatttg

SEQ ID NO: 9261291 - DNA, 22 bp, Homo sapiens
aacatgctttgataaataaaag

SEQ ID NO: 9261292 - DNA, 19 bp, Homo sapiens
aacatggaactggagaggg

SEQ ID NO: 9261293 - DNA, 22 bp, Homo sapiens
aacatggaggcagacagacgtg

SEQ ID NO: 9261294 - DNA, 22 bp, Homo sapiens
aactgcatttgcataagtccat

SEQ ID NO: 9261295 - DNA, 22 bp, Homo sapiens
aactgcttagtgatggatgacc

SEQ ID NO: 9261296 - DNA, 22 bp, Homo sapiens
aatgataagacatgagtagagg

SEQ ID NO: 9261297 - DNA, 21 bp, Homo sapiens
aactgcttcccatcttagggc

SEQ ID NO: 9261298 - DNA, 22 bp, Homo sapiens
aactgcttccttggcaggcatg

SEQ ID NO: 9261299 - DNA, 22 bp, Homo sapiens
aactgcttatctttggtagatg

SEQ ID NO: 9261300 - DNA, 22 bp, Homo sapiens
aatgataccaaacatgtagata

SEQ ID NO: 9261301 - DNA, 22 bp, Homo sapiens
aatgatatgcaaattatcatca

SEQ ID NO: 9261302 - DNA, 22 bp, Homo sapiens
aatgatatttattgaatagatg

SEQ ID NO: 9261303 - DNA, 22 bp, Homo sapiens
aatgatatttattgaatagatg

SEQ ID NO: 9261304 - DNA, 22 bp, Homo sapiens
aatgatatagcagacatagcct

SEQ ID NO: 9261305 - DNA, 22 bp, Homo sapiens
aatgatatagcagacatagcct

SEQ ID NO: 9261306 - DNA, 22 bp, Homo sapiens
aatgatatgcaaattatcatca

SEQ ID NO: 9261307 - DNA, 22 bp, Homo sapiens
aatgatcacctggtaaagagag

SEQ ID NO: 9261308 - DNA, 22 bp, Homo sapiens
aacttaaacccactcatgtaga

SEQ ID NO: 9261309 - DNA, 22 bp, Homo sapiens
aacttaaacccactcatgtaga

SEQ ID NO: 9261310 - DNA, 22 bp, Homo sapiens
aacttaaacccactcatgtaga

SEQ ID NO: 9261311 - DNA, 22 bp, Homo sapiens
aacttacaaggatgatagctgc

SEQ ID NO: 9261312 - DNA, 22 bp, Homo sapiens
aacttacaaggatgatagctgc

SEQ ID NO: 9261313 - DNA, 22 bp, Homo sapiens
aacttaggaaaataaggcatga

SEQ ID NO: 9261314 - DNA, 22 bp, Homo sapiens
aactggttctcttttgcttgtg

SEQ ID NO: 9261315 - DNA, 22 bp, Homo sapiens
aactgttcttcattttcagtat

SEQ ID NO: 9261316 - DNA, 22 bp, Homo sapiens
aactgttacatagttatagatc

SEQ ID NO: 9261317 - DNA, 22 bp, Homo sapiens
aatataaattcctgggcccagc

SEQ ID NO: 9261318 - DNA, 22 bp, Homo sapiens
aatataatgctgttttatgcca

SEQ ID NO: 9261319 - DNA, 22 bp, Homo sapiens
aacgcccgtggttgccaaggta

SEQ ID NO: 9261320 - DNA, 22 bp, Homo sapiens
aacgtcttctctccaagtaaat

SEQ ID NO: 9261321 - DNA, 22 bp, Homo sapiens
aactacagaaaaggtaagctct

SEQ ID NO: 9261322 - DNA, 22 bp, Homo sapiens
aactacagaaaaggtaagctct

SEQ ID NO: 9261323 - DNA, 22 bp, Homo sapiens
aactacagaatcatagaaaata

SEQ ID NO: 9261324 - DNA, 22 bp, Homo sapiens
aactacagcatctatacaaata

SEQ ID NO: 9261325 - DNA, 22 bp, Homo sapiens
aactacagaatcatagaaaata

SEQ ID NO: 9261326 - DNA, 22 bp, Homo sapiens
aactacagaatcatagaaaata

SEQ ID NO: 9261327 - DNA, 22 bp, Homo sapiens
aactacatagaaattagtattt

SEQ ID NO: 9261328 - DNA, 22 bp, Homo sapiens
aactacagtatgtccaaagaat

SEQ ID NO: 9261329 - DNA, 22 bp, Homo sapiens
aactacagtagtttgcccttct

SEQ ID NO: 9261330 - DNA, 22 bp, Homo sapiens
aactacagtagtttgcccttct

SEQ ID NO: 9261331 - DNA, 22 bp, Homo sapiens
aactacagtatgtccaaagaat

SEQ ID NO: 9261332 - DNA, 22 bp, Homo sapiens
aactacagtgggcagaggcaat

SEQ ID NO: 9261333 - DNA, 22 bp, Homo sapiens
aactacagtgggcagaggcaat

SEQ ID NO: 9261334 - DNA, 22 bp, Homo sapiens
aactacagtgggcagaggcaat

SEQ ID NO: 9261335 - DNA, 21 bp, Homo sapiens
aactacagttgttccttcatt

SEQ ID NO: 9261336 - DNA, 22 bp, Homo sapiens
aactacagcatctatacaaata

SEQ ID NO: 9261337 - DNA, 22 bp, Homo sapiens
aactacagcatctatacaaata

SEQ ID NO: 9261338 - DNA, 22 bp, Homo sapiens
aactacagcatctatacaaata

SEQ ID NO: 9261339 - DNA, 19 bp, Homo sapiens
aactacagcgcactgtcct

SEQ ID NO: 9261340 - DNA, 22 bp, Homo sapiens
aactacagggggtggcaggcgg

SEQ ID NO: 9261341 - DNA, 19 bp, Homo sapiens
aactacagcgcactgtcct

SEQ ID NO: 9261342 - DNA, 22 bp, Homo sapiens
aactacagctcttgtctttctg

SEQ ID NO: 9261343 - DNA, 22 bp, Homo sapiens
aatcattctcatgccagtttcc

SEQ ID NO: 9261344 - DNA, 22 bp, Homo sapiens
aatcattcttatttcacagcaa

SEQ ID NO: 9261345 - DNA, 22 bp, Homo sapiens
aatcattgagacaaattagctt

SEQ ID NO: 9261346 - DNA, 22 bp, Homo sapiens
aatcatcttcatcttacacaga

SEQ ID NO: 9261347 - DNA, 22 bp, Homo sapiens
aatcatgaaatatcagttcttt

SEQ ID NO: 9261348 - DNA, 21 bp, Homo sapiens
aatcatacaaaacatgtcagg

SEQ ID NO: 9261349 - DNA, 22 bp, Homo sapiens
aactgcattcagaaagctcact

SEQ ID NO: 9261350 - DNA, 22 bp, Homo sapiens
aagcacagtgggcagagcagcc

SEQ ID NO: 9261351 - DNA, 22 bp, Homo sapiens
aagcacaggttgaggattattc

SEQ ID NO: 9261352 - DNA, 22 bp, Homo sapiens
aagcacagggtgtctgcattca

SEQ ID NO: 9261353 - DNA, 18 bp, Homo sapiens
aagcacaggtgtttcagg

SEQ ID NO: 9261354 - DNA, 22 bp, Homo sapiens
aagcacagggactcaggaccgg

SEQ ID NO: 9261355 - DNA, 22 bp, Homo sapiens
aagcacagggactttaggaata

SEQ ID NO: 9261356 - DNA, 22 bp, Homo sapiens
aagcacagggactttaggaata

SEQ ID NO: 9261357 - DNA, 22 bp, Homo sapiens
aagcacaggggaaataagttgt

SEQ ID NO: 9261358 - DNA, 22 bp, Homo sapiens
aagcacaggagacgcacagcca

SEQ ID NO: 9261359 - DNA, 22 bp, Homo sapiens
aagcacagggactcaggaccgg

SEQ ID NO: 9261360 - DNA, 22 bp, Homo sapiens
aagcacaggatcttgaggagcg

SEQ ID NO: 9261361 - DNA, 22 bp, Homo sapiens
aagcacaggatcttgaggagcg

SEQ ID NO: 9261362 - DNA, 22 bp, Homo sapiens
acactgggttacctgtactatt

SEQ ID NO: 9261363 - DNA, 22 bp, Homo sapiens
acactgggcttgttacgttgca

SEQ ID NO: 9261364 - DNA, 22 bp, Homo sapiens
acactgggtaacatatctgtta

SEQ ID NO: 9261365 - DNA, 22 bp, Homo sapiens
acactggtaggaagagatggct

SEQ ID NO: 9261366 - DNA, 22 bp, Homo sapiens
aagcacagaaaaggagcatgga

SEQ ID NO: 9261367 - DNA, 22 bp, Homo sapiens
acactgcttctctggcagagcc

SEQ ID NO: 9261368 - DNA, 22 bp, Homo sapiens
acactgctaaacagtaaagatg

SEQ ID NO: 9261369 - DNA, 19 bp, Homo sapiens
acactgggagaagactgct

SEQ ID NO: 9261370 - DNA, 22 bp, Homo sapiens
aagatttactagcataatagct

SEQ ID NO: 9261371 - DNA, 22 bp, Homo sapiens
aagatttactagcataatagct

SEQ ID NO: 9261372 - DNA, 22 bp, Homo sapiens
aagatttactagcataatagct

SEQ ID NO: 9261373 - DNA, 22 bp, Homo sapiens
aagatttagggccagtttacat

SEQ ID NO: 9261374 - DNA, 22 bp, Homo sapiens
aagatttactttctttgtaata

SEQ ID NO: 9261375 - DNA, 22 bp, Homo sapiens
aagatttcctggatgtaattcc

SEQ ID NO: 9261376 - DNA, 17 bp, Homo sapiens
aagatttcattagctga

SEQ ID NO: 9261377 - DNA, 22 bp, Homo sapiens
acacaggaaatggtttagtttt

SEQ ID NO: 9261378 - DNA, 22 bp, Homo sapiens
acacaggggaaagtggagctga

SEQ ID NO: 9261379 - DNA, 22 bp, Homo sapiens
acacagggctgcgcctgacccc

SEQ ID NO: 9261380 - DNA, 22 bp, Homo sapiens
acacaggttaaaataattggga

SEQ ID NO: 9261381 - DNA, 18 bp, Homo sapiens
acacaggttattctctcc

SEQ ID NO: 9261382 - DNA, 22 bp, Homo sapiens
acacagtagtttgtcattgcta

SEQ ID NO: 9261383 - DNA, 22 bp, Homo sapiens
aagaggccacagctgacagcac

SEQ ID NO: 9261384 - DNA, 22 bp, Homo sapiens
acacagtaggccaccatgtcat

SEQ ID NO: 9261385 - DNA, 22 bp, Homo sapiens
acacagtaaatattgtctcctc

SEQ ID NO: 9261386 - DNA, 22 bp, Homo sapiens
acacagtaaatatgtattgaat

SEQ ID NO: 9261387 - DNA, 22 bp, Homo sapiens
acacagtaccccaaggctgggc

SEQ ID NO: 9261388 - DNA, 22 bp, Homo sapiens
acacagtaccccaaggctgggc

SEQ ID NO: 9261389 - DNA, 17 bp, Homo sapiens
acacagtacttttttgc

SEQ ID NO: 9261390 - DNA, 22 bp, Homo sapiens
aagaggcttcagatccttcaga

SEQ ID NO: 9261391 - DNA, 22 bp, Homo sapiens
aagaggcttatagtcttcctgt

SEQ ID NO: 9261392 - DNA, 22 bp, Homo sapiens
aagaggcttcagatccttcaga

SEQ ID NO: 9261393 - DNA, 20 bp, Homo sapiens
aagaggctgtggatcctact

SEQ ID NO: 9261394 - DNA, 22 bp, Homo sapiens
aagaggctggcattgatggtag

SEQ ID NO: 9261395 - DNA, 18 bp, Homo sapiens
aagaggctgttctgtggg

SEQ ID NO: 9261396 - DNA, 22 bp, Homo sapiens
aagaggctagccggctcactaa

SEQ ID NO: 9261397 - DNA, 22 bp, Homo sapiens
aagaggctgaatgagaaagtac

SEQ ID NO: 9261398 - DNA, 22 bp, Homo sapiens
aagaggctggaggatactgcgc

SEQ ID NO: 9261399 - DNA, 22 bp, Homo sapiens
aagaggctagccggctcactaa

SEQ ID NO: 9261400 - DNA, 22 bp, Homo sapiens
aagaggctgaatgagaaagtac

SEQ ID NO: 9261401 - DNA, 22 bp, Homo sapiens
aagaggctagccggctcactaa

SEQ ID NO: 9261402 - DNA, 20 bp, Homo sapiens
aagattctgatttgtagcgt

SEQ ID NO: 9261403 - DNA, 18 bp, Homo sapiens
aagattctgcttctctct

SEQ ID NO: 9261404 - DNA, 18 bp, Homo sapiens
aagattctgcttctctct

SEQ ID NO: 9261405 - DNA, 22 bp, Homo sapiens
aagatttaccactttattcaag

SEQ ID NO: 9261406 - DNA, 22 bp, Homo sapiens
aagattgtcaggcttgctgtat

SEQ ID NO: 9261407 - DNA, 22 bp, Homo sapiens
aagcatgtacaatgagtgtctc

SEQ ID NO: 9261408 - DNA, 22 bp, Homo sapiens
aagcatattttaattagccaca

SEQ ID NO: 9261409 - DNA, 22 bp, Homo sapiens
aagcatatattttatatgttgt

SEQ ID NO: 9261410 - DNA, 22 bp, Homo sapiens
aagcatcaacactatattgatg

SEQ ID NO: 9261411 - DNA, 19 bp, Homo sapiens
aagcattagccaaagcatt

SEQ ID NO: 9261412 - DNA, 16 bp, Homo sapiens
aagcattggaattagg

SEQ ID NO: 9261413 - DNA, 22 bp, Homo sapiens
aagcattgtaagcagaagatgc

SEQ ID NO: 9261414 - DNA, 22 bp, Homo sapiens
aagcatgtcccttgtgattcaa

SEQ ID NO: 9261415 - DNA, 22 bp, Homo sapiens
aagcatgtgtataagctgggca

SEQ ID NO: 9261416 - DNA, 22 bp, Homo sapiens
aagcatttatagataagaattt

SEQ ID NO: 9261417 - DNA, 22 bp, Homo sapiens
aagcatttatagataagaattt

SEQ ID NO: 9261418 - DNA, 17 bp, Homo sapiens
aagcatttaatttgcta

SEQ ID NO: 9261419 - DNA, 22 bp, Homo sapiens
acagcagctaaaggtgtctcct

SEQ ID NO: 9261420 - DNA, 22 bp, Homo sapiens
acagcagctaacccctgggcca

SEQ ID NO: 9261421 - DNA, 22 bp, Homo sapiens
acagcagctaaaggtgtctcct

SEQ ID NO: 9261422 - DNA, 22 bp, Homo sapiens
aagcatttctgtttatctatcg

SEQ ID NO: 9261423 - DNA, 22 bp, Homo sapiens
aagcatttcaatataatattca

SEQ ID NO: 9261424 - DNA, 22 bp, Homo sapiens
aagccaggagcgaggcctcggc

SEQ ID NO: 9261425 - DNA, 22 bp, Homo sapiens
aagccaggataaagttgtttta

SEQ ID NO: 9261426 - DNA, 22 bp, Homo sapiens
aagccaagttggaagactgaat

SEQ ID NO: 9261427 - DNA, 21 bp, Homo sapiens
aagccagcccacagtggtttg

SEQ ID NO: 9261428 - DNA, 22 bp, Homo sapiens
acagcagctgccttcaggctct

SEQ ID NO: 9261429 - DNA, 22 bp, Homo sapiens
acagcagctaacccctgggcca

SEQ ID NO: 9261430 - DNA, 22 bp, Homo sapiens
acagcagctgccttcaggctct

SEQ ID NO: 9261431 - DNA, 22 bp, Homo sapiens
acagcagctgccttcaggctct

SEQ ID NO: 9261432 - DNA, 22 bp, Homo sapiens
acagcagctgggttcccaccat

SEQ ID NO: 9261433 - DNA, 22 bp, Homo sapiens
acagcagcttgtctgttcttta

SEQ ID NO: 9261434 - DNA, 22 bp, Homo sapiens
aagcagctgatttcacagctca

SEQ ID NO: 9261435 - DNA, 22 bp, Homo sapiens
aagcagctgatttcacagctca

SEQ ID NO: 9261436 - DNA, 22 bp, Homo sapiens
aagcagccagccatcatgcccg

SEQ ID NO: 9261437 - DNA, 22 bp, Homo sapiens
aagcagccacctcatctccact

SEQ ID NO: 9261438 - DNA, 22 bp, Homo sapiens
aagcagccacctcatctccact

SEQ ID NO: 9261439 - DNA, 22 bp, Homo sapiens
aagcagcctggacttgggctgg

SEQ ID NO: 9261440 - DNA, 22 bp, Homo sapiens
aagcagcctggcatgatgcttt

SEQ ID NO: 9261441 - DNA, 22 bp, Homo sapiens
acagagtattggaaaggcagtg

SEQ ID NO: 9261442 - DNA, 22 bp, Homo sapiens
acagagtatctatcaggagtat

SEQ ID NO: 9261443 - DNA, 21 bp, Homo sapiens
acagagtagttgaaacagaga

SEQ ID NO: 9261444 - DNA, 22 bp, Homo sapiens
acagagtaggtgctcagtaaat

SEQ ID NO: 9261445 - DNA, 22 bp, Homo sapiens
acagagtaggtgctcagtaaat

SEQ ID NO: 9261446 - DNA, 21 bp, Homo sapiens
acagagtagttgaaacagaga

SEQ ID NO: 9261447 - DNA, 22 bp, Homo sapiens
acagagtaggtgctgtcgactg

SEQ ID NO: 9261448 - DNA, 22 bp, Homo sapiens
acagaggtttccattgaggttt

SEQ ID NO: 9261449 - DNA, 23 bp, Homo sapiens
acagagtacagtgtgcttagtgg

SEQ ID NO: 9261450 - DNA, 22 bp, Homo sapiens
acagagtacagacaaaggtcag

SEQ ID NO: 9261451 - DNA, 22 bp, Homo sapiens
acagagtacattcagagactat

SEQ ID NO: 9261452 - DNA, 22 bp, Homo sapiens
acagagtagctcaagaagattg

SEQ ID NO: 9261453 - DNA, 22 bp, Homo sapiens
aagcagaggtagggtgtgcagt

SEQ ID NO: 9261454 - DNA, 18 bp, Homo sapiens
acagacaaaatggaaatg

SEQ ID NO: 9261455 - DNA, 18 bp, Homo sapiens
acagacaaaatggaaatg

SEQ ID NO: 9261456 - DNA, 22 bp, Homo sapiens
acagaatttacacatctctaaa

SEQ ID NO: 9261457 - DNA, 22 bp, Homo sapiens
acagaattgatggaaatctcag

SEQ ID NO: 9261458 - DNA, 22 bp, Homo sapiens
acagaattctctctgcagaggc

SEQ ID NO: 9261459 - DNA, 22 bp, Homo sapiens
acagaattgaagctgagtaaat

SEQ ID NO: 9261460 - DNA, 17 bp, Homo sapiens
aattgtcagcagtagct

SEQ ID NO: 9261461 - DNA, 22 bp, Homo sapiens
aagacagcagcacctctcgttt

SEQ ID NO: 9261462 - DNA, 22 bp, Homo sapiens
aatttaactgagagtactttta

SEQ ID NO: 9261463 - DNA, 22 bp, Homo sapiens
aagacagcactggcattttcaa

SEQ ID NO: 9261464 - DNA, 22 bp, Homo sapiens
aagacaggaaaagctccaggcc

SEQ ID NO: 9261465 - DNA, 22 bp, Homo sapiens
aagacaggaacatagcaaatcc

SEQ ID NO: 9261466 - DNA, 22 bp, Homo sapiens
aagacaggaaaagctccaggcc

SEQ ID NO: 9261467 - DNA, 22 bp, Homo sapiens
aagacagctcaggacagattca

SEQ ID NO: 9261468 - DNA, 22 bp, Homo sapiens
aagacaggaacatagcaaatcc

SEQ ID NO: 9261469 - DNA, 23 bp, Homo sapiens
aattggacttgctgtcaaacttc

SEQ ID NO: 9261470 - DNA, 22 bp, Homo sapiens
aattggactgtgctgctcaaaa

SEQ ID NO: 9261471 - DNA, 22 bp, Homo sapiens
aattggctttgtggtttctgca

SEQ ID NO: 9261472 - DNA, 22 bp, Homo sapiens
aattggcaagcagatttccact

SEQ ID NO: 9261473 - DNA, 22 bp, Homo sapiens
aagaataagtagatgggagaag

SEQ ID NO: 9261474 - DNA, 22 bp, Homo sapiens
aagaataagtagatgggagaag

SEQ ID NO: 9261475 - DNA, 22 bp, Homo sapiens
aagaataagtagatgggagaag

SEQ ID NO: 9261476 - DNA, 22 bp, Homo sapiens
aagaataagaggatttagaaca

SEQ ID NO: 9261477 - DNA, 22 bp, Homo sapiens
aagaataagaggatttagaaca

SEQ ID NO: 9261478 - DNA, 22 bp, Homo sapiens
aagaataagaggatttagaaca

SEQ ID NO: 9261479 - DNA, 22 bp, Homo sapiens
aagaataaattaagatacttag

SEQ ID NO: 9261480 - DNA, 22 bp, Homo sapiens
aagaataaattaagatacttag

SEQ ID NO: 9261481 - DNA, 22 bp, Homo sapiens
aagaataaattaagatacttag

SEQ ID NO: 9261482 - DNA, 23 bp, Homo sapiens
aagaataaatgacattaaaggtg

SEQ ID NO: 9261483 - DNA, 23 bp, Homo sapiens
aagaataaatgacattaaaggtg

SEQ ID NO: 9261484 - DNA, 22 bp, Homo sapiens
aagaagcactttcctacatgtt

SEQ ID NO: 9261485 - DNA, 22 bp, Homo sapiens
aatgttttgcattagttttcta

SEQ ID NO: 9261486 - DNA, 22 bp, Homo sapiens
aatgttttgcattagttttcta

SEQ ID NO: 9261487 - DNA, 22 bp, Homo sapiens
aatgttttctgactgctaactt

SEQ ID NO: 9261488 - DNA, 22 bp, Homo sapiens
aatgttttctgactgctaactt

SEQ ID NO: 9261489 - DNA, 22 bp, Homo sapiens
aatgttttctgactgctaactt

SEQ ID NO: 9261490 - DNA, 22 bp, Homo sapiens
aatgttttctgactgctaactt

SEQ ID NO: 9261491 - DNA, 22 bp, Homo sapiens
aatgttttatagctcaagcaat

SEQ ID NO: 9261492 - DNA, 22 bp, Homo sapiens
aatgttttatagctcaagcaat

SEQ ID NO: 9261493 - DNA, 22 bp, Homo sapiens
aatgttttcattatcctaactg

SEQ ID NO: 9261494 - DNA, 22 bp, Homo sapiens
aatgttttatagctcaagcaat

SEQ ID NO: 9261495 - DNA, 22 bp, Homo sapiens
aatgttttctctgtgaacacat

SEQ ID NO: 9261496 - DNA, 22 bp, Homo sapiens
aatgttttcccagtgcagacga

SEQ ID NO: 9261497 - DNA, 22 bp, Homo sapiens
aatgttttctctgtgaacacat

SEQ ID NO: 9261498 - DNA, 22 bp, Homo sapiens
aatgttttcccagtgcagacga

SEQ ID NO: 9261499 - DNA, 22 bp, Homo sapiens
aatgttttcccagtgcagacga

SEQ ID NO: 9261500 - DNA, 22 bp, Homo sapiens
aatgttttcattatcctaactg

SEQ ID NO: 9261501 - DNA, 22 bp, Homo sapiens
aagaaatgcacacaactgctgg

SEQ ID NO: 9261502 - DNA, 22 bp, Homo sapiens
aatgttttagattactgctggg

SEQ ID NO: 9261503 - DNA, 22 bp, Homo sapiens
aatgttttacagatcccattag

SEQ ID NO: 9261504 - DNA, 22 bp, Homo sapiens
aatgttttagattactgctggg

SEQ ID NO: 9261505 - DNA, 22 bp, Homo sapiens
aatgttttatagctcaagcaat

SEQ ID NO: 9261506 - DNA, 22 bp, Homo sapiens
aatgttttaaaagagattgaga

SEQ ID NO: 9261507 - DNA, 22 bp, Homo sapiens
aacttcatgggttcaaagctgg

SEQ ID NO: 9261508 - DNA, 21 bp, Homo sapiens
aagaaagataattaaggaccc

SEQ ID NO: 9261509 - DNA, 22 bp, Homo sapiens
aacttcatgtaatttaaaacag

SEQ ID NO: 9261510 - DNA, 22 bp, Homo sapiens
aacttcagagctgtgtggtttg

SEQ ID NO: 9261511 - DNA, 22 bp, Homo sapiens
aagaaatattgggccttataaa

SEQ ID NO: 9261512 - DNA, 22 bp, Homo sapiens
aagaaatacatggtttttgagt

SEQ ID NO: 9261513 - DNA, 22 bp, Homo sapiens
aagaaagcattagacaggcatt

SEQ ID NO: 9261514 - DNA, 22 bp, Homo sapiens
aagaaagcattagacaggcatt

SEQ ID NO: 9261515 - DNA, 22 bp, Homo sapiens
acaaggctgaacagtgaagccg

SEQ ID NO: 9261516 - DNA, 22 bp, Homo sapiens
acaaggctgtgggagaacctct

SEQ ID NO: 9261517 - DNA, 22 bp, Homo sapiens
aagagctgattaagtcatgagg

SEQ ID NO: 9261518 - DNA, 22 bp, Homo sapiens
aagagctgcccaaggtgaacag

SEQ ID NO: 9261519 - DNA, 22 bp, Homo sapiens
aagagctgcatctaagccatga

SEQ ID NO: 9261520 - DNA, 22 bp, Homo sapiens
aagagctgattaagtcatgagg

SEQ ID NO: 9261521 - DNA, 20 bp, Homo sapiens
aagagctgactcacagtggt

SEQ ID NO: 9261522 - DNA, 20 bp, Homo sapiens
aagagctgactcacagtggt

SEQ ID NO: 9261523 - DNA, 22 bp, Homo sapiens
acaaggctgttggtcacaaacc

SEQ ID NO: 9261524 - DNA, 19 bp, Homo sapiens
aagagcagggaaagaattg

SEQ ID NO: 9261525 - DNA, 22 bp, Homo sapiens
aagagctggattgtgctgcaga

SEQ ID NO: 9261526 - DNA, 22 bp, Homo sapiens
aagagctggcccaatctgagca

SEQ ID NO: 9261527 - DNA, 22 bp, Homo sapiens
aagagctggatggaatctggga

SEQ ID NO: 9261528 - DNA, 22 bp, Homo sapiens
aagagctggatgaagaaatcaa

SEQ ID NO: 9261529 - DNA, 21 bp, Homo sapiens
aagagctggatcaaggataag

SEQ ID NO: 9261530 - DNA, 22 bp, Homo sapiens
aagagctggaagtgaagataac

SEQ ID NO: 9261531 - DNA, 22 bp, Homo sapiens
aagagctggagctgctacagga

SEQ ID NO: 9261532 - DNA, 22 bp, Homo sapiens
aagagctggagtttgcagccct

SEQ ID NO: 9261533 - DNA, 22 bp, Homo sapiens
aagagctggagtttgcagccct

SEQ ID NO: 9261534 - DNA, 22 bp, Homo sapiens
aagagctggtcacaggtccatt

SEQ ID NO: 9261535 - DNA, 22 bp, Homo sapiens
aagagctggctcttgcagcagc

SEQ ID NO: 9261536 - DNA, 22 bp, Homo sapiens
aagagctggctcttgcagcagc

SEQ ID NO: 9261537 - DNA, 22 bp, Homo sapiens
aagagctgtatgccatatgatt

SEQ ID NO: 9261538 - DNA, 22 bp, Homo sapiens
aagagctgtgggtggtagtcct

SEQ ID NO: 9261539 - DNA, 22 bp, Homo sapiens
aagaggaactgggggctgagtc

SEQ ID NO: 9261540 - DNA, 22 bp, Homo sapiens
aagaggaaatgattgactatat

SEQ ID NO: 9261541 - DNA, 22 bp, Homo sapiens
aagaggaaatgattgactatat

SEQ ID NO: 9261542 - DNA, 22 bp, Homo sapiens
aagacatgttttaagaatattt

SEQ ID NO: 9261543 - DNA, 22 bp, Homo sapiens
aagacatcagtgatgacatttg

SEQ ID NO: 9261544 - DNA, 22 bp, Homo sapiens
aagacatcagtgatgacatttg

SEQ ID NO: 9261545 - DNA, 22 bp, Homo sapiens
acaaagagggaccagtgacttg

SEQ ID NO: 9261546 - DNA, 22 bp, Homo sapiens
acaaagagaccatgagccaaac

SEQ ID NO: 9261547 - DNA, 20 bp, Homo sapiens
acaaagactggaaaagcaag

SEQ ID NO: 9261548 - DNA, 22 bp, Homo sapiens
acaaagataagtcagaaagtca

SEQ ID NO: 9261549 - DNA, 22 bp, Homo sapiens
acaaagatgtttaaagcattta

SEQ ID NO: 9261550 - DNA, 22 bp, Homo sapiens
acaaagatgtttaaagcattta

SEQ ID NO: 9261551 - DNA, 22 bp, Homo sapiens
acaaagatgtttaaagcattta

SEQ ID NO: 9261552 - DNA, 22 bp, Homo sapiens
acaaagctagagaagagaattg

SEQ ID NO: 9261553 - DNA, 20 bp, Homo sapiens
aagagaggaagttatactag

SEQ ID NO: 9261554 - DNA, 22 bp, Homo sapiens
acaaagattcatttgcattatt

SEQ ID NO: 9261555 - DNA, 22 bp, Homo sapiens
aagagatgtggaatcatttaca

SEQ ID NO: 9261556 - DNA, 22 bp, Homo sapiens
aagagatgttgaagtttattag

SEQ ID NO: 9261557 - DNA, 22 bp, Homo sapiens
aagagattggttataagagatt

SEQ ID NO: 9261558 - DNA, 22 bp, Homo sapiens
aagagagaacacagcttgggca

SEQ ID NO: 9261559 - DNA, 22 bp, Homo sapiens
aagagaggggttgcatggaaat

SEQ ID NO: 9261560 - DNA, 22 bp, Homo sapiens
aagagaggggttgcatggaaat

SEQ ID NO: 9261561 - DNA, 22 bp, Homo sapiens
aagagagggacttattaaagtc

SEQ ID NO: 9261562 - DNA, 22 bp, Homo sapiens
gccagccaagattgagaaggta

SEQ ID NO: 9261563 - DNA, 22 bp, Homo sapiens
gccagccacaagggaggcttgt

SEQ ID NO: 9261564 - DNA, 22 bp, Homo sapiens
gccagaggttcaacaactgtct

SEQ ID NO: 9261565 - DNA, 22 bp, Homo sapiens
attgtactacaccatagtactg

SEQ ID NO: 9261566 - DNA, 22 bp, Homo sapiens
attgtacatgcagtgagtcatc

SEQ ID NO: 9261567 - DNA, 19 bp, Homo sapiens
attgtacattgagtttggc

SEQ ID NO: 9261568 - DNA, 22 bp, Homo sapiens
gcatggcattaacaagatggaa

SEQ ID NO: 9261569 - DNA, 22 bp, Homo sapiens
gcatggcatttgaaggtagaag

SEQ ID NO: 9261570 - DNA, 22 bp, Homo sapiens
attgtacatgcagtgagtcatc

SEQ ID NO: 9261571 - DNA, 22 bp, Homo sapiens
attgtacatgcagtgagtcatc

SEQ ID NO: 9261572 - DNA, 22 bp, Homo sapiens
attgtacaggttggaggaagtg

SEQ ID NO: 9261573 - DNA, 22 bp, Homo sapiens
attgtacaggttggaggaagtg

SEQ ID NO: 9261574 - DNA, 22 bp, Homo sapiens
gccagccagtttgctgatggct

SEQ ID NO: 9261575 - DNA, 22 bp, Homo sapiens
gccagctgctcgcgtagggtag

SEQ ID NO: 9261576 - DNA, 22 bp, Homo sapiens
gccagctgctggaacagcgcga

SEQ ID NO: 9261577 - DNA, 22 bp, Homo sapiens
gccagccagagaggcatggtta

SEQ ID NO: 9261578 - DNA, 22 bp, Homo sapiens
gccagccacttcagctatggct

SEQ ID NO: 9261579 - DNA, 22 bp, Homo sapiens
gccagccagaaacgtcacactg

SEQ ID NO: 9261580 - DNA, 23 bp, Homo sapiens
gccagccagaatttctccactgt

SEQ ID NO: 9261581 - DNA, 22 bp, Homo sapiens
gccagccacttcccagactggc

SEQ ID NO: 9261582 - DNA, 22 bp, Homo sapiens
gccagctggagactggcagggg

SEQ ID NO: 9261583 - DNA, 22 bp, Homo sapiens
gccagctggagtgagagtgggc

SEQ ID NO: 9261584 - DNA, 21 bp, Homo sapiens
atttagaaggaaattttgcaa

SEQ ID NO: 9261585 - DNA, 22 bp, Homo sapiens
atttataacgtgcagccagggt

SEQ ID NO: 9261586 - DNA, 22 bp, Homo sapiens
atttagtttaggaaaagtaggt

SEQ ID NO: 9261587 - DNA, 22 bp, Homo sapiens
atttatgacaaccaaagagtga

SEQ ID NO: 9261588 - DNA, 22 bp, Homo sapiens
atttatgacagaagatatgctg

SEQ ID NO: 9261589 - DNA, 22 bp, Homo sapiens
atttatgacgtgttcggtcaat

SEQ ID NO: 9261590 - DNA, 22 bp, Homo sapiens
atttatgtatctgtgtagatca

SEQ ID NO: 9261591 - DNA, 22 bp, Homo sapiens
atttatgtatctgtgtagatca

SEQ ID NO: 9261592 - DNA, 22 bp, Homo sapiens
atttattaagcatctgctatgt

SEQ ID NO: 9261593 - DNA, 22 bp, Homo sapiens
atttattaagcatctgctatgt

SEQ ID NO: 9261594 - DNA, 22 bp, Homo sapiens
atttatgatagctgcattaaag

SEQ ID NO: 9261595 - DNA, 22 bp, Homo sapiens
atttatgattagcctattgttg

SEQ ID NO: 9261596 - DNA, 22 bp, Homo sapiens
atttatgagctgaaccatgaaa

SEQ ID NO: 9261597 - DNA, 22 bp, Homo sapiens
atttatgactggtgaatagaac

SEQ ID NO: 9261598 - DNA, 22 bp, Homo sapiens
gccaggtggctgagcagctgca

SEQ ID NO: 9261599 - DNA, 22 bp, Homo sapiens
atttattatgggatttggcaca

SEQ ID NO: 9261600 - DNA, 22 bp, Homo sapiens
gccatcatatcccctgtgacct

SEQ ID NO: 9261601 - DNA, 22 bp, Homo sapiens
atttattacctcggagtttctg

SEQ ID NO: 9261602 - DNA, 22 bp, Homo sapiens
atttattatgggatttggcaca

SEQ ID NO: 9261603 - DNA, 22 bp, Homo sapiens
atttattacctcggagtttctg

SEQ ID NO: 9261604 - DNA, 19 bp, Homo sapiens
atttattgtatgattccat

SEQ ID NO: 9261605 - DNA, 19 bp, Homo sapiens
atttattgtatgattccat

SEQ ID NO: 9261606 - DNA, 22 bp, Homo sapiens
atttattggtttgcatggtgaa

SEQ ID NO: 9261607 - DNA, 22 bp, Homo sapiens
atttattggtttgcatggtgaa

SEQ ID NO: 9261608 - DNA, 19 bp, Homo sapiens
atttattgtatgattccat

SEQ ID NO: 9261609 - DNA, 19 bp, Homo sapiens
atttattgtatgattccat

SEQ ID NO: 9261610 - DNA, 22 bp, Homo sapiens
atttcaacagagtttgaaggca

SEQ ID NO: 9261611 - DNA, 19 bp, Homo sapiens
atttattgtatgattccat

SEQ ID NO: 9261612 - DNA, 22 bp, Homo sapiens
atttattggtttgcatggtgaa

SEQ ID NO: 9261613 - DNA, 22 bp, Homo sapiens
atttattggtttgcatggtgaa

SEQ ID NO: 9261614 - DNA, 22 bp, Homo sapiens
gccatgaggctccgagaagtca

SEQ ID NO: 9261615 - DNA, 20 bp, Homo sapiens
gccatgaggggaggtgactg

SEQ ID NO: 9261616 - DNA, 22 bp, Homo sapiens
gccatcttgagccaggaagtga

SEQ ID NO: 9261617 - DNA, 22 bp, Homo sapiens
gccatcctctgagcactaggca

SEQ ID NO: 9261618 - DNA, 22 bp, Homo sapiens
atttcaacgttagatgtaatag

SEQ ID NO: 9261619 - DNA, 22 bp, Homo sapiens
atttcaacgttagatgtaatag

SEQ ID NO: 9261620 - DNA, 19 bp, Homo sapiens
atttcaagaggtttattgg

SEQ ID NO: 9261621 - DNA, 22 bp, Homo sapiens
atttcaagtgttgagctcataa

SEQ ID NO: 9261622 - DNA, 19 bp, Homo sapiens
gcccaggggcccgatgctg

SEQ ID NO: 9261623 - DNA, 22 bp, Homo sapiens
gcccaggagttgaatgcagcag

SEQ ID NO: 9261624 - DNA, 22 bp, Homo sapiens
gcccaggagttgaatgcagcag

SEQ ID NO: 9261625 - DNA, 22 bp, Homo sapiens
gcccagggtctacaaaaatatt

SEQ ID NO: 9261626 - DNA, 22 bp, Homo sapiens
gcccagggtgaagtgcagttgt

SEQ ID NO: 9261627 - DNA, 22 bp, Homo sapiens
gcccagggtgcttagaacccat

SEQ ID NO: 9261628 - DNA, 22 bp, Homo sapiens
gcccagtagttcaaggttgcag

SEQ ID NO: 9261629 - DNA, 22 bp, Homo sapiens
gcccagtagttcaaggttgcag

SEQ ID NO: 9261630 - DNA, 21 bp, Homo sapiens
gcccagtgatttcttcacagt

SEQ ID NO: 9261631 - DNA, 22 bp, Homo sapiens
atttcttatctgaggtctacat

SEQ ID NO: 9261632 - DNA, 22 bp, Homo sapiens
atttcttcaggtcagaaataga

SEQ ID NO: 9261633 - DNA, 22 bp, Homo sapiens
gccctgtcccttggcttctagg

SEQ ID NO: 9261634 - DNA, 22 bp, Homo sapiens
gccctgtcggaactgcgacctc

SEQ ID NO: 9261635 - DNA, 18 bp, Homo sapiens
gccctggtggagctggtg

SEQ ID NO: 9261636 - DNA, 20 bp, Homo sapiens
gccctgtgatgtcttgacct

SEQ ID NO: 9261637 - DNA, 22 bp, Homo sapiens
atttcccagggccctcatagtt

SEQ ID NO: 9261638 - DNA, 22 bp, Homo sapiens
atttcccagataaacagctgga

SEQ ID NO: 9261639 - DNA, 22 bp, Homo sapiens
atttcccaggactagaaatata

SEQ ID NO: 9261640 - DNA, 22 bp, Homo sapiens
atttcccactctactacatgct

SEQ ID NO: 9261641 - DNA, 22 bp, Homo sapiens
atttcccactctactacatgct

SEQ ID NO: 9261642 - DNA, 22 bp, Homo sapiens
gcccagtggtaaaagcaggcct

SEQ ID NO: 9261643 - DNA, 22 bp, Homo sapiens
gcccagtgctgagggtgctgct

SEQ ID NO: 9261644 - DNA, 22 bp, Homo sapiens
gccctgggctccctgctccaca

SEQ ID NO: 9261645 - DNA, 22 bp, Homo sapiens
gccctggggaaggtgtctccaa

SEQ ID NO: 9261646 - DNA, 22 bp, Homo sapiens
gccctgggctccctgctccaca

SEQ ID NO: 9261647 - DNA, 22 bp, Homo sapiens
atttcctaatttatgcaggagt

SEQ ID NO: 9261648 - DNA, 22 bp, Homo sapiens
atttcctaatttagggatagac

SEQ ID NO: 9261649 - DNA, 22 bp, Homo sapiens
atttcctaacagaggcaacagt

SEQ ID NO: 9261650 - DNA, 22 bp, Homo sapiens
atttcctaatttatgcaggagt

SEQ ID NO: 9261651 - DNA, 23 bp, Homo sapiens
atttcctactataaaagaggtaa

SEQ ID NO: 9261652 - DNA, 23 bp, Homo sapiens
atttcctaaaagataatcattac

SEQ ID NO: 9261653 - DNA, 23 bp, Homo sapiens
atttcctaaaagataatcattac

SEQ ID NO: 9261654 - DNA, 22 bp, Homo sapiens
attttcctcaagcctctggaag

SEQ ID NO: 9261655 - DNA, 22 bp, Homo sapiens
attttcctccatgtgagcagtt

SEQ ID NO: 9261656 - DNA, 22 bp, Homo sapiens
attttccttctaagaggaaggt

SEQ ID NO: 9261657 - DNA, 22 bp, Homo sapiens
attttcctctggtttccccaga

SEQ ID NO: 9261658 - DNA, 22 bp, Homo sapiens
attttctaagcctgtcagactt

SEQ ID NO: 9261659 - DNA, 22 bp, Homo sapiens
gcctgtgcttaactgacgtgag

SEQ ID NO: 9261660 - DNA, 22 bp, Homo sapiens
gccttcccaccctgcgaggctg

SEQ ID NO: 9261661 - DNA, 22 bp, Homo sapiens
gccttccctggctaggcaagca

SEQ ID NO: 9261662 - DNA, 22 bp, Homo sapiens
gccttccctctcatcctgctgg

SEQ ID NO: 9261663 - DNA, 22 bp, Homo sapiens
gccttcctgcagctctgagcgt

SEQ ID NO: 9261664 - DNA, 22 bp, Homo sapiens
gccttccttacacctgctcagc

SEQ ID NO: 9261665 - DNA, 22 bp, Homo sapiens
attttccaaaataattgttact

SEQ ID NO: 9261666 - DNA, 22 bp, Homo sapiens
attttccagcctttctagaact

SEQ ID NO: 9261667 - DNA, 22 bp, Homo sapiens
attttccagcctttctagaact

SEQ ID NO: 9261668 - DNA, 22 bp, Homo sapiens
attttcattttgcagggtgaga

SEQ ID NO: 9261669 - DNA, 21 bp, Homo sapiens
attttcatttccaggggagga

SEQ ID NO: 9261670 - DNA, 22 bp, Homo sapiens
attttcagttgaaaaagttggt

SEQ ID NO: 9261671 - DNA, 22 bp, Homo sapiens
attttcatcatgggtttaacat

SEQ ID NO: 9261672 - DNA, 22 bp, Homo sapiens
attttcatcatgggtttaacat

SEQ ID NO: 9261673 - DNA, 22 bp, Homo sapiens
attttcatcatgggtttaacat

SEQ ID NO: 9261674 - DNA, 22 bp, Homo sapiens
attttcatcgctaggttggcct

SEQ ID NO: 9261675 - DNA, 21 bp, Homo sapiens
attttcattaattcagtgtgg

SEQ ID NO: 9261676 - DNA, 22 bp, Homo sapiens
attttcatggcttctgctcagt

SEQ ID NO: 9261677 - DNA, 22 bp, Homo sapiens
attttcatggcttctgctcagt

SEQ ID NO: 9261678 - DNA, 22 bp, Homo sapiens
attttcatggcttctgctcagt

SEQ ID NO: 9261679 - DNA, 22 bp, Homo sapiens
attttcatgactaccttaaata

SEQ ID NO: 9261680 - DNA, 22 bp, Homo sapiens
atttcttcctctgtcagtaact

SEQ ID NO: 9261681 - DNA, 22 bp, Homo sapiens
atttcttcctctgtcagtaact

SEQ ID NO: 9261682 - DNA, 22 bp, Homo sapiens
atttggggctcaccagggctga

SEQ ID NO: 9261683 - DNA, 22 bp, Homo sapiens
atttgtaacacgtgacaggttg

SEQ ID NO: 9261684 - DNA, 17 bp, Homo sapiens
atttgtaactagctctt

SEQ ID NO: 9261685 - DNA, 22 bp, Homo sapiens
atttgtacaaatttatgttagt

SEQ ID NO: 9261686 - DNA, 22 bp, Homo sapiens
atttgtaatttcttatctgtgt

SEQ ID NO: 9261687 - DNA, 22 bp, Homo sapiens
atttgtaagctagagccatgat

SEQ ID NO: 9261688 - DNA, 22 bp, Homo sapiens
atttgtaaagtgcttaaaagta

SEQ ID NO: 9261689 - DNA, 22 bp, Homo sapiens
atttggtttcaggattctcagg

SEQ ID NO: 9261690 - DNA, 22 bp, Homo sapiens
atttgtacaaatttatgttagt

SEQ ID NO: 9261691 - DNA, 22 bp, Homo sapiens
atttgtagtgaagtgaaaataa

SEQ ID NO: 9261692 - DNA, 22 bp, Homo sapiens
atttgtaccatctggtatacag

SEQ ID NO: 9261693 - DNA, 22 bp, Homo sapiens
atttgtagtgaagtgaaaataa

SEQ ID NO: 9261694 - DNA, 22 bp, Homo sapiens
atttgtatcaatctcaatatat

SEQ ID NO: 9261695 - DNA, 22 bp, Homo sapiens
atttgtatcaatctcaatatat

SEQ ID NO: 9261696 - DNA, 22 bp, Homo sapiens
atttgtatcttctaatattatc

SEQ ID NO: 9261697 - DNA, 22 bp, Homo sapiens
atttgtatcttctaatattatc

SEQ ID NO: 9261698 - DNA, 22 bp, Homo sapiens
atttgtatcttctaatattatc

SEQ ID NO: 9261699 - DNA, 22 bp, Homo sapiens
attttagagctccaagtacagc

SEQ ID NO: 9261700 - DNA, 19 bp, Homo sapiens
gctcagagacacctgttgc

SEQ ID NO: 9261701 - DNA, 22 bp, Homo sapiens
caaaagaagctcttggggctag

SEQ ID NO: 9261702 - DNA, 22 bp, Homo sapiens
caaaagaagctcttggggctag

SEQ ID NO: 9261703 - DNA, 20 bp, Homo sapiens
caaaagcaatgaagttatga

SEQ ID NO: 9261704 - DNA, 20 bp, Homo sapiens
caaaagcaatgaagttatga

SEQ ID NO: 9261705 - DNA, 22 bp, Homo sapiens
caaaagaagctcttggggctag

SEQ ID NO: 9261706 - DNA, 22 bp, Homo sapiens
caaaagaagctcttggggctag

SEQ ID NO: 9261707 - DNA, 22 bp, Homo sapiens
gccttccttttaccaccagcca

SEQ ID NO: 9261708 - DNA, 17 bp, Homo sapiens
gccttccttcctccaca

SEQ ID NO: 9261709 - DNA, 17 bp, Homo sapiens
gccttccttcctccaca

SEQ ID NO: 9261710 - DNA, 17 bp, Homo sapiens
gccttccttcctccaca

SEQ ID NO: 9261711 - DNA, 22 bp, Homo sapiens
attttgataatcatgttagaga

SEQ ID NO: 9261712 - DNA, 22 bp, Homo sapiens
attttgactgcattacagaaca

SEQ ID NO: 9261713 - DNA, 22 bp, Homo sapiens
attttgataatcatgttagaga

SEQ ID NO: 9261714 - DNA, 22 bp, Homo sapiens
attttgataatcatgttagaga

SEQ ID NO: 9261715 - DNA, 22 bp, Homo sapiens
gctcagagaaaactggggcttg

SEQ ID NO: 9261716 - DNA, 22 bp, Homo sapiens
attttgctgtggtacattagga

SEQ ID NO: 9261717 - DNA, 23 bp, Homo sapiens
attttgcctcttggctgcttagg

SEQ ID NO: 9261718 - DNA, 22 bp, Homo sapiens
attttgcacactatgcagcttt

SEQ ID NO: 9261719 - DNA, 22 bp, Homo sapiens
attttgcacactatgcagcttt

SEQ ID NO: 9261720 - DNA, 22 bp, Homo sapiens
gctctgctgtgtttgttcagca

SEQ ID NO: 9261721 - DNA, 22 bp, Homo sapiens
caaagacacgggaaacaacgtt

SEQ ID NO: 9261722 - DNA, 20 bp, Homo sapiens
caaagacatgctaggggtgg

SEQ ID NO: 9261723 - DNA, 22 bp, Homo sapiens
caaagaccatgtggcctgaaaa

SEQ ID NO: 9261724 - DNA, 22 bp, Homo sapiens
caaagactgcataacacatgaa

SEQ ID NO: 9261725 - DNA, 22 bp, Homo sapiens
caaagaaggaactataatccca

SEQ ID NO: 9261726 - DNA, 22 bp, Homo sapiens
caaacttttgaggagttcagga

SEQ ID NO: 9261727 - DNA, 22 bp, Homo sapiens
caaagaaggaactataatccca

SEQ ID NO: 9261728 - DNA, 22 bp, Homo sapiens
caaagaatagcatggcatttgt

SEQ ID NO: 9261729 - DNA, 22 bp, Homo sapiens
caaagaatcactcatctttagc

SEQ ID NO: 9261730 - DNA, 22 bp, Homo sapiens
caaagaatagtgagaagatgta

SEQ ID NO: 9261731 - DNA, 22 bp, Homo sapiens
caaagaatcactcatctttagc

SEQ ID NO: 9261732 - DNA, 22 bp, Homo sapiens
caaagaatgagtgagtacataa

SEQ ID NO: 9261733 - DNA, 22 bp, Homo sapiens
caaagaatgagtgagtacataa

SEQ ID NO: 9261734 - DNA, 22 bp, Homo sapiens
caaagacacgggaaacaacgtt

SEQ ID NO: 9261735 - DNA, 22 bp, Homo sapiens
gctccccagcttagccctggct

SEQ ID NO: 9261736 - DNA, 22 bp, Homo sapiens
gctcccagggcagcgcagaaga

SEQ ID NO: 9261737 - DNA, 22 bp, Homo sapiens
gctcccagtctgatggaggaga

SEQ ID NO: 9261738 - DNA, 22 bp, Homo sapiens
gctcccaggttcttgggccttg

SEQ ID NO: 9261739 - DNA, 22 bp, Homo sapiens
gctcccagggacactggccact

SEQ ID NO: 9261740 - DNA, 22 bp, Homo sapiens
gctcccagggaccgcagggcag

SEQ ID NO: 9261741 - DNA, 22 bp, Homo sapiens
gctcccagggaccgcagggcag

SEQ ID NO: 9261742 - DNA, 22 bp, Homo sapiens
caaaagcagcaagtttatatgt

SEQ ID NO: 9261743 - DNA, 22 bp, Homo sapiens
gctccagggaacagaatgtact

SEQ ID NO: 9261744 - DNA, 22 bp, Homo sapiens
gctcccaggatgaggagccagg

SEQ ID NO: 9261745 - DNA, 22 bp, Homo sapiens
gctcccaggatgaggagccagg

SEQ ID NO: 9261746 - DNA, 22 bp, Homo sapiens
gcagggcagtgtgtctgtgggg

SEQ ID NO: 9261747 - DNA, 22 bp, Homo sapiens
attctgctggtaactctataaa

SEQ ID NO: 9261748 - DNA, 20 bp, Homo sapiens
attctgctttctgatagagc

SEQ ID NO: 9261749 - DNA, 22 bp, Homo sapiens
attctgcatgtaggtttgctca

SEQ ID NO: 9261750 - DNA, 22 bp, Homo sapiens
attctgcatggtggtgtctctg

SEQ ID NO: 9261751 - DNA, 22 bp, Homo sapiens
attctgcaggtggaggatggca

SEQ ID NO: 9261752 - DNA, 22 bp, Homo sapiens
attctgcataatttcctggcag

SEQ ID NO: 9261753 - DNA, 22 bp, Homo sapiens
attctgcacttcctttgcttcc

SEQ ID NO: 9261754 - DNA, 22 bp, Homo sapiens
attctgcacatccaagaacagg

SEQ ID NO: 9261755 - DNA, 22 bp, Homo sapiens
attctgcaactgttgttggtgg

SEQ ID NO: 9261756 - DNA, 22 bp, Homo sapiens
attctttggacaataagtggtg

SEQ ID NO: 9261757 - DNA, 22 bp, Homo sapiens
attcttttcccaactgctttaa

SEQ ID NO: 9261758 - DNA, 22 bp, Homo sapiens
gcagggcatccctgagcgggtg

SEQ ID NO: 9261759 - DNA, 22 bp, Homo sapiens
attctttccagacactgattgc

SEQ ID NO: 9261760 - DNA, 22 bp, Homo sapiens
gcagggcagtgtgtctgtgggg

SEQ ID NO: 9261761 - DNA, 22 bp, Homo sapiens
gcagggcatccctgagcgggtg

SEQ ID NO: 9261762 - DNA, 22 bp, Homo sapiens
gcagggcatagaggcacggagg

SEQ ID NO: 9261763 - DNA, 22 bp, Homo sapiens
attgcaatctggtgaaaacagt

SEQ ID NO: 9261764 - DNA, 22 bp, Homo sapiens
attgcacaaagagggaaactga

SEQ ID NO: 9261765 - DNA, 22 bp, Homo sapiens
attgcacaaacacagtcagact

SEQ ID NO: 9261766 - DNA, 22 bp, Homo sapiens
gcatggatctaagaggtcaagg

SEQ ID NO: 9261767 - DNA, 22 bp, Homo sapiens
gcatggatgggagtggacagat

SEQ ID NO: 9261768 - DNA, 22 bp, Homo sapiens
gcatggaattcccttatgggcc

SEQ ID NO: 9261769 - DNA, 22 bp, Homo sapiens
gcatggaattcccttatgggcc

SEQ ID NO: 9261770 - DNA, 22 bp, Homo sapiens
gcatggcaaatatcgagggcag

SEQ ID NO: 9261771 - DNA, 22 bp, Homo sapiens
gcatggcagccagtacatggtg

SEQ ID NO: 9261772 - DNA, 21 bp, Homo sapiens
gcatggcaggtcactggggca

SEQ ID NO: 9261773 - DNA, 22 bp, Homo sapiens
gcatggcagtgaggatggtgct

SEQ ID NO: 9261774 - DNA, 22 bp, Homo sapiens
gcatggcagtgaggatggtgct

SEQ ID NO: 9261775 - DNA, 21 bp, Homo sapiens
gcatggcaggtcactggggca

SEQ ID NO: 9261776 - DNA, 22 bp, Homo sapiens
gcatggcaagatcaggagacca

SEQ ID NO: 9261777 - DNA, 22 bp, Homo sapiens
gcatggcaagatcaggagacca

SEQ ID NO: 9261778 - DNA, 22 bp, Homo sapiens
gcatggcaagatcaggagacca

SEQ ID NO: 9261779 - DNA, 22 bp, Homo sapiens
gcatggcaagatcaggagacca

SEQ ID NO: 9261780 - DNA, 22 bp, Homo sapiens
gcagtaagatgtaagtgctata

SEQ ID NO: 9261781 - DNA, 22 bp, Homo sapiens
gcagtaaaggtgacaatatagg

SEQ ID NO: 9261782 - DNA, 22 bp, Homo sapiens
gcagtaaattgagagtcatgtt

SEQ ID NO: 9261783 - DNA, 22 bp, Homo sapiens
gcagtaaataattttgtgtata

SEQ ID NO: 9261784 - DNA, 22 bp, Homo sapiens
gcagtaaagcctgagatatatg

SEQ ID NO: 9261785 - DNA, 22 bp, Homo sapiens
gcagtaaaaaaggatatgtgca

SEQ ID NO: 9261786 - DNA, 16 bp, Homo sapiens
gcagtaaaatggttag

SEQ ID NO: 9261787 - DNA, 22 bp, Homo sapiens
attgcaaataactgtactgaat

SEQ ID NO: 9261788 - DNA, 22 bp, Homo sapiens
attgcaaaggtcccattcaaga

SEQ ID NO: 9261789 - DNA, 22 bp, Homo sapiens
attgaaaaatgactattgctta

SEQ ID NO: 9261790 - DNA, 19 bp, Homo sapiens
gcaggtggatgtggtcagc

SEQ ID NO: 9261791 - DNA, 22 bp, Homo sapiens
gcagtaaaaaaggatatgtgca

SEQ ID NO: 9261792 - DNA, 22 bp, Homo sapiens
attcacaaagaagggaagtaca

SEQ ID NO: 9261793 - DNA, 22 bp, Homo sapiens
attcacaaataacaggtgcaga

SEQ ID NO: 9261794 - DNA, 22 bp, Homo sapiens
attcacaaatgctgccccattc

SEQ ID NO: 9261795 - DNA, 22 bp, Homo sapiens
attccaaacttaccccagagga

SEQ ID NO: 9261796 - DNA, 22 bp, Homo sapiens
attcatgaatctacattgtggt

SEQ ID NO: 9261797 - DNA, 22 bp, Homo sapiens
attccacttagtgactcatttg

SEQ ID NO: 9261798 - DNA, 22 bp, Homo sapiens
attccactgccgaatgatacat

SEQ ID NO: 9261799 - DNA, 22 bp, Homo sapiens
attccacataggccttcatgac

SEQ ID NO: 9261800 - DNA, 22 bp, Homo sapiens
attccacagctacatcaatcta

SEQ ID NO: 9261801 - DNA, 22 bp, Homo sapiens
attccacagccgataccatgac

SEQ ID NO: 9261802 - DNA, 22 bp, Homo sapiens
attccacagctcagcctctctt

SEQ ID NO: 9261803 - DNA, 22 bp, Homo sapiens
attccacacagtaatactcaat

SEQ ID NO: 9261804 - DNA, 22 bp, Homo sapiens
attccaattgtacttgctttta

SEQ ID NO: 9261805 - DNA, 22 bp, Homo sapiens
attccaattgtacttgctttta

SEQ ID NO: 9261806 - DNA, 22 bp, Homo sapiens
attctctgtttccaagatgaaa

SEQ ID NO: 9261807 - DNA, 22 bp, Homo sapiens
attctcatttttatagatgaga

SEQ ID NO: 9261808 - DNA, 22 bp, Homo sapiens
attctctttgtataacatcttg

SEQ ID NO: 9261809 - DNA, 22 bp, Homo sapiens
attctctttgtataacatcttg

SEQ ID NO: 9261810 - DNA, 17 bp, Homo sapiens
attctcagtgtacagtg

SEQ ID NO: 9261811 - DNA, 17 bp, Homo sapiens
attctcagtgtacagtg

SEQ ID NO: 9261812 - DNA, 22 bp, Homo sapiens
attctcatttttatagatgaga

SEQ ID NO: 9261813 - DNA, 22 bp, Homo sapiens
attctcatttgctggctatatg

SEQ ID NO: 9261814 - DNA, 22 bp, Homo sapiens
attctcataggagcgtgaacct

SEQ ID NO: 9261815 - DNA, 22 bp, Homo sapiens
attctgagacaattgccgtcag

SEQ ID NO: 9261816 - DNA, 22 bp, Homo sapiens
attctgagaaatgcattgtcag

SEQ ID NO: 9261817 - DNA, 22 bp, Homo sapiens
attctgaggacagagtctagca

SEQ ID NO: 9261818 - DNA, 22 bp, Homo sapiens
attctgaattctgagcctttca

SEQ ID NO: 9261819 - DNA, 22 bp, Homo sapiens
attctgaagttgcaggagaagc

SEQ ID NO: 9261820 - DNA, 22 bp, Homo sapiens
attctctttgtataacatcttg

SEQ ID NO: 9261821 - DNA, 22 bp, Homo sapiens
gcagctgtgggttccaagtcta

SEQ ID NO: 9261822 - DNA, 22 bp, Homo sapiens
attctgatcattcaagatgtca

SEQ ID NO: 9261823 - DNA, 22 bp, Homo sapiens
attctgatatcttattctagct

SEQ ID NO: 9261824 - DNA, 21 bp, Homo sapiens
attctgagttgtcagtcttca

SEQ ID NO: 9261825 - DNA, 22 bp, Homo sapiens
attctgagtccatgggggcagg

SEQ ID NO: 9261826 - DNA, 22 bp, Homo sapiens
attctgagtccatgggggcagg

SEQ ID NO: 9261827 - DNA, 22 bp, Homo sapiens
gcagcttggatttctgtagttt

SEQ ID NO: 9261828 - DNA, 22 bp, Homo sapiens
gcagcttggtgaaaggtgatgg

SEQ ID NO: 9261829 - DNA, 22 bp, Homo sapiens
gcaggattgggctgaaggagtg

SEQ ID NO: 9261830 - DNA, 22 bp, Homo sapiens
gcaggattgggctgaaggagtg

SEQ ID NO: 9261831 - DNA, 22 bp, Homo sapiens
gcaggcaggcttccttgaactg

SEQ ID NO: 9261832 - DNA, 22 bp, Homo sapiens
gcaggcaggcttccttgaactg

SEQ ID NO: 9261833 - DNA, 22 bp, Homo sapiens
gcaggcaggagcccaactgcct

SEQ ID NO: 9261834 - DNA, 22 bp, Homo sapiens
gcaggcaggagcccaactgcct

SEQ ID NO: 9261835 - DNA, 22 bp, Homo sapiens
gcacagggctgccaggcggctt

SEQ ID NO: 9261836 - DNA, 22 bp, Homo sapiens
gcaccaggcagctgagcaggcc

SEQ ID NO: 9261837 - DNA, 22 bp, Homo sapiens
gcaccaggcagctgagcaggcc

SEQ ID NO: 9261838 - DNA, 22 bp, Homo sapiens
gcaccaggcagctgagcaggcc

SEQ ID NO: 9261839 - DNA, 22 bp, Homo sapiens
gcaccaggcagctgagcaggcc

SEQ ID NO: 9261840 - DNA, 22 bp, Homo sapiens
gcaccaggcttagagccccagg

SEQ ID NO: 9261841 - DNA, 22 bp, Homo sapiens
gcaccaggcagctgagcaggcc

SEQ ID NO: 9261842 - DNA, 22 bp, Homo sapiens
gcaccaggcttagagccccagg

SEQ ID NO: 9261843 - DNA, 22 bp, Homo sapiens
gcaccagggagggtgtgcttca

SEQ ID NO: 9261844 - DNA, 22 bp, Homo sapiens
gcaccagggagggtgtgcttca

SEQ ID NO: 9261845 - DNA, 22 bp, Homo sapiens
gcaccaggtgcagccgggcccc

SEQ ID NO: 9261846 - DNA, 22 bp, Homo sapiens
gcacacagattaggaaacagaa

SEQ ID NO: 9261847 - DNA, 22 bp, Homo sapiens
gcacacagattaggaaacagaa

SEQ ID NO: 9261848 - DNA, 22 bp, Homo sapiens
gcacacagagaggtggtatgtc

SEQ ID NO: 9261849 - DNA, 22 bp, Homo sapiens
gcacacagattaggaaacagaa

SEQ ID NO: 9261850 - DNA, 22 bp, Homo sapiens
gcacacagaattgattcactgt

SEQ ID NO: 9261851 - DNA, 22 bp, Homo sapiens
gcacacaggcagtttccagcca

SEQ ID NO: 9261852 - DNA, 22 bp, Homo sapiens
gcacacaggcagtttccagcca

SEQ ID NO: 9261853 - DNA, 22 bp, Homo sapiens
gcacacaggcagtttccagcca

SEQ ID NO: 9261854 - DNA, 22 bp, Homo sapiens
gcacacagccagctgagggcta

SEQ ID NO: 9261855 - DNA, 22 bp, Homo sapiens
gcacacagccagctgagggcta

SEQ ID NO: 9261856 - DNA, 22 bp, Homo sapiens
gcacacagctagattaccattc

SEQ ID NO: 9261857 - DNA, 22 bp, Homo sapiens
gcacacagccagctgagggcta

SEQ ID NO: 9261858 - DNA, 22 bp, Homo sapiens
attataggcttgagccaccgtg

SEQ ID NO: 9261859 - DNA, 22 bp, Homo sapiens
attataggcttgagccaccgtg

SEQ ID NO: 9261860 - DNA, 22 bp, Homo sapiens
attataggcttgagccaccgtg

SEQ ID NO: 9261861 - DNA, 22 bp, Homo sapiens
attataggcttgagccaccgtg

SEQ ID NO: 9261862 - DNA, 22 bp, Homo sapiens
attataggcttgagccaccgtg

SEQ ID NO: 9261863 - DNA, 22 bp, Homo sapiens
attagtttggtgcaaaagtaat

SEQ ID NO: 9261864 - DNA, 22 bp, Homo sapiens
attagtttggtgcaaaagtaat

SEQ ID NO: 9261865 - DNA, 22 bp, Homo sapiens
attataggcttgagccaccgtg

SEQ ID NO: 9261866 - DNA, 22 bp, Homo sapiens
attataggcttgagccaccgtg

SEQ ID NO: 9261867 - DNA, 22 bp, Homo sapiens
attaagatcattgtagaagatt

SEQ ID NO: 9261868 - DNA, 22 bp, Homo sapiens
attaagactattgatatttaca

SEQ ID NO: 9261869 - DNA, 22 bp, Homo sapiens
attaagactgcccatgttttta

SEQ ID NO: 9261870 - DNA, 22 bp, Homo sapiens
gcacacagaattgattcactgt

SEQ ID NO: 9261871 - DNA, 22 bp, Homo sapiens
gcacacagaattgattcactgt

SEQ ID NO: 9261872 - DNA, 22 bp, Homo sapiens
attatatgtgggatagaattta

SEQ ID NO: 9261873 - DNA, 22 bp, Homo sapiens
attatatgtgggatagaattta

SEQ ID NO: 9261874 - DNA, 22 bp, Homo sapiens
attatattgagtataaccagag

SEQ ID NO: 9261875 - DNA, 22 bp, Homo sapiens
attatattgagtataaccagag

SEQ ID NO: 9261876 - DNA, 22 bp, Homo sapiens
gcagagattatgccatggaaag

SEQ ID NO: 9261877 - DNA, 22 bp, Homo sapiens
gcagagaggaatgaagccatcc

SEQ ID NO: 9261878 - DNA, 22 bp, Homo sapiens
gcagagagttgggctgcgccag

SEQ ID NO: 9261879 - DNA, 21 bp, Homo sapiens
gcagagaatgaactttggctt

SEQ ID NO: 9261880 - DNA, 23 bp, Homo sapiens
gcagagacagccccagcgcgatg

SEQ ID NO: 9261881 - DNA, 22 bp, Homo sapiens
gcagagacagactaatgaaaag

SEQ ID NO: 9261882 - DNA, 22 bp, Homo sapiens
gcagagaccccgcagtgaggcc

SEQ ID NO: 9261883 - DNA, 22 bp, Homo sapiens
attatgggtataacacagttat

SEQ ID NO: 9261884 - DNA, 22 bp, Homo sapiens
attatggacgttaattttggaa

SEQ ID NO: 9261885 - DNA, 22 bp, Homo sapiens
attatgcttaggaaaatatgaa

SEQ ID NO: 9261886 - DNA, 22 bp, Homo sapiens
attatggacatcaaataactct

SEQ ID NO: 9261887 - DNA, 22 bp, Homo sapiens
attatggatggaggcattagtc

SEQ ID NO: 9261888 - DNA, 22 bp, Homo sapiens
attatggagaaatatgtacagg

SEQ ID NO: 9261889 - DNA, 22 bp, Homo sapiens
gcagacaatttattagcagatt

SEQ ID NO: 9261890 - DNA, 22 bp, Homo sapiens
gcagagaaggattgaaaccaga

SEQ ID NO: 9261891 - DNA, 22 bp, Homo sapiens
gcacccagaataaggacaggac

SEQ ID NO: 9261892 - DNA, 22 bp, Homo sapiens
gcacccagaataaggacaggac

SEQ ID NO: 9261893 - DNA, 22 bp, Homo sapiens
gcacccagaataaggacaggac

SEQ ID NO: 9261894 - DNA, 22 bp, Homo sapiens
attatctaggaattgacagaag

SEQ ID NO: 9261895 - DNA, 22 bp, Homo sapiens
attatgctggtttacacatttt

SEQ ID NO: 9261896 - DNA, 22 bp, Homo sapiens
attatgctcacctggcaacttg

SEQ ID NO: 9261897 - DNA, 22 bp, Homo sapiens
attatgaagttgagggaccctg

SEQ ID NO: 9261898 - DNA, 22 bp, Homo sapiens
gatggagtctgaagctgggaac

SEQ ID NO: 9261899 - DNA, 22 bp, Homo sapiens
gatggaggagatggcagggtgc

SEQ ID NO: 9261900 - DNA, 21 bp, Homo sapiens
gatgatggcaggcagcactgg

SEQ ID NO: 9261901 - DNA, 22 bp, Homo sapiens
gatggcacacagacatccccgc

SEQ ID NO: 9261902 - DNA, 22 bp, Homo sapiens
atgttatttctgaaagatcatt

SEQ ID NO: 9261903 - DNA, 22 bp, Homo sapiens
gatggcaggcaggtgagtagag

SEQ ID NO: 9261904 - DNA, 22 bp, Homo sapiens
gatggcagcagcagccagggat

SEQ ID NO: 9261905 - DNA, 22 bp, Homo sapiens
gatggcaaactgggaccagagg

SEQ ID NO: 9261906 - DNA, 22 bp, Homo sapiens
gatggcagcatattgacagcat

SEQ ID NO: 9261907 - DNA, 22 bp, Homo sapiens
gatggcagtcaaccaggtgagg

SEQ ID NO: 9261908 - DNA, 22 bp, Homo sapiens
gatggcagtcaaccaggtgagg

SEQ ID NO: 9261909 - DNA, 22 bp, Homo sapiens
gagtggggcgtggatccagcgt

SEQ ID NO: 9261910 - DNA, 22 bp, Homo sapiens
gagtggggcgtggatccagcgt

SEQ ID NO: 9261911 - DNA, 22 bp, Homo sapiens
atgttatgtctgggaaggggta

SEQ ID NO: 9261912 - DNA, 22 bp, Homo sapiens
atgttatgtctgggaaggggta

SEQ ID NO: 9261913 - DNA, 22 bp, Homo sapiens
gagtggggcgaagtcggcgagt

SEQ ID NO: 9261914 - DNA, 22 bp, Homo sapiens
gagtggggcccactgctgggtg

SEQ ID NO: 9261915 - DNA, 22 bp, Homo sapiens
atgttattaaagtacagattct

SEQ ID NO: 9261916 - DNA, 22 bp, Homo sapiens
atgttattaaagtacagattct

SEQ ID NO: 9261917 - DNA, 22 bp, Homo sapiens
atgttatgtgcaagatacataa

SEQ ID NO: 9261918 - DNA, 22 bp, Homo sapiens
gagtgggcttggggagagtttg

SEQ ID NO: 9261919 - DNA, 22 bp, Homo sapiens
gagtgggcttggggagagtttg

SEQ ID NO: 9261920 - DNA, 22 bp, Homo sapiens
gagtggggaaagccaggacaga

SEQ ID NO: 9261921 - DNA, 22 bp, Homo sapiens
gagtgggcttggggagagtttg

SEQ ID NO: 9261922 - DNA, 20 bp, Homo sapiens
gagtgggccatggagtgaga

SEQ ID NO: 9261923 - DNA, 22 bp, Homo sapiens
gagtgggcaccgtgggcacact

SEQ ID NO: 9261924 - DNA, 23 bp, Homo sapiens
gagtggggagaaattggttaaac

SEQ ID NO: 9261925 - DNA, 22 bp, Homo sapiens
gagtggggaaagccaggacaga

SEQ ID NO: 9261926 - DNA, 22 bp, Homo sapiens
gagtggggcccactgctgggtg

SEQ ID NO: 9261927 - DNA, 22 bp, Homo sapiens
gagtggggcccactgctgggtg

SEQ ID NO: 9261928 - DNA, 22 bp, Homo sapiens
attaacatgagttggagatagg

SEQ ID NO: 9261929 - DNA, 22 bp, Homo sapiens
attaaattttcactaggctccc

SEQ ID NO: 9261930 - DNA, 22 bp, Homo sapiens
gattcttgggccttctgaagtt

SEQ ID NO: 9261931 - DNA, 22 bp, Homo sapiens
attaaattggatctgcatagtt

SEQ ID NO: 9261932 - DNA, 22 bp, Homo sapiens
gattcccatgtctgaggaggtg

SEQ ID NO: 9261933 - DNA, 22 bp, Homo sapiens
gattcctttcgcctgccgagct

SEQ ID NO: 9261934 - DNA, 22 bp, Homo sapiens
gattctgaaattaacagactgg

SEQ ID NO: 9261935 - DNA, 22 bp, Homo sapiens
gattctgagctggtgttttacg

SEQ ID NO: 9261936 - DNA, 22 bp, Homo sapiens
gattctgagctggtgttttacg

SEQ ID NO: 9261937 - DNA, 18 bp, Homo sapiens
gattctgattctggaggc

SEQ ID NO: 9261938 - DNA, 22 bp, Homo sapiens
gattctgatctatagtgttata

SEQ ID NO: 9261939 - DNA, 22 bp, Homo sapiens
gatgtgtaacatgctgtgacat

SEQ ID NO: 9261940 - DNA, 22 bp, Homo sapiens
gattcactcatattttacgttt

SEQ ID NO: 9261941 - DNA, 22 bp, Homo sapiens
gatgtgtagagggaatttcaaa

SEQ ID NO: 9261942 - DNA, 22 bp, Homo sapiens
gattcagtgagggtgagaagaa

SEQ ID NO: 9261943 - DNA, 22 bp, Homo sapiens
gattcataccgtttcttctcca

SEQ ID NO: 9261944 - DNA, 22 bp, Homo sapiens
gattccacagcttcgaggtctt

SEQ ID NO: 9261945 - DNA, 22 bp, Homo sapiens
gatgtctttgccatgcatgtgt

SEQ ID NO: 9261946 - DNA, 22 bp, Homo sapiens
gatgtctttttccaggctcttt

SEQ ID NO: 9261947 - DNA, 22 bp, Homo sapiens
gatgtctttctgtgtgcctaga

SEQ ID NO: 9261948 - DNA, 20 bp, Homo sapiens
gatgtcttggtcacagtggc

SEQ ID NO: 9261949 - DNA, 22 bp, Homo sapiens
gatgtcttggtcaacttgggct

SEQ ID NO: 9261950 - DNA, 22 bp, Homo sapiens
gatgtcttcccatgttcatgtg

SEQ ID NO: 9261951 - DNA, 22 bp, Homo sapiens
gatgtcttctcaactgtagacc

SEQ ID NO: 9261952 - DNA, 22 bp, Homo sapiens
gatgtcttctcaactgtagacc

SEQ ID NO: 9261953 - DNA, 22 bp, Homo sapiens
gatgtcttggcttgctctctgt

SEQ ID NO: 9261954 - DNA, 22 bp, Homo sapiens
atggcaccttccccagagctca

SEQ ID NO: 9261955 - DNA, 22 bp, Homo sapiens
atggcactgacctcccttgtaa

SEQ ID NO: 9261956 - DNA, 22 bp, Homo sapiens
atggcagaaagaatagaggcta

SEQ ID NO: 9261957 - DNA, 22 bp, Homo sapiens
atggcagacacaggcaggcaga

SEQ ID NO: 9261958 - DNA, 22 bp, Homo sapiens
atggcacagtgggaaatgacct

SEQ ID NO: 9261959 - DNA, 22 bp, Homo sapiens
atggcacaggagaggagggctg

SEQ ID NO: 9261960 - DNA, 22 bp, Homo sapiens
atggcaaaaactgcagttacct

SEQ ID NO: 9261961 - DNA, 22 bp, Homo sapiens
atggcaaaaattaacagatcaa

SEQ ID NO: 9261962 - DNA, 22 bp, Homo sapiens
atggcaagcaagctgaagagat

SEQ ID NO: 9261963 - DNA, 22 bp, Homo sapiens
atggcaatgtggcttatttgga

SEQ ID NO: 9261964 - DNA, 21 bp, Homo sapiens
atggatttaaacaggccacaa

SEQ ID NO: 9261965 - DNA, 22 bp, Homo sapiens
atggatggaaaagttgaggaga

SEQ ID NO: 9261966 - DNA, 22 bp, Homo sapiens
gagacaggatttaaccaaagct

SEQ ID NO: 9261967 - DNA, 22 bp, Homo sapiens
gagacaggatttaaccaaagct

SEQ ID NO: 9261968 - DNA, 21 bp, Homo sapiens
gagaatcaggaaggattgatg

SEQ ID NO: 9261969 - DNA, 22 bp, Homo sapiens
gagaatcatttacagaatgatt

SEQ ID NO: 9261970 - DNA, 22 bp, Homo sapiens
atggataatggtgatagttgca

SEQ ID NO: 9261971 - DNA, 22 bp, Homo sapiens
atggatcagaatcccgggaggg

SEQ ID NO: 9261972 - DNA, 22 bp, Homo sapiens
atggatcacagtgccgtgggtg

SEQ ID NO: 9261973 - DNA, 22 bp, Homo sapiens
atggagggtgtcagagagcgaa

SEQ ID NO: 9261974 - DNA, 22 bp, Homo sapiens
atggagggtgtcagagagcgaa

SEQ ID NO: 9261975 - DNA, 22 bp, Homo sapiens
atggataatggtgatagttgca

SEQ ID NO: 9261976 - DNA, 22 bp, Homo sapiens
atggataatgtctctgtttccc

SEQ ID NO: 9261977 - DNA, 22 bp, Homo sapiens
gagacaggcagctagtgggtca

SEQ ID NO: 9261978 - DNA, 22 bp, Homo sapiens
gagacaggccaggtggtactta

SEQ ID NO: 9261979 - DNA, 22 bp, Homo sapiens
gagacaggccaggtggtactta

SEQ ID NO: 9261980 - DNA, 22 bp, Homo sapiens
gagacaggccaggtggtactta

SEQ ID NO: 9261981 - DNA, 22 bp, Homo sapiens
gagacaggccaggtggtactta

SEQ ID NO: 9261982 - DNA, 22 bp, Homo sapiens
gagacaggatttaaccaaagct

SEQ ID NO: 9261983 - DNA, 22 bp, Homo sapiens
gagacaggatttaaccaaagct

SEQ ID NO: 9261984 - DNA, 22 bp, Homo sapiens
gagacaggcagctagtgggtca

SEQ ID NO: 9261985 - DNA, 22 bp, Homo sapiens
gagaaggtggacctgaaggagc

SEQ ID NO: 9261986 - DNA, 22 bp, Homo sapiens
gagaaggggtgatgtgggtaat

SEQ ID NO: 9261987 - DNA, 22 bp, Homo sapiens
gagaaggggtgatgtgggtaat

SEQ ID NO: 9261988 - DNA, 22 bp, Homo sapiens
gagaaggggtgatgtgggtaat

SEQ ID NO: 9261989 - DNA, 22 bp, Homo sapiens
gagaacaggctctggagtcaga

SEQ ID NO: 9261990 - DNA, 22 bp, Homo sapiens
gagaagtttctggtttgcatag

SEQ ID NO: 9261991 - DNA, 22 bp, Homo sapiens
atgctgtgttttaaatggaaat

SEQ ID NO: 9261992 - DNA, 22 bp, Homo sapiens
atgctgttaagataatgggttc

SEQ ID NO: 9261993 - DNA, 22 bp, Homo sapiens
atgcttaactctgtacatagtt

SEQ ID NO: 9261994 - DNA, 22 bp, Homo sapiens
atgcttaactctgtacatagtt

SEQ ID NO: 9261995 - DNA, 22 bp, Homo sapiens
atgctgttattctaatgtgtga

SEQ ID NO: 9261996 - DNA, 22 bp, Homo sapiens
atgcttaaccttggtgtacaat

SEQ ID NO: 9261997 - DNA, 22 bp, Homo sapiens
atgcttaacttcctagtctata

SEQ ID NO: 9261998 - DNA, 22 bp, Homo sapiens
atgctgggaagacaaggtggag

SEQ ID NO: 9261999 - DNA, 22 bp, Homo sapiens
atgctgggaaactgaaaggaat

SEQ ID NO: 9262000 - DNA, 22 bp, Homo sapiens
atgctgggaagacaaggtggag

SEQ ID NO: 9262001 - DNA, 22 bp, Homo sapiens
atgctggttgctaagcagcgat

SEQ ID NO: 9262002 - DNA, 22 bp, Homo sapiens
atgctgtgtcaccttaggattt

SEQ ID NO: 9262003 - DNA, 22 bp, Homo sapiens
atgctgtggaagttcctgaagc

SEQ ID NO: 9262004 - DNA, 22 bp, Homo sapiens
atgctgtgagtgtgccgcagag

SEQ ID NO: 9262005 - DNA, 22 bp, Homo sapiens
atgctgtgaaaaagaaggctga

SEQ ID NO: 9262006 - DNA, 22 bp, Homo sapiens
gagcacaggctgctgtgaactg

SEQ ID NO: 9262007 - DNA, 22 bp, Homo sapiens
gagcacaggctgctgtgaactg

SEQ ID NO: 9262008 - DNA, 22 bp, Homo sapiens
gagcacagctggaggtagcatt

SEQ ID NO: 9262009 - DNA, 19 bp, Homo sapiens
gagcacagcggcatttggt

SEQ ID NO: 9262010 - DNA, 22 bp, Homo sapiens
gagcacagcgcagtttgtaatt

SEQ ID NO: 9262011 - DNA, 22 bp, Homo sapiens
gagcacagcgcagtttgtaatt

SEQ ID NO: 9262012 - DNA, 19 bp, Homo sapiens
gagcacagcggcatttggt

SEQ ID NO: 9262013 - DNA, 22 bp, Homo sapiens
gagcacagcagggctctgggtg

SEQ ID NO: 9262014 - DNA, 22 bp, Homo sapiens
gagcacagattgatttaaaata

SEQ ID NO: 9262015 - DNA, 22 bp, Homo sapiens
atgggagggtggaaaggctctg

SEQ ID NO: 9262016 - DNA, 22 bp, Homo sapiens
atgggagtgtgcttgaggagtt

SEQ ID NO: 9262017 - DNA, 22 bp, Homo sapiens
atgggagtggaggaaaaaagtt

SEQ ID NO: 9262018 - DNA, 22 bp, Homo sapiens
gagcacaggctttggtggacac

SEQ ID NO: 9262019 - DNA, 22 bp, Homo sapiens
gagcacagggaatagacagata

SEQ ID NO: 9262020 - DNA, 22 bp, Homo sapiens
gagcacagggaatagacagata

SEQ ID NO: 9262021 - DNA, 22 bp, Homo sapiens
atgggaggaagagaagatgtct

SEQ ID NO: 9262022 - DNA, 22 bp, Homo sapiens
atggctctgctgggcaaagcaa

SEQ ID NO: 9262023 - DNA, 19 bp, Homo sapiens
atggctctgggatcactgc

SEQ ID NO: 9262024 - DNA, 22 bp, Homo sapiens
atggctgagatgggctccaggc

SEQ ID NO: 9262025 - DNA, 21 bp, Homo sapiens
atggctcaggccatcaatgga

SEQ ID NO: 9262026 - DNA, 21 bp, Homo sapiens
atggctcaggccatcaatgga

SEQ ID NO: 9262027 - DNA, 22 bp, Homo sapiens
atggctcatttatcttgcagcc

SEQ ID NO: 9262028 - DNA, 22 bp, Homo sapiens
atggctcatttatcttgcagcc

SEQ ID NO: 9262029 - DNA, 22 bp, Homo sapiens
atggcagagaaagcgagccaca

SEQ ID NO: 9262030 - DNA, 22 bp, Homo sapiens
gagctgccggcccacagtacta

SEQ ID NO: 9262031 - DNA, 22 bp, Homo sapiens
gagctgccctgagctttgcatg

SEQ ID NO: 9262032 - DNA, 18 bp, Homo sapiens
gagctgccatatttagtt

SEQ ID NO: 9262033 - DNA, 22 bp, Homo sapiens
gagctgccctgagctttgcatg

SEQ ID NO: 9262034 - DNA, 21 bp, Homo sapiens
atgggcagaggcagagaggct

SEQ ID NO: 9262035 - DNA, 22 bp, Homo sapiens
atgggcagagtggggacaggaa

SEQ ID NO: 9262036 - DNA, 21 bp, Homo sapiens
atgggcagaggcagagaggct

SEQ ID NO: 9262037 - DNA, 22 bp, Homo sapiens
gagctgccagacatgggaatga

SEQ ID NO: 9262038 - DNA, 22 bp, Homo sapiens
gagctgccagacatgggaatga

SEQ ID NO: 9262039 - DNA, 22 bp, Homo sapiens
gagctgccaagattacaatcag

SEQ ID NO: 9262040 - DNA, 22 bp, Homo sapiens
gagctgccagtgtatgaattct

SEQ ID NO: 9262041 - DNA, 22 bp, Homo sapiens
gagctgcagcggctgacgcaac

SEQ ID NO: 9262042 - DNA, 22 bp, Homo sapiens
gagctgagttacctccagatca

SEQ ID NO: 9262043 - DNA, 20 bp, Homo sapiens
gagctgagtgtggtcatggg

SEQ ID NO: 9262044 - DNA, 23 bp, Homo sapiens
gagctgagtgtagggagactagg

SEQ ID NO: 9262045 - DNA, 22 bp, Homo sapiens
gagctgagtgtcctaggcatgg

SEQ ID NO: 9262046 - DNA, 22 bp, Homo sapiens
gagctgagtgtcctaggcatgg

SEQ ID NO: 9262047 - DNA, 22 bp, Homo sapiens
atgggcagagctggtgggaggc

SEQ ID NO: 9262048 - DNA, 21 bp, Homo sapiens
atgggcagaggcagagaggct

SEQ ID NO: 9262049 - DNA, 22 bp, Homo sapiens
gagccccaccctagacattctg

SEQ ID NO: 9262050 - DNA, 22 bp, Homo sapiens
atgggcagacagggagctcacg

SEQ ID NO: 9262051 - DNA, 22 bp, Homo sapiens
atgggcagacagggagctcacg

SEQ ID NO: 9262052 - DNA, 22 bp, Homo sapiens
atgggcagacagggagctcacg

SEQ ID NO: 9262053 - DNA, 22 bp, Homo sapiens
atgggatcttgccctgagggct

SEQ ID NO: 9262054 - DNA, 22 bp, Homo sapiens
atgggatgaacttgatctgctt

SEQ ID NO: 9262055 - DNA, 22 bp, Homo sapiens
atgggatgatcacctgagctca

SEQ ID NO: 9262056 - DNA, 22 bp, Homo sapiens
atgggataacaagaaggctgag

SEQ ID NO: 9262057 - DNA, 22 bp, Homo sapiens
gagccccagccctgcttctata

SEQ ID NO: 9262058 - DNA, 22 bp, Homo sapiens
gagccccaggacagctctagtt

SEQ ID NO: 9262059 - DNA, 22 bp, Homo sapiens
gaggttgggatgagggatacag

SEQ ID NO: 9262060 - DNA, 22 bp, Homo sapiens
gagtgcagtatcttctgtgtcc

SEQ ID NO: 9262061 - DNA, 22 bp, Homo sapiens
gagtgcagtatcttctgtgtcc

SEQ ID NO: 9262062 - DNA, 22 bp, Homo sapiens
gaggttggcgccctgcctggcc

SEQ ID NO: 9262063 - DNA, 22 bp, Homo sapiens
gaggttagaggtcagtgcagtc

SEQ ID NO: 9262064 - DNA, 22 bp, Homo sapiens
atgttataaatagagacactgg

SEQ ID NO: 9262065 - DNA, 22 bp, Homo sapiens
atgttatagttataaaatgagg

SEQ ID NO: 9262066 - DNA, 22 bp, Homo sapiens
atgttatggctcaaacatttgg

SEQ ID NO: 9262067 - DNA, 22 bp, Homo sapiens
atgttacatagtccttatttgt

SEQ ID NO: 9262068 - DNA, 22 bp, Homo sapiens
atgttacagttgagtaaattaa

SEQ ID NO: 9262069 - DNA, 22 bp, Homo sapiens
atgttacttagaataattctgg

SEQ ID NO: 9262070 - DNA, 22 bp, Homo sapiens
atgttaggcaatctttcttgtt

SEQ ID NO: 9262071 - DNA, 22 bp, Homo sapiens
atgttagcattgagcacttact

SEQ ID NO: 9262072 - DNA, 22 bp, Homo sapiens
atgttactgtgatcatgatact

SEQ ID NO: 9262073 - DNA, 22 bp, Homo sapiens
atgtggctgatcgcagagctct

SEQ ID NO: 9262074 - DNA, 23 bp, Homo sapiens
atgttaaacataactgaagagcc

SEQ ID NO: 9262075 - DNA, 22 bp, Homo sapiens
atgttaaaagtgaggatggcca

SEQ ID NO: 9262076 - DNA, 22 bp, Homo sapiens
atgttaaaaaccagtacagttg

SEQ ID NO: 9262077 - DNA, 23 bp, Homo sapiens
atgtggctagtgagaccaagaaa

SEQ ID NO: 9262078 - DNA, 22 bp, Homo sapiens
atgtggaatgaacaaaggaggc

SEQ ID NO: 9262079 - DNA, 22 bp, Homo sapiens
atgtgctttctttccaaggggc

SEQ ID NO: 9262080 - DNA, 22 bp, Homo sapiens
atgtgcttcataatcttctcat

SEQ ID NO: 9262081 - DNA, 22 bp, Homo sapiens
atgtgcttcattctacatgaca

SEQ ID NO: 9262082 - DNA, 22 bp, Homo sapiens
atgtgcttggacattctaggaa

SEQ ID NO: 9262083 - DNA, 22 bp, Homo sapiens
atgtgcttgcagatgagcctca

SEQ ID NO: 9262084 - DNA, 22 bp, Homo sapiens
atgtgcttgaagcctcagagaa

SEQ ID NO: 9262085 - DNA, 22 bp, Homo sapiens
atgtgcttgactactctctatt

SEQ ID NO: 9262086 - DNA, 22 bp, Homo sapiens
atgtcagaatctacattctact

SEQ ID NO: 9262087 - DNA, 22 bp, Homo sapiens
atgtcagaatctacattctact

SEQ ID NO: 9262088 - DNA, 22 bp, Homo sapiens
gaggctgaacaggttctcatga

SEQ ID NO: 9262089 - DNA, 22 bp, Homo sapiens
gaggctgaacaggttctcatga

SEQ ID NO: 9262090 - DNA, 22 bp, Homo sapiens
atgtcactgtgaggcagctgtc

SEQ ID NO: 9262091 - DNA, 22 bp, Homo sapiens
gaggctcttcaataggtcaatg

SEQ ID NO: 9262092 - DNA, 22 bp, Homo sapiens
gaggctctggagtaggtacaca

SEQ ID NO: 9262093 - DNA, 20 bp, Homo sapiens
gaggctctgggcatggcgcc

SEQ ID NO: 9262094 - DNA, 22 bp, Homo sapiens
gaggctcctcattcagtatgct

SEQ ID NO: 9262095 - DNA, 22 bp, Homo sapiens
gaggctccgtgctgctgccctg

SEQ ID NO: 9262096 - DNA, 22 bp, Homo sapiens
gaggcctgggttggaggtgcat

SEQ ID NO: 9262097 - DNA, 22 bp, Homo sapiens
gaggctccagcgacacctaggc

SEQ ID NO: 9262098 - DNA, 22 bp, Homo sapiens
atgtatttctatgtagtgaaga

SEQ ID NO: 9262099 - DNA, 22 bp, Homo sapiens
atgtatttctatgtagtgaaga

SEQ ID NO: 9262100 - DNA, 22 bp, Homo sapiens
atgtatttctatgtagtgaaga

SEQ ID NO: 9262101 - DNA, 23 bp, Homo sapiens
atgtatttaaatttcagtgatga

SEQ ID NO: 9262102 - DNA, 22 bp, Homo sapiens
atgtattgtctcttttccttaa

SEQ ID NO: 9262103 - DNA, 18 bp, Homo sapiens
atgtatgtacatatttat

SEQ ID NO: 9262104 - DNA, 22 bp, Homo sapiens
atgtatcacagcaatgtagtca

SEQ ID NO: 9262105 - DNA, 22 bp, Homo sapiens
atgtatgttcaagcaatgatta

SEQ ID NO: 9262106 - DNA, 22 bp, Homo sapiens
atgtatgtctgcatacacatac

SEQ ID NO: 9262107 - DNA, 22 bp, Homo sapiens
atgtattatggttttccttaag

SEQ ID NO: 9262108 - DNA, 22 bp, Homo sapiens
gaggcacagagccctaggagct

SEQ ID NO: 9262109 - DNA, 22 bp, Homo sapiens
gaggcacaccagggagtcttgt

SEQ ID NO: 9262110 - DNA, 23 bp, Homo sapiens
gaggagggtcgtgctgtgttcct

SEQ ID NO: 9262111 - DNA, 22 bp, Homo sapiens
gaggcacaatacatgtctcaag

SEQ ID NO: 9262112 - DNA, 22 bp, Homo sapiens
gaggaggggcacttgtctccta

SEQ ID NO: 9262113 - DNA, 22 bp, Homo sapiens
gaggcacagtgtttggtcagtg

SEQ ID NO: 9262114 - DNA, 22 bp, Homo sapiens
gaggcacagtgtttggtcagtg

SEQ ID NO: 9262115 - DNA, 22 bp, Homo sapiens
gaggcacagtcccgaggcaagg

SEQ ID NO: 9262116 - DNA, 22 bp, Homo sapiens
gaggcacatatatacagagccc

SEQ ID NO: 9262117 - DNA, 22 bp, Homo sapiens
atgtagctgcagatgataatgc

SEQ ID NO: 9262118 - DNA, 20 bp, Homo sapiens
atgtatattactggctgtga

SEQ ID NO: 9262119 - DNA, 22 bp, Homo sapiens
atgtagctgcagatgataatgc

SEQ ID NO: 9262120 - DNA, 22 bp, Homo sapiens
atgggcagagtggggacaggaa

SEQ ID NO: 9262121 - DNA, 22 bp, Homo sapiens
atgggcagagtggggacaggaa

SEQ ID NO: 9262122 - DNA, 22 bp, Homo sapiens
atgggcagctgcagcagtggtg

SEQ ID NO: 9262123 - DNA, 22 bp, Homo sapiens
atgggcaggcactggctctcag

SEQ ID NO: 9262124 - DNA, 22 bp, Homo sapiens
atgggcaggcaaggtggcgagt

SEQ ID NO: 9262125 - DNA, 22 bp, Homo sapiens
atgggcagctgcagcagtggtg

SEQ ID NO: 9262126 - DNA, 22 bp, Homo sapiens
gaggagggcctggtgtcccttc

SEQ ID NO: 9262127 - DNA, 22 bp, Homo sapiens
gaggagggcctggtgtcccttc

SEQ ID NO: 9262128 - DNA, 22 bp, Homo sapiens
gaggagggctttgttgatgtta

SEQ ID NO: 9262129 - DNA, 22 bp, Homo sapiens
gaggaggggacagtacttgtgc

SEQ ID NO: 9262130 - DNA, 22 bp, Homo sapiens
gaggagggcagttcctctttta

SEQ ID NO: 9262131 - DNA, 22 bp, Homo sapiens
gaggagggagctggaagctctt

SEQ ID NO: 9262132 - DNA, 22 bp, Homo sapiens
gaggagggagctggaagctctt

SEQ ID NO: 9262133 - DNA, 22 bp, Homo sapiens
gaggagggagctggaagctctt

SEQ ID NO: 9262134 - DNA, 22 bp, Homo sapiens
gaggagggagctggaagctctt

SEQ ID NO: 9262135 - DNA, 22 bp, Homo sapiens
gaggagggagctggaagctctt

SEQ ID NO: 9262136 - DNA, 22 bp, Homo sapiens
gaggagggagctggaagctctt

SEQ ID NO: 9262137 - DNA, 17 bp, Homo sapiens
cttgttttccactggga

SEQ ID NO: 9262138 - DNA, 17 bp, Homo sapiens
cttgttttccactggga

SEQ ID NO: 9262139 - DNA, 22 bp, Homo sapiens
ctttacacaatgattttcttta

SEQ ID NO: 9262140 - DNA, 22 bp, Homo sapiens
ctttacacttggacccacactt

SEQ ID NO: 9262141 - DNA, 22 bp, Homo sapiens
ctttacaccaagcagatctttc

SEQ ID NO: 9262142 - DNA, 22 bp, Homo sapiens
ctttacaccaagcagatctttc

SEQ ID NO: 9262143 - DNA, 22 bp, Homo sapiens
ctttacataaggataaacctgg

SEQ ID NO: 9262144 - DNA, 22 bp, Homo sapiens
ctttacataaggataaacctgg

SEQ ID NO: 9262145 - DNA, 22 bp, Homo sapiens
ctttacagcttagtggtatgga

SEQ ID NO: 9262146 - DNA, 22 bp, Homo sapiens
ctttacagcctccagaaggaac

SEQ ID NO: 9262147 - DNA, 22 bp, Homo sapiens
ctttacagataggaactactca

SEQ ID NO: 9262148 - DNA, 22 bp, Homo sapiens
atctttgactgccattcttgac

SEQ ID NO: 9262149 - DNA, 22 bp, Homo sapiens
cttgttttaaactgttgtggct

SEQ ID NO: 9262150 - DNA, 22 bp, Homo sapiens
cttgttttaaactgttgtggct

SEQ ID NO: 9262151 - DNA, 22 bp, Homo sapiens
cttgtttgattattgcctgagg

SEQ ID NO: 9262152 - DNA, 22 bp, Homo sapiens
ctttattagatgtagactttct

SEQ ID NO: 9262153 - DNA, 22 bp, Homo sapiens
ctttattagatgtagactttct

SEQ ID NO: 9262154 - DNA, 22 bp, Homo sapiens
ctttattagatgtagactttct

SEQ ID NO: 9262155 - DNA, 22 bp, Homo sapiens
ctttattgtccttcttaggtgg

SEQ ID NO: 9262156 - DNA, 22 bp, Homo sapiens
ctttattgtccttcttaggtgg

SEQ ID NO: 9262157 - DNA, 22 bp, Homo sapiens
ctttattgtccttcttaggtgg

SEQ ID NO: 9262158 - DNA, 22 bp, Homo sapiens
ctttattgtccttcttaggtgg

SEQ ID NO: 9262159 - DNA, 22 bp, Homo sapiens
ctttacttgctttgttacaaaa

SEQ ID NO: 9262160 - DNA, 22 bp, Homo sapiens
ctttacttctcaaaataaagca

SEQ ID NO: 9262161 - DNA, 22 bp, Homo sapiens
ctttattagatgtagactttct

SEQ ID NO: 9262162 - DNA, 22 bp, Homo sapiens
ctttacttcagcaagctttcct

SEQ ID NO: 9262163 - DNA, 22 bp, Homo sapiens
ctttactgccatgcatttataa

SEQ ID NO: 9262164 - DNA, 22 bp, Homo sapiens
ctttacttctcaaaataaagca

SEQ ID NO: 9262165 - DNA, 22 bp, Homo sapiens
ctttacattaatttctactgat

SEQ ID NO: 9262166 - DNA, 22 bp, Homo sapiens
ctttaccacaaggacagaactt

SEQ ID NO: 9262167 - DNA, 22 bp, Homo sapiens
cttctcctctgagtcctgggag

SEQ ID NO: 9262168 - DNA, 22 bp, Homo sapiens
cttctccctggcttctgcacac

SEQ ID NO: 9262169 - DNA, 22 bp, Homo sapiens
cttctccctggcttctgcacac

SEQ ID NO: 9262170 - DNA, 22 bp, Homo sapiens
cttctccagccacgcccactcc

SEQ ID NO: 9262171 - DNA, 17 bp, Homo sapiens
atctggaagctagctga

SEQ ID NO: 9262172 - DNA, 22 bp, Homo sapiens
atctttctatggtactttctcc

SEQ ID NO: 9262173 - DNA, 22 bp, Homo sapiens
atctttctatttctaaaaacta

SEQ ID NO: 9262174 - DNA, 22 bp, Homo sapiens
atctttcttatttgaagaaaga

SEQ ID NO: 9262175 - DNA, 22 bp, Homo sapiens
atctttctatttctaaaaacta

SEQ ID NO: 9262176 - DNA, 22 bp, Homo sapiens
atctttctccatatacatcttt

SEQ ID NO: 9262177 - DNA, 22 bp, Homo sapiens
atctttctctgcactatacaat

SEQ ID NO: 9262178 - DNA, 22 bp, Homo sapiens
atctttctctgcactatacaat

SEQ ID NO: 9262179 - DNA, 22 bp, Homo sapiens
cttctcctgtaagaagatcaaa

SEQ ID NO: 9262180 - DNA, 22 bp, Homo sapiens
atctttcagtttcataccaatt

SEQ ID NO: 9262181 - DNA, 22 bp, Homo sapiens
atctttcagtttcataccaatt

SEQ ID NO: 9262182 - DNA, 22 bp, Homo sapiens
atctttcatctctattatttga

SEQ ID NO: 9262183 - DNA, 22 bp, Homo sapiens
atctttcaatcaggaaaaatct

SEQ ID NO: 9262184 - DNA, 22 bp, Homo sapiens
atctttcaatcaggaaaaatct

SEQ ID NO: 9262185 - DNA, 22 bp, Homo sapiens
atctttcagggccatttgtatt

SEQ ID NO: 9262186 - DNA, 22 bp, Homo sapiens
atctttcagagctccatcaggg

SEQ ID NO: 9262187 - DNA, 22 bp, Homo sapiens
atctttcaatcaggaaaaatct

SEQ ID NO: 9262188 - DNA, 22 bp, Homo sapiens
ctttgcttctccaacctgctca

SEQ ID NO: 9262189 - DNA, 22 bp, Homo sapiens
ctttgcttgacactgtgattgt

SEQ ID NO: 9262190 - DNA, 20 bp, Homo sapiens
ctttgcctattctctgcctg

SEQ ID NO: 9262191 - DNA, 22 bp, Homo sapiens
ctttgcctcctagagcacgttc

SEQ ID NO: 9262192 - DNA, 19 bp, Homo sapiens
ctttgccaaaagaggccat

SEQ ID NO: 9262193 - DNA, 22 bp, Homo sapiens
ctttgccatgttgcctgcagaa

SEQ ID NO: 9262194 - DNA, 22 bp, Homo sapiens
ctttctttgcagtgagccagag

SEQ ID NO: 9262195 - DNA, 22 bp, Homo sapiens
ctttcaaaacgctctgtatgca

SEQ ID NO: 9262196 - DNA, 22 bp, Homo sapiens
ctttcaaaacgctctgtatgca

SEQ ID NO: 9262197 - DNA, 22 bp, Homo sapiens
ctttgggcaaagggccaattcg

SEQ ID NO: 9262198 - DNA, 22 bp, Homo sapiens
atgaattgaggaaaacagtcgt

SEQ ID NO: 9262199 - DNA, 22 bp, Homo sapiens
ctttggcttgccctggcagtac

SEQ ID NO: 9262200 - DNA, 22 bp, Homo sapiens
ctttggcttgccctggcagtac

SEQ ID NO: 9262201 - DNA, 22 bp, Homo sapiens
atgacacatttgtgctgttgaa

SEQ ID NO: 9262202 - DNA, 22 bp, Homo sapiens
atgacaccatattagcctagag

SEQ ID NO: 9262203 - DNA, 22 bp, Homo sapiens
atgacaatggacatagttaaaa

SEQ ID NO: 9262204 - DNA, 22 bp, Homo sapiens
atgacagaaggcctccctgaca

SEQ ID NO: 9262205 - DNA, 22 bp, Homo sapiens
atgacacccccacagcattgtt

SEQ ID NO: 9262206 - DNA, 22 bp, Homo sapiens
atgacactgtcctagtaaggaa

SEQ ID NO: 9262207 - DNA, 22 bp, Homo sapiens
ctttttataccgtgccagttga

SEQ ID NO: 9262208 - DNA, 18 bp, Homo sapiens
cttttgttttccctcctc

SEQ ID NO: 9262209 - DNA, 22 bp, Homo sapiens
cttttgttgcccttgtcgcagg

SEQ ID NO: 9262210 - DNA, 19 bp, Homo sapiens
atgacagagttgataagtg

SEQ ID NO: 9262211 - DNA, 22 bp, Homo sapiens
atgacagaggagtgcaggtgat

SEQ ID NO: 9262212 - DNA, 22 bp, Homo sapiens
ctttttatagctatgtcctatg

SEQ ID NO: 9262213 - DNA, 22 bp, Homo sapiens
ctttttatagctatgtcctatg

SEQ ID NO: 9262214 - DNA, 22 bp, Homo sapiens
ctttttatctcttaatgatgtt

SEQ ID NO: 9262215 - DNA, 22 bp, Homo sapiens
ctttttatctcttaatgatgtt

SEQ ID NO: 9262216 - DNA, 22 bp, Homo sapiens
ctttttatctcttaatgatgtt

SEQ ID NO: 9262217 - DNA, 22 bp, Homo sapiens
ctttttcattggctttaggaca

SEQ ID NO: 9262218 - DNA, 19 bp, Homo sapiens
ctttttcaccttctagaag

SEQ ID NO: 9262219 - DNA, 19 bp, Homo sapiens
ctttttcaccttctagaag

SEQ ID NO: 9262220 - DNA, 22 bp, Homo sapiens
ctttttcattggctttaggaca

SEQ ID NO: 9262221 - DNA, 22 bp, Homo sapiens
atgagcacactgataagcccct

SEQ ID NO: 9262222 - DNA, 22 bp, Homo sapiens
atgagaggtttcgtcagaggaa

SEQ ID NO: 9262223 - DNA, 18 bp, Homo sapiens
atgagaggtgtcagaaga

SEQ ID NO: 9262224 - DNA, 22 bp, Homo sapiens
atgacattgaatatgttaacta

SEQ ID NO: 9262225 - DNA, 22 bp, Homo sapiens
atgagactacctgtaatgtggc

SEQ ID NO: 9262226 - DNA, 22 bp, Homo sapiens
gaagctgaggtcaggtgggtgg

SEQ ID NO: 9262227 - DNA, 22 bp, Homo sapiens
gaagctgagctgaggcatgttg

SEQ ID NO: 9262228 - DNA, 22 bp, Homo sapiens
gaagctgacccaggagcgtgtg

SEQ ID NO: 9262229 - DNA, 22 bp, Homo sapiens
gaaggagctactaataagaggg

SEQ ID NO: 9262230 - DNA, 22 bp, Homo sapiens
gaaggaggcgttagccctagga

SEQ ID NO: 9262231 - DNA, 22 bp, Homo sapiens
gaaggaggcgttagccctagga

SEQ ID NO: 9262232 - DNA, 22 bp, Homo sapiens
gaagcctggtccagagctccca

SEQ ID NO: 9262233 - DNA, 22 bp, Homo sapiens
gaagcctggttcgctggccacc

SEQ ID NO: 9262234 - DNA, 22 bp, Homo sapiens
gaagcagcaagtataggacagg

SEQ ID NO: 9262235 - DNA, 22 bp, Homo sapiens
gaagcctggagaccagatgttg

SEQ ID NO: 9262236 - DNA, 22 bp, Homo sapiens
gaagcctttgcctaaaacatta

SEQ ID NO: 9262237 - DNA, 22 bp, Homo sapiens
gaagcgcggcgtcggcgtgggt

SEQ ID NO: 9262238 - DNA, 22 bp, Homo sapiens
atgcagtggcagctcctggtgt

SEQ ID NO: 9262239 - DNA, 20 bp, Homo sapiens
atgcagtcttgtggcaacta

SEQ ID NO: 9262240 - DNA, 22 bp, Homo sapiens
atgcagtggcagctcctggtgt

SEQ ID NO: 9262241 - DNA, 22 bp, Homo sapiens
atgcagtggcttcagtgtcagt

SEQ ID NO: 9262242 - DNA, 22 bp, Homo sapiens
atgcagtggcagctcctggtgt

SEQ ID NO: 9262243 - DNA, 22 bp, Homo sapiens
atgcagtctaagcatgtaaggg

SEQ ID NO: 9262244 - DNA, 22 bp, Homo sapiens
atgcagtccacaggccacagtg

SEQ ID NO: 9262245 - DNA, 22 bp, Homo sapiens
atgcagtgtttggaagcttaag

SEQ ID NO: 9262246 - DNA, 22 bp, Homo sapiens
atgcagttagcactacagaaga

SEQ ID NO: 9262247 - DNA, 22 bp, Homo sapiens
atgcagttagcagtagctcccc

SEQ ID NO: 9262248 - DNA, 22 bp, Homo sapiens
atgcagttatgtgagggcatga

SEQ ID NO: 9262249 - DNA, 22 bp, Homo sapiens
atgcagttccacaggcgcatgg

SEQ ID NO: 9262250 - DNA, 22 bp, Homo sapiens
atgcagttaggtaatagtctca

SEQ ID NO: 9262251 - DNA, 22 bp, Homo sapiens
atgcagttagtatacttccagt

SEQ ID NO: 9262252 - DNA, 22 bp, Homo sapiens
atgcagtacagataattctaca

SEQ ID NO: 9262253 - DNA, 22 bp, Homo sapiens
atgcagtacatacaaacactga

SEQ ID NO: 9262254 - DNA, 22 bp, Homo sapiens
atgcagtaaatgttctagtttg

SEQ ID NO: 9262255 - DNA, 22 bp, Homo sapiens
atgcagtaaaataggaggtaat

SEQ ID NO: 9262256 - DNA, 22 bp, Homo sapiens
atgcagtaaatgttaagaaaaa

SEQ ID NO: 9262257 - DNA, 22 bp, Homo sapiens
atgcagtactgatacatgccac

SEQ ID NO: 9262258 - DNA, 22 bp, Homo sapiens
atgcagtacagataattctaca

SEQ ID NO: 9262259 - DNA, 22 bp, Homo sapiens
atgcagtagataggcactttta

SEQ ID NO: 9262260 - DNA, 22 bp, Homo sapiens
atgcagtataaatcatttctgg

SEQ ID NO: 9262261 - DNA, 23 bp, Homo sapiens
atgcagtatatgtcagtagttta

SEQ ID NO: 9262262 - DNA, 22 bp, Homo sapiens
atgcagtcatggaatgctctca

SEQ ID NO: 9262263 - DNA, 22 bp, Homo sapiens
atgcagtccaagctctagagtt

SEQ ID NO: 9262264 - DNA, 22 bp, Homo sapiens
gaaggagggagcggcgcggatt

SEQ ID NO: 9262265 - DNA, 22 bp, Homo sapiens
gaaggagggtgcggatctgagc

SEQ ID NO: 9262266 - DNA, 22 bp, Homo sapiens
gaaggaggctccccaaagtctg

SEQ ID NO: 9262267 - DNA, 22 bp, Homo sapiens
gaaggagggagcggcgcggatt

SEQ ID NO: 9262268 - DNA, 22 bp, Homo sapiens
gaaggagggtgcggatctgagc

SEQ ID NO: 9262269 - DNA, 22 bp, Homo sapiens
gaaggaggtctgatacaatatg

SEQ ID NO: 9262270 - DNA, 22 bp, Homo sapiens
gaaggagggtgcggatctgagc

SEQ ID NO: 9262271 - DNA, 22 bp, Homo sapiens
gaaggcaacaccaggatgcact

SEQ ID NO: 9262272 - DNA, 22 bp, Homo sapiens
gaaggaggtgtcagttggactg

SEQ ID NO: 9262273 - DNA, 22 bp, Homo sapiens
gaaggaggtctgcattctacag

SEQ ID NO: 9262274 - DNA, 22 bp, Homo sapiens
gaaggatttgagattatcctag

SEQ ID NO: 9262275 - DNA, 22 bp, Homo sapiens
gaaggaggtgtcagttggactg

SEQ ID NO: 9262276 - DNA, 22 bp, Homo sapiens
atgatgttaccagtacttagag

SEQ ID NO: 9262277 - DNA, 22 bp, Homo sapiens
atgatgttattttcagaaacat

SEQ ID NO: 9262278 - DNA, 22 bp, Homo sapiens
atgatgttgataaattacttta

SEQ ID NO: 9262279 - DNA, 22 bp, Homo sapiens
atgatgttgataaattacttta

SEQ ID NO: 9262280 - DNA, 23 bp, Homo sapiens
gaagcagatgtctgagtaggcag

SEQ ID NO: 9262281 - DNA, 22 bp, Homo sapiens
atgatgttggtttaatttgagt

SEQ ID NO: 9262282 - DNA, 23 bp, Homo sapiens
gaagcagatgtctgagtaggcag

SEQ ID NO: 9262283 - DNA, 22 bp, Homo sapiens
atgatgtctggaggcatgctgt

SEQ ID NO: 9262284 - DNA, 22 bp, Homo sapiens
atgatgttaccagtacttagag

SEQ ID NO: 9262285 - DNA, 22 bp, Homo sapiens
atgatgttaccagtacttagag

SEQ ID NO: 9262286 - DNA, 22 bp, Homo sapiens
atgatgtccctaggcaggtagt

SEQ ID NO: 9262287 - DNA, 22 bp, Homo sapiens
gaagagcatttgcccaggctgt

SEQ ID NO: 9262288 - DNA, 21 bp, Homo sapiens
gaagagagtcctcatcctgag

SEQ ID NO: 9262289 - DNA, 22 bp, Homo sapiens
gaagagatgacaaaggagcatg

SEQ ID NO: 9262290 - DNA, 22 bp, Homo sapiens
gaagagctaaaggcacaggctt

SEQ ID NO: 9262291 - DNA, 22 bp, Homo sapiens
atgatggatgtcacagtctgta

SEQ ID NO: 9262292 - DNA, 22 bp, Homo sapiens
atgagccctggaggcatttttt

SEQ ID NO: 9262293 - DNA, 22 bp, Homo sapiens
atgagcccagggaattcctttc

SEQ ID NO: 9262294 - DNA, 22 bp, Homo sapiens
atgagctgggccatccagtgat

SEQ ID NO: 9262295 - DNA, 22 bp, Homo sapiens
atgagctgtaaggtggcttcct

SEQ ID NO: 9262296 - DNA, 22 bp, Homo sapiens
atgagctgtgggattccagagg

SEQ ID NO: 9262297 - DNA, 22 bp, Homo sapiens
atgagcatccagaacagtgcct

SEQ ID NO: 9262298 - DNA, 22 bp, Homo sapiens
atgagcagtaggttcatggctg

SEQ ID NO: 9262299 - DNA, 22 bp, Homo sapiens
gaagagagagccctggggtccg

SEQ ID NO: 9262300 - DNA, 22 bp, Homo sapiens
gaagagagccgcgggacatcag

SEQ ID NO: 9262301 - DNA, 22 bp, Homo sapiens
gaagagagccgcgggacatcag

SEQ ID NO: 9262302 - DNA, 22 bp, Homo sapiens
gaagtctgagtgggggccaggc

SEQ ID NO: 9262303 - DNA, 22 bp, Homo sapiens
gaagtctgctgctcaggagttt

SEQ ID NO: 9262304 - DNA, 22 bp, Homo sapiens
gaagtcagtcatctcctgtctc

SEQ ID NO: 9262305 - DNA, 22 bp, Homo sapiens
gaagtcagtcatctcctgtctc

SEQ ID NO: 9262306 - DNA, 22 bp, Homo sapiens
atgcagttgcaatggaggactc

SEQ ID NO: 9262307 - DNA, 18 bp, Homo sapiens
atgcagttggtactctca

SEQ ID NO: 9262308 - DNA, 22 bp, Homo sapiens
atgcagtttaaggcacaattag

SEQ ID NO: 9262309 - DNA, 22 bp, Homo sapiens
atgcagtttatctccaaatcat

SEQ ID NO: 9262310 - DNA, 22 bp, Homo sapiens
atgcagttttcaaagactattc

SEQ ID NO: 9262311 - DNA, 22 bp, Homo sapiens
atgcagttttaggggaagggtt

SEQ ID NO: 9262312 - DNA, 22 bp, Homo sapiens
atgcagtttgcttcgcagcagt

SEQ ID NO: 9262313 - DNA, 22 bp, Homo sapiens
atgcagttttaaatcatttcag

SEQ ID NO: 9262314 - DNA, 22 bp, Homo sapiens
gaatttcaagcagtgcaatgtt

SEQ ID NO: 9262315 - DNA, 22 bp, Homo sapiens
gaatttcacaaggtgaggataa

SEQ ID NO: 9262316 - DNA, 22 bp, Homo sapiens
gaatttcagaggtaacatcatc

SEQ ID NO: 9262317 - DNA, 22 bp, Homo sapiens
gaatttcaaagaggttaagagg

SEQ ID NO: 9262318 - DNA, 22 bp, Homo sapiens
gaatttcaaaagccagaacggg

SEQ ID NO: 9262319 - DNA, 22 bp, Homo sapiens
gaatttcaaagaggttaagagg

SEQ ID NO: 9262320 - DNA, 22 bp, Homo sapiens
atgccactgcacttcagcctgg

SEQ ID NO: 9262321 - DNA, 22 bp, Homo sapiens
gaatttatctacgttaagtatg

SEQ ID NO: 9262322 - DNA, 22 bp, Homo sapiens
atgccactgcactccagcctgg

SEQ ID NO: 9262323 - DNA, 22 bp, Homo sapiens
atgccactgcactccagcctgg

SEQ ID NO: 9262324 - DNA, 22 bp, Homo sapiens
atgccactgcactccagcctgg

SEQ ID NO: 9262325 - DNA, 22 bp, Homo sapiens
atgccactgcactccagcctgg

SEQ ID NO: 9262326 - DNA, 22 bp, Homo sapiens
atgccactgcactccagcctgg

SEQ ID NO: 9262327 - DNA, 22 bp, Homo sapiens
atgccactgcactccagcctag

SEQ ID NO: 9262328 - DNA, 22 bp, Homo sapiens
atgccactgcactccagcctag

SEQ ID NO: 9262329 - DNA, 22 bp, Homo sapiens
atgccactgcactccagcctag

SEQ ID NO: 9262330 - DNA, 22 bp, Homo sapiens
atgccactgcactccagcctag

SEQ ID NO: 9262331 - DNA, 22 bp, Homo sapiens
atgctaaatgttaatgttacct

SEQ ID NO: 9262332 - DNA, 22 bp, Homo sapiens
atgctaaatgttaatgttacct

SEQ ID NO: 9262333 - DNA, 22 bp, Homo sapiens
atgctaaattcagacagggtta

SEQ ID NO: 9262334 - DNA, 22 bp, Homo sapiens
atgctaaattcagacagggtta

SEQ ID NO: 9262335 - DNA, 22 bp, Homo sapiens
atgctaaggcccaggagaaaat

SEQ ID NO: 9262336 - DNA, 22 bp, Homo sapiens
atgctaatgagctaaggagtcc

SEQ ID NO: 9262337 - DNA, 22 bp, Homo sapiens
atgctaaactatgatcattttc

SEQ ID NO: 9262338 - DNA, 22 bp, Homo sapiens
atgctaaatgctgggggtacat

SEQ ID NO: 9262339 - DNA, 22 bp, Homo sapiens
atgctaaatgctgggggtacat

SEQ ID NO: 9262340 - DNA, 22 bp, Homo sapiens
atgctaaatggccagtaccaaa

SEQ ID NO: 9262341 - DNA, 22 bp, Homo sapiens
atgctaaatggccagtaccaaa

SEQ ID NO: 9262342 - DNA, 22 bp, Homo sapiens
atgctaaaggggtaggcctcct

SEQ ID NO: 9262343 - DNA, 22 bp, Homo sapiens
atgctaaaggggtaggcctcct

SEQ ID NO: 9262344 - DNA, 22 bp, Homo sapiens
atgctaaagctttgctttcatt

SEQ ID NO: 9262345 - DNA, 22 bp, Homo sapiens
atgctaaataactggtttgact

SEQ ID NO: 9262346 - DNA, 22 bp, Homo sapiens
atgctaaataactggtttgact

SEQ ID NO: 9262347 - DNA, 22 bp, Homo sapiens
atgctaaatccagaagcagtca

SEQ ID NO: 9262348 - DNA, 22 bp, Homo sapiens
atgctaaatccagaagcagtca

SEQ ID NO: 9262349 - DNA, 22 bp, Homo sapiens
gaattttaataaaggtttatca

SEQ ID NO: 9262350 - DNA, 22 bp, Homo sapiens
gaattttaagtgttcgcctctt

SEQ ID NO: 9262351 - DNA, 22 bp, Homo sapiens
gaattttaagtgttcgcctctt

SEQ ID NO: 9262352 - DNA, 22 bp, Homo sapiens
gaatttgctttcgtgacagggt

SEQ ID NO: 9262353 - DNA, 22 bp, Homo sapiens
gaattttagaatatgtgggctt

SEQ ID NO: 9262354 - DNA, 22 bp, Homo sapiens
atgcctggactgtatcccagat

SEQ ID NO: 9262355 - DNA, 22 bp, Homo sapiens
gaatttgcaggtgtgctgtgta

SEQ ID NO: 9262356 - DNA, 22 bp, Homo sapiens
atgctatcttcagcacctaggg

SEQ ID NO: 9262357 - DNA, 22 bp, Homo sapiens
gacagcttaggaagtttctatt

SEQ ID NO: 9262358 - DNA, 22 bp, Homo sapiens
gacagcttagtgaaaatgtaaa

SEQ ID NO: 9262359 - DNA, 22 bp, Homo sapiens
gacagcttcgaggaggtgagct

SEQ ID NO: 9262360 - DNA, 22 bp, Homo sapiens
atgctacatagatacaaaaatg

SEQ ID NO: 9262361 - DNA, 20 bp, Homo sapiens
gacagcttggggtgtcacct

SEQ ID NO: 9262362 - DNA, 22 bp, Homo sapiens
gacagcttctagaaatggtcac

SEQ ID NO: 9262363 - DNA, 22 bp, Homo sapiens
gacagcttctatgtgacgagca

SEQ ID NO: 9262364 - DNA, 22 bp, Homo sapiens
gacagcttctagaggaattggt

SEQ ID NO: 9262365 - DNA, 22 bp, Homo sapiens
gacagcttcttgggccgggcct

SEQ ID NO: 9262366 - DNA, 22 bp, Homo sapiens
gacagcttgcctggtactgcaa

SEQ ID NO: 9262367 - DNA, 22 bp, Homo sapiens
cagccctctgaagaggcgcttg

SEQ ID NO: 9262368 - DNA, 22 bp, Homo sapiens
cagccctctgaagaggcgcttg

SEQ ID NO: 9262369 - DNA, 19 bp, Homo sapiens
cagccctcttaccactgtg

SEQ ID NO: 9262370 - DNA, 22 bp, Homo sapiens
cagccctcctttcactcccagg

SEQ ID NO: 9262371 - DNA, 22 bp, Homo sapiens
cagccctcctaccctgccaggc

SEQ ID NO: 9262372 - DNA, 22 bp, Homo sapiens
cagccctcctaccctgccaggc

SEQ ID NO: 9262373 - DNA, 23 bp, Homo sapiens
gtgagcagcaccatgaggctaga

SEQ ID NO: 9262374 - DNA, 18 bp, Homo sapiens
gtgagcagagagcatcac

SEQ ID NO: 9262375 - DNA, 22 bp, Homo sapiens
cagccctcatctcagcttcttt

SEQ ID NO: 9262376 - DNA, 22 bp, Homo sapiens
gtgagcagaacaggtggcttct

SEQ ID NO: 9262377 - DNA, 18 bp, Homo sapiens
gtgagcagagagcatcac

SEQ ID NO: 9262378 - DNA, 18 bp, Homo sapiens
gtgagcagagagcatcac

SEQ ID NO: 9262379 - DNA, 22 bp, Homo sapiens
gtgagcaattcaaaggcaggaa

SEQ ID NO: 9262380 - DNA, 22 bp, Homo sapiens
gtgagagtgtttggaaatagaa

SEQ ID NO: 9262381 - DNA, 22 bp, Homo sapiens
gtcctggtataattgtttaaaa

SEQ ID NO: 9262382 - DNA, 22 bp, Homo sapiens
gtcctggtcctgcctccccatg

SEQ ID NO: 9262383 - DNA, 22 bp, Homo sapiens
gtcctggtgctggtcattgtcg

SEQ ID NO: 9262384 - DNA, 22 bp, Homo sapiens
gtcctgtcccccaaggctgtgg

SEQ ID NO: 9262385 - DNA, 22 bp, Homo sapiens
gtcctgtcccccaaggctgtgg

SEQ ID NO: 9262386 - DNA, 22 bp, Homo sapiens
gtcctgtgatgagtaccaggtg

SEQ ID NO: 9262387 - DNA, 22 bp, Homo sapiens
gtcctgtgacctgcatcctgag

SEQ ID NO: 9262388 - DNA, 22 bp, Homo sapiens
gtcctgtgccgaggtgggaagc

SEQ ID NO: 9262389 - DNA, 22 bp, Homo sapiens
gtcctgtgccctgggtggcgct

SEQ ID NO: 9262390 - DNA, 22 bp, Homo sapiens
gtcctgtgcccagaccctctgt

SEQ ID NO: 9262391 - DNA, 22 bp, Homo sapiens
gtgaatttctgactaaaagtgc

SEQ ID NO: 9262392 - DNA, 22 bp, Homo sapiens
cagccctggtgccaaggttccc

SEQ ID NO: 9262393 - DNA, 22 bp, Homo sapiens
cagccctgtccagcagagggtg

SEQ ID NO: 9262394 - DNA, 22 bp, Homo sapiens
cagccctgtccagcagagggtg

SEQ ID NO: 9262395 - DNA, 22 bp, Homo sapiens
cagccctgtctatgactgatga

SEQ ID NO: 9262396 - DNA, 22 bp, Homo sapiens
cagccctgtccctgagggacct

SEQ ID NO: 9262397 - DNA, 22 bp, Homo sapiens
gtacacagatgcttgagaatct

SEQ ID NO: 9262398 - DNA, 22 bp, Homo sapiens
gtacacagatgcttgagaatct

SEQ ID NO: 9262399 - DNA, 22 bp, Homo sapiens
gtacacagagtggtggaagaaa

SEQ ID NO: 9262400 - DNA, 22 bp, Homo sapiens
gtacacagagtggtggaagaaa

SEQ ID NO: 9262401 - DNA, 22 bp, Homo sapiens
gtacacaggcagcccagtgctg

SEQ ID NO: 9262402 - DNA, 22 bp, Homo sapiens
gtacacaggcagcccagtgctg

SEQ ID NO: 9262403 - DNA, 22 bp, Homo sapiens
cagcagcctagggttccatcat

SEQ ID NO: 9262404 - DNA, 22 bp, Homo sapiens
gtacacttgactcataggaaat

SEQ ID NO: 9262405 - DNA, 22 bp, Homo sapiens
gtactaaacagagaaccaatat

SEQ ID NO: 9262406 - DNA, 22 bp, Homo sapiens
gtagaaaaagcagtaagtctca

SEQ ID NO: 9262407 - DNA, 20 bp, Homo sapiens
gtacttcaggtgtggtctga

SEQ ID NO: 9262408 - DNA, 22 bp, Homo sapiens
gtactttaaatcaatgtagatt

SEQ ID NO: 9262409 - DNA, 22 bp, Homo sapiens
gtactttaagactccagtagca

SEQ ID NO: 9262410 - DNA, 22 bp, Homo sapiens
gtactttagagtaaaatagacc

SEQ ID NO: 9262411 - DNA, 22 bp, Homo sapiens
gtaggcagtggttggaagagaa

SEQ ID NO: 9262412 - DNA, 22 bp, Homo sapiens
gtaggcagtggttggaagagaa

SEQ ID NO: 9262413 - DNA, 22 bp, Homo sapiens
gtaggcagtctctcaggtgatc

SEQ ID NO: 9262414 - DNA, 22 bp, Homo sapiens
gtaggcagtgcttgattttcca

SEQ ID NO: 9262415 - DNA, 22 bp, Homo sapiens
gtaggccagtgtgaaacctggt

SEQ ID NO: 9262416 - DNA, 22 bp, Homo sapiens
gtaggctgtgtgaggctagaga

SEQ ID NO: 9262417 - DNA, 22 bp, Homo sapiens
gtaggcagggctgtggggagaa

SEQ ID NO: 9262418 - DNA, 22 bp, Homo sapiens
gtaggcagggctgtggggagaa

SEQ ID NO: 9262419 - DNA, 22 bp, Homo sapiens
gtaggcagtctctcaggtgatc

SEQ ID NO: 9262420 - DNA, 22 bp, Homo sapiens
gtaggcagtctctcaggtgatc

SEQ ID NO: 9262421 - DNA, 22 bp, Homo sapiens
gtaggcaggtggaggagtgaag

SEQ ID NO: 9262422 - DNA, 22 bp, Homo sapiens
cagcagcccacgcgtgctgtcc

SEQ ID NO: 9262423 - DNA, 22 bp, Homo sapiens
cagcagcctagaagctctacca

SEQ ID NO: 9262424 - DNA, 22 bp, Homo sapiens
cagcagcctacaatgcacagaa

SEQ ID NO: 9262425 - DNA, 22 bp, Homo sapiens
cagcagccatgtaccacactca

SEQ ID NO: 9262426 - DNA, 22 bp, Homo sapiens
cagcagccactagagggctcac

SEQ ID NO: 9262427 - DNA, 20 bp, Homo sapiens
cagcagccattctagtagta

SEQ ID NO: 9262428 - DNA, 20 bp, Homo sapiens
cagcagccattctagtagta

SEQ ID NO: 9262429 - DNA, 22 bp, Homo sapiens
cagcaaaggtagaagcacagga

SEQ ID NO: 9262430 - DNA, 22 bp, Homo sapiens
cagcagccactagagggctcac

SEQ ID NO: 9262431 - DNA, 22 bp, Homo sapiens
cagcaaaatttgaggattgcct

SEQ ID NO: 9262432 - DNA, 22 bp, Homo sapiens
cagcaaagcaggctcctagaac

SEQ ID NO: 9262433 - DNA, 22 bp, Homo sapiens
cagcaaaggggatgcgtcctaa

SEQ ID NO: 9262434 - DNA, 22 bp, Homo sapiens
cagatttaagatatttgtattg

SEQ ID NO: 9262435 - DNA, 22 bp, Homo sapiens
cagatttaggtcactagaattt

SEQ ID NO: 9262436 - DNA, 22 bp, Homo sapiens
cagattctcactgtattcaggt

SEQ ID NO: 9262437 - DNA, 22 bp, Homo sapiens
cagattccggtcatctctcctt

SEQ ID NO: 9262438 - DNA, 22 bp, Homo sapiens
cagattctccaggggctgcaga

SEQ ID NO: 9262439 - DNA, 22 bp, Homo sapiens
cagatttaagagataaacagtg

SEQ ID NO: 9262440 - DNA, 22 bp, Homo sapiens
cagattcttcattgccccattc

SEQ ID NO: 9262441 - DNA, 22 bp, Homo sapiens
cagccagaacctaggatgagct

SEQ ID NO: 9262442 - DNA, 22 bp, Homo sapiens
cagccagaacctaggatgagct

SEQ ID NO: 9262443 - DNA, 22 bp, Homo sapiens
cagccagaacctaggatgagct

SEQ ID NO: 9262444 - DNA, 22 bp, Homo sapiens
gtccagcaggatgcaagtgcca

SEQ ID NO: 9262445 - DNA, 22 bp, Homo sapiens
gtccagagtagtcgagtattct

SEQ ID NO: 9262446 - DNA, 22 bp, Homo sapiens
cagccagctgtcccaagtgcct

SEQ ID NO: 9262447 - DNA, 22 bp, Homo sapiens
cagccagcttcagatccaagcc

SEQ ID NO: 9262448 - DNA, 22 bp, Homo sapiens
cagccaggagctccccctgctc

SEQ ID NO: 9262449 - DNA, 22 bp, Homo sapiens
cagccaggagctccccctgctc

SEQ ID NO: 9262450 - DNA, 22 bp, Homo sapiens
cagccaggagcctctgcaacta

SEQ ID NO: 9262451 - DNA, 22 bp, Homo sapiens
cagccaggagcctctgcaacta

SEQ ID NO: 9262452 - DNA, 22 bp, Homo sapiens
cagccaggcccccgagtcgttg

SEQ ID NO: 9262453 - DNA, 22 bp, Homo sapiens
cagccaggcccagatcatgctg

SEQ ID NO: 9262454 - DNA, 22 bp, Homo sapiens
cagccaggcccagatcatgctg

SEQ ID NO: 9262455 - DNA, 22 bp, Homo sapiens
cagccaggatggagaactgttg

SEQ ID NO: 9262456 - DNA, 22 bp, Homo sapiens
gtccagagggctgcaggatgct

SEQ ID NO: 9262457 - DNA, 22 bp, Homo sapiens
gtccagagggctgcaggatgct

SEQ ID NO: 9262458 - DNA, 22 bp, Homo sapiens
gtccagagaggcaggaggctac

SEQ ID NO: 9262459 - DNA, 22 bp, Homo sapiens
cagcatctcctgtgcagaggga

SEQ ID NO: 9262460 - DNA, 22 bp, Homo sapiens
gtccagagaggcaggaggctac

SEQ ID NO: 9262461 - DNA, 22 bp, Homo sapiens
gtcagcaaaaaatttatgtgag

SEQ ID NO: 9262462 - DNA, 19 bp, Homo sapiens
gtcagcaccatggacaggg

SEQ ID NO: 9262463 - DNA, 22 bp, Homo sapiens
gtcagcacttttccgaggcaga

SEQ ID NO: 9262464 - DNA, 22 bp, Homo sapiens
gtcagcacctctttggggagct

SEQ ID NO: 9262465 - DNA, 22 bp, Homo sapiens
cagcatccctcaggggcctctg

SEQ ID NO: 9262466 - DNA, 22 bp, Homo sapiens
cagcagtgtctccagcatcaca

SEQ ID NO: 9262467 - DNA, 22 bp, Homo sapiens
cagcagtgtctccagcatcaca

SEQ ID NO: 9262468 - DNA, 22 bp, Homo sapiens
gtcacacagagccctgtgctca

SEQ ID NO: 9262469 - DNA, 21 bp, Homo sapiens
gtcacacaggcctggagctga

SEQ ID NO: 9262470 - DNA, 21 bp, Homo sapiens
gtcacacaggcctggagctga

SEQ ID NO: 9262471 - DNA, 22 bp, Homo sapiens
gtcacacaatagtaagtggtcc

SEQ ID NO: 9262472 - DNA, 22 bp, Homo sapiens
gtcacacagagccctgtgctca

SEQ ID NO: 9262473 - DNA, 22 bp, Homo sapiens
gtcacacacatttctttggtgc

SEQ ID NO: 9262474 - DNA, 22 bp, Homo sapiens
gtcacacaggttgaaatgcagt

SEQ ID NO: 9262475 - DNA, 22 bp, Homo sapiens
gtcacacagggcctccaaatca

SEQ ID NO: 9262476 - DNA, 21 bp, Homo sapiens
gtcacacaggcctggagctga

SEQ ID NO: 9262477 - DNA, 22 bp, Homo sapiens
gtagggacttgttttactagta

SEQ ID NO: 9262478 - DNA, 22 bp, Homo sapiens
gtattttacttacgcatgactt

SEQ ID NO: 9262479 - DNA, 22 bp, Homo sapiens
gtcagatctttggggatgctgt

SEQ ID NO: 9262480 - DNA, 22 bp, Homo sapiens
gtcacagatctcttgagtcaag

SEQ ID NO: 9262481 - DNA, 18 bp, Homo sapiens
gtcacagcagagaactgc

SEQ ID NO: 9262482 - DNA, 22 bp, Homo sapiens
gggaggcagtgctggaggctgg

SEQ ID NO: 9262483 - DNA, 22 bp, Homo sapiens
gggaggcagtgctggaggctgg

SEQ ID NO: 9262484 - DNA, 22 bp, Homo sapiens
gggaggagtgaagattcacctg

SEQ ID NO: 9262485 - DNA, 21 bp, Homo sapiens
gggagctggaaactgggtgac

SEQ ID NO: 9262486 - DNA, 21 bp, Homo sapiens
gggagctggaaactgggtgac

SEQ ID NO: 9262487 - DNA, 22 bp, Homo sapiens
cagacacttattgagcaagtac

SEQ ID NO: 9262488 - DNA, 22 bp, Homo sapiens
cagacactgcagcagtctccca

SEQ ID NO: 9262489 - DNA, 22 bp, Homo sapiens
gggagccaaggagagaggcctt

SEQ ID NO: 9262490 - DNA, 22 bp, Homo sapiens
cagacacaccaggcccattctg

SEQ ID NO: 9262491 - DNA, 22 bp, Homo sapiens
cagacacaccaggcccattctg

SEQ ID NO: 9262492 - DNA, 22 bp, Homo sapiens
cagacacagatatgcatatggc

SEQ ID NO: 9262493 - DNA, 22 bp, Homo sapiens
cagacacagatatgcatatggc

SEQ ID NO: 9262494 - DNA, 22 bp, Homo sapiens
cagacactaggtgacagagtgc

SEQ ID NO: 9262495 - DNA, 22 bp, Homo sapiens
cagacactattgtgtataaatc

SEQ ID NO: 9262496 - DNA, 18 bp, Homo sapiens
cagacactctgctctgca

SEQ ID NO: 9262497 - DNA, 22 bp, Homo sapiens
cagacactatgctaaggtacta

SEQ ID NO: 9262498 - DNA, 22 bp, Homo sapiens
cagacactattgtgtataaatc

SEQ ID NO: 9262499 - DNA, 22 bp, Homo sapiens
cagaaacaggcaacgtgtgcac

SEQ ID NO: 9262500 - DNA, 22 bp, Homo sapiens
cagaaacagagaaatattggct

SEQ ID NO: 9262501 - DNA, 22 bp, Homo sapiens
cagaaacagacatgacgcagta

SEQ ID NO: 9262502 - DNA, 22 bp, Homo sapiens
cagaaacagagaaatattggct

SEQ ID NO: 9262503 - DNA, 22 bp, Homo sapiens
cagaaacacttgtagagaagtt

SEQ ID NO: 9262504 - DNA, 22 bp, Homo sapiens
cagaattatagttgctttttaa

SEQ ID NO: 9262505 - DNA, 22 bp, Homo sapiens
cagaatttaagtggattattct

SEQ ID NO: 9262506 - DNA, 22 bp, Homo sapiens
cagaataaaggtacaattgagt

SEQ ID NO: 9262507 - DNA, 22 bp, Homo sapiens
cagaatttagcacaatgtatgg

SEQ ID NO: 9262508 - DNA, 22 bp, Homo sapiens
cagaatttagaaaacaacataa

SEQ ID NO: 9262509 - DNA, 22 bp, Homo sapiens
cagaatttgaagtaatattcca

SEQ ID NO: 9262510 - DNA, 22 bp, Homo sapiens
cagaaacacttgtagagaagtt

SEQ ID NO: 9262511 - DNA, 22 bp, Homo sapiens
cagaaacacttgtagagaagtt

SEQ ID NO: 9262512 - DNA, 22 bp, Homo sapiens
cagaaacacttgtagagaagtt

SEQ ID NO: 9262513 - DNA, 22 bp, Homo sapiens
cagaaacacttgtagagaagtt

SEQ ID NO: 9262514 - DNA, 22 bp, Homo sapiens
cagaaaatagagtttctctgag

SEQ ID NO: 9262515 - DNA, 22 bp, Homo sapiens
cagaaacactgtatttagggaa

SEQ ID NO: 9262516 - DNA, 22 bp, Homo sapiens
ggctggcactgaggagagctct

SEQ ID NO: 9262517 - DNA, 19 bp, Homo sapiens
ggctggcaagtgacagtgt

SEQ ID NO: 9262518 - DNA, 22 bp, Homo sapiens
ggctggcacctgccctccgctg

SEQ ID NO: 9262519 - DNA, 18 bp, Homo sapiens
cagagcagaggtggagcg

SEQ ID NO: 9262520 - DNA, 22 bp, Homo sapiens
gggcaggggtcagtggccccaa

SEQ ID NO: 9262521 - DNA, 22 bp, Homo sapiens
cagagcagacgttgagattaag

SEQ ID NO: 9262522 - DNA, 22 bp, Homo sapiens
cagagcagacgttgagattaag

SEQ ID NO: 9262523 - DNA, 22 bp, Homo sapiens
cagagcagtgaggagttgtgta

SEQ ID NO: 9262524 - DNA, 22 bp, Homo sapiens
cagagcaggcccactgccctcc

SEQ ID NO: 9262525 - DNA, 22 bp, Homo sapiens
cagagcaggggtttcccaggtt

SEQ ID NO: 9262526 - DNA, 22 bp, Homo sapiens
cagagcaggcccactgccctcc

SEQ ID NO: 9262527 - DNA, 22 bp, Homo sapiens
gggcaggtacaagatgcttctt

SEQ ID NO: 9262528 - DNA, 22 bp, Homo sapiens
cagagcagtggagagtaggtct

SEQ ID NO: 9262529 - DNA, 22 bp, Homo sapiens
cagagcagtgaggagttgtgta

SEQ ID NO: 9262530 - DNA, 22 bp, Homo sapiens
cagagcagtggggttggtcaga

SEQ ID NO: 9262531 - DNA, 22 bp, Homo sapiens
cagagcataattgacatgaggt

SEQ ID NO: 9262532 - DNA, 19 bp, Homo sapiens
cagagcagtggttcctgaa

SEQ ID NO: 9262533 - DNA, 20 bp, Homo sapiens
cagagccaagagcagcatct

SEQ ID NO: 9262534 - DNA, 22 bp, Homo sapiens
cagagaactccagtggctggcg

SEQ ID NO: 9262535 - DNA, 22 bp, Homo sapiens
cagacttgacggcagctgcttt

SEQ ID NO: 9262536 - DNA, 22 bp, Homo sapiens
cagagacacttaacaggaatgg

SEQ ID NO: 9262537 - DNA, 22 bp, Homo sapiens
cagagcactgcttggaggattt

SEQ ID NO: 9262538 - DNA, 22 bp, Homo sapiens
cagagcactgcttggaggattt

SEQ ID NO: 9262539 - DNA, 22 bp, Homo sapiens
gggatgagagtagggtgtgaaa

SEQ ID NO: 9262540 - DNA, 22 bp, Homo sapiens
cagagcagaaacctgggtgatt

SEQ ID NO: 9262541 - DNA, 22 bp, Homo sapiens
cagagcagaaacctgggtgatt

SEQ ID NO: 9262542 - DNA, 22 bp, Homo sapiens
gggatgaattgagtcagaaggg

SEQ ID NO: 9262543 - DNA, 22 bp, Homo sapiens
gggatgagagctgggacagaag

SEQ ID NO: 9262544 - DNA, 22 bp, Homo sapiens
gggctgtaggagctggaatggg

SEQ ID NO: 9262545 - DNA, 22 bp, Homo sapiens
gggctgtaggagctggaatggg

SEQ ID NO: 9262546 - DNA, 22 bp, Homo sapiens
gggctggaggtgagcaggacag

SEQ ID NO: 9262547 - DNA, 22 bp, Homo sapiens
gggctggaggtgagcaggacag

SEQ ID NO: 9262548 - DNA, 22 bp, Homo sapiens
gggctggaggtgagcaggacag

SEQ ID NO: 9262549 - DNA, 19 bp, Homo sapiens
gggctggagggatagagcc

SEQ ID NO: 9262550 - DNA, 22 bp, Homo sapiens
gggctggaggtgagcaggacag

SEQ ID NO: 9262551 - DNA, 22 bp, Homo sapiens
gggctggaggtgagcaggacag

SEQ ID NO: 9262552 - DNA, 22 bp, Homo sapiens
gggctggaggagatccagaggc

SEQ ID NO: 9262553 - DNA, 22 bp, Homo sapiens
gggctggaggagatccagaggc

SEQ ID NO: 9262554 - DNA, 22 bp, Homo sapiens
gggctggaggagatccagaggc

SEQ ID NO: 9262555 - DNA, 22 bp, Homo sapiens
gggctggaggcctgcctggtta

SEQ ID NO: 9262556 - DNA, 21 bp, Homo sapiens
gggctggaggatgggaagccc

SEQ ID NO: 9262557 - DNA, 22 bp, Homo sapiens
cagagccagcagtggggacagg

SEQ ID NO: 9262558 - DNA, 22 bp, Homo sapiens
gggctgagtgggcctcttactt

SEQ ID NO: 9262559 - DNA, 22 bp, Homo sapiens
gggctgagtgggcctcttactt

SEQ ID NO: 9262560 - DNA, 22 bp, Homo sapiens
cagagccactgtctgccaggca

SEQ ID NO: 9262561 - DNA, 22 bp, Homo sapiens
ggggcagaagtagtgcccctga

SEQ ID NO: 9262562 - DNA, 22 bp, Homo sapiens
ggggcagaagtagtgcccctga

SEQ ID NO: 9262563 - DNA, 22 bp, Homo sapiens
ggggcagagagaaggaagcttg

SEQ ID NO: 9262564 - DNA, 22 bp, Homo sapiens
ggggcagagaataaaaacctaa

SEQ ID NO: 9262565 - DNA, 22 bp, Homo sapiens
ggggcagagtagctggggtgtg

SEQ ID NO: 9262566 - DNA, 21 bp, Homo sapiens
ggggcagagctaggccctgca

SEQ ID NO: 9262567 - DNA, 22 bp, Homo sapiens
ggggcagagagaaggaagcttg

SEQ ID NO: 9262568 - DNA, 22 bp, Homo sapiens
ggggcagagcatagctccaatt

SEQ ID NO: 9262569 - DNA, 21 bp, Homo sapiens
ggggcctctccacacagccgg

SEQ ID NO: 9262570 - DNA, 23 bp, Homo sapiens
ggggcctgcaccggtctgcgcgg

SEQ ID NO: 9262571 - DNA, 22 bp, Homo sapiens
ggggcagatggaacagagcaca

SEQ ID NO: 9262572 - DNA, 22 bp, Homo sapiens
ggggcagctaccggaagtaggg

SEQ ID NO: 9262573 - DNA, 22 bp, Homo sapiens
ggggcagatggaacagagcaca

SEQ ID NO: 9262574 - DNA, 22 bp, Homo sapiens
gggtaattggggccttgcagtg

SEQ ID NO: 9262575 - DNA, 20 bp, Homo sapiens
ggggttggctggcacaggga

SEQ ID NO: 9262576 - DNA, 22 bp, Homo sapiens
ggggttggtttaaatgcttgag

SEQ ID NO: 9262577 - DNA, 22 bp, Homo sapiens
gggtaaatctcttttcatggct

SEQ ID NO: 9262578 - DNA, 22 bp, Homo sapiens
ggggtgagctgggcctgtgcct

SEQ ID NO: 9262579 - DNA, 22 bp, Homo sapiens
ggggccttttctgaatgtggaa

SEQ ID NO: 9262580 - DNA, 22 bp, Homo sapiens
ggggtgagtgctcagccccgga

SEQ ID NO: 9262581 - DNA, 22 bp, Homo sapiens
ggggcctgtagagcttcaggga

SEQ ID NO: 9262582 - DNA, 22 bp, Homo sapiens
ggggcctgtagagcttcaggga

SEQ ID NO: 9262583 - DNA, 22 bp, Homo sapiens
ggggcctgtagagcttcaggga

SEQ ID NO: 9262584 - DNA, 19 bp, Homo sapiens
ggggcctgtgatggtcaca

SEQ ID NO: 9262585 - DNA, 22 bp, Homo sapiens
cagatgctaagttatcagcagg

SEQ ID NO: 9262586 - DNA, 22 bp, Homo sapiens
cagatgcagcaaaatgacaggc

SEQ ID NO: 9262587 - DNA, 22 bp, Homo sapiens
ggtcctggaaattgacggaaag

SEQ ID NO: 9262588 - DNA, 20 bp, Homo sapiens
cagatggcacgtcagggcat

SEQ ID NO: 9262589 - DNA, 23 bp, Homo sapiens
cagatgaggttggcagcatggtc

SEQ ID NO: 9262590 - DNA, 22 bp, Homo sapiens
cagatgagcatgggcacaagca

SEQ ID NO: 9262591 - DNA, 18 bp, Homo sapiens
cagatgagatgcaatctc

SEQ ID NO: 9262592 - DNA, 22 bp, Homo sapiens
ggtcaacactgtgaccaacagg

SEQ ID NO: 9262593 - DNA, 20 bp, Homo sapiens
gggtcctgacttggtctcct

SEQ ID NO: 9262594 - DNA, 20 bp, Homo sapiens
gggtcctgacttggtctcct

SEQ ID NO: 9262595 - DNA, 22 bp, Homo sapiens
gggtccctggaattacttgaca

SEQ ID NO: 9262596 - DNA, 22 bp, Homo sapiens
gggtcctgcgtgggcccaggac

SEQ ID NO: 9262597 - DNA, 18 bp, Homo sapiens
gggtcctgtgggagacag

SEQ ID NO: 9262598 - DNA, 22 bp, Homo sapiens
gggtccaggtcttcaggcagag

SEQ ID NO: 9262599 - DNA, 22 bp, Homo sapiens
gggtccaggtcttcaggcagag

SEQ ID NO: 9262600 - DNA, 22 bp, Homo sapiens
gggtcccaggaaggagcagtgt

SEQ ID NO: 9262601 - DNA, 22 bp, Homo sapiens
gggtcccaggaaggagcagtgt

SEQ ID NO: 9262602 - DNA, 22 bp, Homo sapiens
gggtccagtttcatctgaggtt

SEQ ID NO: 9262603 - DNA, 19 bp, Homo sapiens
gggtcccaaaagatgtgct

SEQ ID NO: 9262604 - DNA, 22 bp, Homo sapiens
gggtaggaaatccagaggtggc

SEQ ID NO: 9262605 - DNA, 22 bp, Homo sapiens
gggtaggaaatccagaggtggc

SEQ ID NO: 9262606 - DNA, 22 bp, Homo sapiens
gggttaggtccctcccttctgg

SEQ ID NO: 9262607 - DNA, 22 bp, Homo sapiens
gggttactgcttcaaaaaatta

SEQ ID NO: 9262608 - DNA, 22 bp, Homo sapiens
gggttaaagcaggaagcatctt

SEQ ID NO: 9262609 - DNA, 22 bp, Homo sapiens
gggttaaaacaggaagatcagc

SEQ ID NO: 9262610 - DNA, 22 bp, Homo sapiens
gggtgtgttcctaaggaaacca

SEQ ID NO: 9262611 - DNA, 22 bp, Homo sapiens
gggtgtgtcttttgctcctgga

SEQ ID NO: 9262612 - DNA, 20 bp, Homo sapiens
gggtgtgggcccggccaggc

SEQ ID NO: 9262613 - DNA, 22 bp, Homo sapiens
ggtagtcatggatagctatgag

SEQ ID NO: 9262614 - DNA, 22 bp, Homo sapiens
ggtagtgaggtgaaagagaggt

SEQ ID NO: 9262615 - DNA, 19 bp, Homo sapiens
ggtatatgggcctcacttg

SEQ ID NO: 9262616 - DNA, 22 bp, Homo sapiens
ggtatacaagagcaatttaggg

SEQ ID NO: 9262617 - DNA, 22 bp, Homo sapiens
cacagggttgttctgaggattc

SEQ ID NO: 9262618 - DNA, 22 bp, Homo sapiens
cacaggggcaaactgtagggga

SEQ ID NO: 9262619 - DNA, 22 bp, Homo sapiens
cacagggctttgatggctgagt

SEQ ID NO: 9262620 - DNA, 22 bp, Homo sapiens
cacaggcctggggttgagcggg

SEQ ID NO: 9262621 - DNA, 20 bp, Homo sapiens
cacaggccttgtgagcagac

SEQ ID NO: 9262622 - DNA, 22 bp, Homo sapiens
cacaggccagtaagactgtgtt

SEQ ID NO: 9262623 - DNA, 22 bp, Homo sapiens
cacaggccagtaagactgtgtt

SEQ ID NO: 9262624 - DNA, 20 bp, Homo sapiens
cacaggccccaagacctgta

SEQ ID NO: 9262625 - DNA, 22 bp, Homo sapiens
cacaggccagtaagactgtgtt

SEQ ID NO: 9262626 - DNA, 22 bp, Homo sapiens
cacaggagtgctgctattgttg

SEQ ID NO: 9262627 - DNA, 22 bp, Homo sapiens
ggagagcctgtgcagccgggtt

SEQ ID NO: 9262628 - DNA, 22 bp, Homo sapiens
ggagagctagtgcctgccagta

SEQ ID NO: 9262629 - DNA, 22 bp, Homo sapiens
cacaggcaggaggttctccagt

SEQ ID NO: 9262630 - DNA, 18 bp, Homo sapiens
cacaggcaggtgataggt

SEQ ID NO: 9262631 - DNA, 22 bp, Homo sapiens
cacaggcagccttgtagaagaa

SEQ ID NO: 9262632 - DNA, 22 bp, Homo sapiens
cacaggcacgcctctggccagg

SEQ ID NO: 9262633 - DNA, 23 bp, Homo sapiens
cacaggcagaaatcaagacggta

SEQ ID NO: 9262634 - DNA, 22 bp, Homo sapiens
cacaggcacccctgactgctca

SEQ ID NO: 9262635 - DNA, 21 bp, Homo sapiens
cacaggtgggtcagtgaggcc

SEQ ID NO: 9262636 - DNA, 22 bp, Homo sapiens
cacaggtgtatgaatatgtcca

SEQ ID NO: 9262637 - DNA, 22 bp, Homo sapiens
cacagtaagaaatgaagaggta

SEQ ID NO: 9262638 - DNA, 22 bp, Homo sapiens
cacagtctctgttgctgggacc

SEQ ID NO: 9262639 - DNA, 22 bp, Homo sapiens
cacagtaaggtatcccagtgaa

SEQ ID NO: 9262640 - DNA, 19 bp, Homo sapiens
cacagtgcagccatttctc

SEQ ID NO: 9262641 - DNA, 22 bp, Homo sapiens
cacagtgactggcacatagtaa

SEQ ID NO: 9262642 - DNA, 22 bp, Homo sapiens
ggcaagggttgaagataaggta

SEQ ID NO: 9262643 - DNA, 22 bp, Homo sapiens
ggcaagtggtagaacatctgag

SEQ ID NO: 9262644 - DNA, 22 bp, Homo sapiens
ggcaaggggtcaggctgagaca

SEQ ID NO: 9262645 - DNA, 22 bp, Homo sapiens
ggcaagggacggccgtgagaca

SEQ ID NO: 9262646 - DNA, 22 bp, Homo sapiens
cacagtgcatgatgggcagaag

SEQ ID NO: 9262647 - DNA, 22 bp, Homo sapiens
cacatgaagagagtctagtaat

SEQ ID NO: 9262648 - DNA, 22 bp, Homo sapiens
ggcaattacgtattagtcatgt

SEQ ID NO: 9262649 - DNA, 22 bp, Homo sapiens
cacatgaccactctttacttct

SEQ ID NO: 9262650 - DNA, 22 bp, Homo sapiens
cacatgaaggctggggtcgtga

SEQ ID NO: 9262651 - DNA, 22 bp, Homo sapiens
cacatgaattgatgccaagtgc

SEQ ID NO: 9262652 - DNA, 22 bp, Homo sapiens
ggcagaggtgacagtgtctttt

SEQ ID NO: 9262653 - DNA, 22 bp, Homo sapiens
ggcagaggtgacagtgtctttt

SEQ ID NO: 9262654 - DNA, 22 bp, Homo sapiens
cacatgagtcctgccaggtatg

SEQ ID NO: 9262655 - DNA, 22 bp, Homo sapiens
cacatgatggtggaagccatag

SEQ ID NO: 9262656 - DNA, 22 bp, Homo sapiens
ggcagagtgctctgggcagggg

SEQ ID NO: 9262657 - DNA, 22 bp, Homo sapiens
ggcagagtgctctgggcagggg

SEQ ID NO: 9262658 - DNA, 22 bp, Homo sapiens
ggcagagttggtggagtcagtt

SEQ ID NO: 9262659 - DNA, 20 bp, Homo sapiens
cacatgctgtgtgtttctct

SEQ ID NO: 9262660 - DNA, 22 bp, Homo sapiens
cacatgctccatacagaatggg

SEQ ID NO: 9262661 - DNA, 22 bp, Homo sapiens
cacatgtttggcatgtcaccaa

SEQ ID NO: 9262662 - DNA, 22 bp, Homo sapiens
cacatgtttggcatgtcaccaa

SEQ ID NO: 9262663 - DNA, 22 bp, Homo sapiens
cacatgtttttggccatcatgg

SEQ ID NO: 9262664 - DNA, 22 bp, Homo sapiens
cacattcacatttttccctcta

SEQ ID NO: 9262665 - DNA, 22 bp, Homo sapiens
cacattcacttctctgtccacc

SEQ ID NO: 9262666 - DNA, 22 bp, Homo sapiens
cacattcaggattttccatgtc

SEQ ID NO: 9262667 - DNA, 22 bp, Homo sapiens
cacatgtgtgctgaggactgtg

SEQ ID NO: 9262668 - DNA, 22 bp, Homo sapiens
cacatgcttagatttcagtgga

SEQ ID NO: 9262669 - DNA, 22 bp, Homo sapiens
caccaggaccccacggtgggtt

SEQ ID NO: 9262670 - DNA, 22 bp, Homo sapiens
caccagctttgcccactgccca

SEQ ID NO: 9262671 - DNA, 22 bp, Homo sapiens
caccagctttgcccactgccca

SEQ ID NO: 9262672 - DNA, 22 bp, Homo sapiens
caccaggagcatctaggaggcg

SEQ ID NO: 9262673 - DNA, 22 bp, Homo sapiens
caccaggagcatctaggaggcg

SEQ ID NO: 9262674 - DNA, 22 bp, Homo sapiens
caccaggagccatcaggagtcc

SEQ ID NO: 9262675 - DNA, 22 bp, Homo sapiens
caccagctctccaccaggtttc

SEQ ID NO: 9262676 - DNA, 22 bp, Homo sapiens
caccagctccaccagggcaggt

SEQ ID NO: 9262677 - DNA, 22 bp, Homo sapiens
caccagctgcaacaccatctcc

SEQ ID NO: 9262678 - DNA, 22 bp, Homo sapiens
caccagcttacagtctcacccc

SEQ ID NO: 9262679 - DNA, 22 bp, Homo sapiens
caccagcttcccatcgcgggtc

SEQ ID NO: 9262680 - DNA, 22 bp, Homo sapiens
caccagcttacagtctcacccc

SEQ ID NO: 9262681 - DNA, 22 bp, Homo sapiens
caccagcttctcattgcgggtc

SEQ ID NO: 9262682 - DNA, 22 bp, Homo sapiens
caccagcttgggctgtggaaat

SEQ ID NO: 9262683 - DNA, 22 bp, Homo sapiens
caccagcttgcagtcttaaccc

SEQ ID NO: 9262684 - DNA, 22 bp, Homo sapiens
caccagctactcgggtttcctg

SEQ ID NO: 9262685 - DNA, 22 bp, Homo sapiens
caccagctactccagggccgtg

SEQ ID NO: 9262686 - DNA, 22 bp, Homo sapiens
caccagctccaccagggcaggt

SEQ ID NO: 9262687 - DNA, 22 bp, Homo sapiens
caccagctacagactactgtgt

SEQ ID NO: 9262688 - DNA, 22 bp, Homo sapiens
cacattcaggtggcatgttaga

SEQ ID NO: 9262689 - DNA, 22 bp, Homo sapiens
cacattcatggagtttgcctgt

SEQ ID NO: 9262690 - DNA, 22 bp, Homo sapiens
cactgtatcttttccaaagtct

SEQ ID NO: 9262691 - DNA, 22 bp, Homo sapiens
ggctctgcttcctggaattgtg

SEQ ID NO: 9262692 - DNA, 22 bp, Homo sapiens
cactgtccaatagatacataat

SEQ ID NO: 9262693 - DNA, 22 bp, Homo sapiens
cactgtcacgttctgaaactgt

SEQ ID NO: 9262694 - DNA, 22 bp, Homo sapiens
cactgtattattaggaatgaca

SEQ ID NO: 9262695 - DNA, 21 bp, Homo sapiens
cactgtatagcaggagaaaac

SEQ ID NO: 9262696 - DNA, 22 bp, Homo sapiens
cactgtactgtgaataaggagg

SEQ ID NO: 9262697 - DNA, 22 bp, Homo sapiens
cactgtactgtgaataaggagg

SEQ ID NO: 9262698 - DNA, 22 bp, Homo sapiens
cactggttgcctctttctgttc

SEQ ID NO: 9262699 - DNA, 22 bp, Homo sapiens
cactggttggctgagatccata

SEQ ID NO: 9262700 - DNA, 22 bp, Homo sapiens
cactggttttgctgataaggca

SEQ ID NO: 9262701 - DNA, 22 bp, Homo sapiens
cactgcactccagcctgggtca

SEQ ID NO: 9262702 - DNA, 22 bp, Homo sapiens
cactgcactccagcctgggtca

SEQ ID NO: 9262703 - DNA, 22 bp, Homo sapiens
cactgcactccagcctgggtca

SEQ ID NO: 9262704 - DNA, 22 bp, Homo sapiens
cactgcactccagcctgggtca

SEQ ID NO: 9262705 - DNA, 22 bp, Homo sapiens
cactgcactccagcctgggtga

SEQ ID NO: 9262706 - DNA, 22 bp, Homo sapiens
cactgcactccagcctgggtga

SEQ ID NO: 9262707 - DNA, 22 bp, Homo sapiens
cactgcactccagcctgggtga

SEQ ID NO: 9262708 - DNA, 22 bp, Homo sapiens
cactgcactccagcctgggtga

SEQ ID NO: 9262709 - DNA, 22 bp, Homo sapiens
cactgcactccagcttgggcaa

SEQ ID NO: 9262710 - DNA, 22 bp, Homo sapiens
cactgcactccagcttgggtga

SEQ ID NO: 9262711 - DNA, 22 bp, Homo sapiens
cactgcactccagcttgggtga

SEQ ID NO: 9262712 - DNA, 22 bp, Homo sapiens
cactgtgctccttccttagcac

SEQ ID NO: 9262713 - DNA, 20 bp, Homo sapiens
ggctctggaatctggtgggc

SEQ ID NO: 9262714 - DNA, 22 bp, Homo sapiens
ggctctggaaagtgtccttgat

SEQ ID NO: 9262715 - DNA, 22 bp, Homo sapiens
ggctctggaaagtgtccttgat

SEQ ID NO: 9262716 - DNA, 22 bp, Homo sapiens
ggctctggaaagtgtccttgat

SEQ ID NO: 9262717 - DNA, 20 bp, Homo sapiens
ggctctggaatctggtgggc

SEQ ID NO: 9262718 - DNA, 22 bp, Homo sapiens
cacttaaatgttcctacagcag

SEQ ID NO: 9262719 - DNA, 22 bp, Homo sapiens
cacttaaatctgttgagaaaaa

SEQ ID NO: 9262720 - DNA, 22 bp, Homo sapiens
cacttcattgggaccagggctg

SEQ ID NO: 9262721 - DNA, 19 bp, Homo sapiens
cacttcacatggtgaaagc

SEQ ID NO: 9262722 - DNA, 22 bp, Homo sapiens
cacttcaaggaatatctagaaa

SEQ ID NO: 9262723 - DNA, 17 bp, Homo sapiens
ggctgctgtgctggtgc

SEQ ID NO: 9262724 - DNA, 17 bp, Homo sapiens
ggctgctgtgctggtgc

SEQ ID NO: 9262725 - DNA, 22 bp, Homo sapiens
cacttggtttgggagtacataa

SEQ ID NO: 9262726 - DNA, 21 bp, Homo sapiens
cactatttatatatgccagct

SEQ ID NO: 9262727 - DNA, 22 bp, Homo sapiens
cacggaaacacaggttataaga

SEQ ID NO: 9262728 - DNA, 19 bp, Homo sapiens
cactagtctagatgggatg

SEQ ID NO: 9262729 - DNA, 22 bp, Homo sapiens
cactagttcacaaaataggaaa

SEQ ID NO: 9262730 - DNA, 19 bp, Homo sapiens
cactagtctagatgggatg

SEQ ID NO: 9262731 - DNA, 22 bp, Homo sapiens
cacggccagggctgtgggtgcg

SEQ ID NO: 9262732 - DNA, 22 bp, Homo sapiens
cactagtcctggtttcatgcta

SEQ ID NO: 9262733 - DNA, 22 bp, Homo sapiens
cactgcactccagcctgggaga

SEQ ID NO: 9262734 - DNA, 22 bp, Homo sapiens
cactgcactccagcctgggaga

SEQ ID NO: 9262735 - DNA, 22 bp, Homo sapiens
cactgcactccagcctgggaga

SEQ ID NO: 9262736 - DNA, 22 bp, Homo sapiens
cactgcactccagcctgggaga

SEQ ID NO: 9262737 - DNA, 22 bp, Homo sapiens
cactgcactccagcctgggaga

SEQ ID NO: 9262738 - DNA, 22 bp, Homo sapiens
cactctgacacatgaacttgat

SEQ ID NO: 9262739 - DNA, 22 bp, Homo sapiens
cactgcaacctccacctcctgg

SEQ ID NO: 9262740 - DNA, 22 bp, Homo sapiens
cactgcactccagcctgggaga

SEQ ID NO: 9262741 - DNA, 22 bp, Homo sapiens
cactgcaacctccacctcctgg

SEQ ID NO: 9262742 - DNA, 22 bp, Homo sapiens
cactgcaacctccacctcctgg

SEQ ID NO: 9262743 - DNA, 22 bp, Homo sapiens
cactccctctagttgcattctg

SEQ ID NO: 9262744 - DNA, 22 bp, Homo sapiens
cactcccttcaggagcctagga

SEQ ID NO: 9262745 - DNA, 22 bp, Homo sapiens
cactccaggtcccagttcctgg

SEQ ID NO: 9262746 - DNA, 22 bp, Homo sapiens
cactcctgttccactaaatgag

SEQ ID NO: 9262747 - DNA, 23 bp, Homo sapiens
cactcctgtttctaagccagcat

SEQ ID NO: 9262748 - DNA, 22 bp, Homo sapiens
cacctgcctgcaggggctccac

SEQ ID NO: 9262749 - DNA, 22 bp, Homo sapiens
caccaggctggagtgcagaggt

SEQ ID NO: 9262750 - DNA, 22 bp, Homo sapiens
caccaggctggagtgcagaggt

SEQ ID NO: 9262751 - DNA, 22 bp, Homo sapiens
caccaggctggagtgcagaggt

SEQ ID NO: 9262752 - DNA, 22 bp, Homo sapiens
caccctgtacaaatggacatct

SEQ ID NO: 9262753 - DNA, 22 bp, Homo sapiens
caccaggctgaaccagagggga

SEQ ID NO: 9262754 - DNA, 22 bp, Homo sapiens
caccaggctgaaccagagggga

SEQ ID NO: 9262755 - DNA, 22 bp, Homo sapiens
caccaggctgcccaggacaggg

SEQ ID NO: 9262756 - DNA, 22 bp, Homo sapiens
caccaggctgcccaggacaggg

SEQ ID NO: 9262757 - DNA, 20 bp, Homo sapiens
caccaggcgctctgagaaca

SEQ ID NO: 9262758 - DNA, 22 bp, Homo sapiens
caccaggctgaaccagagggga

SEQ ID NO: 9262759 - DNA, 22 bp, Homo sapiens
cacctggcccagctccagtgct

SEQ ID NO: 9262760 - DNA, 22 bp, Homo sapiens
cacctgctccctcagttccagc

SEQ ID NO: 9262761 - DNA, 20 bp, Homo sapiens
cacctggctgactgtctcca

SEQ ID NO: 9262762 - DNA, 22 bp, Homo sapiens
cacctgggctaaactatgcagg

SEQ ID NO: 9262763 - DNA, 22 bp, Homo sapiens
cacctgggctaaactatgcagg

SEQ ID NO: 9262764 - DNA, 22 bp, Homo sapiens
ggccaggctggtctcagacttc

SEQ ID NO: 9262765 - DNA, 22 bp, Homo sapiens
ggccaggctggttccttgacct

SEQ ID NO: 9262766 - DNA, 22 bp, Homo sapiens
ggccaggctggttccttgacct

SEQ ID NO: 9262767 - DNA, 22 bp, Homo sapiens
ggccaggctgctgggaccccgc

SEQ ID NO: 9262768 - DNA, 22 bp, Homo sapiens
ggccaggctggtctcagacttc

SEQ ID NO: 9262769 - DNA, 22 bp, Homo sapiens
ggccaggctgccctgggagcag

SEQ ID NO: 9262770 - DNA, 22 bp, Homo sapiens
caagcccaggattccccagtta

SEQ ID NO: 9262771 - DNA, 20 bp, Homo sapiens
caagccctctttagcctgcc

SEQ ID NO: 9262772 - DNA, 22 bp, Homo sapiens
gctggctgagttctgtcgtctg

SEQ ID NO: 9262773 - DNA, 22 bp, Homo sapiens
gctggctcttcagtggagatag

SEQ ID NO: 9262774 - DNA, 22 bp, Homo sapiens
gctggcccagggtcacctagga

SEQ ID NO: 9262775 - DNA, 17 bp, Homo sapiens
gctggctgacccatgcc

SEQ ID NO: 9262776 - DNA, 22 bp, Homo sapiens
caagctgcagcgcctgcgccgg

SEQ ID NO: 9262777 - DNA, 22 bp, Homo sapiens
gctgggctcagacctagtgaac

SEQ ID NO: 9262778 - DNA, 22 bp, Homo sapiens
caagctccttacatccacaggg

SEQ ID NO: 9262779 - DNA, 22 bp, Homo sapiens
caagctccttacatccacaggg

SEQ ID NO: 9262780 - DNA, 22 bp, Homo sapiens
caagcctgtctcaccagtgcta

SEQ ID NO: 9262781 - DNA, 22 bp, Homo sapiens
gctggggagcaagagtagtgag

SEQ ID NO: 9262782 - DNA, 22 bp, Homo sapiens
gctggggactccccaccatagc

SEQ ID NO: 9262783 - DNA, 22 bp, Homo sapiens
gctggggagaattgggttatct

SEQ ID NO: 9262784 - DNA, 22 bp, Homo sapiens
gctggggagcaagagtagtgag

SEQ ID NO: 9262785 - DNA, 22 bp, Homo sapiens
gctggggagaattgggttatct

SEQ ID NO: 9262786 - DNA, 22 bp, Homo sapiens
gctgggcttgtggccagctggg

SEQ ID NO: 9262787 - DNA, 22 bp, Homo sapiens
gctggggaccagctgtctctga

SEQ ID NO: 9262788 - DNA, 19 bp, Homo sapiens
gctggggaatggatattga

SEQ ID NO: 9262789 - DNA, 22 bp, Homo sapiens
gctggagaaacaggaggaggaa

SEQ ID NO: 9262790 - DNA, 22 bp, Homo sapiens
caagaaggctatatgggccagg

SEQ ID NO: 9262791 - DNA, 20 bp, Homo sapiens
gctggaagggctagagggct

SEQ ID NO: 9262792 - DNA, 22 bp, Homo sapiens
gctggaattggacccagggctc

SEQ ID NO: 9262793 - DNA, 22 bp, Homo sapiens
gctggaccaggtgtgcacaggc

SEQ ID NO: 9262794 - DNA, 22 bp, Homo sapiens
gctggacaggccacatggagga

SEQ ID NO: 9262795 - DNA, 19 bp, Homo sapiens
caagacaaagcccatcttc

SEQ ID NO: 9262796 - DNA, 22 bp, Homo sapiens
caagaattgtacaaactgggtg

SEQ ID NO: 9262797 - DNA, 22 bp, Homo sapiens
caagaatcctgttcttgaagat

SEQ ID NO: 9262798 - DNA, 22 bp, Homo sapiens
caagaatcaacattatttagtg

SEQ ID NO: 9262799 - DNA, 22 bp, Homo sapiens
caagaataaaatacatgttgat

SEQ ID NO: 9262800 - DNA, 22 bp, Homo sapiens
caagaataaccagacaatagca

SEQ ID NO: 9262801 - DNA, 18 bp, Homo sapiens
gctgcctgcattcctcac

SEQ ID NO: 9262802 - DNA, 22 bp, Homo sapiens
gctgcctgcacagagctgcttt

SEQ ID NO: 9262803 - DNA, 22 bp, Homo sapiens
gctgcctgcacagagctgcttt

SEQ ID NO: 9262804 - DNA, 18 bp, Homo sapiens
gctgcctgcattcctcac

SEQ ID NO: 9262805 - DNA, 22 bp, Homo sapiens
gctgcctgcctagttccacagt

SEQ ID NO: 9262806 - DNA, 22 bp, Homo sapiens
gctgcctgcctagttccacagt

SEQ ID NO: 9262807 - DNA, 22 bp, Homo sapiens
gctgctggccgcccagcttctc

SEQ ID NO: 9262808 - DNA, 22 bp, Homo sapiens
gctgctggccccacatgctcca

SEQ ID NO: 9262809 - DNA, 22 bp, Homo sapiens
gctgctttgacagtgggaacag

SEQ ID NO: 9262810 - DNA, 22 bp, Homo sapiens
gctgctttgacagtgggaacag

SEQ ID NO: 9262811 - DNA, 22 bp, Homo sapiens
gctgctttctgttaggaattgg

SEQ ID NO: 9262812 - DNA, 22 bp, Homo sapiens
gctgctttctgttaggaattgg

SEQ ID NO: 9262813 - DNA, 22 bp, Homo sapiens
gctgctttgcagtagagtaata

SEQ ID NO: 9262814 - DNA, 22 bp, Homo sapiens
gctgctttgtgaaaatcattca

SEQ ID NO: 9262815 - DNA, 22 bp, Homo sapiens
gctgctttgcagtagagtaata

SEQ ID NO: 9262816 - DNA, 22 bp, Homo sapiens
gctgctttgtctgtaaaatgga

SEQ ID NO: 9262817 - DNA, 22 bp, Homo sapiens
gctgctttggggatgaatgaga

SEQ ID NO: 9262818 - DNA, 22 bp, Homo sapiens
gctggaagaatgagtgcctcgt

SEQ ID NO: 9262819 - DNA, 22 bp, Homo sapiens
gctgcttttcacagagacaaga

SEQ ID NO: 9262820 - DNA, 22 bp, Homo sapiens
gctgctttttggatttggcaca

SEQ ID NO: 9262821 - DNA, 22 bp, Homo sapiens
gctgctttttggatttggcaca

SEQ ID NO: 9262822 - DNA, 22 bp, Homo sapiens
gctggaaaaggaggcaaaatat

SEQ ID NO: 9262823 - DNA, 22 bp, Homo sapiens
caaagtgctaggattacaggcg

SEQ ID NO: 9262824 - DNA, 22 bp, Homo sapiens
caaagtgctaggattacaggcc

SEQ ID NO: 9262825 - DNA, 17 bp, Homo sapiens
gctgccacctttggagc

SEQ ID NO: 9262826 - DNA, 22 bp, Homo sapiens
gctgccacgatctctgctgtag

SEQ ID NO: 9262827 - DNA, 22 bp, Homo sapiens
gctgccctccagttcccacagt

SEQ ID NO: 9262828 - DNA, 22 bp, Homo sapiens
gctgccctcccagggcaagctt

SEQ ID NO: 9262829 - DNA, 22 bp, Homo sapiens
gctgccctgactccagcagcct

SEQ ID NO: 9262830 - DNA, 22 bp, Homo sapiens
gctgccctgcatctgtgccttc

SEQ ID NO: 9262831 - DNA, 22 bp, Homo sapiens
gctgccctgcctcagactcctc

SEQ ID NO: 9262832 - DNA, 22 bp, Homo sapiens
gctgccctctctggccccacac

SEQ ID NO: 9262833 - DNA, 22 bp, Homo sapiens
gctgccctctctggccccacac

SEQ ID NO: 9262834 - DNA, 22 bp, Homo sapiens
gctgccctctctggccccacac

SEQ ID NO: 9262835 - DNA, 22 bp, Homo sapiens
gctgccctcccagggcaagctt

SEQ ID NO: 9262836 - DNA, 22 bp, Homo sapiens
gctgccctgacaagctactccc

SEQ ID NO: 9262837 - DNA, 22 bp, Homo sapiens
gctctgcttgcatcatgactgc

SEQ ID NO: 9262838 - DNA, 22 bp, Homo sapiens
caaagtcttcagttgattctga

SEQ ID NO: 9262839 - DNA, 22 bp, Homo sapiens
gctgcctgatttacatagtgaa

SEQ ID NO: 9262840 - DNA, 22 bp, Homo sapiens
gctgcctgcacagagctgcttt

SEQ ID NO: 9262841 - DNA, 22 bp, Homo sapiens
gctgcctgatgtccagcaggac

SEQ ID NO: 9262842 - DNA, 23 bp, Homo sapiens
caacttttggctacatgcttagc

SEQ ID NO: 9262843 - DNA, 23 bp, Homo sapiens
caacttttggctacatgcttagc

SEQ ID NO: 9262844 - DNA, 22 bp, Homo sapiens
caacttttgacacgtgtgctaa

SEQ ID NO: 9262845 - DNA, 22 bp, Homo sapiens
caacttttctgtgaatttaagt

SEQ ID NO: 9262846 - DNA, 22 bp, Homo sapiens
caacttttctgtgaatttaagt

SEQ ID NO: 9262847 - DNA, 22 bp, Homo sapiens
caaattttgtgtgttctctagt

SEQ ID NO: 9262848 - DNA, 22 bp, Homo sapiens
caaattttgtgtgttctctagt

SEQ ID NO: 9262849 - DNA, 22 bp, Homo sapiens
caacaatatgccagactcaatt

SEQ ID NO: 9262850 - DNA, 22 bp, Homo sapiens
caacaatatgctgagtttttca

SEQ ID NO: 9262851 - DNA, 22 bp, Homo sapiens
gctgccctgtctgcagcaggac

SEQ ID NO: 9262852 - DNA, 22 bp, Homo sapiens
gctgccctgtctgcagcaggac

SEQ ID NO: 9262853 - DNA, 22 bp, Homo sapiens
gctgccctgtccggctctcctg

SEQ ID NO: 9262854 - DNA, 22 bp, Homo sapiens
caacacaggttctgcaaaggaa

SEQ ID NO: 9262855 - DNA, 22 bp, Homo sapiens
caacacaggttctgcaaaggaa

SEQ ID NO: 9262856 - DNA, 22 bp, Homo sapiens
caactatagatcaaatgagttt

SEQ ID NO: 9262857 - DNA, 22 bp, Homo sapiens
caactacatccacactttgtta

SEQ ID NO: 9262858 - DNA, 22 bp, Homo sapiens
ggacatttcataagaccattct

SEQ ID NO: 9262859 - DNA, 22 bp, Homo sapiens
ggacatttagtttcattgggca

SEQ ID NO: 9262860 - DNA, 19 bp, Homo sapiens
ggacatttgagttgtttat

SEQ ID NO: 9262861 - DNA, 22 bp, Homo sapiens
ggacatttttcttcctacaatg

SEQ ID NO: 9262862 - DNA, 22 bp, Homo sapiens
ggacatttagaacagagtattt

SEQ ID NO: 9262863 - DNA, 23 bp, Homo sapiens
ggacatgtctctgggtattttga

SEQ ID NO: 9262864 - DNA, 22 bp, Homo sapiens
ggacatggagctccatggaggc

SEQ ID NO: 9262865 - DNA, 22 bp, Homo sapiens
ggacatggaagtatggagtgga

SEQ ID NO: 9262866 - DNA, 18 bp, Homo sapiens
ggacaggagacatgggtg

SEQ ID NO: 9262867 - DNA, 18 bp, Homo sapiens
ggacaggagacatgggtg

SEQ ID NO: 9262868 - DNA, 22 bp, Homo sapiens
cacaacttagcagcttgaaaca

SEQ ID NO: 9262869 - DNA, 22 bp, Homo sapiens
cacaaatggttgtagacattaa

SEQ ID NO: 9262870 - DNA, 22 bp, Homo sapiens
ggaagcctaaagcccaggtctc

SEQ ID NO: 9262871 - DNA, 22 bp, Homo sapiens
ggaagaggaggagccaggcttt

SEQ ID NO: 9262872 - DNA, 23 bp, Homo sapiens
ggaagctcacgtagtcctgcact

SEQ ID NO: 9262873 - DNA, 22 bp, Homo sapiens
ggaagctgccagtccaccagct

SEQ ID NO: 9262874 - DNA, 22 bp, Homo sapiens
ggaagctgaggcccagtgaagg

SEQ ID NO: 9262875 - DNA, 22 bp, Homo sapiens
cacaaatgactgaaacgactgt

SEQ ID NO: 9262876 - DNA, 22 bp, Homo sapiens
cacaaataccagtttcctaaca

SEQ ID NO: 9262877 - DNA, 22 bp, Homo sapiens
ggaagctggtaattgttgggac

SEQ ID NO: 9262878 - DNA, 22 bp, Homo sapiens
ggaagctgtgctctcaggcctc

SEQ ID NO: 9262879 - DNA, 20 bp, Homo sapiens
ggaagctgtgggtccccagg

SEQ ID NO: 9262880 - DNA, 22 bp, Homo sapiens
ggagagaggagcccactgctgt

SEQ ID NO: 9262881 - DNA, 22 bp, Homo sapiens
ggagagaggctggccgtgatga

SEQ ID NO: 9262882 - DNA, 22 bp, Homo sapiens
ggagagcagggtcctgagatac

SEQ ID NO: 9262883 - DNA, 22 bp, Homo sapiens
ggagagcagggaggctgctctg

SEQ ID NO: 9262884 - DNA, 22 bp, Homo sapiens
ggagagcagggaggctgctctg

SEQ ID NO: 9262885 - DNA, 22 bp, Homo sapiens
ggagaaggtgctggtcactgtg

SEQ ID NO: 9262886 - DNA, 22 bp, Homo sapiens
ggagaagggtatgtgtggcgga

SEQ ID NO: 9262887 - DNA, 22 bp, Homo sapiens
ggagaagggacagactcagctt

SEQ ID NO: 9262888 - DNA, 22 bp, Homo sapiens
cacacaggatgaagcagcagaa

SEQ ID NO: 9262889 - DNA, 22 bp, Homo sapiens
cacacaggtaagcctctttcaa

SEQ ID NO: 9262890 - DNA, 22 bp, Homo sapiens
cacacaggatgaagcagcagaa

SEQ ID NO: 9262891 - DNA, 22 bp, Homo sapiens
ggagaaggcacacccacctctg

SEQ ID NO: 9262892 - DNA, 22 bp, Homo sapiens
ggagaagggacagactcagctt

SEQ ID NO: 9262893 - DNA, 22 bp, Homo sapiens
cacacagtaggcactcattaat

SEQ ID NO: 9262894 - DNA, 22 bp, Homo sapiens
cacacagtaggcactcattaat

SEQ ID NO: 9262895 - DNA, 22 bp, Homo sapiens
cacacaggtatatatatgtaca

SEQ ID NO: 9262896 - DNA, 22 bp, Homo sapiens
cacacagtagtatgaggcaaaa

SEQ ID NO: 9262897 - DNA, 22 bp, Homo sapiens
cacacagtggagtattactcag

SEQ ID NO: 9262898 - DNA, 22 bp, Homo sapiens
cacacagtggagtattactcag

SEQ ID NO: 9262899 - DNA, 21 bp, Homo sapiens
cacacagtgatctatccacat

SEQ ID NO: 9262900 - DNA, 20 bp, Homo sapiens
caatttcatcatttcctgtg

SEQ ID NO: 9262901 - DNA, 22 bp, Homo sapiens
caatttcatcttgtgcttcaat

SEQ ID NO: 9262902 - DNA, 22 bp, Homo sapiens
caatttcatgccatgtattgct

SEQ ID NO: 9262903 - DNA, 22 bp, Homo sapiens
caatttcattaatagatataga

SEQ ID NO: 9262904 - DNA, 22 bp, Homo sapiens
caatttctaacattccatggat

SEQ ID NO: 9262905 - DNA, 22 bp, Homo sapiens
ggaagagcctggggtgtcaggc

SEQ ID NO: 9262906 - DNA, 18 bp, Homo sapiens
caatttcaatggtctgaa

SEQ ID NO: 9262907 - DNA, 22 bp, Homo sapiens
caatcacaaagagacaagtgtc

SEQ ID NO: 9262908 - DNA, 22 bp, Homo sapiens
caatcagatatgtgacatattt

SEQ ID NO: 9262909 - DNA, 22 bp, Homo sapiens
caatcacaaagagacaagtgtc

SEQ ID NO: 9262910 - DNA, 22 bp, Homo sapiens
caatattcagtggaaaagccat

SEQ ID NO: 9262911 - DNA, 22 bp, Homo sapiens
caattcttcctgttggatatgc

SEQ ID NO: 9262912 - DNA, 19 bp, Homo sapiens
caattctgcaacactgtcc

SEQ ID NO: 9262913 - DNA, 18 bp, Homo sapiens
caatagaaacagtaggaa

SEQ ID NO: 9262914 - DNA, 22 bp, Homo sapiens
caatagaaggcacagataggta

SEQ ID NO: 9262915 - DNA, 18 bp, Homo sapiens
caatagaaacagtaggaa

SEQ ID NO: 9262916 - DNA, 20 bp, Homo sapiens
caatagaatgtggagataag

SEQ ID NO: 9262917 - DNA, 20 bp, Homo sapiens
caatagaatgtggagataag

SEQ ID NO: 9262918 - DNA, 22 bp, Homo sapiens
caatagatgtttttgcttacca

SEQ ID NO: 9262919 - DNA, 22 bp, Homo sapiens
caatagcagacctagaaagcaa

SEQ ID NO: 9262920 - DNA, 22 bp, Homo sapiens
caatagcagcttctgaatgcaa

SEQ ID NO: 9262921 - DNA, 22 bp, Homo sapiens
caatagcagacctagaaagcaa

SEQ ID NO: 9262922 - DNA, 22 bp, Homo sapiens
caatagcaggtctacagagaga

SEQ ID NO: 9262923 - DNA, 22 bp, Homo sapiens
caatatataatgagtactttcc

SEQ ID NO: 9262924 - DNA, 22 bp, Homo sapiens
caatatataggaacaacttagg

SEQ ID NO: 9262925 - DNA, 19 bp, Homo sapiens
caatatatagtgagtggat

SEQ ID NO: 9262926 - DNA, 22 bp, Homo sapiens
caatatataatgagtactttcc

SEQ ID NO: 9262927 - DNA, 22 bp, Homo sapiens
caataagatgtattgagcagag

SEQ ID NO: 9262928 - DNA, 22 bp, Homo sapiens
caataagtaataggcatctaat

SEQ ID NO: 9262929 - DNA, 22 bp, Homo sapiens
caaggctgtctccagcttccaa

SEQ ID NO: 9262930 - DNA, 22 bp, Homo sapiens
caaggctgtgcagggtccatat

SEQ ID NO: 9262931 - DNA, 22 bp, Homo sapiens
caaggctgtgcagggtccatat

SEQ ID NO: 9262932 - DNA, 22 bp, Homo sapiens
caaggctgcttcagactagtga

SEQ ID NO: 9262933 - DNA, 22 bp, Homo sapiens
caaggctgctggcttctgagct

SEQ ID NO: 9262934 - DNA, 22 bp, Homo sapiens
gctggggagctagacctcagca

SEQ ID NO: 9262935 - DNA, 22 bp, Homo sapiens
gctggggaggcagcagagaaca

SEQ ID NO: 9262936 - DNA, 22 bp, Homo sapiens
gctggggagctagacctcagca

SEQ ID NO: 9262937 - DNA, 22 bp, Homo sapiens
caaggctgctgcgggtcgcacc

SEQ ID NO: 9262938 - DNA, 22 bp, Homo sapiens
caaggctgctgcgggtcgcacc

SEQ ID NO: 9262939 - DNA, 22 bp, Homo sapiens
caaggctgctgcgggtcgcacc

SEQ ID NO: 9262940 - DNA, 22 bp, Homo sapiens
caaggctgcaaaactacatggg

SEQ ID NO: 9262941 - DNA, 21 bp, Homo sapiens
cttcagcaaatacttggcagg

SEQ ID NO: 9262942 - DNA, 22 bp, Homo sapiens
cttcagcaactttggaatgttt

SEQ ID NO: 9262943 - DNA, 22 bp, Homo sapiens
cttcagcaactttggaatgttt

SEQ ID NO: 9262944 - DNA, 22 bp, Homo sapiens
cttcagcaccatagctccttct

SEQ ID NO: 9262945 - DNA, 22 bp, Homo sapiens
cttcagcagatgtgctagagat

SEQ ID NO: 9262946 - DNA, 22 bp, Homo sapiens
cttcagcagcctcttgcataaa

SEQ ID NO: 9262947 - DNA, 22 bp, Homo sapiens
cttcagcacctcagctggagag

SEQ ID NO: 9262948 - DNA, 23 bp, Homo sapiens
cttcagcagaaacataaattctc

SEQ ID NO: 9262949 - DNA, 22 bp, Homo sapiens
cttcagcagatgcaaaacccct

SEQ ID NO: 9262950 - DNA, 22 bp, Homo sapiens
cttcagcagcctcttgcataaa

SEQ ID NO: 9262951 - DNA, 19 bp, Homo sapiens
cttcagcatctccggagct

SEQ ID NO: 9262952 - DNA, 22 bp, Homo sapiens
atccttaatttacttgcatctt

SEQ ID NO: 9262953 - DNA, 22 bp, Homo sapiens
atccttcagctgccctgttacc

SEQ ID NO: 9262954 - DNA, 22 bp, Homo sapiens
atccttcaaaaggaatagcagg

SEQ ID NO: 9262955 - DNA, 22 bp, Homo sapiens
atccttccagagttattctcaa

SEQ ID NO: 9262956 - DNA, 22 bp, Homo sapiens
atccttcttctgctagtgtcta

SEQ ID NO: 9262957 - DNA, 17 bp, Homo sapiens
atccttctgttctttct

SEQ ID NO: 9262958 - DNA, 22 bp, Homo sapiens
atccttctccagtcgtattttt

SEQ ID NO: 9262959 - DNA, 22 bp, Homo sapiens
atccttctccaaaactggctcc

SEQ ID NO: 9262960 - DNA, 22 bp, Homo sapiens
atccttggcagctcagacctac

SEQ ID NO: 9262961 - DNA, 22 bp, Homo sapiens
cttcagaattcctcagcctcag

SEQ ID NO: 9262962 - DNA, 22 bp, Homo sapiens
cttcagagtgcagaagattggg

SEQ ID NO: 9262963 - DNA, 22 bp, Homo sapiens
cttcagagcttgttaaaactgt

SEQ ID NO: 9262964 - DNA, 22 bp, Homo sapiens
cttcagaggggactcaaagtca

SEQ ID NO: 9262965 - DNA, 22 bp, Homo sapiens
ctgtttcagaacttcttaaaaa

SEQ ID NO: 9262966 - DNA, 22 bp, Homo sapiens
ctgtttcctgtcttctcactat

SEQ ID NO: 9262967 - DNA, 22 bp, Homo sapiens
atctggaacaaagcttaggaat

SEQ ID NO: 9262968 - DNA, 22 bp, Homo sapiens
cttcatgttctgcctgtggaag

SEQ ID NO: 9262969 - DNA, 22 bp, Homo sapiens
cttcataaactcagaaggcagc

SEQ ID NO: 9262970 - DNA, 22 bp, Homo sapiens
cttcatgagactccactgccat

SEQ ID NO: 9262971 - DNA, 22 bp, Homo sapiens
cttcatgctgatatcctcgatg

SEQ ID NO: 9262972 - DNA, 22 bp, Homo sapiens
atctccaggattttcacactca

SEQ ID NO: 9262973 - DNA, 22 bp, Homo sapiens
atctcattttggtttctactta

SEQ ID NO: 9262974 - DNA, 22 bp, Homo sapiens
atctcataaacacacatatatg

SEQ ID NO: 9262975 - DNA, 22 bp, Homo sapiens
atctcattttggtttctactta

SEQ ID NO: 9262976 - DNA, 22 bp, Homo sapiens
atctcattttggtttctactta

SEQ ID NO: 9262977 - DNA, 22 bp, Homo sapiens
atctcattctcccgtgccatgg

SEQ ID NO: 9262978 - DNA, 22 bp, Homo sapiens
atctccagtcctggtttcctgg

SEQ ID NO: 9262979 - DNA, 22 bp, Homo sapiens
cttcagttagtttcatgtgagc

SEQ ID NO: 9262980 - DNA, 22 bp, Homo sapiens
cttcagttatgtgccaaggaca

SEQ ID NO: 9262981 - DNA, 22 bp, Homo sapiens
ctgtgccttggcgctgtgccac

SEQ ID NO: 9262982 - DNA, 22 bp, Homo sapiens
ctgtgccttctacttcactcta

SEQ ID NO: 9262983 - DNA, 22 bp, Homo sapiens
ctgtgccttctacttcactcta

SEQ ID NO: 9262984 - DNA, 22 bp, Homo sapiens
ctgtgccttctgcctggaacat

SEQ ID NO: 9262985 - DNA, 22 bp, Homo sapiens
ctgtgcctttgtagctgtgcct

SEQ ID NO: 9262986 - DNA, 22 bp, Homo sapiens
ctgtgcctttgtagctgtgcct

SEQ ID NO: 9262987 - DNA, 22 bp, Homo sapiens
ctgtgcctccagtctcgcttct

SEQ ID NO: 9262988 - DNA, 22 bp, Homo sapiens
ctgtgcctccagtctcgcttct

SEQ ID NO: 9262989 - DNA, 22 bp, Homo sapiens
ctgtgcctccctttactttgag

SEQ ID NO: 9262990 - DNA, 22 bp, Homo sapiens
ctgtgcctgcaggccacatcaa

SEQ ID NO: 9262991 - DNA, 22 bp, Homo sapiens
ctgtgcctgccttgttcactga

SEQ ID NO: 9262992 - DNA, 22 bp, Homo sapiens
ctgtgcctgcaggccacatcaa

SEQ ID NO: 9262993 - DNA, 22 bp, Homo sapiens
ctgtgcctggggggcagagctg

SEQ ID NO: 9262994 - DNA, 22 bp, Homo sapiens
ctgtgccttagtattctcattt

SEQ ID NO: 9262995 - DNA, 22 bp, Homo sapiens
ctgtgcctaagatgcatgtctc

SEQ ID NO: 9262996 - DNA, 22 bp, Homo sapiens
ctgtgcctcagtgtcctcgagt

SEQ ID NO: 9262997 - DNA, 22 bp, Homo sapiens
ctgtgcctccaagtggtctctg

SEQ ID NO: 9262998 - DNA, 22 bp, Homo sapiens
ctgtgccctttgtcctcgtctc

SEQ ID NO: 9262999 - DNA, 22 bp, Homo sapiens
ctgtgccctttcgctgcactgt

SEQ ID NO: 9263000 - DNA, 22 bp, Homo sapiens
ctgtgccctttcgctgcactgt

SEQ ID NO: 9263001 - DNA, 22 bp, Homo sapiens
ctgtgcagtaggtcagggctgg

SEQ ID NO: 9263002 - DNA, 22 bp, Homo sapiens
atcaggaagccagtctaatgga

SEQ ID NO: 9263003 - DNA, 22 bp, Homo sapiens
atcaggaatgaatacttttgga

SEQ ID NO: 9263004 - DNA, 22 bp, Homo sapiens
atcaggaaatacttatttataa

SEQ ID NO: 9263005 - DNA, 20 bp, Homo sapiens
ctgtgctccgggttcctgga

SEQ ID NO: 9263006 - DNA, 22 bp, Homo sapiens
atcaggaagaagaatgtgttgg

SEQ ID NO: 9263007 - DNA, 22 bp, Homo sapiens
atcaggctagtgtgtgtgttca

SEQ ID NO: 9263008 - DNA, 22 bp, Homo sapiens
ctgttattcaagacaaaggcag

SEQ ID NO: 9263009 - DNA, 22 bp, Homo sapiens
ctgttatttctgaatgccatcc

SEQ ID NO: 9263010 - DNA, 22 bp, Homo sapiens
ctgttatcatcaggaggggata

SEQ ID NO: 9263011 - DNA, 22 bp, Homo sapiens
ctgttatttagaacatggaatc

SEQ ID NO: 9263012 - DNA, 22 bp, Homo sapiens
ctgttatttagaacatggaatc

SEQ ID NO: 9263013 - DNA, 22 bp, Homo sapiens
ctgttagtgatcaaagggagag

SEQ ID NO: 9263014 - DNA, 22 bp, Homo sapiens
ctgttatctgttattgccagtt

SEQ ID NO: 9263015 - DNA, 22 bp, Homo sapiens
ctgttactcctttggcagatta

SEQ ID NO: 9263016 - DNA, 22 bp, Homo sapiens
ctgttattttataattcaagaa

SEQ ID NO: 9263017 - DNA, 22 bp, Homo sapiens
ctgtttatggaggtaaggcatc

SEQ ID NO: 9263018 - DNA, 22 bp, Homo sapiens
ctgtttattgagcaatctgcca

SEQ ID NO: 9263019 - DNA, 22 bp, Homo sapiens
ctgtgtgtcctcggacgagttt

SEQ ID NO: 9263020 - DNA, 22 bp, Homo sapiens
atcattcagtgaccacttccca

SEQ ID NO: 9263021 - DNA, 22 bp, Homo sapiens
atcattcagtctctgggacagt

SEQ ID NO: 9263022 - DNA, 22 bp, Homo sapiens
atcattccacatgtaccactag

SEQ ID NO: 9263023 - DNA, 22 bp, Homo sapiens
ctgtgtgtcctcggacgagttt

SEQ ID NO: 9263024 - DNA, 22 bp, Homo sapiens
atcattctagctgttgtgttga

SEQ ID NO: 9263025 - DNA, 22 bp, Homo sapiens
atcattatcctcctatttgcct

SEQ ID NO: 9263026 - DNA, 22 bp, Homo sapiens
atcattcaagtgctctaaaatg

SEQ ID NO: 9263027 - DNA, 22 bp, Homo sapiens
atcattataatggtatagttgt

SEQ ID NO: 9263028 - DNA, 22 bp, Homo sapiens
atcattcagtctctgggacagt

SEQ ID NO: 9263029 - DNA, 22 bp, Homo sapiens
atcattcagcctaagcaagtac

SEQ ID NO: 9263030 - DNA, 22 bp, Homo sapiens
atcattcagcctaagcaagtac

SEQ ID NO: 9263031 - DNA, 22 bp, Homo sapiens
atcattaaatataagcttcaca

SEQ ID NO: 9263032 - DNA, 22 bp, Homo sapiens
ctgtgtcccttgtcccagagcc

SEQ ID NO: 9263033 - DNA, 22 bp, Homo sapiens
atcattagaccaaactagagct

SEQ ID NO: 9263034 - DNA, 22 bp, Homo sapiens
ctgtgtccccctcagccaggtg

SEQ ID NO: 9263035 - DNA, 22 bp, Homo sapiens
ctgtgtcccttgtcccagagcc

SEQ ID NO: 9263036 - DNA, 22 bp, Homo sapiens
ctgtgtcccagtaccttgggta

SEQ ID NO: 9263037 - DNA, 22 bp, Homo sapiens
ctggggagtgaaattcttaaat

SEQ ID NO: 9263038 - DNA, 22 bp, Homo sapiens
ctggggagtgaaattcttaaat

SEQ ID NO: 9263039 - DNA, 22 bp, Homo sapiens
ctggggaggcagggctgcccct

SEQ ID NO: 9263040 - DNA, 22 bp, Homo sapiens
ctggggagtgaaggtaattaca

SEQ ID NO: 9263041 - DNA, 22 bp, Homo sapiens
ctggggatgggacctggcataa

SEQ ID NO: 9263042 - DNA, 22 bp, Homo sapiens
ctggggatgggacctggcataa

SEQ ID NO: 9263043 - DNA, 22 bp, Homo sapiens
ctgggctgttctgcccctgggt

SEQ ID NO: 9263044 - DNA, 22 bp, Homo sapiens
ctgggctgttctgcccctgggt

SEQ ID NO: 9263045 - DNA, 22 bp, Homo sapiens
ctgggctgttctgcccctgggt

SEQ ID NO: 9263046 - DNA, 22 bp, Homo sapiens
ctggggaggatgctacgacctg

SEQ ID NO: 9263047 - DNA, 23 bp, Homo sapiens
ctgggctgtcctgaggtcacctc

SEQ ID NO: 9263048 - DNA, 23 bp, Homo sapiens
ctgggctgtcctgaggtcacctc

SEQ ID NO: 9263049 - DNA, 22 bp, Homo sapiens
ctgggctgtggtgtggcccaaa

SEQ ID NO: 9263050 - DNA, 22 bp, Homo sapiens
ctgggctgtcaatggccctctg

SEQ ID NO: 9263051 - DNA, 22 bp, Homo sapiens
ctgggctgtcaatggccctctg

SEQ ID NO: 9263052 - DNA, 22 bp, Homo sapiens
ctgggctgtcccaaccccatcc

SEQ ID NO: 9263053 - DNA, 22 bp, Homo sapiens
ctggtcctccttgccttcagat

SEQ ID NO: 9263054 - DNA, 22 bp, Homo sapiens
ctggggcagagcccagcaattt

SEQ ID NO: 9263055 - DNA, 22 bp, Homo sapiens
ctggtggagagtgggctctgga

SEQ ID NO: 9263056 - DNA, 22 bp, Homo sapiens
ctggtgctggagcctagtccct

SEQ ID NO: 9263057 - DNA, 22 bp, Homo sapiens
ctggtccttgacgcgtgggagg

SEQ ID NO: 9263058 - DNA, 22 bp, Homo sapiens
ctggtcctctccagcaggcatt

SEQ ID NO: 9263059 - DNA, 22 bp, Homo sapiens
ctggtgctgggcagggctcagg

SEQ ID NO: 9263060 - DNA, 22 bp, Homo sapiens
ctggtgctggcaacagagtagg

SEQ ID NO: 9263061 - DNA, 19 bp, Homo sapiens
ctggtgcttgagtgagtca

SEQ ID NO: 9263062 - DNA, 22 bp, Homo sapiens
ctggtggagatgcctggcccct

SEQ ID NO: 9263063 - DNA, 22 bp, Homo sapiens
atatttgttagagtctatgtgt

SEQ ID NO: 9263064 - DNA, 22 bp, Homo sapiens
ctggtgggaggcaaggtggaag

SEQ ID NO: 9263065 - DNA, 22 bp, Homo sapiens
ctggtgggagcagcaggcagct

SEQ ID NO: 9263066 - DNA, 22 bp, Homo sapiens
ctggtgggagcagcaggcagct

SEQ ID NO: 9263067 - DNA, 22 bp, Homo sapiens
ctggtgggagcagcaggcagct

SEQ ID NO: 9263068 - DNA, 21 bp, Homo sapiens
ctgtattaacttttgcacctt

SEQ ID NO: 9263069 - DNA, 22 bp, Homo sapiens
ctgtattattttcttagctctg

SEQ ID NO: 9263070 - DNA, 22 bp, Homo sapiens
ctgtattagccaggtgcacaag

SEQ ID NO: 9263071 - DNA, 22 bp, Homo sapiens
ctgtattcaagcttctgcccaa

SEQ ID NO: 9263072 - DNA, 22 bp, Homo sapiens
ctgtatgtttctatgaatgtga

SEQ ID NO: 9263073 - DNA, 22 bp, Homo sapiens
ctgtatttagttaaaatgctaa

SEQ ID NO: 9263074 - DNA, 22 bp, Homo sapiens
ctgtccagctgaccagagcagc

SEQ ID NO: 9263075 - DNA, 22 bp, Homo sapiens
ctgtccagctgaccagagcagc

SEQ ID NO: 9263076 - DNA, 21 bp, Homo sapiens
ctgtccaaatttcataacttt

SEQ ID NO: 9263077 - DNA, 22 bp, Homo sapiens
ctgtcatttttttagaacacct

SEQ ID NO: 9263078 - DNA, 22 bp, Homo sapiens
atattttgaagttaataatgtg

SEQ ID NO: 9263079 - DNA, 22 bp, Homo sapiens
ctgtatgaaattaagtaaacag

SEQ ID NO: 9263080 - DNA, 22 bp, Homo sapiens
ctgtatgaaattgtcattttta

SEQ ID NO: 9263081 - DNA, 22 bp, Homo sapiens
ctgtatgattccatttctataa

SEQ ID NO: 9263082 - DNA, 22 bp, Homo sapiens
ctgtatgatatccaaattgata

SEQ ID NO: 9263083 - DNA, 22 bp, Homo sapiens
ctgtatgagttgggaatagaat

SEQ ID NO: 9263084 - DNA, 22 bp, Homo sapiens
ctgtatatgtgcatacacacac

SEQ ID NO: 9263085 - DNA, 22 bp, Homo sapiens
atatttgttagagtctatgtgt

SEQ ID NO: 9263086 - DNA, 22 bp, Homo sapiens
atattttcactgaaccaaagta

SEQ ID NO: 9263087 - DNA, 22 bp, Homo sapiens
ctgggccagggaggtgtctgta

SEQ ID NO: 9263088 - DNA, 22 bp, Homo sapiens
ctgggccagtctcggccgctct

SEQ ID NO: 9263089 - DNA, 22 bp, Homo sapiens
ctgggccagtctcggccgctct

SEQ ID NO: 9263090 - DNA, 22 bp, Homo sapiens
ctgggccagggaggtgtctgta

SEQ ID NO: 9263091 - DNA, 22 bp, Homo sapiens
ctgggccatcagaggggctgga

SEQ ID NO: 9263092 - DNA, 22 bp, Homo sapiens
ctgggccatcagaggggctgga

SEQ ID NO: 9263093 - DNA, 22 bp, Homo sapiens
ctgggccatgggccagcgaggc

SEQ ID NO: 9263094 - DNA, 22 bp, Homo sapiens
ctgggccatgggccagcgaggc

SEQ ID NO: 9263095 - DNA, 22 bp, Homo sapiens
ctgggccatggaagtctctgcc

SEQ ID NO: 9263096 - DNA, 22 bp, Homo sapiens
ctgggccatgggccagcgaggc

SEQ ID NO: 9263097 - DNA, 22 bp, Homo sapiens
ctgggcctggacgggcagatct

SEQ ID NO: 9263098 - DNA, 22 bp, Homo sapiens
ctgggcctggcgttccaggctg

SEQ ID NO: 9263099 - DNA, 22 bp, Homo sapiens
ctgggcctggagcccacgagcc

SEQ ID NO: 9263100 - DNA, 22 bp, Homo sapiens
ctgggcctgggaggccaggtct

SEQ ID NO: 9263101 - DNA, 22 bp, Homo sapiens
ctgggcctggcgttccaggctg

SEQ ID NO: 9263102 - DNA, 22 bp, Homo sapiens
ctgggcctgggaggccaggtct

SEQ ID NO: 9263103 - DNA, 22 bp, Homo sapiens
ctgggcctggggctgttgagag

SEQ ID NO: 9263104 - DNA, 22 bp, Homo sapiens
ctgggctgatttagtcacgttt

SEQ ID NO: 9263105 - DNA, 22 bp, Homo sapiens
ctgggctgatttagtcacgttt

SEQ ID NO: 9263106 - DNA, 22 bp, Homo sapiens
ctgggctgcagcgggagcgacg

SEQ ID NO: 9263107 - DNA, 22 bp, Homo sapiens
ctgggctgtaatgtggcactga

SEQ ID NO: 9263108 - DNA, 22 bp, Homo sapiens
ctgggctgtaatgtggcactga

SEQ ID NO: 9263109 - DNA, 20 bp, Homo sapiens
ctgggctgggctacagggtc

SEQ ID NO: 9263110 - DNA, 20 bp, Homo sapiens
ctgggctgggctacagggtc

SEQ ID NO: 9263111 - DNA, 22 bp, Homo sapiens
atagtcactgccttccatttgt

SEQ ID NO: 9263112 - DNA, 22 bp, Homo sapiens
atagtcttagatcagataaagt

SEQ ID NO: 9263113 - DNA, 22 bp, Homo sapiens
atagtcttagatcagataaagt

SEQ ID NO: 9263114 - DNA, 22 bp, Homo sapiens
atagtcttcagcactttgatca

SEQ ID NO: 9263115 - DNA, 22 bp, Homo sapiens
atagtcttagtctatagttttg

SEQ ID NO: 9263116 - DNA, 22 bp, Homo sapiens
atagtatgaattaaatcatgag

SEQ ID NO: 9263117 - DNA, 22 bp, Homo sapiens
atagtgattgaaaacattctgt

SEQ ID NO: 9263118 - DNA, 21 bp, Homo sapiens
atagtgatagataactgagtt

SEQ ID NO: 9263119 - DNA, 22 bp, Homo sapiens
atagtctttactgctgaattga

SEQ ID NO: 9263120 - DNA, 22 bp, Homo sapiens
atagtgaaaatgctgtcagcat

SEQ ID NO: 9263121 - DNA, 19 bp, Homo sapiens
atagtctttccaattatac

SEQ ID NO: 9263122 - DNA, 22 bp, Homo sapiens
atatattttttgagacagagtc

SEQ ID NO: 9263123 - DNA, 22 bp, Homo sapiens
atatattttttgagacagagtc

SEQ ID NO: 9263124 - DNA, 22 bp, Homo sapiens
atatcacagctctttcattgct

SEQ ID NO: 9263125 - DNA, 22 bp, Homo sapiens
atatcacaggtgtttacctgat

SEQ ID NO: 9263126 - DNA, 22 bp, Homo sapiens
atatcacaggtgtttacctgat

SEQ ID NO: 9263127 - DNA, 22 bp, Homo sapiens
atatcacagtagttgtttagtt

SEQ ID NO: 9263128 - DNA, 22 bp, Homo sapiens
atatcattatgttatgagcaca

SEQ ID NO: 9263129 - DNA, 22 bp, Homo sapiens
atatcattatgttatgagcaca

SEQ ID NO: 9263130 - DNA, 22 bp, Homo sapiens
atatcattatgttatgagcaca

SEQ ID NO: 9263131 - DNA, 22 bp, Homo sapiens
atatcataaatcggtgcatgaa

SEQ ID NO: 9263132 - DNA, 18 bp, Homo sapiens
atatcagctacttcatgg

SEQ ID NO: 9263133 - DNA, 22 bp, Homo sapiens
atatcaaagctagtggaaattt

SEQ ID NO: 9263134 - DNA, 22 bp, Homo sapiens
atatcaaagctagtggaaattt

SEQ ID NO: 9263135 - DNA, 23 bp, Homo sapiens
atatcacacccagtacagtctcc

SEQ ID NO: 9263136 - DNA, 22 bp, Homo sapiens
atatcaaacgaagttattttaa

SEQ ID NO: 9263137 - DNA, 22 bp, Homo sapiens
agtttatgtaaaattagtaatg

SEQ ID NO: 9263138 - DNA, 22 bp, Homo sapiens
agtgttctcagctactagagag

SEQ ID NO: 9263139 - DNA, 22 bp, Homo sapiens
agtgttcatttattcattcact

SEQ ID NO: 9263140 - DNA, 22 bp, Homo sapiens
agtgttcagtgattgtcaaccg

SEQ ID NO: 9263141 - DNA, 19 bp, Homo sapiens
agtttattataggtgattc

SEQ ID NO: 9263142 - DNA, 22 bp, Homo sapiens
agtttatgtctttacttcagct

SEQ ID NO: 9263143 - DNA, 22 bp, Homo sapiens
agtttatgttgtttataagcca

SEQ ID NO: 9263144 - DNA, 22 bp, Homo sapiens
agtgttataaaggccaagtttt

SEQ ID NO: 9263145 - DNA, 22 bp, Homo sapiens
agtgttcactctgtggagccca

SEQ ID NO: 9263146 - DNA, 22 bp, Homo sapiens
agtgttaatggtgtatattagg

SEQ ID NO: 9263147 - DNA, 22 bp, Homo sapiens
agtgttaagagaaaattctgct

SEQ ID NO: 9263148 - DNA, 22 bp, Homo sapiens
agtttcaattcttttcacaaag

SEQ ID NO: 9263149 - DNA, 22 bp, Homo sapiens
agtttatttttgataagtcttg

SEQ ID NO: 9263150 - DNA, 22 bp, Homo sapiens
agtttatttttgataagtcttg

SEQ ID NO: 9263151 - DNA, 17 bp, Homo sapiens
agtttatttagccttct

SEQ ID NO: 9263152 - DNA, 17 bp, Homo sapiens
agtttatttagccttct

SEQ ID NO: 9263153 - DNA, 22 bp, Homo sapiens
agtttatttctccatttaccta

SEQ ID NO: 9263154 - DNA, 22 bp, Homo sapiens
agtttattctgcttggccctcc

SEQ ID NO: 9263155 - DNA, 22 bp, Homo sapiens
agtttattgtatatggtagttt

SEQ ID NO: 9263156 - DNA, 22 bp, Homo sapiens
agtttattgtatatggtagttt

SEQ ID NO: 9263157 - DNA, 20 bp, Homo sapiens
agtttattccaggagaactg

SEQ ID NO: 9263158 - DNA, 20 bp, Homo sapiens
agtttattccaggagaactg

SEQ ID NO: 9263159 - DNA, 22 bp, Homo sapiens
agtttattctctggtcttagta

SEQ ID NO: 9263160 - DNA, 22 bp, Homo sapiens
agtttattctctggtcttagta

SEQ ID NO: 9263161 - DNA, 22 bp, Homo sapiens
agtttattctgcttggccctcc

SEQ ID NO: 9263162 - DNA, 22 bp, Homo sapiens
ctgagtgggtttctgcttgtca

SEQ ID NO: 9263163 - DNA, 22 bp, Homo sapiens
ctgagtgatagcgatggggaac

SEQ ID NO: 9263164 - DNA, 22 bp, Homo sapiens
ctgataatgtcctgcagtaaat

SEQ ID NO: 9263165 - DNA, 21 bp, Homo sapiens
ctgataattgttaaattattt

SEQ ID NO: 9263166 - DNA, 22 bp, Homo sapiens
ctgagtgttttcagccacggcc

SEQ ID NO: 9263167 - DNA, 21 bp, Homo sapiens
ctgataattgttaaattattt

SEQ ID NO: 9263168 - DNA, 22 bp, Homo sapiens
ctgatacaatgctaataaattt

SEQ ID NO: 9263169 - DNA, 22 bp, Homo sapiens
ctgatacatagtagcatgtcat

SEQ ID NO: 9263170 - DNA, 22 bp, Homo sapiens
ctgatatgatgggtgattttca

SEQ ID NO: 9263171 - DNA, 22 bp, Homo sapiens
agttttattccaatgtgcagca

SEQ ID NO: 9263172 - DNA, 22 bp, Homo sapiens
agttttattccaatgtgcagca

SEQ ID NO: 9263173 - DNA, 22 bp, Homo sapiens
agttttattccaatgtgcagca

SEQ ID NO: 9263174 - DNA, 22 bp, Homo sapiens
agttttattgtcccagaggtga

SEQ ID NO: 9263175 - DNA, 22 bp, Homo sapiens
agttttattaaatccacagaag

SEQ ID NO: 9263176 - DNA, 22 bp, Homo sapiens
agtttgtatgccaacagcaaag

SEQ ID NO: 9263177 - DNA, 22 bp, Homo sapiens
ctgatattcattatggagctcc

SEQ ID NO: 9263178 - DNA, 22 bp, Homo sapiens
ctgatattattgaagctggagt

SEQ ID NO: 9263179 - DNA, 22 bp, Homo sapiens
ctgatattctattttgcttgct

SEQ ID NO: 9263180 - DNA, 22 bp, Homo sapiens
ctgatattctttgagctgctaa

SEQ ID NO: 9263181 - DNA, 22 bp, Homo sapiens
agtttcagttctgtcatttata

SEQ ID NO: 9263182 - DNA, 22 bp, Homo sapiens
agtttctctagagtctttgaaa

SEQ ID NO: 9263183 - DNA, 22 bp, Homo sapiens
agtttctctagagtctttgaaa

SEQ ID NO: 9263184 - DNA, 22 bp, Homo sapiens
agtttctcttaatctagtatct

SEQ ID NO: 9263185 - DNA, 22 bp, Homo sapiens
agtttctctcagtatagaatag

SEQ ID NO: 9263186 - DNA, 22 bp, Homo sapiens
agtttctctcagtatagaatag

SEQ ID NO: 9263187 - DNA, 22 bp, Homo sapiens
agtttcttattcttagttatgt

SEQ ID NO: 9263188 - DNA, 22 bp, Homo sapiens
agtttctctttgacaccaaaat

SEQ ID NO: 9263189 - DNA, 22 bp, Homo sapiens
agtttctcttaatctagtatct

SEQ ID NO: 9263190 - DNA, 22 bp, Homo sapiens
agtttctcttaatctagtatct

SEQ ID NO: 9263191 - DNA, 22 bp, Homo sapiens
agtttctgttaccatatttgac

SEQ ID NO: 9263192 - DNA, 22 bp, Homo sapiens
agtttcttggtcacagttttca

SEQ ID NO: 9263193 - DNA, 22 bp, Homo sapiens
agtttcttgaagactgatgttt

SEQ ID NO: 9263194 - DNA, 22 bp, Homo sapiens
agtttcttgaagactgatgttt

SEQ ID NO: 9263195 - DNA, 22 bp, Homo sapiens
agtttctttagatagaaagttc

SEQ ID NO: 9263196 - DNA, 22 bp, Homo sapiens
agtttctttagatagaaagttc

SEQ ID NO: 9263197 - DNA, 22 bp, Homo sapiens
ctgagtccttgggcttagagtg

SEQ ID NO: 9263198 - DNA, 22 bp, Homo sapiens
ctgagtctcccggcagtggagg

SEQ ID NO: 9263199 - DNA, 22 bp, Homo sapiens
ctgagtctcccggcagtggagg

SEQ ID NO: 9263200 - DNA, 22 bp, Homo sapiens
ctgccctctagaggaggactga

SEQ ID NO: 9263201 - DNA, 22 bp, Homo sapiens
ctgccctcgggccctcccatag

SEQ ID NO: 9263202 - DNA, 18 bp, Homo sapiens
ctgccccttctctgagat

SEQ ID NO: 9263203 - DNA, 18 bp, Homo sapiens
ctgcccagagcatttcat

SEQ ID NO: 9263204 - DNA, 22 bp, Homo sapiens
ctgccctctagggatgcactgg

SEQ ID NO: 9263205 - DNA, 22 bp, Homo sapiens
ctgccctgacctgcctcagagt

SEQ ID NO: 9263206 - DNA, 22 bp, Homo sapiens
ctgccctgacctgcctcagagt

SEQ ID NO: 9263207 - DNA, 22 bp, Homo sapiens
ctgccctgactgaccttttgaa

SEQ ID NO: 9263208 - DNA, 22 bp, Homo sapiens
ctgccctggtcccatggctgat

SEQ ID NO: 9263209 - DNA, 22 bp, Homo sapiens
agttttgaaatgaaatgtagtt

SEQ ID NO: 9263210 - DNA, 22 bp, Homo sapiens
agttttctgctaaaccagctaa

SEQ ID NO: 9263211 - DNA, 22 bp, Homo sapiens
agttttctgggatcactggaat

SEQ ID NO: 9263212 - DNA, 21 bp, Homo sapiens
agttttctgagttataaaata

SEQ ID NO: 9263213 - DNA, 22 bp, Homo sapiens
agttttctgacccctgctctat

SEQ ID NO: 9263214 - DNA, 22 bp, Homo sapiens
ctgccctgtttggacagcccgg

SEQ ID NO: 9263215 - DNA, 22 bp, Homo sapiens
ataagcctgattcacttgtcat

SEQ ID NO: 9263216 - DNA, 22 bp, Homo sapiens
ataagtgatatttagctataga

SEQ ID NO: 9263217 - DNA, 22 bp, Homo sapiens
ctgccctgtttggacagcccgg

SEQ ID NO: 9263218 - DNA, 22 bp, Homo sapiens
ataataaaccaggatgggtctg

SEQ ID NO: 9263219 - DNA, 22 bp, Homo sapiens
ctgccctgtctgcagcctggct

SEQ ID NO: 9263220 - DNA, 22 bp, Homo sapiens
ctgccctgtccttcccgccggc

SEQ ID NO: 9263221 - DNA, 22 bp, Homo sapiens
ctgccctgtagctgttctagca

SEQ ID NO: 9263222 - DNA, 22 bp, Homo sapiens
ctgccctgtatcttctcccaat

SEQ ID NO: 9263223 - DNA, 22 bp, Homo sapiens
ctgccctgtgagggtccttggg

SEQ ID NO: 9263224 - DNA, 22 bp, Homo sapiens
ctgccctgtggctctgagtcat

SEQ ID NO: 9263225 - DNA, 22 bp, Homo sapiens
ctgcctgcttttctgggagccg

SEQ ID NO: 9263226 - DNA, 22 bp, Homo sapiens
ctgcctgcttttctgggagccg

SEQ ID NO: 9263227 - DNA, 22 bp, Homo sapiens
ctgcctgcttctgagccagagg

SEQ ID NO: 9263228 - DNA, 22 bp, Homo sapiens
ctgcctgcttctgagccagagg

SEQ ID NO: 9263229 - DNA, 22 bp, Homo sapiens
ctgcctgcttctgagccagagg

SEQ ID NO: 9263230 - DNA, 23 bp, Homo sapiens
ctgcctgctggggagacagatct

SEQ ID NO: 9263231 - DNA, 23 bp, Homo sapiens
ctgcctgctggggagacagatct

SEQ ID NO: 9263232 - DNA, 22 bp, Homo sapiens
ctgcctgcttaccatgcatcag

SEQ ID NO: 9263233 - DNA, 22 bp, Homo sapiens
ctgcctgcttaccatgcatcag

SEQ ID NO: 9263234 - DNA, 22 bp, Homo sapiens
ctgcctgctgattagtattgtc

SEQ ID NO: 9263235 - DNA, 22 bp, Homo sapiens
ctgcctgctgacattctttata

SEQ ID NO: 9263236 - DNA, 18 bp, Homo sapiens
ctgcctgctctccagctt

SEQ ID NO: 9263237 - DNA, 18 bp, Homo sapiens
ctgcctgctctccagctt

SEQ ID NO: 9263238 - DNA, 22 bp, Homo sapiens
ctgcctgctgccctccagagcc

SEQ ID NO: 9263239 - DNA, 22 bp, Homo sapiens
ctgcctgctgcctgtggagggt

SEQ ID NO: 9263240 - DNA, 22 bp, Homo sapiens
ataataactcctgttgaagaac

SEQ ID NO: 9263241 - DNA, 22 bp, Homo sapiens
ataataacacctgaataggaaa

SEQ ID NO: 9263242 - DNA, 22 bp, Homo sapiens
ataataaaccaggatgggtctg

SEQ ID NO: 9263243 - DNA, 22 bp, Homo sapiens
ataataacacctgaataggaaa

SEQ ID NO: 9263244 - DNA, 22 bp, Homo sapiens
ataataatgaaagccactgtgt

SEQ ID NO: 9263245 - DNA, 23 bp, Homo sapiens
ataataattatggcagcaaagtg

SEQ ID NO: 9263246 - DNA, 21 bp, Homo sapiens
atacagaacattgatccaaga

SEQ ID NO: 9263247 - DNA, 21 bp, Homo sapiens
atacagaacattgatccaaga

SEQ ID NO: 9263248 - DNA, 22 bp, Homo sapiens
atacagaactctcagttgtata

SEQ ID NO: 9263249 - DNA, 22 bp, Homo sapiens
atacagaaaatgatgcagagtt

SEQ ID NO: 9263250 - DNA, 22 bp, Homo sapiens
atacactttagaaaaacgctgc

SEQ ID NO: 9263251 - DNA, 22 bp, Homo sapiens
ataatttacaactgcttttaat

SEQ ID NO: 9263252 - DNA, 22 bp, Homo sapiens
ataatttacaactgcttttaat

SEQ ID NO: 9263253 - DNA, 22 bp, Homo sapiens
ataatttaattttcacagtggt

SEQ ID NO: 9263254 - DNA, 22 bp, Homo sapiens
ataatttaattttcacagtggt

SEQ ID NO: 9263255 - DNA, 22 bp, Homo sapiens
ataatttaattttcacagtggt

SEQ ID NO: 9263256 - DNA, 22 bp, Homo sapiens
ataatttaattttcacagtggt

SEQ ID NO: 9263257 - DNA, 22 bp, Homo sapiens
ataatttaaattagtatgtgat

SEQ ID NO: 9263258 - DNA, 22 bp, Homo sapiens
ataatttaaattagtatgtgat

SEQ ID NO: 9263259 - DNA, 20 bp, Homo sapiens
ataatttaccctgcaccact

SEQ ID NO: 9263260 - DNA, 20 bp, Homo sapiens
ataatttaccctgcaccact

SEQ ID NO: 9263261 - DNA, 20 bp, Homo sapiens
ataatttaccctgcaccact

SEQ ID NO: 9263262 - DNA, 22 bp, Homo sapiens
ataatttacaactgcttttaat

SEQ ID NO: 9263263 - DNA, 22 bp, Homo sapiens
ataatttacaactgcttttaat

SEQ ID NO: 9263264 - DNA, 22 bp, Homo sapiens
ataatttacaactgcttttaat

SEQ ID NO: 9263265 - DNA, 22 bp, Homo sapiens
ataattatctcagacacttgtt

SEQ ID NO: 9263266 - DNA, 22 bp, Homo sapiens
ataattatctcagacacttgtt

SEQ ID NO: 9263267 - DNA, 22 bp, Homo sapiens
ataattatctcagacacttgtt

SEQ ID NO: 9263268 - DNA, 22 bp, Homo sapiens
ataatttaaattagtatgtgat

SEQ ID NO: 9263269 - DNA, 22 bp, Homo sapiens
ataatttaaattagtatgtgat

SEQ ID NO: 9263270 - DNA, 22 bp, Homo sapiens
ataattcatgggcctttcacct

SEQ ID NO: 9263271 - DNA, 20 bp, Homo sapiens
ataattatttacttttgtgc

SEQ ID NO: 9263272 - DNA, 20 bp, Homo sapiens
ataattatttacttttgtgc

SEQ ID NO: 9263273 - DNA, 21 bp, Homo sapiens
ataatgtacaaaaactgtctt

SEQ ID NO: 9263274 - DNA, 22 bp, Homo sapiens
ataatgtacaactgcttttaat

SEQ ID NO: 9263275 - DNA, 22 bp, Homo sapiens
ataatcattcacataaggtgct

SEQ ID NO: 9263276 - DNA, 22 bp, Homo sapiens
ataatgtgatatttcatttaca

SEQ ID NO: 9263277 - DNA, 22 bp, Homo sapiens
ataatgtgttcatcttacaatt

SEQ ID NO: 9263278 - DNA, 22 bp, Homo sapiens
ataatgtgttcatcttacaatt

SEQ ID NO: 9263279 - DNA, 22 bp, Homo sapiens
ataatgttgatgattgtctttg

SEQ ID NO: 9263280 - DNA, 22 bp, Homo sapiens
ataatgtttttgtataagcatg

SEQ ID NO: 9263281 - DNA, 22 bp, Homo sapiens
ataatgtttcagtactgtctgt

SEQ ID NO: 9263282 - DNA, 22 bp, Homo sapiens
ataatgtttcagtactgtctgt

SEQ ID NO: 9263283 - DNA, 22 bp, Homo sapiens
atacagaagcctgtatttctgg

SEQ ID NO: 9263284 - DNA, 21 bp, Homo sapiens
atacagaaggtggcaaagtac

SEQ ID NO: 9263285 - DNA, 22 bp, Homo sapiens
ctggaacaagtggccttgcaag

SEQ ID NO: 9263286 - DNA, 22 bp, Homo sapiens
ctggaagaactccagttctgtg

SEQ ID NO: 9263287 - DNA, 22 bp, Homo sapiens
ctggaagaactccagttctgtg

SEQ ID NO: 9263288 - DNA, 21 bp, Homo sapiens
ctggaagaagcagcaggattc

SEQ ID NO: 9263289 - DNA, 22 bp, Homo sapiens
ctggaagaactccagttctgtg

SEQ ID NO: 9263290 - DNA, 22 bp, Homo sapiens
ctggaacagtgttggagcttga

SEQ ID NO: 9263291 - DNA, 23 bp, Homo sapiens
ctggaacatagtagatggtcaga

SEQ ID NO: 9263292 - DNA, 22 bp, Homo sapiens
ctggaactcctggggagctggt

SEQ ID NO: 9263293 - DNA, 22 bp, Homo sapiens
ctggaagacgtttgaagccatg

SEQ ID NO: 9263294 - DNA, 22 bp, Homo sapiens
atacatctcatgtaagagataa

SEQ ID NO: 9263295 - DNA, 22 bp, Homo sapiens
atacatatatggtacttcctgg

SEQ ID NO: 9263296 - DNA, 22 bp, Homo sapiens
atacatatatggtacttcctgg

SEQ ID NO: 9263297 - DNA, 22 bp, Homo sapiens
atacatatatggtacttcctgg

SEQ ID NO: 9263298 - DNA, 22 bp, Homo sapiens
ctggagctggcttccttccact

SEQ ID NO: 9263299 - DNA, 22 bp, Homo sapiens
ctggagctggcttccttccact

SEQ ID NO: 9263300 - DNA, 22 bp, Homo sapiens
ctggagctgggctagggtagga

SEQ ID NO: 9263301 - DNA, 22 bp, Homo sapiens
ctggagctgggctagggtagga

SEQ ID NO: 9263302 - DNA, 22 bp, Homo sapiens
ctggagctgtcttcacaggcct

SEQ ID NO: 9263303 - DNA, 22 bp, Homo sapiens
ctggagctgtcttcacaggcct

SEQ ID NO: 9263304 - DNA, 22 bp, Homo sapiens
ctggagctggcccaggctggcc

SEQ ID NO: 9263305 - DNA, 22 bp, Homo sapiens
ctggagctgccagggctgccgc

SEQ ID NO: 9263306 - DNA, 22 bp, Homo sapiens
ctggagctgctgtccttgggtg

SEQ ID NO: 9263307 - DNA, 22 bp, Homo sapiens
ctggagctgctgtccttgggtg

SEQ ID NO: 9263308 - DNA, 22 bp, Homo sapiens
ctggagctgctgtccttgggtg

SEQ ID NO: 9263309 - DNA, 22 bp, Homo sapiens
ctggagctgccagacgggcaca

SEQ ID NO: 9263310 - DNA, 22 bp, Homo sapiens
atacatgatacttagtacgtag

SEQ ID NO: 9263311 - DNA, 22 bp, Homo sapiens
atacatgatcactgtattataa

SEQ ID NO: 9263312 - DNA, 22 bp, Homo sapiens
atacatctcatgtaagagataa

SEQ ID NO: 9263313 - DNA, 22 bp, Homo sapiens
atacatctcatgtaagagataa

SEQ ID NO: 9263314 - DNA, 22 bp, Homo sapiens
atacatcttccttttaaaatgc

SEQ ID NO: 9263315 - DNA, 22 bp, Homo sapiens
atacatcttccttttaaaatgc

SEQ ID NO: 9263316 - DNA, 22 bp, Homo sapiens
atacatgacagcatagcatcct

SEQ ID NO: 9263317 - DNA, 22 bp, Homo sapiens
atacatcttgtcagattcatgt

SEQ ID NO: 9263318 - DNA, 22 bp, Homo sapiens
atagacagaaagataatagaat

SEQ ID NO: 9263319 - DNA, 22 bp, Homo sapiens
atagaatgtattatagtacaga

SEQ ID NO: 9263320 - DNA, 22 bp, Homo sapiens
atagaattacagtgtgtttgga

SEQ ID NO: 9263321 - DNA, 22 bp, Homo sapiens
atagaattcgtgtttgtaattc

SEQ ID NO: 9263322 - DNA, 22 bp, Homo sapiens
atagaattatggaaagcatctt

SEQ ID NO: 9263323 - DNA, 22 bp, Homo sapiens
atagaatttgcactaaatctgc

SEQ ID NO: 9263324 - DNA, 22 bp, Homo sapiens
atagaatttgtacttgtagaac

SEQ ID NO: 9263325 - DNA, 22 bp, Homo sapiens
atagaatttgcactaaatctgc

SEQ ID NO: 9263326 - DNA, 22 bp, Homo sapiens
atagaattctttgaaatttatg

SEQ ID NO: 9263327 - DNA, 22 bp, Homo sapiens
atagaattctttgaaatttatg

SEQ ID NO: 9263328 - DNA, 22 bp, Homo sapiens
atagcagtggatgtggagaaag

SEQ ID NO: 9263329 - DNA, 22 bp, Homo sapiens
atagcatataagttataaaact

SEQ ID NO: 9263330 - DNA, 22 bp, Homo sapiens
atagggcagtcaggccgccact

SEQ ID NO: 9263331 - DNA, 22 bp, Homo sapiens
atagggaggaactgagtcagga

SEQ ID NO: 9263332 - DNA, 22 bp, Homo sapiens
ataggccatttgagggccaggt

SEQ ID NO: 9263333 - DNA, 22 bp, Homo sapiens
atagtacagagggctactggtt

SEQ ID NO: 9263334 - DNA, 22 bp, Homo sapiens
atagtacacatcctacaatgtt

SEQ ID NO: 9263335 - DNA, 22 bp, Homo sapiens
atagtaaattatcgtggagaga

SEQ ID NO: 9263336 - DNA, 22 bp, Homo sapiens
atagtaactggcatgtttatga

SEQ ID NO: 9263337 - DNA, 22 bp, Homo sapiens
atagaaaggtctttggcagaca

SEQ ID NO: 9263338 - DNA, 18 bp, Homo sapiens
atagaaacctttaatcag

SEQ ID NO: 9263339 - DNA, 23 bp, Homo sapiens
atagaaactaacaatttggctta

SEQ ID NO: 9263340 - DNA, 22 bp, Homo sapiens
atagaatatgacttttagatcc

SEQ ID NO: 9263341 - DNA, 22 bp, Homo sapiens
atagaatagcatagaaaattga

SEQ ID NO: 9263342 - DNA, 22 bp, Homo sapiens
atagaatagcatagaaaattga

SEQ ID NO: 9263343 - DNA, 22 bp, Homo sapiens
atagaatatgacttttagatcc

SEQ ID NO: 9263344 - DNA, 22 bp, Homo sapiens
atagaatatgacttttagatcc

SEQ ID NO: 9263345 - DNA, 22 bp, Homo sapiens
atagaaacagatgcacttctct

SEQ ID NO: 9263346 - DNA, 22 bp, Homo sapiens
atagaaacagggaagcaaagca

SEQ ID NO: 9263347 - DNA, 22 bp, Homo sapiens
atagaaaacagatgtccttaaa

SEQ ID NO: 9263348 - DNA, 22 bp, Homo sapiens
atacttttaattccttctgagt

SEQ ID NO: 9263349 - DNA, 21 bp, Homo sapiens
atactttgaattacagccttg

SEQ ID NO: 9263350 - DNA, 22 bp, Homo sapiens
ctggccaggttttgaacagttg

SEQ ID NO: 9263351 - DNA, 22 bp, Homo sapiens
ctggccaggttttgaacagttg

SEQ ID NO: 9263352 - DNA, 22 bp, Homo sapiens
ctggccaggttttgaacagttg

SEQ ID NO: 9263353 - DNA, 22 bp, Homo sapiens
ctggccagtgactgctcacccg

SEQ ID NO: 9263354 - DNA, 22 bp, Homo sapiens
ctggccagggtgcgatcgtggt

SEQ ID NO: 9263355 - DNA, 22 bp, Homo sapiens
ctggccaggttttgaacagttg

SEQ ID NO: 9263356 - DNA, 22 bp, Homo sapiens
ctggccaggcttgggacagaca

SEQ ID NO: 9263357 - DNA, 22 bp, Homo sapiens
ctggccaggcttgggacagaca

SEQ ID NO: 9263358 - DNA, 22 bp, Homo sapiens
ctggccaggcttgggacagaca

SEQ ID NO: 9263359 - DNA, 22 bp, Homo sapiens
ctggccaggcttgggacagaca

SEQ ID NO: 9263360 - DNA, 22 bp, Homo sapiens
ctggagctgttttttcaggaaa

SEQ ID NO: 9263361 - DNA, 17 bp, Homo sapiens
ctggagctgtgtaacct

SEQ ID NO: 9263362 - DNA, 22 bp, Homo sapiens
ctggagctggtatagggacaaa

SEQ ID NO: 9263363 - DNA, 22 bp, Homo sapiens
ctggagctgttttttcaggaaa

SEQ ID NO: 9263364 - DNA, 22 bp, Homo sapiens
ctggagcttattgggagcagaa

SEQ ID NO: 9263365 - DNA, 22 bp, Homo sapiens
ctggaggaaaacaactgcagac

SEQ ID NO: 9263366 - DNA, 22 bp, Homo sapiens
ctggccaggctctcacgtggtc

SEQ ID NO: 9263367 - DNA, 22 bp, Homo sapiens
ctggccaggcttgggacagaca

SEQ ID NO: 9263368 - DNA, 22 bp, Homo sapiens
ctggccagaggttcctctgccc

SEQ ID NO: 9263369 - DNA, 22 bp, Homo sapiens
ctggccaggctctcacgtggtc

SEQ ID NO: 9263370 - DNA, 17 bp, Homo sapiens
agtggcaggcagatggg

SEQ ID NO: 9263371 - DNA, 22 bp, Homo sapiens
agtggcagccgagcaggagatg

SEQ ID NO: 9263372 - DNA, 22 bp, Homo sapiens
agtggctggcataggaacagac

SEQ ID NO: 9263373 - DNA, 19 bp, Homo sapiens
agtggctgggcagaagcaa

SEQ ID NO: 9263374 - DNA, 19 bp, Homo sapiens
agtggctgggcagaagcaa

SEQ ID NO: 9263375 - DNA, 17 bp, Homo sapiens
agtggcaggcagatggg

SEQ ID NO: 9263376 - DNA, 22 bp, Homo sapiens
agtggcaggcggagatgtagga

SEQ ID NO: 9263377 - DNA, 22 bp, Homo sapiens
agtgcaggccccaggccaggcc

SEQ ID NO: 9263378 - DNA, 22 bp, Homo sapiens
ctctctggcttggcacggagat

SEQ ID NO: 9263379 - DNA, 22 bp, Homo sapiens
ctctctggcttggcacggagat

SEQ ID NO: 9263380 - DNA, 22 bp, Homo sapiens
ctctctccttagctgcagacca

SEQ ID NO: 9263381 - DNA, 22 bp, Homo sapiens
agtgcagggcctgcccagcagg

SEQ ID NO: 9263382 - DNA, 22 bp, Homo sapiens
ctctctgggtcctcttttatag

SEQ ID NO: 9263383 - DNA, 18 bp, Homo sapiens
ctctctgggtgaggacaa

SEQ ID NO: 9263384 - DNA, 22 bp, Homo sapiens
ctctctggtacatagagtttgg

SEQ ID NO: 9263385 - DNA, 18 bp, Homo sapiens
ctctctgggtgaggacaa

SEQ ID NO: 9263386 - DNA, 22 bp, Homo sapiens
ctctctggcttggcacggagat

SEQ ID NO: 9263387 - DNA, 22 bp, Homo sapiens
ctctctgggcccagttggcacc

SEQ ID NO: 9263388 - DNA, 22 bp, Homo sapiens
ctctctgggcccagttggcacc

SEQ ID NO: 9263389 - DNA, 22 bp, Homo sapiens
ctctctgggcccagttggcacc

SEQ ID NO: 9263390 - DNA, 22 bp, Homo sapiens
ctctctggggttccagacgtgg

SEQ ID NO: 9263391 - DNA, 22 bp, Homo sapiens
ctctgagaaagctgtgagctaa

SEQ ID NO: 9263392 - DNA, 22 bp, Homo sapiens
ctctgacaggtggcattatctc

SEQ ID NO: 9263393 - DNA, 22 bp, Homo sapiens
agtggctggtctaaggtcacag

SEQ ID NO: 9263394 - DNA, 22 bp, Homo sapiens
ctctgagaggtgagaagcagca

SEQ ID NO: 9263395 - DNA, 22 bp, Homo sapiens
ctctgagagtgctcagagggta

SEQ ID NO: 9263396 - DNA, 22 bp, Homo sapiens
ctctgagagagctggtgagcac

SEQ ID NO: 9263397 - DNA, 22 bp, Homo sapiens
ctctgagactcaagtgagtggg

SEQ ID NO: 9263398 - DNA, 22 bp, Homo sapiens
ctctgagaagagttcaagtaaa

SEQ ID NO: 9263399 - DNA, 22 bp, Homo sapiens
ctctgagaagccttgatgggga

SEQ ID NO: 9263400 - DNA, 22 bp, Homo sapiens
ctctgagaagagttcaagtaaa

SEQ ID NO: 9263401 - DNA, 22 bp, Homo sapiens
ctctgagaatataagactattt

SEQ ID NO: 9263402 - DNA, 22 bp, Homo sapiens
agtgggcatgatctggtgtctg

SEQ ID NO: 9263403 - DNA, 22 bp, Homo sapiens
agtgggctggtggcagggagaa

SEQ ID NO: 9263404 - DNA, 22 bp, Homo sapiens
agtgggctggtggcagggagaa

SEQ ID NO: 9263405 - DNA, 22 bp, Homo sapiens
agtgggcttactgagggagtgt

SEQ ID NO: 9263406 - DNA, 22 bp, Homo sapiens
agtgggcaaaacagctcagagc

SEQ ID NO: 9263407 - DNA, 22 bp, Homo sapiens
agtgggcagcccaggaggtctt

SEQ ID NO: 9263408 - DNA, 22 bp, Homo sapiens
agtgggcagtgcgctcggatgc

SEQ ID NO: 9263409 - DNA, 22 bp, Homo sapiens
agtgggcagcccaggaggtctt

SEQ ID NO: 9263410 - DNA, 22 bp, Homo sapiens
agtgggcaggcagggtgcgcag

SEQ ID NO: 9263411 - DNA, 20 bp, Homo sapiens
agtgggagagggcagactgc

SEQ ID NO: 9263412 - DNA, 22 bp, Homo sapiens
agtgggagggccatatggtgaa

SEQ ID NO: 9263413 - DNA, 22 bp, Homo sapiens
agtgggagggccatatggtgaa

SEQ ID NO: 9263414 - DNA, 21 bp, Homo sapiens
agtgggatactggaaggtaga

SEQ ID NO: 9263415 - DNA, 22 bp, Homo sapiens
agtgggagagaagcaagtagta

SEQ ID NO: 9263416 - DNA, 22 bp, Homo sapiens
ctctgagcagaggccgtggcta

SEQ ID NO: 9263417 - DNA, 22 bp, Homo sapiens
ctctgagatgcttgaagaggat

SEQ ID NO: 9263418 - DNA, 19 bp, Homo sapiens
ctcttaaattgtctcttgc

SEQ ID NO: 9263419 - DNA, 22 bp, Homo sapiens
ctcttaatgaccttaattcaag

SEQ ID NO: 9263420 - DNA, 22 bp, Homo sapiens
ctcttaatgttttatagattga

SEQ ID NO: 9263421 - DNA, 20 bp, Homo sapiens
ctcttaaatgtaaagtaggc

SEQ ID NO: 9263422 - DNA, 22 bp, Homo sapiens
ctcttacattcttttactagca

SEQ ID NO: 9263423 - DNA, 20 bp, Homo sapiens
ctcttaattgctcacattag

SEQ ID NO: 9263424 - DNA, 22 bp, Homo sapiens
ctcttaatgttttatagattga

SEQ ID NO: 9263425 - DNA, 22 bp, Homo sapiens
ctcttaattaagctgagatctg

SEQ ID NO: 9263426 - DNA, 22 bp, Homo sapiens
ctcttacaagctcccgatataa

SEQ ID NO: 9263427 - DNA, 22 bp, Homo sapiens
ctcttaattaagctgagatctg

SEQ ID NO: 9263428 - DNA, 20 bp, Homo sapiens
ctcttaattgctcacattag

SEQ ID NO: 9263429 - DNA, 19 bp, Homo sapiens
ctcttacagaatagacaca

SEQ ID NO: 9263430 - DNA, 22 bp, Homo sapiens
ctcttacacagattcctctagc

SEQ ID NO: 9263431 - DNA, 22 bp, Homo sapiens
agtgtctgccagctgccaggtg

SEQ ID NO: 9263432 - DNA, 22 bp, Homo sapiens
agtgtctgcagtgatgtctctt

SEQ ID NO: 9263433 - DNA, 21 bp, Homo sapiens
ctctgtttgcctgctgccatc

SEQ ID NO: 9263434 - DNA, 22 bp, Homo sapiens
ctcttaaagaatgttccagctg

SEQ ID NO: 9263435 - DNA, 22 bp, Homo sapiens
ctcttaaagaatgttccagctg

SEQ ID NO: 9263436 - DNA, 22 bp, Homo sapiens
ctcttaaaattacctttgcaaa

SEQ ID NO: 9263437 - DNA, 20 bp, Homo sapiens
agtggggagtcaggagtgcc

SEQ ID NO: 9263438 - DNA, 22 bp, Homo sapiens
agtggggacttatgccagcatt

SEQ ID NO: 9263439 - DNA, 20 bp, Homo sapiens
agtggggagtcaggagtgcc

SEQ ID NO: 9263440 - DNA, 20 bp, Homo sapiens
agtggggagtcaggagtgcc

SEQ ID NO: 9263441 - DNA, 22 bp, Homo sapiens
agtggggaagagcatgggccct

SEQ ID NO: 9263442 - DNA, 22 bp, Homo sapiens
ctgaagcatgcgtttgtaaact

SEQ ID NO: 9263443 - DNA, 22 bp, Homo sapiens
ctgaagcatatcatgccaagtt

SEQ ID NO: 9263444 - DNA, 22 bp, Homo sapiens
ctgaagccagtttgctgccctt

SEQ ID NO: 9263445 - DNA, 23 bp, Homo sapiens
ctgaagcagttccctctctgccc

SEQ ID NO: 9263446 - DNA, 22 bp, Homo sapiens
ctgaagcagggagtgatgaagt

SEQ ID NO: 9263447 - DNA, 22 bp, Homo sapiens
ctgaagcaggcctacttcattg

SEQ ID NO: 9263448 - DNA, 22 bp, Homo sapiens
ctgaagcaggaggggaggcgct

SEQ ID NO: 9263449 - DNA, 22 bp, Homo sapiens
ctgaagctgaaaacttccagca

SEQ ID NO: 9263450 - DNA, 22 bp, Homo sapiens
ctgaagctgggcacttcctttt

SEQ ID NO: 9263451 - DNA, 22 bp, Homo sapiens
ctgagaaaggacctcaaacagg

SEQ ID NO: 9263452 - DNA, 22 bp, Homo sapiens
ctgagagatggtgtgtttataa

SEQ ID NO: 9263453 - DNA, 22 bp, Homo sapiens
ctgagagcctcctgttggctag

SEQ ID NO: 9263454 - DNA, 22 bp, Homo sapiens
ctgagaggcggaggttgcagtg

SEQ ID NO: 9263455 - DNA, 22 bp, Homo sapiens
ctgagaggcggagcttgcagtg

SEQ ID NO: 9263456 - DNA, 22 bp, Homo sapiens
ctgagaggcagccagagaaaat

SEQ ID NO: 9263457 - DNA, 22 bp, Homo sapiens
ctgagaggcggagcttgcagtg

SEQ ID NO: 9263458 - DNA, 22 bp, Homo sapiens
ctgaagcaaatgaaacagctct

SEQ ID NO: 9263459 - DNA, 23 bp, Homo sapiens
ctgaagcaatatcccctcacttc

SEQ ID NO: 9263460 - DNA, 22 bp, Homo sapiens
ctgaagcaggaacagcgagatt

SEQ ID NO: 9263461 - DNA, 22 bp, Homo sapiens
ctgaagcagatgtggctgagat

SEQ ID NO: 9263462 - DNA, 22 bp, Homo sapiens
ctgaagcaattgagagatgttt

SEQ ID NO: 9263463 - DNA, 22 bp, Homo sapiens
ctgaagcacagcatataaataa

SEQ ID NO: 9263464 - DNA, 21 bp, Homo sapiens
agtgtgtgtggaatgagaata

SEQ ID NO: 9263465 - DNA, 22 bp, Homo sapiens
agtgtgtgtttgggcggtttat

SEQ ID NO: 9263466 - DNA, 22 bp, Homo sapiens
agtgtgtgtttgggcggtttat

SEQ ID NO: 9263467 - DNA, 21 bp, Homo sapiens
agtgtgttcttggcattacct

SEQ ID NO: 9263468 - DNA, 23 bp, Homo sapiens
agtgttaaatttcgcacctaaat

SEQ ID NO: 9263469 - DNA, 22 bp, Homo sapiens
agtgtgtgcatgcattcgtgca

SEQ ID NO: 9263470 - DNA, 22 bp, Homo sapiens
agtgtgtgcatgcattcgtgca

SEQ ID NO: 9263471 - DNA, 22 bp, Homo sapiens
agtgtgggggctttggtgtcac

SEQ ID NO: 9263472 - DNA, 22 bp, Homo sapiens
agtgtgggggctttggtgtcac

SEQ ID NO: 9263473 - DNA, 21 bp, Homo sapiens
agtgtgtgataggcaggaaga

SEQ ID NO: 9263474 - DNA, 21 bp, Homo sapiens
agtgtgtgataggcaggaaga

SEQ ID NO: 9263475 - DNA, 22 bp, Homo sapiens
agtgtgtgcctttggatacctg

SEQ ID NO: 9263476 - DNA, 18 bp, Homo sapiens
agtgtgtgccctttcagg

SEQ ID NO: 9263477 - DNA, 22 bp, Homo sapiens
ctcccaggttacatctgagcct

SEQ ID NO: 9263478 - DNA, 22 bp, Homo sapiens
ctcccaggttccgacgcctctt

SEQ ID NO: 9263479 - DNA, 22 bp, Homo sapiens
ctcctcccacggtctcaggaag

SEQ ID NO: 9263480 - DNA, 22 bp, Homo sapiens
ctcccaggtgtcccttctgcca

SEQ ID NO: 9263481 - DNA, 22 bp, Homo sapiens
ctcccaggtgtcccttctgcca

SEQ ID NO: 9263482 - DNA, 22 bp, Homo sapiens
ctcccaggttacatctgagcct

SEQ ID NO: 9263483 - DNA, 22 bp, Homo sapiens
ctcccaggttacatctgagcct

SEQ ID NO: 9263484 - DNA, 22 bp, Homo sapiens
ctcccaggttacatctgagcct

SEQ ID NO: 9263485 - DNA, 22 bp, Homo sapiens
ctcccagggtctaggctgctgg

SEQ ID NO: 9263486 - DNA, 22 bp, Homo sapiens
ctcccagggtagggagagacta

SEQ ID NO: 9263487 - DNA, 22 bp, Homo sapiens
ctcccaggggagtcatctgctt

SEQ ID NO: 9263488 - DNA, 22 bp, Homo sapiens
ctcccaggggagtcatctgctt

SEQ ID NO: 9263489 - DNA, 22 bp, Homo sapiens
agtgcagccgagatcaggtgct

SEQ ID NO: 9263490 - DNA, 22 bp, Homo sapiens
ctcctccctgcgattgctctgc

SEQ ID NO: 9263491 - DNA, 22 bp, Homo sapiens
ctcctccctgcgattgctctgc

SEQ ID NO: 9263492 - DNA, 22 bp, Homo sapiens
ctcctccctctttgccacacat

SEQ ID NO: 9263493 - DNA, 22 bp, Homo sapiens
ctcctccctctttgccacacat

SEQ ID NO: 9263494 - DNA, 22 bp, Homo sapiens
ctcctccctctttgccacacat

SEQ ID NO: 9263495 - DNA, 22 bp, Homo sapiens
ctcctctagaagctgacctgga

SEQ ID NO: 9263496 - DNA, 22 bp, Homo sapiens
ctcctcctggacacaggctgtg

SEQ ID NO: 9263497 - DNA, 22 bp, Homo sapiens
agtgcaggagcctggccagagc

SEQ ID NO: 9263498 - DNA, 22 bp, Homo sapiens
agtgcaggagcctggccagagc

SEQ ID NO: 9263499 - DNA, 22 bp, Homo sapiens
ctccatgaatttgagctttgtg

SEQ ID NO: 9263500 - DNA, 22 bp, Homo sapiens
ctccatcagctgttggttgagg

SEQ ID NO: 9263501 - DNA, 22 bp, Homo sapiens
ctccagttggccccagttggtt

SEQ ID NO: 9263502 - DNA, 22 bp, Homo sapiens
ctccagttggccccagttggtt

SEQ ID NO: 9263503 - DNA, 22 bp, Homo sapiens
agtgacattattttgtgtacta

SEQ ID NO: 9263504 - DNA, 22 bp, Homo sapiens
ctccagttggccccagttggtt

SEQ ID NO: 9263505 - DNA, 22 bp, Homo sapiens
ctccagttggccccagttggtt

SEQ ID NO: 9263506 - DNA, 22 bp, Homo sapiens
ctccagttggccccagttggtt

SEQ ID NO: 9263507 - DNA, 20 bp, Homo sapiens
ctccagtgttcaggggagtg

SEQ ID NO: 9263508 - DNA, 22 bp, Homo sapiens
ctccagtgtctcagagcagatg

SEQ ID NO: 9263509 - DNA, 22 bp, Homo sapiens
ctccagggagctgcgggagcca

SEQ ID NO: 9263510 - DNA, 22 bp, Homo sapiens
ctccagggagctgcgggagcca

SEQ ID NO: 9263511 - DNA, 22 bp, Homo sapiens
ctccagtgctgtcatcccttcc

SEQ ID NO: 9263512 - DNA, 22 bp, Homo sapiens
ctccagtgggggtgagcctaga

SEQ ID NO: 9263513 - DNA, 22 bp, Homo sapiens
ctccagtggtgatggggaagaa

SEQ ID NO: 9263514 - DNA, 22 bp, Homo sapiens
ctccagtgggggtgagcctaga

SEQ ID NO: 9263515 - DNA, 22 bp, Homo sapiens
agtgcagagacctggtcaggca

SEQ ID NO: 9263516 - DNA, 22 bp, Homo sapiens
agtgcagagagcaatactctac

SEQ ID NO: 9263517 - DNA, 22 bp, Homo sapiens
agtgcagatttttagtcagctt

SEQ ID NO: 9263518 - DNA, 22 bp, Homo sapiens
agtgcagatttttagtcagctt

SEQ ID NO: 9263519 - DNA, 22 bp, Homo sapiens
agtgcagagtacatttgtggca

SEQ ID NO: 9263520 - DNA, 22 bp, Homo sapiens
agtgcactggcaccatctcagc

SEQ ID NO: 9263521 - DNA, 22 bp, Homo sapiens
agtgacatttgcaccagctgct

SEQ ID NO: 9263522 - DNA, 22 bp, Homo sapiens
agtgaccaatcatggttagatt

SEQ ID NO: 9263523 - DNA, 22 bp, Homo sapiens
agtgaccaacaatgctgagaag

SEQ ID NO: 9263524 - DNA, 22 bp, Homo sapiens
agtgaccattttcagctagagg

SEQ ID NO: 9263525 - DNA, 22 bp, Homo sapiens
agtgactggtgtgaagttaaat

SEQ ID NO: 9263526 - DNA, 22 bp, Homo sapiens
agtgactgggcagggcagggcc

SEQ ID NO: 9263527 - DNA, 22 bp, Homo sapiens
agtcattttctgcctgtaatct

SEQ ID NO: 9263528 - DNA, 22 bp, Homo sapiens
agtcattttgccagtcttcagg

SEQ ID NO: 9263529 - DNA, 22 bp, Homo sapiens
agtcatttctgtagtcatgttt

SEQ ID NO: 9263530 - DNA, 22 bp, Homo sapiens
agtcatttcccattcttcatat

SEQ ID NO: 9263531 - DNA, 22 bp, Homo sapiens
agtcattttgccagtcttcagg

SEQ ID NO: 9263532 - DNA, 22 bp, Homo sapiens
agtccaaagcagatgagggcca

SEQ ID NO: 9263533 - DNA, 22 bp, Homo sapiens
agtccaagatcaaggtgtcagg

SEQ ID NO: 9263534 - DNA, 22 bp, Homo sapiens
agtccaagatcaaggtgtcaac

SEQ ID NO: 9263535 - DNA, 22 bp, Homo sapiens
agtccaagaccaaggtgtcacc

SEQ ID NO: 9263536 - DNA, 22 bp, Homo sapiens
agtcatcatttatatcaagtct

SEQ ID NO: 9263537 - DNA, 22 bp, Homo sapiens
agtctcttttgcgaagagtgtt

SEQ ID NO: 9263538 - DNA, 22 bp, Homo sapiens
agtctcttggcattctgaaaca

SEQ ID NO: 9263539 - DNA, 22 bp, Homo sapiens
agtctctttaatcacagtgtct

SEQ ID NO: 9263540 - DNA, 22 bp, Homo sapiens
agtccaaggccatacagttgtg

SEQ ID NO: 9263541 - DNA, 22 bp, Homo sapiens
agtctgcaggctgtgatttttt

SEQ ID NO: 9263542 - DNA, 22 bp, Homo sapiens
agtctgagtatctctgagccag

SEQ ID NO: 9263543 - DNA, 22 bp, Homo sapiens
agtctgagtatctctgagccag

SEQ ID NO: 9263544 - DNA, 22 bp, Homo sapiens
agtctgcactcaggtggaggtc

SEQ ID NO: 9263545 - DNA, 21 bp, Homo sapiens
agtctgaggtggggcctagga

SEQ ID NO: 9263546 - DNA, 22 bp, Homo sapiens
ctcaggatggaagcctacagga

SEQ ID NO: 9263547 - DNA, 22 bp, Homo sapiens
ctcaggatgcaggtcacaggac

SEQ ID NO: 9263548 - DNA, 23 bp, Homo sapiens
agtcttactgtcccagaacaggg

SEQ ID NO: 9263549 - DNA, 22 bp, Homo sapiens
agtcttacatgagaaagaacct

SEQ ID NO: 9263550 - DNA, 22 bp, Homo sapiens
agtaataatttatattagggag

SEQ ID NO: 9263551 - DNA, 22 bp, Homo sapiens
agtaacagggtatttgtgtggg

SEQ ID NO: 9263552 - DNA, 22 bp, Homo sapiens
agtaatagagattttaatgtcc

SEQ ID NO: 9263553 - DNA, 22 bp, Homo sapiens
agtaatgcttctagaactattt

SEQ ID NO: 9263554 - DNA, 21 bp, Homo sapiens
agtacaaaaattcctttctca

SEQ ID NO: 9263555 - DNA, 22 bp, Homo sapiens
agtacaaagtgctcctggttct

SEQ ID NO: 9263556 - DNA, 22 bp, Homo sapiens
agtacaaagtgctcctggttct

SEQ ID NO: 9263557 - DNA, 22 bp, Homo sapiens
agtacaaaggcccttgattact

SEQ ID NO: 9263558 - DNA, 22 bp, Homo sapiens
agtacaaaatgcagcatcatca

SEQ ID NO: 9263559 - DNA, 22 bp, Homo sapiens
agtacaaaatgcagcatcatca

SEQ ID NO: 9263560 - DNA, 22 bp, Homo sapiens
agtacaaactgtttcaaagtag

SEQ ID NO: 9263561 - DNA, 20 bp, Homo sapiens
cctttattatttgtatgatg

SEQ ID NO: 9263562 - DNA, 20 bp, Homo sapiens
cctttattatttgtatgatg

SEQ ID NO: 9263563 - DNA, 22 bp, Homo sapiens
cctttaggagtgaggaccgagc

SEQ ID NO: 9263564 - DNA, 22 bp, Homo sapiens
aggtttctatgctgtttatctt

SEQ ID NO: 9263565 - DNA, 22 bp, Homo sapiens
aggtttctatgctgtttatctt

SEQ ID NO: 9263566 - DNA, 19 bp, Homo sapiens
aggtttctaactattcaag

SEQ ID NO: 9263567 - DNA, 21 bp, Homo sapiens
aggtttctcttttatggaggg

SEQ ID NO: 9263568 - DNA, 21 bp, Homo sapiens
aggtttatttcaacttcagga

SEQ ID NO: 9263569 - DNA, 22 bp, Homo sapiens
cctggtgcccccaagccagctg

SEQ ID NO: 9263570 - DNA, 22 bp, Homo sapiens
cctggtgcaggtgtgttgccag

SEQ ID NO: 9263571 - DNA, 22 bp, Homo sapiens
cctggtgccactagagaatgtc

SEQ ID NO: 9263572 - DNA, 22 bp, Homo sapiens
cctggtgccactagagaatgtc

SEQ ID NO: 9263573 - DNA, 22 bp, Homo sapiens
cctggtgcaccaagtaagggtg

SEQ ID NO: 9263574 - DNA, 22 bp, Homo sapiens
aggtgtctgtgatgggagcgat

SEQ ID NO: 9263575 - DNA, 22 bp, Homo sapiens
aggtgtcttcagggtgagacag

SEQ ID NO: 9263576 - DNA, 22 bp, Homo sapiens
aggtgtctgtgatgggagcgat

SEQ ID NO: 9263577 - DNA, 22 bp, Homo sapiens
aggtgtctttgcggcccgccgc

SEQ ID NO: 9263578 - DNA, 22 bp, Homo sapiens
aggtgtctgggctttggagtca

SEQ ID NO: 9263579 - DNA, 22 bp, Homo sapiens
aggtgtctggatgggtgtcctt

SEQ ID NO: 9263580 - DNA, 22 bp, Homo sapiens
aggtgtggcttgaagtctctat

SEQ ID NO: 9263581 - DNA, 22 bp, Homo sapiens
aggtgtggctggggcagaggcc

SEQ ID NO: 9263582 - DNA, 22 bp, Homo sapiens
aggtgtggctggggcagaggcc

SEQ ID NO: 9263583 - DNA, 22 bp, Homo sapiens
aggtgtgggaaacgggtgacct

SEQ ID NO: 9263584 - DNA, 23 bp, Homo sapiens
aggttatgattatagagcgagga

SEQ ID NO: 9263585 - DNA, 22 bp, Homo sapiens
aggttagtgctgaaatgacatg

SEQ ID NO: 9263586 - DNA, 22 bp, Homo sapiens
aggttatatgactgtcatgcct

SEQ ID NO: 9263587 - DNA, 22 bp, Homo sapiens
aggttattaaagtgtatttttg

SEQ ID NO: 9263588 - DNA, 22 bp, Homo sapiens
aggtgtgtataaacatacatat

SEQ ID NO: 9263589 - DNA, 22 bp, Homo sapiens
aggttacagtcatctcagaatc

SEQ ID NO: 9263590 - DNA, 22 bp, Homo sapiens
aggttagaatgtaagagtttca

SEQ ID NO: 9263591 - DNA, 22 bp, Homo sapiens
aggttagaatgtaagagtttca

SEQ ID NO: 9263592 - DNA, 22 bp, Homo sapiens
aggttagataagaaggttgtgg

SEQ ID NO: 9263593 - DNA, 22 bp, Homo sapiens
aggttagatagtttattagaac

SEQ ID NO: 9263594 - DNA, 22 bp, Homo sapiens
aggttagataagaaggttgtgg

SEQ ID NO: 9263595 - DNA, 22 bp, Homo sapiens
aggttagatagtttattagaac

SEQ ID NO: 9263596 - DNA, 22 bp, Homo sapiens
aggttggctgctcttttcctaa

SEQ ID NO: 9263597 - DNA, 22 bp, Homo sapiens
aggttggctgctcttttcctaa

SEQ ID NO: 9263598 - DNA, 22 bp, Homo sapiens
aggttggcctcagggaggctct

SEQ ID NO: 9263599 - DNA, 22 bp, Homo sapiens
cgtgctctggactcgtggcaca

SEQ ID NO: 9263600 - DNA, 22 bp, Homo sapiens
ctaaaattatcaagataattcc

SEQ ID NO: 9263601 - DNA, 22 bp, Homo sapiens
cgtggctcttttctgcatcagg

SEQ ID NO: 9263602 - DNA, 22 bp, Homo sapiens
ctaaaattatcaagataattcc

SEQ ID NO: 9263603 - DNA, 22 bp, Homo sapiens
ctaaacatgaactacatttagg

SEQ ID NO: 9263604 - DNA, 22 bp, Homo sapiens
ctaaacatgcaagagcttctgg

SEQ ID NO: 9263605 - DNA, 22 bp, Homo sapiens
ctaaacatgtagcttttgtggt

SEQ ID NO: 9263606 - DNA, 22 bp, Homo sapiens
ctaaacatgttggtgctttaaa

SEQ ID NO: 9263607 - DNA, 22 bp, Homo sapiens
ctaaacaggaaggagcacctga

SEQ ID NO: 9263608 - DNA, 22 bp, Homo sapiens
ctaaacaatgaacaaagcactg

SEQ ID NO: 9263609 - DNA, 22 bp, Homo sapiens
ctaaacaatgaacaaagcactg

SEQ ID NO: 9263610 - DNA, 22 bp, Homo sapiens
cggtcaggtgcagcgttggcac

SEQ ID NO: 9263611 - DNA, 22 bp, Homo sapiens
cggtcaggtgcagcgttggcac

SEQ ID NO: 9263612 - DNA, 17 bp, Homo sapiens
cgtgagcagcaggtgcc

SEQ ID NO: 9263613 - DNA, 22 bp, Homo sapiens
cgtgccttggtcccaaccccca

SEQ ID NO: 9263614 - DNA, 22 bp, Homo sapiens
cgtgctaacgtttaaggttatg

SEQ ID NO: 9263615 - DNA, 22 bp, Homo sapiens
cgtgcggttagacaggtaccgg

SEQ ID NO: 9263616 - DNA, 22 bp, Homo sapiens
cgcgctgcagacagcggaggcc

SEQ ID NO: 9263617 - DNA, 22 bp, Homo sapiens
cgccttcaggccctttttgttg

SEQ ID NO: 9263618 - DNA, 22 bp, Homo sapiens
cgcctgggagtccacacctgct

SEQ ID NO: 9263619 - DNA, 22 bp, Homo sapiens
cgcctgggagtccacacctgct

SEQ ID NO: 9263620 - DNA, 22 bp, Homo sapiens
agtcagagaatgttttcatgga

SEQ ID NO: 9263621 - DNA, 23 bp, Homo sapiens
agtcagagagtgtgagacaactg

SEQ ID NO: 9263622 - DNA, 22 bp, Homo sapiens
agtcaccaacatggttcccagg

SEQ ID NO: 9263623 - DNA, 22 bp, Homo sapiens
agtcagatttagatgtagcaag

SEQ ID NO: 9263624 - DNA, 22 bp, Homo sapiens
ctacacagagcctacttctgca

SEQ ID NO: 9263625 - DNA, 17 bp, Homo sapiens
agtcagaggagtatctg

SEQ ID NO: 9263626 - DNA, 22 bp, Homo sapiens
ctacagaagaaactatcactat

SEQ ID NO: 9263627 - DNA, 21 bp, Homo sapiens
ctacagaatcgagcattctgg

SEQ ID NO: 9263628 - DNA, 21 bp, Homo sapiens
ctacacagctttctataggaa

SEQ ID NO: 9263629 - DNA, 22 bp, Homo sapiens
ctacacagttctgcctaatggc

SEQ ID NO: 9263630 - DNA, 22 bp, Homo sapiens
ctacacagttctgcctaatggc

SEQ ID NO: 9263631 - DNA, 20 bp, Homo sapiens
ctacacagggttcgctgggc

SEQ ID NO: 9263632 - DNA, 22 bp, Homo sapiens
ctacacttgttcgactgcagga

SEQ ID NO: 9263633 - DNA, 22 bp, Homo sapiens
ctacaccttgatctaacatttt

SEQ ID NO: 9263634 - DNA, 22 bp, Homo sapiens
agtcataattataaacatcagt

SEQ ID NO: 9263635 - DNA, 21 bp, Homo sapiens
ctacagaatcgagcattctgg

SEQ ID NO: 9263636 - DNA, 22 bp, Homo sapiens
agtcaggatttaaactcagaca

SEQ ID NO: 9263637 - DNA, 22 bp, Homo sapiens
agtcagtgttctccggagaggc

SEQ ID NO: 9263638 - DNA, 22 bp, Homo sapiens
aggtgaggtttgggaggtgtca

SEQ ID NO: 9263639 - DNA, 22 bp, Homo sapiens
aggtgagggtgccagtgcatgg

SEQ ID NO: 9263640 - DNA, 19 bp, Homo sapiens
aggtgaggggcaccatgtc

SEQ ID NO: 9263641 - DNA, 19 bp, Homo sapiens
aggtgaggggcaccatgtc

SEQ ID NO: 9263642 - DNA, 22 bp, Homo sapiens
aggtctgggagttcattccctg

SEQ ID NO: 9263643 - DNA, 22 bp, Homo sapiens
aggtctggaggcggagtcagga

SEQ ID NO: 9263644 - DNA, 23 bp, Homo sapiens
aggtctggacccttggcccctgc

SEQ ID NO: 9263645 - DNA, 22 bp, Homo sapiens
aggtctggtgagagcaggtgct

SEQ ID NO: 9263646 - DNA, 22 bp, Homo sapiens
aggtctggtgagagcaggtgct

SEQ ID NO: 9263647 - DNA, 22 bp, Homo sapiens
aggtctgggcaccactggctgc

SEQ ID NO: 9263648 - DNA, 22 bp, Homo sapiens
aggtctgggattgaagacatca

SEQ ID NO: 9263649 - DNA, 20 bp, Homo sapiens
aggtctgaatgtcagggctg

SEQ ID NO: 9263650 - DNA, 17 bp, Homo sapiens
aggtctgagagtatctg

SEQ ID NO: 9263651 - DNA, 22 bp, Homo sapiens
aggtctggaaacagcagggaga

SEQ ID NO: 9263652 - DNA, 19 bp, Homo sapiens
aggtctgcagctgcagttt

SEQ ID NO: 9263653 - DNA, 20 bp, Homo sapiens
aggtctgattccagaatcag

SEQ ID NO: 9263654 - DNA, 20 bp, Homo sapiens
aggtctgattccagaatcag

SEQ ID NO: 9263655 - DNA, 22 bp, Homo sapiens
aggtctgagtcccaggggtacc

SEQ ID NO: 9263656 - DNA, 22 bp, Homo sapiens
aggtctgagtatggcctgagaa

SEQ ID NO: 9263657 - DNA, 22 bp, Homo sapiens
aggtctgagcaggggagaacag

SEQ ID NO: 9263658 - DNA, 18 bp, Homo sapiens
aggtctgaggaagagcct

SEQ ID NO: 9263659 - DNA, 22 bp, Homo sapiens
aggtctgagtagagaaaaggca

SEQ ID NO: 9263660 - DNA, 22 bp, Homo sapiens
aggtggagtgtgcagggagagc

SEQ ID NO: 9263661 - DNA, 22 bp, Homo sapiens
aggtggagtgtgcagggagagc

SEQ ID NO: 9263662 - DNA, 22 bp, Homo sapiens
aggtggagtgtgcagggagagc

SEQ ID NO: 9263663 - DNA, 23 bp, Homo sapiens
aggtggagctgtgcagccggggc

SEQ ID NO: 9263664 - DNA, 22 bp, Homo sapiens
aggtgcttggctcgtgcacaca

SEQ ID NO: 9263665 - DNA, 22 bp, Homo sapiens
aggtggagtgaaggaaaggcag

SEQ ID NO: 9263666 - DNA, 22 bp, Homo sapiens
aggtggagtgaaggaaaggcag

SEQ ID NO: 9263667 - DNA, 22 bp, Homo sapiens
aggtggagttaagtgtgaactg

SEQ ID NO: 9263668 - DNA, 22 bp, Homo sapiens
aggtggagttaagtgtgaactg

SEQ ID NO: 9263669 - DNA, 22 bp, Homo sapiens
aggtggagttggctgtagttca

SEQ ID NO: 9263670 - DNA, 22 bp, Homo sapiens
aggtggagttggctgtagttca

SEQ ID NO: 9263671 - DNA, 22 bp, Homo sapiens
cctgggtgtcatgggcagctgg

SEQ ID NO: 9263672 - DNA, 22 bp, Homo sapiens
cctgggtgtcatgggcagctgg

SEQ ID NO: 9263673 - DNA, 22 bp, Homo sapiens
cctgggttagtatctgtttcca

SEQ ID NO: 9263674 - DNA, 22 bp, Homo sapiens
cctgggttggagagcaatggtg

SEQ ID NO: 9263675 - DNA, 23 bp, Homo sapiens
cctgggtttcagagctgcttttc

SEQ ID NO: 9263676 - DNA, 22 bp, Homo sapiens
cctggtcaggtaactgggctga

SEQ ID NO: 9263677 - DNA, 22 bp, Homo sapiens
cctggtcagagcagtcaggatc

SEQ ID NO: 9263678 - DNA, 22 bp, Homo sapiens
cctgggcagggctggactctca

SEQ ID NO: 9263679 - DNA, 22 bp, Homo sapiens
cctgggcagggctggactctca

SEQ ID NO: 9263680 - DNA, 22 bp, Homo sapiens
cctgggcaggtgtggcttcccc

SEQ ID NO: 9263681 - DNA, 22 bp, Homo sapiens
cctgggcaggtgtggcttcccc

SEQ ID NO: 9263682 - DNA, 22 bp, Homo sapiens
cctgggcagtgctggagttgaa

SEQ ID NO: 9263683 - DNA, 22 bp, Homo sapiens
cctgggcagtgctggagttgaa

SEQ ID NO: 9263684 - DNA, 22 bp, Homo sapiens
aggtgctgtttgtcagcagttt

SEQ ID NO: 9263685 - DNA, 22 bp, Homo sapiens
cctgggcagggagaccaggctc

SEQ ID NO: 9263686 - DNA, 22 bp, Homo sapiens
cctgggcagggctggactctca

SEQ ID NO: 9263687 - DNA, 22 bp, Homo sapiens
cctgggcaggccggacgctggg

SEQ ID NO: 9263688 - DNA, 22 bp, Homo sapiens
cctgggcagggagaccaggctc

SEQ ID NO: 9263689 - DNA, 22 bp, Homo sapiens
cctgggcagcctgctcaaggac

SEQ ID NO: 9263690 - DNA, 22 bp, Homo sapiens
cctgggcaggatgggcccggtg

SEQ ID NO: 9263691 - DNA, 22 bp, Homo sapiens
cctgggcaggatgggcccggtg

SEQ ID NO: 9263692 - DNA, 21 bp, Homo sapiens
aggtgcagagccagggaccag

SEQ ID NO: 9263693 - DNA, 21 bp, Homo sapiens
aggtgcagagccagggaccag

SEQ ID NO: 9263694 - DNA, 22 bp, Homo sapiens
aggtgcagaaaaaagtccttta

SEQ ID NO: 9263695 - DNA, 22 bp, Homo sapiens
aggtgagttacaggaggaggtc

SEQ ID NO: 9263696 - DNA, 22 bp, Homo sapiens
aggtgagttggtaggaagtttg

SEQ ID NO: 9263697 - DNA, 22 bp, Homo sapiens
aggtgagtcctgggcacaggta

SEQ ID NO: 9263698 - DNA, 22 bp, Homo sapiens
aggtgaggtttgggaggtgtca

SEQ ID NO: 9263699 - DNA, 22 bp, Homo sapiens
cctggagcaggagctgcagagg

SEQ ID NO: 9263700 - DNA, 22 bp, Homo sapiens
cctggagcatcaggaggaaggg

SEQ ID NO: 9263701 - DNA, 22 bp, Homo sapiens
cctggagcaggagctgcagagg

SEQ ID NO: 9263702 - DNA, 22 bp, Homo sapiens
cctggagcaggagctgcagagg

SEQ ID NO: 9263703 - DNA, 22 bp, Homo sapiens
cctggagcccaaggcagtgaga

SEQ ID NO: 9263704 - DNA, 22 bp, Homo sapiens
cctggagcccaaggcagtgaga

SEQ ID NO: 9263705 - DNA, 22 bp, Homo sapiens
cctgcctggcccaccttgccac

SEQ ID NO: 9263706 - DNA, 22 bp, Homo sapiens
cctgcctggcccaccttgccac

SEQ ID NO: 9263707 - DNA, 22 bp, Homo sapiens
cctgcctggctgtcagcagagc

SEQ ID NO: 9263708 - DNA, 22 bp, Homo sapiens
cctgcctggatcagccatcctg

SEQ ID NO: 9263709 - DNA, 22 bp, Homo sapiens
cctgcctggcacatagtactct

SEQ ID NO: 9263710 - DNA, 22 bp, Homo sapiens
cctgcctggagctgagtgtgga

SEQ ID NO: 9263711 - DNA, 22 bp, Homo sapiens
cctgcctggagctgagtgtgga

SEQ ID NO: 9263712 - DNA, 22 bp, Homo sapiens
cctgcctggatcagccatcctg

SEQ ID NO: 9263713 - DNA, 22 bp, Homo sapiens
cctgcctggatcagccatcctg

SEQ ID NO: 9263714 - DNA, 22 bp, Homo sapiens
cctgcctgctttctgctttgca

SEQ ID NO: 9263715 - DNA, 22 bp, Homo sapiens
cctgcctgctttctgctttgca

SEQ ID NO: 9263716 - DNA, 22 bp, Homo sapiens
aggggcttgtggagttgctggt

SEQ ID NO: 9263717 - DNA, 23 bp, Homo sapiens
agggtgagcaagctatggagacc

SEQ ID NO: 9263718 - DNA, 22 bp, Homo sapiens
agggtggaagatggcactatct

SEQ ID NO: 9263719 - DNA, 19 bp, Homo sapiens
agggtggcaaaggagggtg

SEQ ID NO: 9263720 - DNA, 22 bp, Homo sapiens
agggtgctgccggacaggtggg

SEQ ID NO: 9263721 - DNA, 22 bp, Homo sapiens
agggtggagggagtccctgagc

SEQ ID NO: 9263722 - DNA, 22 bp, Homo sapiens
agggtgcgttctatgagaatct

SEQ ID NO: 9263723 - DNA, 22 bp, Homo sapiens
agggtggaagatggcactatct

SEQ ID NO: 9263724 - DNA, 22 bp, Homo sapiens
cctgcctgcgtcctctgagggc

SEQ ID NO: 9263725 - DNA, 22 bp, Homo sapiens
cctgcctgcgtcctctgagggc

SEQ ID NO: 9263726 - DNA, 22 bp, Homo sapiens
agggtggcagttactggagcaa

SEQ ID NO: 9263727 - DNA, 22 bp, Homo sapiens
agggtggcagttactggagcaa

SEQ ID NO: 9263728 - DNA, 22 bp, Homo sapiens
agggtggcagttactggagcaa

SEQ ID NO: 9263729 - DNA, 22 bp, Homo sapiens
agggtggcactggtggctctat

SEQ ID NO: 9263730 - DNA, 19 bp, Homo sapiens
agggtggcaaaggagggtg

SEQ ID NO: 9263731 - DNA, 22 bp, Homo sapiens
agggtggcacctggaagggatg

SEQ ID NO: 9263732 - DNA, 22 bp, Homo sapiens
agggtggctggaggaatcagaa

SEQ ID NO: 9263733 - DNA, 22 bp, Homo sapiens
agggtggctgagtagatggaag

SEQ ID NO: 9263734 - DNA, 22 bp, Homo sapiens
agggtggctgagtagatggaag

SEQ ID NO: 9263735 - DNA, 21 bp, Homo sapiens
agggtggctctgggtcagaac

SEQ ID NO: 9263736 - DNA, 22 bp, Homo sapiens
agggtggctgtgaagtgcttgg

SEQ ID NO: 9263737 - DNA, 20 bp, Homo sapiens
cctggagcctggaaggagtc

SEQ ID NO: 9263738 - DNA, 20 bp, Homo sapiens
cctggagcctggaaggagtc

SEQ ID NO: 9263739 - DNA, 22 bp, Homo sapiens
cctggagcgcgggtcaagctgg

SEQ ID NO: 9263740 - DNA, 22 bp, Homo sapiens
cctggagcccctctggccagcc

SEQ ID NO: 9263741 - DNA, 22 bp, Homo sapiens
cctggagcccctctggccagcc

SEQ ID NO: 9263742 - DNA, 22 bp, Homo sapiens
agggtggccatgagggagagat

SEQ ID NO: 9263743 - DNA, 22 bp, Homo sapiens
agggtggcagttactggagcaa

SEQ ID NO: 9263744 - DNA, 22 bp, Homo sapiens
cctggagctcactgggagccgg

SEQ ID NO: 9263745 - DNA, 22 bp, Homo sapiens
cctggagctcactgggagccgg

SEQ ID NO: 9263746 - DNA, 22 bp, Homo sapiens
cctggctcagagtatgtcatcg

SEQ ID NO: 9263747 - DNA, 22 bp, Homo sapiens
aggtagtgtagctgagtgggat

SEQ ID NO: 9263748 - DNA, 17 bp, Homo sapiens
aggtataaaatggtagc

SEQ ID NO: 9263749 - DNA, 22 bp, Homo sapiens
aggtataagtctcatttctgtt

SEQ ID NO: 9263750 - DNA, 22 bp, Homo sapiens
aggtataagtctcatttctgtt

SEQ ID NO: 9263751 - DNA, 22 bp, Homo sapiens
aggtatctggtaagaggcagac

SEQ ID NO: 9263752 - DNA, 22 bp, Homo sapiens
aggtatcaacagcagagtctga

SEQ ID NO: 9263753 - DNA, 22 bp, Homo sapiens
aggggctggagttcgaggttac

SEQ ID NO: 9263754 - DNA, 22 bp, Homo sapiens
aggggctgggacagagccaagc

SEQ ID NO: 9263755 - DNA, 22 bp, Homo sapiens
aggggctggcttatctgagagt

SEQ ID NO: 9263756 - DNA, 22 bp, Homo sapiens
cctgaggcaaggacttggtggc

SEQ ID NO: 9263757 - DNA, 22 bp, Homo sapiens
cctgaggcaaggacttggtggc

SEQ ID NO: 9263758 - DNA, 22 bp, Homo sapiens
cctgaggcccctgaggatagca

SEQ ID NO: 9263759 - DNA, 22 bp, Homo sapiens
aggggctgcctggcttggcact

SEQ ID NO: 9263760 - DNA, 22 bp, Homo sapiens
cctgaggattgttggtgcttcc

SEQ ID NO: 9263761 - DNA, 22 bp, Homo sapiens
cctgaggagattgtggctgggg

SEQ ID NO: 9263762 - DNA, 22 bp, Homo sapiens
cctgaggagattgtggctgggg

SEQ ID NO: 9263763 - DNA, 21 bp, Homo sapiens
aggggacagagtagctccagg

SEQ ID NO: 9263764 - DNA, 22 bp, Homo sapiens
aggggagaaaaatgccttctgt

SEQ ID NO: 9263765 - DNA, 22 bp, Homo sapiens
cctgagagtggtgtacaggaga

SEQ ID NO: 9263766 - DNA, 22 bp, Homo sapiens
cctgagatcagtgcatttggtg

SEQ ID NO: 9263767 - DNA, 17 bp, Homo sapiens
aggggagagtgggaaga

SEQ ID NO: 9263768 - DNA, 22 bp, Homo sapiens
aggggagagttaatgtgaatgt

SEQ ID NO: 9263769 - DNA, 22 bp, Homo sapiens
cctgaggacacacgctgcagga

SEQ ID NO: 9263770 - DNA, 22 bp, Homo sapiens
cctgaggacacacgctgcagga

SEQ ID NO: 9263771 - DNA, 22 bp, Homo sapiens
cctgaggaccagcacccatctg

SEQ ID NO: 9263772 - DNA, 22 bp, Homo sapiens
agggctgcaggcaagatatggc

SEQ ID NO: 9263773 - DNA, 19 bp, Homo sapiens
cctctgccagcccgcctct

SEQ ID NO: 9263774 - DNA, 22 bp, Homo sapiens
cctctggcttactgttgggttt

SEQ ID NO: 9263775 - DNA, 22 bp, Homo sapiens
cctctggcttactgttgggttt

SEQ ID NO: 9263776 - DNA, 21 bp, Homo sapiens
cctctggcttgtgctgtgccc

SEQ ID NO: 9263777 - DNA, 22 bp, Homo sapiens
cctctgggcggagatctgctgc

SEQ ID NO: 9263778 - DNA, 22 bp, Homo sapiens
cctcctggaggctctagggaaa

SEQ ID NO: 9263779 - DNA, 22 bp, Homo sapiens
agggctgagtgggagagagttg

SEQ ID NO: 9263780 - DNA, 22 bp, Homo sapiens
agggctgagtggtgcagtcaaa

SEQ ID NO: 9263781 - DNA, 22 bp, Homo sapiens
agggctgagtggtgcagtcaaa

SEQ ID NO: 9263782 - DNA, 18 bp, Homo sapiens
agggctgatgagtttggg

SEQ ID NO: 9263783 - DNA, 18 bp, Homo sapiens
agggctgatgagtttggg

SEQ ID NO: 9263784 - DNA, 22 bp, Homo sapiens
agggctgatgcaccatgtagcc

SEQ ID NO: 9263785 - DNA, 22 bp, Homo sapiens
agggctgatgcaccatgtagcc

SEQ ID NO: 9263786 - DNA, 23 bp, Homo sapiens
agggctgatgccattgcagctct

SEQ ID NO: 9263787 - DNA, 23 bp, Homo sapiens
agggctgatgccattgcagctct

SEQ ID NO: 9263788 - DNA, 23 bp, Homo sapiens
agggctgatgccattgcagctct

SEQ ID NO: 9263789 - DNA, 23 bp, Homo sapiens
agggctgatgccattgcagctct

SEQ ID NO: 9263790 - DNA, 22 bp, Homo sapiens
cctcctggagcattggtgagga

SEQ ID NO: 9263791 - DNA, 22 bp, Homo sapiens
cctcctggaaaaattccctggc

SEQ ID NO: 9263792 - DNA, 22 bp, Homo sapiens
cctcctggaaaaattccctggc

SEQ ID NO: 9263793 - DNA, 22 bp, Homo sapiens
agggccctccccgctcagggca

SEQ ID NO: 9263794 - DNA, 22 bp, Homo sapiens
agggccctctggcaggccaggc

SEQ ID NO: 9263795 - DNA, 22 bp, Homo sapiens
agggccctccccgctcagggca

SEQ ID NO: 9263796 - DNA, 22 bp, Homo sapiens
agggcccttacgcaggcccttc

SEQ ID NO: 9263797 - DNA, 22 bp, Homo sapiens
agggccctggggtgcactgaca

SEQ ID NO: 9263798 - DNA, 22 bp, Homo sapiens
agggcccttacgcaggcccttc

SEQ ID NO: 9263799 - DNA, 22 bp, Homo sapiens
agggcccttacgcaggcccttc

SEQ ID NO: 9263800 - DNA, 22 bp, Homo sapiens
agggctccaaggaagtgtagct

SEQ ID NO: 9263801 - DNA, 22 bp, Homo sapiens
agggctcccgtgaggtgactgc

SEQ ID NO: 9263802 - DNA, 22 bp, Homo sapiens
agggctccaggggctgggtgac

SEQ ID NO: 9263803 - DNA, 22 bp, Homo sapiens
agggctcctccccggcctccac

SEQ ID NO: 9263804 - DNA, 22 bp, Homo sapiens
agggctcctccccggcctccac

SEQ ID NO: 9263805 - DNA, 18 bp, Homo sapiens
agggctctctgctgggtt

SEQ ID NO: 9263806 - DNA, 22 bp, Homo sapiens
agggctccgggccaccggcctg

SEQ ID NO: 9263807 - DNA, 22 bp, Homo sapiens
agggctccgggcaggcgatgga

SEQ ID NO: 9263808 - DNA, 22 bp, Homo sapiens
agggctcctatgccccatggac

SEQ ID NO: 9263809 - DNA, 22 bp, Homo sapiens
agggctcctatgccccatggac

SEQ ID NO: 9263810 - DNA, 22 bp, Homo sapiens
cctccccacgggcagccggcgc

SEQ ID NO: 9263811 - DNA, 22 bp, Homo sapiens
agggctctgtccccagaggccc

SEQ ID NO: 9263812 - DNA, 20 bp, Homo sapiens
agggctctgccttgctgatg

SEQ ID NO: 9263813 - DNA, 22 bp, Homo sapiens
agggctctggggtggcagagat

SEQ ID NO: 9263814 - DNA, 22 bp, Homo sapiens
agggctctgtccccagaggccc

SEQ ID NO: 9263815 - DNA, 22 bp, Homo sapiens
ccctggaggctggaggcagtag

SEQ ID NO: 9263816 - DNA, 23 bp, Homo sapiens
agggccactgggaaggattactg

SEQ ID NO: 9263817 - DNA, 16 bp, Homo sapiens
agggccagaagcatca

SEQ ID NO: 9263818 - DNA, 22 bp, Homo sapiens
ccctggagggacagctgctcta

SEQ ID NO: 9263819 - DNA, 19 bp, Homo sapiens
ccctggaggagtgttggct

SEQ ID NO: 9263820 - DNA, 22 bp, Homo sapiens
ccctggaggcggagcttgcagt

SEQ ID NO: 9263821 - DNA, 22 bp, Homo sapiens
ccctggaggcggagcttgcagt

SEQ ID NO: 9263822 - DNA, 22 bp, Homo sapiens
agggccagagtacatcagggct

SEQ ID NO: 9263823 - DNA, 22 bp, Homo sapiens
agggccagagtacatcagggct

SEQ ID NO: 9263824 - DNA, 22 bp, Homo sapiens
agggccagagtacatcagggct

SEQ ID NO: 9263825 - DNA, 22 bp, Homo sapiens
agggccagagtctgtgtagata

SEQ ID NO: 9263826 - DNA, 22 bp, Homo sapiens
agggccagagtacatcagggct

SEQ ID NO: 9263827 - DNA, 22 bp, Homo sapiens
agggccagaggcaccttgcagc

SEQ ID NO: 9263828 - DNA, 22 bp, Homo sapiens
agggccagaatccctcagtcta

SEQ ID NO: 9263829 - DNA, 22 bp, Homo sapiens
agggccagaatccctcagtcta

SEQ ID NO: 9263830 - DNA, 16 bp, Homo sapiens
agggccagaagcatca

SEQ ID NO: 9263831 - DNA, 22 bp, Homo sapiens
ccgaggtcctggacttggccct

SEQ ID NO: 9263832 - DNA, 22 bp, Homo sapiens
ccgaggtcctggacttggccct

SEQ ID NO: 9263833 - DNA, 22 bp, Homo sapiens
ccgcccacactaaatatgagcg

SEQ ID NO: 9263834 - DNA, 22 bp, Homo sapiens
agggccctaaggaaggcacaca

SEQ ID NO: 9263835 - DNA, 22 bp, Homo sapiens
agggccctaaggaaggcacaca

SEQ ID NO: 9263836 - DNA, 22 bp, Homo sapiens
cccttcagtgctaggctgcctg

SEQ ID NO: 9263837 - DNA, 22 bp, Homo sapiens
agggccagagtctgtgtagata

SEQ ID NO: 9263838 - DNA, 22 bp, Homo sapiens
ccctttctgggacccctgtctc

SEQ ID NO: 9263839 - DNA, 22 bp, Homo sapiens
ccctttctccagaactgtctga

SEQ ID NO: 9263840 - DNA, 22 bp, Homo sapiens
ccctttcttcttgactgaaaac

SEQ ID NO: 9263841 - DNA, 17 bp, Homo sapiens
ccctctggggagggagg

SEQ ID NO: 9263842 - DNA, 18 bp, Homo sapiens
ccctcttgcacaaagcaa

SEQ ID NO: 9263843 - DNA, 18 bp, Homo sapiens
ccctcttgcacaaagcaa

SEQ ID NO: 9263844 - DNA, 22 bp, Homo sapiens
ccctctggtttgcccttgggtg

SEQ ID NO: 9263845 - DNA, 22 bp, Homo sapiens
ccctcccaggagtggccagaga

SEQ ID NO: 9263846 - DNA, 22 bp, Homo sapiens
agggatgggaactcctccagca

SEQ ID NO: 9263847 - DNA, 22 bp, Homo sapiens
agggatggcaagttaacctgag

SEQ ID NO: 9263848 - DNA, 22 bp, Homo sapiens
ccctctcttagaagaaacacag

SEQ ID NO: 9263849 - DNA, 22 bp, Homo sapiens
agggcagagagatgaatgggat

SEQ ID NO: 9263850 - DNA, 22 bp, Homo sapiens
agggcagagatctgagtgggca

SEQ ID NO: 9263851 - DNA, 22 bp, Homo sapiens
agggcagagcactgaattggga

SEQ ID NO: 9263852 - DNA, 22 bp, Homo sapiens
agggcagaggcggacacggaag

SEQ ID NO: 9263853 - DNA, 20 bp, Homo sapiens
agggcagagggattacaggc

SEQ ID NO: 9263854 - DNA, 22 bp, Homo sapiens
ccctggaggagcttagagcttg

SEQ ID NO: 9263855 - DNA, 22 bp, Homo sapiens
agggagaacagttgcagcagac

SEQ ID NO: 9263856 - DNA, 22 bp, Homo sapiens
agggagaacagttgcagcagac

SEQ ID NO: 9263857 - DNA, 22 bp, Homo sapiens
agggagaaaattggatgcacaa

SEQ ID NO: 9263858 - DNA, 22 bp, Homo sapiens
agggagaaaattggatgcacaa

SEQ ID NO: 9263859 - DNA, 22 bp, Homo sapiens
agggactggctctctgagcagg

SEQ ID NO: 9263860 - DNA, 22 bp, Homo sapiens
agggagaaaattggatgcacaa

SEQ ID NO: 9263861 - DNA, 22 bp, Homo sapiens
agggaggagtcctcaaagtcat

SEQ ID NO: 9263862 - DNA, 22 bp, Homo sapiens
agggaggagtcctcaaagtcat

SEQ ID NO: 9263863 - DNA, 22 bp, Homo sapiens
agggagaaggtttagctgtgag

SEQ ID NO: 9263864 - DNA, 22 bp, Homo sapiens
agggagaaggtccatgcctgtc

SEQ ID NO: 9263865 - DNA, 22 bp, Homo sapiens
agggagaagagaacaaagccct

SEQ ID NO: 9263866 - DNA, 22 bp, Homo sapiens
agggagaaggtccatgcctgtc

SEQ ID NO: 9263867 - DNA, 22 bp, Homo sapiens
agggagtggttaagaaggtgca

SEQ ID NO: 9263868 - DNA, 22 bp, Homo sapiens
agggagtggttaagaaggtgca

SEQ ID NO: 9263869 - DNA, 22 bp, Homo sapiens
agggagtggttaagaaggtgca

SEQ ID NO: 9263870 - DNA, 22 bp, Homo sapiens
agggatggaagacttgaagacc

SEQ ID NO: 9263871 - DNA, 22 bp, Homo sapiens
agggatggaagacttgaagacc

SEQ ID NO: 9263872 - DNA, 22 bp, Homo sapiens
agggatgatttcagtgtctgcc

SEQ ID NO: 9263873 - DNA, 22 bp, Homo sapiens
agggatggatcttggccctgga

SEQ ID NO: 9263874 - DNA, 22 bp, Homo sapiens
agggatggatcttggccctgga

SEQ ID NO: 9263875 - DNA, 22 bp, Homo sapiens
agggatggatcttggccctgga

SEQ ID NO: 9263876 - DNA, 22 bp, Homo sapiens
agggatggagtgcggcccggac

SEQ ID NO: 9263877 - DNA, 22 bp, Homo sapiens
agggatggagtgcggcccggac

SEQ ID NO: 9263878 - DNA, 22 bp, Homo sapiens
agggatggaagctcgtctgcaa

SEQ ID NO: 9263879 - DNA, 22 bp, Homo sapiens
agggatggagcccagctgttct

SEQ ID NO: 9263880 - DNA, 22 bp, Homo sapiens
agggatggagtgcggcccggac

SEQ ID NO: 9263881 - DNA, 22 bp, Homo sapiens
agggatgactcttggctgattc

SEQ ID NO: 9263882 - DNA, 22 bp, Homo sapiens
aggcttcttgagccccacaggc

SEQ ID NO: 9263883 - DNA, 22 bp, Homo sapiens
aggcttgaaatgaaatctgtaa

SEQ ID NO: 9263884 - DNA, 22 bp, Homo sapiens
aggcttgactgctgattttgcc

SEQ ID NO: 9263885 - DNA, 21 bp, Homo sapiens
aggcttggatctagacaggcc

SEQ ID NO: 9263886 - DNA, 21 bp, Homo sapiens
aggcttggatctagacaggcc

SEQ ID NO: 9263887 - DNA, 21 bp, Homo sapiens
aggcttggatctagacaggcc

SEQ ID NO: 9263888 - DNA, 21 bp, Homo sapiens
aggcttggatctagacaggcc

SEQ ID NO: 9263889 - DNA, 22 bp, Homo sapiens
cccaggagttggaggctacggt

SEQ ID NO: 9263890 - DNA, 22 bp, Homo sapiens
cccaggagttggaggctgcagt

SEQ ID NO: 9263891 - DNA, 22 bp, Homo sapiens
cccaggagttggaggctacggt

SEQ ID NO: 9263892 - DNA, 22 bp, Homo sapiens
cccaggagttggaggctacggt

SEQ ID NO: 9263893 - DNA, 22 bp, Homo sapiens
cccaggaggtggaggctgcagt

SEQ ID NO: 9263894 - DNA, 22 bp, Homo sapiens
cccaggaggtggagcttgcagt

SEQ ID NO: 9263895 - DNA, 22 bp, Homo sapiens
cccaggaggtggagcttgcagt

SEQ ID NO: 9263896 - DNA, 22 bp, Homo sapiens
cccaggaggtggagcttgcagt

SEQ ID NO: 9263897 - DNA, 22 bp, Homo sapiens
aggctggctgagctgcagcctg

SEQ ID NO: 9263898 - DNA, 22 bp, Homo sapiens
aggctggctggcaggggacaca

SEQ ID NO: 9263899 - DNA, 22 bp, Homo sapiens
aggctggctggcaggggacaca

SEQ ID NO: 9263900 - DNA, 22 bp, Homo sapiens
aggcttctccacataaagttac

SEQ ID NO: 9263901 - DNA, 19 bp, Homo sapiens
aggcttctaccctgtccag

SEQ ID NO: 9263902 - DNA, 22 bp, Homo sapiens
cccaggggtaaggcgcagcgtg

SEQ ID NO: 9263903 - DNA, 22 bp, Homo sapiens
cccaggggaggtcctcagggaa

SEQ ID NO: 9263904 - DNA, 22 bp, Homo sapiens
cccaggggaggtcctcagggaa

SEQ ID NO: 9263905 - DNA, 19 bp, Homo sapiens
cccaggggacccagcccta

SEQ ID NO: 9263906 - DNA, 22 bp, Homo sapiens
cccagggcttttctcactagac

SEQ ID NO: 9263907 - DNA, 22 bp, Homo sapiens
cccagggcttttctcactagac

SEQ ID NO: 9263908 - DNA, 22 bp, Homo sapiens
cccagggctgtagaatgtccaa

SEQ ID NO: 9263909 - DNA, 22 bp, Homo sapiens
cccagggctgtagaatgtccaa

SEQ ID NO: 9263910 - DNA, 22 bp, Homo sapiens
cccagggctgtagaatgtccaa

SEQ ID NO: 9263911 - DNA, 22 bp, Homo sapiens
cccagggccctggacagctaca

SEQ ID NO: 9263912 - DNA, 22 bp, Homo sapiens
cccagggctgcagatggaggct

SEQ ID NO: 9263913 - DNA, 22 bp, Homo sapiens
cccagggctgcagatggaggct

SEQ ID NO: 9263914 - DNA, 22 bp, Homo sapiens
cccagggctgcagatggaggct

SEQ ID NO: 9263915 - DNA, 21 bp, Homo sapiens
cccagggaagccgcagtcacc

SEQ ID NO: 9263916 - DNA, 22 bp, Homo sapiens
cccagggaagccatttctgact

SEQ ID NO: 9263917 - DNA, 22 bp, Homo sapiens
agggaagaagctggtagtaggt

SEQ ID NO: 9263918 - DNA, 22 bp, Homo sapiens
agggaagaaaatccatcgctgc

SEQ ID NO: 9263919 - DNA, 23 bp, Homo sapiens
agggaagaaacatgaagggctgt

SEQ ID NO: 9263920 - DNA, 22 bp, Homo sapiens
cccaggagttggaggctgcagt

SEQ ID NO: 9263921 - DNA, 22 bp, Homo sapiens
cccaggagttggaggctgcagt

SEQ ID NO: 9263922 - DNA, 22 bp, Homo sapiens
cccaggagttggaggctgcagt

SEQ ID NO: 9263923 - DNA, 20 bp, Homo sapiens
cccaggagtttgctcttact

SEQ ID NO: 9263924 - DNA, 23 bp, Homo sapiens
cccaggagtttcactgcaaaggt

SEQ ID NO: 9263925 - DNA, 23 bp, Homo sapiens
cccaggagtttcactgcaaaggt

SEQ ID NO: 9263926 - DNA, 22 bp, Homo sapiens
cccaggagtttgagttcagcat

SEQ ID NO: 9263927 - DNA, 22 bp, Homo sapiens
cccaggagtttgagttcagcat

SEQ ID NO: 9263928 - DNA, 22 bp, Homo sapiens
agggaaataatctattctgagg

SEQ ID NO: 9263929 - DNA, 23 bp, Homo sapiens
agggaaatactgcaatttttgga

SEQ ID NO: 9263930 - DNA, 22 bp, Homo sapiens
agggaaatctcagctctaaaat

SEQ ID NO: 9263931 - DNA, 21 bp, Homo sapiens
agggaaatccagtcacttttc

SEQ ID NO: 9263932 - DNA, 22 bp, Homo sapiens
agggaaatctttcaacacttca

SEQ ID NO: 9263933 - DNA, 22 bp, Homo sapiens
agggaaattaatgtgagcaatg

SEQ ID NO: 9263934 - DNA, 22 bp, Homo sapiens
agggaaatggagagtgtagttt

SEQ ID NO: 9263935 - DNA, 23 bp, Homo sapiens
agggaacaagcaagctgctagtc

SEQ ID NO: 9263936 - DNA, 22 bp, Homo sapiens
agggaaattaatgtgagcaatg

SEQ ID NO: 9263937 - DNA, 22 bp, Homo sapiens
ccagcctggactgggtcttgtg

SEQ ID NO: 9263938 - DNA, 22 bp, Homo sapiens
aggcccagagcaggaaagggtt

SEQ ID NO: 9263939 - DNA, 22 bp, Homo sapiens
ccagcttgtttgaagctcgtca

SEQ ID NO: 9263940 - DNA, 22 bp, Homo sapiens
ccagcttgaagatgtgctggtt

SEQ ID NO: 9263941 - DNA, 22 bp, Homo sapiens
ccagctttcatatcatgaggta

SEQ ID NO: 9263942 - DNA, 22 bp, Homo sapiens
ccagctttcatatcatgaggta

SEQ ID NO: 9263943 - DNA, 19 bp, Homo sapiens
ccagctggcctgggacctc

SEQ ID NO: 9263944 - DNA, 22 bp, Homo sapiens
ccagcttctctctgatgcagct

SEQ ID NO: 9263945 - DNA, 22 bp, Homo sapiens
ccagcttctctctgatgcagct

SEQ ID NO: 9263946 - DNA, 17 bp, Homo sapiens
aggccagatgaggcaag

SEQ ID NO: 9263947 - DNA, 17 bp, Homo sapiens
aggccagatgaggcaag

SEQ ID NO: 9263948 - DNA, 22 bp, Homo sapiens
aggccagatattgtgctaccca

SEQ ID NO: 9263949 - DNA, 22 bp, Homo sapiens
aggccagagttaaggagaacag

SEQ ID NO: 9263950 - DNA, 22 bp, Homo sapiens
ccagcctcatcatattcctgct

SEQ ID NO: 9263951 - DNA, 22 bp, Homo sapiens
ccagcctcatcgcctgcctgtc

SEQ ID NO: 9263952 - DNA, 22 bp, Homo sapiens
ccagccctgccagagagagctg

SEQ ID NO: 9263953 - DNA, 22 bp, Homo sapiens
ccagccctgccagagagagctg

SEQ ID NO: 9263954 - DNA, 22 bp, Homo sapiens
ccagcctcatcgcctgcctgtc

SEQ ID NO: 9263955 - DNA, 22 bp, Homo sapiens
ccagcctccatgtagatagctg

SEQ ID NO: 9263956 - DNA, 22 bp, Homo sapiens
ccagcctccatgtagatagctg

SEQ ID NO: 9263957 - DNA, 22 bp, Homo sapiens
ccagcctccatgtagatagctg

SEQ ID NO: 9263958 - DNA, 19 bp, Homo sapiens
ccagcctctcttccacccc

SEQ ID NO: 9263959 - DNA, 22 bp, Homo sapiens
ccagcctgaaatgcctcatcct

SEQ ID NO: 9263960 - DNA, 22 bp, Homo sapiens
ccagcctgaaatgcctcatcct

SEQ ID NO: 9263961 - DNA, 22 bp, Homo sapiens
ccagcctgaaatgcctcatcct

SEQ ID NO: 9263962 - DNA, 22 bp, Homo sapiens
ccagcctgaaatgcctcatcct

SEQ ID NO: 9263963 - DNA, 19 bp, Homo sapiens
ccagcctctcttccacccc

SEQ ID NO: 9263964 - DNA, 23 bp, Homo sapiens
ccagcctctgggtcttcatccag

SEQ ID NO: 9263965 - DNA, 22 bp, Homo sapiens
ccagcttttcttatcattataa

SEQ ID NO: 9263966 - DNA, 22 bp, Homo sapiens
aggccctggcccccagagattc

SEQ ID NO: 9263967 - DNA, 22 bp, Homo sapiens
aggccctggcactgcctgggag

SEQ ID NO: 9263968 - DNA, 22 bp, Homo sapiens
aggccctggcccccagagattc

SEQ ID NO: 9263969 - DNA, 18 bp, Homo sapiens
aggccctggcctcgaaca

SEQ ID NO: 9263970 - DNA, 22 bp, Homo sapiens
aggccctgggagcagagatgca

SEQ ID NO: 9263971 - DNA, 22 bp, Homo sapiens
aggccctgggcagttctgtagc

SEQ ID NO: 9263972 - DNA, 22 bp, Homo sapiens
ccaggagatgggagcatctaaa

SEQ ID NO: 9263973 - DNA, 22 bp, Homo sapiens
ccaggagatgggagcatctaaa

SEQ ID NO: 9263974 - DNA, 22 bp, Homo sapiens
ccaggagatttttccatagcac

SEQ ID NO: 9263975 - DNA, 22 bp, Homo sapiens
ccaggagcaaagatcactggga

SEQ ID NO: 9263976 - DNA, 17 bp, Homo sapiens
ccaggagcgtgggtctc

SEQ ID NO: 9263977 - DNA, 22 bp, Homo sapiens
ccaggagatgggaaagtagcag

SEQ ID NO: 9263978 - DNA, 22 bp, Homo sapiens
ccaggagatgatgttggggatt

SEQ ID NO: 9263979 - DNA, 22 bp, Homo sapiens
ccaggagataagctgagtttat

SEQ ID NO: 9263980 - DNA, 19 bp, Homo sapiens
ccaggagagcttggagaag

SEQ ID NO: 9263981 - DNA, 22 bp, Homo sapiens
ccaggagagcagaagcccaggc

SEQ ID NO: 9263982 - DNA, 22 bp, Homo sapiens
ccaggagagcagaagcccaggc

SEQ ID NO: 9263983 - DNA, 22 bp, Homo sapiens
ccaggagagcaggcgtgcagct

SEQ ID NO: 9263984 - DNA, 22 bp, Homo sapiens
ccaggagagcaggcgtgcagct

SEQ ID NO: 9263985 - DNA, 22 bp, Homo sapiens
ccaggagagctctcgttcagtg

SEQ ID NO: 9263986 - DNA, 22 bp, Homo sapiens
ccaggagagctctaaatggctg

SEQ ID NO: 9263987 - DNA, 22 bp, Homo sapiens
ccaggagagcgccctcccggcc

SEQ ID NO: 9263988 - DNA, 22 bp, Homo sapiens
ccaggagagcattgcacagagg

SEQ ID NO: 9263989 - DNA, 22 bp, Homo sapiens
ccagagcaattctcacagaact

SEQ ID NO: 9263990 - DNA, 22 bp, Homo sapiens
ccagagcaattctcacagaact

SEQ ID NO: 9263991 - DNA, 22 bp, Homo sapiens
aggcatggatggatccagggct

SEQ ID NO: 9263992 - DNA, 22 bp, Homo sapiens
aggcatgcgccaatttattaga

SEQ ID NO: 9263993 - DNA, 22 bp, Homo sapiens
aggcatggatgtagcagtgacc

SEQ ID NO: 9263994 - DNA, 23 bp, Homo sapiens
aggcatggcatggatggtggctc

SEQ ID NO: 9263995 - DNA, 22 bp, Homo sapiens
ccagagtgacgtgaagtgtgaa

SEQ ID NO: 9263996 - DNA, 19 bp, Homo sapiens
ccagcagacacagctgccc

SEQ ID NO: 9263997 - DNA, 22 bp, Homo sapiens
ccagcagagctcaaacttcctg

SEQ ID NO: 9263998 - DNA, 22 bp, Homo sapiens
ccagcagagcatggggaggaag

SEQ ID NO: 9263999 - DNA, 22 bp, Homo sapiens
ccagcactgctctcagactgag

SEQ ID NO: 9264000 - DNA, 19 bp, Homo sapiens
ccagcagaagccactcctg

SEQ ID NO: 9264001 - DNA, 22 bp, Homo sapiens
ccagcagacacacaggcgtggg

SEQ ID NO: 9264002 - DNA, 22 bp, Homo sapiens
ccagcagaagctcccgctgggt

SEQ ID NO: 9264003 - DNA, 22 bp, Homo sapiens
aggccagacagctagaaacagg

SEQ ID NO: 9264004 - DNA, 22 bp, Homo sapiens
aggccagaagccagaaatgctt

SEQ ID NO: 9264005 - DNA, 22 bp, Homo sapiens
ccagcagagggcgcttcacacc

SEQ ID NO: 9264006 - DNA, 22 bp, Homo sapiens
aggccagaaatttggagtatgt

SEQ ID NO: 9264007 - DNA, 22 bp, Homo sapiens
ccagcagaggggcggagtgcag

SEQ ID NO: 9264008 - DNA, 22 bp, Homo sapiens
aggccagaaatgtcagggagtg

SEQ ID NO: 9264009 - DNA, 20 bp, Homo sapiens
ccacaggagtccagtcgacc

SEQ ID NO: 9264010 - DNA, 22 bp, Homo sapiens
ccacaggaggaacaattagatg

SEQ ID NO: 9264011 - DNA, 22 bp, Homo sapiens
ccacaggacggaggtctggccg

SEQ ID NO: 9264012 - DNA, 22 bp, Homo sapiens
ccacaggaccagaggagatcac

SEQ ID NO: 9264013 - DNA, 22 bp, Homo sapiens
ccagagagtcgatgggggacac

SEQ ID NO: 9264014 - DNA, 22 bp, Homo sapiens
ccagagagtatcatggagagta

SEQ ID NO: 9264015 - DNA, 22 bp, Homo sapiens
ccagagagtatcatggagagta

SEQ ID NO: 9264016 - DNA, 22 bp, Homo sapiens
ccagagagtatcatggagagta

SEQ ID NO: 9264017 - DNA, 22 bp, Homo sapiens
ccagagaggtagcttaccctct

SEQ ID NO: 9264018 - DNA, 22 bp, Homo sapiens
ccagagagtaaacattttccgg

SEQ ID NO: 9264019 - DNA, 22 bp, Homo sapiens
ccacagctgaccgcaggtgagc

SEQ ID NO: 9264020 - DNA, 22 bp, Homo sapiens
ccacagctgaccgcaggtgagc

SEQ ID NO: 9264021 - DNA, 22 bp, Homo sapiens
ccacagctgaccgcaggtgagc

SEQ ID NO: 9264022 - DNA, 22 bp, Homo sapiens
aggcaggggagctggaagggta

SEQ ID NO: 9264023 - DNA, 22 bp, Homo sapiens
aggcaggggagctggaagggta

SEQ ID NO: 9264024 - DNA, 22 bp, Homo sapiens
aggcaggggagctggaagggta

SEQ ID NO: 9264025 - DNA, 22 bp, Homo sapiens
aggcaggggagctggaagggta

SEQ ID NO: 9264026 - DNA, 22 bp, Homo sapiens
aggcagggtcttgctatgttgc

SEQ ID NO: 9264027 - DNA, 22 bp, Homo sapiens
aggcagggtcttgctatgttgc

SEQ ID NO: 9264028 - DNA, 22 bp, Homo sapiens
aggcagggtgatgataatgatt

SEQ ID NO: 9264029 - DNA, 22 bp, Homo sapiens
aggcagggtgatgataatgatt

SEQ ID NO: 9264030 - DNA, 22 bp, Homo sapiens
aggcagggtcttgctatgttgc

SEQ ID NO: 9264031 - DNA, 22 bp, Homo sapiens
ccaggagctggagggtgcagtg

SEQ ID NO: 9264032 - DNA, 22 bp, Homo sapiens
ccaggagctggagggtgcagtg

SEQ ID NO: 9264033 - DNA, 22 bp, Homo sapiens
ccaggagctggcatgtggagag

SEQ ID NO: 9264034 - DNA, 22 bp, Homo sapiens
ccaggagctatgtacacactat

SEQ ID NO: 9264035 - DNA, 22 bp, Homo sapiens
ccaggagctggagggtgcagtg

SEQ ID NO: 9264036 - DNA, 22 bp, Homo sapiens
ccaggagctggagggtgcagtg

SEQ ID NO: 9264037 - DNA, 17 bp, Homo sapiens
ccaggagcgtgggtctc

SEQ ID NO: 9264038 - DNA, 17 bp, Homo sapiens
ccaggagcgtgggtctc

SEQ ID NO: 9264039 - DNA, 22 bp, Homo sapiens
aggctcagcctgggcctagagc

SEQ ID NO: 9264040 - DNA, 22 bp, Homo sapiens
aggctccaccagtcaggtgcat

SEQ ID NO: 9264041 - DNA, 22 bp, Homo sapiens
ccaggctgtaaacaccttcaaa

SEQ ID NO: 9264042 - DNA, 22 bp, Homo sapiens
ccaggctgtaaacaccttcaaa

SEQ ID NO: 9264043 - DNA, 22 bp, Homo sapiens
aggctccaccctacagagctcc

SEQ ID NO: 9264044 - DNA, 22 bp, Homo sapiens
aggctccaaattaccaagctct

SEQ ID NO: 9264045 - DNA, 22 bp, Homo sapiens
aggctcattcttgcctctgagc

SEQ ID NO: 9264046 - DNA, 22 bp, Homo sapiens
ccagggagcccacaggacaatg

SEQ ID NO: 9264047 - DNA, 22 bp, Homo sapiens
ccagggagcctggtgtgtcagc

SEQ ID NO: 9264048 - DNA, 22 bp, Homo sapiens
ccagggaagtcacattgtctag

SEQ ID NO: 9264049 - DNA, 22 bp, Homo sapiens
aggctccctgaatcgcccgttc

SEQ ID NO: 9264050 - DNA, 17 bp, Homo sapiens
ccagggaggggccgcgc

SEQ ID NO: 9264051 - DNA, 22 bp, Homo sapiens
aggctcctatcgctttcagcaa

SEQ ID NO: 9264052 - DNA, 22 bp, Homo sapiens
ccagggtgaggaggctcccacg

SEQ ID NO: 9264053 - DNA, 22 bp, Homo sapiens
ccagggtgctctgtggcgtcgc

SEQ ID NO: 9264054 - DNA, 22 bp, Homo sapiens
ccagggtgagtgtcatgggtta

SEQ ID NO: 9264055 - DNA, 22 bp, Homo sapiens
ccagggtgaccagctggcctag

SEQ ID NO: 9264056 - DNA, 22 bp, Homo sapiens
ccagggtgaccagctggcctag

SEQ ID NO: 9264057 - DNA, 22 bp, Homo sapiens
ccagggtcttggagaggagtgc

SEQ ID NO: 9264058 - DNA, 22 bp, Homo sapiens
ccagggtgagaaaaggctggat

SEQ ID NO: 9264059 - DNA, 22 bp, Homo sapiens
ccagggtgagaaaaggctggat

SEQ ID NO: 9264060 - DNA, 22 bp, Homo sapiens
ccagggtgagaaaaggctggat

SEQ ID NO: 9264061 - DNA, 22 bp, Homo sapiens
aggctcctgagaggcagaggct

SEQ ID NO: 9264062 - DNA, 22 bp, Homo sapiens
aggctcctgagaggcagaggct

SEQ ID NO: 9264063 - DNA, 22 bp, Homo sapiens
ccagggtcttggagaggagtgc

SEQ ID NO: 9264064 - DNA, 22 bp, Homo sapiens
ccagggcttaacttttcaggag

SEQ ID NO: 9264065 - DNA, 22 bp, Homo sapiens
ccagggcttcagaggttttggc

SEQ ID NO: 9264066 - DNA, 22 bp, Homo sapiens
aggctctgtgacaatcaagctg

SEQ ID NO: 9264067 - DNA, 22 bp, Homo sapiens
aggctctgtcaggcggagcagc

SEQ ID NO: 9264068 - DNA, 22 bp, Homo sapiens
ccagggtggaggctggatggag

SEQ ID NO: 9264069 - DNA, 22 bp, Homo sapiens
ccagggtggaggctggatggag

SEQ ID NO: 9264070 - DNA, 22 bp, Homo sapiens
aggctctgtgatgtgccaggca

SEQ ID NO: 9264071 - DNA, 22 bp, Homo sapiens
aggctctgtgcagcctgcatct

SEQ ID NO: 9264072 - DNA, 22 bp, Homo sapiens
aggctctgtgatgtgccaggca

SEQ ID NO: 9264073 - DNA, 22 bp, Homo sapiens
aggctgaggtaggaggatcgct

SEQ ID NO: 9264074 - DNA, 22 bp, Homo sapiens
aggctgaggtaggaggatcgct

SEQ ID NO: 9264075 - DNA, 22 bp, Homo sapiens
aggctgaggtaggaggatcgct

SEQ ID NO: 9264076 - DNA, 20 bp, Homo sapiens
aggctgagggtgattgtgtc

SEQ ID NO: 9264077 - DNA, 20 bp, Homo sapiens
aggctgagggtgattgtgtc

SEQ ID NO: 9264078 - DNA, 20 bp, Homo sapiens
aggctgagggtgattgtgtc

SEQ ID NO: 9264079 - DNA, 20 bp, Homo sapiens
aggctgagggtgattgtgtc

SEQ ID NO: 9264080 - DNA, 22 bp, Homo sapiens
aggctgaggggcgagggaccct

SEQ ID NO: 9264081 - DNA, 22 bp, Homo sapiens
aggctgaggggcgagggaccct

SEQ ID NO: 9264082 - DNA, 22 bp, Homo sapiens
aggctgaggggcgagggaccct

SEQ ID NO: 9264083 - DNA, 22 bp, Homo sapiens
aggctctgtgcatcctccccaa

SEQ ID NO: 9264084 - DNA, 22 bp, Homo sapiens
aggctctgtgcatcctccccaa

SEQ ID NO: 9264085 - DNA, 22 bp, Homo sapiens
aggctctgttattctagagggc

SEQ ID NO: 9264086 - DNA, 22 bp, Homo sapiens
aggctgaggcgggtagatcacc

SEQ ID NO: 9264087 - DNA, 22 bp, Homo sapiens
aggctgaggggcgagggaccct

SEQ ID NO: 9264088 - DNA, 22 bp, Homo sapiens
aggctgaggggcgagggaccct

SEQ ID NO: 9264089 - DNA, 22 bp, Homo sapiens
aggctgaggggcgagggaccct

SEQ ID NO: 9264090 - DNA, 22 bp, Homo sapiens
aggctgagtcaagttagggtga

SEQ ID NO: 9264091 - DNA, 22 bp, Homo sapiens
aggctgagtcaagttagggtga

SEQ ID NO: 9264092 - DNA, 22 bp, Homo sapiens
aggctgagtcaagttagggtga

SEQ ID NO: 9264093 - DNA, 22 bp, Homo sapiens
aggctgaggtgtgctgtgatcg

SEQ ID NO: 9264094 - DNA, 22 bp, Homo sapiens
aggctgaggtgtgctgtgatcg

SEQ ID NO: 9264095 - DNA, 22 bp, Homo sapiens
aggctgaggtgtgctgtgatcg

SEQ ID NO: 9264096 - DNA, 22 bp, Homo sapiens
aggctgagtcgggaggatcact

SEQ ID NO: 9264097 - DNA, 22 bp, Homo sapiens
aggctgagtcaagttagggtga

SEQ ID NO: 9264098 - DNA, 22 bp, Homo sapiens
aggctgagtcgggaggatcact

SEQ ID NO: 9264099 - DNA, 22 bp, Homo sapiens
aggctgagtcgggaggatcact

SEQ ID NO: 9264100 - DNA, 22 bp, Homo sapiens
aggctgaggtaggaggatcgct

SEQ ID NO: 9264101 - DNA, 22 bp, Homo sapiens
aggctgaggtaggaggatcgct

SEQ ID NO: 9264102 - DNA, 22 bp, Homo sapiens
aggctgaggtaggaggatcgct

SEQ ID NO: 9264103 - DNA, 22 bp, Homo sapiens
aggctgaggtaggaggatcgct

SEQ ID NO: 9264104 - DNA, 22 bp, Homo sapiens
aggctgaggtgtgctgtgatcg

SEQ ID NO: 9264105 - DNA, 22 bp, Homo sapiens
aggctgaggtgtgctgtgatcg

SEQ ID NO: 9264106 - DNA, 22 bp, Homo sapiens
aggctgaggtgtgctgtgatcg

SEQ ID NO: 9264107 - DNA, 22 bp, Homo sapiens
aggctgagtcgggaggatcact

SEQ ID NO: 9264108 - DNA, 22 bp, Homo sapiens
ccatgcacaccagcaggcagac

SEQ ID NO: 9264109 - DNA, 22 bp, Homo sapiens
ccatggcttttgagtctcaaga

SEQ ID NO: 9264110 - DNA, 22 bp, Homo sapiens
ccatggcttttgagtctcaaga

SEQ ID NO: 9264111 - DNA, 22 bp, Homo sapiens
ccatggcttttgagtctcaaga

SEQ ID NO: 9264112 - DNA, 22 bp, Homo sapiens
ccatggcttacagatggagcat

SEQ ID NO: 9264113 - DNA, 22 bp, Homo sapiens
ccatggcttacagatggagcat

SEQ ID NO: 9264114 - DNA, 22 bp, Homo sapiens
ccatgggcactgggtggaggta

SEQ ID NO: 9264115 - DNA, 22 bp, Homo sapiens
aggctgcctgttccaatctcct

SEQ ID NO: 9264116 - DNA, 22 bp, Homo sapiens
aggctgcgttagcctcactccc

SEQ ID NO: 9264117 - DNA, 22 bp, Homo sapiens
aggctgcctcgtgagctcgctg

SEQ ID NO: 9264118 - DNA, 22 bp, Homo sapiens
cccagagatgtcctgagtgata

SEQ ID NO: 9264119 - DNA, 23 bp, Homo sapiens
cccagagcacagcctccagatgc

SEQ ID NO: 9264120 - DNA, 19 bp, Homo sapiens
cccagagcatcctgaactt

SEQ ID NO: 9264121 - DNA, 20 bp, Homo sapiens
cccagagccatagccagaca

SEQ ID NO: 9264122 - DNA, 17 bp, Homo sapiens
aggctggctcacaggga

SEQ ID NO: 9264123 - DNA, 17 bp, Homo sapiens
aggctggctcacaggga

SEQ ID NO: 9264124 - DNA, 22 bp, Homo sapiens
cccagagccggtggtgctcaca

SEQ ID NO: 9264125 - DNA, 21 bp, Homo sapiens
cccagagcctagggagggcac

SEQ ID NO: 9264126 - DNA, 22 bp, Homo sapiens
aggctggcgtcaggggctgtac

SEQ ID NO: 9264127 - DNA, 22 bp, Homo sapiens
aggctggcgtcaggggctgtac

SEQ ID NO: 9264128 - DNA, 22 bp, Homo sapiens
caggccagagtccaactccaga

SEQ ID NO: 9264129 - DNA, 22 bp, Homo sapiens
caggccaggctgcatttgcccc

SEQ ID NO: 9264130 - DNA, 22 bp, Homo sapiens
agctgggcttggccaggtcgct

SEQ ID NO: 9264131 - DNA, 22 bp, Homo sapiens
agctgggcttggccaggtcgct

SEQ ID NO: 9264132 - DNA, 22 bp, Homo sapiens
agctgggcttggccaggtcgct

SEQ ID NO: 9264133 - DNA, 19 bp, Homo sapiens
agctgggctgtcacagtga

SEQ ID NO: 9264134 - DNA, 22 bp, Homo sapiens
agctgggctgggctgagctgag

SEQ ID NO: 9264135 - DNA, 19 bp, Homo sapiens
agctgggctgtcacagtga

SEQ ID NO: 9264136 - DNA, 19 bp, Homo sapiens
agctgggctgtcacagtga

SEQ ID NO: 9264137 - DNA, 22 bp, Homo sapiens
agctgggctggagctccaagcg

SEQ ID NO: 9264138 - DNA, 22 bp, Homo sapiens
agctgggctgggctgagctgag

SEQ ID NO: 9264139 - DNA, 22 bp, Homo sapiens
agctgggctggagctccaagcg

SEQ ID NO: 9264140 - DNA, 22 bp, Homo sapiens
agctggccctcgagagccaatt

SEQ ID NO: 9264141 - DNA, 18 bp, Homo sapiens
agctggccctggctgccg

SEQ ID NO: 9264142 - DNA, 22 bp, Homo sapiens
agctggccggcctccaggtgga

SEQ ID NO: 9264143 - DNA, 20 bp, Homo sapiens
caggcagtttgtggttaggg

SEQ ID NO: 9264144 - DNA, 22 bp, Homo sapiens
agctggcctccgggtgcctggg

SEQ ID NO: 9264145 - DNA, 20 bp, Homo sapiens
caggccagaggtttgatggc

SEQ ID NO: 9264146 - DNA, 20 bp, Homo sapiens
agctggcccacaggtgtggg

SEQ ID NO: 9264147 - DNA, 22 bp, Homo sapiens
caggcacttctgctgcttgtct

SEQ ID NO: 9264148 - DNA, 22 bp, Homo sapiens
caggcactttgctgggggcgca

SEQ ID NO: 9264149 - DNA, 22 bp, Homo sapiens
caggcactgtgttaggcactgt

SEQ ID NO: 9264150 - DNA, 22 bp, Homo sapiens
caggcactgtgctgagctctgc

SEQ ID NO: 9264151 - DNA, 22 bp, Homo sapiens
caggaggacatactggctcaca

SEQ ID NO: 9264152 - DNA, 22 bp, Homo sapiens
caggagccccaggctgacaata

SEQ ID NO: 9264153 - DNA, 22 bp, Homo sapiens
agctgccacctctgcctttggg

SEQ ID NO: 9264154 - DNA, 22 bp, Homo sapiens
agctgccacatggtgtcactgt

SEQ ID NO: 9264155 - DNA, 21 bp, Homo sapiens
agctgccaccctagcttctga

SEQ ID NO: 9264156 - DNA, 22 bp, Homo sapiens
caggaggagcattagcgtctca

SEQ ID NO: 9264157 - DNA, 22 bp, Homo sapiens
caggaggagctggccgcctcat

SEQ ID NO: 9264158 - DNA, 22 bp, Homo sapiens
caggaggagggtacaccatcag

SEQ ID NO: 9264159 - DNA, 22 bp, Homo sapiens
caggaggagggtacaccatcag

SEQ ID NO: 9264160 - DNA, 22 bp, Homo sapiens
caggaggattgcttgaggccag

SEQ ID NO: 9264161 - DNA, 22 bp, Homo sapiens
agctgctgggaccccagatcca

SEQ ID NO: 9264162 - DNA, 22 bp, Homo sapiens
agctgctgcgcctcaccctggc

SEQ ID NO: 9264163 - DNA, 22 bp, Homo sapiens
agctgctgcggaaagatgccac

SEQ ID NO: 9264164 - DNA, 22 bp, Homo sapiens
agctgctgccggtggccaccct

SEQ ID NO: 9264165 - DNA, 22 bp, Homo sapiens
caggcactgcactaccactttt

SEQ ID NO: 9264166 - DNA, 22 bp, Homo sapiens
caggcactggccagtcagcaca

SEQ ID NO: 9264167 - DNA, 22 bp, Homo sapiens
caggcactgcactaccactttt

SEQ ID NO: 9264168 - DNA, 22 bp, Homo sapiens
caggcactggccagtcagcaca

SEQ ID NO: 9264169 - DNA, 22 bp, Homo sapiens
caggcactggggatgctgggat

SEQ ID NO: 9264170 - DNA, 22 bp, Homo sapiens
caggcactgtgctagatccttg

SEQ ID NO: 9264171 - DNA, 22 bp, Homo sapiens
agctgattccactttttcccca

SEQ ID NO: 9264172 - DNA, 22 bp, Homo sapiens
agctgattccactttttcccca

SEQ ID NO: 9264173 - DNA, 23 bp, Homo sapiens
agctgaggctgtgggtgtcagag

SEQ ID NO: 9264174 - DNA, 23 bp, Homo sapiens
agctgaggctgtgggtgtcagag

SEQ ID NO: 9264175 - DNA, 22 bp, Homo sapiens
cagctgagaccagaatgcaggt

SEQ ID NO: 9264176 - DNA, 22 bp, Homo sapiens
cagctgagaccagaatgcaggt

SEQ ID NO: 9264177 - DNA, 22 bp, Homo sapiens
cagctgagaccagaatgcaggt

SEQ ID NO: 9264178 - DNA, 22 bp, Homo sapiens
cagctgagaccagaatgcaggt

SEQ ID NO: 9264179 - DNA, 22 bp, Homo sapiens
cagctgagaagtgatagctgca

SEQ ID NO: 9264180 - DNA, 22 bp, Homo sapiens
cagctgagaaatggggaaaggg

SEQ ID NO: 9264181 - DNA, 22 bp, Homo sapiens
cagctctgggtgacaggagggc

SEQ ID NO: 9264182 - DNA, 22 bp, Homo sapiens
cagctctgggtgacaggagggc

SEQ ID NO: 9264183 - DNA, 22 bp, Homo sapiens
cagctctgggtgacaggagggc

SEQ ID NO: 9264184 - DNA, 22 bp, Homo sapiens
cagctctggttcctgggcccag

SEQ ID NO: 9264185 - DNA, 22 bp, Homo sapiens
cagctctggtccagggagggca

SEQ ID NO: 9264186 - DNA, 20 bp, Homo sapiens
cagctctgggcaggtcgagg

SEQ ID NO: 9264187 - DNA, 22 bp, Homo sapiens
cagctctggggcagagtgacta

SEQ ID NO: 9264188 - DNA, 22 bp, Homo sapiens
cagctctgtaaattccttcatc

SEQ ID NO: 9264189 - DNA, 22 bp, Homo sapiens
cagctctggttcctgggcccag

SEQ ID NO: 9264190 - DNA, 22 bp, Homo sapiens
cagctctggttcctgggcccag

SEQ ID NO: 9264191 - DNA, 22 bp, Homo sapiens
cagctctgtaaattccttcatc

SEQ ID NO: 9264192 - DNA, 22 bp, Homo sapiens
cagctgaaggtaggaaccagga

SEQ ID NO: 9264193 - DNA, 22 bp, Homo sapiens
cagctgaattcttcagactcca

SEQ ID NO: 9264194 - DNA, 22 bp, Homo sapiens
agctgcagttagccccagatga

SEQ ID NO: 9264195 - DNA, 22 bp, Homo sapiens
agctgcagtcaagctgggccac

SEQ ID NO: 9264196 - DNA, 22 bp, Homo sapiens
agctgcagtcaagctgggccac

SEQ ID NO: 9264197 - DNA, 22 bp, Homo sapiens
caggaaggggctcactctggcc

SEQ ID NO: 9264198 - DNA, 22 bp, Homo sapiens
agctgccaagttggagtagcaa

SEQ ID NO: 9264199 - DNA, 22 bp, Homo sapiens
agctgccacagagcctggccag

SEQ ID NO: 9264200 - DNA, 22 bp, Homo sapiens
agctgccacagagcctggccag

SEQ ID NO: 9264201 - DNA, 22 bp, Homo sapiens
agctgccaagtttctcagttta

SEQ ID NO: 9264202 - DNA, 22 bp, Homo sapiens
caggaaggcccacctgtcctgt

SEQ ID NO: 9264203 - DNA, 22 bp, Homo sapiens
caggaaggcgcggctgtgcctg

SEQ ID NO: 9264204 - DNA, 22 bp, Homo sapiens
caggaaggcgcggctgtgcctg

SEQ ID NO: 9264205 - DNA, 22 bp, Homo sapiens
caggaaggggctcactctggcc

SEQ ID NO: 9264206 - DNA, 22 bp, Homo sapiens
agctgcagaggtttgtgcaaca

SEQ ID NO: 9264207 - DNA, 22 bp, Homo sapiens
agctgcagaggtttgtgcaaca

SEQ ID NO: 9264208 - DNA, 22 bp, Homo sapiens
agctgcagagaaaagaggctgg

SEQ ID NO: 9264209 - DNA, 18 bp, Homo sapiens
agctgcagaccaggaggt

SEQ ID NO: 9264210 - DNA, 19 bp, Homo sapiens
agctgcagaccagaagtgc

SEQ ID NO: 9264211 - DNA, 22 bp, Homo sapiens
agctgcagattctatctagaag

SEQ ID NO: 9264212 - DNA, 22 bp, Homo sapiens
agctgcagattctatctagaag

SEQ ID NO: 9264213 - DNA, 22 bp, Homo sapiens
agctgcagcactccagtagccg

SEQ ID NO: 9264214 - DNA, 22 bp, Homo sapiens
agctgcagcactccagtagccg

SEQ ID NO: 9264215 - DNA, 22 bp, Homo sapiens
caggaagagaacatggaggctg

SEQ ID NO: 9264216 - DNA, 22 bp, Homo sapiens
agctgcagcactccagtagccg

SEQ ID NO: 9264217 - DNA, 22 bp, Homo sapiens
caggaaggaccgtccagatcag

SEQ ID NO: 9264218 - DNA, 22 bp, Homo sapiens
cagggatgggatggagtcagtt

SEQ ID NO: 9264219 - DNA, 22 bp, Homo sapiens
cagggatgggatggagtcagtt

SEQ ID NO: 9264220 - DNA, 22 bp, Homo sapiens
cagggagctggtgccagccgac

SEQ ID NO: 9264221 - DNA, 22 bp, Homo sapiens
cagggagctggctggctgtgcc

SEQ ID NO: 9264222 - DNA, 22 bp, Homo sapiens
cagggagctggctggctgtgcc

SEQ ID NO: 9264223 - DNA, 22 bp, Homo sapiens
cagggagctggctggcgtgagt

SEQ ID NO: 9264224 - DNA, 22 bp, Homo sapiens
cagggagctggctggcgtgagt

SEQ ID NO: 9264225 - DNA, 22 bp, Homo sapiens
cagggagctgacaaccaaggag

SEQ ID NO: 9264226 - DNA, 22 bp, Homo sapiens
cagggagctattagggttagtg

SEQ ID NO: 9264227 - DNA, 22 bp, Homo sapiens
cagggagcggagtcccatgcct

SEQ ID NO: 9264228 - DNA, 22 bp, Homo sapiens
caggctggagttacctttaggg

SEQ ID NO: 9264229 - DNA, 22 bp, Homo sapiens
caggctggagttacctttaggg

SEQ ID NO: 9264230 - DNA, 22 bp, Homo sapiens
cagggagaaatctccaggaggt

SEQ ID NO: 9264231 - DNA, 22 bp, Homo sapiens
caggctggagtgcagttgtgca

SEQ ID NO: 9264232 - DNA, 22 bp, Homo sapiens
caggctggagtgcagttgtgca

SEQ ID NO: 9264233 - DNA, 22 bp, Homo sapiens
caggctggagttacctttaggg

SEQ ID NO: 9264234 - DNA, 22 bp, Homo sapiens
caggctggagttacctttaggg

SEQ ID NO: 9264235 - DNA, 22 bp, Homo sapiens
caggctggagtgcagttgtgca

SEQ ID NO: 9264236 - DNA, 22 bp, Homo sapiens
caggctggagtgcagtggtgcc

SEQ ID NO: 9264237 - DNA, 22 bp, Homo sapiens
caggctggagtgcagtggtgcc

SEQ ID NO: 9264238 - DNA, 22 bp, Homo sapiens
caggctggagtgcagtggtgcc

SEQ ID NO: 9264239 - DNA, 22 bp, Homo sapiens
caggctggagtgcagtgtcgcc

SEQ ID NO: 9264240 - DNA, 22 bp, Homo sapiens
caggctggagtgcagtgtcgcc

SEQ ID NO: 9264241 - DNA, 22 bp, Homo sapiens
caggctggacattagatacata

SEQ ID NO: 9264242 - DNA, 22 bp, Homo sapiens
caggctggagtacaattgtgtg

SEQ ID NO: 9264243 - DNA, 22 bp, Homo sapiens
caggctgctgtccacaaagcat

SEQ ID NO: 9264244 - DNA, 22 bp, Homo sapiens
caggctggacattagatacata

SEQ ID NO: 9264245 - DNA, 22 bp, Homo sapiens
caggctgagctctggcctgggc

SEQ ID NO: 9264246 - DNA, 22 bp, Homo sapiens
caggctgcggccgtgtgagcat

SEQ ID NO: 9264247 - DNA, 22 bp, Homo sapiens
caggctgcggccgtgtgagcat

SEQ ID NO: 9264248 - DNA, 22 bp, Homo sapiens
caggctgcggccgtgtgagcat

SEQ ID NO: 9264249 - DNA, 22 bp, Homo sapiens
caggctgcggtcggctctggtc

SEQ ID NO: 9264250 - DNA, 22 bp, Homo sapiens
caggctgcggtcggctctggtc

SEQ ID NO: 9264251 - DNA, 22 bp, Homo sapiens
caggctgcggtcggctctggtc

SEQ ID NO: 9264252 - DNA, 22 bp, Homo sapiens
caggctgctccagggtaggaaa

SEQ ID NO: 9264253 - DNA, 22 bp, Homo sapiens
caggctgctccagggtaggaaa

SEQ ID NO: 9264254 - DNA, 22 bp, Homo sapiens
caggctgcgtttgtgaaaggta

SEQ ID NO: 9264255 - DNA, 19 bp, Homo sapiens
agctgtggatgtgggattt

SEQ ID NO: 9264256 - DNA, 22 bp, Homo sapiens
agctgtggagtagggggttgga

SEQ ID NO: 9264257 - DNA, 22 bp, Homo sapiens
agctgtggagtagggggttgga

SEQ ID NO: 9264258 - DNA, 22 bp, Homo sapiens
agctgtggaagactgtcagggt

SEQ ID NO: 9264259 - DNA, 22 bp, Homo sapiens
agctgtggaagactgtcagggt

SEQ ID NO: 9264260 - DNA, 19 bp, Homo sapiens
agctgtggatgtgggattt

SEQ ID NO: 9264261 - DNA, 22 bp, Homo sapiens
caggctgagctctggcctgggc

SEQ ID NO: 9264262 - DNA, 22 bp, Homo sapiens
agctgtggcaaccttgtcagac

SEQ ID NO: 9264263 - DNA, 22 bp, Homo sapiens
agctgtggcagcactttggagt

SEQ ID NO: 9264264 - DNA, 22 bp, Homo sapiens
agctgtgctgccaagttgctga

SEQ ID NO: 9264265 - DNA, 22 bp, Homo sapiens
agctgtggaagactgtcagggt

SEQ ID NO: 9264266 - DNA, 19 bp, Homo sapiens
agctggggcggtgtgtgtt

SEQ ID NO: 9264267 - DNA, 22 bp, Homo sapiens
caggctcactgtaaggtcagct

SEQ ID NO: 9264268 - DNA, 22 bp, Homo sapiens
caggctcactgtaaggtcagct

SEQ ID NO: 9264269 - DNA, 22 bp, Homo sapiens
caggcctgtctgcacatgaggc

SEQ ID NO: 9264270 - DNA, 22 bp, Homo sapiens
caggctcactttctcagtcaca

SEQ ID NO: 9264271 - DNA, 22 bp, Homo sapiens
caggctcactgtaaggtcagct

SEQ ID NO: 9264272 - DNA, 22 bp, Homo sapiens
caggctcagtcagaaaatgtat

SEQ ID NO: 9264273 - DNA, 22 bp, Homo sapiens
caggctcagctctggccagtgc

SEQ ID NO: 9264274 - DNA, 22 bp, Homo sapiens
cagggcctcgaagcctctgggc

SEQ ID NO: 9264275 - DNA, 22 bp, Homo sapiens
cagggcctctcatcccacgggc

SEQ ID NO: 9264276 - DNA, 22 bp, Homo sapiens
cagggcctcctaaggcatctaa

SEQ ID NO: 9264277 - DNA, 23 bp, Homo sapiens
cagggccaggcagcagctgtcac

SEQ ID NO: 9264278 - DNA, 22 bp, Homo sapiens
cagggatgtctctggaagggag

SEQ ID NO: 9264279 - DNA, 22 bp, Homo sapiens
cagggatgtctctggaagggag

SEQ ID NO: 9264280 - DNA, 22 bp, Homo sapiens
cagggatgtgatgagctgagcc

SEQ ID NO: 9264281 - DNA, 22 bp, Homo sapiens
cagggcttggatctgtggtcag

SEQ ID NO: 9264282 - DNA, 22 bp, Homo sapiens
cagggcttgatctgcatcctgc

SEQ ID NO: 9264283 - DNA, 22 bp, Homo sapiens
caggggctccctgggtgccagt

SEQ ID NO: 9264284 - DNA, 22 bp, Homo sapiens
cagggctcgctcgctcgctcgc

SEQ ID NO: 9264285 - DNA, 22 bp, Homo sapiens
cagggctccccgcaccgcagcc

SEQ ID NO: 9264286 - DNA, 22 bp, Homo sapiens
cagggctccctgcagcctctgt

SEQ ID NO: 9264287 - DNA, 22 bp, Homo sapiens
caggtgagtaacaatgggtgat

SEQ ID NO: 9264288 - DNA, 22 bp, Homo sapiens
caggtgagttttcctccttggt

SEQ ID NO: 9264289 - DNA, 22 bp, Homo sapiens
caggtgaggctgaacagatgaa

SEQ ID NO: 9264290 - DNA, 20 bp, Homo sapiens
caggtgagcagatctgggtg

SEQ ID NO: 9264291 - DNA, 22 bp, Homo sapiens
caggtgagaggcggtcctgcat

SEQ ID NO: 9264292 - DNA, 22 bp, Homo sapiens
caggtgacttctgaggccttca

SEQ ID NO: 9264293 - DNA, 22 bp, Homo sapiens
caggtgagctctatctagggag

SEQ ID NO: 9264294 - DNA, 22 bp, Homo sapiens
caggtgagctctatctagggag

SEQ ID NO: 9264295 - DNA, 22 bp, Homo sapiens
cagggtgcctcccgctcgccgg

SEQ ID NO: 9264296 - DNA, 22 bp, Homo sapiens
cagggtgcctgtcctcagcaaa

SEQ ID NO: 9264297 - DNA, 22 bp, Homo sapiens
cagggtgcgccactcagatgta

SEQ ID NO: 9264298 - DNA, 22 bp, Homo sapiens
cagggtgcgggagatgtgcacc

SEQ ID NO: 9264299 - DNA, 22 bp, Homo sapiens
cagggtgcgccactcagatgta

SEQ ID NO: 9264300 - DNA, 22 bp, Homo sapiens
caggtcctttagtgtccagaac

SEQ ID NO: 9264301 - DNA, 17 bp, Homo sapiens
caggtgacctggtgatg

SEQ ID NO: 9264302 - DNA, 22 bp, Homo sapiens
caggtgacctatggtcactaca

SEQ ID NO: 9264303 - DNA, 22 bp, Homo sapiens
caggtgaccctcagtgtggact

SEQ ID NO: 9264304 - DNA, 22 bp, Homo sapiens
caggtgaccctctcacctgctt

SEQ ID NO: 9264305 - DNA, 22 bp, Homo sapiens
caggtgaccctctcacctgctt

SEQ ID NO: 9264306 - DNA, 22 bp, Homo sapiens
cagggtgcagtgtcgctgctag

SEQ ID NO: 9264307 - DNA, 22 bp, Homo sapiens
cagggtgcagagctagggtagt

SEQ ID NO: 9264308 - DNA, 22 bp, Homo sapiens
cagggtgcatacccatgcatac

SEQ ID NO: 9264309 - DNA, 22 bp, Homo sapiens
cagggtgactgccctggccact

SEQ ID NO: 9264310 - DNA, 22 bp, Homo sapiens
caggggctgtgggcggagcctc

SEQ ID NO: 9264311 - DNA, 22 bp, Homo sapiens
caggggctgtttgcctcaggcc

SEQ ID NO: 9264312 - DNA, 22 bp, Homo sapiens
caggggctgtggcacatggtgt

SEQ ID NO: 9264313 - DNA, 22 bp, Homo sapiens
caggggctgagaaggaacgtcc

SEQ ID NO: 9264314 - DNA, 22 bp, Homo sapiens
caggggctgaaatgttggggtt

SEQ ID NO: 9264315 - DNA, 22 bp, Homo sapiens
caggggctccctgggtgccagt

SEQ ID NO: 9264316 - DNA, 22 bp, Homo sapiens
caggggctctgagattgtctaa

SEQ ID NO: 9264317 - DNA, 22 bp, Homo sapiens
caggggctctaatgcatgatca

SEQ ID NO: 9264318 - DNA, 22 bp, Homo sapiens
cagtttcctgaagagaaagaat

SEQ ID NO: 9264319 - DNA, 22 bp, Homo sapiens
cagtttctacgaaggtcaaccc

SEQ ID NO: 9264320 - DNA, 22 bp, Homo sapiens
cagtttccttgtttacctactg

SEQ ID NO: 9264321 - DNA, 22 bp, Homo sapiens
cagtttctacgacttaagcaca

SEQ ID NO: 9264322 - DNA, 22 bp, Homo sapiens
cagtttctacgacttaagcaca

SEQ ID NO: 9264323 - DNA, 22 bp, Homo sapiens
cagtttatttccaagatgacaa

SEQ ID NO: 9264324 - DNA, 22 bp, Homo sapiens
cagtttccctgcttgaaaacgt

SEQ ID NO: 9264325 - DNA, 22 bp, Homo sapiens
cagtttctcaggcctctcccag

SEQ ID NO: 9264326 - DNA, 22 bp, Homo sapiens
cagtttctctcaataagcatcg

SEQ ID NO: 9264327 - DNA, 22 bp, Homo sapiens
cagttttaaattgttagataat

SEQ ID NO: 9264328 - DNA, 22 bp, Homo sapiens
cagttttaaattttgaatgtct

SEQ ID NO: 9264329 - DNA, 16 bp, Homo sapiens
cagttttaaggcccaa

SEQ ID NO: 9264330 - DNA, 22 bp, Homo sapiens
cagttttatacactgcagctcc

SEQ ID NO: 9264331 - DNA, 22 bp, Homo sapiens
cagttttagggcaatgtgaaga

SEQ ID NO: 9264332 - DNA, 22 bp, Homo sapiens
cagttttagctagagcaaacca

SEQ ID NO: 9264333 - DNA, 22 bp, Homo sapiens
cagttttaggacatgtggatgt

SEQ ID NO: 9264334 - DNA, 22 bp, Homo sapiens
cagttttagctagagcaaacca

SEQ ID NO: 9264335 - DNA, 22 bp, Homo sapiens
cagttttacccaagcttatttt

SEQ ID NO: 9264336 - DNA, 22 bp, Homo sapiens
cagtggcgtgatctctgctcac

SEQ ID NO: 9264337 - DNA, 22 bp, Homo sapiens
cagtggcgtgatctctgctcac

SEQ ID NO: 9264338 - DNA, 22 bp, Homo sapiens
cagtggcgtgatctctgctcac

SEQ ID NO: 9264339 - DNA, 22 bp, Homo sapiens
cagtggcgtgatctctgctcac

SEQ ID NO: 9264340 - DNA, 22 bp, Homo sapiens
cagtggcgtgatctctgctcac

SEQ ID NO: 9264341 - DNA, 22 bp, Homo sapiens
cagtggcgtgatctctgctcac

SEQ ID NO: 9264342 - DNA, 22 bp, Homo sapiens
cagtgggtgatgagtcctgggg

SEQ ID NO: 9264343 - DNA, 22 bp, Homo sapiens
cagtgggtgccatcgtgccctt

SEQ ID NO: 9264344 - DNA, 22 bp, Homo sapiens
cagtgggtggctaagtggctga

SEQ ID NO: 9264345 - DNA, 22 bp, Homo sapiens
cagtggtatttgagagaatgga

SEQ ID NO: 9264346 - DNA, 22 bp, Homo sapiens
cagtggtccctgaggttgctgg

SEQ ID NO: 9264347 - DNA, 22 bp, Homo sapiens
cagtggtgaagagcaggggctc

SEQ ID NO: 9264348 - DNA, 18 bp, Homo sapiens
cagtggtgctgggatgtg

SEQ ID NO: 9264349 - DNA, 22 bp, Homo sapiens
cagtggtctgtgcttctgtaca

SEQ ID NO: 9264350 - DNA, 22 bp, Homo sapiens
cagtggtggaatgaggaattgt

SEQ ID NO: 9264351 - DNA, 22 bp, Homo sapiens
cagttctggaggatagaagtct

SEQ ID NO: 9264352 - DNA, 22 bp, Homo sapiens
catagagtgatgtaaggtatgt

SEQ ID NO: 9264353 - DNA, 22 bp, Homo sapiens
catagatagaggttcctaatag

SEQ ID NO: 9264354 - DNA, 22 bp, Homo sapiens
catagcaagatcacattctgta

SEQ ID NO: 9264355 - DNA, 22 bp, Homo sapiens
catagcaaggtgctttccacat

SEQ ID NO: 9264356 - DNA, 22 bp, Homo sapiens
cagttttatcatctgtgaaatg

SEQ ID NO: 9264357 - DNA, 22 bp, Homo sapiens
cagttttatgaatgcttattag

SEQ ID NO: 9264358 - DNA, 22 bp, Homo sapiens
catacattacctaacttaatgc

SEQ ID NO: 9264359 - DNA, 22 bp, Homo sapiens
cagttttatgtcgaatgtatac

SEQ ID NO: 9264360 - DNA, 22 bp, Homo sapiens
catacatatgtggatgtcatat

SEQ ID NO: 9264361 - DNA, 22 bp, Homo sapiens
catagcggtattccacgtggtt

SEQ ID NO: 9264362 - DNA, 22 bp, Homo sapiens
catagcggtattccacgtggtt

SEQ ID NO: 9264363 - DNA, 22 bp, Homo sapiens
cataggaaaagcattcttcttg

SEQ ID NO: 9264364 - DNA, 22 bp, Homo sapiens
catataaatacaacatgtgtta

SEQ ID NO: 9264365 - DNA, 22 bp, Homo sapiens
catataaatacaacatgtgtta

SEQ ID NO: 9264366 - DNA, 22 bp, Homo sapiens
aggagggagcttaagccaggca

SEQ ID NO: 9264367 - DNA, 22 bp, Homo sapiens
aggagggagcttaagccaggca

SEQ ID NO: 9264368 - DNA, 22 bp, Homo sapiens
aggagggagcttaagccaggca

SEQ ID NO: 9264369 - DNA, 22 bp, Homo sapiens
aggagggagcttaagccaggca

SEQ ID NO: 9264370 - DNA, 21 bp, Homo sapiens
aggaggctgtctctttcagct

SEQ ID NO: 9264371 - DNA, 22 bp, Homo sapiens
catatttcagtctaagatgtgt

SEQ ID NO: 9264372 - DNA, 22 bp, Homo sapiens
catattgtaaaaggttgaatcc

SEQ ID NO: 9264373 - DNA, 22 bp, Homo sapiens
catattcaaggggtaaggcaaa

SEQ ID NO: 9264374 - DNA, 22 bp, Homo sapiens
caggtggcttctctgcagcctt

SEQ ID NO: 9264375 - DNA, 22 bp, Homo sapiens
caggtgggagccacagcgtaca

SEQ ID NO: 9264376 - DNA, 22 bp, Homo sapiens
caggtgggaccatgatagggca

SEQ ID NO: 9264377 - DNA, 22 bp, Homo sapiens
caggtgcagggagttcaggatg

SEQ ID NO: 9264378 - DNA, 22 bp, Homo sapiens
caggtggcttattagggtcagt

SEQ ID NO: 9264379 - DNA, 22 bp, Homo sapiens
caggtggcttctccctaggcca

SEQ ID NO: 9264380 - DNA, 22 bp, Homo sapiens
caggtggcttctccctaggcca

SEQ ID NO: 9264381 - DNA, 22 bp, Homo sapiens
aggacatgtgcctccagggcag

SEQ ID NO: 9264382 - DNA, 22 bp, Homo sapiens
aggacaggattgagctgaactg

SEQ ID NO: 9264383 - DNA, 22 bp, Homo sapiens
aggacatgtaaatggagaggga

SEQ ID NO: 9264384 - DNA, 22 bp, Homo sapiens
caggtgggagcgaggagctact

SEQ ID NO: 9264385 - DNA, 22 bp, Homo sapiens
caggtgggagcgaggagctact

SEQ ID NO: 9264386 - DNA, 22 bp, Homo sapiens
aggaccttggaataacaaattc

SEQ ID NO: 9264387 - DNA, 22 bp, Homo sapiens
aggacctgactggctcctgctt

SEQ ID NO: 9264388 - DNA, 22 bp, Homo sapiens
aggacctggatcacagagatct

SEQ ID NO: 9264389 - DNA, 22 bp, Homo sapiens
aggacccaagcacagttcctgg

SEQ ID NO: 9264390 - DNA, 22 bp, Homo sapiens
aggaccagaggccagagtcagc

SEQ ID NO: 9264391 - DNA, 22 bp, Homo sapiens
aggaccagcctccaggtctctt

SEQ ID NO: 9264392 - DNA, 22 bp, Homo sapiens
aggaccagcctccaggtctctt

SEQ ID NO: 9264393 - DNA, 22 bp, Homo sapiens
cagtgcccttccaggactgcag

SEQ ID NO: 9264394 - DNA, 19 bp, Homo sapiens
cagtgcccgacgcaggtct

SEQ ID NO: 9264395 - DNA, 20 bp, Homo sapiens
cagtgcctatcattaattcc

SEQ ID NO: 9264396 - DNA, 22 bp, Homo sapiens
cagtgcccttccaggactgcag

SEQ ID NO: 9264397 - DNA, 22 bp, Homo sapiens
cagtgcaggtggcagaggacag

SEQ ID NO: 9264398 - DNA, 22 bp, Homo sapiens
aggactccatgtgtcctggaga

SEQ ID NO: 9264399 - DNA, 22 bp, Homo sapiens
cagtgcctcttaagtgtcaccc

SEQ ID NO: 9264400 - DNA, 22 bp, Homo sapiens
cagtgctaggtcgtgtgctggg

SEQ ID NO: 9264401 - DNA, 21 bp, Homo sapiens
cagtgctcaatctgacagtgg

SEQ ID NO: 9264402 - DNA, 21 bp, Homo sapiens
cagtgctcaatctgacagtgg

SEQ ID NO: 9264403 - DNA, 21 bp, Homo sapiens
cagtgctcaggaatagagaga

SEQ ID NO: 9264404 - DNA, 22 bp, Homo sapiens
aggagaaggaagtgcatcacta

SEQ ID NO: 9264405 - DNA, 22 bp, Homo sapiens
cagtgctcctgatgtacccttg

SEQ ID NO: 9264406 - DNA, 22 bp, Homo sapiens
cagtgctcctgatgtacccttg

SEQ ID NO: 9264407 - DNA, 22 bp, Homo sapiens
cagtgctcccgctgccgctgtg

SEQ ID NO: 9264408 - DNA, 22 bp, Homo sapiens
cagtgctcatagctgttcctcc

SEQ ID NO: 9264409 - DNA, 19 bp, Homo sapiens
cagtggcctggaggtctct

SEQ ID NO: 9264410 - DNA, 22 bp, Homo sapiens
cagtggcctgagccaggcttcc

SEQ ID NO: 9264411 - DNA, 22 bp, Homo sapiens
cagtggcctttcctgctgctca

SEQ ID NO: 9264412 - DNA, 22 bp, Homo sapiens
cagtggccatggtggcaggggt

SEQ ID NO: 9264413 - DNA, 22 bp, Homo sapiens
cagtggagaggcatgcttggca

SEQ ID NO: 9264414 - DNA, 22 bp, Homo sapiens
cagtggcatacttggctgatat

SEQ ID NO: 9264415 - DNA, 18 bp, Homo sapiens
cagtggcatagttgagta

SEQ ID NO: 9264416 - DNA, 22 bp, Homo sapiens
cagtggccatggtggcaggggt

SEQ ID NO: 9264417 - DNA, 22 bp, Homo sapiens
cagtggcatggttgactgcagt

SEQ ID NO: 9264418 - DNA, 22 bp, Homo sapiens
aggagaagtaaggctagatgat

SEQ ID NO: 9264419 - DNA, 19 bp, Homo sapiens
aggagaagtagcagaaatt

SEQ ID NO: 9264420 - DNA, 22 bp, Homo sapiens
aggagaagtaaggctagatgat

SEQ ID NO: 9264421 - DNA, 22 bp, Homo sapiens
aggagaagtaaggctagatgat

SEQ ID NO: 9264422 - DNA, 22 bp, Homo sapiens
aggagaaggaggcccctcacac

SEQ ID NO: 9264423 - DNA, 22 bp, Homo sapiens
catggctgaacactcagtgact

SEQ ID NO: 9264424 - DNA, 22 bp, Homo sapiens
catggctgaaattcttcgcttg

SEQ ID NO: 9264425 - DNA, 22 bp, Homo sapiens
aggatttgaacctaggcaatca

SEQ ID NO: 9264426 - DNA, 21 bp, Homo sapiens
aggatttctgtcatttcagat

SEQ ID NO: 9264427 - DNA, 22 bp, Homo sapiens
aggatttagcatgaaatgtgaa

SEQ ID NO: 9264428 - DNA, 22 bp, Homo sapiens
aggatttacaatgattctaggt

SEQ ID NO: 9264429 - DNA, 23 bp, Homo sapiens
catggggagcagtgctcctgacc

SEQ ID NO: 9264430 - DNA, 22 bp, Homo sapiens
catggggatgaggctgagactt

SEQ ID NO: 9264431 - DNA, 22 bp, Homo sapiens
catgggggtctggacaacaggc

SEQ ID NO: 9264432 - DNA, 22 bp, Homo sapiens
catgggggctgaggctgctgta

SEQ ID NO: 9264433 - DNA, 22 bp, Homo sapiens
catgggcttgctctctgagctc

SEQ ID NO: 9264434 - DNA, 22 bp, Homo sapiens
catgggctgctgacaggggctc

SEQ ID NO: 9264435 - DNA, 22 bp, Homo sapiens
catgggcttgctctctgagctc

SEQ ID NO: 9264436 - DNA, 22 bp, Homo sapiens
catgtagtcctaatgctggtga

SEQ ID NO: 9264437 - DNA, 22 bp, Homo sapiens
catgtatagacactcatacagt

SEQ ID NO: 9264438 - DNA, 22 bp, Homo sapiens
catgtcaaccagttgtttgaat

SEQ ID NO: 9264439 - DNA, 22 bp, Homo sapiens
catgtatagttggaactacatc

SEQ ID NO: 9264440 - DNA, 22 bp, Homo sapiens
catgtatagttggaactacatc

SEQ ID NO: 9264441 - DNA, 22 bp, Homo sapiens
catgtcagggaagagagtcagt

SEQ ID NO: 9264442 - DNA, 22 bp, Homo sapiens
aggcactggtctaccccttagt

SEQ ID NO: 9264443 - DNA, 22 bp, Homo sapiens
aggcactgcagattacaggcgc

SEQ ID NO: 9264444 - DNA, 22 bp, Homo sapiens
aggagggatagaaaaatacttg

SEQ ID NO: 9264445 - DNA, 21 bp, Homo sapiens
aggagggcacaaggccaggaa

SEQ ID NO: 9264446 - DNA, 21 bp, Homo sapiens
aggagggcacaaggccaggaa

SEQ ID NO: 9264447 - DNA, 22 bp, Homo sapiens
aggagggcaggctggctgccta

SEQ ID NO: 9264448 - DNA, 22 bp, Homo sapiens
aggagggcaggctggctgccta

SEQ ID NO: 9264449 - DNA, 21 bp, Homo sapiens
aggagggcacaaggccaggaa

SEQ ID NO: 9264450 - DNA, 22 bp, Homo sapiens
aggagggctaggaaaaccagga

SEQ ID NO: 9264451 - DNA, 22 bp, Homo sapiens
aggagggcaggctggctgccta

SEQ ID NO: 9264452 - DNA, 22 bp, Homo sapiens
aggagggctaggaaaaccagga

SEQ ID NO: 9264453 - DNA, 22 bp, Homo sapiens
aggaggggcaatgatagtctgg

SEQ ID NO: 9264454 - DNA, 20 bp, Homo sapiens
aggaggggatagaatcaaag

SEQ ID NO: 9264455 - DNA, 22 bp, Homo sapiens
catgcggctctttccaaaccgg

SEQ ID NO: 9264456 - DNA, 22 bp, Homo sapiens
catgctaaaatatctgaagatt

SEQ ID NO: 9264457 - DNA, 22 bp, Homo sapiens
catgctaaaccagaacatagga

SEQ ID NO: 9264458 - DNA, 22 bp, Homo sapiens
catggcagaaacctgagctgct

SEQ ID NO: 9264459 - DNA, 22 bp, Homo sapiens
catggcagaaacctgagctgct

SEQ ID NO: 9264460 - DNA, 22 bp, Homo sapiens
catggcactgagcaggtatgca

SEQ ID NO: 9264461 - DNA, 22 bp, Homo sapiens
aggatgtgtgtaggctggttaa

SEQ ID NO: 9264462 - DNA, 22 bp, Homo sapiens
aggatgtgttttgagctgacta

SEQ ID NO: 9264463 - DNA, 22 bp, Homo sapiens
aggatgtgttttgagctgacta

SEQ ID NO: 9264464 - DNA, 22 bp, Homo sapiens
aggatgtgttcatagctgacgc

SEQ ID NO: 9264465 - DNA, 22 bp, Homo sapiens
aggatgtgttcatagctgacgc

SEQ ID NO: 9264466 - DNA, 22 bp, Homo sapiens
aggattctgtaatctgtgaaat

SEQ ID NO: 9264467 - DNA, 22 bp, Homo sapiens
aggattcatggtgcagacaaag

SEQ ID NO: 9264468 - DNA, 22 bp, Homo sapiens
catggaatgtgagttgtttagt

SEQ ID NO: 9264469 - DNA, 22 bp, Homo sapiens
catggatatattgtacagtagc

SEQ ID NO: 9264470 - DNA, 22 bp, Homo sapiens
catggatcataaatgtgctaaa

SEQ ID NO: 9264471 - DNA, 22 bp, Homo sapiens
catggcaacaactctttattcc

SEQ ID NO: 9264472 - DNA, 22 bp, Homo sapiens
catggcaataaacctacacagt

SEQ ID NO: 9264473 - DNA, 22 bp, Homo sapiens
catggatagatgaatgcttaaa

SEQ ID NO: 9264474 - DNA, 22 bp, Homo sapiens
ccaagggctgctgaggtgtcca

SEQ ID NO: 9264475 - DNA, 22 bp, Homo sapiens
ccaagggctctggacagagtgg

SEQ ID NO: 9264476 - DNA, 22 bp, Homo sapiens
ccaagggctatttacagaacag

SEQ ID NO: 9264477 - DNA, 22 bp, Homo sapiens
ccaagcttctttcctactacag

SEQ ID NO: 9264478 - DNA, 23 bp, Homo sapiens
ccaagcttgtccctgcctgcttt

SEQ ID NO: 9264479 - DNA, 22 bp, Homo sapiens
ccaagctggatttagctgcaca

SEQ ID NO: 9264480 - DNA, 23 bp, Homo sapiens
ccaagcttctaatgctgctgagc

SEQ ID NO: 9264481 - DNA, 22 bp, Homo sapiens
ccaatattatgaaagtgtgaca

SEQ ID NO: 9264482 - DNA, 22 bp, Homo sapiens
ccaagtgttttataagggacag

SEQ ID NO: 9264483 - DNA, 22 bp, Homo sapiens
ccaagtgatacacccgcctcgg

SEQ ID NO: 9264484 - DNA, 22 bp, Homo sapiens
ccaagtcctgctgccactctac

SEQ ID NO: 9264485 - DNA, 22 bp, Homo sapiens
ccaagcatttctagccagtcac

SEQ ID NO: 9264486 - DNA, 22 bp, Homo sapiens
ccaagcatggggttcagtagga

SEQ ID NO: 9264487 - DNA, 22 bp, Homo sapiens
aggcagcagggccactggctga

SEQ ID NO: 9264488 - DNA, 22 bp, Homo sapiens
aggcagcagggccactggctga

SEQ ID NO: 9264489 - DNA, 23 bp, Homo sapiens
aggcagcaggttgtccagggtga

SEQ ID NO: 9264490 - DNA, 22 bp, Homo sapiens
ccaaaggccaagctcaggtaaa

SEQ ID NO: 9264491 - DNA, 22 bp, Homo sapiens
cattaaaatatctcatggtgtt

SEQ ID NO: 9264492 - DNA, 22 bp, Homo sapiens
aggcactgtgggtgtggccgga

SEQ ID NO: 9264493 - DNA, 22 bp, Homo sapiens
catgttttgtgtacagaatatt

SEQ ID NO: 9264494 - DNA, 22 bp, Homo sapiens
cattaaacaaccttgaatcaat

SEQ ID NO: 9264495 - DNA, 22 bp, Homo sapiens
cattaaattccttgttctcaaa

SEQ ID NO: 9264496 - DNA, 22 bp, Homo sapiens
aggcactgtgctgatgtcttat

SEQ ID NO: 9264497 - DNA, 22 bp, Homo sapiens
aggcactgtgctgatgtcttat

SEQ ID NO: 9264498 - DNA, 22 bp, Homo sapiens
aggcactgtgcagtcccaagca

SEQ ID NO: 9264499 - DNA, 22 bp, Homo sapiens
aggcactgtactaggtacaggg

SEQ ID NO: 9264500 - DNA, 22 bp, Homo sapiens
aggcactgtgctgatgtcttat

SEQ ID NO: 9264501 - DNA, 22 bp, Homo sapiens
aggcactgtgcttcttatatgt

SEQ ID NO: 9264502 - DNA, 22 bp, Homo sapiens
aggcactgtggaagacatggtt

SEQ ID NO: 9264503 - DNA, 15 bp, Homo sapiens
aggcactgtgggacc

SEQ ID NO: 9264504 - DNA, 22 bp, Homo sapiens
aggcactgtggaagacatggtt

SEQ ID NO: 9264505 - DNA, 22 bp, Homo sapiens
cattaacaatgactgcttgact

SEQ ID NO: 9264506 - DNA, 22 bp, Homo sapiens
catttgttaatgctgcttttaa

SEQ ID NO: 9264507 - DNA, 22 bp, Homo sapiens
catttgaaattcttagaacaaa

SEQ ID NO: 9264508 - DNA, 22 bp, Homo sapiens
catttgaaattcttagaacaaa

SEQ ID NO: 9264509 - DNA, 22 bp, Homo sapiens
catttgttcaaccattctcgct

SEQ ID NO: 9264510 - DNA, 22 bp, Homo sapiens
catttgttctgatttcaaaagg

SEQ ID NO: 9264511 - DNA, 22 bp, Homo sapiens
catttgttaattactattatct

SEQ ID NO: 9264512 - DNA, 19 bp, Homo sapiens
aggcagcaggccagggatg

SEQ ID NO: 9264513 - DNA, 19 bp, Homo sapiens
aggcagcaggccagggatg

SEQ ID NO: 9264514 - DNA, 19 bp, Homo sapiens
aggcagcaggccagggatg

SEQ ID NO: 9264515 - DNA, 21 bp, Homo sapiens
aggcagcaggatccagggaca

SEQ ID NO: 9264516 - DNA, 21 bp, Homo sapiens
aggcagcaggatccagggaca

SEQ ID NO: 9264517 - DNA, 22 bp, Homo sapiens
catttgttgggacaatgaaaag

SEQ ID NO: 9264518 - DNA, 22 bp, Homo sapiens
ccacctgagataagagagctca

SEQ ID NO: 9264519 - DNA, 22 bp, Homo sapiens
tctatatcttggctgctgtgaa

SEQ ID NO: 9264520 - DNA, 22 bp, Homo sapiens
tctcaagagggaggcaatcatg

SEQ ID NO: 9264521 - DNA, 22 bp, Homo sapiens
tctcaagcttgttggtatgttt

SEQ ID NO: 9264522 - DNA, 22 bp, Homo sapiens
tctcaagcttgttggtatgttt

SEQ ID NO: 9264523 - DNA, 22 bp, Homo sapiens
tctcaagctactaccttggatc

SEQ ID NO: 9264524 - DNA, 22 bp, Homo sapiens
tctcaaatttgttagataaaat

SEQ ID NO: 9264525 - DNA, 22 bp, Homo sapiens
tctcaaatttatacagagttca

SEQ ID NO: 9264526 - DNA, 18 bp, Homo sapiens
ccactttgcagcctggcc

SEQ ID NO: 9264527 - DNA, 19 bp, Homo sapiens
ccactttgcagatagtgag

SEQ ID NO: 9264528 - DNA, 22 bp, Homo sapiens
ccactttgcaagatattcagag

SEQ ID NO: 9264529 - DNA, 22 bp, Homo sapiens
ccactttgagaagctgatgaaa

SEQ ID NO: 9264530 - DNA, 22 bp, Homo sapiens
ccactttgaaccactgaggtgg

SEQ ID NO: 9264531 - DNA, 22 bp, Homo sapiens
ccacttttgggaacagtgagta

SEQ ID NO: 9264532 - DNA, 22 bp, Homo sapiens
ccactttgtaatgtgttatgtt

SEQ ID NO: 9264533 - DNA, 22 bp, Homo sapiens
ccactttggcaccttctgccta

SEQ ID NO: 9264534 - DNA, 19 bp, Homo sapiens
ccactttgcttctctgggt

SEQ ID NO: 9264535 - DNA, 22 bp, Homo sapiens
tctccacactttctctcccagg

SEQ ID NO: 9264536 - DNA, 22 bp, Homo sapiens
tctccacaccagaaggagctga

SEQ ID NO: 9264537 - DNA, 20 bp, Homo sapiens
tctcagtttctagagtcagg

SEQ ID NO: 9264538 - DNA, 22 bp, Homo sapiens
tctccacaagctttctcctttt

SEQ ID NO: 9264539 - DNA, 22 bp, Homo sapiens
ccagaaaaatcctcccttgtcc

SEQ ID NO: 9264540 - DNA, 22 bp, Homo sapiens
tctcagtttcctcatatgtaaa

SEQ ID NO: 9264541 - DNA, 21 bp, Homo sapiens
ccagagagagggaagtgggtt

SEQ ID NO: 9264542 - DNA, 22 bp, Homo sapiens
ccagagagattgcttctaaaga

SEQ ID NO: 9264543 - DNA, 19 bp, Homo sapiens
ccagagagctaggtacaga

SEQ ID NO: 9264544 - DNA, 19 bp, Homo sapiens
ccagagagctaggtacaga

SEQ ID NO: 9264545 - DNA, 22 bp, Homo sapiens
ccagagagctacaaggcataaa

SEQ ID NO: 9264546 - DNA, 22 bp, Homo sapiens
tctccaggaaagacactggact

SEQ ID NO: 9264547 - DNA, 20 bp, Homo sapiens
tctccagatgcagatgacat

SEQ ID NO: 9264548 - DNA, 22 bp, Homo sapiens
tctccctggagccctgaagcat

SEQ ID NO: 9264549 - DNA, 22 bp, Homo sapiens
tctccgatcacaggttttcaat

SEQ ID NO: 9264550 - DNA, 20 bp, Homo sapiens
tctccctgcccatctcagat

SEQ ID NO: 9264551 - DNA, 23 bp, Homo sapiens
tctccctgaggttgttagcatta

SEQ ID NO: 9264552 - DNA, 22 bp, Homo sapiens
tctccctctttgtctgctttgg

SEQ ID NO: 9264553 - DNA, 22 bp, Homo sapiens
tctccctctgtaagatcagggg

SEQ ID NO: 9264554 - DNA, 22 bp, Homo sapiens
tctcccacggtacaggataaac

SEQ ID NO: 9264555 - DNA, 22 bp, Homo sapiens
tctccctctcagatttattcac

SEQ ID NO: 9264556 - DNA, 22 bp, Homo sapiens
tctcccacagtctcccatggct

SEQ ID NO: 9264557 - DNA, 22 bp, Homo sapiens
ccagagaggcaaaactccttcc

SEQ ID NO: 9264558 - DNA, 22 bp, Homo sapiens
ccacatgctcaccaagtccctg

SEQ ID NO: 9264559 - DNA, 22 bp, Homo sapiens
ccacatgctctctctccaggtt

SEQ ID NO: 9264560 - DNA, 22 bp, Homo sapiens
tcctgactctggtgtcctctac

SEQ ID NO: 9264561 - DNA, 22 bp, Homo sapiens
ccacagtgagttctgtactctg

SEQ ID NO: 9264562 - DNA, 22 bp, Homo sapiens
tcctgactccaggtcctgtgtg

SEQ ID NO: 9264563 - DNA, 22 bp, Homo sapiens
ccacatggtcctcatttactct

SEQ ID NO: 9264564 - DNA, 22 bp, Homo sapiens
ccacatttactggatgctcagg

SEQ ID NO: 9264565 - DNA, 22 bp, Homo sapiens
tcctgaaggcctgagttccacc

SEQ ID NO: 9264566 - DNA, 22 bp, Homo sapiens
tcctgaagtatgggtatggagt

SEQ ID NO: 9264567 - DNA, 22 bp, Homo sapiens
tcctgaattgaactcagttaat

SEQ ID NO: 9264568 - DNA, 22 bp, Homo sapiens
tcctgaagtcacaggctctgag

SEQ ID NO: 9264569 - DNA, 22 bp, Homo sapiens
tcctgaattcctctttgcatcc

SEQ ID NO: 9264570 - DNA, 22 bp, Homo sapiens
tcctctctgcactggccctgcc

SEQ ID NO: 9264571 - DNA, 22 bp, Homo sapiens
tcctctccatgtctcacgccac

SEQ ID NO: 9264572 - DNA, 22 bp, Homo sapiens
tcctctccatgtctcacgccac

SEQ ID NO: 9264573 - DNA, 18 bp, Homo sapiens
tcctctctttccccaggg

SEQ ID NO: 9264574 - DNA, 22 bp, Homo sapiens
tcctctgactcacagcctgggg

SEQ ID NO: 9264575 - DNA, 22 bp, Homo sapiens
ccaccagcttcagcagccgcgg

SEQ ID NO: 9264576 - DNA, 22 bp, Homo sapiens
ccaccagcttcagcagccgcgg

SEQ ID NO: 9264577 - DNA, 22 bp, Homo sapiens
ccaccagctgcatatgcacgta

SEQ ID NO: 9264578 - DNA, 22 bp, Homo sapiens
ccaccagcagtgtgcaaggatt

SEQ ID NO: 9264579 - DNA, 22 bp, Homo sapiens
ccaccacttctggcttctggtg

SEQ ID NO: 9264580 - DNA, 22 bp, Homo sapiens
ccaccacttctggcttctggtg

SEQ ID NO: 9264581 - DNA, 22 bp, Homo sapiens
ccaccagctttgccaccctgct

SEQ ID NO: 9264582 - DNA, 22 bp, Homo sapiens
ccaccaggacagccctgagggg

SEQ ID NO: 9264583 - DNA, 22 bp, Homo sapiens
tcgcccaggctggagtgcagtg

SEQ ID NO: 9264584 - DNA, 22 bp, Homo sapiens
tcgcgggttgcacatggccatc

SEQ ID NO: 9264585 - DNA, 22 bp, Homo sapiens
tcgctgaggctgcacggctgcc

SEQ ID NO: 9264586 - DNA, 22 bp, Homo sapiens
tcgctgaggctgcacggctgcc

SEQ ID NO: 9264587 - DNA, 22 bp, Homo sapiens
tcgctgaggctgcacggctgcc

SEQ ID NO: 9264588 - DNA, 22 bp, Homo sapiens
tcggccacggggtttcctccaa

SEQ ID NO: 9264589 - DNA, 22 bp, Homo sapiens
tcggagctgtagatgaaaccct

SEQ ID NO: 9264590 - DNA, 22 bp, Homo sapiens
ccacccttgggttcggaggccg

SEQ ID NO: 9264591 - DNA, 22 bp, Homo sapiens
ccaccctgtgcaggcgtgggta

SEQ ID NO: 9264592 - DNA, 22 bp, Homo sapiens
ccaccctgtgtttttgccattg

SEQ ID NO: 9264593 - DNA, 22 bp, Homo sapiens
ccaccctgggttctgatgtgga

SEQ ID NO: 9264594 - DNA, 22 bp, Homo sapiens
ccaccctggacaggcctctgag

SEQ ID NO: 9264595 - DNA, 23 bp, Homo sapiens
tcggtgggcgtggaggccgaggc

SEQ ID NO: 9264596 - DNA, 23 bp, Homo sapiens
tctctgagttgtactttcccttg

SEQ ID NO: 9264597 - DNA, 22 bp, Homo sapiens
tctctgagttctcctccagccc

SEQ ID NO: 9264598 - DNA, 22 bp, Homo sapiens
tctctcttgtcaccccatctgc

SEQ ID NO: 9264599 - DNA, 23 bp, Homo sapiens
tctcctggctgcactgtggccac

SEQ ID NO: 9264600 - DNA, 23 bp, Homo sapiens
tctcctggctgcactgtggccac

SEQ ID NO: 9264601 - DNA, 22 bp, Homo sapiens
tctcctggctctaaaaggctgt

SEQ ID NO: 9264602 - DNA, 17 bp, Homo sapiens
tctcctggctctatcag

SEQ ID NO: 9264603 - DNA, 22 bp, Homo sapiens
tctcctggccgggctgtcccct

SEQ ID NO: 9264604 - DNA, 22 bp, Homo sapiens
tctcctggcctttaggttaagg

SEQ ID NO: 9264605 - DNA, 22 bp, Homo sapiens
tctcctggcctttaggttaagg

SEQ ID NO: 9264606 - DNA, 22 bp, Homo sapiens
tctcctggccgggctgtcccct

SEQ ID NO: 9264607 - DNA, 22 bp, Homo sapiens
tctcctggctcaccaggctgga

SEQ ID NO: 9264608 - DNA, 22 bp, Homo sapiens
tctcctggctcaccaggctgga

SEQ ID NO: 9264609 - DNA, 22 bp, Homo sapiens
tctcctggctcaccaggctgga

SEQ ID NO: 9264610 - DNA, 22 bp, Homo sapiens
tctcctggctcaccaggctgga

SEQ ID NO: 9264611 - DNA, 21 bp, Homo sapiens
tctctgggaggacttgtgaga

SEQ ID NO: 9264612 - DNA, 21 bp, Homo sapiens
tctctgggaggacttgtgaga

SEQ ID NO: 9264613 - DNA, 22 bp, Homo sapiens
tctctgggagttgagcagcagc

SEQ ID NO: 9264614 - DNA, 22 bp, Homo sapiens
tctctgggaattttttggacat

SEQ ID NO: 9264615 - DNA, 22 bp, Homo sapiens
tctctgggagcaattgtttgct

SEQ ID NO: 9264616 - DNA, 22 bp, Homo sapiens
tctctgggacactgggtcagtt

SEQ ID NO: 9264617 - DNA, 22 bp, Homo sapiens
tctctgccacagcttctgcctt

SEQ ID NO: 9264618 - DNA, 22 bp, Homo sapiens
tctctgccacagcttctgcctt

SEQ ID NO: 9264619 - DNA, 22 bp, Homo sapiens
tctctgccaccatgagatgggc

SEQ ID NO: 9264620 - DNA, 22 bp, Homo sapiens
tctctgcccaagtttctcaagt

SEQ ID NO: 9264621 - DNA, 22 bp, Homo sapiens
tctctgcccatcctcagtccac

SEQ ID NO: 9264622 - DNA, 22 bp, Homo sapiens
tctctgcccatcctcagtccac

SEQ ID NO: 9264623 - DNA, 22 bp, Homo sapiens
tctctgcccatcctcagtccac

SEQ ID NO: 9264624 - DNA, 22 bp, Homo sapiens
ccagcagagggtcttggccatt

SEQ ID NO: 9264625 - DNA, 22 bp, Homo sapiens
ccagcactgctctcagactgag

SEQ ID NO: 9264626 - DNA, 22 bp, Homo sapiens
ccagcagagtctaggaaggagg

SEQ ID NO: 9264627 - DNA, 22 bp, Homo sapiens
ccagcagcagcgtccaaggaga

SEQ ID NO: 9264628 - DNA, 22 bp, Homo sapiens
ccagcagcgatagggtgagtgc

SEQ ID NO: 9264629 - DNA, 22 bp, Homo sapiens
ccagcagggcagtgccctggac

SEQ ID NO: 9264630 - DNA, 22 bp, Homo sapiens
ccagcagggcagtgccctggac

SEQ ID NO: 9264631 - DNA, 22 bp, Homo sapiens
ccagcagctttattggctctcc

SEQ ID NO: 9264632 - DNA, 22 bp, Homo sapiens
ccagcagctttattggctctcc

SEQ ID NO: 9264633 - DNA, 22 bp, Homo sapiens
ccagcagctgcaaagcctgggt

SEQ ID NO: 9264634 - DNA, 22 bp, Homo sapiens
ccagccctgtcaccaactggag

SEQ ID NO: 9264635 - DNA, 22 bp, Homo sapiens
ccagccctgtcaccaactggag

SEQ ID NO: 9264636 - DNA, 19 bp, Homo sapiens
ccagccctgtcacttcttg

SEQ ID NO: 9264637 - DNA, 22 bp, Homo sapiens
ccagccctgtaaggatgaggca

SEQ ID NO: 9264638 - DNA, 22 bp, Homo sapiens
ccagccctgtcaccaactggag

SEQ ID NO: 9264639 - DNA, 19 bp, Homo sapiens
ccagccctgtcacttcttg

SEQ ID NO: 9264640 - DNA, 22 bp, Homo sapiens
ccagcccttcccaactggccag

SEQ ID NO: 9264641 - DNA, 20 bp, Homo sapiens
ccagcatgtacacatgtgga

SEQ ID NO: 9264642 - DNA, 22 bp, Homo sapiens
ccagcatggcacctgagatgag

SEQ ID NO: 9264643 - DNA, 22 bp, Homo sapiens
ccagcatggcacctgagatgag

SEQ ID NO: 9264644 - DNA, 22 bp, Homo sapiens
ccagccctgcctctcagggccc

SEQ ID NO: 9264645 - DNA, 22 bp, Homo sapiens
ccagccctcactgaggcctctc

SEQ ID NO: 9264646 - DNA, 22 bp, Homo sapiens
tctgcagaattcgaggaagaaa

SEQ ID NO: 9264647 - DNA, 22 bp, Homo sapiens
tctgcagaattcgaggaagaaa

SEQ ID NO: 9264648 - DNA, 22 bp, Homo sapiens
tctgcagaaggaatcagctgag

SEQ ID NO: 9264649 - DNA, 21 bp, Homo sapiens
tctgagagcaactgcccttta

SEQ ID NO: 9264650 - DNA, 22 bp, Homo sapiens
tctgagaggcatctgcacttct

SEQ ID NO: 9264651 - DNA, 22 bp, Homo sapiens
tctctgtgtgggagatcttttt

SEQ ID NO: 9264652 - DNA, 22 bp, Homo sapiens
tctctgtgtgccttcatctgcc

SEQ ID NO: 9264653 - DNA, 22 bp, Homo sapiens
ccagcaggtgtagggctcatgg

SEQ ID NO: 9264654 - DNA, 22 bp, Homo sapiens
ccagcaggtgtagggctcatgg

SEQ ID NO: 9264655 - DNA, 22 bp, Homo sapiens
tctctgttcatggcactatgtc

SEQ ID NO: 9264656 - DNA, 22 bp, Homo sapiens
tctctgttcatggcactatgtc

SEQ ID NO: 9264657 - DNA, 22 bp, Homo sapiens
tctgaaatgacctttccccact

SEQ ID NO: 9264658 - DNA, 22 bp, Homo sapiens
tctgaaatgaactcttgaactt

SEQ ID NO: 9264659 - DNA, 22 bp, Homo sapiens
tctgaaatgacctttccccact

SEQ ID NO: 9264660 - DNA, 22 bp, Homo sapiens
tctcttaaaggtcttcagctga

SEQ ID NO: 9264661 - DNA, 22 bp, Homo sapiens
tctcttaaaggtcttcagctga

SEQ ID NO: 9264662 - DNA, 22 bp, Homo sapiens
tctctgtgtgttggctgtatat

SEQ ID NO: 9264663 - DNA, 22 bp, Homo sapiens
tctctgtgtgttggctgtatat

SEQ ID NO: 9264664 - DNA, 22 bp, Homo sapiens
tctctgtgtgtgtgacagcatt

SEQ ID NO: 9264665 - DNA, 22 bp, Homo sapiens
tctctgtgttccctgttttctc

SEQ ID NO: 9264666 - DNA, 19 bp, Homo sapiens
tctgaattatttatgtacc

SEQ ID NO: 9264667 - DNA, 22 bp, Homo sapiens
tctgaatgcacttagttaccaa

SEQ ID NO: 9264668 - DNA, 22 bp, Homo sapiens
tctgaatgttaggaaactttct

SEQ ID NO: 9264669 - DNA, 19 bp, Homo sapiens
tctgaatgggatgagttgg

SEQ ID NO: 9264670 - DNA, 22 bp, Homo sapiens
tctgaatgtatcgaattgaggc

SEQ ID NO: 9264671 - DNA, 22 bp, Homo sapiens
tctgaatagttctattttaaag

SEQ ID NO: 9264672 - DNA, 19 bp, Homo sapiens
tctgaagtccagggcatac

SEQ ID NO: 9264673 - DNA, 19 bp, Homo sapiens
tctgaagtccagggcatac

SEQ ID NO: 9264674 - DNA, 22 bp, Homo sapiens
tctgaagttcttaaattagttt

SEQ ID NO: 9264675 - DNA, 22 bp, Homo sapiens
tcctcagggaagatgagcctca

SEQ ID NO: 9264676 - DNA, 22 bp, Homo sapiens
tcctcaggctgcctggaagact

SEQ ID NO: 9264677 - DNA, 22 bp, Homo sapiens
tcctcaggctgcctggaagact

SEQ ID NO: 9264678 - DNA, 22 bp, Homo sapiens
tcctcccctcagggcaacggat

SEQ ID NO: 9264679 - DNA, 21 bp, Homo sapiens
tcctctccatgatctgtttgt

SEQ ID NO: 9264680 - DNA, 22 bp, Homo sapiens
tcctctccatattttctgattt

SEQ ID NO: 9264681 - DNA, 22 bp, Homo sapiens
tcctcaggatgtggggtagaat

SEQ ID NO: 9264682 - DNA, 22 bp, Homo sapiens
tcctcaggatgtggagtagaat

SEQ ID NO: 9264683 - DNA, 22 bp, Homo sapiens
tcctcaggagagctcctatgcc

SEQ ID NO: 9264684 - DNA, 22 bp, Homo sapiens
tcctcaggagagctcctatgcc

SEQ ID NO: 9264685 - DNA, 22 bp, Homo sapiens
tcctcaggatctaggagtgctt

SEQ ID NO: 9264686 - DNA, 22 bp, Homo sapiens
tcctcaggatctaggagtgctt

SEQ ID NO: 9264687 - DNA, 22 bp, Homo sapiens
tcctcagcttttatttcacttg

SEQ ID NO: 9264688 - DNA, 22 bp, Homo sapiens
tcctcagctttggtttactcat

SEQ ID NO: 9264689 - DNA, 22 bp, Homo sapiens
tcctagaagatggatcagagaa

SEQ ID NO: 9264690 - DNA, 22 bp, Homo sapiens
tcctagaaggatcattctagtg

SEQ ID NO: 9264691 - DNA, 18 bp, Homo sapiens
tcctcagcctcacctagc

SEQ ID NO: 9264692 - DNA, 22 bp, Homo sapiens
tccctcagaaattctctctgaa

SEQ ID NO: 9264693 - DNA, 22 bp, Homo sapiens
tccctcagaaattctctctgaa

SEQ ID NO: 9264694 - DNA, 22 bp, Homo sapiens
tccctcactggttctgcatccc

SEQ ID NO: 9264695 - DNA, 22 bp, Homo sapiens
tccctaggtcctagtcacagta

SEQ ID NO: 9264696 - DNA, 22 bp, Homo sapiens
tccctagtcgcatctgtggaga

SEQ ID NO: 9264697 - DNA, 22 bp, Homo sapiens
tccctagtcgcatctgtggaga

SEQ ID NO: 9264698 - DNA, 22 bp, Homo sapiens
tccctagtcgcatctgtggaga

SEQ ID NO: 9264699 - DNA, 22 bp, Homo sapiens
cattgaaatatggaaactgatg

SEQ ID NO: 9264700 - DNA, 22 bp, Homo sapiens
cattgaaacctaacataggctg

SEQ ID NO: 9264701 - DNA, 22 bp, Homo sapiens
cattgaaatatggaaactgatg

SEQ ID NO: 9264702 - DNA, 18 bp, Homo sapiens
cattgacagtatatcttt

SEQ ID NO: 9264703 - DNA, 22 bp, Homo sapiens
cattgaatccttccttcagaag

SEQ ID NO: 9264704 - DNA, 22 bp, Homo sapiens
cattgaaaaacgttgactgagt

SEQ ID NO: 9264705 - DNA, 22 bp, Homo sapiens
tcccaggaggtgcttcctagga

SEQ ID NO: 9264706 - DNA, 22 bp, Homo sapiens
tcccaggaggtgcttcctagga

SEQ ID NO: 9264707 - DNA, 16 bp, Homo sapiens
tcccaggaggcggaac

SEQ ID NO: 9264708 - DNA, 22 bp, Homo sapiens
cattgcaccacattgcatccct

SEQ ID NO: 9264709 - DNA, 22 bp, Homo sapiens
tcccagggtcctcttctggaat

SEQ ID NO: 9264710 - DNA, 22 bp, Homo sapiens
tcccagggtcctcttctggaat

SEQ ID NO: 9264711 - DNA, 22 bp, Homo sapiens
tcccggcgctgggaggtgggtc

SEQ ID NO: 9264712 - DNA, 22 bp, Homo sapiens
tccctaaactctgaactgattc

SEQ ID NO: 9264713 - DNA, 22 bp, Homo sapiens
tccccagcttgctacttctgct

SEQ ID NO: 9264714 - DNA, 22 bp, Homo sapiens
tccccagaggaatatgagattg

SEQ ID NO: 9264715 - DNA, 22 bp, Homo sapiens
tccccactctctcctggagctt

SEQ ID NO: 9264716 - DNA, 22 bp, Homo sapiens
tccccagatggccagctacatg

SEQ ID NO: 9264717 - DNA, 22 bp, Homo sapiens
tccccagaggtgaggcagcttt

SEQ ID NO: 9264718 - DNA, 19 bp, Homo sapiens
tccccagcacctctgagtc

SEQ ID NO: 9264719 - DNA, 22 bp, Homo sapiens
tcccagaggaaatggcagctga

SEQ ID NO: 9264720 - DNA, 22 bp, Homo sapiens
tcccagaggaaatggcagctga

SEQ ID NO: 9264721 - DNA, 22 bp, Homo sapiens
tcccagccacaggtgtagccct

SEQ ID NO: 9264722 - DNA, 22 bp, Homo sapiens
tcccagagctgataagccttta

SEQ ID NO: 9264723 - DNA, 22 bp, Homo sapiens
tcccagagctgataagccttta

SEQ ID NO: 9264724 - DNA, 22 bp, Homo sapiens
tcccagagctctggaggttgga

SEQ ID NO: 9264725 - DNA, 22 bp, Homo sapiens
tcccagagctctggaggttgga

SEQ ID NO: 9264726 - DNA, 22 bp, Homo sapiens
tcccagagcctctgccactctg

SEQ ID NO: 9264727 - DNA, 22 bp, Homo sapiens
tcccagagctctgacaccagct

SEQ ID NO: 9264728 - DNA, 22 bp, Homo sapiens
tcccagagctctgacaccagct

SEQ ID NO: 9264729 - DNA, 22 bp, Homo sapiens
tcccagagcccaagttggagag

SEQ ID NO: 9264730 - DNA, 22 bp, Homo sapiens
tcccagagcccaagttggagag

SEQ ID NO: 9264731 - DNA, 22 bp, Homo sapiens
tcccagagcctctgccactctg

SEQ ID NO: 9264732 - DNA, 22 bp, Homo sapiens
cattcattcagcaactgttatt

SEQ ID NO: 9264733 - DNA, 22 bp, Homo sapiens
tcccaggacatgggctctgctc

SEQ ID NO: 9264734 - DNA, 22 bp, Homo sapiens
tcccaggacccaggcattcaca

SEQ ID NO: 9264735 - DNA, 22 bp, Homo sapiens
tcccaggagcaccttttgagcc

SEQ ID NO: 9264736 - DNA, 22 bp, Homo sapiens
tcccaggacttccagttggagg

SEQ ID NO: 9264737 - DNA, 22 bp, Homo sapiens
tcccaggacttccagttggagg

SEQ ID NO: 9264738 - DNA, 22 bp, Homo sapiens
tcccaggaattgaagccagtgt

SEQ ID NO: 9264739 - DNA, 22 bp, Homo sapiens
tcccaggacaggccacatggaa

SEQ ID NO: 9264740 - DNA, 22 bp, Homo sapiens
tcccaggacaggccacatggaa

SEQ ID NO: 9264741 - DNA, 22 bp, Homo sapiens
tcccaggaatccgtcctctaga

SEQ ID NO: 9264742 - DNA, 23 bp, Homo sapiens
tcccaggaatctgcatttttaac

SEQ ID NO: 9264743 - DNA, 22 bp, Homo sapiens
tcccaggaatgtctgaaagtga

SEQ ID NO: 9264744 - DNA, 22 bp, Homo sapiens
tcccagcccagatttgtgtgac

SEQ ID NO: 9264745 - DNA, 22 bp, Homo sapiens
tcccagccattcctttaggtgt

SEQ ID NO: 9264746 - DNA, 22 bp, Homo sapiens
cattatattttactgcatggga

SEQ ID NO: 9264747 - DNA, 22 bp, Homo sapiens
cattatattacagcactgttaa

SEQ ID NO: 9264748 - DNA, 22 bp, Homo sapiens
catgtttctgagaaaagtagga

SEQ ID NO: 9264749 - DNA, 22 bp, Homo sapiens
catgttatttatccattaaaca

SEQ ID NO: 9264750 - DNA, 22 bp, Homo sapiens
catgttaatgaatttttgcagt

SEQ ID NO: 9264751 - DNA, 22 bp, Homo sapiens
catgttaaattgagtttgcaat

SEQ ID NO: 9264752 - DNA, 22 bp, Homo sapiens
catgttaactaagattaactat

SEQ ID NO: 9264753 - DNA, 22 bp, Homo sapiens
catgttaactaagattaactat

SEQ ID NO: 9264754 - DNA, 22 bp, Homo sapiens
catgttaagtgtttgataacca

SEQ ID NO: 9264755 - DNA, 22 bp, Homo sapiens
catgttctcttaatgttaacta

SEQ ID NO: 9264756 - DNA, 22 bp, Homo sapiens
catgttcaaataagtagtttct

SEQ ID NO: 9264757 - DNA, 22 bp, Homo sapiens
cattcaaatgtgccactgtcct

SEQ ID NO: 9264758 - DNA, 22 bp, Homo sapiens
cattcacaaaaccacatgccat

SEQ ID NO: 9264759 - DNA, 22 bp, Homo sapiens
cattcacaaaaccacatgccat

SEQ ID NO: 9264760 - DNA, 22 bp, Homo sapiens
cattcacagagggggaagcatc

SEQ ID NO: 9264761 - DNA, 22 bp, Homo sapiens
cattcacaatagttgaaaggtg

SEQ ID NO: 9264762 - DNA, 22 bp, Homo sapiens
cattcacaaagctgattgatgg

SEQ ID NO: 9264763 - DNA, 22 bp, Homo sapiens
cattcacatcttgttccatcac

SEQ ID NO: 9264764 - DNA, 22 bp, Homo sapiens
cattcagagctttcttatcata

SEQ ID NO: 9264765 - DNA, 22 bp, Homo sapiens
cattcagtcatgctggttttga

SEQ ID NO: 9264766 - DNA, 22 bp, Homo sapiens
cattcattcacattttgtctat

SEQ ID NO: 9264767 - DNA, 22 bp, Homo sapiens
tccacattatgtttctcctttc

SEQ ID NO: 9264768 - DNA, 22 bp, Homo sapiens
tccagacattttatagcagtct

SEQ ID NO: 9264769 - DNA, 22 bp, Homo sapiens
tccacatgacttctaataactg

SEQ ID NO: 9264770 - DNA, 22 bp, Homo sapiens
tccacatgaccattgtgctcct

SEQ ID NO: 9264771 - DNA, 20 bp, Homo sapiens
tccaagccctccttccattc

SEQ ID NO: 9264772 - DNA, 22 bp, Homo sapiens
tcatttatttgactttggagtg

SEQ ID NO: 9264773 - DNA, 22 bp, Homo sapiens
tcattctgcatcactcttgctc

SEQ ID NO: 9264774 - DNA, 22 bp, Homo sapiens
tcattctgcatcactcttgctc

SEQ ID NO: 9264775 - DNA, 22 bp, Homo sapiens
tcattctggatgactttctaga

SEQ ID NO: 9264776 - DNA, 22 bp, Homo sapiens
tcattctctgggatgcagtttg

SEQ ID NO: 9264777 - DNA, 22 bp, Homo sapiens
tcattctcagactcttggcctc

SEQ ID NO: 9264778 - DNA, 22 bp, Homo sapiens
tcattccttaacattcatttgc

SEQ ID NO: 9264779 - DNA, 22 bp, Homo sapiens
tcattccttatccgtatctttt

SEQ ID NO: 9264780 - DNA, 22 bp, Homo sapiens
tcattcctttacagttgatcct

SEQ ID NO: 9264781 - DNA, 22 bp, Homo sapiens
tcattccctcattgttcactgg

SEQ ID NO: 9264782 - DNA, 22 bp, Homo sapiens
tcattccatttccagctctgaa

SEQ ID NO: 9264783 - DNA, 22 bp, Homo sapiens
tcattcctccagcgggagtcca

SEQ ID NO: 9264784 - DNA, 22 bp, Homo sapiens
tcattccttaacattcatttgc

SEQ ID NO: 9264785 - DNA, 22 bp, Homo sapiens
tcattccttatccgtatctttt

SEQ ID NO: 9264786 - DNA, 22 bp, Homo sapiens
tcattcctcaggaagggattta

SEQ ID NO: 9264787 - DNA, 22 bp, Homo sapiens
tcatttatcgctgccttttaaa

SEQ ID NO: 9264788 - DNA, 22 bp, Homo sapiens
tcatttatgcaggaatggcata

SEQ ID NO: 9264789 - DNA, 22 bp, Homo sapiens
tcatttatgcaggaatggcata

SEQ ID NO: 9264790 - DNA, 21 bp, Homo sapiens
tcatttattgagaaatgactg

SEQ ID NO: 9264791 - DNA, 21 bp, Homo sapiens
tcatttattgagaaatgactg

SEQ ID NO: 9264792 - DNA, 22 bp, Homo sapiens
cataaattgtacccattccaac

SEQ ID NO: 9264793 - DNA, 22 bp, Homo sapiens
tcatgaacttcctagccagact

SEQ ID NO: 9264794 - DNA, 22 bp, Homo sapiens
tcatgagtctgcaaattatgga

SEQ ID NO: 9264795 - DNA, 18 bp, Homo sapiens
tcatgaggtagaggctgg

SEQ ID NO: 9264796 - DNA, 22 bp, Homo sapiens
tcatgagtggattaatatggct

SEQ ID NO: 9264797 - DNA, 22 bp, Homo sapiens
tcatgcaacaacacattctggc

SEQ ID NO: 9264798 - DNA, 22 bp, Homo sapiens
tcatgcaaagccaattccagct

SEQ ID NO: 9264799 - DNA, 22 bp, Homo sapiens
tcatgcaaatactgttccagaa

SEQ ID NO: 9264800 - DNA, 22 bp, Homo sapiens
tcatgcaaatactgttccagaa

SEQ ID NO: 9264801 - DNA, 22 bp, Homo sapiens
tcatgcaaagccaattccagct

SEQ ID NO: 9264802 - DNA, 18 bp, Homo sapiens
tcatgcaaacgcttcata

SEQ ID NO: 9264803 - DNA, 22 bp, Homo sapiens
tcatgcaaactctagtccttta

SEQ ID NO: 9264804 - DNA, 22 bp, Homo sapiens
tcatgcaaaagacttgaacttt

SEQ ID NO: 9264805 - DNA, 22 bp, Homo sapiens
tcatgcaaggctgaaacatggt

SEQ ID NO: 9264806 - DNA, 19 bp, Homo sapiens
tcatgcaatcagtgaactg

SEQ ID NO: 9264807 - DNA, 22 bp, Homo sapiens
tcatgcaagaataataggaagg

SEQ ID NO: 9264808 - DNA, 20 bp, Homo sapiens
tcatgcaagattcataaagg

SEQ ID NO: 9264809 - DNA, 19 bp, Homo sapiens
tcatgtctctcatctgtga

SEQ ID NO: 9264810 - DNA, 22 bp, Homo sapiens
catgaaaaatttactgttaaca

SEQ ID NO: 9264811 - DNA, 23 bp, Homo sapiens
tcattccacaaatacttatctag

SEQ ID NO: 9264812 - DNA, 22 bp, Homo sapiens
tcatgtggcttatagaatttgt

SEQ ID NO: 9264813 - DNA, 22 bp, Homo sapiens
tcatgcaatctcttgttcagga

SEQ ID NO: 9264814 - DNA, 19 bp, Homo sapiens
catctttggtcacctagtc

SEQ ID NO: 9264815 - DNA, 22 bp, Homo sapiens
catcttttcagaagccattctg

SEQ ID NO: 9264816 - DNA, 22 bp, Homo sapiens
tccagcctaatgttcttcccac

SEQ ID NO: 9264817 - DNA, 22 bp, Homo sapiens
tccagagacttgcatgtgcttg

SEQ ID NO: 9264818 - DNA, 22 bp, Homo sapiens
tccagctcttgttgcccactgc

SEQ ID NO: 9264819 - DNA, 22 bp, Homo sapiens
tccagcctaggggaacagctgc

SEQ ID NO: 9264820 - DNA, 22 bp, Homo sapiens
tccagcctcatttctcctgctt

SEQ ID NO: 9264821 - DNA, 17 bp, Homo sapiens
tccagcctcctctgctg

SEQ ID NO: 9264822 - DNA, 22 bp, Homo sapiens
tccagctcttgttgcccactgc

SEQ ID NO: 9264823 - DNA, 22 bp, Homo sapiens
tccaggctcagtcaagcacttc

SEQ ID NO: 9264824 - DNA, 22 bp, Homo sapiens
catgtgttaatctttctgcaaa

SEQ ID NO: 9264825 - DNA, 22 bp, Homo sapiens
catgtgttaatctttctgcaaa

SEQ ID NO: 9264826 - DNA, 22 bp, Homo sapiens
catgtgttttgtcatttcaata

SEQ ID NO: 9264827 - DNA, 22 bp, Homo sapiens
catgtgtttcgagactgttgag

SEQ ID NO: 9264828 - DNA, 22 bp, Homo sapiens
catgtgtgtccatgtgactaag

SEQ ID NO: 9264829 - DNA, 22 bp, Homo sapiens
catgtgtgtctccaccagctgc

SEQ ID NO: 9264830 - DNA, 18 bp, Homo sapiens
tccaggctccaggctaac

SEQ ID NO: 9264831 - DNA, 22 bp, Homo sapiens
tccaggctcagtcaagcacttc

SEQ ID NO: 9264832 - DNA, 22 bp, Homo sapiens
tccaggctcccctgcgtgctcc

SEQ ID NO: 9264833 - DNA, 19 bp, Homo sapiens
tccaggctccattggcaga

SEQ ID NO: 9264834 - DNA, 19 bp, Homo sapiens
tccaggctccattggcaga

SEQ ID NO: 9264835 - DNA, 18 bp, Homo sapiens
tccaggctccaggctaac

SEQ ID NO: 9264836 - DNA, 22 bp, Homo sapiens
tccaggctcccctgcgtgctcc

SEQ ID NO: 9264837 - DNA, 22 bp, Homo sapiens
tccaggctcccctgcgtgctcc

SEQ ID NO: 9264838 - DNA, 22 bp, Homo sapiens
tccaggctccctcaggatgcac

SEQ ID NO: 9264839 - DNA, 22 bp, Homo sapiens
tccaggctccctcaggatgcac

SEQ ID NO: 9264840 - DNA, 22 bp, Homo sapiens
taggacttggtgactctcaatg

SEQ ID NO: 9264841 - DNA, 19 bp, Homo sapiens
taggaccctggtggccccc

SEQ ID NO: 9264842 - DNA, 22 bp, Homo sapiens
taggagaggtgaatggcacact

SEQ ID NO: 9264843 - DNA, 22 bp, Homo sapiens
taggagacattgatcccaagaa

SEQ ID NO: 9264844 - DNA, 22 bp, Homo sapiens
taggactttggcgtcagaactg

SEQ ID NO: 9264845 - DNA, 22 bp, Homo sapiens
taggagctaaaatattttatat

SEQ ID NO: 9264846 - DNA, 21 bp, Homo sapiens
taggagctgatggggaagtag

SEQ ID NO: 9264847 - DNA, 22 bp, Homo sapiens
cagggcctgcctggttcctgga

SEQ ID NO: 9264848 - DNA, 22 bp, Homo sapiens
cagggcctgcttccttcttgtt

SEQ ID NO: 9264849 - DNA, 22 bp, Homo sapiens
cagggcctggagctgggcctgc

SEQ ID NO: 9264850 - DNA, 22 bp, Homo sapiens
cagggccttgttcaggagtgaa

SEQ ID NO: 9264851 - DNA, 22 bp, Homo sapiens
cagggccttttagcatcttctc

SEQ ID NO: 9264852 - DNA, 22 bp, Homo sapiens
taggaaatggctcagttactgc

SEQ ID NO: 9264853 - DNA, 22 bp, Homo sapiens
taggaacaagtttccttgctgt

SEQ ID NO: 9264854 - DNA, 22 bp, Homo sapiens
taggaacaagtttccttgctgt

SEQ ID NO: 9264855 - DNA, 22 bp, Homo sapiens
taggaacaactgcaggtacaag

SEQ ID NO: 9264856 - DNA, 22 bp, Homo sapiens
taggaacacagggacttgatga

SEQ ID NO: 9264857 - DNA, 22 bp, Homo sapiens
taggaacacagggacttgatga

SEQ ID NO: 9264858 - DNA, 22 bp, Homo sapiens
taggaacagtcctagaaatctg

SEQ ID NO: 9264859 - DNA, 22 bp, Homo sapiens
taggaacatatgcagtgctttt

SEQ ID NO: 9264860 - DNA, 22 bp, Homo sapiens
taggaacaaagagcctcacatt

SEQ ID NO: 9264861 - DNA, 22 bp, Homo sapiens
taggaaattggaaactcttcac

SEQ ID NO: 9264862 - DNA, 22 bp, Homo sapiens
cagggcaggaatttgacattgc

SEQ ID NO: 9264863 - DNA, 22 bp, Homo sapiens
tagctcctccccatccaggttc

SEQ ID NO: 9264864 - DNA, 22 bp, Homo sapiens
tagctcctccccatccaggttc

SEQ ID NO: 9264865 - DNA, 22 bp, Homo sapiens
tagctcctggctgcagggcctc

SEQ ID NO: 9264866 - DNA, 22 bp, Homo sapiens
tagctaccattattgagcacct

SEQ ID NO: 9264867 - DNA, 22 bp, Homo sapiens
tagctagtagatggggaagctg

SEQ ID NO: 9264868 - DNA, 22 bp, Homo sapiens
tagctagtgtttggagatggat

SEQ ID NO: 9264869 - DNA, 22 bp, Homo sapiens
tagctattttgcttggaaatac

SEQ ID NO: 9264870 - DNA, 22 bp, Homo sapiens
tagctatttggaaaattccaat

SEQ ID NO: 9264871 - DNA, 22 bp, Homo sapiens
tagctatttggaaaattccaat

SEQ ID NO: 9264872 - DNA, 22 bp, Homo sapiens
tagctattgttggtagttaccc

SEQ ID NO: 9264873 - DNA, 22 bp, Homo sapiens
tagggtggttagaaggagtatg

SEQ ID NO: 9264874 - DNA, 22 bp, Homo sapiens
tagggtggttagaaggagtatg

SEQ ID NO: 9264875 - DNA, 22 bp, Homo sapiens
taggtaggtaaacaggactaat

SEQ ID NO: 9264876 - DNA, 22 bp, Homo sapiens
taggtagctttggcgtttcttg

SEQ ID NO: 9264877 - DNA, 22 bp, Homo sapiens
cagggctttttattagctgcct

SEQ ID NO: 9264878 - DNA, 22 bp, Homo sapiens
cagggctttgtgtgcctgggga

SEQ ID NO: 9264879 - DNA, 18 bp, Homo sapiens
cagggctgtggggtcact

SEQ ID NO: 9264880 - DNA, 22 bp, Homo sapiens
cagggctttcctgagaagtgat

SEQ ID NO: 9264881 - DNA, 22 bp, Homo sapiens
caggggacattaaagctccata

SEQ ID NO: 9264882 - DNA, 22 bp, Homo sapiens
caggggaaggagccttgaaact

SEQ ID NO: 9264883 - DNA, 22 bp, Homo sapiens
caggggaaggagccttgaaact

SEQ ID NO: 9264884 - DNA, 22 bp, Homo sapiens
caggggaagatgccaagggaga

SEQ ID NO: 9264885 - DNA, 22 bp, Homo sapiens
tagggacaaagagctgaggcct

SEQ ID NO: 9264886 - DNA, 21 bp, Homo sapiens
tagggcaggcattggaagaga

SEQ ID NO: 9264887 - DNA, 21 bp, Homo sapiens
tagggcaggcattggaagaga

SEQ ID NO: 9264888 - DNA, 22 bp, Homo sapiens
cagggctcatctgtgtgaccag

SEQ ID NO: 9264889 - DNA, 22 bp, Homo sapiens
cagggctccatgcagggactcc

SEQ ID NO: 9264890 - DNA, 22 bp, Homo sapiens
tagggcaggtgaagaaaagcta

SEQ ID NO: 9264891 - DNA, 22 bp, Homo sapiens
tagggcaggggaggaatctgaa

SEQ ID NO: 9264892 - DNA, 22 bp, Homo sapiens
tagggctataagagaataagac

SEQ ID NO: 9264893 - DNA, 22 bp, Homo sapiens
tagggctattctgagtaataat

SEQ ID NO: 9264894 - DNA, 22 bp, Homo sapiens
cagggtggcaggcaccatggcc

SEQ ID NO: 9264895 - DNA, 22 bp, Homo sapiens
cagggtggcactcagcgcatct

SEQ ID NO: 9264896 - DNA, 22 bp, Homo sapiens
tatcatttaacagaatcattgc

SEQ ID NO: 9264897 - DNA, 22 bp, Homo sapiens
tatcataagttaattaaacagt

SEQ ID NO: 9264898 - DNA, 22 bp, Homo sapiens
tatcagtatggattcatggatt

SEQ ID NO: 9264899 - DNA, 22 bp, Homo sapiens
tatcagtagaacaatggacatt

SEQ ID NO: 9264900 - DNA, 22 bp, Homo sapiens
tatcagtagataaacggattgc

SEQ ID NO: 9264901 - DNA, 22 bp, Homo sapiens
tatcataagttaattaaacagt

SEQ ID NO: 9264902 - DNA, 22 bp, Homo sapiens
tatcataagttaattaaacagt

SEQ ID NO: 9264903 - DNA, 22 bp, Homo sapiens
tatcatcactgtaatccgttga

SEQ ID NO: 9264904 - DNA, 22 bp, Homo sapiens
tatcataagttaattaaacagt

SEQ ID NO: 9264905 - DNA, 22 bp, Homo sapiens
tatcatcattggcaggtgagaa

SEQ ID NO: 9264906 - DNA, 22 bp, Homo sapiens
tagtgattcgatgtgggtaagt

SEQ ID NO: 9264907 - DNA, 22 bp, Homo sapiens
tagtgattctgatgtaagacaa

SEQ ID NO: 9264908 - DNA, 22 bp, Homo sapiens
tagtgattaaaggcagaatgtt

SEQ ID NO: 9264909 - DNA, 22 bp, Homo sapiens
tagtgattataaaacagttttt

SEQ ID NO: 9264910 - DNA, 22 bp, Homo sapiens
tagtgattccctatcaaccctg

SEQ ID NO: 9264911 - DNA, 22 bp, Homo sapiens
tagtgaaagtcaaagacagcta

SEQ ID NO: 9264912 - DNA, 22 bp, Homo sapiens
tagtgaaacctgacagatcatg

SEQ ID NO: 9264913 - DNA, 19 bp, Homo sapiens
tagtctttattcttaattt

SEQ ID NO: 9264914 - DNA, 22 bp, Homo sapiens
tagtcttttgagaagtatatct

SEQ ID NO: 9264915 - DNA, 22 bp, Homo sapiens
tagtgaaacctgacagatcatg

SEQ ID NO: 9264916 - DNA, 22 bp, Homo sapiens
tagtgaaacctgacagatcatg

SEQ ID NO: 9264917 - DNA, 22 bp, Homo sapiens
tagtctttttaataaataatgc

SEQ ID NO: 9264918 - DNA, 22 bp, Homo sapiens
tagtctttttaataaataatgc

SEQ ID NO: 9264919 - DNA, 22 bp, Homo sapiens
caggggagttttatgcaacaga

SEQ ID NO: 9264920 - DNA, 22 bp, Homo sapiens
tagtcttcctggaagaagtgtt

SEQ ID NO: 9264921 - DNA, 22 bp, Homo sapiens
cagggcacttaaattgcctcgt

SEQ ID NO: 9264922 - DNA, 20 bp, Homo sapiens
cagggcacactgcagcctcg

SEQ ID NO: 9264923 - DNA, 22 bp, Homo sapiens
cagggcacagttatggaggtgg

SEQ ID NO: 9264924 - DNA, 22 bp, Homo sapiens
cagggcaaagagagcacatgct

SEQ ID NO: 9264925 - DNA, 22 bp, Homo sapiens
cagggcaaagtcttctagaacc

SEQ ID NO: 9264926 - DNA, 21 bp, Homo sapiens
cagggcacacagaggatggta

SEQ ID NO: 9264927 - DNA, 22 bp, Homo sapiens
cagggatggcgctggctgcccg

SEQ ID NO: 9264928 - DNA, 22 bp, Homo sapiens
tagataatttggcatcatattg

SEQ ID NO: 9264929 - DNA, 22 bp, Homo sapiens
tagcaagtgttggtgaagatgt

SEQ ID NO: 9264930 - DNA, 22 bp, Homo sapiens
tagcattatctgtcttatcatt

SEQ ID NO: 9264931 - DNA, 22 bp, Homo sapiens
tagcattagtcagatatgtttt

SEQ ID NO: 9264932 - DNA, 22 bp, Homo sapiens
tagcaatgtgtgtgtataaatt

SEQ ID NO: 9264933 - DNA, 22 bp, Homo sapiens
tagcaatgtaagatgttaacac

SEQ ID NO: 9264934 - DNA, 22 bp, Homo sapiens
tagcaatgcttcattatttaaa

SEQ ID NO: 9264935 - DNA, 22 bp, Homo sapiens
tagcaatgtgtgtgtataaatt

SEQ ID NO: 9264936 - DNA, 22 bp, Homo sapiens
tagcaatgtaagatgttaacac

SEQ ID NO: 9264937 - DNA, 22 bp, Homo sapiens
tagcaatgcttcattatttaaa

SEQ ID NO: 9264938 - DNA, 20 bp, Homo sapiens
tagcaatgagtgttccattt

SEQ ID NO: 9264939 - DNA, 22 bp, Homo sapiens
tagcaatatgctaccttaaatg

SEQ ID NO: 9264940 - DNA, 22 bp, Homo sapiens
tagcaatgctctatgatgaaaa

SEQ ID NO: 9264941 - DNA, 22 bp, Homo sapiens
tagcaatgctctatgatgaaaa

SEQ ID NO: 9264942 - DNA, 20 bp, Homo sapiens
tagcaatgagtgttccattt

SEQ ID NO: 9264943 - DNA, 20 bp, Homo sapiens
tagcattccagaaaactcag

SEQ ID NO: 9264944 - DNA, 22 bp, Homo sapiens
tagcattatttcctctttttgt

SEQ ID NO: 9264945 - DNA, 22 bp, Homo sapiens
tagcattccatcactcagcacc

SEQ ID NO: 9264946 - DNA, 22 bp, Homo sapiens
tagcattccatcactcagcacc

SEQ ID NO: 9264947 - DNA, 22 bp, Homo sapiens
tagctaatggtgaagattcaga

SEQ ID NO: 9264948 - DNA, 22 bp, Homo sapiens
tagctacacatctaaacagcaa

SEQ ID NO: 9264949 - DNA, 22 bp, Homo sapiens
caggctggtcccagagcattgc

SEQ ID NO: 9264950 - DNA, 22 bp, Homo sapiens
tagacattttccctaccctcat

SEQ ID NO: 9264951 - DNA, 22 bp, Homo sapiens
tagacattttctcaacatctct

SEQ ID NO: 9264952 - DNA, 22 bp, Homo sapiens
caggctggtcccagagcattgc

SEQ ID NO: 9264953 - DNA, 22 bp, Homo sapiens
caggctggtcccagagcattgc

SEQ ID NO: 9264954 - DNA, 22 bp, Homo sapiens
caggctgggctccggagataaa

SEQ ID NO: 9264955 - DNA, 22 bp, Homo sapiens
caggctgggctggtgttagagt

SEQ ID NO: 9264956 - DNA, 22 bp, Homo sapiens
caggctgggctggtgttagagt

SEQ ID NO: 9264957 - DNA, 22 bp, Homo sapiens
caggctgggcagcctccccggc

SEQ ID NO: 9264958 - DNA, 21 bp, Homo sapiens
tagaatcactaataagatgta

SEQ ID NO: 9264959 - DNA, 21 bp, Homo sapiens
tagaatcactaataagatgta

SEQ ID NO: 9264960 - DNA, 22 bp, Homo sapiens
caggctgggcagcctccccggc

SEQ ID NO: 9264961 - DNA, 22 bp, Homo sapiens
caggctgggctccggagataaa

SEQ ID NO: 9264962 - DNA, 22 bp, Homo sapiens
tagaatatgtggtgtatacttt

SEQ ID NO: 9264963 - DNA, 22 bp, Homo sapiens
tagaatatgtggtaggatctgg

SEQ ID NO: 9264964 - DNA, 22 bp, Homo sapiens
tagaatatgtggtgtatacttt

SEQ ID NO: 9264965 - DNA, 22 bp, Homo sapiens
tagagcttagtatcctgttaag

SEQ ID NO: 9264966 - DNA, 22 bp, Homo sapiens
tagagtgttttgttaggcagca

SEQ ID NO: 9264967 - DNA, 21 bp, Homo sapiens
tagagtgtctgtgtgggaatt

SEQ ID NO: 9264968 - DNA, 22 bp, Homo sapiens
tagataaattagaaagtttact

SEQ ID NO: 9264969 - DNA, 22 bp, Homo sapiens
tagagctggaatttgcagcaag

SEQ ID NO: 9264970 - DNA, 22 bp, Homo sapiens
tagagctggaatttgcagcaag

SEQ ID NO: 9264971 - DNA, 22 bp, Homo sapiens
tagagctggaatttgcagcaag

SEQ ID NO: 9264972 - DNA, 22 bp, Homo sapiens
tagagctgggcagtgctctgag

SEQ ID NO: 9264973 - DNA, 22 bp, Homo sapiens
tagagctggccgggacagctgg

SEQ ID NO: 9264974 - DNA, 19 bp, Homo sapiens
tagagctgcttcctggcag

SEQ ID NO: 9264975 - DNA, 22 bp, Homo sapiens
tagagctggaaaactgcaggta

SEQ ID NO: 9264976 - DNA, 22 bp, Homo sapiens
tagagctggaaaactgcaggta

SEQ ID NO: 9264977 - DNA, 22 bp, Homo sapiens
tagagctggaaaactgcaggta

SEQ ID NO: 9264978 - DNA, 19 bp, Homo sapiens
tagagcttgttttaggaag

SEQ ID NO: 9264979 - DNA, 22 bp, Homo sapiens
tagagcttggggatttagtagt

SEQ ID NO: 9264980 - DNA, 22 bp, Homo sapiens
tagagcttggggatttagtagt

SEQ ID NO: 9264981 - DNA, 23 bp, Homo sapiens
tagagcttcagcgaatgtgctca

SEQ ID NO: 9264982 - DNA, 23 bp, Homo sapiens
tagagcttcagcgaatgtgctca

SEQ ID NO: 9264983 - DNA, 22 bp, Homo sapiens
tagagcttggactgcattttcg

SEQ ID NO: 9264984 - DNA, 22 bp, Homo sapiens
tagagctgggcagtgctctgag

SEQ ID NO: 9264985 - DNA, 17 bp, Homo sapiens
tagagctggttcaggag

SEQ ID NO: 9264986 - DNA, 22 bp, Homo sapiens
tagagctgggcagtgctctgag

SEQ ID NO: 9264987 - DNA, 22 bp, Homo sapiens
tagagctgtatcaaagagcctt

SEQ ID NO: 9264988 - DNA, 22 bp, Homo sapiens
caggctggagtgagtgtagtgg

SEQ ID NO: 9264989 - DNA, 22 bp, Homo sapiens
caggctggagtacaattgtgtg

SEQ ID NO: 9264990 - DNA, 22 bp, Homo sapiens
caggctggagtgagtgtagtgg

SEQ ID NO: 9264991 - DNA, 22 bp, Homo sapiens
caggctggagtgagtgtagtgg

SEQ ID NO: 9264992 - DNA, 22 bp, Homo sapiens
tactgtgacagagtacttaaac

SEQ ID NO: 9264993 - DNA, 22 bp, Homo sapiens
tactgtgaatacaaaataaatt

SEQ ID NO: 9264994 - DNA, 22 bp, Homo sapiens
caggctgccgtggggtccaggc

SEQ ID NO: 9264995 - DNA, 22 bp, Homo sapiens
tactgtgaatacaaaataaatt

SEQ ID NO: 9264996 - DNA, 22 bp, Homo sapiens
tactgtctgggttcccaagcaa

SEQ ID NO: 9264997 - DNA, 22 bp, Homo sapiens
caggctggagtgcaatggtgct

SEQ ID NO: 9264998 - DNA, 22 bp, Homo sapiens
caggctggagtgcagtggcgcc

SEQ ID NO: 9264999 - DNA, 22 bp, Homo sapiens
caggctggagtgcaatggtgct

SEQ ID NO: 9265000 - DNA, 22 bp, Homo sapiens
caggctggagtgcaatggcaca

SEQ ID NO: 9265001 - DNA, 22 bp, Homo sapiens
caggctggagtgcaatggcaca

SEQ ID NO: 9265002 - DNA, 22 bp, Homo sapiens
caggctggagtgagtgtagtgg

SEQ ID NO: 9265003 - DNA, 22 bp, Homo sapiens
caggctggagtgcaatgacgcc

SEQ ID NO: 9265004 - DNA, 22 bp, Homo sapiens
caggctggagtgcaatgacgcc

SEQ ID NO: 9265005 - DNA, 22 bp, Homo sapiens
caggctggagtgcagtggcgcc

SEQ ID NO: 9265006 - DNA, 22 bp, Homo sapiens
caggctggagtgcagtggcgcc

SEQ ID NO: 9265007 - DNA, 22 bp, Homo sapiens
caggctggagtgcagtggcgct

SEQ ID NO: 9265008 - DNA, 22 bp, Homo sapiens
caggctggagtgcagtggcgct

SEQ ID NO: 9265009 - DNA, 22 bp, Homo sapiens
caggctggagtgcagtggggcg

SEQ ID NO: 9265010 - DNA, 22 bp, Homo sapiens
caggctggagtgcagtggggcg

SEQ ID NO: 9265011 - DNA, 22 bp, Homo sapiens
caggctggagtgcagtggggcg

SEQ ID NO: 9265012 - DNA, 22 bp, Homo sapiens
caggctggagtgcagtggcgct

SEQ ID NO: 9265013 - DNA, 22 bp, Homo sapiens
tagaatactagtgaagtcatcg

SEQ ID NO: 9265014 - DNA, 22 bp, Homo sapiens
tagaatagtgttttcattatgg

SEQ ID NO: 9265015 - DNA, 22 bp, Homo sapiens
tagaatatacactacagcttaa

SEQ ID NO: 9265016 - DNA, 22 bp, Homo sapiens
caggctggagtgcagtggtgcc

SEQ ID NO: 9265017 - DNA, 22 bp, Homo sapiens
caggctggagtgcagtggtgcc

SEQ ID NO: 9265018 - DNA, 22 bp, Homo sapiens
gtgaggggagtaaagccatgtt

SEQ ID NO: 9265019 - DNA, 17 bp, Homo sapiens
gtgagggcagaggatgg

SEQ ID NO: 9265020 - DNA, 22 bp, Homo sapiens
gtgaggggtggctgagcagttt

SEQ ID NO: 9265021 - DNA, 22 bp, Homo sapiens
gtgaggggtggctgagcagttt

SEQ ID NO: 9265022 - DNA, 22 bp, Homo sapiens
gtgaggggtggctgagcagttt

SEQ ID NO: 9265023 - DNA, 22 bp, Homo sapiens
gtgaggggccaagagtagggca

SEQ ID NO: 9265024 - DNA, 22 bp, Homo sapiens
gtgaggggccaagagtagggca

SEQ ID NO: 9265025 - DNA, 22 bp, Homo sapiens
tactattgaatcattgtcaatc

SEQ ID NO: 9265026 - DNA, 22 bp, Homo sapiens
tactatgttcttcctaaatagt

SEQ ID NO: 9265027 - DNA, 22 bp, Homo sapiens
tacctgaaccaagcccagctct

SEQ ID NO: 9265028 - DNA, 22 bp, Homo sapiens
tacctctctaaacccagggaca

SEQ ID NO: 9265029 - DNA, 22 bp, Homo sapiens
tacctgaagtaacaatgaatat

SEQ ID NO: 9265030 - DNA, 22 bp, Homo sapiens
tactatgtgaaaatactatagt

SEQ ID NO: 9265031 - DNA, 22 bp, Homo sapiens
tactcaaactcactaagacaga

SEQ ID NO: 9265032 - DNA, 22 bp, Homo sapiens
tactcacattctgtttcttgct

SEQ ID NO: 9265033 - DNA, 22 bp, Homo sapiens
tactgtctggagttgccaaagg

SEQ ID NO: 9265034 - DNA, 22 bp, Homo sapiens
tactgtctctgccctggccagg

SEQ ID NO: 9265035 - DNA, 22 bp, Homo sapiens
tactgtcattagcattaacttt

SEQ ID NO: 9265036 - DNA, 22 bp, Homo sapiens
tactgtatttgataagtgaagt

SEQ ID NO: 9265037 - DNA, 22 bp, Homo sapiens
tactgtatgatttcatgtatat

SEQ ID NO: 9265038 - DNA, 22 bp, Homo sapiens
tactgtatgaattatgttattt

SEQ ID NO: 9265039 - DNA, 22 bp, Homo sapiens
tcagcttttgtcagaaattgta

SEQ ID NO: 9265040 - DNA, 22 bp, Homo sapiens
tcagcttttgtcagaaattgta

SEQ ID NO: 9265041 - DNA, 22 bp, Homo sapiens
tcagctttttacatgtgaaata

SEQ ID NO: 9265042 - DNA, 22 bp, Homo sapiens
tcaggaaagaagatgctcagtg

SEQ ID NO: 9265043 - DNA, 22 bp, Homo sapiens
tcaggaaagagtaatgtataca

SEQ ID NO: 9265044 - DNA, 22 bp, Homo sapiens
cataaaatggcttgttctttaa

SEQ ID NO: 9265045 - DNA, 19 bp, Homo sapiens
cataaatgtacaagataca

SEQ ID NO: 9265046 - DNA, 19 bp, Homo sapiens
cataaatgtacaagataca

SEQ ID NO: 9265047 - DNA, 19 bp, Homo sapiens
cataaatgtacaagataca

SEQ ID NO: 9265048 - DNA, 22 bp, Homo sapiens
cataaaatggcttgttctttaa

SEQ ID NO: 9265049 - DNA, 22 bp, Homo sapiens
cataaagtagcagagcatgact

SEQ ID NO: 9265050 - DNA, 22 bp, Homo sapiens
cagtttatagctctagcagctt

SEQ ID NO: 9265051 - DNA, 22 bp, Homo sapiens
cagtttatatataagcacattg

SEQ ID NO: 9265052 - DNA, 22 bp, Homo sapiens
cagtttatatataagcacattg

SEQ ID NO: 9265053 - DNA, 22 bp, Homo sapiens
cagtttatagttgttatgtgtg

SEQ ID NO: 9265054 - DNA, 22 bp, Homo sapiens
tcagcttttaaaaacaagaagt

SEQ ID NO: 9265055 - DNA, 22 bp, Homo sapiens
tcagctttgcaagttagaaaat

SEQ ID NO: 9265056 - DNA, 22 bp, Homo sapiens
tcagctttgcaagttagaaaat

SEQ ID NO: 9265057 - DNA, 22 bp, Homo sapiens
tcagctgccccagtggccccag

SEQ ID NO: 9265058 - DNA, 22 bp, Homo sapiens
tcagctgcataagtcaccttgc

SEQ ID NO: 9265059 - DNA, 22 bp, Homo sapiens
tcagcagaggggaaggcatctg

SEQ ID NO: 9265060 - DNA, 22 bp, Homo sapiens
tcagcagaggggaaggcatctg

SEQ ID NO: 9265061 - DNA, 22 bp, Homo sapiens
tcagcagactaggcagattact

SEQ ID NO: 9265062 - DNA, 22 bp, Homo sapiens
cagttacattaataatgcacat

SEQ ID NO: 9265063 - DNA, 22 bp, Homo sapiens
cagttacatgctcatgtcatca

SEQ ID NO: 9265064 - DNA, 22 bp, Homo sapiens
tcagcagaagtatagaggccat

SEQ ID NO: 9265065 - DNA, 22 bp, Homo sapiens
tcagatgccctttgttttagac

SEQ ID NO: 9265066 - DNA, 22 bp, Homo sapiens
tcagatgccaactgaacaacag

SEQ ID NO: 9265067 - DNA, 21 bp, Homo sapiens
cagttacagccaggacaaggc

SEQ ID NO: 9265068 - DNA, 19 bp, Homo sapiens
cagttacaggcactgtggg

SEQ ID NO: 9265069 - DNA, 22 bp, Homo sapiens
cagttacagctgcaccagagcc

SEQ ID NO: 9265070 - DNA, 22 bp, Homo sapiens
cagttacatatttagtaggtta

SEQ ID NO: 9265071 - DNA, 22 bp, Homo sapiens
cagttacataaatgataaaatg

SEQ ID NO: 9265072 - DNA, 19 bp, Homo sapiens
cagttacagcagctaagac

SEQ ID NO: 9265073 - DNA, 22 bp, Homo sapiens
cagttacagagccagttagaga

SEQ ID NO: 9265074 - DNA, 18 bp, Homo sapiens
cagttacaccttcattca

SEQ ID NO: 9265075 - DNA, 21 bp, Homo sapiens
cagttacacaagtgttaccag

SEQ ID NO: 9265076 - DNA, 22 bp, Homo sapiens
cagttacacaccattgtgaaca

SEQ ID NO: 9265077 - DNA, 22 bp, Homo sapiens
cagttaaacgggccatgtgagt

SEQ ID NO: 9265078 - DNA, 22 bp, Homo sapiens
cagttaatgtcctatacaatag

SEQ ID NO: 9265079 - DNA, 22 bp, Homo sapiens
cagttaatcttgccattatatc

SEQ ID NO: 9265080 - DNA, 22 bp, Homo sapiens
cagttaaattctccagttacca

SEQ ID NO: 9265081 - DNA, 22 bp, Homo sapiens
cagtgtctccagatgctccaat

SEQ ID NO: 9265082 - DNA, 18 bp, Homo sapiens
cagtgtcttggtaaaata

SEQ ID NO: 9265083 - DNA, 22 bp, Homo sapiens
cagtgtcttatttgtagctcag

SEQ ID NO: 9265084 - DNA, 22 bp, Homo sapiens
cagtgtctgggacagaaagtca

SEQ ID NO: 9265085 - DNA, 22 bp, Homo sapiens
cagtgtttagcacagtgcttgg

SEQ ID NO: 9265086 - DNA, 22 bp, Homo sapiens
cagtgtgaggaattagtgtcca

SEQ ID NO: 9265087 - DNA, 22 bp, Homo sapiens
cagtgtgcctgaatcaagtgtt

SEQ ID NO: 9265088 - DNA, 23 bp, Homo sapiens
cagtgtgacgaggtgaggcaggc

SEQ ID NO: 9265089 - DNA, 23 bp, Homo sapiens
cagtgtgacgaggtgaggcaggc

SEQ ID NO: 9265090 - DNA, 22 bp, Homo sapiens
cagtgtgacttctgagctgcca

SEQ ID NO: 9265091 - DNA, 22 bp, Homo sapiens
cagtgtttgtggaattcaggtg

SEQ ID NO: 9265092 - DNA, 22 bp, Homo sapiens
cagtgccacaggaatggccaat

SEQ ID NO: 9265093 - DNA, 22 bp, Homo sapiens
cagtgccagaggtactagtgga

SEQ ID NO: 9265094 - DNA, 22 bp, Homo sapiens
cagtgccagaggtactagtgga

SEQ ID NO: 9265095 - DNA, 21 bp, Homo sapiens
cagtgccagccacaggacgcc

SEQ ID NO: 9265096 - DNA, 22 bp, Homo sapiens
cagtgccatgatgcagagcaat

SEQ ID NO: 9265097 - DNA, 22 bp, Homo sapiens
cagtgccatgtctgagccccta

SEQ ID NO: 9265098 - DNA, 22 bp, Homo sapiens
cagtgcccaagatgtgccatgc

SEQ ID NO: 9265099 - DNA, 22 bp, Homo sapiens
cagtgccatattgaaagacatt

SEQ ID NO: 9265100 - DNA, 22 bp, Homo sapiens
cagtggctgtgaccagggacct

SEQ ID NO: 9265101 - DNA, 22 bp, Homo sapiens
cagtggctggttagggacagga

SEQ ID NO: 9265102 - DNA, 22 bp, Homo sapiens
cagtggcttctcatgtcattca

SEQ ID NO: 9265103 - DNA, 22 bp, Homo sapiens
cagtggcttcttcctagagcca

SEQ ID NO: 9265104 - DNA, 22 bp, Homo sapiens
cagtggcttctcatgtcattca

SEQ ID NO: 9265105 - DNA, 22 bp, Homo sapiens
cagtgggatatgggggcagcat

SEQ ID NO: 9265106 - DNA, 22 bp, Homo sapiens
cagtgggctgtgatggattcac

SEQ ID NO: 9265107 - DNA, 22 bp, Homo sapiens
cagtgggatatgggggcagcat

SEQ ID NO: 9265108 - DNA, 22 bp, Homo sapiens
cagtgggattgggattggaacc

SEQ ID NO: 9265109 - DNA, 22 bp, Homo sapiens
cagtgggaatgaagtggaggcc

SEQ ID NO: 9265110 - DNA, 22 bp, Homo sapiens
cagtgggaagggcagaggcttt

SEQ ID NO: 9265111 - DNA, 22 bp, Homo sapiens
cagtgggtagtggggattagca

SEQ ID NO: 9265112 - DNA, 22 bp, Homo sapiens
cagtgggtcctaagtacagttc

SEQ ID NO: 9265113 - DNA, 22 bp, Homo sapiens
cagtgggtaggaaaggctcttc

SEQ ID NO: 9265114 - DNA, 22 bp, Homo sapiens
cagtgggggtgaggccgaggta

SEQ ID NO: 9265115 - DNA, 22 bp, Homo sapiens
cagtgggggtgaggccgaggta

SEQ ID NO: 9265116 - DNA, 23 bp, Homo sapiens
cagtgggcttctaactgctcctg

SEQ ID NO: 9265117 - DNA, 23 bp, Homo sapiens
cagtgggcttctaactgctcctg

SEQ ID NO: 9265118 - DNA, 22 bp, Homo sapiens
cagtggggaggccaggatagaa

SEQ ID NO: 9265119 - DNA, 20 bp, Homo sapiens
cagtcccaatccagggccag

SEQ ID NO: 9265120 - DNA, 20 bp, Homo sapiens
cagtcccaatccagggccag

SEQ ID NO: 9265121 - DNA, 20 bp, Homo sapiens
cagtcccaatccagggccag

SEQ ID NO: 9265122 - DNA, 22 bp, Homo sapiens
cagtcccacaagatctccacaa

SEQ ID NO: 9265123 - DNA, 22 bp, Homo sapiens
cagtcccactagtgccaatacc

SEQ ID NO: 9265124 - DNA, 22 bp, Homo sapiens
cagtcccaccaggatcgctctt

SEQ ID NO: 9265125 - DNA, 18 bp, Homo sapiens
cagtcccaaaccttagga

SEQ ID NO: 9265126 - DNA, 18 bp, Homo sapiens
cagtcccaaaccttagga

SEQ ID NO: 9265127 - DNA, 19 bp, Homo sapiens
cagtcccaaattcttgtca

SEQ ID NO: 9265128 - DNA, 22 bp, Homo sapiens
cagtcccaaggaggaagcagtc

SEQ ID NO: 9265129 - DNA, 22 bp, Homo sapiens
cagtcccaaggaggaagcagtc

SEQ ID NO: 9265130 - DNA, 22 bp, Homo sapiens
tatttctttcaggtatgtgttg

SEQ ID NO: 9265131 - DNA, 22 bp, Homo sapiens
tatttcttgttccctccaagtt

SEQ ID NO: 9265132 - DNA, 22 bp, Homo sapiens
tatttctttcaggtatgtgttg

SEQ ID NO: 9265133 - DNA, 21 bp, Homo sapiens
tatttctttgactctctccct

SEQ ID NO: 9265134 - DNA, 21 bp, Homo sapiens
tatttctttgactctctccct

SEQ ID NO: 9265135 - DNA, 22 bp, Homo sapiens
cagtcccagacccagaaggtgg

SEQ ID NO: 9265136 - DNA, 22 bp, Homo sapiens
cagtcccagaagagcctgggag

SEQ ID NO: 9265137 - DNA, 22 bp, Homo sapiens
cagtcccagacatagtaaggga

SEQ ID NO: 9265138 - DNA, 22 bp, Homo sapiens
cagtcccagacatagtaaggga

SEQ ID NO: 9265139 - DNA, 22 bp, Homo sapiens
cagtagtggtctatcactggag

SEQ ID NO: 9265140 - DNA, 22 bp, Homo sapiens
cagtagtctttttcctcctaga

SEQ ID NO: 9265141 - DNA, 22 bp, Homo sapiens
cagtaggaaggatgcagaaaaa

SEQ ID NO: 9265142 - DNA, 22 bp, Homo sapiens
tatttccaagctgaatccaatg

SEQ ID NO: 9265143 - DNA, 22 bp, Homo sapiens
tatttccaccctcagtaaggaa

SEQ ID NO: 9265144 - DNA, 21 bp, Homo sapiens
tatttccaaccctttatcctt

SEQ ID NO: 9265145 - DNA, 22 bp, Homo sapiens
tatttccaaaagcctattatga

SEQ ID NO: 9265146 - DNA, 22 bp, Homo sapiens
cagtagcatgcttatcttttga

SEQ ID NO: 9265147 - DNA, 22 bp, Homo sapiens
cagtagcatgtaataaagacag

SEQ ID NO: 9265148 - DNA, 22 bp, Homo sapiens
tatttccacctattattttctg

SEQ ID NO: 9265149 - DNA, 22 bp, Homo sapiens
caggttcccaggtccagggctt

SEQ ID NO: 9265150 - DNA, 22 bp, Homo sapiens
caggttccagttgcagggactt

SEQ ID NO: 9265151 - DNA, 22 bp, Homo sapiens
caggttcagcaggaggcatccc

SEQ ID NO: 9265152 - DNA, 22 bp, Homo sapiens
cagggtggccctgtggtctcat

SEQ ID NO: 9265153 - DNA, 22 bp, Homo sapiens
cagggtggccctgtggtctcat

SEQ ID NO: 9265154 - DNA, 22 bp, Homo sapiens
cagggtggccctgtggtctcat

SEQ ID NO: 9265155 - DNA, 22 bp, Homo sapiens
cagggtgggcacccagcctcca

SEQ ID NO: 9265156 - DNA, 22 bp, Homo sapiens
cagggtggggaaatagcgccct

SEQ ID NO: 9265157 - DNA, 22 bp, Homo sapiens
caggtggtcaggcagatgggct

SEQ ID NO: 9265158 - DNA, 22 bp, Homo sapiens
caggtgtgccgggagcagtttg

SEQ ID NO: 9265159 - DNA, 22 bp, Homo sapiens
caggttctgaggatggtgcctg

SEQ ID NO: 9265160 - DNA, 22 bp, Homo sapiens
caggtttctagttctaagaata

SEQ ID NO: 9265161 - DNA, 22 bp, Homo sapiens
caggttggggacttaggatgac

SEQ ID NO: 9265162 - DNA, 22 bp, Homo sapiens
caggttgaaagtggaggagcta

SEQ ID NO: 9265163 - DNA, 21 bp, Homo sapiens
tatttagttttacaaatgtgg

SEQ ID NO: 9265164 - DNA, 22 bp, Homo sapiens
caggtttcattggcagcttcat

SEQ ID NO: 9265165 - DNA, 21 bp, Homo sapiens
tatttagttttacaaatgtgg

SEQ ID NO: 9265166 - DNA, 22 bp, Homo sapiens
tatttcattctttatcaggagc

SEQ ID NO: 9265167 - DNA, 22 bp, Homo sapiens
tatttcattctttatcaggagc

SEQ ID NO: 9265168 - DNA, 22 bp, Homo sapiens
tatttcattctttatcaggagc

SEQ ID NO: 9265169 - DNA, 22 bp, Homo sapiens
tatttcatgtgcaccataattc

SEQ ID NO: 9265170 - DNA, 22 bp, Homo sapiens
tcacacttagagcgaattgttt

SEQ ID NO: 9265171 - DNA, 22 bp, Homo sapiens
cagtgaggaagctgtctggacc

SEQ ID NO: 9265172 - DNA, 22 bp, Homo sapiens
cagtgagctcctgtctgtccct

SEQ ID NO: 9265173 - DNA, 22 bp, Homo sapiens
tcacagactcttgattgtctaa

SEQ ID NO: 9265174 - DNA, 22 bp, Homo sapiens
cagtgacacccagtctggccca

SEQ ID NO: 9265175 - DNA, 22 bp, Homo sapiens
cagtgaagtttaaagtgtagat

SEQ ID NO: 9265176 - DNA, 19 bp, Homo sapiens
tcacaagagagataaagtg

SEQ ID NO: 9265177 - DNA, 22 bp, Homo sapiens
tcacaagactgagcttgcttga

SEQ ID NO: 9265178 - DNA, 22 bp, Homo sapiens
tcacaagacagaaaacatttag

SEQ ID NO: 9265179 - DNA, 22 bp, Homo sapiens
tcacaagacagaaaacatttag

SEQ ID NO: 9265180 - DNA, 22 bp, Homo sapiens
tcacaagacaagacaaattgca

SEQ ID NO: 9265181 - DNA, 22 bp, Homo sapiens
tcacaaatattttaacagtagg

SEQ ID NO: 9265182 - DNA, 22 bp, Homo sapiens
tcaatgactggtccaaggtggc

SEQ ID NO: 9265183 - DNA, 22 bp, Homo sapiens
tatttgaaagtgtacaaaaact

SEQ ID NO: 9265184 - DNA, 22 bp, Homo sapiens
tatttgaaagtgtacaaaaact

SEQ ID NO: 9265185 - DNA, 22 bp, Homo sapiens
tatttgaaagtgtacaaaaact

SEQ ID NO: 9265186 - DNA, 22 bp, Homo sapiens
tatttcttttcgtgacttattg

SEQ ID NO: 9265187 - DNA, 22 bp, Homo sapiens
tatttcttttcgtgacttattg

SEQ ID NO: 9265188 - DNA, 22 bp, Homo sapiens
tatttcttttcgtgacttattg

SEQ ID NO: 9265189 - DNA, 22 bp, Homo sapiens
tcacaaatgaggaaatcgagca

SEQ ID NO: 9265190 - DNA, 22 bp, Homo sapiens
tcacaaatttcagctccctgaa

SEQ ID NO: 9265191 - DNA, 22 bp, Homo sapiens
tcacaagacaagacaaattgca

SEQ ID NO: 9265192 - DNA, 22 bp, Homo sapiens
tcacaggaggaacctggcctgg

SEQ ID NO: 9265193 - DNA, 22 bp, Homo sapiens
tcacaggaccctgagggtggcg

SEQ ID NO: 9265194 - DNA, 22 bp, Homo sapiens
tcacaggaagggtaaatattta

SEQ ID NO: 9265195 - DNA, 22 bp, Homo sapiens
tcacaggacagccttccacccg

SEQ ID NO: 9265196 - DNA, 22 bp, Homo sapiens
tcacagagaactataatccatc

SEQ ID NO: 9265197 - DNA, 22 bp, Homo sapiens
tcacagagaaatgtggcacaaa

SEQ ID NO: 9265198 - DNA, 22 bp, Homo sapiens
tcacagctgttttgtccattaa

SEQ ID NO: 9265199 - DNA, 22 bp, Homo sapiens
tcacagagaaaagctatcacaa

SEQ ID NO: 9265200 - DNA, 22 bp, Homo sapiens
tcacagttcaactagttcagat

SEQ ID NO: 9265201 - DNA, 22 bp, Homo sapiens
cagtgccaagccacagatcact

SEQ ID NO: 9265202 - DNA, 22 bp, Homo sapiens
tcacagttgattgaaacacagc

SEQ ID NO: 9265203 - DNA, 22 bp, Homo sapiens
tcacagtttccataggtcagca

SEQ ID NO: 9265204 - DNA, 22 bp, Homo sapiens
tcacaggagggagagacaccca

SEQ ID NO: 9265205 - DNA, 22 bp, Homo sapiens
tcacagttactccttcagatga

SEQ ID NO: 9265206 - DNA, 22 bp, Homo sapiens
tcacagttaattgttggaatgt

SEQ ID NO: 9265207 - DNA, 22 bp, Homo sapiens
tcacagtgtggcaactcacaga

SEQ ID NO: 9265208 - DNA, 22 bp, Homo sapiens
tcacagtgttggaatcagagct

SEQ ID NO: 9265209 - DNA, 22 bp, Homo sapiens
tgggtcagattgagcccctggt

SEQ ID NO: 9265210 - DNA, 22 bp, Homo sapiens
cctgcctggggacaaaggaggg

SEQ ID NO: 9265211 - DNA, 22 bp, Homo sapiens
cctgcctggtgtaagtctaagg

SEQ ID NO: 9265212 - DNA, 22 bp, Homo sapiens
cctgcctgggctcacttgccag

SEQ ID NO: 9265213 - DNA, 22 bp, Homo sapiens
cctgcctgggctcacttgccag

SEQ ID NO: 9265214 - DNA, 20 bp, Homo sapiens
cctgcctgcctcggctcatt

SEQ ID NO: 9265215 - DNA, 22 bp, Homo sapiens
cctgcctgtaagatgggtacaa

SEQ ID NO: 9265216 - DNA, 22 bp, Homo sapiens
cctgcctgtaagatgggtacaa

SEQ ID NO: 9265217 - DNA, 22 bp, Homo sapiens
cctgcctgtactagagacccag

SEQ ID NO: 9265218 - DNA, 22 bp, Homo sapiens
cctgcctgtaagatgggtacaa

SEQ ID NO: 9265219 - DNA, 22 bp, Homo sapiens
cctgcctgtcatcgcctgcgcc

SEQ ID NO: 9265220 - DNA, 20 bp, Homo sapiens
cctgcctgtgtttgtgatga

SEQ ID NO: 9265221 - DNA, 20 bp, Homo sapiens
cctgcctgtgtttgtgatga

SEQ ID NO: 9265222 - DNA, 22 bp, Homo sapiens
cctgcctgtccctcagtccaca

SEQ ID NO: 9265223 - DNA, 22 bp, Homo sapiens
cctgcctgtccctcagtccaca

SEQ ID NO: 9265224 - DNA, 22 bp, Homo sapiens
cctgccaggctttgggcttctg

SEQ ID NO: 9265225 - DNA, 22 bp, Homo sapiens
cctgccagggccttggaagaaa

SEQ ID NO: 9265226 - DNA, 18 bp, Homo sapiens
cctgccagtctggagcag

SEQ ID NO: 9265227 - DNA, 18 bp, Homo sapiens
cctgccagtctggagcag

SEQ ID NO: 9265228 - DNA, 22 bp, Homo sapiens
cctgccaggctttgggcttctg

SEQ ID NO: 9265229 - DNA, 22 bp, Homo sapiens
cctgccaggctttgggcttctg

SEQ ID NO: 9265230 - DNA, 22 bp, Homo sapiens
cctgccaggctttgggcttctg

SEQ ID NO: 9265231 - DNA, 22 bp, Homo sapiens
cctgccaggcgagtctaggcca

SEQ ID NO: 9265232 - DNA, 22 bp, Homo sapiens
cctgccaggccagtgagcttcc

SEQ ID NO: 9265233 - DNA, 22 bp, Homo sapiens
tgggtaggtgtggcctgaatgt

SEQ ID NO: 9265234 - DNA, 22 bp, Homo sapiens
tgggtaggggacgtggaagaaa

SEQ ID NO: 9265235 - DNA, 22 bp, Homo sapiens
tgggtatatatgttgctacaga

SEQ ID NO: 9265236 - DNA, 22 bp, Homo sapiens
tgggtatacaaataatctcttt

SEQ ID NO: 9265237 - DNA, 22 bp, Homo sapiens
tgggtcagacagccagtgggcc

SEQ ID NO: 9265238 - DNA, 22 bp, Homo sapiens
tggtctggaactcctggcttca

SEQ ID NO: 9265239 - DNA, 22 bp, Homo sapiens
tggtctgggcaaatccttctga

SEQ ID NO: 9265240 - DNA, 22 bp, Homo sapiens
cctgctctaaatctcatggaac

SEQ ID NO: 9265241 - DNA, 22 bp, Homo sapiens
cctgctctaaatctcatggaac

SEQ ID NO: 9265242 - DNA, 22 bp, Homo sapiens
cctgctctaaatctcatggaac

SEQ ID NO: 9265243 - DNA, 22 bp, Homo sapiens
cctgctggacaggggtgttcat

SEQ ID NO: 9265244 - DNA, 22 bp, Homo sapiens
cctgctggacgtggaggagggg

SEQ ID NO: 9265245 - DNA, 22 bp, Homo sapiens
tggtctcttcttccaagatggc

SEQ ID NO: 9265246 - DNA, 22 bp, Homo sapiens
tggtctcttcttccaagatggc

SEQ ID NO: 9265247 - DNA, 22 bp, Homo sapiens
tggtctgatggtcccaccaccg

SEQ ID NO: 9265248 - DNA, 22 bp, Homo sapiens
cctgctggcattcttgctccct

SEQ ID NO: 9265249 - DNA, 22 bp, Homo sapiens
cctgctggccagtggagggctg

SEQ ID NO: 9265250 - DNA, 22 bp, Homo sapiens
cctgctgggcctgagcaatgag

SEQ ID NO: 9265251 - DNA, 22 bp, Homo sapiens
cctgcttcagggatgatggcac

SEQ ID NO: 9265252 - DNA, 22 bp, Homo sapiens
cctgcttcagggatgatggcac

SEQ ID NO: 9265253 - DNA, 22 bp, Homo sapiens
cctgcttaacattgccatgaca

SEQ ID NO: 9265254 - DNA, 20 bp, Homo sapiens
cctgctgtgctttccatgga

SEQ ID NO: 9265255 - DNA, 22 bp, Homo sapiens
tgtaaagaaatagcatttgtag

SEQ ID NO: 9265256 - DNA, 22 bp, Homo sapiens
cctgctttgctggtaccatcag

SEQ ID NO: 9265257 - DNA, 22 bp, Homo sapiens
tgtaagtgctcagctgatggtt

SEQ ID NO: 9265258 - DNA, 21 bp, Homo sapiens
tgtaagtttcatctgaattgg

SEQ ID NO: 9265259 - DNA, 22 bp, Homo sapiens
tgtaagtagtaatggaaggaca

SEQ ID NO: 9265260 - DNA, 22 bp, Homo sapiens
tgtaatgagaaagagagtgaat

SEQ ID NO: 9265261 - DNA, 22 bp, Homo sapiens
tgtaatgatgtacttagaagga

SEQ ID NO: 9265262 - DNA, 22 bp, Homo sapiens
tgtaatgagtcacttaccttaa

SEQ ID NO: 9265263 - DNA, 23 bp, Homo sapiens
tgtacagttgtttgactcagctc

SEQ ID NO: 9265264 - DNA, 18 bp, Homo sapiens
tgtacagttatgagcatt

SEQ ID NO: 9265265 - DNA, 18 bp, Homo sapiens
tgtacagttatgagcatt

SEQ ID NO: 9265266 - DNA, 23 bp, Homo sapiens
tgtacagttgtttgactcagctc

SEQ ID NO: 9265267 - DNA, 22 bp, Homo sapiens
tgtacagtgtagtcatgaggtt

SEQ ID NO: 9265268 - DNA, 22 bp, Homo sapiens
tgtacatacatagatatacaca

SEQ ID NO: 9265269 - DNA, 22 bp, Homo sapiens
tgtacatacatagatatacaca

SEQ ID NO: 9265270 - DNA, 22 bp, Homo sapiens
tgtacatgaataaaagatcttg

SEQ ID NO: 9265271 - DNA, 19 bp, Homo sapiens
tgtacatatagagctcagt

SEQ ID NO: 9265272 - DNA, 22 bp, Homo sapiens
cctggagcacatggcaggaggc

SEQ ID NO: 9265273 - DNA, 22 bp, Homo sapiens
tgtacatttagagctcaataga

SEQ ID NO: 9265274 - DNA, 22 bp, Homo sapiens
cctggagcttttccatcctgga

SEQ ID NO: 9265275 - DNA, 18 bp, Homo sapiens
cctggagctccacagcaa

SEQ ID NO: 9265276 - DNA, 22 bp, Homo sapiens
cctggagcttggtcacgctgcg

SEQ ID NO: 9265277 - DNA, 22 bp, Homo sapiens
cctggaggcggaggttgcagtg

SEQ ID NO: 9265278 - DNA, 22 bp, Homo sapiens
cctggaggctctgggagggcag

SEQ ID NO: 9265279 - DNA, 22 bp, Homo sapiens
cctggagggcgccgcacagtcc

SEQ ID NO: 9265280 - DNA, 22 bp, Homo sapiens
cctggagggaccctggccctgt

SEQ ID NO: 9265281 - DNA, 22 bp, Homo sapiens
cctggagggaccctggccctgt

SEQ ID NO: 9265282 - DNA, 22 bp, Homo sapiens
tgtcaagttgttaagttctggg

SEQ ID NO: 9265283 - DNA, 22 bp, Homo sapiens
tgtcaagtgattagccataatg

SEQ ID NO: 9265284 - DNA, 22 bp, Homo sapiens
tgtcaacagatctcaaagctgg

SEQ ID NO: 9265285 - DNA, 22 bp, Homo sapiens
tgtcaacagatactagagagct

SEQ ID NO: 9265286 - DNA, 22 bp, Homo sapiens
tgtcaaccaggtattttggtct

SEQ ID NO: 9265287 - DNA, 22 bp, Homo sapiens
tgtcaaatagtagaaagatggc

SEQ ID NO: 9265288 - DNA, 22 bp, Homo sapiens
tgtattctaaatacatcttacc

SEQ ID NO: 9265289 - DNA, 22 bp, Homo sapiens
tgtattctctcaatatttcata

SEQ ID NO: 9265290 - DNA, 22 bp, Homo sapiens
cctgagggcgccgagctcccag

SEQ ID NO: 9265291 - DNA, 22 bp, Homo sapiens
cctgagggcgccgagctcccag

SEQ ID NO: 9265292 - DNA, 22 bp, Homo sapiens
cctgagggctcagcccccagcc

SEQ ID NO: 9265293 - DNA, 22 bp, Homo sapiens
cctgaggcttaatctgtcccaa

SEQ ID NO: 9265294 - DNA, 22 bp, Homo sapiens
cctgaggcttaatctgtcccaa

SEQ ID NO: 9265295 - DNA, 22 bp, Homo sapiens
cctgaggcttaatctgtcccaa

SEQ ID NO: 9265296 - DNA, 22 bp, Homo sapiens
cctgaggctctcctgaataatg

SEQ ID NO: 9265297 - DNA, 22 bp, Homo sapiens
cctgaggctggcccttccatcc

SEQ ID NO: 9265298 - DNA, 22 bp, Homo sapiens
cctgaggctctcctgaataatg

SEQ ID NO: 9265299 - DNA, 22 bp, Homo sapiens
cctgaggctccacctccagaga

SEQ ID NO: 9265300 - DNA, 22 bp, Homo sapiens
cctgaggctccacctccagaga

SEQ ID NO: 9265301 - DNA, 22 bp, Homo sapiens
cctgaggccctggctgtgctga

SEQ ID NO: 9265302 - DNA, 22 bp, Homo sapiens
cctgaggctccacctccagaga

SEQ ID NO: 9265303 - DNA, 22 bp, Homo sapiens
cctgaggccctggctgtgctga

SEQ ID NO: 9265304 - DNA, 22 bp, Homo sapiens
cctgaggccctggctgtgctga

SEQ ID NO: 9265305 - DNA, 22 bp, Homo sapiens
cctgagacatgaaccaggctcc

SEQ ID NO: 9265306 - DNA, 22 bp, Homo sapiens
cctgagctggcagtgacctgga

SEQ ID NO: 9265307 - DNA, 22 bp, Homo sapiens
cctgagacatgaaccaggctcc

SEQ ID NO: 9265308 - DNA, 22 bp, Homo sapiens
cctgactctggccaggccagct

SEQ ID NO: 9265309 - DNA, 22 bp, Homo sapiens
cctgagaaacctggtgcaatta

SEQ ID NO: 9265310 - DNA, 22 bp, Homo sapiens
cctgacttaagtctcctgttgg

SEQ ID NO: 9265311 - DNA, 22 bp, Homo sapiens
cctgacagtccttttctagtgt

SEQ ID NO: 9265312 - DNA, 22 bp, Homo sapiens
cctgacaggagaagcgcagcat

SEQ ID NO: 9265313 - DNA, 22 bp, Homo sapiens
cctgaccatttgccacatgggt

SEQ ID NO: 9265314 - DNA, 19 bp, Homo sapiens
cctgaccacacaggccttg

SEQ ID NO: 9265315 - DNA, 22 bp, Homo sapiens
cctgaccacccttggacaaggt

SEQ ID NO: 9265316 - DNA, 22 bp, Homo sapiens
cctgaccagagtgagggcttag

SEQ ID NO: 9265317 - DNA, 21 bp, Homo sapiens
cctgagggtggttgtgaagat

SEQ ID NO: 9265318 - DNA, 22 bp, Homo sapiens
cctgaggtcacaacttgcttat

SEQ ID NO: 9265319 - DNA, 22 bp, Homo sapiens
cctgaggtcacaacttgcttat

SEQ ID NO: 9265320 - DNA, 21 bp, Homo sapiens
cctgagggtggttgtgaagat

SEQ ID NO: 9265321 - DNA, 22 bp, Homo sapiens
cctgaggtcagccattcttgcc

SEQ ID NO: 9265322 - DNA, 22 bp, Homo sapiens
cctgaggtcacaacttgcttat

SEQ ID NO: 9265323 - DNA, 22 bp, Homo sapiens
cctgaggtcagccattcttgcc

SEQ ID NO: 9265324 - DNA, 22 bp, Homo sapiens
cctgaggtcagcggttcccaca

SEQ ID NO: 9265325 - DNA, 22 bp, Homo sapiens
cctgaggtcatgcatttccaac

SEQ ID NO: 9265326 - DNA, 22 bp, Homo sapiens
tgggggagagaggcattctttc

SEQ ID NO: 9265327 - DNA, 22 bp, Homo sapiens
tgggggtggttcttgcctccag

SEQ ID NO: 9265328 - DNA, 22 bp, Homo sapiens
tgggggtgtcctggtgcacaca

SEQ ID NO: 9265329 - DNA, 22 bp, Homo sapiens
tggggtaggagtcagcgagaga

SEQ ID NO: 9265330 - DNA, 22 bp, Homo sapiens
tggggtagggaaaagaagtcga

SEQ ID NO: 9265331 - DNA, 22 bp, Homo sapiens
tggggtaggtatgaaaactagg

SEQ ID NO: 9265332 - DNA, 17 bp, Homo sapiens
tggggtccccgatggtg

SEQ ID NO: 9265333 - DNA, 22 bp, Homo sapiens
tgggggtgtcctggtgcacaca

SEQ ID NO: 9265334 - DNA, 22 bp, Homo sapiens
tgggggtgtgccagggacctcc

SEQ ID NO: 9265335 - DNA, 22 bp, Homo sapiens
tggggtaggagtcagcgagaga

SEQ ID NO: 9265336 - DNA, 22 bp, Homo sapiens
cctgcacagccggacccctgct

SEQ ID NO: 9265337 - DNA, 22 bp, Homo sapiens
cctgcaagagcggagaagccag

SEQ ID NO: 9265338 - DNA, 20 bp, Homo sapiens
tggggtcctggaggggatcc

SEQ ID NO: 9265339 - DNA, 20 bp, Homo sapiens
tggggtcctggaggggatcc

SEQ ID NO: 9265340 - DNA, 22 bp, Homo sapiens
tggggtcctctcacttggaggg

SEQ ID NO: 9265341 - DNA, 22 bp, Homo sapiens
cctgccagagcagcttgtcctc

SEQ ID NO: 9265342 - DNA, 22 bp, Homo sapiens
cctgcagaagagtccagctcat

SEQ ID NO: 9265343 - DNA, 22 bp, Homo sapiens
cctgccaggccagtgagcttcc

SEQ ID NO: 9265344 - DNA, 22 bp, Homo sapiens
cctgccaggagctggtgctgca

SEQ ID NO: 9265345 - DNA, 22 bp, Homo sapiens
cctgcactacctggggctgctg

SEQ ID NO: 9265346 - DNA, 22 bp, Homo sapiens
cctgcagaaagggtccccagga

SEQ ID NO: 9265347 - DNA, 22 bp, Homo sapiens
cctgcacctctgtgcttggaac

SEQ ID NO: 9265348 - DNA, 20 bp, Homo sapiens
tggctctctctagtaagtgg

SEQ ID NO: 9265349 - DNA, 22 bp, Homo sapiens
tggctctcccaatacctttctg

SEQ ID NO: 9265350 - DNA, 23 bp, Homo sapiens
tggctctctcagtgctgcagagg

SEQ ID NO: 9265351 - DNA, 22 bp, Homo sapiens
cctccctgcgctcctgcggcgg

SEQ ID NO: 9265352 - DNA, 22 bp, Homo sapiens
tggctctcagctcccagcagcc

SEQ ID NO: 9265353 - DNA, 22 bp, Homo sapiens
tggctctcagctcccagcagcc

SEQ ID NO: 9265354 - DNA, 22 bp, Homo sapiens
cctccctgctcctcaactggca

SEQ ID NO: 9265355 - DNA, 22 bp, Homo sapiens
cctccctgctcctcaactggca

SEQ ID NO: 9265356 - DNA, 21 bp, Homo sapiens
tgggagagcgttgctgtcctc

SEQ ID NO: 9265357 - DNA, 22 bp, Homo sapiens
tgggagcaggaagcaggaagta

SEQ ID NO: 9265358 - DNA, 22 bp, Homo sapiens
tgggagcaggaagcaggaagta

SEQ ID NO: 9265359 - DNA, 22 bp, Homo sapiens
tggctctctgggaggtcctggc

SEQ ID NO: 9265360 - DNA, 23 bp, Homo sapiens
tgggagctcaagggaggctgccc

SEQ ID NO: 9265361 - DNA, 22 bp, Homo sapiens
cctctggcagccagccagttgt

SEQ ID NO: 9265362 - DNA, 22 bp, Homo sapiens
cctctggcatagcaagtggcct

SEQ ID NO: 9265363 - DNA, 22 bp, Homo sapiens
cctctggcaagtgatttatcat

SEQ ID NO: 9265364 - DNA, 22 bp, Homo sapiens
cctctggcaacttcacagccca

SEQ ID NO: 9265365 - DNA, 22 bp, Homo sapiens
tgggagcctggcaggccagagg

SEQ ID NO: 9265366 - DNA, 22 bp, Homo sapiens
tgggagccattttagaggctgc

SEQ ID NO: 9265367 - DNA, 22 bp, Homo sapiens
tgggagcaggtgtgctagggaa

SEQ ID NO: 9265368 - DNA, 22 bp, Homo sapiens
tgggagcagttcaggtgtggct

SEQ ID NO: 9265369 - DNA, 22 bp, Homo sapiens
tgggagcagttcaggtgtggct

SEQ ID NO: 9265370 - DNA, 22 bp, Homo sapiens
tgggagcagttcaggtgtggct

SEQ ID NO: 9265371 - DNA, 22 bp, Homo sapiens
tgggagcagttgcatctccagt

SEQ ID NO: 9265372 - DNA, 22 bp, Homo sapiens
tgggagcagttgtgaagctcag

SEQ ID NO: 9265373 - DNA, 22 bp, Homo sapiens
tgggcagggagctggaaccaca

SEQ ID NO: 9265374 - DNA, 22 bp, Homo sapiens
tgggccacgtgacccttaccct

SEQ ID NO: 9265375 - DNA, 22 bp, Homo sapiens
tgggccactcttccctgggtct

SEQ ID NO: 9265376 - DNA, 22 bp, Homo sapiens
cctctggccatcccccattaag

SEQ ID NO: 9265377 - DNA, 22 bp, Homo sapiens
cctctggccacatgggacatag

SEQ ID NO: 9265378 - DNA, 22 bp, Homo sapiens
cctctggccagagaaaggccag

SEQ ID NO: 9265379 - DNA, 22 bp, Homo sapiens
tgggccagatccatggcaataa

SEQ ID NO: 9265380 - DNA, 21 bp, Homo sapiens
tgggccagatctgagtttcta

SEQ ID NO: 9265381 - DNA, 22 bp, Homo sapiens
tgggccagaggcatggagctat

SEQ ID NO: 9265382 - DNA, 22 bp, Homo sapiens
tgggccagaggcatggagctat

SEQ ID NO: 9265383 - DNA, 22 bp, Homo sapiens
tgggccagaggcatggagctat

SEQ ID NO: 9265384 - DNA, 22 bp, Homo sapiens
tgggccagatccatggcaataa

SEQ ID NO: 9265385 - DNA, 22 bp, Homo sapiens
tgggccagagagtaagaaaggt

SEQ ID NO: 9265386 - DNA, 22 bp, Homo sapiens
tgggccagagagtaagaaaggt

SEQ ID NO: 9265387 - DNA, 22 bp, Homo sapiens
tgggccacttgaaagtggatgt

SEQ ID NO: 9265388 - DNA, 22 bp, Homo sapiens
tgggccagaagtatgcatgttt

SEQ ID NO: 9265389 - DNA, 22 bp, Homo sapiens
cctcttctgagtgagactccct

SEQ ID NO: 9265390 - DNA, 22 bp, Homo sapiens
cctcttgattggttggaagcgg

SEQ ID NO: 9265391 - DNA, 22 bp, Homo sapiens
cctcttgccaatcagctacaga

SEQ ID NO: 9265392 - DNA, 22 bp, Homo sapiens
cctgaaaatcaaggtagtttgg

SEQ ID NO: 9265393 - DNA, 22 bp, Homo sapiens
cctgaagcaagggtaggcaggt

SEQ ID NO: 9265394 - DNA, 22 bp, Homo sapiens
cctgaaaatatcctctcctttg

SEQ ID NO: 9265395 - DNA, 22 bp, Homo sapiens
cctctttgtgcctgcaggctgc

SEQ ID NO: 9265396 - DNA, 22 bp, Homo sapiens
cctgaagggactccagagagca

SEQ ID NO: 9265397 - DNA, 17 bp, Homo sapiens
cctgaaggcacttccag

SEQ ID NO: 9265398 - DNA, 22 bp, Homo sapiens
cctgaagctcttaagaccttta

SEQ ID NO: 9265399 - DNA, 22 bp, Homo sapiens
cctgaatgcctgacatttcact

SEQ ID NO: 9265400 - DNA, 22 bp, Homo sapiens
cctcagccttggccccaggcag

SEQ ID NO: 9265401 - DNA, 22 bp, Homo sapiens
tggcctcggcatccagcaagag

SEQ ID NO: 9265402 - DNA, 23 bp, Homo sapiens
tggcctctccccacctggcagaa

SEQ ID NO: 9265403 - DNA, 22 bp, Homo sapiens
tggcctggggacctgtgagacc

SEQ ID NO: 9265404 - DNA, 22 bp, Homo sapiens
tggcctgggtcacaccagggtc

SEQ ID NO: 9265405 - DNA, 22 bp, Homo sapiens
tggctaacaaggtgaaaccccg

SEQ ID NO: 9265406 - DNA, 22 bp, Homo sapiens
cctcagctcttccctgtgcaca

SEQ ID NO: 9265407 - DNA, 22 bp, Homo sapiens
cctcagccttggccccaggcag

SEQ ID NO: 9265408 - DNA, 22 bp, Homo sapiens
cctcagctgctgcacagctttt

SEQ ID NO: 9265409 - DNA, 22 bp, Homo sapiens
cctcagctgcttccctggagcc

SEQ ID NO: 9265410 - DNA, 22 bp, Homo sapiens
cctcagaagctcaaggacattg

SEQ ID NO: 9265411 - DNA, 21 bp, Homo sapiens
tggcctcccacacttccatgg

SEQ ID NO: 9265412 - DNA, 22 bp, Homo sapiens
tggcctcagattattgcacagt

SEQ ID NO: 9265413 - DNA, 22 bp, Homo sapiens
cctcactctgcaccctgcagca

SEQ ID NO: 9265414 - DNA, 19 bp, Homo sapiens
cctcaccctgcagaggagg

SEQ ID NO: 9265415 - DNA, 22 bp, Homo sapiens
cctcagaagaagtggaattgat

SEQ ID NO: 9265416 - DNA, 22 bp, Homo sapiens
cctcagaacggaaatggttttg

SEQ ID NO: 9265417 - DNA, 22 bp, Homo sapiens
cctcagaagactttagggaaga

SEQ ID NO: 9265418 - DNA, 22 bp, Homo sapiens
cctcactggccagccaggggtg

SEQ ID NO: 9265419 - DNA, 22 bp, Homo sapiens
tggctaggctccaagagctgga

SEQ ID NO: 9265420 - DNA, 22 bp, Homo sapiens
tggctcagccattcgtgttgcc

SEQ ID NO: 9265421 - DNA, 22 bp, Homo sapiens
tggctcagccattcgtgttgcc

SEQ ID NO: 9265422 - DNA, 22 bp, Homo sapiens
tggctcagcgcggcctggtctt

SEQ ID NO: 9265423 - DNA, 22 bp, Homo sapiens
tggctcagcgcggcctggtctt

SEQ ID NO: 9265424 - DNA, 22 bp, Homo sapiens
tggctacaagtgtgtttagttt

SEQ ID NO: 9265425 - DNA, 22 bp, Homo sapiens
tggctacatttgttgatcactt

SEQ ID NO: 9265426 - DNA, 19 bp, Homo sapiens
cctccccttggaccagcaa

SEQ ID NO: 9265427 - DNA, 22 bp, Homo sapiens
cctccctccattgccatcgtct

SEQ ID NO: 9265428 - DNA, 22 bp, Homo sapiens
cctcccctgctcagaactctgg

SEQ ID NO: 9265429 - DNA, 22 bp, Homo sapiens
cctccctccctgcagaagccac

SEQ ID NO: 9265430 - DNA, 22 bp, Homo sapiens
cctccctccctcttatggttta

SEQ ID NO: 9265431 - DNA, 22 bp, Homo sapiens
cctccctccattgccatcgtct

SEQ ID NO: 9265432 - DNA, 22 bp, Homo sapiens
tggctcagcgcggcctggtctt

SEQ ID NO: 9265433 - DNA, 22 bp, Homo sapiens
cctcccaggcattgccattttc

SEQ ID NO: 9265434 - DNA, 22 bp, Homo sapiens
cctcacagagcccagatgtcta

SEQ ID NO: 9265435 - DNA, 22 bp, Homo sapiens
cctcacagaggggcagccatct

SEQ ID NO: 9265436 - DNA, 22 bp, Homo sapiens
cctcacagcaaggatttcagtg

SEQ ID NO: 9265437 - DNA, 22 bp, Homo sapiens
cctcacagccctcctctagcac

SEQ ID NO: 9265438 - DNA, 22 bp, Homo sapiens
cctcacagccctcctctagcac

SEQ ID NO: 9265439 - DNA, 21 bp, Homo sapiens
cctattgaatataggaagatt

SEQ ID NO: 9265440 - DNA, 22 bp, Homo sapiens
cctcacagtgttcgtgtcagat

SEQ ID NO: 9265441 - DNA, 22 bp, Homo sapiens
cctcacagtttggctaactgtg

SEQ ID NO: 9265442 - DNA, 17 bp, Homo sapiens
cctcacagggaccagac

SEQ ID NO: 9265443 - DNA, 20 bp, Homo sapiens
cctcacagggcagagagggg

SEQ ID NO: 9265444 - DNA, 22 bp, Homo sapiens
cctcacagcctcatgcccagcc

SEQ ID NO: 9265445 - DNA, 22 bp, Homo sapiens
cctcacagcctcatgcccagcc

SEQ ID NO: 9265446 - DNA, 22 bp, Homo sapiens
ccgtggagttgtgctgagtatg

SEQ ID NO: 9265447 - DNA, 22 bp, Homo sapiens
ccgggcctcgggacaccgggta

SEQ ID NO: 9265448 - DNA, 22 bp, Homo sapiens
ccggctactcgggaggctgacg

SEQ ID NO: 9265449 - DNA, 22 bp, Homo sapiens
ccggctactcgggaggctgacg

SEQ ID NO: 9265450 - DNA, 22 bp, Homo sapiens
ccggctactcgggaggctgacg

SEQ ID NO: 9265451 - DNA, 22 bp, Homo sapiens
ccctgtgggaactcctgagttg

SEQ ID NO: 9265452 - DNA, 22 bp, Homo sapiens
ccgcgccacccattcccactga

SEQ ID NO: 9265453 - DNA, 22 bp, Homo sapiens
ccggagtgtctggcctgctggg

SEQ ID NO: 9265454 - DNA, 22 bp, Homo sapiens
ccggctactcgggaggctgacg

SEQ ID NO: 9265455 - DNA, 20 bp, Homo sapiens
ccctgtgattggcaagtgtc

SEQ ID NO: 9265456 - DNA, 20 bp, Homo sapiens
ccctgtgattggcaagtgtc

SEQ ID NO: 9265457 - DNA, 22 bp, Homo sapiens
ccctgtggaggcagcatcctgc

SEQ ID NO: 9265458 - DNA, 22 bp, Homo sapiens
ccctgtgcctagttggcctaaa

SEQ ID NO: 9265459 - DNA, 22 bp, Homo sapiens
ccctggaggaaaatctgaggct

SEQ ID NO: 9265460 - DNA, 22 bp, Homo sapiens
ccctggagctgcttgcatgttg

SEQ ID NO: 9265461 - DNA, 22 bp, Homo sapiens
ccctgggagtccactgatgtca

SEQ ID NO: 9265462 - DNA, 22 bp, Homo sapiens
ccctggaggaaaatctgaggct

SEQ ID NO: 9265463 - DNA, 22 bp, Homo sapiens
ccctggtggggccagacttgct

SEQ ID NO: 9265464 - DNA, 22 bp, Homo sapiens
ccctggtgccctgggtcagcct

SEQ ID NO: 9265465 - DNA, 22 bp, Homo sapiens
ccctgggataccagacaccaga

SEQ ID NO: 9265466 - DNA, 22 bp, Homo sapiens
ccctggtggtacggcactggca

SEQ ID NO: 9265467 - DNA, 22 bp, Homo sapiens
ccctggtgtccactggaggaag

SEQ ID NO: 9265468 - DNA, 22 bp, Homo sapiens
ccctggtggtacggcactggca

SEQ ID NO: 9265469 - DNA, 22 bp, Homo sapiens
ccctggtggtacggcactggca

SEQ ID NO: 9265470 - DNA, 22 bp, Homo sapiens
ccctggtgtccactggaggaag

SEQ ID NO: 9265471 - DNA, 21 bp, Homo sapiens
ccctggttccactgtcaccgc

SEQ ID NO: 9265472 - DNA, 22 bp, Homo sapiens
ccctggttcaggtttctctgaa

SEQ ID NO: 9265473 - DNA, 22 bp, Homo sapiens
ccctgtctgtaccgtgatgagc

SEQ ID NO: 9265474 - DNA, 22 bp, Homo sapiens
ccctgtctgtaccgtgatgagc

SEQ ID NO: 9265475 - DNA, 22 bp, Homo sapiens
ccctgtccttggctgtgaggct

SEQ ID NO: 9265476 - DNA, 22 bp, Homo sapiens
ccctgtctcattgatcacttgt

SEQ ID NO: 9265477 - DNA, 23 bp, Homo sapiens
ccctgtagcccaggacaggcttt

SEQ ID NO: 9265478 - DNA, 22 bp, Homo sapiens
ccctgcagacgtcttgatgcct

SEQ ID NO: 9265479 - DNA, 22 bp, Homo sapiens
ccctgcagagagtgcttttgtg

SEQ ID NO: 9265480 - DNA, 22 bp, Homo sapiens
ccctgcagagccagccctgacc

SEQ ID NO: 9265481 - DNA, 22 bp, Homo sapiens
ccctgcagagaccactgacctt

SEQ ID NO: 9265482 - DNA, 22 bp, Homo sapiens
ccctgcagagaccactgacctt

SEQ ID NO: 9265483 - DNA, 22 bp, Homo sapiens
ccctgaggagagcgcttcccga

SEQ ID NO: 9265484 - DNA, 22 bp, Homo sapiens
ccctgaggaccaggaaggaggg

SEQ ID NO: 9265485 - DNA, 22 bp, Homo sapiens
tggaagggaacaggtgggtgtt

SEQ ID NO: 9265486 - DNA, 22 bp, Homo sapiens
ccctgaggaccaggaaggaggg

SEQ ID NO: 9265487 - DNA, 22 bp, Homo sapiens
ccctgcagagggatgggggcag

SEQ ID NO: 9265488 - DNA, 22 bp, Homo sapiens
ccctgcagagccagccctgacc

SEQ ID NO: 9265489 - DNA, 22 bp, Homo sapiens
ccctgcagagccagccctgacc

SEQ ID NO: 9265490 - DNA, 22 bp, Homo sapiens
ccctgcagcattctctaactgg

SEQ ID NO: 9265491 - DNA, 22 bp, Homo sapiens
ccctgcagatctagggtccttc

SEQ ID NO: 9265492 - DNA, 22 bp, Homo sapiens
ccctgcagatcagtgagaactt

SEQ ID NO: 9265493 - DNA, 22 bp, Homo sapiens
ccctgcagccggccagctcatt

SEQ ID NO: 9265494 - DNA, 20 bp, Homo sapiens
ccctgcagccatgggagtgg

SEQ ID NO: 9265495 - DNA, 22 bp, Homo sapiens
ccctgcagccggccagctcatt

SEQ ID NO: 9265496 - DNA, 22 bp, Homo sapiens
tggacaggttgagtaggaggag

SEQ ID NO: 9265497 - DNA, 22 bp, Homo sapiens
tggacaggtgcacacagcagcc

SEQ ID NO: 9265498 - DNA, 22 bp, Homo sapiens
tggacaggttgagtaggaggag

SEQ ID NO: 9265499 - DNA, 23 bp, Homo sapiens
ccctgcagtcagggtgagatggt

SEQ ID NO: 9265500 - DNA, 23 bp, Homo sapiens
ccctgcagtcagggtgagatggt

SEQ ID NO: 9265501 - DNA, 22 bp, Homo sapiens
tggacatcttagtcatgtcaat

SEQ ID NO: 9265502 - DNA, 22 bp, Homo sapiens
ccctgcctgtgggcatcaacat

SEQ ID NO: 9265503 - DNA, 22 bp, Homo sapiens
ccctgcctgtgggcatcaacat

SEQ ID NO: 9265504 - DNA, 22 bp, Homo sapiens
ccctgccttcttggcctttaaa

SEQ ID NO: 9265505 - DNA, 22 bp, Homo sapiens
ccctgcctgtgggcatcaacat

SEQ ID NO: 9265506 - DNA, 22 bp, Homo sapiens
ccctgcctgtgggcatcaacat

SEQ ID NO: 9265507 - DNA, 22 bp, Homo sapiens
ccctgcctctgaagctgctcag

SEQ ID NO: 9265508 - DNA, 22 bp, Homo sapiens
ccctgcctctgaagctgctcag

SEQ ID NO: 9265509 - DNA, 22 bp, Homo sapiens
ccctgcctctgaagctgctcag

SEQ ID NO: 9265510 - DNA, 22 bp, Homo sapiens
ccctgcctacagggttttcttt

SEQ ID NO: 9265511 - DNA, 22 bp, Homo sapiens
ccctgcctacagggttttcttt

SEQ ID NO: 9265512 - DNA, 22 bp, Homo sapiens
ccctgcctacagggttttcttt

SEQ ID NO: 9265513 - DNA, 19 bp, Homo sapiens
ccctgccctggtgactggg

SEQ ID NO: 9265514 - DNA, 19 bp, Homo sapiens
ccctgccctggtgactggg

SEQ ID NO: 9265515 - DNA, 23 bp, Homo sapiens
ccctggagctagtctgagcgggg

SEQ ID NO: 9265516 - DNA, 23 bp, Homo sapiens
ccctggagctagtctgagcagag

SEQ ID NO: 9265517 - DNA, 22 bp, Homo sapiens
tggaggtgacggggcctcgttg

SEQ ID NO: 9265518 - DNA, 22 bp, Homo sapiens
tggaggtgacggggcctcgttg

SEQ ID NO: 9265519 - DNA, 22 bp, Homo sapiens
tggaggtggagttggaaactga

SEQ ID NO: 9265520 - DNA, 22 bp, Homo sapiens
ccctggagctagtctgagcaga

SEQ ID NO: 9265521 - DNA, 19 bp, Homo sapiens
tggaggggtttgaatgtgg

SEQ ID NO: 9265522 - DNA, 22 bp, Homo sapiens
tggaggggcaatggagcgcgga

SEQ ID NO: 9265523 - DNA, 22 bp, Homo sapiens
tggaggggcaatggagcgcgga

SEQ ID NO: 9265524 - DNA, 19 bp, Homo sapiens
tggaggggtttgaatgtgg

SEQ ID NO: 9265525 - DNA, 22 bp, Homo sapiens
tggaggtctctgtctgggcagg

SEQ ID NO: 9265526 - DNA, 22 bp, Homo sapiens
tggaggtcttacccagggctat

SEQ ID NO: 9265527 - DNA, 22 bp, Homo sapiens
ccctgctcttctgactcaagct

SEQ ID NO: 9265528 - DNA, 23 bp, Homo sapiens
ccctgctcaggggtctgattctc

SEQ ID NO: 9265529 - DNA, 22 bp, Homo sapiens
ccctgctcttagtgcctgtgtg

SEQ ID NO: 9265530 - DNA, 18 bp, Homo sapiens
tggagggcttgctgcagc

SEQ ID NO: 9265531 - DNA, 22 bp, Homo sapiens
ccctgccttgttggagcctatg

SEQ ID NO: 9265532 - DNA, 22 bp, Homo sapiens
ccctgccttgtctgggctaggt

SEQ ID NO: 9265533 - DNA, 22 bp, Homo sapiens
ccctgccttgtctgggctaggt

SEQ ID NO: 9265534 - DNA, 22 bp, Homo sapiens
ccctgccttgttggagcctatg

SEQ ID NO: 9265535 - DNA, 22 bp, Homo sapiens
ccctgccttgttggagcctatg

SEQ ID NO: 9265536 - DNA, 22 bp, Homo sapiens
ccctgccttgttggagcctatg

SEQ ID NO: 9265537 - DNA, 22 bp, Homo sapiens
ccctgccttgttggagcctatg

SEQ ID NO: 9265538 - DNA, 22 bp, Homo sapiens
ccctgccttcttggcctttaaa

SEQ ID NO: 9265539 - DNA, 22 bp, Homo sapiens
ccctgccttcttggcctttaaa

SEQ ID NO: 9265540 - DNA, 22 bp, Homo sapiens
ccctgccttggggtccacaccg

SEQ ID NO: 9265541 - DNA, 22 bp, Homo sapiens
ccctgccttcttggcctttaaa

SEQ ID NO: 9265542 - DNA, 22 bp, Homo sapiens
ccctgccttggggtccacaccg

SEQ ID NO: 9265543 - DNA, 22 bp, Homo sapiens
ccctgccttggggtccacaccg

SEQ ID NO: 9265544 - DNA, 22 bp, Homo sapiens
ccctgccttggggtccacaccg

SEQ ID NO: 9265545 - DNA, 22 bp, Homo sapiens
ccctgccttggggtccacaccg

SEQ ID NO: 9265546 - DNA, 22 bp, Homo sapiens
ccctgccttgtctgggctaggt

SEQ ID NO: 9265547 - DNA, 22 bp, Homo sapiens
tgcctgccctgaaaactgccca

SEQ ID NO: 9265548 - DNA, 20 bp, Homo sapiens
tgcctgcccctgctttttcc

SEQ ID NO: 9265549 - DNA, 22 bp, Homo sapiens
tgcctccatgtttcagcatcta

SEQ ID NO: 9265550 - DNA, 22 bp, Homo sapiens
tgcctgcctaggaagctgtgaa

SEQ ID NO: 9265551 - DNA, 22 bp, Homo sapiens
tgcctgcctcaggccgagtgct

SEQ ID NO: 9265552 - DNA, 22 bp, Homo sapiens
tgcctgcctaggaagctgtgaa

SEQ ID NO: 9265553 - DNA, 22 bp, Homo sapiens
tgcctgcctctggcagccctgc

SEQ ID NO: 9265554 - DNA, 22 bp, Homo sapiens
tgcctgccttgctgctggacag

SEQ ID NO: 9265555 - DNA, 22 bp, Homo sapiens
tgcctcagtttcatctgcagaa

SEQ ID NO: 9265556 - DNA, 22 bp, Homo sapiens
tgcctcagtttcatctgcagaa

SEQ ID NO: 9265557 - DNA, 22 bp, Homo sapiens
tgcctcagtttcatctgcagaa

SEQ ID NO: 9265558 - DNA, 22 bp, Homo sapiens
tgcctcagtttctccatatgaa

SEQ ID NO: 9265559 - DNA, 22 bp, Homo sapiens
tgcctcataacactcctggagt

SEQ ID NO: 9265560 - DNA, 22 bp, Homo sapiens
tgcctgctagatatccaggtga

SEQ ID NO: 9265561 - DNA, 22 bp, Homo sapiens
tgcctgctccagtcctgtccac

SEQ ID NO: 9265562 - DNA, 19 bp, Homo sapiens
tgcctgctcctggcttcca

SEQ ID NO: 9265563 - DNA, 22 bp, Homo sapiens
tgctttatttataaaatagcaa

SEQ ID NO: 9265564 - DNA, 22 bp, Homo sapiens
tgctttatttataaaatagcaa

SEQ ID NO: 9265565 - DNA, 22 bp, Homo sapiens
tgctttcatattgcctatgact

SEQ ID NO: 9265566 - DNA, 22 bp, Homo sapiens
tgctttcattcacaaaatagca

SEQ ID NO: 9265567 - DNA, 21 bp, Homo sapiens
tgctttcagactcttacagaa

SEQ ID NO: 9265568 - DNA, 22 bp, Homo sapiens
tgctttcacctgtttgcaccca

SEQ ID NO: 9265569 - DNA, 22 bp, Homo sapiens
tgctttcacatgtatgcacaaa

SEQ ID NO: 9265570 - DNA, 22 bp, Homo sapiens
tggaagggaaagtttggggtcc

SEQ ID NO: 9265571 - DNA, 22 bp, Homo sapiens
tggaagacaaagattcaatatt

SEQ ID NO: 9265572 - DNA, 22 bp, Homo sapiens
tggaaggcaggacctgccttgg

SEQ ID NO: 9265573 - DNA, 22 bp, Homo sapiens
tggaagacagttgatgggagtt

SEQ ID NO: 9265574 - DNA, 22 bp, Homo sapiens
tggaagacaggcatggaagtgg

SEQ ID NO: 9265575 - DNA, 22 bp, Homo sapiens
tggaagacaggagatgtgtgta

SEQ ID NO: 9265576 - DNA, 22 bp, Homo sapiens
tggaaagacattcagccgctgg

SEQ ID NO: 9265577 - DNA, 22 bp, Homo sapiens
tggaaagacatgtccttcatta

SEQ ID NO: 9265578 - DNA, 22 bp, Homo sapiens
ccctagaacacgcagacactga

SEQ ID NO: 9265579 - DNA, 22 bp, Homo sapiens
tggaagaaggcagagaggcatt

SEQ ID NO: 9265580 - DNA, 22 bp, Homo sapiens
tggaagaataggatagaagaac

SEQ ID NO: 9265581 - DNA, 22 bp, Homo sapiens
tggaagaataggatagaagaac

SEQ ID NO: 9265582 - DNA, 22 bp, Homo sapiens
ccctaatgcagctgagaagggc

SEQ ID NO: 9265583 - DNA, 21 bp, Homo sapiens
ccctaactctaaaggatccat

SEQ ID NO: 9265584 - DNA, 23 bp, Homo sapiens
ccctaactaattctagggcctaa

SEQ ID NO: 9265585 - DNA, 21 bp, Homo sapiens
cccgtggagaaaaggaatgag

SEQ ID NO: 9265586 - DNA, 22 bp, Homo sapiens
cccgtgtggacagcgtgccagt

SEQ ID NO: 9265587 - DNA, 22 bp, Homo sapiens
cccgtcccttttgcccgctggt

SEQ ID NO: 9265588 - DNA, 22 bp, Homo sapiens
cccgggaggtggagactgcagt

SEQ ID NO: 9265589 - DNA, 22 bp, Homo sapiens
ccagggttggtctctctgaggt

SEQ ID NO: 9265590 - DNA, 22 bp, Homo sapiens
ccagggtttaaattctgactat

SEQ ID NO: 9265591 - DNA, 22 bp, Homo sapiens
ccagggttggtctctctgaggt

SEQ ID NO: 9265592 - DNA, 22 bp, Homo sapiens
ccagggtttagcaagcctacaa

SEQ ID NO: 9265593 - DNA, 22 bp, Homo sapiens
ccagggtgtgggcgtcggcacg

SEQ ID NO: 9265594 - DNA, 22 bp, Homo sapiens
ccagggttgcagggagccagca

SEQ ID NO: 9265595 - DNA, 22 bp, Homo sapiens
ccagggttataaatgcatctgt

SEQ ID NO: 9265596 - DNA, 22 bp, Homo sapiens
ccagggttggcaagcaaggctt

SEQ ID NO: 9265597 - DNA, 22 bp, Homo sapiens
ccagggttggtattcacctgga

SEQ ID NO: 9265598 - DNA, 22 bp, Homo sapiens
ccagggttgctgtatggcactt

SEQ ID NO: 9265599 - DNA, 22 bp, Homo sapiens
ccagggttggatgagtcactta

SEQ ID NO: 9265600 - DNA, 22 bp, Homo sapiens
ccagggtgggaggctgaaggcg

SEQ ID NO: 9265601 - DNA, 22 bp, Homo sapiens
ccagggtggggcaggcccactg

SEQ ID NO: 9265602 - DNA, 22 bp, Homo sapiens
ccagggtgggaggctgaaggcg

SEQ ID NO: 9265603 - DNA, 22 bp, Homo sapiens
ccagggtgggaggctgaaggcg

SEQ ID NO: 9265604 - DNA, 22 bp, Homo sapiens
ccagggtggcgtagatgctggg

SEQ ID NO: 9265605 - DNA, 22 bp, Homo sapiens
ccagggtgtagggattccagat

SEQ ID NO: 9265606 - DNA, 22 bp, Homo sapiens
ccagggtgtgagaaggaagtag

SEQ ID NO: 9265607 - DNA, 22 bp, Homo sapiens
ccagggtgtgagaaggaagtag

SEQ ID NO: 9265608 - DNA, 22 bp, Homo sapiens
ccagggtgtgagaaggaagtag

SEQ ID NO: 9265609 - DNA, 22 bp, Homo sapiens
ccagggtgtgggcgtcggcacg

SEQ ID NO: 9265610 - DNA, 22 bp, Homo sapiens
ccagggtgtgagaaggaagtag

SEQ ID NO: 9265611 - DNA, 22 bp, Homo sapiens
ccagggtggggtccaggaacca

SEQ ID NO: 9265612 - DNA, 22 bp, Homo sapiens
ccagggtggggtccaggaacca

SEQ ID NO: 9265613 - DNA, 22 bp, Homo sapiens
ccagggtggggtccaggaacca

SEQ ID NO: 9265614 - DNA, 22 bp, Homo sapiens
ccagggtggggtccaggaacca

SEQ ID NO: 9265615 - DNA, 22 bp, Homo sapiens
tgagaggtgaggcatgaggcat

SEQ ID NO: 9265616 - DNA, 22 bp, Homo sapiens
tgagagtagagtcttcatctgt

SEQ ID NO: 9265617 - DNA, 22 bp, Homo sapiens
ccaggtctatcaagttgggctc

SEQ ID NO: 9265618 - DNA, 22 bp, Homo sapiens
ccaggtcctgttttcaccacag

SEQ ID NO: 9265619 - DNA, 19 bp, Homo sapiens
tgagagtgaggaaggcttc

SEQ ID NO: 9265620 - DNA, 22 bp, Homo sapiens
tgagagtggttcagctcagaag

SEQ ID NO: 9265621 - DNA, 22 bp, Homo sapiens
tgagagtattttggcattatca

SEQ ID NO: 9265622 - DNA, 22 bp, Homo sapiens
tgagagtattttggcattatca

SEQ ID NO: 9265623 - DNA, 22 bp, Homo sapiens
tgagagtgaaatgtcacatgtc

SEQ ID NO: 9265624 - DNA, 22 bp, Homo sapiens
tgagataacatggaagagtagc

SEQ ID NO: 9265625 - DNA, 22 bp, Homo sapiens
tgagataactctgatttatgtt

SEQ ID NO: 9265626 - DNA, 22 bp, Homo sapiens
tgagagttttgacgcttgtaac

SEQ ID NO: 9265627 - DNA, 22 bp, Homo sapiens
tgagagttctctcttcaggtgg

SEQ ID NO: 9265628 - DNA, 22 bp, Homo sapiens
tgagagttcctcctctttccac

SEQ ID NO: 9265629 - DNA, 23 bp, Homo sapiens
tgagctggtattgtccatctcca

SEQ ID NO: 9265630 - DNA, 23 bp, Homo sapiens
tgagctggtattgtccatctcca

SEQ ID NO: 9265631 - DNA, 22 bp, Homo sapiens
tgaggaatgctgagcagaggaa

SEQ ID NO: 9265632 - DNA, 22 bp, Homo sapiens
tgaggaagttgtttctcttcta

SEQ ID NO: 9265633 - DNA, 22 bp, Homo sapiens
tgaggacaatccctaactcaga

SEQ ID NO: 9265634 - DNA, 22 bp, Homo sapiens
tgagctgggctgggctgagctg

SEQ ID NO: 9265635 - DNA, 23 bp, Homo sapiens
tgagctgggcctgcaggggtctc

SEQ ID NO: 9265636 - DNA, 22 bp, Homo sapiens
tgagctgggctgggctgagctg

SEQ ID NO: 9265637 - DNA, 22 bp, Homo sapiens
tgagctgggctgggctgagctg

SEQ ID NO: 9265638 - DNA, 22 bp, Homo sapiens
tgaggacatgagtgggacagag

SEQ ID NO: 9265639 - DNA, 23 bp, Homo sapiens
ccagtggcgtaaactagaggata

SEQ ID NO: 9265640 - DNA, 22 bp, Homo sapiens
ccagtgtgccaatttacagctg

SEQ ID NO: 9265641 - DNA, 22 bp, Homo sapiens
ccagtgggaacactggcattgc

SEQ ID NO: 9265642 - DNA, 22 bp, Homo sapiens
ccagtggctacaggggggttga

SEQ ID NO: 9265643 - DNA, 22 bp, Homo sapiens
tgagctgggaagagcagccaga

SEQ ID NO: 9265644 - DNA, 22 bp, Homo sapiens
tgagctgggaagagcagccaga

SEQ ID NO: 9265645 - DNA, 22 bp, Homo sapiens
tgagctgggagtggtgatgagg

SEQ ID NO: 9265646 - DNA, 22 bp, Homo sapiens
tgagctggcttgtcaaccaggg

SEQ ID NO: 9265647 - DNA, 22 bp, Homo sapiens
tgagctggcttgtcaaccaggg

SEQ ID NO: 9265648 - DNA, 22 bp, Homo sapiens
tgagctggcttgtcaaccaggg

SEQ ID NO: 9265649 - DNA, 22 bp, Homo sapiens
tgagcccaggagttggaggctg

SEQ ID NO: 9265650 - DNA, 22 bp, Homo sapiens
tgagctggcaggggctcaggga

SEQ ID NO: 9265651 - DNA, 22 bp, Homo sapiens
tgagcagaagattggaacttac

SEQ ID NO: 9265652 - DNA, 22 bp, Homo sapiens
tgagcagaacacgggatccatg

SEQ ID NO: 9265653 - DNA, 22 bp, Homo sapiens
tgagcagaagccctcctggact

SEQ ID NO: 9265654 - DNA, 22 bp, Homo sapiens
tgagcagaaaagaatgctgagc

SEQ ID NO: 9265655 - DNA, 22 bp, Homo sapiens
tgagcccaggagttggagaccg

SEQ ID NO: 9265656 - DNA, 22 bp, Homo sapiens
tgagcagacttgatgaggcagc

SEQ ID NO: 9265657 - DNA, 22 bp, Homo sapiens
tgagcagaagttataaataaga

SEQ ID NO: 9265658 - DNA, 22 bp, Homo sapiens
tgagcagaatgttcagataaat

SEQ ID NO: 9265659 - DNA, 22 bp, Homo sapiens
tgagcagactctgcagagccac

SEQ ID NO: 9265660 - DNA, 22 bp, Homo sapiens
ccagggccaagagacctcgagg

SEQ ID NO: 9265661 - DNA, 22 bp, Homo sapiens
ccagggcatgtccaagacttag

SEQ ID NO: 9265662 - DNA, 22 bp, Homo sapiens
ccagggcatgtccaagacttag

SEQ ID NO: 9265663 - DNA, 22 bp, Homo sapiens
ccagggcatgtaactaatggtg

SEQ ID NO: 9265664 - DNA, 22 bp, Homo sapiens
ccagggcatgggaagaactgaa

SEQ ID NO: 9265665 - DNA, 23 bp, Homo sapiens
tgacagagcacagtgggggagat

SEQ ID NO: 9265666 - DNA, 21 bp, Homo sapiens
ccagggaagaaatgagggcag

SEQ ID NO: 9265667 - DNA, 22 bp, Homo sapiens
tgacaatgggtggacaagatag

SEQ ID NO: 9265668 - DNA, 22 bp, Homo sapiens
tgacaatgggtggacaagatag

SEQ ID NO: 9265669 - DNA, 22 bp, Homo sapiens
tgacaattgcagacacagaagt

SEQ ID NO: 9265670 - DNA, 22 bp, Homo sapiens
ccaggctttctcctgactcaca

SEQ ID NO: 9265671 - DNA, 22 bp, Homo sapiens
ccaggctttcccagcctctcca

SEQ ID NO: 9265672 - DNA, 22 bp, Homo sapiens
ccaggctttcccagcctctcca

SEQ ID NO: 9265673 - DNA, 22 bp, Homo sapiens
ccagggaaaatcaacttctact

SEQ ID NO: 9265674 - DNA, 22 bp, Homo sapiens
ccaggcttttctcatggagtca

SEQ ID NO: 9265675 - DNA, 22 bp, Homo sapiens
ccaggcttttagctgcatggca

SEQ ID NO: 9265676 - DNA, 19 bp, Homo sapiens
ccaggctttatgcaaatac

SEQ ID NO: 9265677 - DNA, 22 bp, Homo sapiens
ccaggctttaagaggtggaaac

SEQ ID NO: 9265678 - DNA, 19 bp, Homo sapiens
ccaggctttatgcaaatac

SEQ ID NO: 9265679 - DNA, 22 bp, Homo sapiens
ccaggcttggtgtgtggtcagg

SEQ ID NO: 9265680 - DNA, 22 bp, Homo sapiens
tgaaggagaattaataggcatt

SEQ ID NO: 9265681 - DNA, 21 bp, Homo sapiens
tgaaggagaggaccgagtgct

SEQ ID NO: 9265682 - DNA, 21 bp, Homo sapiens
tgaaggagaggaccgagtgct

SEQ ID NO: 9265683 - DNA, 22 bp, Homo sapiens
tgaccctcttccccatgcgctc

SEQ ID NO: 9265684 - DNA, 22 bp, Homo sapiens
tgaccctgagagctgaatggct

SEQ ID NO: 9265685 - DNA, 22 bp, Homo sapiens
tgaccctgcttcttggtgcagg

SEQ ID NO: 9265686 - DNA, 22 bp, Homo sapiens
tgagaaaactcaaagacagatc

SEQ ID NO: 9265687 - DNA, 22 bp, Homo sapiens
tgagaaaaggttgagatgataa

SEQ ID NO: 9265688 - DNA, 22 bp, Homo sapiens
tgagaaaactcaaagacagatc

SEQ ID NO: 9265689 - DNA, 22 bp, Homo sapiens
tgagaaaactcaaagacagatc

SEQ ID NO: 9265690 - DNA, 22 bp, Homo sapiens
tgagaaaactcaaagacagatc

SEQ ID NO: 9265691 - DNA, 22 bp, Homo sapiens
tgacttttggacctcactgtcc

SEQ ID NO: 9265692 - DNA, 22 bp, Homo sapiens
tgagaaaacagtttgtaataat

SEQ ID NO: 9265693 - DNA, 22 bp, Homo sapiens
tgacttttggacctcactgtcc

SEQ ID NO: 9265694 - DNA, 22 bp, Homo sapiens
ccagggccagtaagattggcat

SEQ ID NO: 9265695 - DNA, 23 bp, Homo sapiens
ccagggcccctacaccactgtcc

SEQ ID NO: 9265696 - DNA, 22 bp, Homo sapiens
tgacatgctaagattatgttat

SEQ ID NO: 9265697 - DNA, 22 bp, Homo sapiens
tgacatttttataagagtcaaa

SEQ ID NO: 9265698 - DNA, 22 bp, Homo sapiens
tgacatttttgtacaaagtcag

SEQ ID NO: 9265699 - DNA, 22 bp, Homo sapiens
tgaccacacgtctggaattgtg

SEQ ID NO: 9265700 - DNA, 22 bp, Homo sapiens
tgaccaatactgtggatgccag

SEQ ID NO: 9265701 - DNA, 22 bp, Homo sapiens
tgaccaaaggtggtttatttgg

SEQ ID NO: 9265702 - DNA, 22 bp, Homo sapiens
tgaccaaagagttgcttgtatt

SEQ ID NO: 9265703 - DNA, 22 bp, Homo sapiens
tgaccacagacccaatgactac

SEQ ID NO: 9265704 - DNA, 22 bp, Homo sapiens
tgaccacacttgatcactctga

SEQ ID NO: 9265705 - DNA, 22 bp, Homo sapiens
tgaccacattgatttctcatcc

SEQ ID NO: 9265706 - DNA, 22 bp, Homo sapiens
tgaccacagacccaatgactac

SEQ ID NO: 9265707 - DNA, 22 bp, Homo sapiens
tgaccaggatactgcagggatg

SEQ ID NO: 9265708 - DNA, 22 bp, Homo sapiens
tgacccatcaggccacatgagg

SEQ ID NO: 9265709 - DNA, 22 bp, Homo sapiens
tctttaaagttggagcttgcaa

SEQ ID NO: 9265710 - DNA, 22 bp, Homo sapiens
tcttgtttcttctaagcagcag

SEQ ID NO: 9265711 - DNA, 22 bp, Homo sapiens
tcttgtttctgtatataatgac

SEQ ID NO: 9265712 - DNA, 22 bp, Homo sapiens
tcttgtttggattttgggcagt

SEQ ID NO: 9265713 - DNA, 22 bp, Homo sapiens
tcttgttttgaactcatcagga

SEQ ID NO: 9265714 - DNA, 22 bp, Homo sapiens
tcttgttttgaactcatcagga

SEQ ID NO: 9265715 - DNA, 22 bp, Homo sapiens
tcttgttttgaactcatcagga

SEQ ID NO: 9265716 - DNA, 23 bp, Homo sapiens
tcttgtttcctttgcgctatcca

SEQ ID NO: 9265717 - DNA, 23 bp, Homo sapiens
tcttgtttcctttgcgctatcca

SEQ ID NO: 9265718 - DNA, 22 bp, Homo sapiens
tcttgttatcaggaaaacagta

SEQ ID NO: 9265719 - DNA, 21 bp, Homo sapiens
ccagcctcagatcagggagct

SEQ ID NO: 9265720 - DNA, 18 bp, Homo sapiens
tcttgcctgcaccctctc

SEQ ID NO: 9265721 - DNA, 22 bp, Homo sapiens
ccagcctcactggcatcaccta

SEQ ID NO: 9265722 - DNA, 22 bp, Homo sapiens
tcttgggggactttggcatgga

SEQ ID NO: 9265723 - DNA, 22 bp, Homo sapiens
tcttggtatacgcatggcattg

SEQ ID NO: 9265724 - DNA, 22 bp, Homo sapiens
tcttgtcactactgttatgcat

SEQ ID NO: 9265725 - DNA, 23 bp, Homo sapiens
tctgcagacgctgttctattgtc

SEQ ID NO: 9265726 - DNA, 22 bp, Homo sapiens
tctgcagacaggaagctgaggc

SEQ ID NO: 9265727 - DNA, 22 bp, Homo sapiens
tctgcagacttgataaccactg

SEQ ID NO: 9265728 - DNA, 22 bp, Homo sapiens
tctgcagacttgcctaagtgtg

SEQ ID NO: 9265729 - DNA, 19 bp, Homo sapiens
tctgcagaggaattcttca

SEQ ID NO: 9265730 - DNA, 22 bp, Homo sapiens
tctgcagagggagtgctgggtc

SEQ ID NO: 9265731 - DNA, 22 bp, Homo sapiens
tctgcagaggtaatttacagat

SEQ ID NO: 9265732 - DNA, 22 bp, Homo sapiens
ccagcccttgagatggaaggga

SEQ ID NO: 9265733 - DNA, 22 bp, Homo sapiens
ccagcccttgctgaagggtggc

SEQ ID NO: 9265734 - DNA, 22 bp, Homo sapiens
tctttattttatgcttgtgcaa

SEQ ID NO: 9265735 - DNA, 22 bp, Homo sapiens
tctttattttatgcttgtgcaa

SEQ ID NO: 9265736 - DNA, 22 bp, Homo sapiens
tctttcaaagcaaaatgaggct

SEQ ID NO: 9265737 - DNA, 22 bp, Homo sapiens
tctttatttctgaatcccccat

SEQ ID NO: 9265738 - DNA, 22 bp, Homo sapiens
tctttatttctgaatcccccat

SEQ ID NO: 9265739 - DNA, 22 bp, Homo sapiens
tctttatttaagtctgttgtaa

SEQ ID NO: 9265740 - DNA, 22 bp, Homo sapiens
tctttatttaagtctgttgtaa

SEQ ID NO: 9265741 - DNA, 18 bp, Homo sapiens
tctttaagttgtcagagt

SEQ ID NO: 9265742 - DNA, 22 bp, Homo sapiens
ccaggctcaggcctgctcgttg

SEQ ID NO: 9265743 - DNA, 22 bp, Homo sapiens
ccaggctcaggtgcgagagaca

SEQ ID NO: 9265744 - DNA, 17 bp, Homo sapiens
ccaggctccatcactgt

SEQ ID NO: 9265745 - DNA, 22 bp, Homo sapiens
ccaggctccccaggaggccctt

SEQ ID NO: 9265746 - DNA, 17 bp, Homo sapiens
ccaggctccatcactgt

SEQ ID NO: 9265747 - DNA, 22 bp, Homo sapiens
ccaggctcactgactaccacat

SEQ ID NO: 9265748 - DNA, 22 bp, Homo sapiens
ccaggctcagcgcgcacgtctg

SEQ ID NO: 9265749 - DNA, 22 bp, Homo sapiens
ccaggctcagcgcgcacgtctg

SEQ ID NO: 9265750 - DNA, 22 bp, Homo sapiens
ccaggctcactgactaccacat

SEQ ID NO: 9265751 - DNA, 22 bp, Homo sapiens
ccaggctcacagcatcccagga

SEQ ID NO: 9265752 - DNA, 22 bp, Homo sapiens
tgaacagactgacctctgacct

SEQ ID NO: 9265753 - DNA, 22 bp, Homo sapiens
tgaacacattttcttcagtaga

SEQ ID NO: 9265754 - DNA, 22 bp, Homo sapiens
tgaacagatcaatagaactgac

SEQ ID NO: 9265755 - DNA, 22 bp, Homo sapiens
tgaacagatggcccagcagagg

SEQ ID NO: 9265756 - DNA, 22 bp, Homo sapiens
tgaagagatagaagtacatgct

SEQ ID NO: 9265757 - DNA, 22 bp, Homo sapiens
tgaagagatagaagtacatgct

SEQ ID NO: 9265758 - DNA, 22 bp, Homo sapiens
tgaagagatagaagtacatgct

SEQ ID NO: 9265759 - DNA, 22 bp, Homo sapiens
tgaacagtcaaaaagtgaccat

SEQ ID NO: 9265760 - DNA, 22 bp, Homo sapiens
tgaagaggccaaactatcattg

SEQ ID NO: 9265761 - DNA, 22 bp, Homo sapiens
tgaaggaaagagggaacatccc

SEQ ID NO: 9265762 - DNA, 22 bp, Homo sapiens
tgaagctttaggatgggttcat

SEQ ID NO: 9265763 - DNA, 22 bp, Homo sapiens
tgaagatttagacctctttgcc

SEQ ID NO: 9265764 - DNA, 22 bp, Homo sapiens
tgaagatttccaccaaatcaca

SEQ ID NO: 9265765 - DNA, 17 bp, Homo sapiens
tgaagatgcatggcagc

SEQ ID NO: 9265766 - DNA, 22 bp, Homo sapiens
tgaagattgtgcttggcctgta

SEQ ID NO: 9265767 - DNA, 17 bp, Homo sapiens
tgaagatgcatggcagc

SEQ ID NO: 9265768 - DNA, 22 bp, Homo sapiens
tgaaggaatgagggagtgggtc

SEQ ID NO: 9265769 - DNA, 22 bp, Homo sapiens
tgaaggaatgagggagtgggtc

SEQ ID NO: 9265770 - DNA, 22 bp, Homo sapiens
tgaaggaagaataggcagtgtt

SEQ ID NO: 9265771 - DNA, 22 bp, Homo sapiens
tgaaggaatgagtatactgttt

SEQ ID NO: 9265772 - DNA, 22 bp, Homo sapiens
tgaaggagaattaataggcatt

SEQ ID NO: 9265773 - DNA, 22 bp, Homo sapiens
tgaaagcactgattctcaactc

SEQ ID NO: 9265774 - DNA, 22 bp, Homo sapiens
tgaaagcagatagctctgttgt

SEQ ID NO: 9265775 - DNA, 22 bp, Homo sapiens
tgaaagcagatagctctgttgt

SEQ ID NO: 9265776 - DNA, 22 bp, Homo sapiens
tgaaagcactgattctcaactc

SEQ ID NO: 9265777 - DNA, 22 bp, Homo sapiens
ccaggctcctcatgatcttgtt

SEQ ID NO: 9265778 - DNA, 22 bp, Homo sapiens
tgaaagctgtccactaggctgt

SEQ ID NO: 9265779 - DNA, 22 bp, Homo sapiens
tgaaagctgtccactaggctgt

SEQ ID NO: 9265780 - DNA, 22 bp, Homo sapiens
tgaaagcattagtctaaggtag

SEQ ID NO: 9265781 - DNA, 22 bp, Homo sapiens
tgaaagcatgcttgccaagctt

SEQ ID NO: 9265782 - DNA, 22 bp, Homo sapiens
tgaaagcagtgccatgattatg

SEQ ID NO: 9265783 - DNA, 22 bp, Homo sapiens
tgaaagcagtgccatgattatg

SEQ ID NO: 9265784 - DNA, 22 bp, Homo sapiens
tgaaagcatatgctaaagacca

SEQ ID NO: 9265785 - DNA, 22 bp, Homo sapiens
tgaaagcagtgccatgattatg

SEQ ID NO: 9265786 - DNA, 22 bp, Homo sapiens
tgaaagcagtgatttctccttc

SEQ ID NO: 9265787 - DNA, 22 bp, Homo sapiens
tgaaagcaggcgggctacttta

SEQ ID NO: 9265788 - DNA, 22 bp, Homo sapiens
tgaaagcaggcgggctacttta

SEQ ID NO: 9265789 - DNA, 22 bp, Homo sapiens
ccaggctgctcacaagctgccc

SEQ ID NO: 9265790 - DNA, 22 bp, Homo sapiens
ccaggctgctcacaagctgccc

SEQ ID NO: 9265791 - DNA, 22 bp, Homo sapiens
ccaggctgctcacaagctgccc

SEQ ID NO: 9265792 - DNA, 22 bp, Homo sapiens
tgaacacacacctatgtacaaa

SEQ ID NO: 9265793 - DNA, 18 bp, Homo sapiens
tgaacacagtacaattcc

SEQ ID NO: 9265794 - DNA, 22 bp, Homo sapiens
tgaacacagggccaaacttgag

SEQ ID NO: 9265795 - DNA, 22 bp, Homo sapiens
tgaacacagcatattttgttac

SEQ ID NO: 9265796 - DNA, 22 bp, Homo sapiens
tgaacacagttctgatgagctt

SEQ ID NO: 9265797 - DNA, 22 bp, Homo sapiens
ccaggctgcagtcaaggggcat

SEQ ID NO: 9265798 - DNA, 22 bp, Homo sapiens
ccaggctgcagtcaaggggcat

SEQ ID NO: 9265799 - DNA, 22 bp, Homo sapiens
ccaggctgccgaggaaagaaag

SEQ ID NO: 9265800 - DNA, 22 bp, Homo sapiens
ccaggctgccgaggaaagaaag

SEQ ID NO: 9265801 - DNA, 22 bp, Homo sapiens
ccaggctgccgaggaaagaaag

SEQ ID NO: 9265802 - DNA, 22 bp, Homo sapiens
ccaggctgagcatgattggagc

SEQ ID NO: 9265803 - DNA, 22 bp, Homo sapiens
tgaaaggaagagggctactcct

SEQ ID NO: 9265804 - DNA, 22 bp, Homo sapiens
tgaaagggaacctgctggactg

SEQ ID NO: 9265805 - DNA, 22 bp, Homo sapiens
ccaggctgagcatgattggagc

SEQ ID NO: 9265806 - DNA, 22 bp, Homo sapiens
ccaggctgcagtcaaggggcat

SEQ ID NO: 9265807 - DNA, 22 bp, Homo sapiens
cccaagggtgcccagcagagga

SEQ ID NO: 9265808 - DNA, 22 bp, Homo sapiens
tgattagctgaagaatatgctg

SEQ ID NO: 9265809 - DNA, 22 bp, Homo sapiens
cccacaggcaggtgcatgggct

SEQ ID NO: 9265810 - DNA, 22 bp, Homo sapiens
cccacaggcaggtgcatgggct

SEQ ID NO: 9265811 - DNA, 22 bp, Homo sapiens
cccacaggtggaagcctcggaa

SEQ ID NO: 9265812 - DNA, 22 bp, Homo sapiens
cccacaggctaggggtagggca

SEQ ID NO: 9265813 - DNA, 22 bp, Homo sapiens
cccacagggctgctgatggcag

SEQ ID NO: 9265814 - DNA, 22 bp, Homo sapiens
cccacagggctgctgatggcag

SEQ ID NO: 9265815 - DNA, 22 bp, Homo sapiens
cccacccagcctggctgagggg

SEQ ID NO: 9265816 - DNA, 22 bp, Homo sapiens
cccacccagcctggctgagggg

SEQ ID NO: 9265817 - DNA, 22 bp, Homo sapiens
tgcagagagttagggcccgtat

SEQ ID NO: 9265818 - DNA, 22 bp, Homo sapiens
tgcagaggtttccaggcaagtt

SEQ ID NO: 9265819 - DNA, 22 bp, Homo sapiens
tgcagaggtttccaggcaagtt

SEQ ID NO: 9265820 - DNA, 22 bp, Homo sapiens
tgcagaggtgttgctgagataa

SEQ ID NO: 9265821 - DNA, 22 bp, Homo sapiens
tgcagaggtgttgctgagataa

SEQ ID NO: 9265822 - DNA, 22 bp, Homo sapiens
cccagcactttgaatatgtcac

SEQ ID NO: 9265823 - DNA, 22 bp, Homo sapiens
cccagcactttgaatatgtcac

SEQ ID NO: 9265824 - DNA, 22 bp, Homo sapiens
cccagcagaatctgatgagggc

SEQ ID NO: 9265825 - DNA, 22 bp, Homo sapiens
cccagcagatggctatgtgcta

SEQ ID NO: 9265826 - DNA, 23 bp, Homo sapiens
cccagcagagatgaggaggggtc

SEQ ID NO: 9265827 - DNA, 23 bp, Homo sapiens
cccagcagagatgaggaggggtc

SEQ ID NO: 9265828 - DNA, 22 bp, Homo sapiens
cccagcagccagaatgaggagc

SEQ ID NO: 9265829 - DNA, 22 bp, Homo sapiens
tgcagcaggttccaaagggtta

SEQ ID NO: 9265830 - DNA, 22 bp, Homo sapiens
cccagagggtggaggttgcagt

SEQ ID NO: 9265831 - DNA, 22 bp, Homo sapiens
cccagagatcttgtcctttcca

SEQ ID NO: 9265832 - DNA, 22 bp, Homo sapiens
cccagcactcagcaggctcata

SEQ ID NO: 9265833 - DNA, 22 bp, Homo sapiens
cccagagaagtgaagtgacttg

SEQ ID NO: 9265834 - DNA, 22 bp, Homo sapiens
cccagagaaccttctgtgccac

SEQ ID NO: 9265835 - DNA, 22 bp, Homo sapiens
cccagactcctctggctggtgg

SEQ ID NO: 9265836 - DNA, 22 bp, Homo sapiens
cccagactgcagagcgggcaga

SEQ ID NO: 9265837 - DNA, 22 bp, Homo sapiens
cccagagaatctttcagaaagg

SEQ ID NO: 9265838 - DNA, 22 bp, Homo sapiens
cccagagaatctttcagaaagg

SEQ ID NO: 9265839 - DNA, 22 bp, Homo sapiens
cccagagaattccacatagagg

SEQ ID NO: 9265840 - DNA, 22 bp, Homo sapiens
tgcagagtaaaagcagatgcta

SEQ ID NO: 9265841 - DNA, 22 bp, Homo sapiens
cccaaccagaaattgacagaca

SEQ ID NO: 9265842 - DNA, 22 bp, Homo sapiens
cccaaccagaaattgacagaga

SEQ ID NO: 9265843 - DNA, 22 bp, Homo sapiens
cccaactactctcaggcagctt

SEQ ID NO: 9265844 - DNA, 22 bp, Homo sapiens
cccaagcagggtgcagaggcat

SEQ ID NO: 9265845 - DNA, 19 bp, Homo sapiens
cccaacttgactattttct

SEQ ID NO: 9265846 - DNA, 19 bp, Homo sapiens
cccaactggatccatcata

SEQ ID NO: 9265847 - DNA, 22 bp, Homo sapiens
cccaagagatcgcatgtagttg

SEQ ID NO: 9265848 - DNA, 22 bp, Homo sapiens
cccaagatctttcgtgcactaa

SEQ ID NO: 9265849 - DNA, 22 bp, Homo sapiens
tgattacagtatttgagatcca

SEQ ID NO: 9265850 - DNA, 22 bp, Homo sapiens
tgattagacaaaggaatcatgc

SEQ ID NO: 9265851 - DNA, 22 bp, Homo sapiens
tgattacattggtaatgtttat

SEQ ID NO: 9265852 - DNA, 22 bp, Homo sapiens
tgattacactatttgggaatag

SEQ ID NO: 9265853 - DNA, 22 bp, Homo sapiens
tgattacacagcagtaatttca

SEQ ID NO: 9265854 - DNA, 23 bp, Homo sapiens
tgattacaggaagttcaagtgtt

SEQ ID NO: 9265855 - DNA, 22 bp, Homo sapiens
tgattagatagtaagtgactaa

SEQ ID NO: 9265856 - DNA, 22 bp, Homo sapiens
tgattcaactttcataacaaaa

SEQ ID NO: 9265857 - DNA, 22 bp, Homo sapiens
ccatggcaatggtcagtctatt

SEQ ID NO: 9265858 - DNA, 19 bp, Homo sapiens
ccatggcaatgatctgatg

SEQ ID NO: 9265859 - DNA, 22 bp, Homo sapiens
ccatggagcgggtgagtgagtg

SEQ ID NO: 9265860 - DNA, 22 bp, Homo sapiens
ccatggagttcctctggtctat

SEQ ID NO: 9265861 - DNA, 22 bp, Homo sapiens
ccatggatctggatctatcttt

SEQ ID NO: 9265862 - DNA, 20 bp, Homo sapiens
ccatggccacatctgtgctg

SEQ ID NO: 9265863 - DNA, 20 bp, Homo sapiens
ccatggccacatctgtgctg

SEQ ID NO: 9265864 - DNA, 22 bp, Homo sapiens
ccatggcattttatgtgtctta

SEQ ID NO: 9265865 - DNA, 22 bp, Homo sapiens
ccatttttcacaagactcactt

SEQ ID NO: 9265866 - DNA, 22 bp, Homo sapiens
ccatttttgacagaaggcctaa

SEQ ID NO: 9265867 - DNA, 22 bp, Homo sapiens
ccatttttcataaactatccaa

SEQ ID NO: 9265868 - DNA, 22 bp, Homo sapiens
cccaaagcagggtcattgggcc

SEQ ID NO: 9265869 - DNA, 22 bp, Homo sapiens
cccaaagaaaacagtacctcag

SEQ ID NO: 9265870 - DNA, 22 bp, Homo sapiens
ccatggccgccgctgctcagga

SEQ ID NO: 9265871 - DNA, 22 bp, Homo sapiens
ccatggcctcgctctacgtggg

SEQ ID NO: 9265872 - DNA, 22 bp, Homo sapiens
ccatttttaaagagcttaagta

SEQ ID NO: 9265873 - DNA, 22 bp, Homo sapiens
ccattgtttatttagacttaat

SEQ ID NO: 9265874 - DNA, 18 bp, Homo sapiens
tgaggcagtcagtgatgg

SEQ ID NO: 9265875 - DNA, 18 bp, Homo sapiens
tgaggcagtcagtgatgg

SEQ ID NO: 9265876 - DNA, 22 bp, Homo sapiens
tgaggcagtattttagtgactt

SEQ ID NO: 9265877 - DNA, 22 bp, Homo sapiens
tgaggcagtattttagtgactt

SEQ ID NO: 9265878 - DNA, 22 bp, Homo sapiens
tgaggcaggtggattacaaggt

SEQ ID NO: 9265879 - DNA, 22 bp, Homo sapiens
tgaggcagtattctccattcca

SEQ ID NO: 9265880 - DNA, 21 bp, Homo sapiens
tgaggcaggggtgcttttgtc

SEQ ID NO: 9265881 - DNA, 22 bp, Homo sapiens
tgaggcaggtaagcaagttttg

SEQ ID NO: 9265882 - DNA, 22 bp, Homo sapiens
ccagtgttcataattttacact

SEQ ID NO: 9265883 - DNA, 22 bp, Homo sapiens
ccagtgttcatcaagaaaatgt

SEQ ID NO: 9265884 - DNA, 22 bp, Homo sapiens
ccagtgttcagtatgcattaag

SEQ ID NO: 9265885 - DNA, 22 bp, Homo sapiens
ccagtgttcaatacatatttgt

SEQ ID NO: 9265886 - DNA, 22 bp, Homo sapiens
ccagtgttattttagagtgtga

SEQ ID NO: 9265887 - DNA, 22 bp, Homo sapiens
ccagtgttagagactgatacag

SEQ ID NO: 9265888 - DNA, 22 bp, Homo sapiens
ccagtgttacggcttgaactat

SEQ ID NO: 9265889 - DNA, 22 bp, Homo sapiens
ccagtgtgttccctgcctcact

SEQ ID NO: 9265890 - DNA, 23 bp, Homo sapiens
ccagtgtggtaggtccacaggtg

SEQ ID NO: 9265891 - DNA, 23 bp, Homo sapiens
ccagtgtggtaggtccacaggtg

SEQ ID NO: 9265892 - DNA, 22 bp, Homo sapiens
ccagtgtggccaggtgctggta

SEQ ID NO: 9265893 - DNA, 22 bp, Homo sapiens
ccagtgtggtaggtccacaggt

SEQ ID NO: 9265894 - DNA, 22 bp, Homo sapiens
ccatggagcacctcacagaggc

SEQ ID NO: 9265895 - DNA, 22 bp, Homo sapiens
tgatgaccgccaacgtttaggt

SEQ ID NO: 9265896 - DNA, 22 bp, Homo sapiens
tgatgaggacctggtctctgct

SEQ ID NO: 9265897 - DNA, 22 bp, Homo sapiens
tgatacagtcagctcacaattg

SEQ ID NO: 9265898 - DNA, 22 bp, Homo sapiens
tgaggcagtgctgggaagcctg

SEQ ID NO: 9265899 - DNA, 18 bp, Homo sapiens
tgaggcagtcagtgatgg

SEQ ID NO: 9265900 - DNA, 22 bp, Homo sapiens
tgatgaattagtaacaaatgag

SEQ ID NO: 9265901 - DNA, 22 bp, Homo sapiens
tgatgacaaactttcctgatgc

SEQ ID NO: 9265902 - DNA, 22 bp, Homo sapiens
tgatgacagtgttacagctcca

SEQ ID NO: 9265903 - DNA, 22 bp, Homo sapiens
cccaggaaatagccaggaggtg

SEQ ID NO: 9265904 - DNA, 22 bp, Homo sapiens
cccaggaattggaggctgcagt

SEQ ID NO: 9265905 - DNA, 22 bp, Homo sapiens
cccaggaaagtggaggcggctg

SEQ ID NO: 9265906 - DNA, 22 bp, Homo sapiens
cccaggaaagtggaggcggctg

SEQ ID NO: 9265907 - DNA, 22 bp, Homo sapiens
cccagctccgagctccgagccg

SEQ ID NO: 9265908 - DNA, 22 bp, Homo sapiens
cccagctccctggtatttgtgc

SEQ ID NO: 9265909 - DNA, 22 bp, Homo sapiens
cccagctccctggtatttgtgc

SEQ ID NO: 9265910 - DNA, 22 bp, Homo sapiens
cccagctccctggtatttgtgc

SEQ ID NO: 9265911 - DNA, 22 bp, Homo sapiens
cccagctccgagctccgagccg

SEQ ID NO: 9265912 - DNA, 22 bp, Homo sapiens
cccagctccctggtatttgtgc

SEQ ID NO: 9265913 - DNA, 18 bp, Homo sapiens
cccagctccacttccctc

SEQ ID NO: 9265914 - DNA, 18 bp, Homo sapiens
cccagctccacttccctc

SEQ ID NO: 9265915 - DNA, 18 bp, Homo sapiens
cccagctccacttccctc

SEQ ID NO: 9265916 - DNA, 22 bp, Homo sapiens
cccagctccagagccagaaaca

SEQ ID NO: 9265917 - DNA, 18 bp, Homo sapiens
cccagctccacttccctc

SEQ ID NO: 9265918 - DNA, 22 bp, Homo sapiens
cccagctccagagccagaaaca

SEQ ID NO: 9265919 - DNA, 22 bp, Homo sapiens
cccagctccagagccagaaaca

SEQ ID NO: 9265920 - DNA, 22 bp, Homo sapiens
cccagctccagagccagaaaca

SEQ ID NO: 9265921 - DNA, 22 bp, Homo sapiens
cccagctcccaagttgctatgg

SEQ ID NO: 9265922 - DNA, 22 bp, Homo sapiens
cccagctcccaagttgctatgg

SEQ ID NO: 9265923 - DNA, 22 bp, Homo sapiens
cccagctcccatgttctccaat

SEQ ID NO: 9265924 - DNA, 22 bp, Homo sapiens
cccagctcccatgttctccaat

SEQ ID NO: 9265925 - DNA, 22 bp, Homo sapiens
cccaggactcttcactgcagcc

SEQ ID NO: 9265926 - DNA, 22 bp, Homo sapiens
cccaggagaatataatgttctt

SEQ ID NO: 9265927 - DNA, 21 bp, Homo sapiens
cccaggagaagaaaagatgca

SEQ ID NO: 9265928 - DNA, 22 bp, Homo sapiens
cccagctcaagcagagagctaa

SEQ ID NO: 9265929 - DNA, 22 bp, Homo sapiens
cccagctcaagcagagagctaa

SEQ ID NO: 9265930 - DNA, 22 bp, Homo sapiens
cccagctcatcaggagccgccc

SEQ ID NO: 9265931 - DNA, 22 bp, Homo sapiens
cccagctcatcaggagccgccc

SEQ ID NO: 9265932 - DNA, 22 bp, Homo sapiens
cccagctccaagggacagcgaa

SEQ ID NO: 9265933 - DNA, 22 bp, Homo sapiens
cccagctccaagggacagcgaa

SEQ ID NO: 9265934 - DNA, 22 bp, Homo sapiens
cccagctccaagggacagcgaa

SEQ ID NO: 9265935 - DNA, 22 bp, Homo sapiens
cccagctccaagggacagcgaa

SEQ ID NO: 9265936 - DNA, 18 bp, Homo sapiens
cccagctccacttccctc

SEQ ID NO: 9265937 - DNA, 18 bp, Homo sapiens
cccagctccacttccctc

SEQ ID NO: 9265938 - DNA, 22 bp, Homo sapiens
tgcagtggaagaggtggagatc

SEQ ID NO: 9265939 - DNA, 22 bp, Homo sapiens
tgcagtggaatctggagagcag

SEQ ID NO: 9265940 - DNA, 22 bp, Homo sapiens
tgcagtggaatctggagagcag

SEQ ID NO: 9265941 - DNA, 22 bp, Homo sapiens
tgcagtggaggccgtgagacag

SEQ ID NO: 9265942 - DNA, 22 bp, Homo sapiens
tgcagtggaggccgtgagacag

SEQ ID NO: 9265943 - DNA, 22 bp, Homo sapiens
tgcagtgcctcggcagtgcagc

SEQ ID NO: 9265944 - DNA, 22 bp, Homo sapiens
tgcagtggaagaggtggagatc

SEQ ID NO: 9265945 - DNA, 22 bp, Homo sapiens
tgcagtggaaagactcagactt

SEQ ID NO: 9265946 - DNA, 22 bp, Homo sapiens
tgcagtcttccagctgcacaaa

SEQ ID NO: 9265947 - DNA, 22 bp, Homo sapiens
tgcagtctggatgtcctcagat

SEQ ID NO: 9265948 - DNA, 22 bp, Homo sapiens
cccagcatctccaggcatggcc

SEQ ID NO: 9265949 - DNA, 22 bp, Homo sapiens
cccagcatctccaggcatggcc

SEQ ID NO: 9265950 - DNA, 22 bp, Homo sapiens
cccagcaggtgccatcactctg

SEQ ID NO: 9265951 - DNA, 22 bp, Homo sapiens
cccagcatggagtgaggactca

SEQ ID NO: 9265952 - DNA, 22 bp, Homo sapiens
cccagccaaggtgctggtgttg

SEQ ID NO: 9265953 - DNA, 22 bp, Homo sapiens
cccagccaaggtgctggtgttg

SEQ ID NO: 9265954 - DNA, 22 bp, Homo sapiens
cccagcatttctgggctgcact

SEQ ID NO: 9265955 - DNA, 22 bp, Homo sapiens
cccagcatttctgggctgcact

SEQ ID NO: 9265956 - DNA, 22 bp, Homo sapiens
cccagccagcctcttcccatat

SEQ ID NO: 9265957 - DNA, 22 bp, Homo sapiens
cccagcaggtcggtgctgcctg

SEQ ID NO: 9265958 - DNA, 22 bp, Homo sapiens
tgcagcattagtacaagtctca

SEQ ID NO: 9265959 - DNA, 22 bp, Homo sapiens
tgcagcatccatatattattag

SEQ ID NO: 9265960 - DNA, 22 bp, Homo sapiens
cccagccctgacctattggaaa

SEQ ID NO: 9265961 - DNA, 20 bp, Homo sapiens
cccagcccctacctgttgcc

SEQ ID NO: 9265962 - DNA, 22 bp, Homo sapiens
cccagcccagcgttcgaggggt

SEQ ID NO: 9265963 - DNA, 22 bp, Homo sapiens
cccagcccccgagtgtctggaa

SEQ ID NO: 9265964 - DNA, 22 bp, Homo sapiens
cccagcccagcgttcgaggggt

SEQ ID NO: 9265965 - DNA, 22 bp, Homo sapiens
cccagcccacggtcctgggtgg

SEQ ID NO: 9265966 - DNA, 22 bp, Homo sapiens
cccagccagcctcttcccatat

SEQ ID NO: 9265967 - DNA, 18 bp, Homo sapiens
cccagcccaccatttctc

SEQ ID NO: 9265968 - DNA, 19 bp, Homo sapiens
cccaggagtctggctggtt

SEQ ID NO: 9265969 - DNA, 20 bp, Homo sapiens
cccaggagtgagcagcttta

SEQ ID NO: 9265970 - DNA, 20 bp, Homo sapiens
cccaggagtgagcagcttta

SEQ ID NO: 9265971 - DNA, 22 bp, Homo sapiens
tgccctggttacactggagtcc

SEQ ID NO: 9265972 - DNA, 20 bp, Homo sapiens
cccaggagtgagcagcttta

SEQ ID NO: 9265973 - DNA, 20 bp, Homo sapiens
cccaggagtgagcagcttta

SEQ ID NO: 9265974 - DNA, 22 bp, Homo sapiens
tgcctcagtctaaagtctctca

SEQ ID NO: 9265975 - DNA, 22 bp, Homo sapiens
tgcctcagtctaaagtctctca

SEQ ID NO: 9265976 - DNA, 22 bp, Homo sapiens
tgcctcagtttcatctgcagaa

SEQ ID NO: 9265977 - DNA, 23 bp, Homo sapiens
tgcctcagtggaatgtgagggtg

SEQ ID NO: 9265978 - DNA, 23 bp, Homo sapiens
tgcctcagtggaatgtgagggtg

SEQ ID NO: 9265979 - DNA, 22 bp, Homo sapiens
cccaggaggttgaggctgcagt

SEQ ID NO: 9265980 - DNA, 19 bp, Homo sapiens
tgccctgcacgctgtcctg

SEQ ID NO: 9265981 - DNA, 22 bp, Homo sapiens
cccaggaggttgaggctgcagt

SEQ ID NO: 9265982 - DNA, 22 bp, Homo sapiens
cccaggaggttgaggctgcagt

SEQ ID NO: 9265983 - DNA, 22 bp, Homo sapiens
cccaggaggttggggctacagt

SEQ ID NO: 9265984 - DNA, 19 bp, Homo sapiens
cccaggagtctggctggtt

SEQ ID NO: 9265985 - DNA, 19 bp, Homo sapiens
cccaggagtctggctggtt

SEQ ID NO: 9265986 - DNA, 19 bp, Homo sapiens
cccaggagtctggctggtt

SEQ ID NO: 9265987 - DNA, 21 bp, Homo sapiens
cccaggagtcctatttaaatg

SEQ ID NO: 9265988 - DNA, 22 bp, Homo sapiens
cccaggaggttggggctacagt

SEQ ID NO: 9265989 - DNA, 22 bp, Homo sapiens
cccaggaggttggggctacagt

SEQ ID NO: 9265990 - DNA, 22 bp, Homo sapiens
cccaggagtaagtgacattgtt

SEQ ID NO: 9265991 - DNA, 22 bp, Homo sapiens
cccaggagtaagtgacattgtt

SEQ ID NO: 9265992 - DNA, 22 bp, Homo sapiens
tgccctcattataagaggctca

SEQ ID NO: 9265993 - DNA, 23 bp, Homo sapiens
tgccctcccaatgcttcggtcac

SEQ ID NO: 9265994 - DNA, 22 bp, Homo sapiens
tgccctccacagtggctccacc

SEQ ID NO: 9265995 - DNA, 22 bp, Homo sapiens
tgccctcctcctgagcccatgt

SEQ ID NO: 9265996 - DNA, 22 bp, Homo sapiens
cccaggaggcggaggttgcagt

SEQ ID NO: 9265997 - DNA, 22 bp, Homo sapiens
cccaggaggcggaggttgcagt

SEQ ID NO: 9265998 - DNA, 22 bp, Homo sapiens
cccaggaggcggaggttgcagt

SEQ ID NO: 9265999 - DNA, 22 bp, Homo sapiens
cccaggaggcggaggttgcagt

SEQ ID NO: 9266000 - DNA, 19 bp, Homo sapiens
cccaggaggcggaggttgc

SEQ ID NO: 9266001 - DNA, 22 bp, Homo sapiens
cccaggaggcggaggttgtggt

SEQ ID NO: 9266002 - DNA, 22 bp, Homo sapiens
cccaggaggcggaggttgtggt

SEQ ID NO: 9266003 - DNA, 21 bp, Homo sapiens
cccaggaggctgagaagagca

SEQ ID NO: 9266004 - DNA, 21 bp, Homo sapiens
cccaggaggctgagaagagca

SEQ ID NO: 9266005 - DNA, 22 bp, Homo sapiens
tgccctcagcagcagctcctgc

SEQ ID NO: 9266006 - DNA, 22 bp, Homo sapiens
cccaggagatctggatctcgtc

SEQ ID NO: 9266007 - DNA, 22 bp, Homo sapiens
cccaggagatctggatctcgtc

SEQ ID NO: 9266008 - DNA, 22 bp, Homo sapiens
cccaggaggacattccataccc

SEQ ID NO: 9266009 - DNA, 21 bp, Homo sapiens
cccaggaggagctccggctcc

SEQ ID NO: 9266010 - DNA, 21 bp, Homo sapiens
cccaggaggagctccggctcc

SEQ ID NO: 9266011 - DNA, 22 bp, Homo sapiens
cccaggaggacattccataccc

SEQ ID NO: 9266012 - DNA, 22 bp, Homo sapiens
tgcatattttctgattcagaag

SEQ ID NO: 9266013 - DNA, 22 bp, Homo sapiens
cccaggagataacgttcccaag

SEQ ID NO: 9266014 - DNA, 22 bp, Homo sapiens
cccaggagataacgttcccaag

SEQ ID NO: 9266015 - DNA, 22 bp, Homo sapiens
tgcatatttgtatgatgtttag

SEQ ID NO: 9266016 - DNA, 22 bp, Homo sapiens
tgcatatttgattgagatacct

SEQ ID NO: 9266017 - DNA, 22 bp, Homo sapiens
tgcatatttgtatgatgtttag

SEQ ID NO: 9266018 - DNA, 22 bp, Homo sapiens
tgcatattttataaagatggaa

SEQ ID NO: 9266019 - DNA, 22 bp, Homo sapiens
tgcatattgtccttgatattat

SEQ ID NO: 9266020 - DNA, 21 bp, Homo sapiens
tgcatattcttctggtggctg

SEQ ID NO: 9266021 - DNA, 22 bp, Homo sapiens
tgcatattgtccttgatattat

SEQ ID NO: 9266022 - DNA, 22 bp, Homo sapiens
tgcatattgtgaaaatgtagat

SEQ ID NO: 9266023 - DNA, 22 bp, Homo sapiens
tgcatatatttgagattatggc

SEQ ID NO: 9266024 - DNA, 22 bp, Homo sapiens
tgcatattctcctttattttgt

SEQ ID NO: 9266025 - DNA, 22 bp, Homo sapiens
tgcatattctcctttattttgt

SEQ ID NO: 9266026 - DNA, 22 bp, Homo sapiens
tgcatattataaagagaattag

SEQ ID NO: 9266027 - DNA, 22 bp, Homo sapiens
tgcatattatgtgtatctgtct

SEQ ID NO: 9266028 - DNA, 22 bp, Homo sapiens
cccaggagacagaaacagaggt

SEQ ID NO: 9266029 - DNA, 22 bp, Homo sapiens
cccaggagacagaaacagaggt

SEQ ID NO: 9266030 - DNA, 22 bp, Homo sapiens
cccaggagaatatttttgggtc

SEQ ID NO: 9266031 - DNA, 22 bp, Homo sapiens
cccaggagacagaaacagaggt

SEQ ID NO: 9266032 - DNA, 21 bp, Homo sapiens
tgcatatataagtgcatacac

SEQ ID NO: 9266033 - DNA, 22 bp, Homo sapiens
cccaggagacagaaacagaggt

SEQ ID NO: 9266034 - DNA, 22 bp, Homo sapiens
cccaggagacagaaacagaggt

SEQ ID NO: 9266035 - DNA, 22 bp, Homo sapiens
cccaggaggcctgcctggccgg

SEQ ID NO: 9266036 - DNA, 22 bp, Homo sapiens
cccaggaggcctgcctggccgg

SEQ ID NO: 9266037 - DNA, 22 bp, Homo sapiens
cccaggaggcgcaggttgcggt

SEQ ID NO: 9266038 - DNA, 22 bp, Homo sapiens
cccaggaggcgcaggttgcggt

SEQ ID NO: 9266039 - DNA, 22 bp, Homo sapiens
cccaggaggccaaggttgcagt

SEQ ID NO: 9266040 - DNA, 22 bp, Homo sapiens
cccaggaggccaaggttgcagt

SEQ ID NO: 9266041 - DNA, 22 bp, Homo sapiens
cccaggaggccaaggttgcagt

SEQ ID NO: 9266042 - DNA, 22 bp, Homo sapiens
cccaggaggccaaggttgcagt

SEQ ID NO: 9266043 - DNA, 22 bp, Homo sapiens
cccaggaggcagaggttggagc

SEQ ID NO: 9266044 - DNA, 22 bp, Homo sapiens
cccaggaggcagaggttggagc

SEQ ID NO: 9266045 - DNA, 22 bp, Homo sapiens
cccaggaggcagatgttgcagt

SEQ ID NO: 9266046 - DNA, 22 bp, Homo sapiens
cccaggaggcagaggttgcagt

SEQ ID NO: 9266047 - DNA, 22 bp, Homo sapiens
cccaggaggcagaggttgcagt

SEQ ID NO: 9266048 - DNA, 22 bp, Homo sapiens
cccaggaggcagaggttgcagt

SEQ ID NO: 9266049 - DNA, 22 bp, Homo sapiens
cccaggaggcagaggttgcagt

SEQ ID NO: 9266050 - DNA, 22 bp, Homo sapiens
cccaggaggaggaaaaagctcg

SEQ ID NO: 9266051 - DNA, 21 bp, Homo sapiens
cccaggaggagctccggctcc

SEQ ID NO: 9266052 - DNA, 22 bp, Homo sapiens
cccaggaggcagaagttgcagt

SEQ ID NO: 9266053 - DNA, 22 bp, Homo sapiens
cccaggaggcagaagttgcagt

SEQ ID NO: 9266054 - DNA, 22 bp, Homo sapiens
cccaggaggcagaagttgcagt

SEQ ID NO: 9266055 - DNA, 22 bp, Homo sapiens
cccaggaggcagaagttgcagt

SEQ ID NO: 9266056 - DNA, 22 bp, Homo sapiens
cccaggaggcagagatagcagt

SEQ ID NO: 9266057 - DNA, 22 bp, Homo sapiens
cccaggaggcagagatagcagt

SEQ ID NO: 9266058 - DNA, 22 bp, Homo sapiens
cccaggaggcagagatagcagt

SEQ ID NO: 9266059 - DNA, 22 bp, Homo sapiens
cccaggaggcagagcttgcagt

SEQ ID NO: 9266060 - DNA, 22 bp, Homo sapiens
cccaggaggcagagcttgcagt

SEQ ID NO: 9266061 - DNA, 22 bp, Homo sapiens
cccaggaggcagagcttgcagt

SEQ ID NO: 9266062 - DNA, 22 bp, Homo sapiens
cccaggaggcagagcttgcagt

SEQ ID NO: 9266063 - DNA, 22 bp, Homo sapiens
ttggagtgacagatgaggaaac

SEQ ID NO: 9266064 - DNA, 22 bp, Homo sapiens
ttggataaaaatgtttaagtgt

SEQ ID NO: 9266065 - DNA, 22 bp, Homo sapiens
ttggatcaaatttcatgctgtc

SEQ ID NO: 9266066 - DNA, 22 bp, Homo sapiens
ttggaggttattaacactggcc

SEQ ID NO: 9266067 - DNA, 22 bp, Homo sapiens
ttggaggtttcccaactgtggg

SEQ ID NO: 9266068 - DNA, 22 bp, Homo sapiens
ttggatccatctcaggcatagg

SEQ ID NO: 9266069 - DNA, 22 bp, Homo sapiens
ttggatcatggaatgtctgctt

SEQ ID NO: 9266070 - DNA, 22 bp, Homo sapiens
ctccactcaacaagcccagtgt

SEQ ID NO: 9266071 - DNA, 22 bp, Homo sapiens
ctccactcaacaagcccagtgt

SEQ ID NO: 9266072 - DNA, 18 bp, Homo sapiens
ctccagagctgtgagaca

SEQ ID NO: 9266073 - DNA, 22 bp, Homo sapiens
ttggagggacagatggctaggc

SEQ ID NO: 9266074 - DNA, 22 bp, Homo sapiens
ttggaggggccactgcagagct

SEQ ID NO: 9266075 - DNA, 22 bp, Homo sapiens
ttggaaggggcagagtggctgc

SEQ ID NO: 9266076 - DNA, 22 bp, Homo sapiens
ttggaagggatattggcatatg

SEQ ID NO: 9266077 - DNA, 22 bp, Homo sapiens
ttggaaaatgaggcacagagag

SEQ ID NO: 9266078 - DNA, 22 bp, Homo sapiens
ttggaaaagtgaaactagatgc

SEQ ID NO: 9266079 - DNA, 22 bp, Homo sapiens
ctcagtctgtcttgtctgtgtt

SEQ ID NO: 9266080 - DNA, 22 bp, Homo sapiens
ctcagtctgtcttgtctgtgtt

SEQ ID NO: 9266081 - DNA, 22 bp, Homo sapiens
ttggaagcagtgtacactgtac

SEQ ID NO: 9266082 - DNA, 22 bp, Homo sapiens
ttggaagattacttagttttct

SEQ ID NO: 9266083 - DNA, 22 bp, Homo sapiens
ttggaagatctaacagaggcat

SEQ ID NO: 9266084 - DNA, 20 bp, Homo sapiens
ttggctctgatcagtggagc

SEQ ID NO: 9266085 - DNA, 22 bp, Homo sapiens
ctccagaggatgcaggtgaggg

SEQ ID NO: 9266086 - DNA, 22 bp, Homo sapiens
ctccagaggtccccgcggcact

SEQ ID NO: 9266087 - DNA, 22 bp, Homo sapiens
ttggctgagagctgctctgcag

SEQ ID NO: 9266088 - DNA, 22 bp, Homo sapiens
ttggctgaatgaggtcaccttt

SEQ ID NO: 9266089 - DNA, 22 bp, Homo sapiens
ttggctctttcctcacacagga

SEQ ID NO: 9266090 - DNA, 22 bp, Homo sapiens
ttggctgccttcacccctggcc

SEQ ID NO: 9266091 - DNA, 22 bp, Homo sapiens
ctccagcctcatctcctggctg

SEQ ID NO: 9266092 - DNA, 22 bp, Homo sapiens
ctccaggacactaacccaggct

SEQ ID NO: 9266093 - DNA, 22 bp, Homo sapiens
ttggctgatgcaagagcttcct

SEQ ID NO: 9266094 - DNA, 22 bp, Homo sapiens
ctccaggacccagtggctccag

SEQ ID NO: 9266095 - DNA, 22 bp, Homo sapiens
ctccaggactcaggcccctggg

SEQ ID NO: 9266096 - DNA, 22 bp, Homo sapiens
ctccaggaccagggctcctgga

SEQ ID NO: 9266097 - DNA, 22 bp, Homo sapiens
ctccaggacagattcagggcca

SEQ ID NO: 9266098 - DNA, 22 bp, Homo sapiens
ttgccctgtctcactatgttaa

SEQ ID NO: 9266099 - DNA, 22 bp, Homo sapiens
ttgccctgtcagtagaagtgca

SEQ ID NO: 9266100 - DNA, 22 bp, Homo sapiens
ttgccctgtcttaagctggcaa

SEQ ID NO: 9266101 - DNA, 22 bp, Homo sapiens
ttgccctgcctccctgaggtga

SEQ ID NO: 9266102 - DNA, 22 bp, Homo sapiens
ttgccctgaagaacgtcccaga

SEQ ID NO: 9266103 - DNA, 21 bp, Homo sapiens
ttgcccctgagtttttctgag

SEQ ID NO: 9266104 - DNA, 22 bp, Homo sapiens
ttgcatatgaagctgacttaaa

SEQ ID NO: 9266105 - DNA, 22 bp, Homo sapiens
ttgcatcagaaaatatgggaag

SEQ ID NO: 9266106 - DNA, 22 bp, Homo sapiens
ttgcatatcctccaacacatgg

SEQ ID NO: 9266107 - DNA, 22 bp, Homo sapiens
ttgcatatatttctaaggaggt

SEQ ID NO: 9266108 - DNA, 22 bp, Homo sapiens
ttgcatatgaagctgacttaaa

SEQ ID NO: 9266109 - DNA, 22 bp, Homo sapiens
ttgcatatcctccaacacatgg

SEQ ID NO: 9266110 - DNA, 22 bp, Homo sapiens
ttgcatatcctccaacacatgg

SEQ ID NO: 9266111 - DNA, 22 bp, Homo sapiens
ttgcatcagtcctcaataaaat

SEQ ID NO: 9266112 - DNA, 22 bp, Homo sapiens
ttgcccagagtccacagcgtac

SEQ ID NO: 9266113 - DNA, 18 bp, Homo sapiens
ctcagggtgaccaatgca

SEQ ID NO: 9266114 - DNA, 22 bp, Homo sapiens
ctcaggtcgctatttctcttac

SEQ ID NO: 9266115 - DNA, 22 bp, Homo sapiens
ctcaggtcacggatctgagctg

SEQ ID NO: 9266116 - DNA, 20 bp, Homo sapiens
ctcagtaaaagcacagggtc

SEQ ID NO: 9266117 - DNA, 22 bp, Homo sapiens
ctcagtaaggatgcttcagcgg

SEQ ID NO: 9266118 - DNA, 22 bp, Homo sapiens
ctcagggctctgcatgcacacg

SEQ ID NO: 9266119 - DNA, 23 bp, Homo sapiens
ctcagggatagaaaggaagacag

SEQ ID NO: 9266120 - DNA, 22 bp, Homo sapiens
ctcagggaattgaatctccttg

SEQ ID NO: 9266121 - DNA, 22 bp, Homo sapiens
ctcagggaattatttctgtcct

SEQ ID NO: 9266122 - DNA, 22 bp, Homo sapiens
ctcagggatggtgaagcaccca

SEQ ID NO: 9266123 - DNA, 22 bp, Homo sapiens
ctcagggatgggcagatgttaa

SEQ ID NO: 9266124 - DNA, 22 bp, Homo sapiens
ttgcagaaaacagttttcttgt

SEQ ID NO: 9266125 - DNA, 22 bp, Homo sapiens
ttgcagttgtttagaatatgtg

SEQ ID NO: 9266126 - DNA, 22 bp, Homo sapiens
ttgcagtttatgttcctgcagt

SEQ ID NO: 9266127 - DNA, 22 bp, Homo sapiens
ttgcagttgtctttcctaattt

SEQ ID NO: 9266128 - DNA, 22 bp, Homo sapiens
ttgcagttgttgccttccctga

SEQ ID NO: 9266129 - DNA, 19 bp, Homo sapiens
ttgcagttgggtggggagt

SEQ ID NO: 9266130 - DNA, 22 bp, Homo sapiens
ttgcagttgctttctatattga

SEQ ID NO: 9266131 - DNA, 22 bp, Homo sapiens
ttgcagttgctgtatttaagga

SEQ ID NO: 9266132 - DNA, 22 bp, Homo sapiens
ttgcataaagattttattgcat

SEQ ID NO: 9266133 - DNA, 22 bp, Homo sapiens
ttgcataaaagagtatatctta

SEQ ID NO: 9266134 - DNA, 22 bp, Homo sapiens
ttgcataaaagagtatatctta

SEQ ID NO: 9266135 - DNA, 22 bp, Homo sapiens
ttgcagttttctgcctcatttc

SEQ ID NO: 9266136 - DNA, 22 bp, Homo sapiens
ttgcagttttgacagaccaaat

SEQ ID NO: 9266137 - DNA, 22 bp, Homo sapiens
ttgcagtttgtggcaactttga

SEQ ID NO: 9266138 - DNA, 22 bp, Homo sapiens
ttgcagtttctggatgccttct

SEQ ID NO: 9266139 - DNA, 22 bp, Homo sapiens
ttgcagtttgcttttaatggga

SEQ ID NO: 9266140 - DNA, 22 bp, Homo sapiens
ttgcataaatgcttaaaatttg

SEQ ID NO: 9266141 - DNA, 22 bp, Homo sapiens
ttgcataaagattttattgcat

SEQ ID NO: 9266142 - DNA, 22 bp, Homo sapiens
ttgcatagtgctgaggttcggg

SEQ ID NO: 9266143 - DNA, 22 bp, Homo sapiens
ttgcataatagctacccactca

SEQ ID NO: 9266144 - DNA, 22 bp, Homo sapiens
ttgcataaatgcttaaaatttg

SEQ ID NO: 9266145 - DNA, 22 bp, Homo sapiens
ttgcataacagccattaaagta

SEQ ID NO: 9266146 - DNA, 22 bp, Homo sapiens
ctcaggaggaggaagttcattg

SEQ ID NO: 9266147 - DNA, 22 bp, Homo sapiens
ctcaggaggatgactgccttgg

SEQ ID NO: 9266148 - DNA, 22 bp, Homo sapiens
ctcagctggcaattctggctcc

SEQ ID NO: 9266149 - DNA, 19 bp, Homo sapiens
ctcagctgtagctcatgtg

SEQ ID NO: 9266150 - DNA, 22 bp, Homo sapiens
ctcagccccaatttgccctctt

SEQ ID NO: 9266151 - DNA, 22 bp, Homo sapiens
ctcaggaaaggccatgcaaggg

SEQ ID NO: 9266152 - DNA, 22 bp, Homo sapiens
ctcaggaaaatattgaagaagt

SEQ ID NO: 9266153 - DNA, 22 bp, Homo sapiens
ctcagcttctacctcctgagtg

SEQ ID NO: 9266154 - DNA, 22 bp, Homo sapiens
ctcaggagatgacagaaggtat

SEQ ID NO: 9266155 - DNA, 22 bp, Homo sapiens
ctcaggacccggtccaggtggg

SEQ ID NO: 9266156 - DNA, 22 bp, Homo sapiens
ctcaggaaggaagcagggagcc

SEQ ID NO: 9266157 - DNA, 22 bp, Homo sapiens
ttctattgcacacaaataatta

SEQ ID NO: 9266158 - DNA, 22 bp, Homo sapiens
ttctattgacattcactgtaac

SEQ ID NO: 9266159 - DNA, 22 bp, Homo sapiens
ttctattgaatgataatctata

SEQ ID NO: 9266160 - DNA, 22 bp, Homo sapiens
ttctattgggcagcattgcttc

SEQ ID NO: 9266161 - DNA, 22 bp, Homo sapiens
ttctattgcacacaaataatta

SEQ ID NO: 9266162 - DNA, 22 bp, Homo sapiens
ttctattgtaccttttctctca

SEQ ID NO: 9266163 - DNA, 22 bp, Homo sapiens
ttctatgtggatatagaactgc

SEQ ID NO: 9266164 - DNA, 22 bp, Homo sapiens
ttctatgttctaagtctcaagg

SEQ ID NO: 9266165 - DNA, 22 bp, Homo sapiens
ttctatgtgttgacaagcctga

SEQ ID NO: 9266166 - DNA, 22 bp, Homo sapiens
ttctatgtggcatcaagctcag

SEQ ID NO: 9266167 - DNA, 22 bp, Homo sapiens
ttctatgtggatatagaactgc

SEQ ID NO: 9266168 - DNA, 22 bp, Homo sapiens
ttctatgtggatatagaactgc

SEQ ID NO: 9266169 - DNA, 22 bp, Homo sapiens
ttctatgtgctggagaatattt

SEQ ID NO: 9266170 - DNA, 22 bp, Homo sapiens
ttctatgtgctggagaatattt

SEQ ID NO: 9266171 - DNA, 22 bp, Homo sapiens
ttctatgtgctggagaatattt

SEQ ID NO: 9266172 - DNA, 22 bp, Homo sapiens
ttctatgtcagtgtgctctgtg

SEQ ID NO: 9266173 - DNA, 22 bp, Homo sapiens
ttctatgtagtagcagagccaa

SEQ ID NO: 9266174 - DNA, 22 bp, Homo sapiens
ttctatgtagataaggctgctc

SEQ ID NO: 9266175 - DNA, 22 bp, Homo sapiens
ttctgcaggagccctagtgtat

SEQ ID NO: 9266176 - DNA, 22 bp, Homo sapiens
ttctgcatacactgaatgtagt

SEQ ID NO: 9266177 - DNA, 22 bp, Homo sapiens
ttctgaaggctcctcaggaaag

SEQ ID NO: 9266178 - DNA, 22 bp, Homo sapiens
ttctgaaggctcctcaggaaag

SEQ ID NO: 9266179 - DNA, 22 bp, Homo sapiens
ttctgcagcccaacagtagttt

SEQ ID NO: 9266180 - DNA, 22 bp, Homo sapiens
ttctatttccagtccttcagag

SEQ ID NO: 9266181 - DNA, 23 bp, Homo sapiens
ttctggatgttctagtctgagag

SEQ ID NO: 9266182 - DNA, 22 bp, Homo sapiens
ttctggaagctgcaggtggccg

SEQ ID NO: 9266183 - DNA, 22 bp, Homo sapiens
ttctgcatggagaaactgagtc

SEQ ID NO: 9266184 - DNA, 22 bp, Homo sapiens
ttctgcatctgaatttaagtac

SEQ ID NO: 9266185 - DNA, 22 bp, Homo sapiens
ctaaaaatccacactaggtgaa

SEQ ID NO: 9266186 - DNA, 22 bp, Homo sapiens
ctagagaaacgccgtgggagga

SEQ ID NO: 9266187 - DNA, 22 bp, Homo sapiens
ctagagaacaacattcatatgg

SEQ ID NO: 9266188 - DNA, 22 bp, Homo sapiens
ctagagaagaggttaagcatga

SEQ ID NO: 9266189 - DNA, 22 bp, Homo sapiens
ctagagaatcttttaagaagtg

SEQ ID NO: 9266190 - DNA, 22 bp, Homo sapiens
ctagagaatcttttaagaagtg

SEQ ID NO: 9266191 - DNA, 22 bp, Homo sapiens
ctagaaatattttacagtcaag

SEQ ID NO: 9266192 - DNA, 22 bp, Homo sapiens
ctagagaaaatgatagcaggaa

SEQ ID NO: 9266193 - DNA, 22 bp, Homo sapiens
ctagagaaacagtgctctgaac

SEQ ID NO: 9266194 - DNA, 22 bp, Homo sapiens
ctaaaaatccacactaggtgaa

SEQ ID NO: 9266195 - DNA, 22 bp, Homo sapiens
ttctatgattcatttagaagtt

SEQ ID NO: 9266196 - DNA, 19 bp, Homo sapiens
ctagagtaataagtacttt

SEQ ID NO: 9266197 - DNA, 22 bp, Homo sapiens
ctagagctgttctgtgcactca

SEQ ID NO: 9266198 - DNA, 22 bp, Homo sapiens
ctagagctattcaaggttttat

SEQ ID NO: 9266199 - DNA, 22 bp, Homo sapiens
ctagagaattgtcttgagagtt

SEQ ID NO: 9266200 - DNA, 20 bp, Homo sapiens
cgtgtgtggctattttgggt

SEQ ID NO: 9266201 - DNA, 22 bp, Homo sapiens
cgtgtggtcccggcaaggcaag

SEQ ID NO: 9266202 - DNA, 22 bp, Homo sapiens
cgtgtggtcccggcaaggcaag

SEQ ID NO: 9266203 - DNA, 22 bp, Homo sapiens
cgtgtggtcccggcaaggcaag

SEQ ID NO: 9266204 - DNA, 22 bp, Homo sapiens
cgtgtggtcccggcaaggcaag

SEQ ID NO: 9266205 - DNA, 22 bp, Homo sapiens
ctaaaaatccacactaggtgaa

SEQ ID NO: 9266206 - DNA, 23 bp, Homo sapiens
cgttttttcctcagatgttctgg

SEQ ID NO: 9266207 - DNA, 22 bp, Homo sapiens
cgtttattttgaagattccact

SEQ ID NO: 9266208 - DNA, 22 bp, Homo sapiens
cgttttcttcactttgcaagtt

SEQ ID NO: 9266209 - DNA, 22 bp, Homo sapiens
cgttttcatgggtagaggttct

SEQ ID NO: 9266210 - DNA, 22 bp, Homo sapiens
cgtgtgtgtacctgcgcattta

SEQ ID NO: 9266211 - DNA, 22 bp, Homo sapiens
cgtgtttcagccagggccacct

SEQ ID NO: 9266212 - DNA, 22 bp, Homo sapiens
ttctggccaaggctgccagatt

SEQ ID NO: 9266213 - DNA, 22 bp, Homo sapiens
ctataattatgctcaaaatgta

SEQ ID NO: 9266214 - DNA, 22 bp, Homo sapiens
ctataaatctacccagcattgg

SEQ ID NO: 9266215 - DNA, 22 bp, Homo sapiens
ctataaatctacccagcattgg

SEQ ID NO: 9266216 - DNA, 22 bp, Homo sapiens
ctataaatctacccagcattgg

SEQ ID NO: 9266217 - DNA, 22 bp, Homo sapiens
ctataaatctacccagcattgg

SEQ ID NO: 9266218 - DNA, 22 bp, Homo sapiens
ctcactgcaacctccgcctcct

SEQ ID NO: 9266219 - DNA, 22 bp, Homo sapiens
ctcactgcaacctctgcctccc

SEQ ID NO: 9266220 - DNA, 22 bp, Homo sapiens
ctcactgcaacctctgccccca

SEQ ID NO: 9266221 - DNA, 22 bp, Homo sapiens
ctcactgcaagctcagcctccc

SEQ ID NO: 9266222 - DNA, 22 bp, Homo sapiens
ctcactgcaagctcagcctccc

SEQ ID NO: 9266223 - DNA, 22 bp, Homo sapiens
ctcactgcaagctcagcctccc

SEQ ID NO: 9266224 - DNA, 22 bp, Homo sapiens
ctatacatcccaatttcagaga

SEQ ID NO: 9266225 - DNA, 22 bp, Homo sapiens
ctatacagcagcttactagtta

SEQ ID NO: 9266226 - DNA, 17 bp, Homo sapiens
ctcagagcaggacagaa

SEQ ID NO: 9266227 - DNA, 22 bp, Homo sapiens
ctcagagcccagggtacacccg

SEQ ID NO: 9266228 - DNA, 22 bp, Homo sapiens
ctcagagccagttagcaggtgc

SEQ ID NO: 9266229 - DNA, 17 bp, Homo sapiens
ctcagagcaggacagaa

SEQ ID NO: 9266230 - DNA, 22 bp, Homo sapiens
ctcagagcaatgaacatgcaaa

SEQ ID NO: 9266231 - DNA, 21 bp, Homo sapiens
ctcagagacaaatgccatccc

SEQ ID NO: 9266232 - DNA, 22 bp, Homo sapiens
ctcagagagttaagtgaattac

SEQ ID NO: 9266233 - DNA, 22 bp, Homo sapiens
ctcactgcaagctcagcctccc

SEQ ID NO: 9266234 - DNA, 22 bp, Homo sapiens
ttctttctctactagcagagct

SEQ ID NO: 9266235 - DNA, 22 bp, Homo sapiens
ctcactgcaagctccacctctt

SEQ ID NO: 9266236 - DNA, 22 bp, Homo sapiens
ttctttctctactagcagagct

SEQ ID NO: 9266237 - DNA, 22 bp, Homo sapiens
ttctttctctactagcagagct

SEQ ID NO: 9266238 - DNA, 22 bp, Homo sapiens
ttctttctctccacaaggcttg

SEQ ID NO: 9266239 - DNA, 22 bp, Homo sapiens
ttctttctctgtaaaaggaaaa

SEQ ID NO: 9266240 - DNA, 22 bp, Homo sapiens
ttctttctgggaagagttcaga

SEQ ID NO: 9266241 - DNA, 22 bp, Homo sapiens
ttctttctgggaagagttcaga

SEQ ID NO: 9266242 - DNA, 22 bp, Homo sapiens
ttctttctgggaagagttcaga

SEQ ID NO: 9266243 - DNA, 22 bp, Homo sapiens
ttctttctggggtccttcggct

SEQ ID NO: 9266244 - DNA, 21 bp, Homo sapiens
ttctttctgaatctgaagtat

SEQ ID NO: 9266245 - DNA, 22 bp, Homo sapiens
ttctttctgaatacagttgagt

SEQ ID NO: 9266246 - DNA, 22 bp, Homo sapiens
ttctttctgtcatggtgtactg

SEQ ID NO: 9266247 - DNA, 22 bp, Homo sapiens
ttctttctggggtccttcggct

SEQ ID NO: 9266248 - DNA, 22 bp, Homo sapiens
ctcagaaaggtgccatttatgt

SEQ ID NO: 9266249 - DNA, 22 bp, Homo sapiens
ttctttctgtccataatgagac

SEQ ID NO: 9266250 - DNA, 22 bp, Homo sapiens
ttctttctgtccataatgagac

SEQ ID NO: 9266251 - DNA, 22 bp, Homo sapiens
ctcagaaagggttgctgagggc

SEQ ID NO: 9266252 - DNA, 21 bp, Homo sapiens
ctcagagaaatgtctgggagc

SEQ ID NO: 9266253 - DNA, 22 bp, Homo sapiens
ccttagcattagaagctgtggg

SEQ ID NO: 9266254 - DNA, 22 bp, Homo sapiens
ccttagcatggctgtgctgtgt

SEQ ID NO: 9266255 - DNA, 22 bp, Homo sapiens
ccttagctggagtggtggaatg

SEQ ID NO: 9266256 - DNA, 22 bp, Homo sapiens
ttacaaagagtgccagagtgtg

SEQ ID NO: 9266257 - DNA, 22 bp, Homo sapiens
ccttagcaaattggcatcttct

SEQ ID NO: 9266258 - DNA, 22 bp, Homo sapiens
ccttagatcaggctgtctaggg

SEQ ID NO: 9266259 - DNA, 22 bp, Homo sapiens
ccttagaaggctgaataattct

SEQ ID NO: 9266260 - DNA, 22 bp, Homo sapiens
ccttagcaactgtcatagagca

SEQ ID NO: 9266261 - DNA, 22 bp, Homo sapiens
ccttagcaacacttagcaactg

SEQ ID NO: 9266262 - DNA, 22 bp, Homo sapiens
ccttagcagggagtctgtccag

SEQ ID NO: 9266263 - DNA, 22 bp, Homo sapiens
ccttagcagggccgggcctggg

SEQ ID NO: 9266264 - DNA, 22 bp, Homo sapiens
cctgtgtgtctgtcactgcaca

SEQ ID NO: 9266265 - DNA, 21 bp, Homo sapiens
cctgtgtgtgtccctttaaga

SEQ ID NO: 9266266 - DNA, 22 bp, Homo sapiens
cctgtttggtacaatctgccaa

SEQ ID NO: 9266267 - DNA, 22 bp, Homo sapiens
ccttacaatgcagtttacttag

SEQ ID NO: 9266268 - DNA, 22 bp, Homo sapiens
ccttacacctaaaatgagagtt

SEQ ID NO: 9266269 - DNA, 22 bp, Homo sapiens
ccttaaaagaactatctcttct

SEQ ID NO: 9266270 - DNA, 22 bp, Homo sapiens
ttacagtttacataagaattgt

SEQ ID NO: 9266271 - DNA, 22 bp, Homo sapiens
ttacagtttaccaagaatattg

SEQ ID NO: 9266272 - DNA, 22 bp, Homo sapiens
ttacagtttaagaggaaacaaa

SEQ ID NO: 9266273 - DNA, 21 bp, Homo sapiens
ttacagaatccatgggaagtc

SEQ ID NO: 9266274 - DNA, 22 bp, Homo sapiens
ttacagaagtttcagcgtttta

SEQ ID NO: 9266275 - DNA, 22 bp, Homo sapiens
ttacagttgcccccagcctcgc

SEQ ID NO: 9266276 - DNA, 22 bp, Homo sapiens
ttacagttgctacaaaggataa

SEQ ID NO: 9266277 - DNA, 21 bp, Homo sapiens
ttacagttgatggagtattcc

SEQ ID NO: 9266278 - DNA, 22 bp, Homo sapiens
ttacagttagaatctgatgaaa

SEQ ID NO: 9266279 - DNA, 22 bp, Homo sapiens
ttacaaagcaggtcagctgaaa

SEQ ID NO: 9266280 - DNA, 22 bp, Homo sapiens
ttacaaagattatattcagtta

SEQ ID NO: 9266281 - DNA, 22 bp, Homo sapiens
ttacaaagattatattcagtta

SEQ ID NO: 9266282 - DNA, 22 bp, Homo sapiens
ttacaaagcgttgagacaagta

SEQ ID NO: 9266283 - DNA, 22 bp, Homo sapiens
ttacaaagcgttgagacaagta

SEQ ID NO: 9266284 - DNA, 22 bp, Homo sapiens
ttacagaagtattgagagatcc

SEQ ID NO: 9266285 - DNA, 22 bp, Homo sapiens
ttacaaagcaggtcagctgaaa

SEQ ID NO: 9266286 - DNA, 22 bp, Homo sapiens
ttacaaagcaggtcagctgaaa

SEQ ID NO: 9266287 - DNA, 22 bp, Homo sapiens
ttacaaagcgctttacctctga

SEQ ID NO: 9266288 - DNA, 22 bp, Homo sapiens
ttaagatttgtagagaaaaagc

SEQ ID NO: 9266289 - DNA, 22 bp, Homo sapiens
ttaagattttcttcagtattat

SEQ ID NO: 9266290 - DNA, 22 bp, Homo sapiens
ttaagaggtggtcgtgtctgtg

SEQ ID NO: 9266291 - DNA, 22 bp, Homo sapiens
ttaagatagaacccagtagtct

SEQ ID NO: 9266292 - DNA, 22 bp, Homo sapiens
ttaagaggagatcatactggag

SEQ ID NO: 9266293 - DNA, 22 bp, Homo sapiens
ttaagagggtgatgctagcatt

SEQ ID NO: 9266294 - DNA, 22 bp, Homo sapiens
ttaagaggtgaggcctttaaga

SEQ ID NO: 9266295 - DNA, 22 bp, Homo sapiens
ttaagaggtgaggcctttaaga

SEQ ID NO: 9266296 - DNA, 22 bp, Homo sapiens
ttaagaggtggtcgtgtctgtg

SEQ ID NO: 9266297 - DNA, 22 bp, Homo sapiens
ttaagaggagatcatactggag

SEQ ID NO: 9266298 - DNA, 22 bp, Homo sapiens
ttaagagggtgatgctagcatt

SEQ ID NO: 9266299 - DNA, 22 bp, Homo sapiens
ttaaattcattccaacttttga

SEQ ID NO: 9266300 - DNA, 22 bp, Homo sapiens
ttaaattccagcctcataatag

SEQ ID NO: 9266301 - DNA, 22 bp, Homo sapiens
ttaaattgtcatttgagcaatg

SEQ ID NO: 9266302 - DNA, 22 bp, Homo sapiens
ttaaattccagcctcataatag

SEQ ID NO: 9266303 - DNA, 22 bp, Homo sapiens
ttaaattatttctagtgaggtg

SEQ ID NO: 9266304 - DNA, 22 bp, Homo sapiens
ttaaattatttctagtgaggtg

SEQ ID NO: 9266305 - DNA, 22 bp, Homo sapiens
ttaaattattgagggattgtca

SEQ ID NO: 9266306 - DNA, 22 bp, Homo sapiens
ttaaattatttctagtgaggtg

SEQ ID NO: 9266307 - DNA, 22 bp, Homo sapiens
tgtcagcagctggtttgctgtt

SEQ ID NO: 9266308 - DNA, 22 bp, Homo sapiens
ttaaattagtcaagcttctctg

SEQ ID NO: 9266309 - DNA, 22 bp, Homo sapiens
ttaaattagtcaagcttctctg

SEQ ID NO: 9266310 - DNA, 21 bp, Homo sapiens
tgtcagcaacaatactttctc

SEQ ID NO: 9266311 - DNA, 22 bp, Homo sapiens
tgtcaatagttttgagttctct

SEQ ID NO: 9266312 - DNA, 22 bp, Homo sapiens
ttagcaaatatcttgaaacagg

SEQ ID NO: 9266313 - DNA, 22 bp, Homo sapiens
ttagcaagaaagattgcagcac

SEQ ID NO: 9266314 - DNA, 22 bp, Homo sapiens
ttagcaattccaggtaagttat

SEQ ID NO: 9266315 - DNA, 22 bp, Homo sapiens
ttagcaagataacagtaatttt

SEQ ID NO: 9266316 - DNA, 22 bp, Homo sapiens
ttagcacaggcaactccacata

SEQ ID NO: 9266317 - DNA, 22 bp, Homo sapiens
ttagcaaactctgttagattct

SEQ ID NO: 9266318 - DNA, 18 bp, Homo sapiens
ccttcagctctgccagta

SEQ ID NO: 9266319 - DNA, 22 bp, Homo sapiens
ttagcaaatatcttgaaacagg

SEQ ID NO: 9266320 - DNA, 22 bp, Homo sapiens
ttagcaaagtttgccatctagt

SEQ ID NO: 9266321 - DNA, 21 bp, Homo sapiens
ttagcaaagcaaacacatgct

SEQ ID NO: 9266322 - DNA, 21 bp, Homo sapiens
ttagcaaagcaaacacatgct

SEQ ID NO: 9266323 - DNA, 21 bp, Homo sapiens
ttagcaaagcaaacacatgct

SEQ ID NO: 9266324 - DNA, 22 bp, Homo sapiens
ccttcagcctagaacttgagag

SEQ ID NO: 9266325 - DNA, 22 bp, Homo sapiens
ccttcagaatgaaattctaatg

SEQ ID NO: 9266326 - DNA, 23 bp, Homo sapiens
ccttcagaagaagtaacaggggc

SEQ ID NO: 9266327 - DNA, 22 bp, Homo sapiens
ccttcagaggtgtagattgcgt

SEQ ID NO: 9266328 - DNA, 22 bp, Homo sapiens
ttacataacggtatgaaaaatg

SEQ ID NO: 9266329 - DNA, 22 bp, Homo sapiens
ttacataacggtatgaaaaatg

SEQ ID NO: 9266330 - DNA, 22 bp, Homo sapiens
ttacataaaagttcacgtaggc

SEQ ID NO: 9266331 - DNA, 22 bp, Homo sapiens
ttacataaaagttcacgtaggc

SEQ ID NO: 9266332 - DNA, 22 bp, Homo sapiens
ttacataaaagttcacgtaggc

SEQ ID NO: 9266333 - DNA, 22 bp, Homo sapiens
ttacatacctcatagactcagg

SEQ ID NO: 9266334 - DNA, 22 bp, Homo sapiens
ttacataactttaaaatgccgt

SEQ ID NO: 9266335 - DNA, 22 bp, Homo sapiens
ttacataactttaaaatgccgt

SEQ ID NO: 9266336 - DNA, 22 bp, Homo sapiens
ttacatacttactagatctatg

SEQ ID NO: 9266337 - DNA, 22 bp, Homo sapiens
ttacatacttactagatctatg

SEQ ID NO: 9266338 - DNA, 22 bp, Homo sapiens
ttacatacttactagatctatg

SEQ ID NO: 9266339 - DNA, 22 bp, Homo sapiens
ccttgaaatgttctcactgggg

SEQ ID NO: 9266340 - DNA, 22 bp, Homo sapiens
ccttgaaatgagaaaaagttgg

SEQ ID NO: 9266341 - DNA, 22 bp, Homo sapiens
ccttgagccagggagctggcag

SEQ ID NO: 9266342 - DNA, 22 bp, Homo sapiens
ccttgcccgctgcctctgagtt

SEQ ID NO: 9266343 - DNA, 22 bp, Homo sapiens
ccttgcctcattgtgcttctcc

SEQ ID NO: 9266344 - DNA, 22 bp, Homo sapiens
ttagggaaacaaacattttctt

SEQ ID NO: 9266345 - DNA, 22 bp, Homo sapiens
ttagggaaagcagcattccctt

SEQ ID NO: 9266346 - DNA, 22 bp, Homo sapiens
ttagggaaataaaattatcagt

SEQ ID NO: 9266347 - DNA, 22 bp, Homo sapiens
ttagtttataattcatttctgt

SEQ ID NO: 9266348 - DNA, 22 bp, Homo sapiens
ttataaagattgttatgtatct

SEQ ID NO: 9266349 - DNA, 22 bp, Homo sapiens
ttagttttcccatctttatggt

SEQ ID NO: 9266350 - DNA, 22 bp, Homo sapiens
ttagttttcccatctttatggt

SEQ ID NO: 9266351 - DNA, 22 bp, Homo sapiens
ttagttttctcatctatctcac

SEQ ID NO: 9266352 - DNA, 22 bp, Homo sapiens
ttataaagtgagaagtgctatg

SEQ ID NO: 9266353 - DNA, 23 bp, Homo sapiens
ttataaatattttcaggtgtgtt

SEQ ID NO: 9266354 - DNA, 23 bp, Homo sapiens
ttataaatattttcaggtgtgtt

SEQ ID NO: 9266355 - DNA, 22 bp, Homo sapiens
ttataacactgccttgtcacca

SEQ ID NO: 9266356 - DNA, 22 bp, Homo sapiens
ttataacaacagtttactttaa

SEQ ID NO: 9266357 - DNA, 22 bp, Homo sapiens
ttataacaacagtttactttaa

SEQ ID NO: 9266358 - DNA, 22 bp, Homo sapiens
ttatcacttatgagctttttgc

SEQ ID NO: 9266359 - DNA, 22 bp, Homo sapiens
ttatcataagtaattgaaataa

SEQ ID NO: 9266360 - DNA, 22 bp, Homo sapiens
ttatccaaactggtgaatcatt

SEQ ID NO: 9266361 - DNA, 22 bp, Homo sapiens
ttatcatgggacctgaatttta

SEQ ID NO: 9266362 - DNA, 22 bp, Homo sapiens
ttatcattgtcgcagtctaatt

SEQ ID NO: 9266363 - DNA, 22 bp, Homo sapiens
ttatcattgtcgcagtctaatt

SEQ ID NO: 9266364 - DNA, 22 bp, Homo sapiens
ttatcatgggacctgaatttta

SEQ ID NO: 9266365 - DNA, 22 bp, Homo sapiens
ttatcataagtaattgaaataa

SEQ ID NO: 9266366 - DNA, 22 bp, Homo sapiens
ttatcatctcctgctgtggtta

SEQ ID NO: 9266367 - DNA, 22 bp, Homo sapiens
cgctgccaggtcaccaggggta

SEQ ID NO: 9266368 - DNA, 22 bp, Homo sapiens
cgctgccaggatcccctgccgg

SEQ ID NO: 9266369 - DNA, 22 bp, Homo sapiens
cgctgcagaagcgtgttcagga

SEQ ID NO: 9266370 - DNA, 22 bp, Homo sapiens
cgctgcagatgggagctggttg

SEQ ID NO: 9266371 - DNA, 22 bp, Homo sapiens
ttcaaagtaccgtacttaatgg

SEQ ID NO: 9266372 - DNA, 22 bp, Homo sapiens
ttcaaagtaccgtacttaatgg

SEQ ID NO: 9266373 - DNA, 22 bp, Homo sapiens
cgctgccttcatcccacgccta

SEQ ID NO: 9266374 - DNA, 20 bp, Homo sapiens
cgctccagtcgctggtgtgt

SEQ ID NO: 9266375 - DNA, 22 bp, Homo sapiens
ttatttcatgtaaaatttatgt

SEQ ID NO: 9266376 - DNA, 22 bp, Homo sapiens
cgcctcagccgtggtcatcttc

SEQ ID NO: 9266377 - DNA, 20 bp, Homo sapiens
ttatttcagttgctagattg

SEQ ID NO: 9266378 - DNA, 20 bp, Homo sapiens
ttatttcagttgctagattg

SEQ ID NO: 9266379 - DNA, 22 bp, Homo sapiens
ttatttcatataatgttatcaa

SEQ ID NO: 9266380 - DNA, 20 bp, Homo sapiens
ttatttcagttgctagattg

SEQ ID NO: 9266381 - DNA, 22 bp, Homo sapiens
ttatttatgttaacagtcgaga

SEQ ID NO: 9266382 - DNA, 22 bp, Homo sapiens
ttatttatgttaacagtcgaga

SEQ ID NO: 9266383 - DNA, 22 bp, Homo sapiens
ttatttattgtgtacctactgt

SEQ ID NO: 9266384 - DNA, 22 bp, Homo sapiens
ttatttattgtgtacctactgt

SEQ ID NO: 9266385 - DNA, 22 bp, Homo sapiens
ttattgcaactcctaaatagag

SEQ ID NO: 9266386 - DNA, 22 bp, Homo sapiens
ttattgcaactttagggataga

SEQ ID NO: 9266387 - DNA, 22 bp, Homo sapiens
ttattgcaactcctaaatagag

SEQ ID NO: 9266388 - DNA, 22 bp, Homo sapiens
ttattgcaccttcctcactaac

SEQ ID NO: 9266389 - DNA, 22 bp, Homo sapiens
ttattgcactattgattttcta

SEQ ID NO: 9266390 - DNA, 22 bp, Homo sapiens
ttattgcactattgattttcta

SEQ ID NO: 9266391 - DNA, 22 bp, Homo sapiens
ttattgcaccatgcctcagttt

SEQ ID NO: 9266392 - DNA, 23 bp, Homo sapiens
ttattgcaaggtaaaattgctga

SEQ ID NO: 9266393 - DNA, 23 bp, Homo sapiens
ttattgcaaggtaaaattgctga

SEQ ID NO: 9266394 - DNA, 23 bp, Homo sapiens
ttattgcaaggtaaaattgctga

SEQ ID NO: 9266395 - DNA, 22 bp, Homo sapiens
ttattgcagatggtgtgagaga

SEQ ID NO: 9266396 - DNA, 17 bp, Homo sapiens
ttattgcagtgctgaag

SEQ ID NO: 9266397 - DNA, 22 bp, Homo sapiens
ttattgcagccgcagggcgctg

SEQ ID NO: 9266398 - DNA, 22 bp, Homo sapiens
ttattgcagatggtgtgagaga

SEQ ID NO: 9266399 - DNA, 22 bp, Homo sapiens
ttattgcctgtcattattgaat

SEQ ID NO: 9266400 - DNA, 22 bp, Homo sapiens
ttattgcatagattatgccata

SEQ ID NO: 9266401 - DNA, 23 bp, Homo sapiens
ttattgcatccaaatgcattcct

SEQ ID NO: 9266402 - DNA, 22 bp, Homo sapiens
ttattgccatcctggaacctag

SEQ ID NO: 9266403 - DNA, 22 bp, Homo sapiens
ttattgcaaaggaagagcttga

SEQ ID NO: 9266404 - DNA, 22 bp, Homo sapiens
ttattgcaaccttttctggtgt

SEQ ID NO: 9266405 - DNA, 22 bp, Homo sapiens
ttattgcaaccttttctggtgt

SEQ ID NO: 9266406 - DNA, 22 bp, Homo sapiens
cgagatggtatttttaacgcag

SEQ ID NO: 9266407 - DNA, 22 bp, Homo sapiens
cgagagtggacagggcgcagct

SEQ ID NO: 9266408 - DNA, 22 bp, Homo sapiens
cgagagttagctaggagtcaca

SEQ ID NO: 9266409 - DNA, 22 bp, Homo sapiens
cgagagttagctaggagtcaca

SEQ ID NO: 9266410 - DNA, 22 bp, Homo sapiens
cgaacacacttgggagttctga

SEQ ID NO: 9266411 - DNA, 22 bp, Homo sapiens
cctttttctgagttgtagcttc

SEQ ID NO: 9266412 - DNA, 22 bp, Homo sapiens
ttatccaacatgacttatgtcc

SEQ ID NO: 9266413 - DNA, 22 bp, Homo sapiens
ccttttgctctcccatccagaa

SEQ ID NO: 9266414 - DNA, 22 bp, Homo sapiens
ccttttgctctcccatccagaa

SEQ ID NO: 9266415 - DNA, 22 bp, Homo sapiens
ccttttgctctcccatccagaa

SEQ ID NO: 9266416 - DNA, 22 bp, Homo sapiens
cctttttccctggagggacagc

SEQ ID NO: 9266417 - DNA, 22 bp, Homo sapiens
cctttttcaatatagaattgca

SEQ ID NO: 9266418 - DNA, 22 bp, Homo sapiens
ccttttgaaggtgttgttaagt

SEQ ID NO: 9266419 - DNA, 22 bp, Homo sapiens
ccttttcttgccactgactcgg

SEQ ID NO: 9266420 - DNA, 22 bp, Homo sapiens
cggcagagacggcgctttgaac

SEQ ID NO: 9266421 - DNA, 22 bp, Homo sapiens
cggcagagacggcgctttgaac

SEQ ID NO: 9266422 - DNA, 22 bp, Homo sapiens
cggatcatgtgacctttgagtg

SEQ ID NO: 9266423 - DNA, 18 bp, Homo sapiens
cggatcatgcgctgaggc

SEQ ID NO: 9266424 - DNA, 22 bp, Homo sapiens
cggcagagccctgagtcagcct

SEQ ID NO: 9266425 - DNA, 22 bp, Homo sapiens
cggcagagccctgagtcagcct

SEQ ID NO: 9266426 - DNA, 22 bp, Homo sapiens
cggcagagcggcgagcccctcc

SEQ ID NO: 9266427 - DNA, 22 bp, Homo sapiens
cggcagagcggcgagcccctcc

SEQ ID NO: 9266428 - DNA, 22 bp, Homo sapiens
cggcagagcttcctgctcagcg

SEQ ID NO: 9266429 - DNA, 18 bp, Homo sapiens
cggcagagtgcttctagc

SEQ ID NO: 9266430 - DNA, 22 bp, Homo sapiens
cggcagagcttcctgctcagcg

SEQ ID NO: 9266431 - DNA, 18 bp, Homo sapiens
cggcagagtgcttctagc

SEQ ID NO: 9266432 - DNA, 22 bp, Homo sapiens
cggcagagtgtgtgcgtgcatg

SEQ ID NO: 9266433 - DNA, 22 bp, Homo sapiens
cggcagagtgtgtgcgtgcatg

SEQ ID NO: 9266434 - DNA, 22 bp, Homo sapiens
cggcaggacctcatttccttct

SEQ ID NO: 9266435 - DNA, 22 bp, Homo sapiens
cggagtcttgctatgttgccca

SEQ ID NO: 9266436 - DNA, 22 bp, Homo sapiens
cggagtcttgctatgttgccca

SEQ ID NO: 9266437 - DNA, 22 bp, Homo sapiens
cggagtcttgctatgttgccca

SEQ ID NO: 9266438 - DNA, 22 bp, Homo sapiens
cggaggttgaggctgcagtgag

SEQ ID NO: 9266439 - DNA, 22 bp, Homo sapiens
ttcaaattaccacatttgctta

SEQ ID NO: 9266440 - DNA, 22 bp, Homo sapiens
ttcaaatccctgctccactatt

SEQ ID NO: 9266441 - DNA, 22 bp, Homo sapiens
ttcaaatgatggcagtcctggc

SEQ ID NO: 9266442 - DNA, 22 bp, Homo sapiens
ttcaaatctctcctaatccact

SEQ ID NO: 9266443 - DNA, 21 bp, Homo sapiens
ttcaaagtttgcctaaagatt

SEQ ID NO: 9266444 - DNA, 22 bp, Homo sapiens
ttcaaagtgtgacctgacaagc

SEQ ID NO: 9266445 - DNA, 22 bp, Homo sapiens
ttcaaagtgtgacctgacaagc

SEQ ID NO: 9266446 - DNA, 22 bp, Homo sapiens
ttcaaagtgtgacctgacaagc

SEQ ID NO: 9266447 - DNA, 20 bp, Homo sapiens
ttcaaagtgtatgatatgca

SEQ ID NO: 9266448 - DNA, 22 bp, Homo sapiens
ttcaaagtgctgttcaaagtag

SEQ ID NO: 9266449 - DNA, 22 bp, Homo sapiens
cgtgagcaaaatggacactccc

SEQ ID NO: 9266450 - DNA, 22 bp, Homo sapiens
cgtgggaggaaaaatgggcttc

SEQ ID NO: 9266451 - DNA, 22 bp, Homo sapiens
cgtgggagtggtgggtgctcag

SEQ ID NO: 9266452 - DNA, 22 bp, Homo sapiens
cggggcctagtctacctcggca

SEQ ID NO: 9266453 - DNA, 22 bp, Homo sapiens
cggggcctagctgcacaccctc

SEQ ID NO: 9266454 - DNA, 22 bp, Homo sapiens
cggggccctggggctgaaggtc

SEQ ID NO: 9266455 - DNA, 22 bp, Homo sapiens
cggggagggcagaggctccctc

SEQ ID NO: 9266456 - DNA, 22 bp, Homo sapiens
cggggagggcagaggctccctc

SEQ ID NO: 9266457 - DNA, 22 bp, Homo sapiens
cggggcagagggtcttctccag

SEQ ID NO: 9266458 - DNA, 22 bp, Homo sapiens
cggggcagaaagttgtcttttg

SEQ ID NO: 9266459 - DNA, 22 bp, Homo sapiens
cggggcagagggtcttctccag

SEQ ID NO: 9266460 - DNA, 22 bp, Homo sapiens
cggggcaggagtccctgtagag

SEQ ID NO: 9266461 - DNA, 22 bp, Homo sapiens
cggggcaggagtccctgtagag

SEQ ID NO: 9266462 - DNA, 23 bp, Homo sapiens
cggggccagggtcaggaccggtc

SEQ ID NO: 9266463 - DNA, 22 bp, Homo sapiens
cggggccctggggctgaaggtc

SEQ ID NO: 9266464 - DNA, 22 bp, Homo sapiens
cggggaagcggttctggcggta

SEQ ID NO: 9266465 - DNA, 22 bp, Homo sapiens
cggggaggcttcggattaaagc

SEQ ID NO: 9266466 - DNA, 22 bp, Homo sapiens
cggggaggcttcggattaaagc

SEQ ID NO: 9266467 - DNA, 22 bp, Homo sapiens
cgggctggctgcagctgctgga

SEQ ID NO: 9266468 - DNA, 22 bp, Homo sapiens
ctggagccccaggctgtgcaga

SEQ ID NO: 9266469 - DNA, 22 bp, Homo sapiens
ctggagccctgaatgggcagga

SEQ ID NO: 9266470 - DNA, 22 bp, Homo sapiens
ctggagccccaggctgtgcaga

SEQ ID NO: 9266471 - DNA, 22 bp, Homo sapiens
ctggagccccaggctgtgcaga

SEQ ID NO: 9266472 - DNA, 22 bp, Homo sapiens
ctggagcaggtttaggagtccc

SEQ ID NO: 9266473 - DNA, 22 bp, Homo sapiens
ctggagcaggtttaggagtccc

SEQ ID NO: 9266474 - DNA, 22 bp, Homo sapiens
ctggagcaggtttaggagtccc

SEQ ID NO: 9266475 - DNA, 22 bp, Homo sapiens
ctggagcaggcttgtcccagct

SEQ ID NO: 9266476 - DNA, 22 bp, Homo sapiens
ctggagcagcaggtggccaggg

SEQ ID NO: 9266477 - DNA, 22 bp, Homo sapiens
ctggagcagcaggtggccaggg

SEQ ID NO: 9266478 - DNA, 22 bp, Homo sapiens
ctggagcctaggttgacctggg

SEQ ID NO: 9266479 - DNA, 22 bp, Homo sapiens
ctggagccggaccagggacggt

SEQ ID NO: 9266480 - DNA, 22 bp, Homo sapiens
ctggagccggaccagggacggt

SEQ ID NO: 9266481 - DNA, 22 bp, Homo sapiens
ctggagcaaaagtgactcctct

SEQ ID NO: 9266482 - DNA, 22 bp, Homo sapiens
ctggagattaagttctcagcca

SEQ ID NO: 9266483 - DNA, 22 bp, Homo sapiens
ctggagataagcagtcccaggc

SEQ ID NO: 9266484 - DNA, 22 bp, Homo sapiens
ctggagataagcagtcccaggc

SEQ ID NO: 9266485 - DNA, 22 bp, Homo sapiens
ctggagatactgctctccatat

SEQ ID NO: 9266486 - DNA, 19 bp, Homo sapiens
ctggagatagggcctttaa

SEQ ID NO: 9266487 - DNA, 19 bp, Homo sapiens
ctggagatagggcctttaa

SEQ ID NO: 9266488 - DNA, 22 bp, Homo sapiens
ctggagagtaatctctgtgtta

SEQ ID NO: 9266489 - DNA, 22 bp, Homo sapiens
ctggagaggctgggaacaggtt

SEQ ID NO: 9266490 - DNA, 22 bp, Homo sapiens
ctggagagggagctgttggaag

SEQ ID NO: 9266491 - DNA, 22 bp, Homo sapiens
ctggagagggagccctggcagt

SEQ ID NO: 9266492 - DNA, 22 bp, Homo sapiens
ctggagagggagccctggcagt

SEQ ID NO: 9266493 - DNA, 22 bp, Homo sapiens
ctggagaaacatcaggcatagg

SEQ ID NO: 9266494 - DNA, 22 bp, Homo sapiens
ctgctgtctagtatcttaaaaa

SEQ ID NO: 9266495 - DNA, 22 bp, Homo sapiens
ctgctgtgagtttggaggtcta

SEQ ID NO: 9266496 - DNA, 22 bp, Homo sapiens
ctggaagagtgactttgcattt

SEQ ID NO: 9266497 - DNA, 22 bp, Homo sapiens
ctggaagaggacacacgaatca

SEQ ID NO: 9266498 - DNA, 22 bp, Homo sapiens
ctggaagaggggaaatgccatg

SEQ ID NO: 9266499 - DNA, 22 bp, Homo sapiens
ctggaagagtcctaaacagata

SEQ ID NO: 9266500 - DNA, 22 bp, Homo sapiens
ctggaagagtaatataaattag

SEQ ID NO: 9266501 - DNA, 22 bp, Homo sapiens
ctgctctgaccctttcaccttc

SEQ ID NO: 9266502 - DNA, 22 bp, Homo sapiens
ctgctctgaccctttcaccttc

SEQ ID NO: 9266503 - DNA, 22 bp, Homo sapiens
ctgctctgttcccccatcatct

SEQ ID NO: 9266504 - DNA, 22 bp, Homo sapiens
ctgctctgttcccccatcatct

SEQ ID NO: 9266505 - DNA, 22 bp, Homo sapiens
ctgctctgtttcttagctgggt

SEQ ID NO: 9266506 - DNA, 22 bp, Homo sapiens
ctgctcttcacactacacccgt

SEQ ID NO: 9266507 - DNA, 22 bp, Homo sapiens
ctgctctgtttcttagctgggt

SEQ ID NO: 9266508 - DNA, 22 bp, Homo sapiens
ctgccttttcatctgagctgga

SEQ ID NO: 9266509 - DNA, 22 bp, Homo sapiens
ctgccttttaaagccagtgtta

SEQ ID NO: 9266510 - DNA, 22 bp, Homo sapiens
ctgcctttgtgatcagttcttt

SEQ ID NO: 9266511 - DNA, 22 bp, Homo sapiens
ctgcctttggggagttagaggg

SEQ ID NO: 9266512 - DNA, 21 bp, Homo sapiens
ctgctctgacagtgaggccag

SEQ ID NO: 9266513 - DNA, 22 bp, Homo sapiens
ctgcctttgcccttgacactgt

SEQ ID NO: 9266514 - DNA, 22 bp, Homo sapiens
ctgcctttgcccttgacactgt

SEQ ID NO: 9266515 - DNA, 22 bp, Homo sapiens
ctgccttccaaccccagactcc

SEQ ID NO: 9266516 - DNA, 22 bp, Homo sapiens
ctgcctgttttctgatagattt

SEQ ID NO: 9266517 - DNA, 22 bp, Homo sapiens
ctgccttcatctctgagctggg

SEQ ID NO: 9266518 - DNA, 18 bp, Homo sapiens
ctgcctgttgctgagagg

SEQ ID NO: 9266519 - DNA, 22 bp, Homo sapiens
ctgcctgtttcctcttgctccc

SEQ ID NO: 9266520 - DNA, 19 bp, Homo sapiens
ctgcctgttatggagagaa

SEQ ID NO: 9266521 - DNA, 22 bp, Homo sapiens
ctgcctgttagtctagcagtta

SEQ ID NO: 9266522 - DNA, 22 bp, Homo sapiens
ctgcctgtgtgtgcctgcagaa

SEQ ID NO: 9266523 - DNA, 22 bp, Homo sapiens
ctgcctgtggtctgtgatctaa

SEQ ID NO: 9266524 - DNA, 22 bp, Homo sapiens
ctgcctgtggtctgtgatctaa

SEQ ID NO: 9266525 - DNA, 22 bp, Homo sapiens
ctgcctgtgggtacaagtggaa

SEQ ID NO: 9266526 - DNA, 22 bp, Homo sapiens
ctgcctggggaatgtgaggatt

SEQ ID NO: 9266527 - DNA, 22 bp, Homo sapiens
ctgcctggggaatgtgaggatt

SEQ ID NO: 9266528 - DNA, 22 bp, Homo sapiens
ctgcctgtgccaccgcctcatt

SEQ ID NO: 9266529 - DNA, 22 bp, Homo sapiens
ctgcctggggcatcagtcaagg

SEQ ID NO: 9266530 - DNA, 22 bp, Homo sapiens
ctgcctggggaatgtgaggatt

SEQ ID NO: 9266531 - DNA, 22 bp, Homo sapiens
ctgctgaaaacaataatgatga

SEQ ID NO: 9266532 - DNA, 22 bp, Homo sapiens
ctgctgaaaacaataatgatga

SEQ ID NO: 9266533 - DNA, 22 bp, Homo sapiens
ctgctcttgagggactgcggtc

SEQ ID NO: 9266534 - DNA, 22 bp, Homo sapiens
ctgctcttcccactcactccca

SEQ ID NO: 9266535 - DNA, 22 bp, Homo sapiens
ctgctgacagccctgcttcagg

SEQ ID NO: 9266536 - DNA, 22 bp, Homo sapiens
ctgctgacaaaataaaatgctc

SEQ ID NO: 9266537 - DNA, 22 bp, Homo sapiens
ctgctgactcttcctggagtga

SEQ ID NO: 9266538 - DNA, 22 bp, Homo sapiens
ctgctgactcattttcaacact

SEQ ID NO: 9266539 - DNA, 19 bp, Homo sapiens
ctgctgaattagctctgga

SEQ ID NO: 9266540 - DNA, 22 bp, Homo sapiens
ctgctgaatgtctctttggttt

SEQ ID NO: 9266541 - DNA, 22 bp, Homo sapiens
ctgctgaagttgttggtctttt

SEQ ID NO: 9266542 - DNA, 22 bp, Homo sapiens
ctgctgagaaaagactgaggga

SEQ ID NO: 9266543 - DNA, 22 bp, Homo sapiens
ctgctgacttacactgtttatt

SEQ ID NO: 9266544 - DNA, 20 bp, Homo sapiens
ctgctgagagcctggcttgc

SEQ ID NO: 9266545 - DNA, 22 bp, Homo sapiens
ctgctgagagccccagctgaga

SEQ ID NO: 9266546 - DNA, 22 bp, Homo sapiens
ctgctgagcatcagggctgccc

SEQ ID NO: 9266547 - DNA, 22 bp, Homo sapiens
ctgctgggaaggtctgctcagt

SEQ ID NO: 9266548 - DNA, 22 bp, Homo sapiens
ctgctgagcatcagggctgccc

SEQ ID NO: 9266549 - DNA, 22 bp, Homo sapiens
ctgctgggatagaagtatctca

SEQ ID NO: 9266550 - DNA, 22 bp, Homo sapiens
ctgctgggaaggtctgctcagt

SEQ ID NO: 9266551 - DNA, 22 bp, Homo sapiens
ctgctgggaaggtctgctcagt

SEQ ID NO: 9266552 - DNA, 22 bp, Homo sapiens
ctgctgggcagaggctgcatga

SEQ ID NO: 9266553 - DNA, 22 bp, Homo sapiens
ctgctgggtttgcctttcacca

SEQ ID NO: 9266554 - DNA, 22 bp, Homo sapiens
ctgctgggtttgcctttcacca

SEQ ID NO: 9266555 - DNA, 19 bp, Homo sapiens
ctgctgggtgctgagggag

SEQ ID NO: 9266556 - DNA, 22 bp, Homo sapiens
ctgctgggtccccctgctgatt

SEQ ID NO: 9266557 - DNA, 22 bp, Homo sapiens
ctgctgggtccccctgctgatt

SEQ ID NO: 9266558 - DNA, 22 bp, Homo sapiens
ctgctgggtctatgcaagtgga

SEQ ID NO: 9266559 - DNA, 22 bp, Homo sapiens
ctgctgggtctatgcaagtgga

SEQ ID NO: 9266560 - DNA, 22 bp, Homo sapiens
ctgctgtcaaaaatcactccat

SEQ ID NO: 9266561 - DNA, 22 bp, Homo sapiens
ctgctgtacttaggaagaggaa

SEQ ID NO: 9266562 - DNA, 22 bp, Homo sapiens
ctgctgtcatagccatccctcc

SEQ ID NO: 9266563 - DNA, 22 bp, Homo sapiens
ctgctgtcaaaggaaatatttg

SEQ ID NO: 9266564 - DNA, 22 bp, Homo sapiens
ctgctgtccaggagtgccctgt

SEQ ID NO: 9266565 - DNA, 22 bp, Homo sapiens
ctgaggccgtctgggtctgcag

SEQ ID NO: 9266566 - DNA, 22 bp, Homo sapiens
ctgaggccgtctgggtctgcag

SEQ ID NO: 9266567 - DNA, 22 bp, Homo sapiens
ctgaggccgttggtgggcctta

SEQ ID NO: 9266568 - DNA, 23 bp, Homo sapiens
ctgaggcctgctgcgttcaggtt

SEQ ID NO: 9266569 - DNA, 22 bp, Homo sapiens
ctgagccaaaaagcagagcttg

SEQ ID NO: 9266570 - DNA, 22 bp, Homo sapiens
ctgagcatttgtgcagcttctc

SEQ ID NO: 9266571 - DNA, 22 bp, Homo sapiens
ctgagccaaaaagcagagcttg

SEQ ID NO: 9266572 - DNA, 22 bp, Homo sapiens
ctgaggcctggtgaggtggtga

SEQ ID NO: 9266573 - DNA, 22 bp, Homo sapiens
ctgaggcctgtgttggggcagt

SEQ ID NO: 9266574 - DNA, 22 bp, Homo sapiens
ctgaggctaacctcgagagaca

SEQ ID NO: 9266575 - DNA, 22 bp, Homo sapiens
ctgaggcctgtgttggggcagt

SEQ ID NO: 9266576 - DNA, 22 bp, Homo sapiens
ctgaggcctggccccaccacag

SEQ ID NO: 9266577 - DNA, 22 bp, Homo sapiens
ctgaggcctggccccaccacag

SEQ ID NO: 9266578 - DNA, 22 bp, Homo sapiens
ctgaggcctgggggcgtggacg

SEQ ID NO: 9266579 - DNA, 22 bp, Homo sapiens
ctgaggcctgggggcgtggacg

SEQ ID NO: 9266580 - DNA, 22 bp, Homo sapiens
ctgaggctaacctcgagagaca

SEQ ID NO: 9266581 - DNA, 22 bp, Homo sapiens
ctgaggctagtataaagagcat

SEQ ID NO: 9266582 - DNA, 22 bp, Homo sapiens
ctgaggctcaagggcaggtggg

SEQ ID NO: 9266583 - DNA, 22 bp, Homo sapiens
ctgaggctcaagggcaggtggg

SEQ ID NO: 9266584 - DNA, 22 bp, Homo sapiens
ctgaggctcaagggcaggtggg

SEQ ID NO: 9266585 - DNA, 22 bp, Homo sapiens
ctgaggctcaagggcaggtggg

SEQ ID NO: 9266586 - DNA, 22 bp, Homo sapiens
ctgaggctggagtgcagtggtg

SEQ ID NO: 9266587 - DNA, 22 bp, Homo sapiens
ctgaggctggagtgcagtggtg

SEQ ID NO: 9266588 - DNA, 22 bp, Homo sapiens
ctgaggctggagtgcagtggtg

SEQ ID NO: 9266589 - DNA, 23 bp, Homo sapiens
ctgaggggaaaagggcttcaggc

SEQ ID NO: 9266590 - DNA, 22 bp, Homo sapiens
ctgaggtcaggagttcaagctg

SEQ ID NO: 9266591 - DNA, 17 bp, Homo sapiens
ctgaggggagtgctgtg

SEQ ID NO: 9266592 - DNA, 22 bp, Homo sapiens
ctgaggtcctcagagggaaagg

SEQ ID NO: 9266593 - DNA, 22 bp, Homo sapiens
ctgaggtctattttgaaactgc

SEQ ID NO: 9266594 - DNA, 22 bp, Homo sapiens
ctgaggtctagacaccccaggg

SEQ ID NO: 9266595 - DNA, 22 bp, Homo sapiens
ctgaggtccttgactgcttgcc

SEQ ID NO: 9266596 - DNA, 22 bp, Homo sapiens
ctgaggctgaagagggcctacg

SEQ ID NO: 9266597 - DNA, 22 bp, Homo sapiens
ctgaggctctgagaaagccaaa

SEQ ID NO: 9266598 - DNA, 22 bp, Homo sapiens
ctgaggctcagcgtgaggaaag

SEQ ID NO: 9266599 - DNA, 22 bp, Homo sapiens
ctgaggctccctcgggtctgct

SEQ ID NO: 9266600 - DNA, 22 bp, Homo sapiens
ctgaggctctgagaaagccaaa

SEQ ID NO: 9266601 - DNA, 22 bp, Homo sapiens
ctgaggctgcccagggccaggt

SEQ ID NO: 9266602 - DNA, 22 bp, Homo sapiens
ctgaggctgcccagggccaggt

SEQ ID NO: 9266603 - DNA, 22 bp, Homo sapiens
ctgaggctggagtgcagtggtg

SEQ ID NO: 9266604 - DNA, 22 bp, Homo sapiens
ctgaggctgagacaggtgaaat

SEQ ID NO: 9266605 - DNA, 22 bp, Homo sapiens
ctgaggctgcccagggccaggt

SEQ ID NO: 9266606 - DNA, 22 bp, Homo sapiens
ctgagcaggatattcacagcag

SEQ ID NO: 9266607 - DNA, 22 bp, Homo sapiens
ctgagcagtagagggtctcttt

SEQ ID NO: 9266608 - DNA, 22 bp, Homo sapiens
ctgagcagtggttcttgagcgc

SEQ ID NO: 9266609 - DNA, 22 bp, Homo sapiens
ctgagcagtctgactcaagcta

SEQ ID NO: 9266610 - DNA, 22 bp, Homo sapiens
ctgagcagtgctttgcagtggg

SEQ ID NO: 9266611 - DNA, 19 bp, Homo sapiens
ctgagcagcggcagcactt

SEQ ID NO: 9266612 - DNA, 22 bp, Homo sapiens
ctgagcagaagggtgcacgtgc

SEQ ID NO: 9266613 - DNA, 22 bp, Homo sapiens
ctgagcagaccatggcagaggt

SEQ ID NO: 9266614 - DNA, 22 bp, Homo sapiens
ctgagcaggatattcacagcag

SEQ ID NO: 9266615 - DNA, 22 bp, Homo sapiens
ctgagcagctgttacagagtgt

SEQ ID NO: 9266616 - DNA, 22 bp, Homo sapiens
ctcttcctttcccttgagggtg

SEQ ID NO: 9266617 - DNA, 22 bp, Homo sapiens
ctcttctgtacctcggcctcca

SEQ ID NO: 9266618 - DNA, 22 bp, Homo sapiens
ctcttctgtacctcggcctcca

SEQ ID NO: 9266619 - DNA, 22 bp, Homo sapiens
ctcttcttatggccgtggctga

SEQ ID NO: 9266620 - DNA, 22 bp, Homo sapiens
ctgagcactgggcacatagctg

SEQ ID NO: 9266621 - DNA, 22 bp, Homo sapiens
ctcttcttatggccgtggctga

SEQ ID NO: 9266622 - DNA, 22 bp, Homo sapiens
ctcttcttatggccgtggctga

SEQ ID NO: 9266623 - DNA, 22 bp, Homo sapiens
ctcttcctacagtctgctatgc

SEQ ID NO: 9266624 - DNA, 22 bp, Homo sapiens
ctcttcccagctccacgagagg

SEQ ID NO: 9266625 - DNA, 22 bp, Homo sapiens
ttttggaacacagacattagaa

SEQ ID NO: 9266626 - DNA, 22 bp, Homo sapiens
ttttgcttgagtgcacaaaatg

SEQ ID NO: 9266627 - DNA, 22 bp, Homo sapiens
ttttgctttaagatggagagga

SEQ ID NO: 9266628 - DNA, 22 bp, Homo sapiens
ttttgctttaagatggagagga

SEQ ID NO: 9266629 - DNA, 22 bp, Homo sapiens
ttttgcttttgtaacacagtgt

SEQ ID NO: 9266630 - DNA, 22 bp, Homo sapiens
ctgaggtgctatggaggatacg

SEQ ID NO: 9266631 - DNA, 22 bp, Homo sapiens
ctgaggtggaacagaggtgaag

SEQ ID NO: 9266632 - DNA, 22 bp, Homo sapiens
ctgaggtggaacagaggtgaag

SEQ ID NO: 9266633 - DNA, 22 bp, Homo sapiens
ctgaggtgctatggaggatacg

SEQ ID NO: 9266634 - DNA, 22 bp, Homo sapiens
ctgaggtgctagggtccctgct

SEQ ID NO: 9266635 - DNA, 22 bp, Homo sapiens
ctgaggtgctagggtccctgct

SEQ ID NO: 9266636 - DNA, 19 bp, Homo sapiens
ctgaggtgcagtaagaggc

SEQ ID NO: 9266637 - DNA, 22 bp, Homo sapiens
ctgaggtgatgtcaaatgggtt

SEQ ID NO: 9266638 - DNA, 22 bp, Homo sapiens
ctgaggtgagcttccctgggct

SEQ ID NO: 9266639 - DNA, 19 bp, Homo sapiens
ctgaggtgaggggcatcat

SEQ ID NO: 9266640 - DNA, 22 bp, Homo sapiens
ctgaggtgagaggaggccatgt

SEQ ID NO: 9266641 - DNA, 22 bp, Homo sapiens
ctgaggtctattttgaaactgc

SEQ ID NO: 9266642 - DNA, 23 bp, Homo sapiens
ctgaggtctgcaattctagtagt

SEQ ID NO: 9266643 - DNA, 22 bp, Homo sapiens
ctgaggtctctttccatagtga

SEQ ID NO: 9266644 - DNA, 23 bp, Homo sapiens
ctgaggtctgcaattctagtagt

SEQ ID NO: 9266645 - DNA, 22 bp, Homo sapiens
ctgaggtggcatcctagctcta

SEQ ID NO: 9266646 - DNA, 22 bp, Homo sapiens
ctgaggtggcatcctagctcta

SEQ ID NO: 9266647 - DNA, 23 bp, Homo sapiens
ctgaggtggagagtgaggtaagt

SEQ ID NO: 9266648 - DNA, 22 bp, Homo sapiens
ctgaggtggcgcctctctttaa

SEQ ID NO: 9266649 - DNA, 22 bp, Homo sapiens
ctgaggtgtgaaatggtggcaa

SEQ ID NO: 9266650 - DNA, 22 bp, Homo sapiens
ctgaggtgtgaaatggtggcaa

SEQ ID NO: 9266651 - DNA, 22 bp, Homo sapiens
ctgaggtgtgaaatggtggcaa

SEQ ID NO: 9266652 - DNA, 22 bp, Homo sapiens
ctgaggtggggcctgggcatca

SEQ ID NO: 9266653 - DNA, 22 bp, Homo sapiens
ctgaggtgttgatgacctatgc

SEQ ID NO: 9266654 - DNA, 22 bp, Homo sapiens
ctgcagctgtctctactgggca

SEQ ID NO: 9266655 - DNA, 22 bp, Homo sapiens
ctgcagctgtagaggacagtgg

SEQ ID NO: 9266656 - DNA, 22 bp, Homo sapiens
ctgcagcctaggtgcagctggg

SEQ ID NO: 9266657 - DNA, 22 bp, Homo sapiens
ctgcagcctaggtgcagctggg

SEQ ID NO: 9266658 - DNA, 22 bp, Homo sapiens
ctgaggtttacaagctattgct

SEQ ID NO: 9266659 - DNA, 23 bp, Homo sapiens
ctgcagccgcgtggggacgtgga

SEQ ID NO: 9266660 - DNA, 22 bp, Homo sapiens
ctgcagcctcaacctcctgagc

SEQ ID NO: 9266661 - DNA, 22 bp, Homo sapiens
ctgcagcctcaacctcctgagc

SEQ ID NO: 9266662 - DNA, 22 bp, Homo sapiens
ctgcagcctcaacctcctgagc

SEQ ID NO: 9266663 - DNA, 22 bp, Homo sapiens
ctgcagctttggaaacctgttt

SEQ ID NO: 9266664 - DNA, 22 bp, Homo sapiens
ctgcagctttcgctccatcagc

SEQ ID NO: 9266665 - DNA, 22 bp, Homo sapiens
ctgcaggaatctgtgctaggtg

SEQ ID NO: 9266666 - DNA, 22 bp, Homo sapiens
ctgcaggaatctgtgctaggtg

SEQ ID NO: 9266667 - DNA, 22 bp, Homo sapiens
ctgcaggactgaaagatgaggt

SEQ ID NO: 9266668 - DNA, 22 bp, Homo sapiens
ctgcccaggctgaaggaacatc

SEQ ID NO: 9266669 - DNA, 22 bp, Homo sapiens
ctgcccaggggagtgctgtcgg

SEQ ID NO: 9266670 - DNA, 22 bp, Homo sapiens
ctgccccaggcctccttttctt

SEQ ID NO: 9266671 - DNA, 22 bp, Homo sapiens
ctgccccaccccaacctgaggt

SEQ ID NO: 9266672 - DNA, 22 bp, Homo sapiens
ctgccccaggacctcttctgga

SEQ ID NO: 9266673 - DNA, 22 bp, Homo sapiens
ctgccccagtgccaggcaggtg

SEQ ID NO: 9266674 - DNA, 22 bp, Homo sapiens
ctgccccatggtccctggtggg

SEQ ID NO: 9266675 - DNA, 22 bp, Homo sapiens
ctgcccacagttctctgccatg

SEQ ID NO: 9266676 - DNA, 22 bp, Homo sapiens
ctgcccagattttaccacctgc

SEQ ID NO: 9266677 - DNA, 20 bp, Homo sapiens
ctgcccagccactgagggat

SEQ ID NO: 9266678 - DNA, 20 bp, Homo sapiens
ctgcccagccactgagggat

SEQ ID NO: 9266679 - DNA, 20 bp, Homo sapiens
ctgcccagccactgagggat

SEQ ID NO: 9266680 - DNA, 22 bp, Homo sapiens
ctgcaggagcaaagcctctgct

SEQ ID NO: 9266681 - DNA, 22 bp, Homo sapiens
ctgcaggagcaaagcctctgct

SEQ ID NO: 9266682 - DNA, 22 bp, Homo sapiens
ctgcaggagcaagcctgggaga

SEQ ID NO: 9266683 - DNA, 22 bp, Homo sapiens
ctgcaggaggatcctgagagtg

SEQ ID NO: 9266684 - DNA, 21 bp, Homo sapiens
ctgcaggatgctgaagccagg

SEQ ID NO: 9266685 - DNA, 22 bp, Homo sapiens
ctctggcctgcttcctcaggta

SEQ ID NO: 9266686 - DNA, 22 bp, Homo sapiens
ctctggcctgcttcctcaggta

SEQ ID NO: 9266687 - DNA, 22 bp, Homo sapiens
ctctggcctgcagatccatgct

SEQ ID NO: 9266688 - DNA, 22 bp, Homo sapiens
ctctggccccagtggccccttg

SEQ ID NO: 9266689 - DNA, 22 bp, Homo sapiens
ctctggccagagcctgcgggaa

SEQ ID NO: 9266690 - DNA, 22 bp, Homo sapiens
ctctggagtgcagcctggtggc

SEQ ID NO: 9266691 - DNA, 22 bp, Homo sapiens
tttgcaaagtgactattatatg

SEQ ID NO: 9266692 - DNA, 22 bp, Homo sapiens
tttgcaaagtgactattatatg

SEQ ID NO: 9266693 - DNA, 22 bp, Homo sapiens
tttgacttctatctagtaagaa

SEQ ID NO: 9266694 - DNA, 22 bp, Homo sapiens
ctctgcagaggcccaaggctga

SEQ ID NO: 9266695 - DNA, 22 bp, Homo sapiens
ctctgcagaatttgagctgctc

SEQ ID NO: 9266696 - DNA, 22 bp, Homo sapiens
tttgaccctgttattctccctg

SEQ ID NO: 9266697 - DNA, 22 bp, Homo sapiens
ctctgcaatctgagcacttgta

SEQ ID NO: 9266698 - DNA, 22 bp, Homo sapiens
ctctgcaacttctagcagtgtc

SEQ ID NO: 9266699 - DNA, 22 bp, Homo sapiens
ctctgcaagtccagcccctggc

SEQ ID NO: 9266700 - DNA, 22 bp, Homo sapiens
ctctgagttgaggcaggagagt

SEQ ID NO: 9266701 - DNA, 22 bp, Homo sapiens
ctctgagtttcatttccctcct

SEQ ID NO: 9266702 - DNA, 22 bp, Homo sapiens
ctctgatgtctgggggctggat

SEQ ID NO: 9266703 - DNA, 19 bp, Homo sapiens
tttgaaagagttttattgg

SEQ ID NO: 9266704 - DNA, 22 bp, Homo sapiens
ctctgaggtttcctcacaagct

SEQ ID NO: 9266705 - DNA, 22 bp, Homo sapiens
tttgaaaattagacacaggcta

SEQ ID NO: 9266706 - DNA, 22 bp, Homo sapiens
tttgaaaatttaagtgctacac

SEQ ID NO: 9266707 - DNA, 22 bp, Homo sapiens
tttgaaaagaaccatcgcctta

SEQ ID NO: 9266708 - DNA, 22 bp, Homo sapiens
tttgaaaacttaatttggtcgt

SEQ ID NO: 9266709 - DNA, 22 bp, Homo sapiens
tttgaaaatttaagtgctacac

SEQ ID NO: 9266710 - DNA, 22 bp, Homo sapiens
tttgaaagaaaccagtgagtga

SEQ ID NO: 9266711 - DNA, 22 bp, Homo sapiens
tttgaaagaatttatgtacttt

SEQ ID NO: 9266712 - DNA, 22 bp, Homo sapiens
tttgaaagaatttatgtacttt

SEQ ID NO: 9266713 - DNA, 22 bp, Homo sapiens
tttgaaagacagaatatttttg

SEQ ID NO: 9266714 - DNA, 22 bp, Homo sapiens
ctctgacaccatctcatgacag

SEQ ID NO: 9266715 - DNA, 22 bp, Homo sapiens
tttcttgattagctgtggctca

SEQ ID NO: 9266716 - DNA, 22 bp, Homo sapiens
ctctgaagatggtaccagcttt

SEQ ID NO: 9266717 - DNA, 22 bp, Homo sapiens
ctctgaaattggccctcagcag

SEQ ID NO: 9266718 - DNA, 22 bp, Homo sapiens
ctctgaaattggccctcagcag

SEQ ID NO: 9266719 - DNA, 22 bp, Homo sapiens
ctctgaagccccaaatagtccg

SEQ ID NO: 9266720 - DNA, 22 bp, Homo sapiens
tttcttggatgtgaaactaggg

SEQ ID NO: 9266721 - DNA, 22 bp, Homo sapiens
tttcttggagctcttagggtcg

SEQ ID NO: 9266722 - DNA, 22 bp, Homo sapiens
tttcttgccagagaaaaagagt

SEQ ID NO: 9266723 - DNA, 22 bp, Homo sapiens
tttcttgggttccagttcccag

SEQ ID NO: 9266724 - DNA, 22 bp, Homo sapiens
tttgaaaaaggcctttggtatg

SEQ ID NO: 9266725 - DNA, 22 bp, Homo sapiens
ttttgcttaatctagattttgc

SEQ ID NO: 9266726 - DNA, 22 bp, Homo sapiens
ttttgcttaatctagattttgc

SEQ ID NO: 9266727 - DNA, 22 bp, Homo sapiens
ttttgcctgagagtgaaaataa

SEQ ID NO: 9266728 - DNA, 21 bp, Homo sapiens
ctctgtgttgagggtgttgag

SEQ ID NO: 9266729 - DNA, 17 bp, Homo sapiens
ttttctctcttggattc

SEQ ID NO: 9266730 - DNA, 17 bp, Homo sapiens
ttttctctcttggattc

SEQ ID NO: 9266731 - DNA, 22 bp, Homo sapiens
ctctgtgtggtcctctgtattg

SEQ ID NO: 9266732 - DNA, 22 bp, Homo sapiens
ctctgtgtggtcctctgtattg

SEQ ID NO: 9266733 - DNA, 22 bp, Homo sapiens
ctctgtgttcagcctagcagaa

SEQ ID NO: 9266734 - DNA, 22 bp, Homo sapiens
ctctgtgttcagcctagcagaa

SEQ ID NO: 9266735 - DNA, 22 bp, Homo sapiens
ctctgtgttccgggttgctgct

SEQ ID NO: 9266736 - DNA, 22 bp, Homo sapiens
ctctgtgtcagctgggtgtgca

SEQ ID NO: 9266737 - DNA, 22 bp, Homo sapiens
ctctgtggttagactatggctg

SEQ ID NO: 9266738 - DNA, 22 bp, Homo sapiens
ctctgtgcctcagttttcttct

SEQ ID NO: 9266739 - DNA, 22 bp, Homo sapiens
ctctgtgattttgtgagccaga

SEQ ID NO: 9266740 - DNA, 22 bp, Homo sapiens
ctctgtgcttatgctccatggg

SEQ ID NO: 9266741 - DNA, 22 bp, Homo sapiens
tttgttctaacttctgcagaca

SEQ ID NO: 9266742 - DNA, 22 bp, Homo sapiens
tttgttcattttgagctcatca

SEQ ID NO: 9266743 - DNA, 22 bp, Homo sapiens
ctctgtggcttgcctttctgtc

SEQ ID NO: 9266744 - DNA, 22 bp, Homo sapiens
ctctgtggtggagtgggtcacc

SEQ ID NO: 9266745 - DNA, 22 bp, Homo sapiens
ctctgggctgaatggctgaacc

SEQ ID NO: 9266746 - DNA, 20 bp, Homo sapiens
ctctgggctgcaccctcgcc

SEQ ID NO: 9266747 - DNA, 23 bp, Homo sapiens
ctctgggtccgatgtcctgacag

SEQ ID NO: 9266748 - DNA, 22 bp, Homo sapiens
ctctggctatctgtttctatgt

SEQ ID NO: 9266749 - DNA, 22 bp, Homo sapiens
ctctgggtggtctcactgagtg

SEQ ID NO: 9266750 - DNA, 22 bp, Homo sapiens
ctctgggtgtgacagcacctgg

SEQ ID NO: 9266751 - DNA, 23 bp, Homo sapiens
ctctgggtccgatgtcctgacag

SEQ ID NO: 9266752 - DNA, 22 bp, Homo sapiens
tttgttcagctctcattgatta

SEQ ID NO: 9266753 - DNA, 21 bp, Homo sapiens
tttgttcaggcaagttacagt

SEQ ID NO: 9266754 - DNA, 21 bp, Homo sapiens
tttgttcaggggcaaagttaa

SEQ ID NO: 9266755 - DNA, 21 bp, Homo sapiens
tttgttcaggggcaaagttaa

SEQ ID NO: 9266756 - DNA, 21 bp, Homo sapiens
tttgttcaggcaagttacagt

SEQ ID NO: 9266757 - DNA, 22 bp, Homo sapiens
tttgttcatgcctatattctca

SEQ ID NO: 9266758 - DNA, 22 bp, Homo sapiens
tttgttcatgcctatattctca

SEQ ID NO: 9266759 - DNA, 22 bp, Homo sapiens
tttgttcattagtacagttgta

SEQ ID NO: 9266760 - DNA, 21 bp, Homo sapiens
tttgttcatagctcactcttt

SEQ ID NO: 9266761 - DNA, 22 bp, Homo sapiens
tttctcaagttcagatatttga

SEQ ID NO: 9266762 - DNA, 22 bp, Homo sapiens
tttctcaagttcagatatttga

SEQ ID NO: 9266763 - DNA, 19 bp, Homo sapiens
ctctctggcggtgtctgcg

SEQ ID NO: 9266764 - DNA, 22 bp, Homo sapiens
tttctcaagttcagatatttga

SEQ ID NO: 9266765 - DNA, 22 bp, Homo sapiens
tttctcaagttcagatatttga

SEQ ID NO: 9266766 - DNA, 22 bp, Homo sapiens
ctctctggtcccagattccaga

SEQ ID NO: 9266767 - DNA, 19 bp, Homo sapiens
ctctctggcggtgtctgcg

SEQ ID NO: 9266768 - DNA, 18 bp, Homo sapiens
ctctctggtctggatccc

SEQ ID NO: 9266769 - DNA, 22 bp, Homo sapiens
tttctcaaggtgtcatgtattt

SEQ ID NO: 9266770 - DNA, 22 bp, Homo sapiens
tttctcaaggtgtcatgtattt

SEQ ID NO: 9266771 - DNA, 22 bp, Homo sapiens
tttctcaaggtgtcatgtattt

SEQ ID NO: 9266772 - DNA, 22 bp, Homo sapiens
tttctcaactgtattatgcaga

SEQ ID NO: 9266773 - DNA, 22 bp, Homo sapiens
tttctattttaaaggcatatgg

SEQ ID NO: 9266774 - DNA, 22 bp, Homo sapiens
tttctattttaaaggcatatgg

SEQ ID NO: 9266775 - DNA, 22 bp, Homo sapiens
tttctattttaaaggcatatgg

SEQ ID NO: 9266776 - DNA, 22 bp, Homo sapiens
tttctacatgtcaatccaaacc

SEQ ID NO: 9266777 - DNA, 22 bp, Homo sapiens
tttctcaaattgcatgagtagc

SEQ ID NO: 9266778 - DNA, 22 bp, Homo sapiens
tttctcaacagagtatgccctt

SEQ ID NO: 9266779 - DNA, 22 bp, Homo sapiens
tttctcaacctcaacactattt

SEQ ID NO: 9266780 - DNA, 22 bp, Homo sapiens
tttctcaaaagacagaagtgaa

SEQ ID NO: 9266781 - DNA, 22 bp, Homo sapiens
tttctcaaatactgttccagga

SEQ ID NO: 9266782 - DNA, 22 bp, Homo sapiens
ctctctggtttcagcgaagggg

SEQ ID NO: 9266783 - DNA, 22 bp, Homo sapiens
ctctctgtatgtgtatatttat

SEQ ID NO: 9266784 - DNA, 22 bp, Homo sapiens
ctctctggtttcagcgaagggg

SEQ ID NO: 9266785 - DNA, 22 bp, Homo sapiens
ctctctgtggtggctgtcccat

SEQ ID NO: 9266786 - DNA, 22 bp, Homo sapiens
ctctctgtggtggctgtcccat

SEQ ID NO: 9266787 - DNA, 22 bp, Homo sapiens
ctctcttcccgtgagtgttgca

SEQ ID NO: 9266788 - DNA, 22 bp, Homo sapiens
ctctctgttcattgagtcaaaa

SEQ ID NO: 9266789 - DNA, 22 bp, Homo sapiens
ctctcttcccgtgagtgttgca

SEQ ID NO: 9266790 - DNA, 22 bp, Homo sapiens
ctctctgttatgctttcatgaa

SEQ ID NO: 9266791 - DNA, 22 bp, Homo sapiens
ctctctgttatgctttcatgaa

SEQ ID NO: 9266792 - DNA, 22 bp, Homo sapiens
ctctctgttatgctttcatgaa

SEQ ID NO: 9266793 - DNA, 22 bp, Homo sapiens
ctctctttcattggtcgccttg

SEQ ID NO: 9266794 - DNA, 18 bp, Homo sapiens
ctctctttccactctttg

SEQ ID NO: 9266795 - DNA, 22 bp, Homo sapiens
ctctgaaagacaagctctcatt

SEQ ID NO: 9266796 - DNA, 22 bp, Homo sapiens
ctctgaaactcctgcaccttct

SEQ ID NO: 9266797 - DNA, 22 bp, Homo sapiens
ctctgaaactccagccccaggt

SEQ ID NO: 9266798 - DNA, 18 bp, Homo sapiens
ctctgaaagacacaccag

SEQ ID NO: 9266799 - DNA, 22 bp, Homo sapiens
ctctgaaagagtttagtattat

SEQ ID NO: 9266800 - DNA, 22 bp, Homo sapiens
ctctgaaagagtttagtattat

SEQ ID NO: 9266801 - DNA, 22 bp, Homo sapiens
ctctgaaagttagagaaaatag

SEQ ID NO: 9266802 - DNA, 22 bp, Homo sapiens
ctctgaaagttagagaaaatag

SEQ ID NO: 9266803 - DNA, 22 bp, Homo sapiens
ctctgaaagcaaaactagagaa

SEQ ID NO: 9266804 - DNA, 22 bp, Homo sapiens
ctctgaaagcaaaactagagaa

SEQ ID NO: 9266805 - DNA, 22 bp, Homo sapiens
ctctctttctgaatgaggacta

SEQ ID NO: 9266806 - DNA, 18 bp, Homo sapiens
ctctctttccactctttg

SEQ ID NO: 9266807 - DNA, 22 bp, Homo sapiens
ctctgaaaatgtggtggggaaa

SEQ ID NO: 9266808 - DNA, 22 bp, Homo sapiens
ctctctttgatgtataaataat

SEQ ID NO: 9266809 - DNA, 22 bp, Homo sapiens
ctctgaaaatgtggtggggaaa

SEQ ID NO: 9266810 - DNA, 22 bp, Homo sapiens
ctctctttttcgtgtgccgaag

SEQ ID NO: 9266811 - DNA, 22 bp, Homo sapiens
tttccactcctattgcatctca

SEQ ID NO: 9266812 - DNA, 22 bp, Homo sapiens
tttccaatttggtagtcatcgg

SEQ ID NO: 9266813 - DNA, 22 bp, Homo sapiens
tttctacagctggtgcaacttt

SEQ ID NO: 9266814 - DNA, 22 bp, Homo sapiens
tttcctttctagaagcctaaat

SEQ ID NO: 9266815 - DNA, 22 bp, Homo sapiens
tttcattacgtgtttgacttgt

SEQ ID NO: 9266816 - DNA, 22 bp, Homo sapiens
tttccaataaagtgtcattgtt

SEQ ID NO: 9266817 - DNA, 22 bp, Homo sapiens
tttccaataaggtcaccttcct

SEQ ID NO: 9266818 - DNA, 22 bp, Homo sapiens
tttcatgttacatttaaaatgt

SEQ ID NO: 9266819 - DNA, 22 bp, Homo sapiens
tttcatgttacatttaaaatgt

SEQ ID NO: 9266820 - DNA, 22 bp, Homo sapiens
tttcatgttggatactgtttca

SEQ ID NO: 9266821 - DNA, 22 bp, Homo sapiens
tttcatgttggatactgtttca

SEQ ID NO: 9266822 - DNA, 22 bp, Homo sapiens
tttcattaaagtcaaatctggt

SEQ ID NO: 9266823 - DNA, 22 bp, Homo sapiens
tttcattacgtgtttgacttgt

SEQ ID NO: 9266824 - DNA, 22 bp, Homo sapiens
tttcattaaagtcaaatctggt

SEQ ID NO: 9266825 - DNA, 22 bp, Homo sapiens
tttcattaaagtcaaatctggt

SEQ ID NO: 9266826 - DNA, 22 bp, Homo sapiens
ctcctgtggtcaagggtgggac

SEQ ID NO: 9266827 - DNA, 22 bp, Homo sapiens
tttcagaatagcaaagcaagct

SEQ ID NO: 9266828 - DNA, 22 bp, Homo sapiens
ctccttcctgcagatctgagat

SEQ ID NO: 9266829 - DNA, 22 bp, Homo sapiens
tttcagtttatgtcttgaatta

SEQ ID NO: 9266830 - DNA, 22 bp, Homo sapiens
tttcagtttatgtcttgaatta

SEQ ID NO: 9266831 - DNA, 22 bp, Homo sapiens
tttcagtttcatggcacagcta

SEQ ID NO: 9266832 - DNA, 19 bp, Homo sapiens
ctccttccctggtttctgt

SEQ ID NO: 9266833 - DNA, 22 bp, Homo sapiens
tttcagaaccaagagagacatc

SEQ ID NO: 9266834 - DNA, 22 bp, Homo sapiens
tttcagaaccaagagagacatc

SEQ ID NO: 9266835 - DNA, 22 bp, Homo sapiens
tttcagaaattatattagatgc

SEQ ID NO: 9266836 - DNA, 22 bp, Homo sapiens
tttcagaaccgctaaaataaat

SEQ ID NO: 9266837 - DNA, 22 bp, Homo sapiens
tttcagaaccgctaaaataaat

SEQ ID NO: 9266838 - DNA, 22 bp, Homo sapiens
tttcagaaccgctaaaataaat

SEQ ID NO: 9266839 - DNA, 22 bp, Homo sapiens
ctccaggccagggaagtggaca

SEQ ID NO: 9266840 - DNA, 22 bp, Homo sapiens
ctccaggccagggaagtggaca

SEQ ID NO: 9266841 - DNA, 22 bp, Homo sapiens
ctccaggcccacggccgcggcc

SEQ ID NO: 9266842 - DNA, 23 bp, Homo sapiens
tttatattcctaatgtcttgagc

SEQ ID NO: 9266843 - DNA, 22 bp, Homo sapiens
tttatgagcctcaaatctgagt

SEQ ID NO: 9266844 - DNA, 22 bp, Homo sapiens
tttatgattattttaaagcagc

SEQ ID NO: 9266845 - DNA, 22 bp, Homo sapiens
ctccaggagggggatggctgta

SEQ ID NO: 9266846 - DNA, 22 bp, Homo sapiens
ctccaggccaagattaagtaat

SEQ ID NO: 9266847 - DNA, 22 bp, Homo sapiens
ctccaggatacctgttcctata

SEQ ID NO: 9266848 - DNA, 19 bp, Homo sapiens
ctccaggatggctgggcga

SEQ ID NO: 9266849 - DNA, 22 bp, Homo sapiens
tttatgtaagtggaatgatgcc

SEQ ID NO: 9266850 - DNA, 22 bp, Homo sapiens
tttatgtaagtggaatgatgcc

SEQ ID NO: 9266851 - DNA, 19 bp, Homo sapiens
tttattcacctttaccttg

SEQ ID NO: 9266852 - DNA, 19 bp, Homo sapiens
tttattcacctttaccttg

SEQ ID NO: 9266853 - DNA, 22 bp, Homo sapiens
tttattcactggggtctgcccg

SEQ ID NO: 9266854 - DNA, 23 bp, Homo sapiens
tttatgcagcatgtagaacatgg

SEQ ID NO: 9266855 - DNA, 23 bp, Homo sapiens
tttatgcagcatgtagaacatgg

SEQ ID NO: 9266856 - DNA, 23 bp, Homo sapiens
tttatgcagcatgtagaacatgg

SEQ ID NO: 9266857 - DNA, 21 bp, Homo sapiens
tttatgcagataatgctattt

SEQ ID NO: 9266858 - DNA, 22 bp, Homo sapiens
tttatgcagcactttacatttg

SEQ ID NO: 9266859 - DNA, 22 bp, Homo sapiens
tttatgcacacttagacatggc

SEQ ID NO: 9266860 - DNA, 22 bp, Homo sapiens
tttatgattattttaaagcagc

SEQ ID NO: 9266861 - DNA, 22 bp, Homo sapiens
tttatgcagcctcagtatcaga

SEQ ID NO: 9266862 - DNA, 22 bp, Homo sapiens
gaaaaatgctccaaatctgtgg

SEQ ID NO: 9266863 - DNA, 22 bp, Homo sapiens
gaaaaatgctccaaatctgtgg

SEQ ID NO: 9266864 - DNA, 22 bp, Homo sapiens
gaaacagctttaagtgatactg

SEQ ID NO: 9266865 - DNA, 22 bp, Homo sapiens
gaaaaatgagctgatgtcaggg

SEQ ID NO: 9266866 - DNA, 22 bp, Homo sapiens
gaaacagctagaaagccattgg

SEQ ID NO: 9266867 - DNA, 22 bp, Homo sapiens
gaaacagcccctgtgtgaagca

SEQ ID NO: 9266868 - DNA, 22 bp, Homo sapiens
gaaaaatgctccaaatctgtgg

SEQ ID NO: 9266869 - DNA, 22 bp, Homo sapiens
ctttttgttgtccacactagga

SEQ ID NO: 9266870 - DNA, 22 bp, Homo sapiens
ctttttgttgtccacactagga

SEQ ID NO: 9266871 - DNA, 22 bp, Homo sapiens
ctttttgtgtatgctacagttg

SEQ ID NO: 9266872 - DNA, 22 bp, Homo sapiens
ctttttgtgtatgctacagttg

SEQ ID NO: 9266873 - DNA, 22 bp, Homo sapiens
ctttttgtgtatgctacagttg

SEQ ID NO: 9266874 - DNA, 22 bp, Homo sapiens
ctttttgtctctgtcctgatga

SEQ ID NO: 9266875 - DNA, 22 bp, Homo sapiens
ctttttgttgtataagcccttt

SEQ ID NO: 9266876 - DNA, 22 bp, Homo sapiens
ctttttgttgtataagcccttt

SEQ ID NO: 9266877 - DNA, 22 bp, Homo sapiens
cttttttcctaaggcaacatga

SEQ ID NO: 9266878 - DNA, 22 bp, Homo sapiens
ctttttgtctctgtcctgatga

SEQ ID NO: 9266879 - DNA, 22 bp, Homo sapiens
gaaaaatgagctgatgtcaggg

SEQ ID NO: 9266880 - DNA, 22 bp, Homo sapiens
gaaagaagctttagatggctat

SEQ ID NO: 9266881 - DNA, 22 bp, Homo sapiens
gaaagaatcaactatgtctctg

SEQ ID NO: 9266882 - DNA, 22 bp, Homo sapiens
gaaagaatgagcatcatgactt

SEQ ID NO: 9266883 - DNA, 22 bp, Homo sapiens
gaaagaatgctatagtgacttc

SEQ ID NO: 9266884 - DNA, 22 bp, Homo sapiens
gaaactttcatgaatataagat

SEQ ID NO: 9266885 - DNA, 22 bp, Homo sapiens
gaaacctcttagcctctctttg

SEQ ID NO: 9266886 - DNA, 22 bp, Homo sapiens
gaaaccctgagaggtggtctgg

SEQ ID NO: 9266887 - DNA, 22 bp, Homo sapiens
gaaactgagtaggctagagcac

SEQ ID NO: 9266888 - DNA, 22 bp, Homo sapiens
gaaactagatgtattagagatt

SEQ ID NO: 9266889 - DNA, 22 bp, Homo sapiens
ctttggcaacacatgtgggaca

SEQ ID NO: 9266890 - DNA, 20 bp, Homo sapiens
ctttttctccagctctgagc

SEQ ID NO: 9266891 - DNA, 22 bp, Homo sapiens
ctttttctaatcataattgtct

SEQ ID NO: 9266892 - DNA, 22 bp, Homo sapiens
ctttttcttctaggtgtgcctg

SEQ ID NO: 9266893 - DNA, 22 bp, Homo sapiens
ctttttctgatgttccatgatt

SEQ ID NO: 9266894 - DNA, 22 bp, Homo sapiens
ctttttctgatgttccatgatt

SEQ ID NO: 9266895 - DNA, 16 bp, Homo sapiens
ctttttctcccctctt

SEQ ID NO: 9266896 - DNA, 22 bp, Homo sapiens
cttttgttaggagaaaacatca

SEQ ID NO: 9266897 - DNA, 22 bp, Homo sapiens
ctttttcccaggtggagagagg

SEQ ID NO: 9266898 - DNA, 22 bp, Homo sapiens
cttttgttctacagctggggaa

SEQ ID NO: 9266899 - DNA, 22 bp, Homo sapiens
cttttgttaggagaaaacatca

SEQ ID NO: 9266900 - DNA, 22 bp, Homo sapiens
gaagaagcaggagtgtgtagca

SEQ ID NO: 9266901 - DNA, 22 bp, Homo sapiens
gaagaactgtgacagaagcagt

SEQ ID NO: 9266902 - DNA, 22 bp, Homo sapiens
gaagaactttagggcagaattt

SEQ ID NO: 9266903 - DNA, 19 bp, Homo sapiens
gaagaagcttgagaagtag

SEQ ID NO: 9266904 - DNA, 22 bp, Homo sapiens
gaagaaggaagatcatgcttga

SEQ ID NO: 9266905 - DNA, 22 bp, Homo sapiens
gaagaaattgaattcatgagct

SEQ ID NO: 9266906 - DNA, 22 bp, Homo sapiens
gaagaacaagcagtgctttcct

SEQ ID NO: 9266907 - DNA, 22 bp, Homo sapiens
gaagaacacttcatgattcatt

SEQ ID NO: 9266908 - DNA, 22 bp, Homo sapiens
gaagaactgacaaactagatca

SEQ ID NO: 9266909 - DNA, 22 bp, Homo sapiens
gaactttaaaacaaagtacagt

SEQ ID NO: 9266910 - DNA, 22 bp, Homo sapiens
gaacttgagatatgagtaggta

SEQ ID NO: 9266911 - DNA, 22 bp, Homo sapiens
gaaattgtcagcttctttcagt

SEQ ID NO: 9266912 - DNA, 20 bp, Homo sapiens
gaaattctcgtattagttta

SEQ ID NO: 9266913 - DNA, 22 bp, Homo sapiens
gaaatatttctcttgagcccct

SEQ ID NO: 9266914 - DNA, 22 bp, Homo sapiens
gaaatattgtactggagatgtt

SEQ ID NO: 9266915 - DNA, 22 bp, Homo sapiens
gaaatattgggactcagagctt

SEQ ID NO: 9266916 - DNA, 22 bp, Homo sapiens
gaaatattgggactcagagctt

SEQ ID NO: 9266917 - DNA, 22 bp, Homo sapiens
gaaatattgggactcagagctt

SEQ ID NO: 9266918 - DNA, 22 bp, Homo sapiens
gaaatattgggactcagagctt

SEQ ID NO: 9266919 - DNA, 22 bp, Homo sapiens
gaaatattgtactggagatgtt

SEQ ID NO: 9266920 - DNA, 22 bp, Homo sapiens
gaaatattgtactggagatgtt

SEQ ID NO: 9266921 - DNA, 22 bp, Homo sapiens
gaaatattgtactggagatgtt

SEQ ID NO: 9266922 - DNA, 22 bp, Homo sapiens
gaaatgtatgtcttcccccatt

SEQ ID NO: 9266923 - DNA, 20 bp, Homo sapiens
gaaatgtatctcttgattct

SEQ ID NO: 9266924 - DNA, 22 bp, Homo sapiens
gaaatgtaggcataattatttt

SEQ ID NO: 9266925 - DNA, 22 bp, Homo sapiens
gaaatattcttgtcttgttttc

SEQ ID NO: 9266926 - DNA, 22 bp, Homo sapiens
gaaatattcttgtcttgttttc

SEQ ID NO: 9266927 - DNA, 22 bp, Homo sapiens
gaaatattcttgtcttgttttc

SEQ ID NO: 9266928 - DNA, 22 bp, Homo sapiens
gaaatattcttgtcttgttttc

SEQ ID NO: 9266929 - DNA, 22 bp, Homo sapiens
gaaatattacagtggaggggat

SEQ ID NO: 9266930 - DNA, 22 bp, Homo sapiens
gaaatatacattgcaggaagag

SEQ ID NO: 9266931 - DNA, 22 bp, Homo sapiens
gaaatattacagtggaggggat

SEQ ID NO: 9266932 - DNA, 22 bp, Homo sapiens
gaaatattacagtggaggggat

SEQ ID NO: 9266933 - DNA, 22 bp, Homo sapiens
gaaatattacagtggaggggat

SEQ ID NO: 9266934 - DNA, 22 bp, Homo sapiens
gaaatatacattgcaggaagag

SEQ ID NO: 9266935 - DNA, 22 bp, Homo sapiens
gaaatacaggaatgccacacag

SEQ ID NO: 9266936 - DNA, 22 bp, Homo sapiens
gaaatacagaaagggctgaatg

SEQ ID NO: 9266937 - DNA, 22 bp, Homo sapiens
gaaagagaacctgggcctagat

SEQ ID NO: 9266938 - DNA, 22 bp, Homo sapiens
gaaagacatagttgcaagatgg

SEQ ID NO: 9266939 - DNA, 22 bp, Homo sapiens
gaaagacatagttgcaagatgg

SEQ ID NO: 9266940 - DNA, 22 bp, Homo sapiens
ctttctctgtgtttcacatgct

SEQ ID NO: 9266941 - DNA, 22 bp, Homo sapiens
ctttctctgtgtttcacatgct

SEQ ID NO: 9266942 - DNA, 22 bp, Homo sapiens
ctttctctgtgtggtaaagggc

SEQ ID NO: 9266943 - DNA, 22 bp, Homo sapiens
ctttctctgtggtgaggagggt

SEQ ID NO: 9266944 - DNA, 22 bp, Homo sapiens
ctttctctggaggggagtggtt

SEQ ID NO: 9266945 - DNA, 22 bp, Homo sapiens
ctttctctggaggggagtggtt

SEQ ID NO: 9266946 - DNA, 20 bp, Homo sapiens
ctttctctaatttataagta

SEQ ID NO: 9266947 - DNA, 20 bp, Homo sapiens
ctttctctaatttataagta

SEQ ID NO: 9266948 - DNA, 22 bp, Homo sapiens
ctttctagttgacagcatgcca

SEQ ID NO: 9266949 - DNA, 22 bp, Homo sapiens
ctttctcagtgttaattacttt

SEQ ID NO: 9266950 - DNA, 22 bp, Homo sapiens
ctttctccctgtcccaaactgg

SEQ ID NO: 9266951 - DNA, 22 bp, Homo sapiens
ctttctcagtgttaattacttt

SEQ ID NO: 9266952 - DNA, 22 bp, Homo sapiens
ctttctccagagctgcttattt

SEQ ID NO: 9266953 - DNA, 22 bp, Homo sapiens
ctttctcttacccaaggatctg

SEQ ID NO: 9266954 - DNA, 22 bp, Homo sapiens
ctttctcttcactgtcatgatc

SEQ ID NO: 9266955 - DNA, 22 bp, Homo sapiens
ctttctctgtgtttcacatgct

SEQ ID NO: 9266956 - DNA, 22 bp, Homo sapiens
ctttctctgtgtttcacatgct

SEQ ID NO: 9266957 - DNA, 22 bp, Homo sapiens
ctttctcttacccaaggatctg

SEQ ID NO: 9266958 - DNA, 22 bp, Homo sapiens
ctttctctgtgtttcacatgct

SEQ ID NO: 9266959 - DNA, 22 bp, Homo sapiens
ctttcctccactccctaggctt

SEQ ID NO: 9266960 - DNA, 22 bp, Homo sapiens
ctttcctctggcactgtctggt

SEQ ID NO: 9266961 - DNA, 22 bp, Homo sapiens
ctttcctgaggagtatggctgt

SEQ ID NO: 9266962 - DNA, 22 bp, Homo sapiens
ctttcctgaaatctcttctgca

SEQ ID NO: 9266963 - DNA, 22 bp, Homo sapiens
ctttccttctcgtggttctcac

SEQ ID NO: 9266964 - DNA, 22 bp, Homo sapiens
ctttccttctcgtggttctcac

SEQ ID NO: 9266965 - DNA, 22 bp, Homo sapiens
ctttccttaataagcaggtata

SEQ ID NO: 9266966 - DNA, 22 bp, Homo sapiens
ctttcctggctggcagttgtgg

SEQ ID NO: 9266967 - DNA, 23 bp, Homo sapiens
ctttcctttctttgacacccagc

SEQ ID NO: 9266968 - DNA, 23 bp, Homo sapiens
ctttcctttctttgacacccagc

SEQ ID NO: 9266969 - DNA, 22 bp, Homo sapiens
ctttcctagttggtcccagcac

SEQ ID NO: 9266970 - DNA, 22 bp, Homo sapiens
cttggagtcaataagatctaga

SEQ ID NO: 9266971 - DNA, 22 bp, Homo sapiens
cttggaggatgtgcggctgccc

SEQ ID NO: 9266972 - DNA, 22 bp, Homo sapiens
cttggagattcattgcctgaaa

SEQ ID NO: 9266973 - DNA, 22 bp, Homo sapiens
cttggaggaaaggcagggagac

SEQ ID NO: 9266974 - DNA, 22 bp, Homo sapiens
cttgcctccctcagctcacagc

SEQ ID NO: 9266975 - DNA, 22 bp, Homo sapiens
cttgcctccctcagctcacagc

SEQ ID NO: 9266976 - DNA, 22 bp, Homo sapiens
cttgcctccctcagctcacagc

SEQ ID NO: 9266977 - DNA, 22 bp, Homo sapiens
cttgcctccctcagctcacagc

SEQ ID NO: 9266978 - DNA, 19 bp, Homo sapiens
cttcttcttggcagccaag

SEQ ID NO: 9266979 - DNA, 22 bp, Homo sapiens
cttgcctacttgtcaaccagca

SEQ ID NO: 9266980 - DNA, 22 bp, Homo sapiens
cttcttcttcccccttcagggg

SEQ ID NO: 9266981 - DNA, 22 bp, Homo sapiens
cttcttctggacaggcagctcc

SEQ ID NO: 9266982 - DNA, 22 bp, Homo sapiens
cttcttctggacaggcagctcc

SEQ ID NO: 9266983 - DNA, 22 bp, Homo sapiens
cttcttctggtttatgtggcaa

SEQ ID NO: 9266984 - DNA, 22 bp, Homo sapiens
cttgcctgccactacagctgaa

SEQ ID NO: 9266985 - DNA, 22 bp, Homo sapiens
cttgcctgaggaacagagggta

SEQ ID NO: 9266986 - DNA, 22 bp, Homo sapiens
cttgcctctgctaatggtttct

SEQ ID NO: 9266987 - DNA, 22 bp, Homo sapiens
cttgctggggtaagtctgtgct

SEQ ID NO: 9266988 - DNA, 22 bp, Homo sapiens
cttgctgtcccttggtatgaac

SEQ ID NO: 9266989 - DNA, 22 bp, Homo sapiens
cttgctgtcttgcatttagagc

SEQ ID NO: 9266990 - DNA, 22 bp, Homo sapiens
cttcttctcaaggggcaggtgg

SEQ ID NO: 9266991 - DNA, 22 bp, Homo sapiens
cttcttctctacatcctttgat

SEQ ID NO: 9266992 - DNA, 22 bp, Homo sapiens
cttcttcctgctgcagcctcca

SEQ ID NO: 9266993 - DNA, 22 bp, Homo sapiens
cttcttcctgctgcagcctcca

SEQ ID NO: 9266994 - DNA, 22 bp, Homo sapiens
cttcttcccagcttccctcacc

SEQ ID NO: 9266995 - DNA, 22 bp, Homo sapiens
cttcttcccagcttccctcacc

SEQ ID NO: 9266996 - DNA, 22 bp, Homo sapiens
cttcttccaagcttatgctcaa

SEQ ID NO: 9266997 - DNA, 22 bp, Homo sapiens
cttgctttcagtctcggcctca

SEQ ID NO: 9266998 - DNA, 22 bp, Homo sapiens
cttgctttatctggtttctcat

SEQ ID NO: 9266999 - DNA, 22 bp, Homo sapiens
cttgctgtgtgccatcagggct

SEQ ID NO: 9267000 - DNA, 22 bp, Homo sapiens
cttgctgttatccatattatct

SEQ ID NO: 9267001 - DNA, 22 bp, Homo sapiens
cttggaaagttatcattttcct

SEQ ID NO: 9267002 - DNA, 22 bp, Homo sapiens
cttggaacaaattaaacaatac

SEQ ID NO: 9267003 - DNA, 22 bp, Homo sapiens
cttgcttttgctgatgattaag

SEQ ID NO: 9267004 - DNA, 22 bp, Homo sapiens
cttggaacttagtaatatgaca

SEQ ID NO: 9267005 - DNA, 21 bp, Homo sapiens
cttggaacgggtagaactcac

SEQ ID NO: 9267006 - DNA, 22 bp, Homo sapiens
cttggaatggggcagaaaatgg

SEQ ID NO: 9267007 - DNA, 22 bp, Homo sapiens
cttggaattgatgattttcata

SEQ ID NO: 9267008 - DNA, 22 bp, Homo sapiens
cttggacccactcccagaattg

SEQ ID NO: 9267009 - DNA, 22 bp, Homo sapiens
cttggagagagcctcagctgtt

SEQ ID NO: 9267010 - DNA, 22 bp, Homo sapiens
cttcttcataggcagtcctgtt

SEQ ID NO: 9267011 - DNA, 22 bp, Homo sapiens
cttcttcatctgtaaaacttgg

SEQ ID NO: 9267012 - DNA, 22 bp, Homo sapiens
cttcttcagaggccagcctctg

SEQ ID NO: 9267013 - DNA, 20 bp, Homo sapiens
cttcttcagcctatgcttca

SEQ ID NO: 9267014 - DNA, 22 bp, Homo sapiens
cttctgtgacgtatgtgaggac

SEQ ID NO: 9267015 - DNA, 22 bp, Homo sapiens
cttccctggtgttagcccaatg

SEQ ID NO: 9267016 - DNA, 22 bp, Homo sapiens
cttccctggtgttagcccaatg

SEQ ID NO: 9267017 - DNA, 22 bp, Homo sapiens
cttccctgataagagcctcaga

SEQ ID NO: 9267018 - DNA, 22 bp, Homo sapiens
cttccctgagctttctcaggct

SEQ ID NO: 9267019 - DNA, 22 bp, Homo sapiens
cttccctgataagagcctcaga

SEQ ID NO: 9267020 - DNA, 22 bp, Homo sapiens
cttccctgataagagcctcaga

SEQ ID NO: 9267021 - DNA, 22 bp, Homo sapiens
cttccctgataagagcctcaga

SEQ ID NO: 9267022 - DNA, 19 bp, Homo sapiens
cttcccctgttacctcact

SEQ ID NO: 9267023 - DNA, 19 bp, Homo sapiens
cttcccctgttacctcact

SEQ ID NO: 9267024 - DNA, 19 bp, Homo sapiens
cttcccctgttacctcact

SEQ ID NO: 9267025 - DNA, 21 bp, Homo sapiens
cttccccaggctggtctgtat

SEQ ID NO: 9267026 - DNA, 22 bp, Homo sapiens
cttccctcctggattccagact

SEQ ID NO: 9267027 - DNA, 22 bp, Homo sapiens
cttcccagaccttagagtgcag

SEQ ID NO: 9267028 - DNA, 22 bp, Homo sapiens
cttcccagacggggtggcagcc

SEQ ID NO: 9267029 - DNA, 22 bp, Homo sapiens
cttccccaagtagagaggggag

SEQ ID NO: 9267030 - DNA, 22 bp, Homo sapiens
cttccccaaccccgactgtgtg

SEQ ID NO: 9267031 - DNA, 22 bp, Homo sapiens
cttcccagttctgcttgagggg

SEQ ID NO: 9267032 - DNA, 22 bp, Homo sapiens
cttccccaggacctctgctaaa

SEQ ID NO: 9267033 - DNA, 22 bp, Homo sapiens
cttcccagttctgcttgagggg

SEQ ID NO: 9267034 - DNA, 22 bp, Homo sapiens
cttcccagttctgcttgagggg

SEQ ID NO: 9267035 - DNA, 22 bp, Homo sapiens
cttcaaatacaagtagattatg

SEQ ID NO: 9267036 - DNA, 22 bp, Homo sapiens
cttcaaatccccctgagtttga

SEQ ID NO: 9267037 - DNA, 23 bp, Homo sapiens
ctgttaaattccttaagagcagg

SEQ ID NO: 9267038 - DNA, 22 bp, Homo sapiens
ctgttaaatgagaaagcagact

SEQ ID NO: 9267039 - DNA, 20 bp, Homo sapiens
ctgttaaaaggtatgaattc

SEQ ID NO: 9267040 - DNA, 22 bp, Homo sapiens
ctgttaaaaagaccaatggatt

SEQ ID NO: 9267041 - DNA, 20 bp, Homo sapiens
ctgttaaaaggtatgaattc

SEQ ID NO: 9267042 - DNA, 22 bp, Homo sapiens
ctgttaaaatgtggtcttaaaa

SEQ ID NO: 9267043 - DNA, 22 bp, Homo sapiens
ctgttaaaatgtggtcttaaaa

SEQ ID NO: 9267044 - DNA, 22 bp, Homo sapiens
ctgttaaagatagttaagcttc

SEQ ID NO: 9267045 - DNA, 22 bp, Homo sapiens
cttcacagtcaccctgctgtgt

SEQ ID NO: 9267046 - DNA, 22 bp, Homo sapiens
cttcacagtaaatccagaagaa

SEQ ID NO: 9267047 - DNA, 23 bp, Homo sapiens
cttcacaggttcaggggattaag

SEQ ID NO: 9267048 - DNA, 23 bp, Homo sapiens
cttcacaggttcaggggattaag

SEQ ID NO: 9267049 - DNA, 22 bp, Homo sapiens
cttcacagccaacatgggcaca

SEQ ID NO: 9267050 - DNA, 22 bp, Homo sapiens
cttcacagcatgagctttggag

SEQ ID NO: 9267051 - DNA, 16 bp, Homo sapiens
cttcacagaggagagt

SEQ ID NO: 9267052 - DNA, 22 bp, Homo sapiens
cttcactgcagtcatggctctg

SEQ ID NO: 9267053 - DNA, 22 bp, Homo sapiens
cttccaggacaccagggtagta

SEQ ID NO: 9267054 - DNA, 22 bp, Homo sapiens
cttccagggtccaggaagagcc

SEQ ID NO: 9267055 - DNA, 22 bp, Homo sapiens
cttcacttcacagatgccaaga

SEQ ID NO: 9267056 - DNA, 22 bp, Homo sapiens
cttcacttgctcatcatgctat

SEQ ID NO: 9267057 - DNA, 22 bp, Homo sapiens
ctgtggcacatgtggcaaggcc

SEQ ID NO: 9267058 - DNA, 22 bp, Homo sapiens
ctgtggcacatgtggcaaggcc

SEQ ID NO: 9267059 - DNA, 23 bp, Homo sapiens
ctgtggcaagtcctgcacctgcc

SEQ ID NO: 9267060 - DNA, 22 bp, Homo sapiens
ctgtggcaagtctgcctgtcac

SEQ ID NO: 9267061 - DNA, 22 bp, Homo sapiens
ctgtggcaggaagggactagca

SEQ ID NO: 9267062 - DNA, 22 bp, Homo sapiens
ctgtggcactcaagaagcctcc

SEQ ID NO: 9267063 - DNA, 22 bp, Homo sapiens
ctgtggatttacttgagaagct

SEQ ID NO: 9267064 - DNA, 23 bp, Homo sapiens
ctgtggcaagtcctgcacctgcc

SEQ ID NO: 9267065 - DNA, 22 bp, Homo sapiens
ctgtggagtttgtggcgctgac

SEQ ID NO: 9267066 - DNA, 22 bp, Homo sapiens
ctgtggatttaggcagagctga

SEQ ID NO: 9267067 - DNA, 22 bp, Homo sapiens
ctgtggcaggtgtctggggcag

SEQ ID NO: 9267068 - DNA, 22 bp, Homo sapiens
ctgtggcaggaagggactagca

SEQ ID NO: 9267069 - DNA, 22 bp, Homo sapiens
ctgtggcaggtgtctggggcag

SEQ ID NO: 9267070 - DNA, 22 bp, Homo sapiens
ctgtggcaggtgtctggggcag

SEQ ID NO: 9267071 - DNA, 22 bp, Homo sapiens
ctgtggcaggtgtctggggcag

SEQ ID NO: 9267072 - DNA, 20 bp, Homo sapiens
ctgtggcatctgtcatggtg

SEQ ID NO: 9267073 - DNA, 20 bp, Homo sapiens
ctgtggcatctgtcatggtg

SEQ ID NO: 9267074 - DNA, 22 bp, Homo sapiens
ctgtggcattgccgaggctggc

SEQ ID NO: 9267075 - DNA, 22 bp, Homo sapiens
ctgtggcattgccgaggctggc

SEQ ID NO: 9267076 - DNA, 22 bp, Homo sapiens
ctgtggcattgccgaggctggc

SEQ ID NO: 9267077 - DNA, 22 bp, Homo sapiens
ctgtggcattgtgaggactgca

SEQ ID NO: 9267078 - DNA, 20 bp, Homo sapiens
ctgtggcatctgtcatggtg

SEQ ID NO: 9267079 - DNA, 22 bp, Homo sapiens
ctgtggcattgccgaggctggc

SEQ ID NO: 9267080 - DNA, 22 bp, Homo sapiens
ctgtgggatgggacctcagctg

SEQ ID NO: 9267081 - DNA, 22 bp, Homo sapiens
ctgtgggatgggacctcagctg

SEQ ID NO: 9267082 - DNA, 22 bp, Homo sapiens
ctgtgggagcactggggaccga

SEQ ID NO: 9267083 - DNA, 22 bp, Homo sapiens
ctgtggctttctctgcctcctt

SEQ ID NO: 9267084 - DNA, 22 bp, Homo sapiens
ctgtggtggcacagcgggctgg

SEQ ID NO: 9267085 - DNA, 22 bp, Homo sapiens
ctgtggtggcacagcgggctgg

SEQ ID NO: 9267086 - DNA, 22 bp, Homo sapiens
ctgtggtgagcaactgactgaa

SEQ ID NO: 9267087 - DNA, 21 bp, Homo sapiens
ctgtggtacagctgggacgga

SEQ ID NO: 9267088 - DNA, 22 bp, Homo sapiens
ctgtggtcaccaggctggggcc

SEQ ID NO: 9267089 - DNA, 22 bp, Homo sapiens
ctgtggggccaaattctcctct

SEQ ID NO: 9267090 - DNA, 22 bp, Homo sapiens
ctgtgtgtgagaagcaggttga

SEQ ID NO: 9267091 - DNA, 23 bp, Homo sapiens
ctgtgtgtgccgagggtggccac

SEQ ID NO: 9267092 - DNA, 23 bp, Homo sapiens
ctgtgtgtgccgagggtggccac

SEQ ID NO: 9267093 - DNA, 22 bp, Homo sapiens
ctgtgtgtgaacacagcccagc

SEQ ID NO: 9267094 - DNA, 22 bp, Homo sapiens
ctgtgtgtgaacacagcccagc

SEQ ID NO: 9267095 - DNA, 22 bp, Homo sapiens
ctgtgtgtgagaagcaggttga

SEQ ID NO: 9267096 - DNA, 22 bp, Homo sapiens
ctgtgtgtgctacaggcttcca

SEQ ID NO: 9267097 - DNA, 22 bp, Homo sapiens
ctgtgtgtgctacaggcttcca

SEQ ID NO: 9267098 - DNA, 22 bp, Homo sapiens
ctgtgtgtgtctgcagcatact

SEQ ID NO: 9267099 - DNA, 22 bp, Homo sapiens
ctgtgtgtgtctgcagcatact

SEQ ID NO: 9267100 - DNA, 22 bp, Homo sapiens
ctgtgtgtgtctgcagcatact

SEQ ID NO: 9267101 - DNA, 22 bp, Homo sapiens
ctgtgtgtttatatcatttcct

SEQ ID NO: 9267102 - DNA, 22 bp, Homo sapiens
ctgtgtttctgagaagtgggga

SEQ ID NO: 9267103 - DNA, 22 bp, Homo sapiens
ctgtgtttggacaacttttcag

SEQ ID NO: 9267104 - DNA, 22 bp, Homo sapiens
ctgtgtttgacaggcggtctcc

SEQ ID NO: 9267105 - DNA, 22 bp, Homo sapiens
ctgtgttttgagatattattaa

SEQ ID NO: 9267106 - DNA, 22 bp, Homo sapiens
ctgtgttttgagatattattaa

SEQ ID NO: 9267107 - DNA, 22 bp, Homo sapiens
ctgtgtttttggtctgatctat

SEQ ID NO: 9267108 - DNA, 22 bp, Homo sapiens
ctgtgtttttggtctgatctat

SEQ ID NO: 9267109 - DNA, 22 bp, Homo sapiens
ctgtgttttgattaaaaagcaa

SEQ ID NO: 9267110 - DNA, 22 bp, Homo sapiens
ctgtgaattaagtattgttatc

SEQ ID NO: 9267111 - DNA, 22 bp, Homo sapiens
ctgtgaatgttgaataaatcct

SEQ ID NO: 9267112 - DNA, 22 bp, Homo sapiens
ctgtgaatgttatatctcaatg

SEQ ID NO: 9267113 - DNA, 22 bp, Homo sapiens
ctgtgaattgcaacaattgcaa

SEQ ID NO: 9267114 - DNA, 22 bp, Homo sapiens
ctgtgaatttaaagcacacatc

SEQ ID NO: 9267115 - DNA, 22 bp, Homo sapiens
ctgtgaattttccaatattccg

SEQ ID NO: 9267116 - DNA, 22 bp, Homo sapiens
ctgtgacagagcttgagtgaga

SEQ ID NO: 9267117 - DNA, 22 bp, Homo sapiens
ctgtgaatttaaagcacacatc

SEQ ID NO: 9267118 - DNA, 21 bp, Homo sapiens
ctgtccctctttgcttccctc

SEQ ID NO: 9267119 - DNA, 22 bp, Homo sapiens
ctgtgaaactggacagcacttg

SEQ ID NO: 9267120 - DNA, 22 bp, Homo sapiens
ctgtccctcatcacctctgggt

SEQ ID NO: 9267121 - DNA, 22 bp, Homo sapiens
ctgtccctctcacacctcacca

SEQ ID NO: 9267122 - DNA, 22 bp, Homo sapiens
ctgtccctctcacacctcacca

SEQ ID NO: 9267123 - DNA, 21 bp, Homo sapiens
ctgtgactccctgggcaatcc

SEQ ID NO: 9267124 - DNA, 22 bp, Homo sapiens
ctgtgactgcagcaccaagtaa

SEQ ID NO: 9267125 - DNA, 22 bp, Homo sapiens
ctgtgacttccactactgatca

SEQ ID NO: 9267126 - DNA, 22 bp, Homo sapiens
ctgtgagggcagggaccagagg

SEQ ID NO: 9267127 - DNA, 22 bp, Homo sapiens
ctgtgaggcctttggccagata

SEQ ID NO: 9267128 - DNA, 22 bp, Homo sapiens
ctgtgagctgggtggccaggac

SEQ ID NO: 9267129 - DNA, 22 bp, Homo sapiens
ctgtggaaggtttagataggta

SEQ ID NO: 9267130 - DNA, 22 bp, Homo sapiens
ctgtggaattgatgcttagtgt

SEQ ID NO: 9267131 - DNA, 22 bp, Homo sapiens
ctgtccccgcgagtccagagct

SEQ ID NO: 9267132 - DNA, 20 bp, Homo sapiens
ctgtccccgaggtcaccagg

SEQ ID NO: 9267133 - DNA, 22 bp, Homo sapiens
ctgtccccgcgagtccagagct

SEQ ID NO: 9267134 - DNA, 22 bp, Homo sapiens
ctgtcccctgtgctttcacttg

SEQ ID NO: 9267135 - DNA, 22 bp, Homo sapiens
ctgtccccacccaaatctcatc

SEQ ID NO: 9267136 - DNA, 22 bp, Homo sapiens
ctgtccccacccaaatctcatc

SEQ ID NO: 9267137 - DNA, 22 bp, Homo sapiens
ctgtcccagatgttctcagcac

SEQ ID NO: 9267138 - DNA, 22 bp, Homo sapiens
ctgtcccagatgttctcagcac

SEQ ID NO: 9267139 - DNA, 22 bp, Homo sapiens
ctgtcccagatgttctcagcac

SEQ ID NO: 9267140 - DNA, 22 bp, Homo sapiens
ctgtcccaggagctgtaagaca

SEQ ID NO: 9267141 - DNA, 22 bp, Homo sapiens
ctgtcccaggagctgtaagaca

SEQ ID NO: 9267142 - DNA, 22 bp, Homo sapiens
ctgtcccacaagcagtgtgcac

SEQ ID NO: 9267143 - DNA, 22 bp, Homo sapiens
ctggttggtgccacatggtggc

SEQ ID NO: 9267144 - DNA, 22 bp, Homo sapiens
ctggttgggaggttggctttca

SEQ ID NO: 9267145 - DNA, 22 bp, Homo sapiens
ctggttggaagtgcagactctc

SEQ ID NO: 9267146 - DNA, 22 bp, Homo sapiens
ctggttttatgttatagatgga

SEQ ID NO: 9267147 - DNA, 22 bp, Homo sapiens
ctgtcatggtcagattgtcatc

SEQ ID NO: 9267148 - DNA, 22 bp, Homo sapiens
ctgtcattcttacataatgtga

SEQ ID NO: 9267149 - DNA, 22 bp, Homo sapiens
ctgtcattcttacataatgtga

SEQ ID NO: 9267150 - DNA, 22 bp, Homo sapiens
ctgtcatcacagttgagcagcc

SEQ ID NO: 9267151 - DNA, 22 bp, Homo sapiens
ctgtcagttcttccagatagag

SEQ ID NO: 9267152 - DNA, 22 bp, Homo sapiens
ctgtcagtaggctcccatcatt

SEQ ID NO: 9267153 - DNA, 21 bp, Homo sapiens
ctgggctcatggtgttacaga

SEQ ID NO: 9267154 - DNA, 22 bp, Homo sapiens
ctgggctccactacttgctaac

SEQ ID NO: 9267155 - DNA, 22 bp, Homo sapiens
ctgggctccactcccacagtgt

SEQ ID NO: 9267156 - DNA, 22 bp, Homo sapiens
ctgggctcagtgtctcactcct

SEQ ID NO: 9267157 - DNA, 22 bp, Homo sapiens
ctgggctcagtggctcatggct

SEQ ID NO: 9267158 - DNA, 22 bp, Homo sapiens
ctgggctcagtggctcatggct

SEQ ID NO: 9267159 - DNA, 22 bp, Homo sapiens
ctgggcctcatgcacagagatg

SEQ ID NO: 9267160 - DNA, 22 bp, Homo sapiens
ctgggctcaaatcctggccctg

SEQ ID NO: 9267161 - DNA, 22 bp, Homo sapiens
ctgggctcagcccatgctgtcc

SEQ ID NO: 9267162 - DNA, 22 bp, Homo sapiens
ctgggctcagcccatgctgtcc

SEQ ID NO: 9267163 - DNA, 22 bp, Homo sapiens
ctgggccctatggaagaaaggg

SEQ ID NO: 9267164 - DNA, 22 bp, Homo sapiens
ctgggccctatggaagaaaggg

SEQ ID NO: 9267165 - DNA, 22 bp, Homo sapiens
ctgggcctagaggaagctgaca

SEQ ID NO: 9267166 - DNA, 22 bp, Homo sapiens
ctgggccctgaagacagtcagg

SEQ ID NO: 9267167 - DNA, 22 bp, Homo sapiens
ctgggcctagcaacagaggagt

SEQ ID NO: 9267168 - DNA, 22 bp, Homo sapiens
ctgggcctagcaacagaggagt

SEQ ID NO: 9267169 - DNA, 22 bp, Homo sapiens
ctgggcctagcaacagaggagt

SEQ ID NO: 9267170 - DNA, 23 bp, Homo sapiens
ctgggcctatggtctgaatccaa

SEQ ID NO: 9267171 - DNA, 22 bp, Homo sapiens
ctgggcctcaccctagaccaat

SEQ ID NO: 9267172 - DNA, 22 bp, Homo sapiens
ctgggcctcaatctcagagttt

SEQ ID NO: 9267173 - DNA, 22 bp, Homo sapiens
ctgggcctcatccccagagttt

SEQ ID NO: 9267174 - DNA, 22 bp, Homo sapiens
ctgggcctcatccccagagttt

SEQ ID NO: 9267175 - DNA, 22 bp, Homo sapiens
ctgggcctcatcctcagagttt

SEQ ID NO: 9267176 - DNA, 22 bp, Homo sapiens
ctgggccaggaccagggttgaa

SEQ ID NO: 9267177 - DNA, 22 bp, Homo sapiens
ctgggccagcaactgcaatgga

SEQ ID NO: 9267178 - DNA, 22 bp, Homo sapiens
ctgggatgtgaggagcgcctct

SEQ ID NO: 9267179 - DNA, 22 bp, Homo sapiens
ctgggatgggaactgagaatca

SEQ ID NO: 9267180 - DNA, 22 bp, Homo sapiens
ctgggatgggaactgagaatca

SEQ ID NO: 9267181 - DNA, 22 bp, Homo sapiens
ctgggatgtctatagaacactt

SEQ ID NO: 9267182 - DNA, 22 bp, Homo sapiens
ctgggatgctccggcctggatg

SEQ ID NO: 9267183 - DNA, 22 bp, Homo sapiens
ctgggatgcggaggttgcggtg

SEQ ID NO: 9267184 - DNA, 22 bp, Homo sapiens
ctgggagtttctagagaaagac

SEQ ID NO: 9267185 - DNA, 22 bp, Homo sapiens
ctgggatgatagtgctagtatt

SEQ ID NO: 9267186 - DNA, 22 bp, Homo sapiens
ctgggagtttgttagtaatgca

SEQ ID NO: 9267187 - DNA, 22 bp, Homo sapiens
ctgggaggcggaggttgcagtg

SEQ ID NO: 9267188 - DNA, 22 bp, Homo sapiens
ctgggagtccaggatacagatg

SEQ ID NO: 9267189 - DNA, 22 bp, Homo sapiens
ctgggagtggtgacagctctcg

SEQ ID NO: 9267190 - DNA, 22 bp, Homo sapiens
ctgggagtggtgacagctctcg

SEQ ID NO: 9267191 - DNA, 22 bp, Homo sapiens
ctggagctccagggtctcctct

SEQ ID NO: 9267192 - DNA, 22 bp, Homo sapiens
ctggagctccagggtctcctct

SEQ ID NO: 9267193 - DNA, 22 bp, Homo sapiens
ctgggaggcggaggttgcagtg

SEQ ID NO: 9267194 - DNA, 22 bp, Homo sapiens
ctggagctaataatccatctga

SEQ ID NO: 9267195 - DNA, 22 bp, Homo sapiens
ctggagctaataatccatctga

SEQ ID NO: 9267196 - DNA, 22 bp, Homo sapiens
ctggagctaggaagtccaagat

SEQ ID NO: 9267197 - DNA, 22 bp, Homo sapiens
ctggagctaggaagtccaagat

SEQ ID NO: 9267198 - DNA, 22 bp, Homo sapiens
ctggagctcagcccaggttcca

SEQ ID NO: 9267199 - DNA, 22 bp, Homo sapiens
ctggagccttcaccaggggaaa

SEQ ID NO: 9267200 - DNA, 22 bp, Homo sapiens
ctggtggggagtcctggtctcc

SEQ ID NO: 9267201 - DNA, 22 bp, Homo sapiens
ctggtgcctcctccctgtgctt

SEQ ID NO: 9267202 - DNA, 22 bp, Homo sapiens
ctggtcaaaaattatgcttact

SEQ ID NO: 9267203 - DNA, 22 bp, Homo sapiens
ctggtatagtataaattaatgt

SEQ ID NO: 9267204 - DNA, 22 bp, Homo sapiens
ctggtcaataatcatgtagtac

SEQ ID NO: 9267205 - DNA, 22 bp, Homo sapiens
ctggttatcctgcctattttgt

SEQ ID NO: 9267206 - DNA, 22 bp, Homo sapiens
ctggtgtggactccgcgcggag

SEQ ID NO: 9267207 - DNA, 22 bp, Homo sapiens
ctggtgtcattttagcctcagg

SEQ ID NO: 9267208 - DNA, 22 bp, Homo sapiens
ctggtgtgattgagcccaggtg

SEQ ID NO: 9267209 - DNA, 22 bp, Homo sapiens
ctggtgtctgctccctcacagc

SEQ ID NO: 9267210 - DNA, 22 bp, Homo sapiens
ctggtgtctgctccctcacagc

SEQ ID NO: 9267211 - DNA, 22 bp, Homo sapiens
ctggtgtctgattctcccctga

SEQ ID NO: 9267212 - DNA, 22 bp, Homo sapiens
ctgggttttattacagtgagct

SEQ ID NO: 9267213 - DNA, 22 bp, Homo sapiens
ctgggttccatgtagccaagag

SEQ ID NO: 9267214 - DNA, 22 bp, Homo sapiens
ctgggttctatttttggcttca

SEQ ID NO: 9267215 - DNA, 22 bp, Homo sapiens
ctgggttgcaaagcgctggctg

SEQ ID NO: 9267216 - DNA, 22 bp, Homo sapiens
ctgggtttagggtctccccttg

SEQ ID NO: 9267217 - DNA, 22 bp, Homo sapiens
ctgggtggaaagtgctgagaat

SEQ ID NO: 9267218 - DNA, 22 bp, Homo sapiens
ctgggtggaaagtgctgagaat

SEQ ID NO: 9267219 - DNA, 22 bp, Homo sapiens
ctgggtggttttgatgtgaatt

SEQ ID NO: 9267220 - DNA, 22 bp, Homo sapiens
ctgggtgtagatggaagtttgg

SEQ ID NO: 9267221 - DNA, 22 bp, Homo sapiens
ctgggtggttctaactgttgat

SEQ ID NO: 9267222 - DNA, 22 bp, Homo sapiens
ctgggtgttgggtactgaccgt

SEQ ID NO: 9267223 - DNA, 22 bp, Homo sapiens
ctgggtgtcaggagacatgatg

SEQ ID NO: 9267224 - DNA, 22 bp, Homo sapiens
ctgggtgtagcccagtatgagg

SEQ ID NO: 9267225 - DNA, 22 bp, Homo sapiens
ctggggtggtgcaggcctcatg

SEQ ID NO: 9267226 - DNA, 22 bp, Homo sapiens
ctggggtggtgcaggcctcatg

SEQ ID NO: 9267227 - DNA, 22 bp, Homo sapiens
ctggggtggtgcaggcctcatg

SEQ ID NO: 9267228 - DNA, 22 bp, Homo sapiens
ctgggtggaaagtgctgagaat

SEQ ID NO: 9267229 - DNA, 22 bp, Homo sapiens
ctgggtgcttactttgtgctag

SEQ ID NO: 9267230 - DNA, 22 bp, Homo sapiens
ctggggtggtgcaggcctcatg

SEQ ID NO: 9267231 - DNA, 22 bp, Homo sapiens
ctggggtggatgggtccaagtt

SEQ ID NO: 9267232 - DNA, 22 bp, Homo sapiens
ctggggtggaggagctcccctg

SEQ ID NO: 9267233 - DNA, 22 bp, Homo sapiens
ctggggtggaggagctcccctg

SEQ ID NO: 9267234 - DNA, 22 bp, Homo sapiens
ctggggtggagattggcaatct

SEQ ID NO: 9267235 - DNA, 22 bp, Homo sapiens
ctgggggtcgcgcctctgggca

SEQ ID NO: 9267236 - DNA, 22 bp, Homo sapiens
ctggggggctactgacagagga

SEQ ID NO: 9267237 - DNA, 22 bp, Homo sapiens
ctggggtgagcagaaacagggg

SEQ ID NO: 9267238 - DNA, 22 bp, Homo sapiens
ctggggtctcaattctagcggg

SEQ ID NO: 9267239 - DNA, 22 bp, Homo sapiens
ctggggtcagggatcagagagc

SEQ ID NO: 9267240 - DNA, 22 bp, Homo sapiens
ctggggtcagggatcagagagc

SEQ ID NO: 9267241 - DNA, 22 bp, Homo sapiens
ctgggctctaagggagcaccgt

SEQ ID NO: 9267242 - DNA, 22 bp, Homo sapiens
ctggggctgtaggaggacttat

SEQ ID NO: 9267243 - DNA, 22 bp, Homo sapiens
ctggggctggtgaggcaggctc

SEQ ID NO: 9267244 - DNA, 22 bp, Homo sapiens
ctgggctccctcatgtgtctgc

SEQ ID NO: 9267245 - DNA, 22 bp, Homo sapiens
ctgggctcctaaccatccaggt

SEQ ID NO: 9267246 - DNA, 22 bp, Homo sapiens
ctgggctcctaaccatccaggt

SEQ ID NO: 9267247 - DNA, 22 bp, Homo sapiens
ctgggctcctaaccatccaggt

SEQ ID NO: 9267248 - DNA, 20 bp, Homo sapiens
ctgggctcggtggccctggc

SEQ ID NO: 9267249 - DNA, 18 bp, Homo sapiens
ctgggctcgagagatcct

SEQ ID NO: 9267250 - DNA, 18 bp, Homo sapiens
ctgggctcgagagatcct

SEQ ID NO: 9267251 - DNA, 23 bp, Homo sapiens
gaggtgtgaattctgggtgctgc

SEQ ID NO: 9267252 - DNA, 22 bp, Homo sapiens
gaggtttcactgtgttgtccag

SEQ ID NO: 9267253 - DNA, 22 bp, Homo sapiens
gaggttgtttcaacagtagtct

SEQ ID NO: 9267254 - DNA, 22 bp, Homo sapiens
gagtaaaagttggattacaaag

SEQ ID NO: 9267255 - DNA, 22 bp, Homo sapiens
gaggtttcttatcaagaaagct

SEQ ID NO: 9267256 - DNA, 22 bp, Homo sapiens
gaggttttaggctgccattatt

SEQ ID NO: 9267257 - DNA, 22 bp, Homo sapiens
gaggttttaagttgaaggggga

SEQ ID NO: 9267258 - DNA, 22 bp, Homo sapiens
gaggtgggagggcagtccctaa

SEQ ID NO: 9267259 - DNA, 22 bp, Homo sapiens
gaggtggcttagtctctggaca

SEQ ID NO: 9267260 - DNA, 22 bp, Homo sapiens
gaggtgggagggcagtccctaa

SEQ ID NO: 9267261 - DNA, 22 bp, Homo sapiens
gagtaacataccaaaattcaca

SEQ ID NO: 9267262 - DNA, 22 bp, Homo sapiens
gagtaaaagttggattacaaag

SEQ ID NO: 9267263 - DNA, 22 bp, Homo sapiens
gagtaagagctggctttggtgt

SEQ ID NO: 9267264 - DNA, 22 bp, Homo sapiens
gagtaacaaatacttcagtagt

SEQ ID NO: 9267265 - DNA, 22 bp, Homo sapiens
gaggtgagaagggggtcagatg

SEQ ID NO: 9267266 - DNA, 22 bp, Homo sapiens
gaggtgagaagggggtcagatg

SEQ ID NO: 9267267 - DNA, 22 bp, Homo sapiens
gaggtgagaagggggtcagatg

SEQ ID NO: 9267268 - DNA, 22 bp, Homo sapiens
gaggtgagaagggggtcagatg

SEQ ID NO: 9267269 - DNA, 22 bp, Homo sapiens
gaggtgagaagggggtcagatg

SEQ ID NO: 9267270 - DNA, 22 bp, Homo sapiens
gaggtgaaagttattcatttat

SEQ ID NO: 9267271 - DNA, 22 bp, Homo sapiens
gaggtgagtggatcacgaggtc

SEQ ID NO: 9267272 - DNA, 22 bp, Homo sapiens
gaggtgagtggatcacgaggtc

SEQ ID NO: 9267273 - DNA, 22 bp, Homo sapiens
gaggtgagtggatcacgaggtc

SEQ ID NO: 9267274 - DNA, 22 bp, Homo sapiens
gaggtgcttcctttgggctctg

SEQ ID NO: 9267275 - DNA, 22 bp, Homo sapiens
gaggtgcctggcgatgtctctg

SEQ ID NO: 9267276 - DNA, 22 bp, Homo sapiens
gagggctgatgttgccacctca

SEQ ID NO: 9267277 - DNA, 22 bp, Homo sapiens
gagggtcttacctaagcagggt

SEQ ID NO: 9267278 - DNA, 22 bp, Homo sapiens
gagggctgatgcttacttattt

SEQ ID NO: 9267279 - DNA, 22 bp, Homo sapiens
gagggtgcaggcaagagcaaaa

SEQ ID NO: 9267280 - DNA, 20 bp, Homo sapiens
gagggtgggacttcctaggc

SEQ ID NO: 9267281 - DNA, 22 bp, Homo sapiens
gagggtggctcctccctgggcc

SEQ ID NO: 9267282 - DNA, 22 bp, Homo sapiens
gagggtggctcctccctgggcc

SEQ ID NO: 9267283 - DNA, 22 bp, Homo sapiens
gagggtggcctttagagcccat

SEQ ID NO: 9267284 - DNA, 22 bp, Homo sapiens
gagggtggagctccagaatctg

SEQ ID NO: 9267285 - DNA, 22 bp, Homo sapiens
gagggtggatcagcctgattgg

SEQ ID NO: 9267286 - DNA, 22 bp, Homo sapiens
gagggtggaagagctgctgaga

SEQ ID NO: 9267287 - DNA, 22 bp, Homo sapiens
gagggtggaagagctgctgaga

SEQ ID NO: 9267288 - DNA, 22 bp, Homo sapiens
gagggtgggtttcttgcacgtc

SEQ ID NO: 9267289 - DNA, 22 bp, Homo sapiens
gagggtggtggcttaaggtgct

SEQ ID NO: 9267290 - DNA, 22 bp, Homo sapiens
gagggtggggaatagactgcta

SEQ ID NO: 9267291 - DNA, 22 bp, Homo sapiens
gagggtggggaatagactgcta

SEQ ID NO: 9267292 - DNA, 22 bp, Homo sapiens
gagggtggggaatagactgcta

SEQ ID NO: 9267293 - DNA, 22 bp, Homo sapiens
gagggtggggaatagactgcta

SEQ ID NO: 9267294 - DNA, 22 bp, Homo sapiens
gagggtgggccagatatgaggg

SEQ ID NO: 9267295 - DNA, 22 bp, Homo sapiens
gagggtgggctcctatctgggt

SEQ ID NO: 9267296 - DNA, 22 bp, Homo sapiens
gagggtgggctttgttcctcca

SEQ ID NO: 9267297 - DNA, 19 bp, Homo sapiens
gaggcgaggcgtgcaggag

SEQ ID NO: 9267298 - DNA, 22 bp, Homo sapiens
gaggcctgtagtcatggatgta

SEQ ID NO: 9267299 - DNA, 22 bp, Homo sapiens
gaggcctgtagtcatggatgta

SEQ ID NO: 9267300 - DNA, 22 bp, Homo sapiens
gaggcctgtcgctaggcctctg

SEQ ID NO: 9267301 - DNA, 22 bp, Homo sapiens
gaggcctgtcgctaggcctctg

SEQ ID NO: 9267302 - DNA, 22 bp, Homo sapiens
gaggcctggtctatgagatgtt

SEQ ID NO: 9267303 - DNA, 22 bp, Homo sapiens
gaggcctggtctatgagatgtt

SEQ ID NO: 9267304 - DNA, 22 bp, Homo sapiens
gaggcctggtttgcatgagaat

SEQ ID NO: 9267305 - DNA, 22 bp, Homo sapiens
gaggcctggtttccagcatcct

SEQ ID NO: 9267306 - DNA, 22 bp, Homo sapiens
gaggctggtaggaaaggaaaca

SEQ ID NO: 9267307 - DNA, 22 bp, Homo sapiens
gaggctggggtctgcctttctg

SEQ ID NO: 9267308 - DNA, 22 bp, Homo sapiens
gaggcgggcagatcacctgagg

SEQ ID NO: 9267309 - DNA, 22 bp, Homo sapiens
gaggctaagtaactgtccatgg

SEQ ID NO: 9267310 - DNA, 22 bp, Homo sapiens
gaggctagagcaggggctcaat

SEQ ID NO: 9267311 - DNA, 22 bp, Homo sapiens
gaggctggtcagccctaagatc

SEQ ID NO: 9267312 - DNA, 22 bp, Homo sapiens
gaggctggtggttagttccatt

SEQ ID NO: 9267313 - DNA, 22 bp, Homo sapiens
gaggctggtggttagttccatt

SEQ ID NO: 9267314 - DNA, 22 bp, Homo sapiens
gaggctggtaggaaaggaaaca

SEQ ID NO: 9267315 - DNA, 22 bp, Homo sapiens
gaggctggtcagccctaagatc

SEQ ID NO: 9267316 - DNA, 22 bp, Homo sapiens
gaggctggtttgccttttggca

SEQ ID NO: 9267317 - DNA, 22 bp, Homo sapiens
gaggctggttctgaagtactgt

SEQ ID NO: 9267318 - DNA, 22 bp, Homo sapiens
gaggctggttctgaagtactgt

SEQ ID NO: 9267319 - DNA, 22 bp, Homo sapiens
gaggctggttctgaagtactgt

SEQ ID NO: 9267320 - DNA, 22 bp, Homo sapiens
gaggctggttcccttgatcttt

SEQ ID NO: 9267321 - DNA, 22 bp, Homo sapiens
gagggccagatcccaggaggaa

SEQ ID NO: 9267322 - DNA, 22 bp, Homo sapiens
gagggccagatcccaggaggaa

SEQ ID NO: 9267323 - DNA, 22 bp, Homo sapiens
gagggccagcagcctcagcatg

SEQ ID NO: 9267324 - DNA, 22 bp, Homo sapiens
gagggccagatcccaggaggaa

SEQ ID NO: 9267325 - DNA, 22 bp, Homo sapiens
gagggccagagtcctggggtca

SEQ ID NO: 9267326 - DNA, 22 bp, Homo sapiens
gagggccaggcggagacaggcg

SEQ ID NO: 9267327 - DNA, 22 bp, Homo sapiens
gagggccaggcagcaagaaggc

SEQ ID NO: 9267328 - DNA, 22 bp, Homo sapiens
gagggccaggcggagacaggcg

SEQ ID NO: 9267329 - DNA, 22 bp, Homo sapiens
gagggccaggcggagacaggcg

SEQ ID NO: 9267330 - DNA, 22 bp, Homo sapiens
gagggccaggcggagacaggcg

SEQ ID NO: 9267331 - DNA, 22 bp, Homo sapiens
gagggccaggcagcaagaaggc

SEQ ID NO: 9267332 - DNA, 22 bp, Homo sapiens
gagggccagcctgccaagggcc

SEQ ID NO: 9267333 - DNA, 22 bp, Homo sapiens
gagggccattctgagggggtga

SEQ ID NO: 9267334 - DNA, 22 bp, Homo sapiens
gagggcctctgtgggtgctcac

SEQ ID NO: 9267335 - DNA, 22 bp, Homo sapiens
gagggcctctgctgctccacat

SEQ ID NO: 9267336 - DNA, 22 bp, Homo sapiens
gagggctgaagtgttttatgag

SEQ ID NO: 9267337 - DNA, 22 bp, Homo sapiens
gagggctgataaatgcgcatgg

SEQ ID NO: 9267338 - DNA, 22 bp, Homo sapiens
gagggctgataaatgcgcatgg

SEQ ID NO: 9267339 - DNA, 22 bp, Homo sapiens
gagggctgataacaggaataca

SEQ ID NO: 9267340 - DNA, 22 bp, Homo sapiens
gagggctgataacaggaataca

SEQ ID NO: 9267341 - DNA, 22 bp, Homo sapiens
gagggagaattgcagccagcgt

SEQ ID NO: 9267342 - DNA, 22 bp, Homo sapiens
gagggccacgttcagggctctc

SEQ ID NO: 9267343 - DNA, 22 bp, Homo sapiens
gagggagaaggactatcaggct

SEQ ID NO: 9267344 - DNA, 22 bp, Homo sapiens
gagggacagctaaagagaaatt

SEQ ID NO: 9267345 - DNA, 22 bp, Homo sapiens
gaggccagaatgagctgaatgc

SEQ ID NO: 9267346 - DNA, 22 bp, Homo sapiens
gaggccagaatgagtctctggg

SEQ ID NO: 9267347 - DNA, 22 bp, Homo sapiens
gaggccagaagtgcctcgggct

SEQ ID NO: 9267348 - DNA, 22 bp, Homo sapiens
gaggccagaagtctgagatcag

SEQ ID NO: 9267349 - DNA, 22 bp, Homo sapiens
gaggccacttcctactggagga

SEQ ID NO: 9267350 - DNA, 22 bp, Homo sapiens
gaggccacttcctactggagga

SEQ ID NO: 9267351 - DNA, 22 bp, Homo sapiens
gaggccactgtccctgccttcc

SEQ ID NO: 9267352 - DNA, 22 bp, Homo sapiens
gaggcctggagccgcctaggcg

SEQ ID NO: 9267353 - DNA, 22 bp, Homo sapiens
gaggccagagttccccgagtca

SEQ ID NO: 9267354 - DNA, 21 bp, Homo sapiens
gaggccactaataggggcaga

SEQ ID NO: 9267355 - DNA, 22 bp, Homo sapiens
gaggccactgtccctgccttcc

SEQ ID NO: 9267356 - DNA, 22 bp, Homo sapiens
gaggccactgtccctgccttcc

SEQ ID NO: 9267357 - DNA, 22 bp, Homo sapiens
gaggccacggaagggagctgtg

SEQ ID NO: 9267358 - DNA, 22 bp, Homo sapiens
gaggccacggttttccttgggg

SEQ ID NO: 9267359 - DNA, 22 bp, Homo sapiens
gaggccacggttttccttgggg

SEQ ID NO: 9267360 - DNA, 22 bp, Homo sapiens
gaggccacgtgcttatgtttct

SEQ ID NO: 9267361 - DNA, 22 bp, Homo sapiens
gaggccacgtgcttatgtttct

SEQ ID NO: 9267362 - DNA, 22 bp, Homo sapiens
gaggccacggaagggagctgtg

SEQ ID NO: 9267363 - DNA, 22 bp, Homo sapiens
gaggccacggaagggagctgtg

SEQ ID NO: 9267364 - DNA, 22 bp, Homo sapiens
gaggcatggcctgaggctagga

SEQ ID NO: 9267365 - DNA, 22 bp, Homo sapiens
gaggcatgcagagctggagcag

SEQ ID NO: 9267366 - DNA, 22 bp, Homo sapiens
gaggatgtaaaatagacaaaat

SEQ ID NO: 9267367 - DNA, 22 bp, Homo sapiens
gaggatggaggtgtgagctatg

SEQ ID NO: 9267368 - DNA, 22 bp, Homo sapiens
gaggatggaggtgtgagctatg

SEQ ID NO: 9267369 - DNA, 22 bp, Homo sapiens
gaggatggaggcagttagggcc

SEQ ID NO: 9267370 - DNA, 22 bp, Homo sapiens
gaggatggaggtgtgagctatg

SEQ ID NO: 9267371 - DNA, 22 bp, Homo sapiens
gaggatggtgagcaggacccag

SEQ ID NO: 9267372 - DNA, 22 bp, Homo sapiens
gaggatggtatgaggcaagcaa

SEQ ID NO: 9267373 - DNA, 22 bp, Homo sapiens
gaggagtggagttgctgggttg

SEQ ID NO: 9267374 - DNA, 22 bp, Homo sapiens
gaggatcatttgagcctaggag

SEQ ID NO: 9267375 - DNA, 22 bp, Homo sapiens
gaggagtgccagccgtggagtc

SEQ ID NO: 9267376 - DNA, 22 bp, Homo sapiens
gaggaggtggagtcatgcagag

SEQ ID NO: 9267377 - DNA, 22 bp, Homo sapiens
gaggaggttccgggtggagaag

SEQ ID NO: 9267378 - DNA, 22 bp, Homo sapiens
gaggaggttccgggtggagaag

SEQ ID NO: 9267379 - DNA, 22 bp, Homo sapiens
gaggagagagggactgtctgca

SEQ ID NO: 9267380 - DNA, 22 bp, Homo sapiens
gaggaccacagatgagcctgca

SEQ ID NO: 9267381 - DNA, 22 bp, Homo sapiens
gaggacagtgtgatctgccagc

SEQ ID NO: 9267382 - DNA, 22 bp, Homo sapiens
gaggacagtgtgatctgccagc

SEQ ID NO: 9267383 - DNA, 22 bp, Homo sapiens
gaggagagaacattcctccata

SEQ ID NO: 9267384 - DNA, 22 bp, Homo sapiens
gaggagactgacagcagattct

SEQ ID NO: 9267385 - DNA, 22 bp, Homo sapiens
gaggagacggggtgcctggagc

SEQ ID NO: 9267386 - DNA, 22 bp, Homo sapiens
gaggagacggggtgcctggagc

SEQ ID NO: 9267387 - DNA, 22 bp, Homo sapiens
gaggagaaagcagtgatttgtg

SEQ ID NO: 9267388 - DNA, 22 bp, Homo sapiens
gaggactgcagatgggtgcatc

SEQ ID NO: 9267389 - DNA, 22 bp, Homo sapiens
gaggactgcagatgggtgcatc

SEQ ID NO: 9267390 - DNA, 21 bp, Homo sapiens
gaggactgcacactctgattg

SEQ ID NO: 9267391 - DNA, 22 bp, Homo sapiens
gaggagaaattatccttggtgt

SEQ ID NO: 9267392 - DNA, 22 bp, Homo sapiens
gaggagacagtggagccgctac

SEQ ID NO: 9267393 - DNA, 22 bp, Homo sapiens
gaggagacatatttttgaagca

SEQ ID NO: 9267394 - DNA, 22 bp, Homo sapiens
gaggagacggggtgcctggagc

SEQ ID NO: 9267395 - DNA, 22 bp, Homo sapiens
gagctggtcgaaatgggctgac

SEQ ID NO: 9267396 - DNA, 22 bp, Homo sapiens
gagctggtccacaatctgcagg

SEQ ID NO: 9267397 - DNA, 22 bp, Homo sapiens
gagctggtcgaaatgggctgac

SEQ ID NO: 9267398 - DNA, 22 bp, Homo sapiens
gagctggtgatcagctggagga

SEQ ID NO: 9267399 - DNA, 22 bp, Homo sapiens
gagctggtgatcagctggagga

SEQ ID NO: 9267400 - DNA, 22 bp, Homo sapiens
gagctggtgtgtgcccgagcac

SEQ ID NO: 9267401 - DNA, 22 bp, Homo sapiens
gagctggtggtgagaaagctct

SEQ ID NO: 9267402 - DNA, 22 bp, Homo sapiens
gagctggtgatcagctggagga

SEQ ID NO: 9267403 - DNA, 22 bp, Homo sapiens
gagctggtgctcttgtcaagac

SEQ ID NO: 9267404 - DNA, 22 bp, Homo sapiens
gagctggtcagtttcagggcca

SEQ ID NO: 9267405 - DNA, 22 bp, Homo sapiens
gagctggtcagtttcaggagag

SEQ ID NO: 9267406 - DNA, 22 bp, Homo sapiens
gagctccctggaggttcagata

SEQ ID NO: 9267407 - DNA, 22 bp, Homo sapiens
gagctcccaggccccagcaagg

SEQ ID NO: 9267408 - DNA, 22 bp, Homo sapiens
gagctcccaggccccagcaagg

SEQ ID NO: 9267409 - DNA, 22 bp, Homo sapiens
gagctccagggaacagcagcta

SEQ ID NO: 9267410 - DNA, 22 bp, Homo sapiens
gagctccagggaacagcagcta

SEQ ID NO: 9267411 - DNA, 22 bp, Homo sapiens
gagctcctgaaacgttcctgcc

SEQ ID NO: 9267412 - DNA, 22 bp, Homo sapiens
gagctgggatttgaacctggga

SEQ ID NO: 9267413 - DNA, 22 bp, Homo sapiens
gagctgggatttgaacctggga

SEQ ID NO: 9267414 - DNA, 22 bp, Homo sapiens
gagctgtgtgcctggatggtct

SEQ ID NO: 9267415 - DNA, 17 bp, Homo sapiens
gaggacagggaagtagg

SEQ ID NO: 9267416 - DNA, 20 bp, Homo sapiens
gagctgtgctctcaggagcc

SEQ ID NO: 9267417 - DNA, 22 bp, Homo sapiens
gagctggttctgtccagggaat

SEQ ID NO: 9267418 - DNA, 22 bp, Homo sapiens
gagctgtccgcccctgggccga

SEQ ID NO: 9267419 - DNA, 22 bp, Homo sapiens
gagctgtccgcccctgggccga

SEQ ID NO: 9267420 - DNA, 22 bp, Homo sapiens
gagctgtccaagatggtcgtaa

SEQ ID NO: 9267421 - DNA, 22 bp, Homo sapiens
gagctgtcctaccaggagtcct

SEQ ID NO: 9267422 - DNA, 22 bp, Homo sapiens
gagctgtgagggacacattgct

SEQ ID NO: 9267423 - DNA, 22 bp, Homo sapiens
gagctgtgagggacacattgct

SEQ ID NO: 9267424 - DNA, 22 bp, Homo sapiens
gagctcattcattcattgcctg

SEQ ID NO: 9267425 - DNA, 22 bp, Homo sapiens
gagctcattcattcattgcctg

SEQ ID NO: 9267426 - DNA, 22 bp, Homo sapiens
gagctcaggtggtcaaaacaat

SEQ ID NO: 9267427 - DNA, 23 bp, Homo sapiens
gagctcaggtagggctcgcccgc

SEQ ID NO: 9267428 - DNA, 22 bp, Homo sapiens
gagctcagggcattgagcaaga

SEQ ID NO: 9267429 - DNA, 22 bp, Homo sapiens
gagctcaggtggtcaaaacaat

SEQ ID NO: 9267430 - DNA, 22 bp, Homo sapiens
gagctcagtgtagtcatggctt

SEQ ID NO: 9267431 - DNA, 22 bp, Homo sapiens
gagctcagcaaaggtctgtgtg

SEQ ID NO: 9267432 - DNA, 22 bp, Homo sapiens
gagctcagcactaaaatcatgt

SEQ ID NO: 9267433 - DNA, 22 bp, Homo sapiens
gagctcagcaaaggtctgtgtg

SEQ ID NO: 9267434 - DNA, 22 bp, Homo sapiens
gagctcagaggcgtctttgtcc

SEQ ID NO: 9267435 - DNA, 22 bp, Homo sapiens
gagctcagattctggtgtcaga

SEQ ID NO: 9267436 - DNA, 22 bp, Homo sapiens
gagctcaggagcatcagaagaa

SEQ ID NO: 9267437 - DNA, 22 bp, Homo sapiens
gagctcaggagcatcagaagaa

SEQ ID NO: 9267438 - DNA, 22 bp, Homo sapiens
gagctcagcctgaggcctggct

SEQ ID NO: 9267439 - DNA, 22 bp, Homo sapiens
gagctcaggagcatcagaagaa

SEQ ID NO: 9267440 - DNA, 22 bp, Homo sapiens
gagctcagcccaaagagcagtg

SEQ ID NO: 9267441 - DNA, 22 bp, Homo sapiens
gagctcagcccaaagagcagtg

SEQ ID NO: 9267442 - DNA, 22 bp, Homo sapiens
gagcaggctctgcctgtgtgtc

SEQ ID NO: 9267443 - DNA, 22 bp, Homo sapiens
gagctcagaggattctggggag

SEQ ID NO: 9267444 - DNA, 22 bp, Homo sapiens
gagctcagaggattctggggag

SEQ ID NO: 9267445 - DNA, 22 bp, Homo sapiens
gagctcagactcgggcctgggg

SEQ ID NO: 9267446 - DNA, 22 bp, Homo sapiens
gagcaggccagcaatggaaggg

SEQ ID NO: 9267447 - DNA, 22 bp, Homo sapiens
gagcaggatgggagctggggcc

SEQ ID NO: 9267448 - DNA, 22 bp, Homo sapiens
gagcaggcattctagtggctga

SEQ ID NO: 9267449 - DNA, 22 bp, Homo sapiens
gagcaggcattctagtggctga

SEQ ID NO: 9267450 - DNA, 22 bp, Homo sapiens
gagcaacagtttatggtttttc

SEQ ID NO: 9267451 - DNA, 22 bp, Homo sapiens
gagcaacactccacattgctag

SEQ ID NO: 9267452 - DNA, 22 bp, Homo sapiens
gagcaaagcttttagggccttt

SEQ ID NO: 9267453 - DNA, 22 bp, Homo sapiens
gagcaaagcttttagggccttt

SEQ ID NO: 9267454 - DNA, 23 bp, Homo sapiens
gagcaaacccgtctatgccctcc

SEQ ID NO: 9267455 - DNA, 22 bp, Homo sapiens
gagaggatccacaaaccaggaa

SEQ ID NO: 9267456 - DNA, 22 bp, Homo sapiens
gagattttcagcttgactggga

SEQ ID NO: 9267457 - DNA, 22 bp, Homo sapiens
gagatttcttttgatgcctgtc

SEQ ID NO: 9267458 - DNA, 17 bp, Homo sapiens
gagattttcgtcctgaa

SEQ ID NO: 9267459 - DNA, 22 bp, Homo sapiens
gagatttattgacttaacagta

SEQ ID NO: 9267460 - DNA, 22 bp, Homo sapiens
gagcacagatcctggagccaca

SEQ ID NO: 9267461 - DNA, 22 bp, Homo sapiens
gagcacagaatcttcccatgca

SEQ ID NO: 9267462 - DNA, 22 bp, Homo sapiens
gagcaatggaagatagataaca

SEQ ID NO: 9267463 - DNA, 22 bp, Homo sapiens
gagcaatgcccttcaccagccc

SEQ ID NO: 9267464 - DNA, 22 bp, Homo sapiens
gagcaatggaagatagataaca

SEQ ID NO: 9267465 - DNA, 22 bp, Homo sapiens
gagcaatgcccttcaccagccc

SEQ ID NO: 9267466 - DNA, 22 bp, Homo sapiens
gagcaagatcctgtttttctat

SEQ ID NO: 9267467 - DNA, 22 bp, Homo sapiens
gagcaagactcactgcatcttg

SEQ ID NO: 9267468 - DNA, 22 bp, Homo sapiens
gagcaccctacctgccactgag

SEQ ID NO: 9267469 - DNA, 22 bp, Homo sapiens
gagcacagtgtgttgtgatttc

SEQ ID NO: 9267470 - DNA, 22 bp, Homo sapiens
gagcacagtccttttgttaaaa

SEQ ID NO: 9267471 - DNA, 22 bp, Homo sapiens
gagcacagtccttttgttaaaa

SEQ ID NO: 9267472 - DNA, 22 bp, Homo sapiens
gagcacagtccttttgttaaaa

SEQ ID NO: 9267473 - DNA, 22 bp, Homo sapiens
gagcacagtaaagcagtgtcac

SEQ ID NO: 9267474 - DNA, 22 bp, Homo sapiens
gagcactgatttatttttgtct

SEQ ID NO: 9267475 - DNA, 22 bp, Homo sapiens
gagcactgtactcatttgcact

SEQ ID NO: 9267476 - DNA, 22 bp, Homo sapiens
gagcagaacaggccgggtggga

SEQ ID NO: 9267477 - DNA, 22 bp, Homo sapiens
gagcagaacaggccgggtggga

SEQ ID NO: 9267478 - DNA, 22 bp, Homo sapiens
gagcagaactactcacatatcg

SEQ ID NO: 9267479 - DNA, 18 bp, Homo sapiens
gagcagaggctcaactgg

SEQ ID NO: 9267480 - DNA, 22 bp, Homo sapiens
gagcagagcttctcaaagtaaa

SEQ ID NO: 9267481 - DNA, 22 bp, Homo sapiens
gagcagagacagtacaactggc

SEQ ID NO: 9267482 - DNA, 22 bp, Homo sapiens
gagcagagacagtacaactggc

SEQ ID NO: 9267483 - DNA, 22 bp, Homo sapiens
gagcagagacagtacaactggc

SEQ ID NO: 9267484 - DNA, 22 bp, Homo sapiens
gagcagagacagtacaactggc

SEQ ID NO: 9267485 - DNA, 22 bp, Homo sapiens
gagcaggaactgaaaatgagac

SEQ ID NO: 9267486 - DNA, 22 bp, Homo sapiens
gagcaggacgtgggaatgggaa

SEQ ID NO: 9267487 - DNA, 22 bp, Homo sapiens
gagcaggacagcagcttcctgg

SEQ ID NO: 9267488 - DNA, 22 bp, Homo sapiens
gagcaggacgtgggaatgggaa

SEQ ID NO: 9267489 - DNA, 22 bp, Homo sapiens
gagcaggaaggccagaagggtc

SEQ ID NO: 9267490 - DNA, 22 bp, Homo sapiens
gagaacctctccacaagtctgg

SEQ ID NO: 9267491 - DNA, 22 bp, Homo sapiens
gagaacattaatagttaatttt

SEQ ID NO: 9267492 - DNA, 22 bp, Homo sapiens
gagaactttctgtgtttttatc

SEQ ID NO: 9267493 - DNA, 22 bp, Homo sapiens
gagaactttctgtgtttttatc

SEQ ID NO: 9267494 - DNA, 22 bp, Homo sapiens
gagaacttgaacttttcctctg

SEQ ID NO: 9267495 - DNA, 16 bp, Homo sapiens
gagaagagcccggcag

SEQ ID NO: 9267496 - DNA, 22 bp, Homo sapiens
gagaagaacttgggcaaagtca

SEQ ID NO: 9267497 - DNA, 22 bp, Homo sapiens
gactcagagatccctggaggtc

SEQ ID NO: 9267498 - DNA, 19 bp, Homo sapiens
gactcacaccttccgctgt

SEQ ID NO: 9267499 - DNA, 22 bp, Homo sapiens
gagaaagggaacttacagagtg

SEQ ID NO: 9267500 - DNA, 22 bp, Homo sapiens
gagaaagggataatttgaagag

SEQ ID NO: 9267501 - DNA, 22 bp, Homo sapiens
gagaagcaggtttagcagacaa

SEQ ID NO: 9267502 - DNA, 22 bp, Homo sapiens
gagaagccgagtcagctgagcc

SEQ ID NO: 9267503 - DNA, 22 bp, Homo sapiens
gagaagccgagtcagctgagcc

SEQ ID NO: 9267504 - DNA, 22 bp, Homo sapiens
gagaagcaggtttagcagacaa

SEQ ID NO: 9267505 - DNA, 22 bp, Homo sapiens
gagaagcaatttccaactgtgc

SEQ ID NO: 9267506 - DNA, 22 bp, Homo sapiens
gagaagcaatttccaactgtgc

SEQ ID NO: 9267507 - DNA, 22 bp, Homo sapiens
gagaagcaatttccaactgtgc

SEQ ID NO: 9267508 - DNA, 22 bp, Homo sapiens
gagaagcaatcagtggccaccc

SEQ ID NO: 9267509 - DNA, 22 bp, Homo sapiens
gagaagcaatcagtggccaccc

SEQ ID NO: 9267510 - DNA, 22 bp, Homo sapiens
gagaagcaatcagtggccaccc

SEQ ID NO: 9267511 - DNA, 22 bp, Homo sapiens
gagaagcaatcagcagccaccc

SEQ ID NO: 9267512 - DNA, 22 bp, Homo sapiens
gagaagcaatcgtgacatctcc

SEQ ID NO: 9267513 - DNA, 22 bp, Homo sapiens
gagaagcaatcgtgacatctcc

SEQ ID NO: 9267514 - DNA, 22 bp, Homo sapiens
gagagaagaatgttccgaggcc

SEQ ID NO: 9267515 - DNA, 22 bp, Homo sapiens
gagagaagggggatatgagcct

SEQ ID NO: 9267516 - DNA, 22 bp, Homo sapiens
gagagaagggggatatgagcct

SEQ ID NO: 9267517 - DNA, 22 bp, Homo sapiens
gagagaagaaagccatggtcct

SEQ ID NO: 9267518 - DNA, 18 bp, Homo sapiens
gagaggagccagaatttt

SEQ ID NO: 9267519 - DNA, 22 bp, Homo sapiens
gagagctgtaatagtcatgtct

SEQ ID NO: 9267520 - DNA, 22 bp, Homo sapiens
gagagctgtcagcgtagcaccg

SEQ ID NO: 9267521 - DNA, 22 bp, Homo sapiens
gagagctgtccggctgagcagc

SEQ ID NO: 9267522 - DNA, 22 bp, Homo sapiens
gagaggagaagcctgcgcttca

SEQ ID NO: 9267523 - DNA, 22 bp, Homo sapiens
gagaggagtaggctgatggtgc

SEQ ID NO: 9267524 - DNA, 22 bp, Homo sapiens
gagaggagtaggctgatggtgc

SEQ ID NO: 9267525 - DNA, 22 bp, Homo sapiens
gagaggagtaggctgatggtgc

SEQ ID NO: 9267526 - DNA, 22 bp, Homo sapiens
gagaggagtagacactttggtt

SEQ ID NO: 9267527 - DNA, 22 bp, Homo sapiens
gagaggaggtggctatgacagc

SEQ ID NO: 9267528 - DNA, 22 bp, Homo sapiens
gagaggaggtggctatgacagc

SEQ ID NO: 9267529 - DNA, 22 bp, Homo sapiens
gagaggaggtggctatgacagc

SEQ ID NO: 9267530 - DNA, 22 bp, Homo sapiens
gagagccatggtggagatgggg

SEQ ID NO: 9267531 - DNA, 18 bp, Homo sapiens
gagagcccagcaggtggt

SEQ ID NO: 9267532 - DNA, 22 bp, Homo sapiens
gagagccatggtggagatgggg

SEQ ID NO: 9267533 - DNA, 22 bp, Homo sapiens
gagagccctacaaggcgttttg

SEQ ID NO: 9267534 - DNA, 22 bp, Homo sapiens
gagagccagcagtaaagacatt

SEQ ID NO: 9267535 - DNA, 22 bp, Homo sapiens
gagagcaggaggcagcgggacg

SEQ ID NO: 9267536 - DNA, 22 bp, Homo sapiens
gagagacagcacacagtgtggg

SEQ ID NO: 9267537 - DNA, 22 bp, Homo sapiens
gaccttcaagcaccatatttat

SEQ ID NO: 9267538 - DNA, 22 bp, Homo sapiens
gaccttcagtgtgtttctcaca

SEQ ID NO: 9267539 - DNA, 22 bp, Homo sapiens
gaccttcttgctgtgtcctaac

SEQ ID NO: 9267540 - DNA, 22 bp, Homo sapiens
gacctgggtaaggggctgacaa

SEQ ID NO: 9267541 - DNA, 22 bp, Homo sapiens
gaccttcttgctgtgtcctaac

SEQ ID NO: 9267542 - DNA, 22 bp, Homo sapiens
gaccttcttgctgtgtcctaac

SEQ ID NO: 9267543 - DNA, 19 bp, Homo sapiens
gactacagggggaagaagt

SEQ ID NO: 9267544 - DNA, 22 bp, Homo sapiens
gactacaggtgtgtgccaccat

SEQ ID NO: 9267545 - DNA, 22 bp, Homo sapiens
gactagtcatttgcattccgtc

SEQ ID NO: 9267546 - DNA, 22 bp, Homo sapiens
gactatttatttacagaaagct

SEQ ID NO: 9267547 - DNA, 22 bp, Homo sapiens
gacatgtcggatagaatgagtt

SEQ ID NO: 9267548 - DNA, 20 bp, Homo sapiens
gacatgtctttctcacacaa

SEQ ID NO: 9267549 - DNA, 22 bp, Homo sapiens
gacatgggatgagatgaagcat

SEQ ID NO: 9267550 - DNA, 22 bp, Homo sapiens
gacatggatacttgataagggg

SEQ ID NO: 9267551 - DNA, 22 bp, Homo sapiens
gacatggatacttgataagggg

SEQ ID NO: 9267552 - DNA, 22 bp, Homo sapiens
gacatggcttctaggaagcttt

SEQ ID NO: 9267553 - DNA, 22 bp, Homo sapiens
gacatgcatgaatgcaggtctc

SEQ ID NO: 9267554 - DNA, 22 bp, Homo sapiens
gacctggaagaactgaggcctt

SEQ ID NO: 9267555 - DNA, 22 bp, Homo sapiens
gacctgcctgagctgcctctgc

SEQ ID NO: 9267556 - DNA, 22 bp, Homo sapiens
gacatgttatctctggcttcaa

SEQ ID NO: 9267557 - DNA, 22 bp, Homo sapiens
gacatgtgctgtctcttaaatt

SEQ ID NO: 9267558 - DNA, 22 bp, Homo sapiens
gacatatgtgtacatggagatt

SEQ ID NO: 9267559 - DNA, 22 bp, Homo sapiens
gacagctgtacactcctggtta

SEQ ID NO: 9267560 - DNA, 18 bp, Homo sapiens
gacagctgtcctgagccc

SEQ ID NO: 9267561 - DNA, 22 bp, Homo sapiens
gacagctggcagtggaaaggtg

SEQ ID NO: 9267562 - DNA, 22 bp, Homo sapiens
gacagctggcagtggaaaggtg

SEQ ID NO: 9267563 - DNA, 17 bp, Homo sapiens
gacagctggttcctggc

SEQ ID NO: 9267564 - DNA, 22 bp, Homo sapiens
gacagtgcatttcctggcatgg

SEQ ID NO: 9267565 - DNA, 22 bp, Homo sapiens
gacagtctggcctaaagggtta

SEQ ID NO: 9267566 - DNA, 22 bp, Homo sapiens
gacagctggcagtggaaaggtg

SEQ ID NO: 9267567 - DNA, 22 bp, Homo sapiens
gacagccatcagcacacgctgc

SEQ ID NO: 9267568 - DNA, 22 bp, Homo sapiens
gacagctgaaaaatgtaaggta

SEQ ID NO: 9267569 - DNA, 22 bp, Homo sapiens
gacagcaggtgcttgggaaagg

SEQ ID NO: 9267570 - DNA, 22 bp, Homo sapiens
gacagcagggacatgtaggaag

SEQ ID NO: 9267571 - DNA, 22 bp, Homo sapiens
gacagcagggacatgtaggaag

SEQ ID NO: 9267572 - DNA, 22 bp, Homo sapiens
gacagccaggtctgatgaccca

SEQ ID NO: 9267573 - DNA, 22 bp, Homo sapiens
gacagcagtttttctctagggt

SEQ ID NO: 9267574 - DNA, 22 bp, Homo sapiens
gaatgctaagcatgtgggagtt

SEQ ID NO: 9267575 - DNA, 22 bp, Homo sapiens
gaatgctgagactaaagagctt

SEQ ID NO: 9267576 - DNA, 22 bp, Homo sapiens
gaatgcagatggctggtgtatg

SEQ ID NO: 9267577 - DNA, 22 bp, Homo sapiens
gaagaatatataatgattttgt

SEQ ID NO: 9267578 - DNA, 22 bp, Homo sapiens
gaagaatattcttgatcttaga

SEQ ID NO: 9267579 - DNA, 22 bp, Homo sapiens
gaagaatatggctctcagcaat

SEQ ID NO: 9267580 - DNA, 22 bp, Homo sapiens
gaagaagtatttttgtcctgtt

SEQ ID NO: 9267581 - DNA, 22 bp, Homo sapiens
gaagaaggtggcccaggggtag

SEQ ID NO: 9267582 - DNA, 22 bp, Homo sapiens
gaagaaggtgctacacagggca

SEQ ID NO: 9267583 - DNA, 22 bp, Homo sapiens
gaagaaggtgccagaggcttac

SEQ ID NO: 9267584 - DNA, 19 bp, Homo sapiens
gaatgggaatgggaaagct

SEQ ID NO: 9267585 - DNA, 22 bp, Homo sapiens
gaatggaaactgggagatggcc

SEQ ID NO: 9267586 - DNA, 22 bp, Homo sapiens
gaatgctggcttacaggcagtt

SEQ ID NO: 9267587 - DNA, 22 bp, Homo sapiens
gaatgcttggaacctgaagttc

SEQ ID NO: 9267588 - DNA, 22 bp, Homo sapiens
gaattaattgtgtggtttgaat

SEQ ID NO: 9267589 - DNA, 22 bp, Homo sapiens
gaattaaaatagttttggtcga

SEQ ID NO: 9267590 - DNA, 22 bp, Homo sapiens
gaattacaaagtgagacaagct

SEQ ID NO: 9267591 - DNA, 22 bp, Homo sapiens
gaattacagccagaagaatgaa

SEQ ID NO: 9267592 - DNA, 22 bp, Homo sapiens
gaatttaaggaccaagcatttt

SEQ ID NO: 9267593 - DNA, 22 bp, Homo sapiens
gacaaaacacattagtttaaaa

SEQ ID NO: 9267594 - DNA, 22 bp, Homo sapiens
gacaaaactgagatcacactgt

SEQ ID NO: 9267595 - DNA, 22 bp, Homo sapiens
gacaaaactgagatcacactgt

SEQ ID NO: 9267596 - DNA, 21 bp, Homo sapiens
gacaaacatttcatagcttta

SEQ ID NO: 9267597 - DNA, 21 bp, Homo sapiens
gacaaacatttcatagcttta

SEQ ID NO: 9267598 - DNA, 20 bp, Homo sapiens
gaattttatgaacactacca

SEQ ID NO: 9267599 - DNA, 22 bp, Homo sapiens
gaattttattactagtcaactg

SEQ ID NO: 9267600 - DNA, 22 bp, Homo sapiens
gaattttgcttttatgtcaagt

SEQ ID NO: 9267601 - DNA, 22 bp, Homo sapiens
gacaaaacacattagtttaaaa

SEQ ID NO: 9267602 - DNA, 22 bp, Homo sapiens
gacagcaggagatcatgataga

SEQ ID NO: 9267603 - DNA, 22 bp, Homo sapiens
gacagcagcatgtttacaggcc

SEQ ID NO: 9267604 - DNA, 20 bp, Homo sapiens
gacaacacagcttcaggtcc

SEQ ID NO: 9267605 - DNA, 22 bp, Homo sapiens
gacagcagccacagggagaggg

SEQ ID NO: 9267606 - DNA, 22 bp, Homo sapiens
gacaaagcctaagaagtattta

SEQ ID NO: 9267607 - DNA, 22 bp, Homo sapiens
gacaaagcagacaagataattc

SEQ ID NO: 9267608 - DNA, 23 bp, Homo sapiens
gacaaagcacttgaaatgtgtac

SEQ ID NO: 9267609 - DNA, 18 bp, Homo sapiens
tcacagtgctcttgccta

SEQ ID NO: 9267610 - DNA, 23 bp, Homo sapiens
tcacataatccttcatccacagg

SEQ ID NO: 9267611 - DNA, 22 bp, Homo sapiens
tcacatacactaggatattttt

SEQ ID NO: 9267612 - DNA, 22 bp, Homo sapiens
tcacatttatttcaaagttact

SEQ ID NO: 9267613 - DNA, 22 bp, Homo sapiens
tcacatttctcagcactgatga

SEQ ID NO: 9267614 - DNA, 22 bp, Homo sapiens
tcacatttctgattataccaaa

SEQ ID NO: 9267615 - DNA, 22 bp, Homo sapiens
tcacatttctcagcactgatga

SEQ ID NO: 9267616 - DNA, 22 bp, Homo sapiens
tcacatttctgattataccaaa

SEQ ID NO: 9267617 - DNA, 22 bp, Homo sapiens
tcacatgctgtgtgtggagatc

SEQ ID NO: 9267618 - DNA, 22 bp, Homo sapiens
tcacatgctactgagccagacc

SEQ ID NO: 9267619 - DNA, 22 bp, Homo sapiens
tcacattgccgtctgtgcactt

SEQ ID NO: 9267620 - DNA, 22 bp, Homo sapiens
tcacatttatttcaaagttact

SEQ ID NO: 9267621 - DNA, 22 bp, Homo sapiens
tcacagtatctagaaatgaggg

SEQ ID NO: 9267622 - DNA, 22 bp, Homo sapiens
tcacagtatcaggtggagtgga

SEQ ID NO: 9267623 - DNA, 22 bp, Homo sapiens
tcacagtatcacacaaggatta

SEQ ID NO: 9267624 - DNA, 22 bp, Homo sapiens
tcacagtcggtgacttcttgct

SEQ ID NO: 9267625 - DNA, 22 bp, Homo sapiens
tcacagtcggtgacttcttgct

SEQ ID NO: 9267626 - DNA, 22 bp, Homo sapiens
tcacagtgacagccaatgtttt

SEQ ID NO: 9267627 - DNA, 23 bp, Homo sapiens
tcacagtatctctggagccatag

SEQ ID NO: 9267628 - DNA, 22 bp, Homo sapiens
tcacagtattcatgaacatgga

SEQ ID NO: 9267629 - DNA, 22 bp, Homo sapiens
tcaactggttcttgaatgtata

SEQ ID NO: 9267630 - DNA, 22 bp, Homo sapiens
tcaagaaactgtgctacagagt

SEQ ID NO: 9267631 - DNA, 22 bp, Homo sapiens
tcaacttggctttttaaagtcc

SEQ ID NO: 9267632 - DNA, 22 bp, Homo sapiens
tcaaccagagtttttcttaata

SEQ ID NO: 9267633 - DNA, 22 bp, Homo sapiens
tcaacaataggatatagcaggt

SEQ ID NO: 9267634 - DNA, 22 bp, Homo sapiens
tcaacaatgggtctgtaatgga

SEQ ID NO: 9267635 - DNA, 22 bp, Homo sapiens
tcaacaattgcatgttgatgtt

SEQ ID NO: 9267636 - DNA, 22 bp, Homo sapiens
tcaacaatgggtctgtaatgga

SEQ ID NO: 9267637 - DNA, 22 bp, Homo sapiens
tcaacaataggatatagcaggt

SEQ ID NO: 9267638 - DNA, 22 bp, Homo sapiens
tcactgcaacctccacctcctg

SEQ ID NO: 9267639 - DNA, 22 bp, Homo sapiens
tcactgcaacctccacctcctg

SEQ ID NO: 9267640 - DNA, 22 bp, Homo sapiens
tcactgcaacctccacctcctg

SEQ ID NO: 9267641 - DNA, 22 bp, Homo sapiens
tcactgcaacctccacctcctg

SEQ ID NO: 9267642 - DNA, 22 bp, Homo sapiens
tcactgcaacctccacctcctg

SEQ ID NO: 9267643 - DNA, 22 bp, Homo sapiens
tcactgcaacctccacctcctg

SEQ ID NO: 9267644 - DNA, 22 bp, Homo sapiens
tcactgcaacctccacctcctg

SEQ ID NO: 9267645 - DNA, 22 bp, Homo sapiens
tcactgcaacctccacctcctg

SEQ ID NO: 9267646 - DNA, 22 bp, Homo sapiens
tcactgcaacctccacctcctg

SEQ ID NO: 9267647 - DNA, 22 bp, Homo sapiens
tcactgcaacctccacctcctg

SEQ ID NO: 9267648 - DNA, 23 bp, Homo sapiens
tcactgctactcagcctgagatt

SEQ ID NO: 9267649 - DNA, 22 bp, Homo sapiens
tcactgctatattggatactga

SEQ ID NO: 9267650 - DNA, 22 bp, Homo sapiens
tcactgctatattggatactga

SEQ ID NO: 9267651 - DNA, 22 bp, Homo sapiens
tcactgctcgataacatgatta

SEQ ID NO: 9267652 - DNA, 22 bp, Homo sapiens
tcactgctctctaagcatcgcc

SEQ ID NO: 9267653 - DNA, 22 bp, Homo sapiens
tcactgctctccaatgtggagt

SEQ ID NO: 9267654 - DNA, 22 bp, Homo sapiens
tcagaaaataactgttagtttg

SEQ ID NO: 9267655 - DNA, 22 bp, Homo sapiens
tcactgctctgaaagtacaggg

SEQ ID NO: 9267656 - DNA, 22 bp, Homo sapiens
tcactgcaacctccacctcccg

SEQ ID NO: 9267657 - DNA, 22 bp, Homo sapiens
tcactgcaacctccacctcccg

SEQ ID NO: 9267658 - DNA, 22 bp, Homo sapiens
tcactgcaacctccacctcccg

SEQ ID NO: 9267659 - DNA, 22 bp, Homo sapiens
tcactgcaacctccacctcccg

SEQ ID NO: 9267660 - DNA, 22 bp, Homo sapiens
tcactgcaacctccacctcccg

SEQ ID NO: 9267661 - DNA, 22 bp, Homo sapiens
tcactgcaacctccacctcccg

SEQ ID NO: 9267662 - DNA, 22 bp, Homo sapiens
tcactgcaacctccacctcccg

SEQ ID NO: 9267663 - DNA, 22 bp, Homo sapiens
tcactgattatgaaaatgaagg

SEQ ID NO: 9267664 - DNA, 22 bp, Homo sapiens
tcactgcaacctccacctcccg

SEQ ID NO: 9267665 - DNA, 22 bp, Homo sapiens
tcactgcaacctccacctcccg

SEQ ID NO: 9267666 - DNA, 22 bp, Homo sapiens
tcactgcaacctccacctcccg

SEQ ID NO: 9267667 - DNA, 22 bp, Homo sapiens
tcacatttgcaattgcattgtt

SEQ ID NO: 9267668 - DNA, 22 bp, Homo sapiens
tcacatttgctatcccactcct

SEQ ID NO: 9267669 - DNA, 22 bp, Homo sapiens
tcacatttgcaattgcattgtt

SEQ ID NO: 9267670 - DNA, 22 bp, Homo sapiens
tcacatttgataatgcccattg

SEQ ID NO: 9267671 - DNA, 22 bp, Homo sapiens
tcacatttgtgttttattagag

SEQ ID NO: 9267672 - DNA, 22 bp, Homo sapiens
tcacatttgttcctctgcactt

SEQ ID NO: 9267673 - DNA, 22 bp, Homo sapiens
tcacatttgttcttgaatctaa

SEQ ID NO: 9267674 - DNA, 22 bp, Homo sapiens
tcacatttgttcctctgcactt

SEQ ID NO: 9267675 - DNA, 22 bp, Homo sapiens
tcacatttgttcttgaatctaa

SEQ ID NO: 9267676 - DNA, 22 bp, Homo sapiens
tcacattttagtaccatgattt

SEQ ID NO: 9267677 - DNA, 22 bp, Homo sapiens
tcagaaaccagctctctcaatt

SEQ ID NO: 9267678 - DNA, 22 bp, Homo sapiens
tcagaaacactcttcttctgtc

SEQ ID NO: 9267679 - DNA, 22 bp, Homo sapiens
tcagaaagcttttacttaaaca

SEQ ID NO: 9267680 - DNA, 22 bp, Homo sapiens
tcagaaagcttttacttaaaca

SEQ ID NO: 9267681 - DNA, 22 bp, Homo sapiens
tcagaaaggttctatgttttac

SEQ ID NO: 9267682 - DNA, 22 bp, Homo sapiens
tcagaacactttctctactgac

SEQ ID NO: 9267683 - DNA, 22 bp, Homo sapiens
tcagaacagaagaaggaacacg

SEQ ID NO: 9267684 - DNA, 22 bp, Homo sapiens
tcagaacaattgggaaccatta

SEQ ID NO: 9267685 - DNA, 22 bp, Homo sapiens
tcagaacagaagctggctataa

SEQ ID NO: 9267686 - DNA, 22 bp, Homo sapiens
tcagaacagaagctggctataa

SEQ ID NO: 9267687 - DNA, 22 bp, Homo sapiens
tcagaagccttgattatctaga

SEQ ID NO: 9267688 - DNA, 22 bp, Homo sapiens
tcagaagccggaagtgctcctc

SEQ ID NO: 9267689 - DNA, 22 bp, Homo sapiens
tcagaagccaccttttgttggg

SEQ ID NO: 9267690 - DNA, 22 bp, Homo sapiens
tcagaagccgggcaggttttgg

SEQ ID NO: 9267691 - DNA, 22 bp, Homo sapiens
tcagaacaggactggctgccat

SEQ ID NO: 9267692 - DNA, 22 bp, Homo sapiens
tcagaacagctctcagatatcc

SEQ ID NO: 9267693 - DNA, 22 bp, Homo sapiens
tcagaacaggttgtactatgtc

SEQ ID NO: 9267694 - DNA, 22 bp, Homo sapiens
tcagaacagcgagaatattcac

SEQ ID NO: 9267695 - DNA, 22 bp, Homo sapiens
tcagaagttgataaagtagttg

SEQ ID NO: 9267696 - DNA, 22 bp, Homo sapiens
tcagaataagttatgaaatgaa

SEQ ID NO: 9267697 - DNA, 22 bp, Homo sapiens
tcagaatatattcatgttgtca

SEQ ID NO: 9267698 - DNA, 22 bp, Homo sapiens
tcagaatatgctaatgacattt

SEQ ID NO: 9267699 - DNA, 22 bp, Homo sapiens
tcagaatcggtggggccaggaa

SEQ ID NO: 9267700 - DNA, 22 bp, Homo sapiens
tcagaatctctggaggcttggc

SEQ ID NO: 9267701 - DNA, 22 bp, Homo sapiens
tcagaatctaaataggctccag

SEQ ID NO: 9267702 - DNA, 21 bp, Homo sapiens
tcagaatctgtgagctatctc

SEQ ID NO: 9267703 - DNA, 22 bp, Homo sapiens
tcagaatctgaaaagcgcttgg

SEQ ID NO: 9267704 - DNA, 22 bp, Homo sapiens
tcagaatctttctagagtctag

SEQ ID NO: 9267705 - DNA, 22 bp, Homo sapiens
tcaggagacaaagggtgcggag

SEQ ID NO: 9267706 - DNA, 22 bp, Homo sapiens
tcaggagaaggcaatgtggaaa

SEQ ID NO: 9267707 - DNA, 22 bp, Homo sapiens
tcaggacagagatcagaacttc

SEQ ID NO: 9267708 - DNA, 22 bp, Homo sapiens
tcaggacagggatcacatcatc

SEQ ID NO: 9267709 - DNA, 22 bp, Homo sapiens
tcaggacatttgtcagcaggag

SEQ ID NO: 9267710 - DNA, 22 bp, Homo sapiens
tcaggacacttggcacaaggtc

SEQ ID NO: 9267711 - DNA, 19 bp, Homo sapiens
tcagctggcaggcctcctc

SEQ ID NO: 9267712 - DNA, 22 bp, Homo sapiens
tcagctggagatgagaaccgaa

SEQ ID NO: 9267713 - DNA, 22 bp, Homo sapiens
tcagctggcagttcagaggctg

SEQ ID NO: 9267714 - DNA, 18 bp, Homo sapiens
tcagctggggctgcagcc

SEQ ID NO: 9267715 - DNA, 22 bp, Homo sapiens
tcaggaattttgttctgtatcc

SEQ ID NO: 9267716 - DNA, 22 bp, Homo sapiens
tcagctctgcctgtggaggcac

SEQ ID NO: 9267717 - DNA, 22 bp, Homo sapiens
tcagctctgcctgtggaggcac

SEQ ID NO: 9267718 - DNA, 22 bp, Homo sapiens
tcagctctgcactccactgtgg

SEQ ID NO: 9267719 - DNA, 22 bp, Homo sapiens
tcagccaggcacaatggcagct

SEQ ID NO: 9267720 - DNA, 22 bp, Homo sapiens
tcagccaggcacaatggcagct

SEQ ID NO: 9267721 - DNA, 22 bp, Homo sapiens
tcagccaggcagccccctggtc

SEQ ID NO: 9267722 - DNA, 22 bp, Homo sapiens
tcagccagccagctacaggctt

SEQ ID NO: 9267723 - DNA, 19 bp, Homo sapiens
tcagctctggggtcagtgg

SEQ ID NO: 9267724 - DNA, 22 bp, Homo sapiens
tcagctgccccgggcactgccc

SEQ ID NO: 9267725 - DNA, 22 bp, Homo sapiens
tcagctgcctctccctggaaga

SEQ ID NO: 9267726 - DNA, 22 bp, Homo sapiens
tcagctgcctttcccatgctag

SEQ ID NO: 9267727 - DNA, 22 bp, Homo sapiens
tcagctgctgtggtatgtacat

SEQ ID NO: 9267728 - DNA, 22 bp, Homo sapiens
tcagctgctctgttgagctgaa

SEQ ID NO: 9267729 - DNA, 23 bp, Homo sapiens
tcagctgcttcctcctgcctgcc

SEQ ID NO: 9267730 - DNA, 22 bp, Homo sapiens
tcagctgctctgttgagctgaa

SEQ ID NO: 9267731 - DNA, 22 bp, Homo sapiens
tcagctgcgacaggggcctgag

SEQ ID NO: 9267732 - DNA, 22 bp, Homo sapiens
tcagctgctcaaatttatgtca

SEQ ID NO: 9267733 - DNA, 22 bp, Homo sapiens
tcagccagcattacccctgact

SEQ ID NO: 9267734 - DNA, 22 bp, Homo sapiens
tcagccagagggggcaaaggaa

SEQ ID NO: 9267735 - DNA, 22 bp, Homo sapiens
tcagccaagcagccatcatctg

SEQ ID NO: 9267736 - DNA, 17 bp, Homo sapiens
tcagcatacacagagaa

SEQ ID NO: 9267737 - DNA, 20 bp, Homo sapiens
tcagcatgctcctcagacat

SEQ ID NO: 9267738 - DNA, 22 bp, Homo sapiens
tcagcagggagaggagaatgca

SEQ ID NO: 9267739 - DNA, 17 bp, Homo sapiens
tcagcaggggccaagct

SEQ ID NO: 9267740 - DNA, 17 bp, Homo sapiens
tcagcaggggccaagct

SEQ ID NO: 9267741 - DNA, 22 bp, Homo sapiens
tcagcagggctgtggtgtggct

SEQ ID NO: 9267742 - DNA, 22 bp, Homo sapiens
tcagcaagaagctgtgggcttc

SEQ ID NO: 9267743 - DNA, 22 bp, Homo sapiens
tcagcaggctgtcagcaggggc

SEQ ID NO: 9267744 - DNA, 22 bp, Homo sapiens
tcagatggcacacagagcctgc

SEQ ID NO: 9267745 - DNA, 22 bp, Homo sapiens
tcagatgcttagagattagact

SEQ ID NO: 9267746 - DNA, 22 bp, Homo sapiens
tcagatgcttagtgactacaca

SEQ ID NO: 9267747 - DNA, 22 bp, Homo sapiens
tcagatggtactaatttaagga

SEQ ID NO: 9267748 - DNA, 22 bp, Homo sapiens
tcagatggtcattcactagggt

SEQ ID NO: 9267749 - DNA, 22 bp, Homo sapiens
tcagacagaaagatgagtatgg

SEQ ID NO: 9267750 - DNA, 22 bp, Homo sapiens
tcagaattctacaatagatcag

SEQ ID NO: 9267751 - DNA, 22 bp, Homo sapiens
tccaaagaacattgctgagacc

SEQ ID NO: 9267752 - DNA, 22 bp, Homo sapiens
tccaaagaacctggctactgtc

SEQ ID NO: 9267753 - DNA, 22 bp, Homo sapiens
tccaaagcatttggctcccacc

SEQ ID NO: 9267754 - DNA, 19 bp, Homo sapiens
tccaaagaagttcacattt

SEQ ID NO: 9267755 - DNA, 20 bp, Homo sapiens
tccaaagaagttcacattta

SEQ ID NO: 9267756 - DNA, 22 bp, Homo sapiens
tccaaagacttgctgtatgtaa

SEQ ID NO: 9267757 - DNA, 22 bp, Homo sapiens
tccaaagagcttaggagagaaa

SEQ ID NO: 9267758 - DNA, 22 bp, Homo sapiens
tccaaagaggttaagaacgaga

SEQ ID NO: 9267759 - DNA, 22 bp, Homo sapiens
tccaaagagcttaggagagaaa

SEQ ID NO: 9267760 - DNA, 22 bp, Homo sapiens
tccaaaggcaaaactgtggtgt

SEQ ID NO: 9267761 - DNA, 21 bp, Homo sapiens
tccaaaggagactgagtgtgt

SEQ ID NO: 9267762 - DNA, 21 bp, Homo sapiens
tcatttttattgctaccttgc

SEQ ID NO: 9267763 - DNA, 21 bp, Homo sapiens
tcatttttattgctaccttgc

SEQ ID NO: 9267764 - DNA, 22 bp, Homo sapiens
tcatttttagcgcgcaaaagtt

SEQ ID NO: 9267765 - DNA, 22 bp, Homo sapiens
tcatttgttacagccacatacc

SEQ ID NO: 9267766 - DNA, 22 bp, Homo sapiens
tcatttttgaccatgggtagga

SEQ ID NO: 9267767 - DNA, 22 bp, Homo sapiens
tcatttttgtctccggtttgtg

SEQ ID NO: 9267768 - DNA, 22 bp, Homo sapiens
tcatttttcacacagggtcacc

SEQ ID NO: 9267769 - DNA, 22 bp, Homo sapiens
tcatttttctcttacacgtaga

SEQ ID NO: 9267770 - DNA, 22 bp, Homo sapiens
tcattttttgcatacctgtgtc

SEQ ID NO: 9267771 - DNA, 22 bp, Homo sapiens
tcatttttttccggtaggaata

SEQ ID NO: 9267772 - DNA, 21 bp, Homo sapiens
tccaaaaaggagcgtccttct

SEQ ID NO: 9267773 - DNA, 22 bp, Homo sapiens
tccaaaaaacgtttgaatagtt

SEQ ID NO: 9267774 - DNA, 23 bp, Homo sapiens
tccaattcaattgggtcaggaag

SEQ ID NO: 9267775 - DNA, 19 bp, Homo sapiens
tccaatttgtatgttttca

SEQ ID NO: 9267776 - DNA, 19 bp, Homo sapiens
tccaatttctattcatgtt

SEQ ID NO: 9267777 - DNA, 19 bp, Homo sapiens
tccaatttgtatgttttca

SEQ ID NO: 9267778 - DNA, 22 bp, Homo sapiens
tccaataaccacaatcagatag

SEQ ID NO: 9267779 - DNA, 22 bp, Homo sapiens
tccaataaccacaatcagatag

SEQ ID NO: 9267780 - DNA, 19 bp, Homo sapiens
tccaaggcatggcccagtg

SEQ ID NO: 9267781 - DNA, 22 bp, Homo sapiens
tccaagcttgctttagccacag

SEQ ID NO: 9267782 - DNA, 22 bp, Homo sapiens
tccaagaagctcagcaaacatc

SEQ ID NO: 9267783 - DNA, 22 bp, Homo sapiens
tccaagaagctcagcaaacatc

SEQ ID NO: 9267784 - DNA, 22 bp, Homo sapiens
tccaacttctgcaatcagtttg

SEQ ID NO: 9267785 - DNA, 22 bp, Homo sapiens
tccaactttctcctccggcttg

SEQ ID NO: 9267786 - DNA, 22 bp, Homo sapiens
tcattgccatggcatttgcaga

SEQ ID NO: 9267787 - DNA, 22 bp, Homo sapiens
tcattgttaattgtatgatctg

SEQ ID NO: 9267788 - DNA, 22 bp, Homo sapiens
tcattgttactgtttagttgcc

SEQ ID NO: 9267789 - DNA, 22 bp, Homo sapiens
tcattgtcgctctgcggtgttc

SEQ ID NO: 9267790 - DNA, 22 bp, Homo sapiens
tcattgtctctcttttcatata

SEQ ID NO: 9267791 - DNA, 22 bp, Homo sapiens
tcattgtctctcttttcatata

SEQ ID NO: 9267792 - DNA, 22 bp, Homo sapiens
tcattgtcagctcttgacttct

SEQ ID NO: 9267793 - DNA, 22 bp, Homo sapiens
tcattgtcttgatatgattgtc

SEQ ID NO: 9267794 - DNA, 23 bp, Homo sapiens
tcattgtgactgtgccacataac

SEQ ID NO: 9267795 - DNA, 22 bp, Homo sapiens
tcattgccatggcatttgcaga

SEQ ID NO: 9267796 - DNA, 22 bp, Homo sapiens
tcatgcaggacttacaagagat

SEQ ID NO: 9267797 - DNA, 22 bp, Homo sapiens
tcatgcaggcagcctttagtaa

SEQ ID NO: 9267798 - DNA, 22 bp, Homo sapiens
tcatgcagcttttccattcagc

SEQ ID NO: 9267799 - DNA, 22 bp, Homo sapiens
tcatgcagcaatatgcattagg

SEQ ID NO: 9267800 - DNA, 22 bp, Homo sapiens
tcatgcagatttggaggtattt

SEQ ID NO: 9267801 - DNA, 22 bp, Homo sapiens
tcatgcagataagaataagtaa

SEQ ID NO: 9267802 - DNA, 22 bp, Homo sapiens
tcatttactggatccataagca

SEQ ID NO: 9267803 - DNA, 22 bp, Homo sapiens
tcatttactgtaggagtgaacc

SEQ ID NO: 9267804 - DNA, 22 bp, Homo sapiens
tcatttactggatccataagca

SEQ ID NO: 9267805 - DNA, 22 bp, Homo sapiens
tcatttacatgtctttctctga

SEQ ID NO: 9267806 - DNA, 22 bp, Homo sapiens
tcatttataaggatgcaattaa

SEQ ID NO: 9267807 - DNA, 22 bp, Homo sapiens
tcatttacacttcacaaatgga

SEQ ID NO: 9267808 - DNA, 22 bp, Homo sapiens
tcatttaataatttttgagtag

SEQ ID NO: 9267809 - DNA, 22 bp, Homo sapiens
tcatttaataatttttgagtag

SEQ ID NO: 9267810 - DNA, 22 bp, Homo sapiens
tcattgttgacataccaagagc

SEQ ID NO: 9267811 - DNA, 22 bp, Homo sapiens
tcattgtttctgcttttcatga

SEQ ID NO: 9267812 - DNA, 22 bp, Homo sapiens
tcattgtttctgcttttcatga

SEQ ID NO: 9267813 - DNA, 22 bp, Homo sapiens
tcatttcagatgcatttagaat

SEQ ID NO: 9267814 - DNA, 22 bp, Homo sapiens
tcatttcagatgcatttagaat

SEQ ID NO: 9267815 - DNA, 22 bp, Homo sapiens
tcatttcagatgcatttagaat

SEQ ID NO: 9267816 - DNA, 22 bp, Homo sapiens
tcatttcacttctctagggaga

SEQ ID NO: 9267817 - DNA, 22 bp, Homo sapiens
tcatttcacttctctagggaga

SEQ ID NO: 9267818 - DNA, 22 bp, Homo sapiens
tcatttcagccatttttaaatg

SEQ ID NO: 9267819 - DNA, 23 bp, Homo sapiens
tcatttcaggttgcatggtacca

SEQ ID NO: 9267820 - DNA, 22 bp, Homo sapiens
tcatttcagccatttttaaatg

SEQ ID NO: 9267821 - DNA, 23 bp, Homo sapiens
tcatttcacagtgagcttcctag

SEQ ID NO: 9267822 - DNA, 23 bp, Homo sapiens
tcatttcacagtgagcttcctag

SEQ ID NO: 9267823 - DNA, 22 bp, Homo sapiens
tcatttcaatgatactactaag

SEQ ID NO: 9267824 - DNA, 17 bp, Homo sapiens
tcatttcagtaaatcca

SEQ ID NO: 9267825 - DNA, 17 bp, Homo sapiens
tcatttcagtaaatcca

SEQ ID NO: 9267826 - DNA, 17 bp, Homo sapiens
tcatttcagtaaatcca

SEQ ID NO: 9267827 - DNA, 22 bp, Homo sapiens
tcatttcagtcctctgtgtgag

SEQ ID NO: 9267828 - DNA, 23 bp, Homo sapiens
tcatttcatccagccttgagagt

SEQ ID NO: 9267829 - DNA, 22 bp, Homo sapiens
tcatttcagtggcacagaagat

SEQ ID NO: 9267830 - DNA, 22 bp, Homo sapiens
tcatttcagtggcacagaagat

SEQ ID NO: 9267831 - DNA, 22 bp, Homo sapiens
tcatttcagtggcacagaagat

SEQ ID NO: 9267832 - DNA, 22 bp, Homo sapiens
tcatttcagtggcacagaagat

SEQ ID NO: 9267833 - DNA, 22 bp, Homo sapiens
tcatttctatctatgcagcttc

SEQ ID NO: 9267834 - DNA, 23 bp, Homo sapiens
tcatttcatccagccttgagagt

SEQ ID NO: 9267835 - DNA, 22 bp, Homo sapiens
tcatttcatgtctcaggcactg

SEQ ID NO: 9267836 - DNA, 23 bp, Homo sapiens
tcatttcatccagccttgagagt

SEQ ID NO: 9267837 - DNA, 23 bp, Homo sapiens
tcatttcatccagccttgagagt

SEQ ID NO: 9267838 - DNA, 20 bp, Homo sapiens
tcatttcttggggttccaag

SEQ ID NO: 9267839 - DNA, 20 bp, Homo sapiens
tcatttcttggggttccaag

SEQ ID NO: 9267840 - DNA, 22 bp, Homo sapiens
tcatttctgagccttccatgat

SEQ ID NO: 9267841 - DNA, 22 bp, Homo sapiens
tcatttctgttgtgcatcactg

SEQ ID NO: 9267842 - DNA, 22 bp, Homo sapiens
tcatttctgttgtgcatcactg

SEQ ID NO: 9267843 - DNA, 22 bp, Homo sapiens
tcatttctgttgtgcatcactg

SEQ ID NO: 9267844 - DNA, 22 bp, Homo sapiens
tcatttctctgagtctgataat

SEQ ID NO: 9267845 - DNA, 22 bp, Homo sapiens
tcatttctctgagtctgataat

SEQ ID NO: 9267846 - DNA, 21 bp, Homo sapiens
tcatttctctatgtatttcac

SEQ ID NO: 9267847 - DNA, 22 bp, Homo sapiens
tcatttctcctaagtgaaatat

SEQ ID NO: 9267848 - DNA, 22 bp, Homo sapiens
tcatttctccgacctgctgtcc

SEQ ID NO: 9267849 - DNA, 22 bp, Homo sapiens
tcatttctcctaagtgaaatat

SEQ ID NO: 9267850 - DNA, 22 bp, Homo sapiens
tcatttctcctaagtgaaatat

SEQ ID NO: 9267851 - DNA, 22 bp, Homo sapiens
tcatttctcccggccaaaaact

SEQ ID NO: 9267852 - DNA, 22 bp, Homo sapiens
tcatttctattgctactgtctg

SEQ ID NO: 9267853 - DNA, 22 bp, Homo sapiens
tcatttctcccggccaaaaact

SEQ ID NO: 9267854 - DNA, 17 bp, Homo sapiens
tcatttctaggcactcc

SEQ ID NO: 9267855 - DNA, 22 bp, Homo sapiens
tcatttctccgacctgctgtcc

SEQ ID NO: 9267856 - DNA, 22 bp, Homo sapiens
tcatacattcagcagatatttg

SEQ ID NO: 9267857 - DNA, 22 bp, Homo sapiens
tcatacatcttgtatatctatc

SEQ ID NO: 9267858 - DNA, 22 bp, Homo sapiens
tcatacatcttgtatatctatc

SEQ ID NO: 9267859 - DNA, 22 bp, Homo sapiens
tcataaattgattatgtgcttt

SEQ ID NO: 9267860 - DNA, 22 bp, Homo sapiens
tcatacatcttgtatatctatc

SEQ ID NO: 9267861 - DNA, 22 bp, Homo sapiens
tcataaatgcagtgtcataaat

SEQ ID NO: 9267862 - DNA, 22 bp, Homo sapiens
tcataaatgcagtgtcataaat

SEQ ID NO: 9267863 - DNA, 22 bp, Homo sapiens
tcataaattagctgtctttgaa

SEQ ID NO: 9267864 - DNA, 22 bp, Homo sapiens
tcataaattgattatgtgcttt

SEQ ID NO: 9267865 - DNA, 22 bp, Homo sapiens
tcatagatgtgctgtgcacaaa

SEQ ID NO: 9267866 - DNA, 22 bp, Homo sapiens
tcatctgaaattgtatatgtag

SEQ ID NO: 9267867 - DNA, 22 bp, Homo sapiens
tcatctgaccactttatctctc

SEQ ID NO: 9267868 - DNA, 22 bp, Homo sapiens
tcatacattcagcagatatttg

SEQ ID NO: 9267869 - DNA, 22 bp, Homo sapiens
tcatcttctattaatagggaga

SEQ ID NO: 9267870 - DNA, 22 bp, Homo sapiens
tcatctgttcatacacatgcgt

SEQ ID NO: 9267871 - DNA, 22 bp, Homo sapiens
tcatctgaccccatctattctc

SEQ ID NO: 9267872 - DNA, 22 bp, Homo sapiens
tcatctgtctgagagacttctg

SEQ ID NO: 9267873 - DNA, 22 bp, Homo sapiens
tcatgaaaatagatcagaaatt

SEQ ID NO: 9267874 - DNA, 22 bp, Homo sapiens
tcatcttgctgccattgcttta

SEQ ID NO: 9267875 - DNA, 22 bp, Homo sapiens
tcagtgtttttaaagcaatata

SEQ ID NO: 9267876 - DNA, 22 bp, Homo sapiens
tcagtgttttccagggtctact

SEQ ID NO: 9267877 - DNA, 22 bp, Homo sapiens
tcagtgttttccagggtctact

SEQ ID NO: 9267878 - DNA, 22 bp, Homo sapiens
tcagtgttttaactgtctttta

SEQ ID NO: 9267879 - DNA, 22 bp, Homo sapiens
tcagtgtttgtggcaaatgtta

SEQ ID NO: 9267880 - DNA, 22 bp, Homo sapiens
tcagtgttttaactgtctttta

SEQ ID NO: 9267881 - DNA, 22 bp, Homo sapiens
tcagtgtttcctagagcatata

SEQ ID NO: 9267882 - DNA, 22 bp, Homo sapiens
tcagtgtttcctgtggtacagc

SEQ ID NO: 9267883 - DNA, 22 bp, Homo sapiens
tcagtgtttcctgtggtacagc

SEQ ID NO: 9267884 - DNA, 22 bp, Homo sapiens
tcagtgtttgaacccagggtta

SEQ ID NO: 9267885 - DNA, 22 bp, Homo sapiens
tcagtgtttggtttcagaattg

SEQ ID NO: 9267886 - DNA, 22 bp, Homo sapiens
tcataaagttatcaccaaatcc

SEQ ID NO: 9267887 - DNA, 22 bp, Homo sapiens
tcataaagttatcaccaaatcc

SEQ ID NO: 9267888 - DNA, 20 bp, Homo sapiens
tcagttaagttgctgaatct

SEQ ID NO: 9267889 - DNA, 22 bp, Homo sapiens
tcataaagcttgcctgcagtgt

SEQ ID NO: 9267890 - DNA, 23 bp, Homo sapiens
tcataaatattagcacagtagga

SEQ ID NO: 9267891 - DNA, 23 bp, Homo sapiens
tcataaatattagcacagtagga

SEQ ID NO: 9267892 - DNA, 23 bp, Homo sapiens
tcataaatattagcacagtagga

SEQ ID NO: 9267893 - DNA, 22 bp, Homo sapiens
tcataaatcatactccatttgc

SEQ ID NO: 9267894 - DNA, 22 bp, Homo sapiens
tcagtgttggtcaagaatcagt

SEQ ID NO: 9267895 - DNA, 22 bp, Homo sapiens
tcagtgttggctacatctgcct

SEQ ID NO: 9267896 - DNA, 22 bp, Homo sapiens
tcagtgttgtgcacatacaaaa

SEQ ID NO: 9267897 - DNA, 22 bp, Homo sapiens
tcagtgtttacatgcatccttg

SEQ ID NO: 9267898 - DNA, 22 bp, Homo sapiens
tcagtgtttattgcggtgtgta

SEQ ID NO: 9267899 - DNA, 22 bp, Homo sapiens
tcagtgtttcagtttggaaatg

SEQ ID NO: 9267900 - DNA, 22 bp, Homo sapiens
tcagtgtttattcaatgttatt

SEQ ID NO: 9267901 - DNA, 22 bp, Homo sapiens
tcagtgtttaccgtatgttgtt

SEQ ID NO: 9267902 - DNA, 22 bp, Homo sapiens
tcagtgttggagataattgcac

SEQ ID NO: 9267903 - DNA, 22 bp, Homo sapiens
tcagtgttggcattcagaaatg

SEQ ID NO: 9267904 - DNA, 22 bp, Homo sapiens
tcagtgttgaattttttgcaaa

SEQ ID NO: 9267905 - DNA, 22 bp, Homo sapiens
tcagtgttcttatttaattagg

SEQ ID NO: 9267906 - DNA, 22 bp, Homo sapiens
tcagtgttctggatttggggca

SEQ ID NO: 9267907 - DNA, 22 bp, Homo sapiens
tcagtccttggcatttaggagc

SEQ ID NO: 9267908 - DNA, 22 bp, Homo sapiens
tcagtccttggcatttaggagc

SEQ ID NO: 9267909 - DNA, 23 bp, Homo sapiens
tcagtcctgtaggggctccaggt

SEQ ID NO: 9267910 - DNA, 22 bp, Homo sapiens
tcagtcctgggccggcatcctc

SEQ ID NO: 9267911 - DNA, 22 bp, Homo sapiens
tcagtcctatccaaactatata

SEQ ID NO: 9267912 - DNA, 22 bp, Homo sapiens
tcagtcctacacgctcagggac

SEQ ID NO: 9267913 - DNA, 22 bp, Homo sapiens
tcagtaaataactcagatgctc

SEQ ID NO: 9267914 - DNA, 22 bp, Homo sapiens
tcagtaaatgaatgaatatatg

SEQ ID NO: 9267915 - DNA, 22 bp, Homo sapiens
tcagtaaatctctaattggcat

SEQ ID NO: 9267916 - DNA, 22 bp, Homo sapiens
tcagtaaagttctttcttgctg

SEQ ID NO: 9267917 - DNA, 22 bp, Homo sapiens
tcagtaaagtctctagagggta

SEQ ID NO: 9267918 - DNA, 22 bp, Homo sapiens
tcagtaaaggggaggtgatggg

SEQ ID NO: 9267919 - DNA, 22 bp, Homo sapiens
tcagtaaaggctaggttatgct

SEQ ID NO: 9267920 - DNA, 22 bp, Homo sapiens
tcagtaaaataaaacatgggac

SEQ ID NO: 9267921 - DNA, 22 bp, Homo sapiens
tcagtaaaattacagatctaca

SEQ ID NO: 9267922 - DNA, 22 bp, Homo sapiens
tcagtaaacaggtttaagtcct

SEQ ID NO: 9267923 - DNA, 21 bp, Homo sapiens
tcagtaaacctaaagattgta

SEQ ID NO: 9267924 - DNA, 22 bp, Homo sapiens
tcagtaaatgcttgcaggccga

SEQ ID NO: 9267925 - DNA, 23 bp, Homo sapiens
tcagtaaatggtaaagtctcttc

SEQ ID NO: 9267926 - DNA, 22 bp, Homo sapiens
tcagtaaccctgctgttcagag

SEQ ID NO: 9267927 - DNA, 22 bp, Homo sapiens
tcagtaaatggttgctgttatt

SEQ ID NO: 9267928 - DNA, 22 bp, Homo sapiens
tcagtaaccctgctgttcagag

SEQ ID NO: 9267929 - DNA, 19 bp, Homo sapiens
tcagtaacttttaagagga

SEQ ID NO: 9267930 - DNA, 22 bp, Homo sapiens
tcagtaacttcatgaccaagca

SEQ ID NO: 9267931 - DNA, 22 bp, Homo sapiens
tcagtaacttacttattcacct

SEQ ID NO: 9267932 - DNA, 22 bp, Homo sapiens
tcagtaaatgaatgaatatatg

SEQ ID NO: 9267933 - DNA, 22 bp, Homo sapiens
tcagtaaatgagcaaaaatttc

SEQ ID NO: 9267934 - DNA, 22 bp, Homo sapiens
tcagtaaatgcctttctgtgaa

SEQ ID NO: 9267935 - DNA, 22 bp, Homo sapiens
tcagtataattgctggcactga

SEQ ID NO: 9267936 - DNA, 22 bp, Homo sapiens
tcagtaattacctatgactcga

SEQ ID NO: 9267937 - DNA, 22 bp, Homo sapiens
tcagtaattacctatgactcga

SEQ ID NO: 9267938 - DNA, 21 bp, Homo sapiens
tcagtaaaaaaactacctaga

SEQ ID NO: 9267939 - DNA, 22 bp, Homo sapiens
tcagtaaaacctgcttttagtg

SEQ ID NO: 9267940 - DNA, 22 bp, Homo sapiens
tcagtaaaagggtgctttactc

SEQ ID NO: 9267941 - DNA, 22 bp, Homo sapiens
tcagggctgcagaagaggcagg

SEQ ID NO: 9267942 - DNA, 22 bp, Homo sapiens
tcagggctccggaagtggcctc

SEQ ID NO: 9267943 - DNA, 22 bp, Homo sapiens
tcagggcatctcttaagtggtg

SEQ ID NO: 9267944 - DNA, 22 bp, Homo sapiens
tcagggcatactcttcaaggtc

SEQ ID NO: 9267945 - DNA, 22 bp, Homo sapiens
tcagggcatcatcatgaatata

SEQ ID NO: 9267946 - DNA, 22 bp, Homo sapiens
tcaggctgtaaatggtgtgggt

SEQ ID NO: 9267947 - DNA, 22 bp, Homo sapiens
tcaggctgtagggcccctggag

SEQ ID NO: 9267948 - DNA, 22 bp, Homo sapiens
tcaggctgtaaatggtgtgggt

SEQ ID NO: 9267949 - DNA, 22 bp, Homo sapiens
tcaggctggtggtcagatggct

SEQ ID NO: 9267950 - DNA, 22 bp, Homo sapiens
tcaggctggtggtcagatggct

SEQ ID NO: 9267951 - DNA, 22 bp, Homo sapiens
tcaggctggtccccacagtgga

SEQ ID NO: 9267952 - DNA, 22 bp, Homo sapiens
tcaggctggtccccacagtgga

SEQ ID NO: 9267953 - DNA, 22 bp, Homo sapiens
tcaggctggtccccacagtgga

SEQ ID NO: 9267954 - DNA, 22 bp, Homo sapiens
tcaggctggtggtcagatggct

SEQ ID NO: 9267955 - DNA, 20 bp, Homo sapiens
tcaggctggtgggctttccc

SEQ ID NO: 9267956 - DNA, 22 bp, Homo sapiens
tcaggagagagttgggtaggct

SEQ ID NO: 9267957 - DNA, 22 bp, Homo sapiens
tcaggagagagttgggtaggct

SEQ ID NO: 9267958 - DNA, 22 bp, Homo sapiens
tcaggagagagaaattggggct

SEQ ID NO: 9267959 - DNA, 17 bp, Homo sapiens
tcaggctgggtgcagtg

SEQ ID NO: 9267960 - DNA, 17 bp, Homo sapiens
tcaggctgggtgcagtg

SEQ ID NO: 9267961 - DNA, 22 bp, Homo sapiens
tcaggagagaaagaatacaatt

SEQ ID NO: 9267962 - DNA, 17 bp, Homo sapiens
tcaggctgggtgcagtg

SEQ ID NO: 9267963 - DNA, 17 bp, Homo sapiens
tcaggctgggtgcagtg

SEQ ID NO: 9267964 - DNA, 17 bp, Homo sapiens
tcaggctgggtgcagtg

SEQ ID NO: 9267965 - DNA, 22 bp, Homo sapiens
tcagggcaggcgagcagctgct

SEQ ID NO: 9267966 - DNA, 21 bp, Homo sapiens
tcagggcagctgctcttcaga

SEQ ID NO: 9267967 - DNA, 22 bp, Homo sapiens
tcaggcttttcctgcctcctac

SEQ ID NO: 9267968 - DNA, 22 bp, Homo sapiens
tcaggctgttcctgtccaaaat

SEQ ID NO: 9267969 - DNA, 22 bp, Homo sapiens
tcaggctgttcctgtccaaaat

SEQ ID NO: 9267970 - DNA, 22 bp, Homo sapiens
tcaggctgtagggcccctggag

SEQ ID NO: 9267971 - DNA, 22 bp, Homo sapiens
tcaggctgtatatcttgcactc

SEQ ID NO: 9267972 - DNA, 22 bp, Homo sapiens
tcaggctgtagggcccctggag

SEQ ID NO: 9267973 - DNA, 22 bp, Homo sapiens
tcaggctgttagccacctcctc

SEQ ID NO: 9267974 - DNA, 22 bp, Homo sapiens
tcaggcttccaggctctgctga

SEQ ID NO: 9267975 - DNA, 22 bp, Homo sapiens
tcaggcttggtgctccagtgcc

SEQ ID NO: 9267976 - DNA, 22 bp, Homo sapiens
tcctgcctcttgccttcttcac

SEQ ID NO: 9267977 - DNA, 22 bp, Homo sapiens
tcctgcctcttgccttcttcac

SEQ ID NO: 9267978 - DNA, 22 bp, Homo sapiens
tcctgcctctccatgctaacta

SEQ ID NO: 9267979 - DNA, 22 bp, Homo sapiens
tcctgcctctccatgctaacta

SEQ ID NO: 9267980 - DNA, 22 bp, Homo sapiens
tcctgcctcttttcttattcca

SEQ ID NO: 9267981 - DNA, 22 bp, Homo sapiens
tcctgcctcttttcttattcca

SEQ ID NO: 9267982 - DNA, 22 bp, Homo sapiens
tcctgcctcttgccttcttcac

SEQ ID NO: 9267983 - DNA, 22 bp, Homo sapiens
tcctgcctcttttcttattcca

SEQ ID NO: 9267984 - DNA, 22 bp, Homo sapiens
tcctgcctgcaatcccagcact

SEQ ID NO: 9267985 - DNA, 22 bp, Homo sapiens
tcctgcctgcaatcccagcact

SEQ ID NO: 9267986 - DNA, 22 bp, Homo sapiens
tcctgcctgcaatcccagcact

SEQ ID NO: 9267987 - DNA, 22 bp, Homo sapiens
tcctgcctgagcgtggaggagg

SEQ ID NO: 9267988 - DNA, 22 bp, Homo sapiens
tcctgcctgagcgtggaggagg

SEQ ID NO: 9267989 - DNA, 22 bp, Homo sapiens
tcctgcctgcaatcccagcact

SEQ ID NO: 9267990 - DNA, 22 bp, Homo sapiens
tcctgcctgagcgtggaggagg

SEQ ID NO: 9267991 - DNA, 22 bp, Homo sapiens
tcctgcctagcaggtgacctat

SEQ ID NO: 9267992 - DNA, 22 bp, Homo sapiens
tcctgcctagcaggtgacctat

SEQ ID NO: 9267993 - DNA, 22 bp, Homo sapiens
tcctgcctagcaggtgacctat

SEQ ID NO: 9267994 - DNA, 22 bp, Homo sapiens
tcctgcctagcaggtgacctat

SEQ ID NO: 9267995 - DNA, 22 bp, Homo sapiens
tcctgcctcacagttgaagttt

SEQ ID NO: 9267996 - DNA, 22 bp, Homo sapiens
tcctgcctaccttgcggaggtg

SEQ ID NO: 9267997 - DNA, 22 bp, Homo sapiens
tcctgcctaccttgcggaggtg

SEQ ID NO: 9267998 - DNA, 22 bp, Homo sapiens
tcctgcctaccttgcggaggtg

SEQ ID NO: 9267999 - DNA, 22 bp, Homo sapiens
tcctgcctagcaggtgacctat

SEQ ID NO: 9268000 - DNA, 22 bp, Homo sapiens
tcctgcctcacagttgaagttt

SEQ ID NO: 9268001 - DNA, 22 bp, Homo sapiens
tcctgcctcacagttgaagttt

SEQ ID NO: 9268002 - DNA, 22 bp, Homo sapiens
tcctgcctcaggctctggagta

SEQ ID NO: 9268003 - DNA, 22 bp, Homo sapiens
tcctgcctcacagttgaagttt

SEQ ID NO: 9268004 - DNA, 22 bp, Homo sapiens
tcctgcctcaggctctggagta

SEQ ID NO: 9268005 - DNA, 22 bp, Homo sapiens
tcctgcctctccatgctaacta

SEQ ID NO: 9268006 - DNA, 22 bp, Homo sapiens
tcctgcctcaggctctggagta

SEQ ID NO: 9268007 - DNA, 22 bp, Homo sapiens
tcctgcccagagctctccactc

SEQ ID NO: 9268008 - DNA, 22 bp, Homo sapiens
tcctgcccagagctctccactc

SEQ ID NO: 9268009 - DNA, 20 bp, Homo sapiens
tcctgcagtcgctagcgccc

SEQ ID NO: 9268010 - DNA, 22 bp, Homo sapiens
tcctgcaggtggatgattctct

SEQ ID NO: 9268011 - DNA, 22 bp, Homo sapiens
tcctgcaggggctgaggaacca

SEQ ID NO: 9268012 - DNA, 22 bp, Homo sapiens
tcctgcagctctgagaagcatc

SEQ ID NO: 9268013 - DNA, 22 bp, Homo sapiens
tcctgcagctctgagaagcatc

SEQ ID NO: 9268014 - DNA, 22 bp, Homo sapiens
tcctgcagctgaagctcatgtg

SEQ ID NO: 9268015 - DNA, 22 bp, Homo sapiens
tcctgcagctgcagacctgggg

SEQ ID NO: 9268016 - DNA, 22 bp, Homo sapiens
tcctgcaggcctgttcccagta

SEQ ID NO: 9268017 - DNA, 22 bp, Homo sapiens
tcctgcaggcttgagtcctcag

SEQ ID NO: 9268018 - DNA, 18 bp, Homo sapiens
tcctgcagcttctatgta

SEQ ID NO: 9268019 - DNA, 22 bp, Homo sapiens
tcctgcagccactgcaggcaga

SEQ ID NO: 9268020 - DNA, 22 bp, Homo sapiens
tcctgcagccattagaggtcaa

SEQ ID NO: 9268021 - DNA, 22 bp, Homo sapiens
tcctgcagatcaaagcctttga

SEQ ID NO: 9268022 - DNA, 23 bp, Homo sapiens
tcctgcagataagctggttgaca

SEQ ID NO: 9268023 - DNA, 22 bp, Homo sapiens
tcctgcagagtcccactgattt

SEQ ID NO: 9268024 - DNA, 22 bp, Homo sapiens
tcctgcagagccgccctcaggt

SEQ ID NO: 9268025 - DNA, 22 bp, Homo sapiens
tcctgcagagccgccctcaggt

SEQ ID NO: 9268026 - DNA, 22 bp, Homo sapiens
tcctgcacaccttgagcttgga

SEQ ID NO: 9268027 - DNA, 22 bp, Homo sapiens
tcctgcagacctcagtcaggtc

SEQ ID NO: 9268028 - DNA, 22 bp, Homo sapiens
tcctgcagagacagaggcctca

SEQ ID NO: 9268029 - DNA, 22 bp, Homo sapiens
tcctgcagagacagaggcctca

SEQ ID NO: 9268030 - DNA, 19 bp, Homo sapiens
tcctgcagaccagacctgt

SEQ ID NO: 9268031 - DNA, 22 bp, Homo sapiens
tcctgcagacctcagtcaggtc

SEQ ID NO: 9268032 - DNA, 22 bp, Homo sapiens
tcctgaggaaagttcatgaatg

SEQ ID NO: 9268033 - DNA, 22 bp, Homo sapiens
tcctgaggaaagttcatgaatg

SEQ ID NO: 9268034 - DNA, 22 bp, Homo sapiens
tcctgaggaccctgtcaggggc

SEQ ID NO: 9268035 - DNA, 23 bp, Homo sapiens
tcctgaggaatggcatctcacat

SEQ ID NO: 9268036 - DNA, 22 bp, Homo sapiens
tcctgaggaatgtgaagagaac

SEQ ID NO: 9268037 - DNA, 22 bp, Homo sapiens
tcctgaggactaacaggaagga

SEQ ID NO: 9268038 - DNA, 22 bp, Homo sapiens
tcctgaggactaacaggaagga

SEQ ID NO: 9268039 - DNA, 22 bp, Homo sapiens
tcctgagtgagagctgggaggt

SEQ ID NO: 9268040 - DNA, 22 bp, Homo sapiens
tcctgaggttttaaaactattc

SEQ ID NO: 9268041 - DNA, 22 bp, Homo sapiens
tcctgaggctaaagtgcagtgg

SEQ ID NO: 9268042 - DNA, 22 bp, Homo sapiens
tcctgaggctaaagtgcagtgg

SEQ ID NO: 9268043 - DNA, 22 bp, Homo sapiens
tcctgaggcctctgtgatgtga

SEQ ID NO: 9268044 - DNA, 22 bp, Homo sapiens
tcctgaggcacaatcctagaat

SEQ ID NO: 9268045 - DNA, 22 bp, Homo sapiens
tcctgaggatggttgaagtgca

SEQ ID NO: 9268046 - DNA, 20 bp, Homo sapiens
tcctgagatttaaggggttc

SEQ ID NO: 9268047 - DNA, 20 bp, Homo sapiens
tcctgagatttaaggggttc

SEQ ID NO: 9268048 - DNA, 22 bp, Homo sapiens
tcctgagatgtggagctccatg

SEQ ID NO: 9268049 - DNA, 22 bp, Homo sapiens
tcctgagatgtggagctccatg

SEQ ID NO: 9268050 - DNA, 22 bp, Homo sapiens
tcctgagatccttttagggatc

SEQ ID NO: 9268051 - DNA, 23 bp, Homo sapiens
tcctgagatgagacagtgctgcc

SEQ ID NO: 9268052 - DNA, 22 bp, Homo sapiens
tcctgagataggagttgaaggc

SEQ ID NO: 9268053 - DNA, 22 bp, Homo sapiens
tcctgagataaatctcatgtga

SEQ ID NO: 9268054 - DNA, 22 bp, Homo sapiens
tcctgagaggggtgggtttccc

SEQ ID NO: 9268055 - DNA, 22 bp, Homo sapiens
tcctgagaggtgtgaggtgcag

SEQ ID NO: 9268056 - DNA, 22 bp, Homo sapiens
tcctgagaggtgtgaggtgcag

SEQ ID NO: 9268057 - DNA, 22 bp, Homo sapiens
tcctgagagtcaagaatgcagg

SEQ ID NO: 9268058 - DNA, 22 bp, Homo sapiens
tcctctggtcttcggtgtggac

SEQ ID NO: 9268059 - DNA, 22 bp, Homo sapiens
tcctctggtcctgcagcagatc

SEQ ID NO: 9268060 - DNA, 19 bp, Homo sapiens
tcctctggtaccacccttg

SEQ ID NO: 9268061 - DNA, 22 bp, Homo sapiens
tcctctggggcgtggtcctgga

SEQ ID NO: 9268062 - DNA, 22 bp, Homo sapiens
tcctcttctgcccatcagaggc

SEQ ID NO: 9268063 - DNA, 22 bp, Homo sapiens
tcctcttctgcctatatctgcc

SEQ ID NO: 9268064 - DNA, 22 bp, Homo sapiens
tcctcttgggaatacctttcta

SEQ ID NO: 9268065 - DNA, 22 bp, Homo sapiens
tcctctggttatacttgcaccc

SEQ ID NO: 9268066 - DNA, 22 bp, Homo sapiens
tcctgaagaaggcagatatttg

SEQ ID NO: 9268067 - DNA, 22 bp, Homo sapiens
tcctgaagagccctgctctgtg

SEQ ID NO: 9268068 - DNA, 22 bp, Homo sapiens
tcctgaagaacgaagtcatgta

SEQ ID NO: 9268069 - DNA, 22 bp, Homo sapiens
tcctgaacattatgcaagcttc

SEQ ID NO: 9268070 - DNA, 22 bp, Homo sapiens
tcctgaagcagttagcatgagc

SEQ ID NO: 9268071 - DNA, 22 bp, Homo sapiens
tcctgaagatgaaaagagaggt

SEQ ID NO: 9268072 - DNA, 19 bp, Homo sapiens
tcctgaaaacttctggaat

SEQ ID NO: 9268073 - DNA, 22 bp, Homo sapiens
tcctgaaaaattacatgttcag

SEQ ID NO: 9268074 - DNA, 19 bp, Homo sapiens
tcctgaaaacttctggaat

SEQ ID NO: 9268075 - DNA, 22 bp, Homo sapiens
tcctgaaattctggttgtcact

SEQ ID NO: 9268076 - DNA, 22 bp, Homo sapiens
tcctgaaatgtgcacatgacat

SEQ ID NO: 9268077 - DNA, 22 bp, Homo sapiens
tcctgaaaataatttcacaaga

SEQ ID NO: 9268078 - DNA, 22 bp, Homo sapiens
tcctgaaatgtgcacatgacat

SEQ ID NO: 9268079 - DNA, 22 bp, Homo sapiens
tcctgaaaataatttcacaaga

SEQ ID NO: 9268080 - DNA, 20 bp, Homo sapiens
tcctgagacctgggaaggtt

SEQ ID NO: 9268081 - DNA, 22 bp, Homo sapiens
tcctgagagcagagtccaggtg

SEQ ID NO: 9268082 - DNA, 22 bp, Homo sapiens
tcctgagagccttggcttcaga

SEQ ID NO: 9268083 - DNA, 22 bp, Homo sapiens
tcctgagagcagctgctttgga

SEQ ID NO: 9268084 - DNA, 22 bp, Homo sapiens
tcctgagagccttggcttcaga

SEQ ID NO: 9268085 - DNA, 22 bp, Homo sapiens
tcctgaagctctcttaaggaaa

SEQ ID NO: 9268086 - DNA, 22 bp, Homo sapiens
tcctgaagcctgagtgatgact

SEQ ID NO: 9268087 - DNA, 22 bp, Homo sapiens
tcctgaaggagcagttgctggg

SEQ ID NO: 9268088 - DNA, 22 bp, Homo sapiens
tcctgaaggcagatggggatca

SEQ ID NO: 9268089 - DNA, 22 bp, Homo sapiens
tcctgagaaggcacagcttgca

SEQ ID NO: 9268090 - DNA, 22 bp, Homo sapiens
tcctgagaatagagttgcatgt

SEQ ID NO: 9268091 - DNA, 22 bp, Homo sapiens
tcccgataggcagggctctggc

SEQ ID NO: 9268092 - DNA, 22 bp, Homo sapiens
tcccagggactctctgccttcc

SEQ ID NO: 9268093 - DNA, 22 bp, Homo sapiens
tcccagggactggatgatgcag

SEQ ID NO: 9268094 - DNA, 22 bp, Homo sapiens
tcccagggacccagcctgatac

SEQ ID NO: 9268095 - DNA, 22 bp, Homo sapiens
tcccagggacccagcctgatac

SEQ ID NO: 9268096 - DNA, 20 bp, Homo sapiens
tccctcagcacttctacctc

SEQ ID NO: 9268097 - DNA, 22 bp, Homo sapiens
tccctcagagaccgtggtgcag

SEQ ID NO: 9268098 - DNA, 21 bp, Homo sapiens
tccctcagacagggtgcctat

SEQ ID NO: 9268099 - DNA, 22 bp, Homo sapiens
tccctcagatgagctcctagca

SEQ ID NO: 9268100 - DNA, 22 bp, Homo sapiens
tccctcagatgagctcctagca

SEQ ID NO: 9268101 - DNA, 22 bp, Homo sapiens
tcccagggacaccaagctgttt

SEQ ID NO: 9268102 - DNA, 23 bp, Homo sapiens
tcccagggaaggtgagcgaggct

SEQ ID NO: 9268103 - DNA, 22 bp, Homo sapiens
tcccagggacaccaagctgttt

SEQ ID NO: 9268104 - DNA, 22 bp, Homo sapiens
tcccaggctgggggcctgaagt

SEQ ID NO: 9268105 - DNA, 22 bp, Homo sapiens
tcccaggctgggggcctgaagt

SEQ ID NO: 9268106 - DNA, 20 bp, Homo sapiens
tcccaggctgggctccagct

SEQ ID NO: 9268107 - DNA, 22 bp, Homo sapiens
tcccaggctggcaggcagcagt

SEQ ID NO: 9268108 - DNA, 22 bp, Homo sapiens
tcccaggctaggcctctgcgtt

SEQ ID NO: 9268109 - DNA, 22 bp, Homo sapiens
tcccaggctaggcctctgcgtt

SEQ ID NO: 9268110 - DNA, 23 bp, Homo sapiens
tccctcaggccttatctccatct

SEQ ID NO: 9268111 - DNA, 22 bp, Homo sapiens
tccctcagcttgtctccatgca

SEQ ID NO: 9268112 - DNA, 22 bp, Homo sapiens
tccctcagcttgtctccatgca

SEQ ID NO: 9268113 - DNA, 22 bp, Homo sapiens
tccctcagcttgtctccatgca

SEQ ID NO: 9268114 - DNA, 22 bp, Homo sapiens
tccctcagggtgcagttgcttt

SEQ ID NO: 9268115 - DNA, 20 bp, Homo sapiens
tccctcagtcctggctttgt

SEQ ID NO: 9268116 - DNA, 19 bp, Homo sapiens
tccctcagtctgccaggcc

SEQ ID NO: 9268117 - DNA, 22 bp, Homo sapiens
tccctccagaatggtgaggaag

SEQ ID NO: 9268118 - DNA, 22 bp, Homo sapiens
tccctccacacctgctggtacc

SEQ ID NO: 9268119 - DNA, 22 bp, Homo sapiens
tccctccccacttctgagcttt

SEQ ID NO: 9268120 - DNA, 22 bp, Homo sapiens
tccctccccacttctgagcttt

SEQ ID NO: 9268121 - DNA, 20 bp, Homo sapiens
tccctccctccagctctggg

SEQ ID NO: 9268122 - DNA, 22 bp, Homo sapiens
tccctccataacagaggtgagc

SEQ ID NO: 9268123 - DNA, 20 bp, Homo sapiens
tccctccctccagctctggg

SEQ ID NO: 9268124 - DNA, 20 bp, Homo sapiens
tccctccctccagctctggg

SEQ ID NO: 9268125 - DNA, 18 bp, Homo sapiens
tccctccctgctgtggcc

SEQ ID NO: 9268126 - DNA, 18 bp, Homo sapiens
tccctccctgctgtggcc

SEQ ID NO: 9268127 - DNA, 19 bp, Homo sapiens
tccctccctgtaatctcac

SEQ ID NO: 9268128 - DNA, 19 bp, Homo sapiens
tccctccctgtaatctcac

SEQ ID NO: 9268129 - DNA, 22 bp, Homo sapiens
tccctctcttgggcgtggctca

SEQ ID NO: 9268130 - DNA, 22 bp, Homo sapiens
tccctctgtgttgggcatgcct

SEQ ID NO: 9268131 - DNA, 22 bp, Homo sapiens
tccctgagactctggagtgtaa

SEQ ID NO: 9268132 - DNA, 22 bp, Homo sapiens
tccctgagaaagcccaggaggt

SEQ ID NO: 9268133 - DNA, 22 bp, Homo sapiens
tccctgccctgccttcatggtt

SEQ ID NO: 9268134 - DNA, 22 bp, Homo sapiens
tccctggcagctaagggtggtc

SEQ ID NO: 9268135 - DNA, 22 bp, Homo sapiens
tccctggctgtgttcaggtgcg

SEQ ID NO: 9268136 - DNA, 22 bp, Homo sapiens
tccctgggaacaaaggatgaga

SEQ ID NO: 9268137 - DNA, 19 bp, Homo sapiens
tccctggcgcctctcgggc

SEQ ID NO: 9268138 - DNA, 22 bp, Homo sapiens
tcctagaatgcacctctgctgt

SEQ ID NO: 9268139 - DNA, 22 bp, Homo sapiens
tcctagaatctttgtaagattg

SEQ ID NO: 9268140 - DNA, 22 bp, Homo sapiens
tcctagagcctccagagggaga

SEQ ID NO: 9268141 - DNA, 22 bp, Homo sapiens
tcctagaatagtgtgtctggag

SEQ ID NO: 9268142 - DNA, 22 bp, Homo sapiens
tcctagaataatctttgactgc

SEQ ID NO: 9268143 - DNA, 22 bp, Homo sapiens
tccctgggaccggcagctcaca

SEQ ID NO: 9268144 - DNA, 22 bp, Homo sapiens
tccctgggagatgatgatgagg

SEQ ID NO: 9268145 - DNA, 16 bp, Homo sapiens
tccctgggagtggtgg

SEQ ID NO: 9268146 - DNA, 22 bp, Homo sapiens
tcctaaaggctgcttttatatt

SEQ ID NO: 9268147 - DNA, 22 bp, Homo sapiens
tccgtgttccaagacagggtgg

SEQ ID NO: 9268148 - DNA, 22 bp, Homo sapiens
tcctcagcaaacacttcactct

SEQ ID NO: 9268149 - DNA, 22 bp, Homo sapiens
tcctcagatgctcttggacgcc

SEQ ID NO: 9268150 - DNA, 22 bp, Homo sapiens
tcctcagcattagcacagacat

SEQ ID NO: 9268151 - DNA, 22 bp, Homo sapiens
tcctcagacaccctgctggctt

SEQ ID NO: 9268152 - DNA, 22 bp, Homo sapiens
tcctcagacttccctttgtgta

SEQ ID NO: 9268153 - DNA, 22 bp, Homo sapiens
tcctcagggaagatgagcctca

SEQ ID NO: 9268154 - DNA, 21 bp, Homo sapiens
tcctcagggccccagagcact

SEQ ID NO: 9268155 - DNA, 22 bp, Homo sapiens
tcctcagggcggcctccgtctt

SEQ ID NO: 9268156 - DNA, 19 bp, Homo sapiens
tcctcaggggctcacagac

SEQ ID NO: 9268157 - DNA, 22 bp, Homo sapiens
tcctcaggtcaaagcaggagaa

SEQ ID NO: 9268158 - DNA, 19 bp, Homo sapiens
tcctcaggggctcacagac

SEQ ID NO: 9268159 - DNA, 22 bp, Homo sapiens
tcctcagaatcacctggcagct

SEQ ID NO: 9268160 - DNA, 20 bp, Homo sapiens
tcctcagaagacatttgggg

SEQ ID NO: 9268161 - DNA, 22 bp, Homo sapiens
tcctcacagggcaggaaggagg

SEQ ID NO: 9268162 - DNA, 22 bp, Homo sapiens
tcctcacatggtgagccacaca

SEQ ID NO: 9268163 - DNA, 22 bp, Homo sapiens
tcctcacagtcaacactttgag

SEQ ID NO: 9268164 - DNA, 22 bp, Homo sapiens
tcctcacatggtgagccacaca

SEQ ID NO: 9268165 - DNA, 22 bp, Homo sapiens
tcctcagaaacccctgtgaggt

SEQ ID NO: 9268166 - DNA, 22 bp, Homo sapiens
tcctcacatggtgagccacaca

SEQ ID NO: 9268167 - DNA, 22 bp, Homo sapiens
tcctcactgcagtgctccgagc

SEQ ID NO: 9268168 - DNA, 22 bp, Homo sapiens
tcctagttctggttctgtcact

SEQ ID NO: 9268169 - DNA, 22 bp, Homo sapiens
tcctcacaagcaagcacaggta

SEQ ID NO: 9268170 - DNA, 22 bp, Homo sapiens
tcctcacaagcaagcacaggta

SEQ ID NO: 9268171 - DNA, 22 bp, Homo sapiens
tcctagttctctgccagtcgct

SEQ ID NO: 9268172 - DNA, 22 bp, Homo sapiens
tcctcacactatagatgaggat

SEQ ID NO: 9268173 - DNA, 22 bp, Homo sapiens
tcctcacagctggttcattcag

SEQ ID NO: 9268174 - DNA, 22 bp, Homo sapiens
tcctcacagcatgaccaggcag

SEQ ID NO: 9268175 - DNA, 22 bp, Homo sapiens
tcctcacagagtggcaggcaat

SEQ ID NO: 9268176 - DNA, 22 bp, Homo sapiens
tcctcacagatgggtgcatagc

SEQ ID NO: 9268177 - DNA, 22 bp, Homo sapiens
tcctcacagcatgaccaggcag

SEQ ID NO: 9268178 - DNA, 22 bp, Homo sapiens
tcccagcattaatgcctgtcag

SEQ ID NO: 9268179 - DNA, 22 bp, Homo sapiens
tcccagcataacaaactgcccg

SEQ ID NO: 9268180 - DNA, 23 bp, Homo sapiens
tcccagcctcttctcttgcatac

SEQ ID NO: 9268181 - DNA, 22 bp, Homo sapiens
tcccagccggtgcctgggtccc

SEQ ID NO: 9268182 - DNA, 22 bp, Homo sapiens
tcccagaggttgagtcacttat

SEQ ID NO: 9268183 - DNA, 22 bp, Homo sapiens
tcccagagtattagcaattgct

SEQ ID NO: 9268184 - DNA, 22 bp, Homo sapiens
tcccagaggtctctgctggttc

SEQ ID NO: 9268185 - DNA, 22 bp, Homo sapiens
tcccagaggtctctgctggttc

SEQ ID NO: 9268186 - DNA, 22 bp, Homo sapiens
tcccagaggttgagtcacttat

SEQ ID NO: 9268187 - DNA, 22 bp, Homo sapiens
tcccagaggctccagtctctat

SEQ ID NO: 9268188 - DNA, 22 bp, Homo sapiens
tcccagaggctccagtctctat

SEQ ID NO: 9268189 - DNA, 22 bp, Homo sapiens
tcccagaggcagttggtaactt

SEQ ID NO: 9268190 - DNA, 22 bp, Homo sapiens
tcccagaggctccagtctctat

SEQ ID NO: 9268191 - DNA, 22 bp, Homo sapiens
tcccagagccaagctatggatg

SEQ ID NO: 9268192 - DNA, 22 bp, Homo sapiens
tcccagagccaagctatggatg

SEQ ID NO: 9268193 - DNA, 22 bp, Homo sapiens
tcccagaggactgttggtgcta

SEQ ID NO: 9268194 - DNA, 22 bp, Homo sapiens
tcccagaggcagttggtaactt

SEQ ID NO: 9268195 - DNA, 22 bp, Homo sapiens
tcccagccttccttgtggtgaa

SEQ ID NO: 9268196 - DNA, 22 bp, Homo sapiens
tcccaggccataaaactcagag

SEQ ID NO: 9268197 - DNA, 22 bp, Homo sapiens
tcccaggcgcctggtggggagc

SEQ ID NO: 9268198 - DNA, 22 bp, Homo sapiens
tcccagccttccagtctggttt

SEQ ID NO: 9268199 - DNA, 22 bp, Homo sapiens
tcccagccttatctcccctggc

SEQ ID NO: 9268200 - DNA, 22 bp, Homo sapiens
tcccagcctgacagtgcatcaa

SEQ ID NO: 9268201 - DNA, 22 bp, Homo sapiens
tcccagagatttcctctccttc

SEQ ID NO: 9268202 - DNA, 22 bp, Homo sapiens
tcccagagatttcctctccttc

SEQ ID NO: 9268203 - DNA, 22 bp, Homo sapiens
tcccagagacagagcctcctcc

SEQ ID NO: 9268204 - DNA, 22 bp, Homo sapiens
tcccagagacatcatttctccg

SEQ ID NO: 9268205 - DNA, 22 bp, Homo sapiens
tcccagagacatcatttctccg

SEQ ID NO: 9268206 - DNA, 22 bp, Homo sapiens
tcccagagacagagcctcctcc

SEQ ID NO: 9268207 - DNA, 22 bp, Homo sapiens
tcccagagcagatgtgctaaag

SEQ ID NO: 9268208 - DNA, 22 bp, Homo sapiens
tcccagagcagatgtgctaaag

SEQ ID NO: 9268209 - DNA, 22 bp, Homo sapiens
tcccagagcagtactccaggag

SEQ ID NO: 9268210 - DNA, 22 bp, Homo sapiens
tcccagagccaagctatggatg

SEQ ID NO: 9268211 - DNA, 22 bp, Homo sapiens
tcccagagcagtactccaggag

SEQ ID NO: 9268212 - DNA, 22 bp, Homo sapiens
tcccagagcagtactccaggag

SEQ ID NO: 9268213 - DNA, 22 bp, Homo sapiens
tcccaaagtcaagctgtgtctt

SEQ ID NO: 9268214 - DNA, 22 bp, Homo sapiens
tcccaaagtattagcatttcaa

SEQ ID NO: 9268215 - DNA, 22 bp, Homo sapiens
tcccaaagtattagcatttcaa

SEQ ID NO: 9268216 - DNA, 22 bp, Homo sapiens
tcccaaagtattagcatttcaa

SEQ ID NO: 9268217 - DNA, 22 bp, Homo sapiens
tcccaagagctctgggataagg

SEQ ID NO: 9268218 - DNA, 22 bp, Homo sapiens
tcccagagaagagctggatgga

SEQ ID NO: 9268219 - DNA, 22 bp, Homo sapiens
tcccagagaagagctggatgga

SEQ ID NO: 9268220 - DNA, 22 bp, Homo sapiens
tcccagagaaagtcaaggtctt

SEQ ID NO: 9268221 - DNA, 22 bp, Homo sapiens
tccatgggaagattttgagtgg

SEQ ID NO: 9268222 - DNA, 22 bp, Homo sapiens
tccatggggcccaggatgagag

SEQ ID NO: 9268223 - DNA, 22 bp, Homo sapiens
tccatggagatggatgactgta

SEQ ID NO: 9268224 - DNA, 22 bp, Homo sapiens
tccatggagatggatgactgta

SEQ ID NO: 9268225 - DNA, 22 bp, Homo sapiens
tccatgggtagccctggttgag

SEQ ID NO: 9268226 - DNA, 22 bp, Homo sapiens
tccatggggcccaggatgagag

SEQ ID NO: 9268227 - DNA, 22 bp, Homo sapiens
tccattatacttctgattcaaa

SEQ ID NO: 9268228 - DNA, 22 bp, Homo sapiens
tccattcttttgctgtcttcct

SEQ ID NO: 9268229 - DNA, 22 bp, Homo sapiens
tcccaaagctactcttctgact

SEQ ID NO: 9268230 - DNA, 22 bp, Homo sapiens
tcccaaaggtccgagcgggaat

SEQ ID NO: 9268231 - DNA, 21 bp, Homo sapiens
tccagggctttgattctctca

SEQ ID NO: 9268232 - DNA, 21 bp, Homo sapiens
tccagggctttgattctctca

SEQ ID NO: 9268233 - DNA, 19 bp, Homo sapiens
tccagggctttatggcttt

SEQ ID NO: 9268234 - DNA, 18 bp, Homo sapiens
tccagggcttcctcctct

SEQ ID NO: 9268235 - DNA, 22 bp, Homo sapiens
tccagggcttgacagggtgcct

SEQ ID NO: 9268236 - DNA, 22 bp, Homo sapiens
tccagggcttgacagggtgcct

SEQ ID NO: 9268237 - DNA, 22 bp, Homo sapiens
tccagggcttggctgggacggt

SEQ ID NO: 9268238 - DNA, 22 bp, Homo sapiens
tccagggcttggctgggacggt

SEQ ID NO: 9268239 - DNA, 22 bp, Homo sapiens
tccagggcttggctgggacggt

SEQ ID NO: 9268240 - DNA, 22 bp, Homo sapiens
tccaggtgacagagacaggata

SEQ ID NO: 9268241 - DNA, 22 bp, Homo sapiens
tccaggtgagtgcaggtgcaga

SEQ ID NO: 9268242 - DNA, 22 bp, Homo sapiens
tccaggtgtatttactgaagta

SEQ ID NO: 9268243 - DNA, 22 bp, Homo sapiens
tccaggtgggctgcacccaggc

SEQ ID NO: 9268244 - DNA, 19 bp, Homo sapiens
tccaggtggagagacaccc

SEQ ID NO: 9268245 - DNA, 22 bp, Homo sapiens
tccaggtgccggggactgaggc

SEQ ID NO: 9268246 - DNA, 22 bp, Homo sapiens
tccagtcaagcttgagaatttc

SEQ ID NO: 9268247 - DNA, 22 bp, Homo sapiens
tccaggtttcgctacaggagag

SEQ ID NO: 9268248 - DNA, 22 bp, Homo sapiens
tccaggttttctgaaggcagga

SEQ ID NO: 9268249 - DNA, 22 bp, Homo sapiens
tccaggttttctgaaggcagga

SEQ ID NO: 9268250 - DNA, 22 bp, Homo sapiens
tccagtacaggtctctcatttc

SEQ ID NO: 9268251 - DNA, 22 bp, Homo sapiens
tccagggctgttactttacata

SEQ ID NO: 9268252 - DNA, 18 bp, Homo sapiens
tccagggcttcctcctct

SEQ ID NO: 9268253 - DNA, 22 bp, Homo sapiens
tccagggctgggttggctcagc

SEQ ID NO: 9268254 - DNA, 22 bp, Homo sapiens
tccagggacacagagtccttct

SEQ ID NO: 9268255 - DNA, 22 bp, Homo sapiens
tccagggacacagagtccttct

SEQ ID NO: 9268256 - DNA, 22 bp, Homo sapiens
tccagggacagcgctggagcta

SEQ ID NO: 9268257 - DNA, 22 bp, Homo sapiens
tccagggctgacttgggagagg

SEQ ID NO: 9268258 - DNA, 22 bp, Homo sapiens
tccagggctgacttgggagagg

SEQ ID NO: 9268259 - DNA, 22 bp, Homo sapiens
tccagggctgacttgggagagg

SEQ ID NO: 9268260 - DNA, 22 bp, Homo sapiens
tccagggaaggtgtgaggctgg

SEQ ID NO: 9268261 - DNA, 22 bp, Homo sapiens
tccagggaaggtgtgaggctgg

SEQ ID NO: 9268262 - DNA, 21 bp, Homo sapiens
tccagggaatttcaactttta

SEQ ID NO: 9268263 - DNA, 22 bp, Homo sapiens
tccagggaagagcagaggctac

SEQ ID NO: 9268264 - DNA, 22 bp, Homo sapiens
tccagggaagagcagaggctac

SEQ ID NO: 9268265 - DNA, 22 bp, Homo sapiens
tccagggaaggtgtgaggctgg

SEQ ID NO: 9268266 - DNA, 22 bp, Homo sapiens
tccaggctgggctgaagggtgc

SEQ ID NO: 9268267 - DNA, 23 bp, Homo sapiens
tccaggctgggacttcaactggc

SEQ ID NO: 9268268 - DNA, 22 bp, Homo sapiens
tccaggctttttcatgctgtct

SEQ ID NO: 9268269 - DNA, 23 bp, Homo sapiens
tccaggctgggacttcaactggc

SEQ ID NO: 9268270 - DNA, 22 bp, Homo sapiens
tccagggaagagcagaggctac

SEQ ID NO: 9268271 - DNA, 21 bp, Homo sapiens
tccagggaacttctcaggaat

SEQ ID NO: 9268272 - DNA, 22 bp, Homo sapiens
tccaattttctgatttcacttg

SEQ ID NO: 9268273 - DNA, 22 bp, Homo sapiens
tccaggctaattttgcattgtt

SEQ ID NO: 9268274 - DNA, 22 bp, Homo sapiens
tccaggctaattttgcattgtt

SEQ ID NO: 9268275 - DNA, 22 bp, Homo sapiens
tccaggctaattttgcattgtt

SEQ ID NO: 9268276 - DNA, 22 bp, Homo sapiens
tccaggctggcctcgcgtgaca

SEQ ID NO: 9268277 - DNA, 22 bp, Homo sapiens
tccaggctggcctcgcgtgaca

SEQ ID NO: 9268278 - DNA, 18 bp, Homo sapiens
tccaggctggattgatga

SEQ ID NO: 9268279 - DNA, 22 bp, Homo sapiens
tccaggctggagtgcagtggcg

SEQ ID NO: 9268280 - DNA, 22 bp, Homo sapiens
tccaggctggagtgcagtggcg

SEQ ID NO: 9268281 - DNA, 18 bp, Homo sapiens
tccaggctggattgatga

SEQ ID NO: 9268282 - DNA, 22 bp, Homo sapiens
tccaggctggctcttcaaaatt

SEQ ID NO: 9268283 - DNA, 22 bp, Homo sapiens
tccaggctggcctcgcgtgaca

SEQ ID NO: 9268284 - DNA, 22 bp, Homo sapiens
tccaggctggctcttcaaaatt

SEQ ID NO: 9268285 - DNA, 22 bp, Homo sapiens
tccaggctggctcttcaaaatt

SEQ ID NO: 9268286 - DNA, 22 bp, Homo sapiens
tccaggctggctcttcaaaatt

SEQ ID NO: 9268287 - DNA, 22 bp, Homo sapiens
tccaggctggacatgaggcggg

SEQ ID NO: 9268288 - DNA, 22 bp, Homo sapiens
tccaggctggagtgcagtggca

SEQ ID NO: 9268289 - DNA, 22 bp, Homo sapiens
tccaggctggagtgcagtggca

SEQ ID NO: 9268290 - DNA, 22 bp, Homo sapiens
tccaggctggagtgcagtggca

SEQ ID NO: 9268291 - DNA, 22 bp, Homo sapiens
tccaggctggagtgcagtggcg

SEQ ID NO: 9268292 - DNA, 22 bp, Homo sapiens
tccaggctggacatgaggcggg

SEQ ID NO: 9268293 - DNA, 22 bp, Homo sapiens
tccaggctggacatgaggcggg

SEQ ID NO: 9268294 - DNA, 21 bp, Homo sapiens
tccaggctggaaggggcgttg

SEQ ID NO: 9268295 - DNA, 21 bp, Homo sapiens
tccaggctggaaggggcgttg

SEQ ID NO: 9268296 - DNA, 22 bp, Homo sapiens
tccaggctaggtttacaggaca

SEQ ID NO: 9268297 - DNA, 22 bp, Homo sapiens
tccaggctagcctggtagagaa

SEQ ID NO: 9268298 - DNA, 22 bp, Homo sapiens
tccaggctagcctggtagagaa

SEQ ID NO: 9268299 - DNA, 22 bp, Homo sapiens
tccaggctagagtgcagtggcc

SEQ ID NO: 9268300 - DNA, 22 bp, Homo sapiens
tccaggctagagtgcagtggcc

SEQ ID NO: 9268301 - DNA, 22 bp, Homo sapiens
tccaggctagagtgcagtggcc

SEQ ID NO: 9268302 - DNA, 22 bp, Homo sapiens
tccaggctagaagtcacaggcc

SEQ ID NO: 9268303 - DNA, 22 bp, Homo sapiens
tccaggctacttggattcctgg

SEQ ID NO: 9268304 - DNA, 22 bp, Homo sapiens
tccaggctacttggattcctgg

SEQ ID NO: 9268305 - DNA, 22 bp, Homo sapiens
tccaggctagaagtcacaggcc

SEQ ID NO: 9268306 - DNA, 22 bp, Homo sapiens
tccaggctagaagtcacaggcc

SEQ ID NO: 9268307 - DNA, 20 bp, Homo sapiens
tatgctttttataagattga

SEQ ID NO: 9268308 - DNA, 20 bp, Homo sapiens
tatgctttttataagattga

SEQ ID NO: 9268309 - DNA, 22 bp, Homo sapiens
tatgcttttaacctgtaactga

SEQ ID NO: 9268310 - DNA, 22 bp, Homo sapiens
tatgctttggtagagagttgtg

SEQ ID NO: 9268311 - DNA, 22 bp, Homo sapiens
tatgcttttaacctgtaactga

SEQ ID NO: 9268312 - DNA, 22 bp, Homo sapiens
tatgctttgcaattggaaaagg

SEQ ID NO: 9268313 - DNA, 22 bp, Homo sapiens
tatgctttgcaattggaaaagg

SEQ ID NO: 9268314 - DNA, 22 bp, Homo sapiens
tatgctttacttttcattgtga

SEQ ID NO: 9268315 - DNA, 22 bp, Homo sapiens
tatgctttacttttcattgtga

SEQ ID NO: 9268316 - DNA, 22 bp, Homo sapiens
tatgctttcattcatatgtgag

SEQ ID NO: 9268317 - DNA, 22 bp, Homo sapiens
tatgctttcattcatatgtgag

SEQ ID NO: 9268318 - DNA, 22 bp, Homo sapiens
tatgctttaaccctcttatatt

SEQ ID NO: 9268319 - DNA, 22 bp, Homo sapiens
tatggacatctgaagttgcaga

SEQ ID NO: 9268320 - DNA, 22 bp, Homo sapiens
tatggaaagggagtttaatttg

SEQ ID NO: 9268321 - DNA, 22 bp, Homo sapiens
tatggaaagtgttttcttctgt

SEQ ID NO: 9268322 - DNA, 22 bp, Homo sapiens
tatggaaagctctttttgattg

SEQ ID NO: 9268323 - DNA, 22 bp, Homo sapiens
tatggaaaaatgtatcttgtca

SEQ ID NO: 9268324 - DNA, 22 bp, Homo sapiens
tatggtagaaaaactgagtccc

SEQ ID NO: 9268325 - DNA, 22 bp, Homo sapiens
tatggtaaatgagcatatgttc

SEQ ID NO: 9268326 - DNA, 22 bp, Homo sapiens
tatgtactcatcaactattgaa

SEQ ID NO: 9268327 - DNA, 22 bp, Homo sapiens
tatgtactctaatttgtctcat

SEQ ID NO: 9268328 - DNA, 22 bp, Homo sapiens
tatgtagcaatagcatcatact

SEQ ID NO: 9268329 - DNA, 22 bp, Homo sapiens
tatgtatccgtgtgtgtacaga

SEQ ID NO: 9268330 - DNA, 22 bp, Homo sapiens
tatgtatatgtatacacacaca

SEQ ID NO: 9268331 - DNA, 22 bp, Homo sapiens
tatgtatatggtagaagtatgt

SEQ ID NO: 9268332 - DNA, 22 bp, Homo sapiens
tatgtcaaaaaagattatgttt

SEQ ID NO: 9268333 - DNA, 22 bp, Homo sapiens
tatgtcaaagttaagaaatagg

SEQ ID NO: 9268334 - DNA, 22 bp, Homo sapiens
tattaattcttgccaattctcc

SEQ ID NO: 9268335 - DNA, 22 bp, Homo sapiens
tattaataagtgactactagct

SEQ ID NO: 9268336 - DNA, 22 bp, Homo sapiens
tattaataagtgactactagct

SEQ ID NO: 9268337 - DNA, 22 bp, Homo sapiens
tattaagatacgtagttgtaaa

SEQ ID NO: 9268338 - DNA, 22 bp, Homo sapiens
tattaagatacgtagttgtaaa

SEQ ID NO: 9268339 - DNA, 22 bp, Homo sapiens
tattaagatacgtagttgtaaa

SEQ ID NO: 9268340 - DNA, 22 bp, Homo sapiens
tattaaattatggatttaggag

SEQ ID NO: 9268341 - DNA, 22 bp, Homo sapiens
tattaacatgaactgacttttc

SEQ ID NO: 9268342 - DNA, 22 bp, Homo sapiens
tatgtcatgggtcaaaatgaag

SEQ ID NO: 9268343 - DNA, 22 bp, Homo sapiens
tatgtttatactttgatgtact

SEQ ID NO: 9268344 - DNA, 19 bp, Homo sapiens
tatgtccctttcccccatt

SEQ ID NO: 9268345 - DNA, 18 bp, Homo sapiens
tataaacacacttaggtt

SEQ ID NO: 9268346 - DNA, 18 bp, Homo sapiens
tataaacacacttaggtt

SEQ ID NO: 9268347 - DNA, 22 bp, Homo sapiens
tataaaatggcatcagctccaa

SEQ ID NO: 9268348 - DNA, 22 bp, Homo sapiens
tataaaatggcatcagctccaa

SEQ ID NO: 9268349 - DNA, 22 bp, Homo sapiens
tataaaattctcagtttggggt

SEQ ID NO: 9268350 - DNA, 22 bp, Homo sapiens
tataaaatggcatcagctccaa

SEQ ID NO: 9268351 - DNA, 22 bp, Homo sapiens
tataaaacagaaagcactacct

SEQ ID NO: 9268352 - DNA, 22 bp, Homo sapiens
tataaaatggcatcagctccaa

SEQ ID NO: 9268353 - DNA, 22 bp, Homo sapiens
tataaagagtctcaaagaagtt

SEQ ID NO: 9268354 - DNA, 22 bp, Homo sapiens
tataaagagtctatctggtggc

SEQ ID NO: 9268355 - DNA, 22 bp, Homo sapiens
tataaagaagtgtaaacaggaa

SEQ ID NO: 9268356 - DNA, 22 bp, Homo sapiens
tataaagaagtgtaaacaggaa

SEQ ID NO: 9268357 - DNA, 22 bp, Homo sapiens
tataaagaatccagaagagaca

SEQ ID NO: 9268358 - DNA, 22 bp, Homo sapiens
tataaagtttcgaaagatgtat

SEQ ID NO: 9268359 - DNA, 22 bp, Homo sapiens
tataaagttggggctgaagtaa

SEQ ID NO: 9268360 - DNA, 22 bp, Homo sapiens
tataaagtgtgaactgtgagta

SEQ ID NO: 9268361 - DNA, 22 bp, Homo sapiens
tataaagagtctcaaagaagtt

SEQ ID NO: 9268362 - DNA, 22 bp, Homo sapiens
tatcactacactaagatacaga

SEQ ID NO: 9268363 - DNA, 22 bp, Homo sapiens
tatcagaaatgccttaaattgg

SEQ ID NO: 9268364 - DNA, 22 bp, Homo sapiens
tatcagaagacttacagtatcg

SEQ ID NO: 9268365 - DNA, 22 bp, Homo sapiens
tatcactacacttcagctttaa

SEQ ID NO: 9268366 - DNA, 22 bp, Homo sapiens
tatcagcatctcctcaaagata

SEQ ID NO: 9268367 - DNA, 22 bp, Homo sapiens
tatcaggaagaacacgtgaaat

SEQ ID NO: 9268368 - DNA, 22 bp, Homo sapiens
tatcagctcggaatctgttgaa

SEQ ID NO: 9268369 - DNA, 22 bp, Homo sapiens
tatcatttaacagaatcattgc

SEQ ID NO: 9268370 - DNA, 22 bp, Homo sapiens
tatcagaaggaagtgcctttaa

SEQ ID NO: 9268371 - DNA, 22 bp, Homo sapiens
tatcagaaggcacatggagtct

SEQ ID NO: 9268372 - DNA, 22 bp, Homo sapiens
tatcagaaggcacatggagtct

SEQ ID NO: 9268373 - DNA, 22 bp, Homo sapiens
tatcagaatgcagccatgtgca

SEQ ID NO: 9268374 - DNA, 23 bp, Homo sapiens
tatctttttcaatgttggaaata

SEQ ID NO: 9268375 - DNA, 22 bp, Homo sapiens
tatcttttgagttctcaagatg

SEQ ID NO: 9268376 - DNA, 22 bp, Homo sapiens
tatgaaaaggtggccaatgtag

SEQ ID NO: 9268377 - DNA, 22 bp, Homo sapiens
tatgaaacattcatacaaataa

SEQ ID NO: 9268378 - DNA, 22 bp, Homo sapiens
tatgaaaatttagctgaagcat

SEQ ID NO: 9268379 - DNA, 22 bp, Homo sapiens
tatgaaaaggtggccaatgtag

SEQ ID NO: 9268380 - DNA, 22 bp, Homo sapiens
tatcattttactgtgacatttt

SEQ ID NO: 9268381 - DNA, 22 bp, Homo sapiens
tatcattttactgtgacatttt

SEQ ID NO: 9268382 - DNA, 22 bp, Homo sapiens
tatcatttgttattattagtgg

SEQ ID NO: 9268383 - DNA, 23 bp, Homo sapiens
tatcatttcagctctctgcctgg

SEQ ID NO: 9268384 - DNA, 22 bp, Homo sapiens
tatgaattctcttgtgtatagt

SEQ ID NO: 9268385 - DNA, 22 bp, Homo sapiens
tatgaatataccacaatttagg

SEQ ID NO: 9268386 - DNA, 20 bp, Homo sapiens
tatgaagatatgtgaacagc

SEQ ID NO: 9268387 - DNA, 22 bp, Homo sapiens
tatgaagattgcggtctggaat

SEQ ID NO: 9268388 - DNA, 22 bp, Homo sapiens
tatgaaattgccatttttatgg

SEQ ID NO: 9268389 - DNA, 22 bp, Homo sapiens
tatgaaatgatggggaaaatag

SEQ ID NO: 9268390 - DNA, 22 bp, Homo sapiens
tcaaagagctattcagttgtgg

SEQ ID NO: 9268391 - DNA, 22 bp, Homo sapiens
tcaaagatagatgttgagaaat

SEQ ID NO: 9268392 - DNA, 22 bp, Homo sapiens
tcaaagagctctatcttcaaaa

SEQ ID NO: 9268393 - DNA, 22 bp, Homo sapiens
tcaaagatagatgttgagaaat

SEQ ID NO: 9268394 - DNA, 22 bp, Homo sapiens
tcaaacttggtaagagaaatac

SEQ ID NO: 9268395 - DNA, 22 bp, Homo sapiens
tattttgaggtatttttgagct

SEQ ID NO: 9268396 - DNA, 22 bp, Homo sapiens
tattttgcaaacctgagtttga

SEQ ID NO: 9268397 - DNA, 22 bp, Homo sapiens
tattttgaggtatttttgagct

SEQ ID NO: 9268398 - DNA, 22 bp, Homo sapiens
tattttgacgattttatgcaaa

SEQ ID NO: 9268399 - DNA, 22 bp, Homo sapiens
tattttgactattaaaccaaca

SEQ ID NO: 9268400 - DNA, 22 bp, Homo sapiens
tattttgtaattggtcatagct

SEQ ID NO: 9268401 - DNA, 22 bp, Homo sapiens
tattttgtaattggtcatagct

SEQ ID NO: 9268402 - DNA, 20 bp, Homo sapiens
tattttgcaattatggttca

SEQ ID NO: 9268403 - DNA, 22 bp, Homo sapiens
tattttgcgttgagtcagattt

SEQ ID NO: 9268404 - DNA, 22 bp, Homo sapiens
tattttgtatttatgcaagaaa

SEQ ID NO: 9268405 - DNA, 22 bp, Homo sapiens
tattttgttttgtatccactgt

SEQ ID NO: 9268406 - DNA, 22 bp, Homo sapiens
tattttgttaataatccagtcc

SEQ ID NO: 9268407 - DNA, 22 bp, Homo sapiens
tattttgttaataatccagtcc

SEQ ID NO: 9268408 - DNA, 22 bp, Homo sapiens
tcaaagtttgtggcaatttatt

SEQ ID NO: 9268409 - DNA, 22 bp, Homo sapiens
tcaaagttacttgtggttttct

SEQ ID NO: 9268410 - DNA, 22 bp, Homo sapiens
tcaaataaggagtcatgaccat

SEQ ID NO: 9268411 - DNA, 22 bp, Homo sapiens
tcaaagtaggggtaagccaggc

SEQ ID NO: 9268412 - DNA, 22 bp, Homo sapiens
tcaaagtaaaagtatagagttt

SEQ ID NO: 9268413 - DNA, 22 bp, Homo sapiens
tcaaaggttaactctgttgttc

SEQ ID NO: 9268414 - DNA, 22 bp, Homo sapiens
tcaaatatgtgatagaagctaa

SEQ ID NO: 9268415 - DNA, 22 bp, Homo sapiens
tcaaatagttgacattaacttg

SEQ ID NO: 9268416 - DNA, 22 bp, Homo sapiens
tcaaatatgtgatagaagctaa

SEQ ID NO: 9268417 - DNA, 22 bp, Homo sapiens
tcaaataggcttgtagtgactg

SEQ ID NO: 9268418 - DNA, 22 bp, Homo sapiens
tcaaataatgccattcatcatc

SEQ ID NO: 9268419 - DNA, 22 bp, Homo sapiens
tcaaataatgccattcatcatc

SEQ ID NO: 9268420 - DNA, 22 bp, Homo sapiens
tcaaatctttaacatgtgcaaa

SEQ ID NO: 9268421 - DNA, 22 bp, Homo sapiens
tcaaatcaccaaactcactggc

SEQ ID NO: 9268422 - DNA, 21 bp, Homo sapiens
tcaaatcaggtatcactattg

SEQ ID NO: 9268423 - DNA, 22 bp, Homo sapiens
tcaaatcaccaaactcactggc

SEQ ID NO: 9268424 - DNA, 21 bp, Homo sapiens
tcaaatcatgtactgaccaca

SEQ ID NO: 9268425 - DNA, 22 bp, Homo sapiens
tatttaaaaagaggccagctgg

SEQ ID NO: 9268426 - DNA, 22 bp, Homo sapiens
tattgtgccaggtaatgtgttc

SEQ ID NO: 9268427 - DNA, 22 bp, Homo sapiens
tattgtgcatgttgaataacta

SEQ ID NO: 9268428 - DNA, 22 bp, Homo sapiens
tatttaaaatagtgctccagca

SEQ ID NO: 9268429 - DNA, 22 bp, Homo sapiens
tatttaaaataagccccagtgg

SEQ ID NO: 9268430 - DNA, 22 bp, Homo sapiens
tatttaataaaactatggcatg

SEQ ID NO: 9268431 - DNA, 22 bp, Homo sapiens
tatttaataaaactatggcatg

SEQ ID NO: 9268432 - DNA, 22 bp, Homo sapiens
tatttaagatgtgtcataaaga

SEQ ID NO: 9268433 - DNA, 22 bp, Homo sapiens
tatttaaccagttaaatttcca

SEQ ID NO: 9268434 - DNA, 22 bp, Homo sapiens
tatttaactggaaacacaatga

SEQ ID NO: 9268435 - DNA, 22 bp, Homo sapiens
tattacaaattataatgggaga

SEQ ID NO: 9268436 - DNA, 22 bp, Homo sapiens
tattacaagaaagggcatgaat

SEQ ID NO: 9268437 - DNA, 22 bp, Homo sapiens
tattgtcacgtcttaattctag

SEQ ID NO: 9268438 - DNA, 21 bp, Homo sapiens
tattgtcaatctgctttcaga

SEQ ID NO: 9268439 - DNA, 22 bp, Homo sapiens
tattgtattaaggattcaagta

SEQ ID NO: 9268440 - DNA, 22 bp, Homo sapiens
tattgtatcttctgtttagaag

SEQ ID NO: 9268441 - DNA, 22 bp, Homo sapiens
tattacaatttacattgcactt

SEQ ID NO: 9268442 - DNA, 22 bp, Homo sapiens
tattacaatttacattgcactt

SEQ ID NO: 9268443 - DNA, 21 bp, Homo sapiens
tattgtcaatctgctttcaga

SEQ ID NO: 9268444 - DNA, 22 bp, Homo sapiens
tattgtccaataggatgttcct

SEQ ID NO: 9268445 - DNA, 22 bp, Homo sapiens
tatttggaaatgataaagtact

SEQ ID NO: 9268446 - DNA, 22 bp, Homo sapiens
tatttggaatagcttgctaatg

SEQ ID NO: 9268447 - DNA, 22 bp, Homo sapiens
tattttctggggagagtgaacc

SEQ ID NO: 9268448 - DNA, 22 bp, Homo sapiens
tattttctggacagtcttgctt

SEQ ID NO: 9268449 - DNA, 23 bp, Homo sapiens
tattttccaaatgatgactacat

SEQ ID NO: 9268450 - DNA, 22 bp, Homo sapiens
tatttcttgttattctcgttga

SEQ ID NO: 9268451 - DNA, 22 bp, Homo sapiens
tatttcttgttattctcgttga

SEQ ID NO: 9268452 - DNA, 22 bp, Homo sapiens
tatttgatagagataaatgata

SEQ ID NO: 9268453 - DNA, 22 bp, Homo sapiens
tatttgatagagataaatgata

SEQ ID NO: 9268454 - DNA, 22 bp, Homo sapiens
tatttgaagggagaaagtgcca

SEQ ID NO: 9268455 - DNA, 22 bp, Homo sapiens
tatttgaaggcatacattttga

SEQ ID NO: 9268456 - DNA, 23 bp, Homo sapiens
tatttgctactggtaattctgga

SEQ ID NO: 9268457 - DNA, 22 bp, Homo sapiens
tatttgatagagataaatgata

SEQ ID NO: 9268458 - DNA, 22 bp, Homo sapiens
tatttgatgaaggtaaagtctt

SEQ ID NO: 9268459 - DNA, 22 bp, Homo sapiens
tatttgatgaaggtaaagtctt

SEQ ID NO: 9268460 - DNA, 22 bp, Homo sapiens
tatttgatggttctaaaacagc

SEQ ID NO: 9268461 - DNA, 22 bp, Homo sapiens
tatttgatggttctaaaacagc

SEQ ID NO: 9268462 - DNA, 22 bp, Homo sapiens
tatttgcaaagaactacactag

SEQ ID NO: 9268463 - DNA, 22 bp, Homo sapiens
tatttgcaacataaaactctga

SEQ ID NO: 9268464 - DNA, 23 bp, Homo sapiens
taggccagggtgacctggggaga

SEQ ID NO: 9268465 - DNA, 22 bp, Homo sapiens
taggccaggacagagcttccag

SEQ ID NO: 9268466 - DNA, 22 bp, Homo sapiens
taggccagtggcaggttgtgtg

SEQ ID NO: 9268467 - DNA, 22 bp, Homo sapiens
taggccagcccttagtcctgtc

SEQ ID NO: 9268468 - DNA, 22 bp, Homo sapiens
taggcagggattagggttgatt

SEQ ID NO: 9268469 - DNA, 22 bp, Homo sapiens
taggcagctgcaaacttcggtc

SEQ ID NO: 9268470 - DNA, 22 bp, Homo sapiens
taggcagaggtatggtaaggac

SEQ ID NO: 9268471 - DNA, 21 bp, Homo sapiens
taggcagaggagcaggtatct

SEQ ID NO: 9268472 - DNA, 22 bp, Homo sapiens
taggcagatgttaacaggaaaa

SEQ ID NO: 9268473 - DNA, 22 bp, Homo sapiens
taggcagatgttaacaggaaaa

SEQ ID NO: 9268474 - DNA, 22 bp, Homo sapiens
tagctgttaagttgtttggaaa

SEQ ID NO: 9268475 - DNA, 22 bp, Homo sapiens
taggcagaaaggaaggcaagtt

SEQ ID NO: 9268476 - DNA, 22 bp, Homo sapiens
tagctgtgtagacactcagagc

SEQ ID NO: 9268477 - DNA, 22 bp, Homo sapiens
taggcagaaaggaaggcaagtt

SEQ ID NO: 9268478 - DNA, 20 bp, Homo sapiens
taggcagagctgtgcagcct

SEQ ID NO: 9268479 - DNA, 20 bp, Homo sapiens
taggcagagctgtgcagcct

SEQ ID NO: 9268480 - DNA, 20 bp, Homo sapiens
taggcagagctgtgcagcct

SEQ ID NO: 9268481 - DNA, 22 bp, Homo sapiens
tagctgtcaccagaaatggcca

SEQ ID NO: 9268482 - DNA, 22 bp, Homo sapiens
tagctggttctccaggagctag

SEQ ID NO: 9268483 - DNA, 22 bp, Homo sapiens
tagctgtcagcaatcaagtggt

SEQ ID NO: 9268484 - DNA, 22 bp, Homo sapiens
tagctgtcagcaatcaagtggt

SEQ ID NO: 9268485 - DNA, 22 bp, Homo sapiens
tagctggtctttaagcatgtaa

SEQ ID NO: 9268486 - DNA, 22 bp, Homo sapiens
tagggctgtttaaaagtgaggt

SEQ ID NO: 9268487 - DNA, 22 bp, Homo sapiens
tagggctgtttaaaagtgaggt

SEQ ID NO: 9268488 - DNA, 22 bp, Homo sapiens
tagggctgttagtaattctcag

SEQ ID NO: 9268489 - DNA, 22 bp, Homo sapiens
tagggctgtgtctccaggacca

SEQ ID NO: 9268490 - DNA, 22 bp, Homo sapiens
tagggctgggtacactcttgcc

SEQ ID NO: 9268491 - DNA, 16 bp, Homo sapiens
tagggctgggaaggag

SEQ ID NO: 9268492 - DNA, 16 bp, Homo sapiens
tagggctgggaaggag

SEQ ID NO: 9268493 - DNA, 22 bp, Homo sapiens
tagggctggcgtgctcagggaa

SEQ ID NO: 9268494 - DNA, 22 bp, Homo sapiens
tagggctgtggtcagtcctcta

SEQ ID NO: 9268495 - DNA, 22 bp, Homo sapiens
tagggctgtgtctccaggacca

SEQ ID NO: 9268496 - DNA, 22 bp, Homo sapiens
tagggctgcctatggctagata

SEQ ID NO: 9268497 - DNA, 22 bp, Homo sapiens
tagggctgcctatggctagata

SEQ ID NO: 9268498 - DNA, 22 bp, Homo sapiens
tagggctgctgcagatgacagg

SEQ ID NO: 9268499 - DNA, 22 bp, Homo sapiens
tagggctgccatttgcttttct

SEQ ID NO: 9268500 - DNA, 22 bp, Homo sapiens
tagggctgcagaacaatggcct

SEQ ID NO: 9268501 - DNA, 22 bp, Homo sapiens
tagggctgaggcaacaagggag

SEQ ID NO: 9268502 - DNA, 19 bp, Homo sapiens
tagggctggccgggcggtg

SEQ ID NO: 9268503 - DNA, 22 bp, Homo sapiens
tagggctgctttgtattctgct

SEQ ID NO: 9268504 - DNA, 22 bp, Homo sapiens
tagggctgctgcagatgacagg

SEQ ID NO: 9268505 - DNA, 22 bp, Homo sapiens
tagggctggcgtgctcagggaa

SEQ ID NO: 9268506 - DNA, 19 bp, Homo sapiens
tagggctggccgggcggtg

SEQ ID NO: 9268507 - DNA, 22 bp, Homo sapiens
tagggcagagtccaggatgggc

SEQ ID NO: 9268508 - DNA, 22 bp, Homo sapiens
tagggcagccacccaggctgct

SEQ ID NO: 9268509 - DNA, 22 bp, Homo sapiens
tagggcagattcggtggagttt

SEQ ID NO: 9268510 - DNA, 22 bp, Homo sapiens
tagggcagccacccaggctgct

SEQ ID NO: 9268511 - DNA, 23 bp, Homo sapiens
tagggcagctgggagggacatgc

SEQ ID NO: 9268512 - DNA, 22 bp, Homo sapiens
tagggctgaggcaacaagggag

SEQ ID NO: 9268513 - DNA, 22 bp, Homo sapiens
tagggcagctgcatcaggcact

SEQ ID NO: 9268514 - DNA, 22 bp, Homo sapiens
tagggcagccacccaggctgct

SEQ ID NO: 9268515 - DNA, 22 bp, Homo sapiens
tagggcagctgcatcaggcact

SEQ ID NO: 9268516 - DNA, 22 bp, Homo sapiens
tagtgcttaacacaaagtgatt

SEQ ID NO: 9268517 - DNA, 22 bp, Homo sapiens
tagtgctttaagtttacagaga

SEQ ID NO: 9268518 - DNA, 22 bp, Homo sapiens
tagtgcttctaccctaggcagg

SEQ ID NO: 9268519 - DNA, 22 bp, Homo sapiens
tagtgcttggtggagatggaga

SEQ ID NO: 9268520 - DNA, 22 bp, Homo sapiens
tagtggagaagtggagtctgtg

SEQ ID NO: 9268521 - DNA, 18 bp, Homo sapiens
tagtggaactgctctggg

SEQ ID NO: 9268522 - DNA, 22 bp, Homo sapiens
tagtggagtagaaaccaaagaa

SEQ ID NO: 9268523 - DNA, 22 bp, Homo sapiens
tagtggagggtgtagctgctgg

SEQ ID NO: 9268524 - DNA, 22 bp, Homo sapiens
tagtggaggtggtctgtgaact

SEQ ID NO: 9268525 - DNA, 22 bp, Homo sapiens
tagtggaggcctgttgtgtgca

SEQ ID NO: 9268526 - DNA, 22 bp, Homo sapiens
tagtggagagttgttttgtgca

SEQ ID NO: 9268527 - DNA, 22 bp, Homo sapiens
tagtggaggggatgcaaagctt

SEQ ID NO: 9268528 - DNA, 22 bp, Homo sapiens
tagtggagaggatgtggagaaa

SEQ ID NO: 9268529 - DNA, 22 bp, Homo sapiens
tagtggaactgtgtcatacaaa

SEQ ID NO: 9268530 - DNA, 22 bp, Homo sapiens
tagttacaattatgcatggaaa

SEQ ID NO: 9268531 - DNA, 22 bp, Homo sapiens
tagttacaatgggttctgtgac

SEQ ID NO: 9268532 - DNA, 22 bp, Homo sapiens
tagttacaaaccaacaggcagc

SEQ ID NO: 9268533 - DNA, 22 bp, Homo sapiens
tagttacacatgggtagggaat

SEQ ID NO: 9268534 - DNA, 22 bp, Homo sapiens
tagttacagaagataagggtat

SEQ ID NO: 9268535 - DNA, 22 bp, Homo sapiens
tagttacagcaggcaggatata

SEQ ID NO: 9268536 - DNA, 22 bp, Homo sapiens
tagttacagagaaatgatttga

SEQ ID NO: 9268537 - DNA, 22 bp, Homo sapiens
tagttacagatctaggactgtt

SEQ ID NO: 9268538 - DNA, 22 bp, Homo sapiens
taggggaggggatcatgtgctg

SEQ ID NO: 9268539 - DNA, 22 bp, Homo sapiens
taggggagctcgggtgcaatcg

SEQ ID NO: 9268540 - DNA, 23 bp, Homo sapiens
taggggaaaaatcttctgcaatt

SEQ ID NO: 9268541 - DNA, 22 bp, Homo sapiens
taggggaactggcacagggcag

SEQ ID NO: 9268542 - DNA, 22 bp, Homo sapiens
taggggctcagaacatgtcctt

SEQ ID NO: 9268543 - DNA, 21 bp, Homo sapiens
taggggctggggctccagctg

SEQ ID NO: 9268544 - DNA, 22 bp, Homo sapiens
taggggcttgtaatttaataga

SEQ ID NO: 9268545 - DNA, 22 bp, Homo sapiens
tagtctctggagactctagggg

SEQ ID NO: 9268546 - DNA, 22 bp, Homo sapiens
tagtctctgctttgcccttggc

SEQ ID NO: 9268547 - DNA, 22 bp, Homo sapiens
tagggggctttgctgcttgaca

SEQ ID NO: 9268548 - DNA, 22 bp, Homo sapiens
tagtttcatatgcaaaatagta

SEQ ID NO: 9268549 - DNA, 22 bp, Homo sapiens
tagtttcatatgcaaaatagta

SEQ ID NO: 9268550 - DNA, 22 bp, Homo sapiens
tagtttcatatgcaaaatagta

SEQ ID NO: 9268551 - DNA, 22 bp, Homo sapiens
tagtttatgattttttggaagg

SEQ ID NO: 9268552 - DNA, 22 bp, Homo sapiens
tagtttaggtggggtagacaga

SEQ ID NO: 9268553 - DNA, 22 bp, Homo sapiens
tagtttaggatccaatctaaga

SEQ ID NO: 9268554 - DNA, 22 bp, Homo sapiens
tagtttttaagtgtacaatttc

SEQ ID NO: 9268555 - DNA, 22 bp, Homo sapiens
tagttttatgaattggtataat

SEQ ID NO: 9268556 - DNA, 22 bp, Homo sapiens
tagttttgaggattatatgtga

SEQ ID NO: 9268557 - DNA, 22 bp, Homo sapiens
tagtttttactgcgagttataa

SEQ ID NO: 9268558 - DNA, 21 bp, Homo sapiens
tagtttctacccagttaatgg

SEQ ID NO: 9268559 - DNA, 21 bp, Homo sapiens
tagtttctacccagttaatgg

SEQ ID NO: 9268560 - DNA, 22 bp, Homo sapiens
tagtttctaaactgaactgtca

SEQ ID NO: 9268561 - DNA, 22 bp, Homo sapiens
tagtttctaaagcttcctaggt

SEQ ID NO: 9268562 - DNA, 22 bp, Homo sapiens
tagtttctaaagcttcctaggt

SEQ ID NO: 9268563 - DNA, 22 bp, Homo sapiens
tagttttataatgttaacatct

SEQ ID NO: 9268564 - DNA, 22 bp, Homo sapiens
tagtttagaatgttgcaataca

SEQ ID NO: 9268565 - DNA, 22 bp, Homo sapiens
tagtttactcatctataaaatg

SEQ ID NO: 9268566 - DNA, 22 bp, Homo sapiens
tagtttaatggtcaactaatga

SEQ ID NO: 9268567 - DNA, 22 bp, Homo sapiens
tagttgaaagggattattgtgg

SEQ ID NO: 9268568 - DNA, 22 bp, Homo sapiens
tagttgacttctctatcccagc

SEQ ID NO: 9268569 - DNA, 23 bp, Homo sapiens
tagttattttctctgtaatttgc

SEQ ID NO: 9268570 - DNA, 22 bp, Homo sapiens
tagttattattgttactatcag

SEQ ID NO: 9268571 - DNA, 22 bp, Homo sapiens
tagttattattgttactatcag

SEQ ID NO: 9268572 - DNA, 23 bp, Homo sapiens
tagttacattattgtcagagctg

SEQ ID NO: 9268573 - DNA, 22 bp, Homo sapiens
tagttagagatgaattttgtct

SEQ ID NO: 9268574 - DNA, 22 bp, Homo sapiens
tagttacagcaggcaggatata

SEQ ID NO: 9268575 - DNA, 22 bp, Homo sapiens
tagttacaggagtttctgaaat

SEQ ID NO: 9268576 - DNA, 22 bp, Homo sapiens
tagttacagtgcatagcaagat

SEQ ID NO: 9268577 - DNA, 22 bp, Homo sapiens
tagttacataaagtggactgtt

SEQ ID NO: 9268578 - DNA, 22 bp, Homo sapiens
tacttacatgaattcaagagca

SEQ ID NO: 9268579 - DNA, 22 bp, Homo sapiens
tacttacattagcaaacaaggt

SEQ ID NO: 9268580 - DNA, 22 bp, Homo sapiens
tagaaatggagaacagattaat

SEQ ID NO: 9268581 - DNA, 23 bp, Homo sapiens
tagaacatcggtgtcttggagca

SEQ ID NO: 9268582 - DNA, 22 bp, Homo sapiens
tagaacatgtgaaaatatagcc

SEQ ID NO: 9268583 - DNA, 22 bp, Homo sapiens
tagaactagaacaaggatttga

SEQ ID NO: 9268584 - DNA, 22 bp, Homo sapiens
tagaactagaacaaggatttga

SEQ ID NO: 9268585 - DNA, 22 bp, Homo sapiens
tagaactaaagaacaactttga

SEQ ID NO: 9268586 - DNA, 22 bp, Homo sapiens
tagaacttaaatatgttttccc

SEQ ID NO: 9268587 - DNA, 22 bp, Homo sapiens
tagaacttgaatgtgaaatcag

SEQ ID NO: 9268588 - DNA, 22 bp, Homo sapiens
tagaacttcttacagctaagtt

SEQ ID NO: 9268589 - DNA, 22 bp, Homo sapiens
tagaacttattagaaaggctca

SEQ ID NO: 9268590 - DNA, 22 bp, Homo sapiens
tagactatttcttttgcatagg

SEQ ID NO: 9268591 - DNA, 22 bp, Homo sapiens
tagacaggagtcaggctagaat

SEQ ID NO: 9268592 - DNA, 22 bp, Homo sapiens
tagacaggaaacattaggatgg

SEQ ID NO: 9268593 - DNA, 22 bp, Homo sapiens
tagacaggaaacattaggatgg

SEQ ID NO: 9268594 - DNA, 22 bp, Homo sapiens
tagaagattcatttcctctgaa

SEQ ID NO: 9268595 - DNA, 22 bp, Homo sapiens
tagaagaaagtgaagctgggga

SEQ ID NO: 9268596 - DNA, 22 bp, Homo sapiens
tagaagaaaagcacttagagat

SEQ ID NO: 9268597 - DNA, 20 bp, Homo sapiens
tagaacttttcagtatggat

SEQ ID NO: 9268598 - DNA, 22 bp, Homo sapiens
tagaactttcagaaattccaaa

SEQ ID NO: 9268599 - DNA, 22 bp, Homo sapiens
tagaactttgccttagggcaaa

SEQ ID NO: 9268600 - DNA, 22 bp, Homo sapiens
tagaagaacatgtcaaactata

SEQ ID NO: 9268601 - DNA, 22 bp, Homo sapiens
tagagaaaagcagggatcagga

SEQ ID NO: 9268602 - DNA, 22 bp, Homo sapiens
tagagaaaagcagggatcagga

SEQ ID NO: 9268603 - DNA, 22 bp, Homo sapiens
tagagaaataagctttgccttg

SEQ ID NO: 9268604 - DNA, 22 bp, Homo sapiens
tagagaaacagaaccaacaggg

SEQ ID NO: 9268605 - DNA, 21 bp, Homo sapiens
tagagaaaagaagctgttcct

SEQ ID NO: 9268606 - DNA, 22 bp, Homo sapiens
tagagaaaaccactggtgagct

SEQ ID NO: 9268607 - DNA, 22 bp, Homo sapiens
tagagaattgtagcctgcaaga

SEQ ID NO: 9268608 - DNA, 22 bp, Homo sapiens
tagatataaggtccttagaaca

SEQ ID NO: 9268609 - DNA, 22 bp, Homo sapiens
tagatataaggtccttagaaca

SEQ ID NO: 9268610 - DNA, 22 bp, Homo sapiens
tagatacttataatcttccaag

SEQ ID NO: 9268611 - DNA, 23 bp, Homo sapiens
tagatactgcatataggtggaat

SEQ ID NO: 9268612 - DNA, 20 bp, Homo sapiens
tagatacccaatgctcatca

SEQ ID NO: 9268613 - DNA, 22 bp, Homo sapiens
tagagtctagtgtatacaaagt

SEQ ID NO: 9268614 - DNA, 22 bp, Homo sapiens
tagctgccattgctccaggaag

SEQ ID NO: 9268615 - DNA, 22 bp, Homo sapiens
tagctgccagaccattcttact

SEQ ID NO: 9268616 - DNA, 22 bp, Homo sapiens
tagctgccagaccattcttact

SEQ ID NO: 9268617 - DNA, 22 bp, Homo sapiens
tagctgcctagacagctatagc

SEQ ID NO: 9268618 - DNA, 22 bp, Homo sapiens
tagctgcccatctttcctttag

SEQ ID NO: 9268619 - DNA, 17 bp, Homo sapiens
tagctgccccgaatgct

SEQ ID NO: 9268620 - DNA, 22 bp, Homo sapiens
tagctgcctttgggctcctgct

SEQ ID NO: 9268621 - DNA, 22 bp, Homo sapiens
tagctgcctttgggctcctgct

SEQ ID NO: 9268622 - DNA, 19 bp, Homo sapiens
tagctgcctgttacctcca

SEQ ID NO: 9268623 - DNA, 19 bp, Homo sapiens
tagctgcctgttacctcca

SEQ ID NO: 9268624 - DNA, 22 bp, Homo sapiens
tagctgcctatgtgataagaga

SEQ ID NO: 9268625 - DNA, 22 bp, Homo sapiens
tagcaggggtagatagagtgtg

SEQ ID NO: 9268626 - DNA, 22 bp, Homo sapiens
tagcagggtctcaggagtcagg

SEQ ID NO: 9268627 - DNA, 22 bp, Homo sapiens
tagcagggtccaatgtgaggca

SEQ ID NO: 9268628 - DNA, 22 bp, Homo sapiens
tagcagggtccaatgtgaggca

SEQ ID NO: 9268629 - DNA, 22 bp, Homo sapiens
tagcagggtctcaggagtcagg

SEQ ID NO: 9268630 - DNA, 22 bp, Homo sapiens
tagctgacgctaaataaatgtt

SEQ ID NO: 9268631 - DNA, 22 bp, Homo sapiens
tagctgacagatacaatcagat

SEQ ID NO: 9268632 - DNA, 22 bp, Homo sapiens
tagctgccaaaagggtgggcta

SEQ ID NO: 9268633 - DNA, 22 bp, Homo sapiens
tagctgccaaaagggtgggcta

SEQ ID NO: 9268634 - DNA, 22 bp, Homo sapiens
tagcagcttccagagagggcag

SEQ ID NO: 9268635 - DNA, 22 bp, Homo sapiens
tagcagggccaggctgggaacc

SEQ ID NO: 9268636 - DNA, 22 bp, Homo sapiens
tagcagggatacaaggtcgcct

SEQ ID NO: 9268637 - DNA, 22 bp, Homo sapiens
tagcaaagttttgtggtgatta

SEQ ID NO: 9268638 - DNA, 23 bp, Homo sapiens
tagcaaagttgtttgggaaattt

SEQ ID NO: 9268639 - DNA, 22 bp, Homo sapiens
tagcaaaggtagagttttgaga

SEQ ID NO: 9268640 - DNA, 22 bp, Homo sapiens
tagcaaaggccttggacacgct

SEQ ID NO: 9268641 - DNA, 22 bp, Homo sapiens
tagcaaaggatgactatgtacc

SEQ ID NO: 9268642 - DNA, 22 bp, Homo sapiens
tagcaaagctccgtagttattt

SEQ ID NO: 9268643 - DNA, 22 bp, Homo sapiens
tagcaaatacatgatgtaattt

SEQ ID NO: 9268644 - DNA, 22 bp, Homo sapiens
tagatctgatacaattcatctg

SEQ ID NO: 9268645 - DNA, 22 bp, Homo sapiens
tagatgaccttgtgttaggcaa

SEQ ID NO: 9268646 - DNA, 22 bp, Homo sapiens
tagatgaaatttgtgtgtatgc

SEQ ID NO: 9268647 - DNA, 18 bp, Homo sapiens
tagcaaagatgtggattg

SEQ ID NO: 9268648 - DNA, 22 bp, Homo sapiens
tagcaaagaccaaagctagttg

SEQ ID NO: 9268649 - DNA, 22 bp, Homo sapiens
tagcaaagaagatattattgca

SEQ ID NO: 9268650 - DNA, 21 bp, Homo sapiens
tagcaaagccagatgtatatt

SEQ ID NO: 9268651 - DNA, 22 bp, Homo sapiens
tagcaaagcccttgctgtgtaa

SEQ ID NO: 9268652 - DNA, 22 bp, Homo sapiens
tagcaaagcccttgctgtgtaa

SEQ ID NO: 9268653 - DNA, 22 bp, Homo sapiens
tagcaaaatgtggatgtagttg

SEQ ID NO: 9268654 - DNA, 22 bp, Homo sapiens
tagcaaagaacctgatacccca

SEQ ID NO: 9268655 - DNA, 22 bp, Homo sapiens
tagcaaagaagatattattgca

SEQ ID NO: 9268656 - DNA, 22 bp, Homo sapiens
gttatacttatgtgcaaaaata

SEQ ID NO: 9268657 - DNA, 22 bp, Homo sapiens
gttataaatgactgcaaaagtt

SEQ ID NO: 9268658 - DNA, 22 bp, Homo sapiens
gttataaatgactgcaaaagtt

SEQ ID NO: 9268659 - DNA, 22 bp, Homo sapiens
gttataaatgactgcaaaagtt

SEQ ID NO: 9268660 - DNA, 19 bp, Homo sapiens
gttatcaaggggctacttt

SEQ ID NO: 9268661 - DNA, 22 bp, Homo sapiens
gttatcttccctttgatgattt

SEQ ID NO: 9268662 - DNA, 22 bp, Homo sapiens
gttattgcacagtgggtgaggt

SEQ ID NO: 9268663 - DNA, 20 bp, Homo sapiens
gttattgcgtaagactcgct

SEQ ID NO: 9268664 - DNA, 22 bp, Homo sapiens
gttattgcagtatagaggtcta

SEQ ID NO: 9268665 - DNA, 22 bp, Homo sapiens
gttattgctaaaggttttcatt

SEQ ID NO: 9268666 - DNA, 22 bp, Homo sapiens
gttattgctatacatgtacact

SEQ ID NO: 9268667 - DNA, 22 bp, Homo sapiens
gttatcttctatttctcatact

SEQ ID NO: 9268668 - DNA, 22 bp, Homo sapiens
gttatgattgaaattccagttt

SEQ ID NO: 9268669 - DNA, 22 bp, Homo sapiens
gttatgaaataaatatagatca

SEQ ID NO: 9268670 - DNA, 22 bp, Homo sapiens
gttatgaagtcattcacaaata

SEQ ID NO: 9268671 - DNA, 22 bp, Homo sapiens
gttcttcagtcacatcacagaa

SEQ ID NO: 9268672 - DNA, 22 bp, Homo sapiens
gttctgctgtaatatctctgct

SEQ ID NO: 9268673 - DNA, 22 bp, Homo sapiens
gttattgtgtttgttcagggca

SEQ ID NO: 9268674 - DNA, 22 bp, Homo sapiens
gttattgtttatcctgcacccc

SEQ ID NO: 9268675 - DNA, 22 bp, Homo sapiens
gttattgtccatttatttagca

SEQ ID NO: 9268676 - DNA, 22 bp, Homo sapiens
gttattgtccatttatttagca

SEQ ID NO: 9268677 - DNA, 22 bp, Homo sapiens
gttatttaactttgtagcatgg

SEQ ID NO: 9268678 - DNA, 22 bp, Homo sapiens
gttattgtttatcctgcacccc

SEQ ID NO: 9268679 - DNA, 22 bp, Homo sapiens
gttatttataaggtgtaactcc

SEQ ID NO: 9268680 - DNA, 22 bp, Homo sapiens
gttatttcagccacagagtgca

SEQ ID NO: 9268681 - DNA, 22 bp, Homo sapiens
gttattgtccagcacagttggg

SEQ ID NO: 9268682 - DNA, 22 bp, Homo sapiens
gttattgtccagcacagttggg

SEQ ID NO: 9268683 - DNA, 22 bp, Homo sapiens
gttattgctctactcaatgtta

SEQ ID NO: 9268684 - DNA, 17 bp, Homo sapiens
gttattgctgcttcctt

SEQ ID NO: 9268685 - DNA, 22 bp, Homo sapiens
gttattgctggatagatacatc

SEQ ID NO: 9268686 - DNA, 23 bp, Homo sapiens
gttattgctggtgctggccagcc

SEQ ID NO: 9268687 - DNA, 22 bp, Homo sapiens
gttattgctggatagatacatc

SEQ ID NO: 9268688 - DNA, 22 bp, Homo sapiens
gttattgcttttttacaaatca

SEQ ID NO: 9268689 - DNA, 22 bp, Homo sapiens
gtgttcttttgcttcacagaaa

SEQ ID NO: 9268690 - DNA, 22 bp, Homo sapiens
gtgttgatgacattttagaaac

SEQ ID NO: 9268691 - DNA, 21 bp, Homo sapiens
gtgttggcatatggtggttga

SEQ ID NO: 9268692 - DNA, 22 bp, Homo sapiens
gtgttcaaaatgtaggtagatt

SEQ ID NO: 9268693 - DNA, 22 bp, Homo sapiens
gtgttctctagagctgtacaaa

SEQ ID NO: 9268694 - DNA, 22 bp, Homo sapiens
gtgttctctagagctgtacaaa

SEQ ID NO: 9268695 - DNA, 22 bp, Homo sapiens
gtgttctaatggctgagggatg

SEQ ID NO: 9268696 - DNA, 22 bp, Homo sapiens
gtgctgggattacaggtgtgag

SEQ ID NO: 9268697 - DNA, 22 bp, Homo sapiens
gtgttattagagcattaatttt

SEQ ID NO: 9268698 - DNA, 22 bp, Homo sapiens
gttaaattcgatgatggataaa

SEQ ID NO: 9268699 - DNA, 22 bp, Homo sapiens
gttaaattcgatgatggataaa

SEQ ID NO: 9268700 - DNA, 22 bp, Homo sapiens
gttaacaaatgtaaagcaatta

SEQ ID NO: 9268701 - DNA, 22 bp, Homo sapiens
gttaaataacctcatgtccgtt

SEQ ID NO: 9268702 - DNA, 22 bp, Homo sapiens
gttaaataacctcatgtccgtt

SEQ ID NO: 9268703 - DNA, 22 bp, Homo sapiens
gttataaatacctaataggatt

SEQ ID NO: 9268704 - DNA, 22 bp, Homo sapiens
gttataaatacctaataggatt

SEQ ID NO: 9268705 - DNA, 23 bp, Homo sapiens
gttaacatggtccatggaagagc

SEQ ID NO: 9268706 - DNA, 22 bp, Homo sapiens
gttaacaaccaaacagaagttc

SEQ ID NO: 9268707 - DNA, 20 bp, Homo sapiens
gtgtttcatgtgatacaatg

SEQ ID NO: 9268708 - DNA, 22 bp, Homo sapiens
gtgtttgctggagctctgggtc

SEQ ID NO: 9268709 - DNA, 22 bp, Homo sapiens
gttaaataacctcatgtccgtt

SEQ ID NO: 9268710 - DNA, 22 bp, Homo sapiens
gttcttctcttgtaatggaatc

SEQ ID NO: 9268711 - DNA, 22 bp, Homo sapiens
gttctttaagtggagaaggaaa

SEQ ID NO: 9268712 - DNA, 22 bp, Homo sapiens
gttgaaagatgtcttggttccc

SEQ ID NO: 9268713 - DNA, 22 bp, Homo sapiens
gttgaaaatacagattcctagg

SEQ ID NO: 9268714 - DNA, 22 bp, Homo sapiens
gttgaaaatgactttataccat

SEQ ID NO: 9268715 - DNA, 22 bp, Homo sapiens
gttgaaagtagatgctatttgg

SEQ ID NO: 9268716 - DNA, 22 bp, Homo sapiens
gttgaaatcctaaccccctagt

SEQ ID NO: 9268717 - DNA, 22 bp, Homo sapiens
gttgaactatgttttatctgac

SEQ ID NO: 9268718 - DNA, 22 bp, Homo sapiens
gttgagcaaggccagagaagcc

SEQ ID NO: 9268719 - DNA, 22 bp, Homo sapiens
gtttatcttaatggactcagag

SEQ ID NO: 9268720 - DNA, 22 bp, Homo sapiens
gtttatgaaatttcaggcattt

SEQ ID NO: 9268721 - DNA, 22 bp, Homo sapiens
gtttatgaatgttactatagag

SEQ ID NO: 9268722 - DNA, 21 bp, Homo sapiens
gtttatgaatcttgtcctgct

SEQ ID NO: 9268723 - DNA, 22 bp, Homo sapiens
gtttatgaatgtgtcagacata

SEQ ID NO: 9268724 - DNA, 22 bp, Homo sapiens
gtttatgaattgcattcccttt

SEQ ID NO: 9268725 - DNA, 22 bp, Homo sapiens
gtttatgaggaaaagttatgat

SEQ ID NO: 9268726 - DNA, 22 bp, Homo sapiens
gtttatgagttacgtaggggtt

SEQ ID NO: 9268727 - DNA, 22 bp, Homo sapiens
gtttattatacaacaaaagcta

SEQ ID NO: 9268728 - DNA, 22 bp, Homo sapiens
gtttattatacaacaaaagcta

SEQ ID NO: 9268729 - DNA, 22 bp, Homo sapiens
gtttattaactgtcaagtgatt

SEQ ID NO: 9268730 - DNA, 22 bp, Homo sapiens
gtttattagagttttctgtctg

SEQ ID NO: 9268731 - DNA, 22 bp, Homo sapiens
gtttattagagttttctgtctg

SEQ ID NO: 9268732 - DNA, 22 bp, Homo sapiens
gtttgtgtaacatgatgatgat

SEQ ID NO: 9268733 - DNA, 22 bp, Homo sapiens
gtttgtgtaacatgatgatgat

SEQ ID NO: 9268734 - DNA, 22 bp, Homo sapiens
gtttgtttatacaaaagatcct

SEQ ID NO: 9268735 - DNA, 21 bp, Homo sapiens
gttttaagggagaaaacctag

SEQ ID NO: 9268736 - DNA, 20 bp, Homo sapiens
gttttaaggcacaggccttt

SEQ ID NO: 9268737 - DNA, 20 bp, Homo sapiens
gttttaaggcacaggccttt

SEQ ID NO: 9268738 - DNA, 22 bp, Homo sapiens
gtttgtttgtagggaagccgtg

SEQ ID NO: 9268739 - DNA, 22 bp, Homo sapiens
gtttgttttaagataggatgga

SEQ ID NO: 9268740 - DNA, 22 bp, Homo sapiens
gtttgaaagtggcaagtccttg

SEQ ID NO: 9268741 - DNA, 22 bp, Homo sapiens
gtttcacagatggggagacacg

SEQ ID NO: 9268742 - DNA, 22 bp, Homo sapiens
gtttcaaagtcagaaaaggagg

SEQ ID NO: 9268743 - DNA, 22 bp, Homo sapiens
gtttgaaaaaagcagtatgtaa

SEQ ID NO: 9268744 - DNA, 22 bp, Homo sapiens
gtttcttttaaaatatgtagac

SEQ ID NO: 9268745 - DNA, 22 bp, Homo sapiens
gtttcttagacagacattatct

SEQ ID NO: 9268746 - DNA, 22 bp, Homo sapiens
gtttctttctattgactgaaca

SEQ ID NO: 9268747 - DNA, 23 bp, Homo sapiens
taaagcaaagtcaagtgcactcc

SEQ ID NO: 9268748 - DNA, 22 bp, Homo sapiens
taaagcaaaaatgaactgccat

SEQ ID NO: 9268749 - DNA, 22 bp, Homo sapiens
taaagatgttctcatttcatag

SEQ ID NO: 9268750 - DNA, 22 bp, Homo sapiens
taaagacatggtgtaggtgaac

SEQ ID NO: 9268751 - DNA, 22 bp, Homo sapiens
taaagacatggtgtaggtgaac

SEQ ID NO: 9268752 - DNA, 22 bp, Homo sapiens
taaagagccattgtatggtttt

SEQ ID NO: 9268753 - DNA, 22 bp, Homo sapiens
taaagataagacatcaactgag

SEQ ID NO: 9268754 - DNA, 17 bp, Homo sapiens
taaagatcagccatgta

SEQ ID NO: 9268755 - DNA, 22 bp, Homo sapiens
taaagcaatttgagcaagttct

SEQ ID NO: 9268756 - DNA, 22 bp, Homo sapiens
taaagcacagtatgagcattgg

SEQ ID NO: 9268757 - DNA, 22 bp, Homo sapiens
taaagcaatgaaagttttgcag

SEQ ID NO: 9268758 - DNA, 22 bp, Homo sapiens
taaagcaaggcaaattgttggt

SEQ ID NO: 9268759 - DNA, 22 bp, Homo sapiens
taaagcaaggaatagagtagtc

SEQ ID NO: 9268760 - DNA, 22 bp, Homo sapiens
taaagcaaggaatagagtagtc

SEQ ID NO: 9268761 - DNA, 22 bp, Homo sapiens
taaatgataataatgctagtgt

SEQ ID NO: 9268762 - DNA, 22 bp, Homo sapiens
taaagcagccagggtctaagcc

SEQ ID NO: 9268763 - DNA, 22 bp, Homo sapiens
taaatgatttatgtatgtgaaa

SEQ ID NO: 9268764 - DNA, 22 bp, Homo sapiens
taaatgatttatgtatgtgaaa

SEQ ID NO: 9268765 - DNA, 22 bp, Homo sapiens
taaatgcaaagcttggcgctta

SEQ ID NO: 9268766 - DNA, 22 bp, Homo sapiens
taaatgcagttagtacttgcca

SEQ ID NO: 9268767 - DNA, 22 bp, Homo sapiens
taaatgcagcagtttctgttct

SEQ ID NO: 9268768 - DNA, 22 bp, Homo sapiens
taaatgcagtacaaattgttct

SEQ ID NO: 9268769 - DNA, 22 bp, Homo sapiens
taaatgcagttagtacttgcca

SEQ ID NO: 9268770 - DNA, 23 bp, Homo sapiens
taaagacagccttcaggattctg

SEQ ID NO: 9268771 - DNA, 22 bp, Homo sapiens
taaagacagatggaccagccat

SEQ ID NO: 9268772 - DNA, 22 bp, Homo sapiens
taaagacactggttttaatcat

SEQ ID NO: 9268773 - DNA, 22 bp, Homo sapiens
taaagacagatggaccagccat

SEQ ID NO: 9268774 - DNA, 22 bp, Homo sapiens
taaagacactggttttaatcat

SEQ ID NO: 9268775 - DNA, 22 bp, Homo sapiens
taaagacataggatcagggaga

SEQ ID NO: 9268776 - DNA, 20 bp, Homo sapiens
taaagacataagctactatc

SEQ ID NO: 9268777 - DNA, 22 bp, Homo sapiens
taaagacatgcaaagtctaatt

SEQ ID NO: 9268778 - DNA, 22 bp, Homo sapiens
taaagacatgcaaagtctaatt

SEQ ID NO: 9268779 - DNA, 22 bp, Homo sapiens
taaagacatgcaaagtctaatt

SEQ ID NO: 9268780 - DNA, 22 bp, Homo sapiens
taaaagtaggaatgaaacgcat

SEQ ID NO: 9268781 - DNA, 22 bp, Homo sapiens
taaaagtatactttcaaaggag

SEQ ID NO: 9268782 - DNA, 22 bp, Homo sapiens
taaaagtaggaatgaaacgcat

SEQ ID NO: 9268783 - DNA, 22 bp, Homo sapiens
taaaagattttataggaacaag

SEQ ID NO: 9268784 - DNA, 22 bp, Homo sapiens
taaaagagaatggataacagag

SEQ ID NO: 9268785 - DNA, 21 bp, Homo sapiens
taaaagatgacaagacagctc

SEQ ID NO: 9268786 - DNA, 22 bp, Homo sapiens
taaaagacatataactgtagga

SEQ ID NO: 9268787 - DNA, 22 bp, Homo sapiens
taaaagacatataactgtagga

SEQ ID NO: 9268788 - DNA, 22 bp, Homo sapiens
gttttacaaatgacggcattca

SEQ ID NO: 9268789 - DNA, 21 bp, Homo sapiens
gttttaagggagaaaacctag

SEQ ID NO: 9268790 - DNA, 21 bp, Homo sapiens
gttttaagggagaaaacctag

SEQ ID NO: 9268791 - DNA, 22 bp, Homo sapiens
taaaacttaactatccagatta

SEQ ID NO: 9268792 - DNA, 22 bp, Homo sapiens
taaaactttgaaggtgctcagt

SEQ ID NO: 9268793 - DNA, 22 bp, Homo sapiens
taaaacttctcatttttatggt

SEQ ID NO: 9268794 - DNA, 22 bp, Homo sapiens
taagacatcattaaacagcaat

SEQ ID NO: 9268795 - DNA, 22 bp, Homo sapiens
taagacatcattaaacagcaat

SEQ ID NO: 9268796 - DNA, 22 bp, Homo sapiens
taagacatcattaaacagcaat

SEQ ID NO: 9268797 - DNA, 22 bp, Homo sapiens
taagacatccgttgcttataat

SEQ ID NO: 9268798 - DNA, 22 bp, Homo sapiens
taagacatccgttgcttataat

SEQ ID NO: 9268799 - DNA, 22 bp, Homo sapiens
taagacatcctggatgttcaaa

SEQ ID NO: 9268800 - DNA, 22 bp, Homo sapiens
taagacatcctggatgttcaaa

SEQ ID NO: 9268801 - DNA, 22 bp, Homo sapiens
taagacatcctggatgttcaaa

SEQ ID NO: 9268802 - DNA, 21 bp, Homo sapiens
taagacagtatgaatactttc

SEQ ID NO: 9268803 - DNA, 22 bp, Homo sapiens
taagacagggtctattcttagt

SEQ ID NO: 9268804 - DNA, 22 bp, Homo sapiens
taagacatagccaagagcatcc

SEQ ID NO: 9268805 - DNA, 22 bp, Homo sapiens
taagacataaataggcttttta

SEQ ID NO: 9268806 - DNA, 22 bp, Homo sapiens
taagacataaataggcttttta

SEQ ID NO: 9268807 - DNA, 22 bp, Homo sapiens
taagacatttgacaaaccattt

SEQ ID NO: 9268808 - DNA, 22 bp, Homo sapiens
taagacatgagactcagccagt

SEQ ID NO: 9268809 - DNA, 22 bp, Homo sapiens
taagacatgagactcagccagt

SEQ ID NO: 9268810 - DNA, 22 bp, Homo sapiens
taagacatgtccaggctgtgag

SEQ ID NO: 9268811 - DNA, 22 bp, Homo sapiens
taagacatgtccaggctgtgag

SEQ ID NO: 9268812 - DNA, 22 bp, Homo sapiens
taagacaattcttcagtcacaa

SEQ ID NO: 9268813 - DNA, 22 bp, Homo sapiens
taagacagggagggctctcagc

SEQ ID NO: 9268814 - DNA, 22 bp, Homo sapiens
taagcatattccagtcatgtcc

SEQ ID NO: 9268815 - DNA, 22 bp, Homo sapiens
taagcatggtggtaaaagaggt

SEQ ID NO: 9268816 - DNA, 22 bp, Homo sapiens
taagaggatatttggccagaag

SEQ ID NO: 9268817 - DNA, 21 bp, Homo sapiens
taagcatatcagatagactct

SEQ ID NO: 9268818 - DNA, 22 bp, Homo sapiens
taagaggatatttggccagaag

SEQ ID NO: 9268819 - DNA, 22 bp, Homo sapiens
taagagctgaggcattgggaca

SEQ ID NO: 9268820 - DNA, 22 bp, Homo sapiens
taagagctgttcaggtacccat

SEQ ID NO: 9268821 - DNA, 22 bp, Homo sapiens
taagaggatatttggccagaag

SEQ ID NO: 9268822 - DNA, 22 bp, Homo sapiens
taagagatggttatcaaaagca

SEQ ID NO: 9268823 - DNA, 22 bp, Homo sapiens
taagagatgcttttctaaataa

SEQ ID NO: 9268824 - DNA, 22 bp, Homo sapiens
taagagattctaaagctactgg

SEQ ID NO: 9268825 - DNA, 22 bp, Homo sapiens
taaatgtgttgtggatgaagtt

SEQ ID NO: 9268826 - DNA, 22 bp, Homo sapiens
taaatgctccatacatacacca

SEQ ID NO: 9268827 - DNA, 22 bp, Homo sapiens
taaatgctcagaccttattcca

SEQ ID NO: 9268828 - DNA, 22 bp, Homo sapiens
taaatgctatcgcataaaacct

SEQ ID NO: 9268829 - DNA, 22 bp, Homo sapiens
taaatgctatcgcataaaacct

SEQ ID NO: 9268830 - DNA, 22 bp, Homo sapiens
taacagctctgtgtggctgtaa

SEQ ID NO: 9268831 - DNA, 22 bp, Homo sapiens
taacaggatgacagcagacatt

SEQ ID NO: 9268832 - DNA, 19 bp, Homo sapiens
taacaggggaaaatgatca

SEQ ID NO: 9268833 - DNA, 22 bp, Homo sapiens
taacagctggcgttataggaat

SEQ ID NO: 9268834 - DNA, 20 bp, Homo sapiens
taacaggaagcattatttta

SEQ ID NO: 9268835 - DNA, 22 bp, Homo sapiens
taaatgtttagtcttatttggg

SEQ ID NO: 9268836 - DNA, 22 bp, Homo sapiens
taaatgttttgtgggttgagtt

SEQ ID NO: 9268837 - DNA, 22 bp, Homo sapiens
taaatgttgtaagtacatctaa

SEQ ID NO: 9268838 - DNA, 22 bp, Homo sapiens
taacagtattgaagataaacta

SEQ ID NO: 9268839 - DNA, 22 bp, Homo sapiens
taacagttggtgtaatttcttg

SEQ ID NO: 9268840 - DNA, 20 bp, Homo sapiens
taacatagtccagagaacga

SEQ ID NO: 9268841 - DNA, 22 bp, Homo sapiens
taacatcaaacatgttttaaag

SEQ ID NO: 9268842 - DNA, 22 bp, Homo sapiens
taacatcaaactgcattttcta

SEQ ID NO: 9268843 - DNA, 22 bp, Homo sapiens
taacatctttagcagctcgaac

SEQ ID NO: 9268844 - DNA, 22 bp, Homo sapiens
taacatctttagcagctcgaac

SEQ ID NO: 9268845 - DNA, 22 bp, Homo sapiens
taacatgagagctaagacatta

SEQ ID NO: 9268846 - DNA, 22 bp, Homo sapiens
taacagtatagcctaacatttc

SEQ ID NO: 9268847 - DNA, 22 bp, Homo sapiens
taacagtatagcctaacatttc

SEQ ID NO: 9268848 - DNA, 22 bp, Homo sapiens
taacagtaaagtaagttagctt

SEQ ID NO: 9268849 - DNA, 20 bp, Homo sapiens
taacagtaagtgatgttaca

SEQ ID NO: 9268850 - DNA, 22 bp, Homo sapiens
taacagtatatttaccaaacct

SEQ ID NO: 9268851 - DNA, 22 bp, Homo sapiens
taacagtattgaagataaacta

SEQ ID NO: 9268852 - DNA, 22 bp, Homo sapiens
taacagtattgaagataaacta

SEQ ID NO: 9268853 - DNA, 22 bp, Homo sapiens
taatatctacttcatagagttt

SEQ ID NO: 9268854 - DNA, 22 bp, Homo sapiens
taatccagggtattctagtttc

SEQ ID NO: 9268855 - DNA, 22 bp, Homo sapiens
taatatatttctgctaagctca

SEQ ID NO: 9268856 - DNA, 22 bp, Homo sapiens
taatctatcaagcaacaaagtg

SEQ ID NO: 9268857 - DNA, 22 bp, Homo sapiens
taatctactgtttatatgaaat

SEQ ID NO: 9268858 - DNA, 18 bp, Homo sapiens
taatcttacagacaggat

SEQ ID NO: 9268859 - DNA, 22 bp, Homo sapiens
taatcttagcaacctccagtgt

SEQ ID NO: 9268860 - DNA, 19 bp, Homo sapiens
taatcttattgggcagatt

SEQ ID NO: 9268861 - DNA, 22 bp, Homo sapiens
taatgaacaatatatcaatagc

SEQ ID NO: 9268862 - DNA, 22 bp, Homo sapiens
taatgaacacagaatttcactt

SEQ ID NO: 9268863 - DNA, 22 bp, Homo sapiens
taatcttagacatgtatttttc

SEQ ID NO: 9268864 - DNA, 22 bp, Homo sapiens
taatcttagacatgtatttttc

SEQ ID NO: 9268865 - DNA, 22 bp, Homo sapiens
taattattctagtcacatagca

SEQ ID NO: 9268866 - DNA, 22 bp, Homo sapiens
taattattctagtcacatagca

SEQ ID NO: 9268867 - DNA, 22 bp, Homo sapiens
taattattatgacaacaattgc

SEQ ID NO: 9268868 - DNA, 22 bp, Homo sapiens
taattattatgacaacaattgc

SEQ ID NO: 9268869 - DNA, 22 bp, Homo sapiens
taattattatgacaacaattgc

SEQ ID NO: 9268870 - DNA, 22 bp, Homo sapiens
taattcttgttcagaggtagta

SEQ ID NO: 9268871 - DNA, 22 bp, Homo sapiens
taattctagattgacattttga

SEQ ID NO: 9268872 - DNA, 22 bp, Homo sapiens
taattctagattgacattttga

SEQ ID NO: 9268873 - DNA, 22 bp, Homo sapiens
taattcatgggcccagtgatat

SEQ ID NO: 9268874 - DNA, 22 bp, Homo sapiens
taattcctagaaattattctca

SEQ ID NO: 9268875 - DNA, 22 bp, Homo sapiens
taattcatgggcccagtgatat

SEQ ID NO: 9268876 - DNA, 22 bp, Homo sapiens
taattattgtctgaagagttat

SEQ ID NO: 9268877 - DNA, 22 bp, Homo sapiens
taattcttcaggccttttgtct

SEQ ID NO: 9268878 - DNA, 22 bp, Homo sapiens
taattgaactaacatgcaaaca

SEQ ID NO: 9268879 - DNA, 22 bp, Homo sapiens
taatttacttgcaaataacaat

SEQ ID NO: 9268880 - DNA, 22 bp, Homo sapiens
taatttatgatgcaaagaaaag

SEQ ID NO: 9268881 - DNA, 22 bp, Homo sapiens
taatatacttcccatagtttga

SEQ ID NO: 9268882 - DNA, 22 bp, Homo sapiens
taatatatacctttgttaggaa

SEQ ID NO: 9268883 - DNA, 22 bp, Homo sapiens
taatatatacctttgttaggaa

SEQ ID NO: 9268884 - DNA, 22 bp, Homo sapiens
taatatacttcccatagtttga

SEQ ID NO: 9268885 - DNA, 22 bp, Homo sapiens
taatataccaaactgtaatttt

SEQ ID NO: 9268886 - DNA, 22 bp, Homo sapiens
taatataccaaactgtaatttt

SEQ ID NO: 9268887 - DNA, 22 bp, Homo sapiens
taatagtcattgtataccttgg

SEQ ID NO: 9268888 - DNA, 22 bp, Homo sapiens
taaggaggttggtgggttggat

SEQ ID NO: 9268889 - DNA, 22 bp, Homo sapiens
taatagttatggttggttctca

SEQ ID NO: 9268890 - DNA, 22 bp, Homo sapiens
taaggaggtgcccactctcagg

SEQ ID NO: 9268891 - DNA, 22 bp, Homo sapiens
taaggagggggaatgattggca

SEQ ID NO: 9268892 - DNA, 22 bp, Homo sapiens
taaggaggctgctgtgaagaaa

SEQ ID NO: 9268893 - DNA, 22 bp, Homo sapiens
taaggaggcgaggtggtgagca

SEQ ID NO: 9268894 - DNA, 22 bp, Homo sapiens
taaggaggcagtcattatcagg

SEQ ID NO: 9268895 - DNA, 22 bp, Homo sapiens
taagcttcaaagaacatattgg

SEQ ID NO: 9268896 - DNA, 22 bp, Homo sapiens
taagctattcctgaagaaggtt

SEQ ID NO: 9268897 - DNA, 21 bp, Homo sapiens
taagctaaacattcagttaac

SEQ ID NO: 9268898 - DNA, 22 bp, Homo sapiens
taagctcactgtaagaactgat

SEQ ID NO: 9268899 - DNA, 22 bp, Homo sapiens
taagcctgcatgaaccatgaga

SEQ ID NO: 9268900 - DNA, 22 bp, Homo sapiens
taagcctgcatgaaccatgaga

SEQ ID NO: 9268901 - DNA, 22 bp, Homo sapiens
taagccactagtctgttatgaa

SEQ ID NO: 9268902 - DNA, 21 bp, Homo sapiens
taagccaccatgtgaaaccag

SEQ ID NO: 9268903 - DNA, 22 bp, Homo sapiens
taagcattcaatgcttagcact

SEQ ID NO: 9268904 - DNA, 22 bp, Homo sapiens
taaggaaggggaaagacatgtc

SEQ ID NO: 9268905 - DNA, 22 bp, Homo sapiens
taaggaaggggaaagacatgtc

SEQ ID NO: 9268906 - DNA, 22 bp, Homo sapiens
tacacataggagggtaataaaa

SEQ ID NO: 9268907 - DNA, 22 bp, Homo sapiens
tacacatacattgcttacaagg

SEQ ID NO: 9268908 - DNA, 22 bp, Homo sapiens
tacacataaaatgctcatggta

SEQ ID NO: 9268909 - DNA, 22 bp, Homo sapiens
tacacagaaattgtgtagggat

SEQ ID NO: 9268910 - DNA, 22 bp, Homo sapiens
tacacagaacctggtgtacagt

SEQ ID NO: 9268911 - DNA, 22 bp, Homo sapiens
tacacagaacctggtgtacagt

SEQ ID NO: 9268912 - DNA, 22 bp, Homo sapiens
tacacagtaaatggtaaataca

SEQ ID NO: 9268913 - DNA, 22 bp, Homo sapiens
tacacacatgcatttgccttat

SEQ ID NO: 9268914 - DNA, 22 bp, Homo sapiens
tacacacatgcatttgccttat

SEQ ID NO: 9268915 - DNA, 22 bp, Homo sapiens
tacacacatgcatttgccttat

SEQ ID NO: 9268916 - DNA, 22 bp, Homo sapiens
tacacacagaggccatgggatt

SEQ ID NO: 9268917 - DNA, 22 bp, Homo sapiens
tacacacagaggccatgggatt

SEQ ID NO: 9268918 - DNA, 22 bp, Homo sapiens
tacacacagaggccatgggatt

SEQ ID NO: 9268919 - DNA, 22 bp, Homo sapiens
tacacacagaggccatgggatt

SEQ ID NO: 9268920 - DNA, 22 bp, Homo sapiens
tacaagaaatttctgcatatat

SEQ ID NO: 9268921 - DNA, 22 bp, Homo sapiens
tacaagaaatttctgcatatat

SEQ ID NO: 9268922 - DNA, 22 bp, Homo sapiens
tacaagaaagtccagtgggttt

SEQ ID NO: 9268923 - DNA, 22 bp, Homo sapiens
tacaagaaactacatgaatgca

SEQ ID NO: 9268924 - DNA, 21 bp, Homo sapiens
taatttattcagcacagtgtt

SEQ ID NO: 9268925 - DNA, 22 bp, Homo sapiens
taatttatgatgcaaagaaaag

SEQ ID NO: 9268926 - DNA, 22 bp, Homo sapiens
taatttatggtatgtgtgtaat

SEQ ID NO: 9268927 - DNA, 22 bp, Homo sapiens
tacaacatgtggtcctttatga

SEQ ID NO: 9268928 - DNA, 22 bp, Homo sapiens
tacaagaaggaaaactagcaat

SEQ ID NO: 9268929 - DNA, 22 bp, Homo sapiens
tacaagaagaggcagagctgga

SEQ ID NO: 9268930 - DNA, 22 bp, Homo sapiens
tacaagaaggatggagcccact

SEQ ID NO: 9268931 - DNA, 20 bp, Homo sapiens
tacaagaatccccagttgtc

SEQ ID NO: 9268932 - DNA, 22 bp, Homo sapiens
tacaagaatttctttctggttg

SEQ ID NO: 9268933 - DNA, 22 bp, Homo sapiens
tacaagaatgtcttaaaagctc

SEQ ID NO: 9268934 - DNA, 22 bp, Homo sapiens
tacaagagcagtaagcttgtcc

SEQ ID NO: 9268935 - DNA, 22 bp, Homo sapiens
tacagtgtccctttttcagaca

SEQ ID NO: 9268936 - DNA, 22 bp, Homo sapiens
tacagtgtctgcaactgcacac

SEQ ID NO: 9268937 - DNA, 22 bp, Homo sapiens
tacagtggggagctcaggagag

SEQ ID NO: 9268938 - DNA, 22 bp, Homo sapiens
tacagtgctttttggtggagaa

SEQ ID NO: 9268939 - DNA, 22 bp, Homo sapiens
tacagtgcttggtatctagtaa

SEQ ID NO: 9268940 - DNA, 22 bp, Homo sapiens
tacagtgcacatttcttaggaa

SEQ ID NO: 9268941 - DNA, 22 bp, Homo sapiens
tacagtgcaatgtgatgtagat

SEQ ID NO: 9268942 - DNA, 22 bp, Homo sapiens
tacagtgctagaacctgctgta

SEQ ID NO: 9268943 - DNA, 22 bp, Homo sapiens
tacagtgcatagaggcatgata

SEQ ID NO: 9268944 - DNA, 22 bp, Homo sapiens
tacagtgcgatttttaggcctc

SEQ ID NO: 9268945 - DNA, 22 bp, Homo sapiens
tacagtgcgggtgcgggcctct

SEQ ID NO: 9268946 - DNA, 22 bp, Homo sapiens
tacagtctttggaaagagatag

SEQ ID NO: 9268947 - DNA, 22 bp, Homo sapiens
tacagtctttggaaagagatag

SEQ ID NO: 9268948 - DNA, 22 bp, Homo sapiens
tacagtcaagcataagaagtca

SEQ ID NO: 9268949 - DNA, 22 bp, Homo sapiens
tacagtctctgataactgtcag

SEQ ID NO: 9268950 - DNA, 22 bp, Homo sapiens
tacagagatgtgaaaagctcta

SEQ ID NO: 9268951 - DNA, 22 bp, Homo sapiens
tacagtatggaaaatgtatagt

SEQ ID NO: 9268952 - DNA, 22 bp, Homo sapiens
tacagtatgttcttgaatttgg

SEQ ID NO: 9268953 - DNA, 22 bp, Homo sapiens
tacagtgtgacatttctacaaa

SEQ ID NO: 9268954 - DNA, 22 bp, Homo sapiens
tacagtgtgacatttctacaaa

SEQ ID NO: 9268955 - DNA, 22 bp, Homo sapiens
tacagtgtctggatatcaaagg

SEQ ID NO: 9268956 - DNA, 22 bp, Homo sapiens
tacagtgtctggatatcaaagg

SEQ ID NO: 9268957 - DNA, 22 bp, Homo sapiens
tacagtgtgaataagcaggcat

SEQ ID NO: 9268958 - DNA, 22 bp, Homo sapiens
tacatgaacaaaatagcagaaa

SEQ ID NO: 9268959 - DNA, 22 bp, Homo sapiens
tacatgaacaaaatagcagaaa

SEQ ID NO: 9268960 - DNA, 22 bp, Homo sapiens
tacatgaagaaaattaagcagt

SEQ ID NO: 9268961 - DNA, 22 bp, Homo sapiens
tacatgaacctttatgtgtgat

SEQ ID NO: 9268962 - DNA, 22 bp, Homo sapiens
tacatgaatgtttcaatattgt

SEQ ID NO: 9268963 - DNA, 22 bp, Homo sapiens
tacatgaagttgtctaaactgg

SEQ ID NO: 9268964 - DNA, 22 bp, Homo sapiens
tacatgaatgtttcaatattgt

SEQ ID NO: 9268965 - DNA, 21 bp, Homo sapiens
tacatgagtgtatgagcatat

SEQ ID NO: 9268966 - DNA, 22 bp, Homo sapiens
tacatgaatttgagtcagagga

SEQ ID NO: 9268967 - DNA, 18 bp, Homo sapiens
tacatgcataaatgaagc

SEQ ID NO: 9268968 - DNA, 22 bp, Homo sapiens
taccaagtgtattatgctttgt

SEQ ID NO: 9268969 - DNA, 22 bp, Homo sapiens
taccaagtgtattatgctttgt

SEQ ID NO: 9268970 - DNA, 19 bp, Homo sapiens
taccaatcccttggtttac

SEQ ID NO: 9268971 - DNA, 22 bp, Homo sapiens
taccaagtcatctattcccatg

SEQ ID NO: 9268972 - DNA, 22 bp, Homo sapiens
tacatgtaggtgacattttaat

SEQ ID NO: 9268973 - DNA, 22 bp, Homo sapiens
tacatgtaattttcatagtaag

SEQ ID NO: 9268974 - DNA, 22 bp, Homo sapiens
tacatgcattggatggcaatag

SEQ ID NO: 9268975 - DNA, 22 bp, Homo sapiens
tacatgctccactttctcctgt

SEQ ID NO: 9268976 - DNA, 22 bp, Homo sapiens
tacatgctccttatgagaatct

SEQ ID NO: 9268977 - DNA, 22 bp, Homo sapiens
tacatgctcagtaactttcagt

SEQ ID NO: 9268978 - DNA, 22 bp, Homo sapiens
tacatgtaagacatgagactct

SEQ ID NO: 9268979 - DNA, 22 bp, Homo sapiens
tacatgtaagacatgagactct

SEQ ID NO: 9268980 - DNA, 22 bp, Homo sapiens
tacatggtggtggcacttgact

SEQ ID NO: 9268981 - DNA, 22 bp, Homo sapiens
tacatgggtaggttaagtcata

SEQ ID NO: 9268982 - DNA, 22 bp, Homo sapiens
tacatgctggtgactgtagaca

SEQ ID NO: 9268983 - DNA, 22 bp, Homo sapiens
tacatggatgttatccttactg

SEQ ID NO: 9268984 - DNA, 22 bp, Homo sapiens
tacatgcttctatatgtgaagt

SEQ ID NO: 9268985 - DNA, 22 bp, Homo sapiens
tactcctgctgatcctgccagc

SEQ ID NO: 9268986 - DNA, 22 bp, Homo sapiens
tactcctgctgatcctgccagc

SEQ ID NO: 9268987 - DNA, 22 bp, Homo sapiens
tactgtgtgcccagccgagctg

SEQ ID NO: 9268988 - DNA, 22 bp, Homo sapiens
tactgtgtgattccatttacgt

SEQ ID NO: 9268989 - DNA, 22 bp, Homo sapiens
tactgtgtcttaggatgtggaa

SEQ ID NO: 9268990 - DNA, 22 bp, Homo sapiens
tactgttaatgttaaattcagg

SEQ ID NO: 9268991 - DNA, 22 bp, Homo sapiens
tactgttaatgttaaattcagg

SEQ ID NO: 9268992 - DNA, 22 bp, Homo sapiens
tactgtgtgcccagccgagctg

SEQ ID NO: 9268993 - DNA, 22 bp, Homo sapiens
tactgtgtggtgagctgtctcc

SEQ ID NO: 9268994 - DNA, 22 bp, Homo sapiens
tacttacagaaggaagcaattg

SEQ ID NO: 9268995 - DNA, 22 bp, Homo sapiens
tacttacacagctgtagaaggt

SEQ ID NO: 9268996 - DNA, 22 bp, Homo sapiens
tacttacagagcttataagtta

SEQ ID NO: 9268997 - DNA, 22 bp, Homo sapiens
tacttacagagcttataagtta

SEQ ID NO: 9268998 - DNA, 22 bp, Homo sapiens
tacttacagttacggcaagtgg

SEQ ID NO: 9268999 - DNA, 22 bp, Homo sapiens
tacttacataaaaactgaatgt

SEQ ID NO: 9269000 - DNA, 22 bp, Homo sapiens
tacttaaaactgatagaatctc

SEQ ID NO: 9269001 - DNA, 22 bp, Homo sapiens
tacttaaaactgatagaatctc

SEQ ID NO: 9269002 - DNA, 22 bp, Homo sapiens
tactgttttttagactcatggt

SEQ ID NO: 9269003 - DNA, 22 bp, Homo sapiens
tacttaaaaattatcaaagtgg

SEQ ID NO: 9269004 - DNA, 22 bp, Homo sapiens
tacttaaaaattatcaaagtgg

SEQ ID NO: 9269005 - DNA, 22 bp, Homo sapiens
tactgttttctttatagtacag

SEQ ID NO: 9269006 - DNA, 22 bp, Homo sapiens
tactgtttttgcctctttagaa

SEQ ID NO: 9269007 - DNA, 22 bp, Homo sapiens
tactgttttctataatggctgt

SEQ ID NO: 9269008 - DNA, 22 bp, Homo sapiens
tactgtttgcagtttgcagtat

SEQ ID NO: 9269009 - DNA, 22 bp, Homo sapiens
tactgtttcctgaagcagatgc

SEQ ID NO: 9269010 - DNA, 22 bp, Homo sapiens
tactgttatatatagcagcagt

SEQ ID NO: 9269011 - DNA, 21 bp, Homo sapiens
tactacagtctctttatcagt

SEQ ID NO: 9269012 - DNA, 22 bp, Homo sapiens
tactacagtatgtgtgttatac

SEQ ID NO: 9269013 - DNA, 22 bp, Homo sapiens
tactacatacagaatttagaga

SEQ ID NO: 9269014 - DNA, 22 bp, Homo sapiens
tactacattaataaaacattca

SEQ ID NO: 9269015 - DNA, 23 bp, Homo sapiens
tactacagggtcttgctatgaat

SEQ ID NO: 9269016 - DNA, 22 bp, Homo sapiens
taccatttgagagagaacataa

SEQ ID NO: 9269017 - DNA, 17 bp, Homo sapiens
tactagaatagagacag

SEQ ID NO: 9269018 - DNA, 22 bp, Homo sapiens
tactagtttctaccttacagaa

SEQ ID NO: 9269019 - DNA, 22 bp, Homo sapiens
tactagtcttctgctattccct

SEQ ID NO: 9269020 - DNA, 22 bp, Homo sapiens
tactagctaacattctcaccaa

SEQ ID NO: 9269021 - DNA, 22 bp, Homo sapiens
tactataaagtcttaatgagtc

SEQ ID NO: 9269022 - DNA, 22 bp, Homo sapiens
tactatactctccattttatag

SEQ ID NO: 9269023 - DNA, 22 bp, Homo sapiens
taccagctcacacaatctttgt

SEQ ID NO: 9269024 - DNA, 22 bp, Homo sapiens
taccagcatcacagcatgttgg

SEQ ID NO: 9269025 - DNA, 22 bp, Homo sapiens
taccaggaattattttacattt

SEQ ID NO: 9269026 - DNA, 22 bp, Homo sapiens
taccaggcagctgcacagaggc

SEQ ID NO: 9269027 - DNA, 15 bp, Homo sapiens
taccagctgatccgt

SEQ ID NO: 9269028 - DNA, 22 bp, Homo sapiens
taccagcttccttcaagatgtg

SEQ ID NO: 9269029 - DNA, 22 bp, Homo sapiens
taccacctcaacctcatctgac

SEQ ID NO: 9269030 - DNA, 22 bp, Homo sapiens
taccacagcaaatgaggccaac

SEQ ID NO: 9269031 - DNA, 20 bp, Homo sapiens
taccacttatttgaataatt

SEQ ID NO: 9269032 - DNA, 19 bp, Homo sapiens
taccatgttgactttcctg

SEQ ID NO: 9269033 - DNA, 22 bp, Homo sapiens
taccattgtaccaaggtaattt

SEQ ID NO: 9269034 - DNA, 22 bp, Homo sapiens
taccatgtcttcaataagtcta

SEQ ID NO: 9269035 - DNA, 22 bp, Homo sapiens
taccatgatgtttgagttacta

SEQ ID NO: 9269036 - DNA, 22 bp, Homo sapiens
taccatttacttgaaaataaaa

SEQ ID NO: 9269037 - DNA, 22 bp, Homo sapiens
taccatttcagtaaaaacttag

SEQ ID NO: 9269038 - DNA, 22 bp, Homo sapiens
taccaggtctgtgcaggtgtca

SEQ ID NO: 9269039 - DNA, 22 bp, Homo sapiens
taccatgatcaggctcatcctt

SEQ ID NO: 9269040 - DNA, 22 bp, Homo sapiens
taccataacgtaatgaacttga

SEQ ID NO: 9269041 - DNA, 22 bp, Homo sapiens
taccataacgtaatgaacttga

SEQ ID NO: 9269042 - DNA, 22 bp, Homo sapiens
taccagttgatgttttaaatag

SEQ ID NO: 9269043 - DNA, 22 bp, Homo sapiens
ggcagcactgcagcttgttggg

SEQ ID NO: 9269044 - DNA, 22 bp, Homo sapiens
ggcagcagaactggccctgtat

SEQ ID NO: 9269045 - DNA, 22 bp, Homo sapiens
ggcagcagaactggccctgtat

SEQ ID NO: 9269046 - DNA, 22 bp, Homo sapiens
ggcagcacgacaggagtggaag

SEQ ID NO: 9269047 - DNA, 21 bp, Homo sapiens
ggcagcactacctgaagcata

SEQ ID NO: 9269048 - DNA, 22 bp, Homo sapiens
ggcagcacgacaggagtggaag

SEQ ID NO: 9269049 - DNA, 22 bp, Homo sapiens
ggcagcactgcagcttgttggg

SEQ ID NO: 9269050 - DNA, 18 bp, Homo sapiens
ggcagcaagaagggaggg

SEQ ID NO: 9269051 - DNA, 22 bp, Homo sapiens
ggcagcaactcggagagaagag

SEQ ID NO: 9269052 - DNA, 20 bp, Homo sapiens
ggcagcaaccatatgctaca

SEQ ID NO: 9269053 - DNA, 22 bp, Homo sapiens
ggcagcaagtggtgggagactt

SEQ ID NO: 9269054 - DNA, 22 bp, Homo sapiens
ggcagcaaggcctcgggtgagc

SEQ ID NO: 9269055 - DNA, 19 bp, Homo sapiens
ggcagcaagctctgaaggc

SEQ ID NO: 9269056 - DNA, 22 bp, Homo sapiens
ggcagcaaccaaccaggcattt

SEQ ID NO: 9269057 - DNA, 22 bp, Homo sapiens
ggcagcaaatattgtcagctgt

SEQ ID NO: 9269058 - DNA, 22 bp, Homo sapiens
ggcagcaaagtcacatggaaaa

SEQ ID NO: 9269059 - DNA, 22 bp, Homo sapiens
ggcagatgttgcagtgagcaga

SEQ ID NO: 9269060 - DNA, 22 bp, Homo sapiens
ggcagatgttatatgatctgag

SEQ ID NO: 9269061 - DNA, 22 bp, Homo sapiens
ggcagaggtgaagttcacaagg

SEQ ID NO: 9269062 - DNA, 22 bp, Homo sapiens
ggcagaggtgaagttcacaagg

SEQ ID NO: 9269063 - DNA, 22 bp, Homo sapiens
ggcagaggtgacagtgtctttt

SEQ ID NO: 9269064 - DNA, 22 bp, Homo sapiens
ggcactgagcgggctctgagcg

SEQ ID NO: 9269065 - DNA, 22 bp, Homo sapiens
ggcactgagaggctcttcctaa

SEQ ID NO: 9269066 - DNA, 22 bp, Homo sapiens
ggcactgactgtgcagcgcacc

SEQ ID NO: 9269067 - DNA, 22 bp, Homo sapiens
ggcactgactgtgcagcgcacc

SEQ ID NO: 9269068 - DNA, 22 bp, Homo sapiens
ggcacctggatgtagcagtgaa

SEQ ID NO: 9269069 - DNA, 22 bp, Homo sapiens
ggcacctggatgtagcagtgaa

SEQ ID NO: 9269070 - DNA, 22 bp, Homo sapiens
ggcacctggaggtttactggat

SEQ ID NO: 9269071 - DNA, 22 bp, Homo sapiens
ggcaccaggggatgtaatgtcc

SEQ ID NO: 9269072 - DNA, 22 bp, Homo sapiens
ggcaccagggcaagggtctttc

SEQ ID NO: 9269073 - DNA, 22 bp, Homo sapiens
ggcaccagggacaatcctcttc

SEQ ID NO: 9269074 - DNA, 22 bp, Homo sapiens
ggcaccagggaaggaaggctgg

SEQ ID NO: 9269075 - DNA, 16 bp, Homo sapiens
ggcaccagtgaacaca

SEQ ID NO: 9269076 - DNA, 16 bp, Homo sapiens
ggcaccagtgaacaca

SEQ ID NO: 9269077 - DNA, 22 bp, Homo sapiens
ggcaccagggaaggaaggctgg

SEQ ID NO: 9269078 - DNA, 22 bp, Homo sapiens
ggaggcacttcccgtctcagcc

SEQ ID NO: 9269079 - DNA, 22 bp, Homo sapiens
ggaggagtgtggggcactctgc

SEQ ID NO: 9269080 - DNA, 22 bp, Homo sapiens
ggaggatgagctacgaggagct

SEQ ID NO: 9269081 - DNA, 22 bp, Homo sapiens
ggaggaggggtgactgaatgct

SEQ ID NO: 9269082 - DNA, 22 bp, Homo sapiens
ggaggaggggtgactgaatgct

SEQ ID NO: 9269083 - DNA, 22 bp, Homo sapiens
ggaggaggggtttacattggaa

SEQ ID NO: 9269084 - DNA, 22 bp, Homo sapiens
ggcaggctgttcacctgctttt

SEQ ID NO: 9269085 - DNA, 22 bp, Homo sapiens
ggcagctagaattgtgatgctg

SEQ ID NO: 9269086 - DNA, 22 bp, Homo sapiens
ggcagctattccaagcagcact

SEQ ID NO: 9269087 - DNA, 22 bp, Homo sapiens
ggcagccttgagggaggcctgg

SEQ ID NO: 9269088 - DNA, 22 bp, Homo sapiens
ggcagccttgagggaggcctgg

SEQ ID NO: 9269089 - DNA, 21 bp, Homo sapiens
ggcagcctgacccccagagag

SEQ ID NO: 9269090 - DNA, 23 bp, Homo sapiens
ggcagcctctgactctgctttgc

SEQ ID NO: 9269091 - DNA, 22 bp, Homo sapiens
ggcagcctccagggcactggtg

SEQ ID NO: 9269092 - DNA, 22 bp, Homo sapiens
ggcagcctccagggcactggtg

SEQ ID NO: 9269093 - DNA, 22 bp, Homo sapiens
ggcagccttgactagtgactta

SEQ ID NO: 9269094 - DNA, 22 bp, Homo sapiens
ggcagccttgactagtgactta

SEQ ID NO: 9269095 - DNA, 22 bp, Homo sapiens
ggcagccttctctcataggtga

SEQ ID NO: 9269096 - DNA, 22 bp, Homo sapiens
ggcagccttctctcataggtga

SEQ ID NO: 9269097 - DNA, 19 bp, Homo sapiens
ggcagcctgcacgggctgc

SEQ ID NO: 9269098 - DNA, 19 bp, Homo sapiens
ggcagcctgcacgggctgc

SEQ ID NO: 9269099 - DNA, 18 bp, Homo sapiens
ggcagcctggacatgctc

SEQ ID NO: 9269100 - DNA, 18 bp, Homo sapiens
ggcagcctggacatgctc

SEQ ID NO: 9269101 - DNA, 22 bp, Homo sapiens
ggcagccatgtcccagggcttc

SEQ ID NO: 9269102 - DNA, 22 bp, Homo sapiens
ggcagccatgtgggcagcgagt

SEQ ID NO: 9269103 - DNA, 22 bp, Homo sapiens
ggcagccatgtcccagggcttc

SEQ ID NO: 9269104 - DNA, 22 bp, Homo sapiens
ggcagccatgtgggcagcgagt

SEQ ID NO: 9269105 - DNA, 17 bp, Homo sapiens
ggcagcctcaggcgttt

SEQ ID NO: 9269106 - DNA, 17 bp, Homo sapiens
ggcagcctcaggcgttt

SEQ ID NO: 9269107 - DNA, 18 bp, Homo sapiens
ggcagcctacccacttgt

SEQ ID NO: 9269108 - DNA, 17 bp, Homo sapiens
ggcagtggaggaagaga

SEQ ID NO: 9269109 - DNA, 17 bp, Homo sapiens
ggcagtggaggaagaga

SEQ ID NO: 9269110 - DNA, 17 bp, Homo sapiens
ggcagtggaggaagaga

SEQ ID NO: 9269111 - DNA, 18 bp, Homo sapiens
ggcagtgcagtctcaggg

SEQ ID NO: 9269112 - DNA, 22 bp, Homo sapiens
ggcagtgccactaagctctgct

SEQ ID NO: 9269113 - DNA, 22 bp, Homo sapiens
ggcagtgagctggagggaagga

SEQ ID NO: 9269114 - DNA, 22 bp, Homo sapiens
ggcagtgagctggagggaagga

SEQ ID NO: 9269115 - DNA, 22 bp, Homo sapiens
ggcagtgagctggagggaagga

SEQ ID NO: 9269116 - DNA, 22 bp, Homo sapiens
ggcagtgagtcccggagaggcc

SEQ ID NO: 9269117 - DNA, 22 bp, Homo sapiens
ggcagtgagtcccggagaggcc

SEQ ID NO: 9269118 - DNA, 22 bp, Homo sapiens
ggcagtgatgtcaaacagtgaa

SEQ ID NO: 9269119 - DNA, 21 bp, Homo sapiens
ggcagtgatgtgaagtgcatc

SEQ ID NO: 9269120 - DNA, 22 bp, Homo sapiens
ggcagggccctgattcctgggg

SEQ ID NO: 9269121 - DNA, 22 bp, Homo sapiens
ggcaggggtcctggtgttgact

SEQ ID NO: 9269122 - DNA, 22 bp, Homo sapiens
ggcaggggtcctggtgttgact

SEQ ID NO: 9269123 - DNA, 22 bp, Homo sapiens
ggcagggaaacagctgatccca

SEQ ID NO: 9269124 - DNA, 22 bp, Homo sapiens
ggcagggaaacagctgatccca

SEQ ID NO: 9269125 - DNA, 22 bp, Homo sapiens
ggcagggagagcatgctgataa

SEQ ID NO: 9269126 - DNA, 22 bp, Homo sapiens
ggcctctgcaactggctgtggc

SEQ ID NO: 9269127 - DNA, 22 bp, Homo sapiens
ggcctctgccccagccacacct

SEQ ID NO: 9269128 - DNA, 22 bp, Homo sapiens
ggcctctgcctcatctgggcac

SEQ ID NO: 9269129 - DNA, 22 bp, Homo sapiens
ggcctctctggcatggctgccc

SEQ ID NO: 9269130 - DNA, 22 bp, Homo sapiens
ggcctctcttgggacagctgtc

SEQ ID NO: 9269131 - DNA, 22 bp, Homo sapiens
ggcctcatcacagtgcattagt

SEQ ID NO: 9269132 - DNA, 18 bp, Homo sapiens
ggcctctggactggcagc

SEQ ID NO: 9269133 - DNA, 22 bp, Homo sapiens
ggcctctggtcaagacaagcat

SEQ ID NO: 9269134 - DNA, 22 bp, Homo sapiens
ggctcacgcaattatcccggcc

SEQ ID NO: 9269135 - DNA, 22 bp, Homo sapiens
ggctcactgcaacttccgcctc

SEQ ID NO: 9269136 - DNA, 22 bp, Homo sapiens
ggctcactgcaacttccgcctc

SEQ ID NO: 9269137 - DNA, 22 bp, Homo sapiens
ggctcactgcaacttccgcctc

SEQ ID NO: 9269138 - DNA, 22 bp, Homo sapiens
ggctcaccattttcactctctg

SEQ ID NO: 9269139 - DNA, 22 bp, Homo sapiens
ggctcaccatggcctccctgct

SEQ ID NO: 9269140 - DNA, 22 bp, Homo sapiens
ggctagggaaaatgattggata

SEQ ID NO: 9269141 - DNA, 23 bp, Homo sapiens
ggctctgaggatggagctggtgg

SEQ ID NO: 9269142 - DNA, 22 bp, Homo sapiens
ggctctgaattattcctgagtc

SEQ ID NO: 9269143 - DNA, 22 bp, Homo sapiens
ggctctgaagggtgacaggttt

SEQ ID NO: 9269144 - DNA, 22 bp, Homo sapiens
ggctctctccttggctttcaga

SEQ ID NO: 9269145 - DNA, 22 bp, Homo sapiens
ggctctctgaggaaacccttcc

SEQ ID NO: 9269146 - DNA, 22 bp, Homo sapiens
ggctctgaaggagacagctgct

SEQ ID NO: 9269147 - DNA, 22 bp, Homo sapiens
ggctctgaaggagacagctgct

SEQ ID NO: 9269148 - DNA, 22 bp, Homo sapiens
ggctctgaacatggggaggagt

SEQ ID NO: 9269149 - DNA, 22 bp, Homo sapiens
ggctcactttggggtcagctgg

SEQ ID NO: 9269150 - DNA, 22 bp, Homo sapiens
ggctcactgcaacttccgcctc

SEQ ID NO: 9269151 - DNA, 22 bp, Homo sapiens
ggccacagtctctggaaggatg

SEQ ID NO: 9269152 - DNA, 20 bp, Homo sapiens
ggccacagggtgctggtgga

SEQ ID NO: 9269153 - DNA, 20 bp, Homo sapiens
ggccacagggtgctggtgga

SEQ ID NO: 9269154 - DNA, 20 bp, Homo sapiens
ggccacagggtgctggtgga

SEQ ID NO: 9269155 - DNA, 20 bp, Homo sapiens
ggccacagggtgctggtgga

SEQ ID NO: 9269156 - DNA, 22 bp, Homo sapiens
ggccacagcagatgcttcagat

SEQ ID NO: 9269157 - DNA, 22 bp, Homo sapiens
ggccacagcagatgcttcagat

SEQ ID NO: 9269158 - DNA, 22 bp, Homo sapiens
ggccacagcaatgctgtgatgt

SEQ ID NO: 9269159 - DNA, 22 bp, Homo sapiens
ggccacagcaatgctgtgatgt

SEQ ID NO: 9269160 - DNA, 22 bp, Homo sapiens
ggccacagcaatgctgtgatgt

SEQ ID NO: 9269161 - DNA, 22 bp, Homo sapiens
ggccacagagggcgggatgctg

SEQ ID NO: 9269162 - DNA, 22 bp, Homo sapiens
ggcagtggctcctctctactcc

SEQ ID NO: 9269163 - DNA, 22 bp, Homo sapiens
ggcagtggcatgtgggtagtgg

SEQ ID NO: 9269164 - DNA, 22 bp, Homo sapiens
ggcagtgggaaataagtgagaa

SEQ ID NO: 9269165 - DNA, 22 bp, Homo sapiens
ggcagtggctcctctctactcc

SEQ ID NO: 9269166 - DNA, 22 bp, Homo sapiens
ggcagtggctgtagtctcttgg

SEQ ID NO: 9269167 - DNA, 17 bp, Homo sapiens
ggccacagagcttgggg

SEQ ID NO: 9269168 - DNA, 17 bp, Homo sapiens
ggccacagagcttgggg

SEQ ID NO: 9269169 - DNA, 17 bp, Homo sapiens
ggccacagagcttgggg

SEQ ID NO: 9269170 - DNA, 17 bp, Homo sapiens
ggccacagagcttgggg

SEQ ID NO: 9269171 - DNA, 22 bp, Homo sapiens
ggcagtgggtggatctcaggga

SEQ ID NO: 9269172 - DNA, 22 bp, Homo sapiens
ggcagtgggtggatctcaggga

SEQ ID NO: 9269173 - DNA, 19 bp, Homo sapiens
ggccagcacagggctctgt

SEQ ID NO: 9269174 - DNA, 22 bp, Homo sapiens
ggccagagttgatggcatcttg

SEQ ID NO: 9269175 - DNA, 22 bp, Homo sapiens
ggccagcagacctcagggactc

SEQ ID NO: 9269176 - DNA, 21 bp, Homo sapiens
ggccagcagcgtccactgtgg

SEQ ID NO: 9269177 - DNA, 22 bp, Homo sapiens
ggccagcagacctcagggactc

SEQ ID NO: 9269178 - DNA, 22 bp, Homo sapiens
ggccagagtctatatgcagaca

SEQ ID NO: 9269179 - DNA, 22 bp, Homo sapiens
ggccagagttgatggcatcttg

SEQ ID NO: 9269180 - DNA, 22 bp, Homo sapiens
ggccacctctgccctactgagt

SEQ ID NO: 9269181 - DNA, 22 bp, Homo sapiens
ggccagaggtgtcctcagttct

SEQ ID NO: 9269182 - DNA, 19 bp, Homo sapiens
ggccacctctcttcccagg

SEQ ID NO: 9269183 - DNA, 21 bp, Homo sapiens
ggccacagttagggctcagga

SEQ ID NO: 9269184 - DNA, 21 bp, Homo sapiens
ggccacagttagggctcagga

SEQ ID NO: 9269185 - DNA, 22 bp, Homo sapiens
ggccacagtgggaaatcctggg

SEQ ID NO: 9269186 - DNA, 22 bp, Homo sapiens
ggccacagtgggaaatcctggg

SEQ ID NO: 9269187 - DNA, 22 bp, Homo sapiens
ggccaccagtcctctggcaggg

SEQ ID NO: 9269188 - DNA, 22 bp, Homo sapiens
ggccacatgtggctgctcgtat

SEQ ID NO: 9269189 - DNA, 22 bp, Homo sapiens
ggccacatgaattcttggacag

SEQ ID NO: 9269190 - DNA, 22 bp, Homo sapiens
ggcccaggctggagtgcagtgg

SEQ ID NO: 9269191 - DNA, 22 bp, Homo sapiens
ggcccaggatgcaagaactgaa

SEQ ID NO: 9269192 - DNA, 22 bp, Homo sapiens
ggcccagctttcattccttgct

SEQ ID NO: 9269193 - DNA, 22 bp, Homo sapiens
ggcccagctgtatattacagtt

SEQ ID NO: 9269194 - DNA, 22 bp, Homo sapiens
ggcccagctgtatattacagtt

SEQ ID NO: 9269195 - DNA, 22 bp, Homo sapiens
ggcccagctgtgcttccagccc

SEQ ID NO: 9269196 - DNA, 22 bp, Homo sapiens
ggcccagtgtgggtggatgttg

SEQ ID NO: 9269197 - DNA, 22 bp, Homo sapiens
ggcccagtgtcccggtcgtggc

SEQ ID NO: 9269198 - DNA, 22 bp, Homo sapiens
ggcccagtgtaccccaggcagt

SEQ ID NO: 9269199 - DNA, 22 bp, Homo sapiens
ggcccagtgctgttcacccagt

SEQ ID NO: 9269200 - DNA, 22 bp, Homo sapiens
ggcccaggctggagtgcggtgg

SEQ ID NO: 9269201 - DNA, 22 bp, Homo sapiens
ggcccaggtccagcgagtacct

SEQ ID NO: 9269202 - DNA, 22 bp, Homo sapiens
ggcccagtctggggccctgtga

SEQ ID NO: 9269203 - DNA, 20 bp, Homo sapiens
ggcccagtgaaccaggacgg

SEQ ID NO: 9269204 - DNA, 22 bp, Homo sapiens
ggccagcatggcaagaccaact

SEQ ID NO: 9269205 - DNA, 22 bp, Homo sapiens
ggccagcagtcacagggtcaga

SEQ ID NO: 9269206 - DNA, 22 bp, Homo sapiens
ggccagcagtcacagggtcaga

SEQ ID NO: 9269207 - DNA, 22 bp, Homo sapiens
ggccagcagtatatagctaatt

SEQ ID NO: 9269208 - DNA, 22 bp, Homo sapiens
ggccagcagtcacagggtcaga

SEQ ID NO: 9269209 - DNA, 22 bp, Homo sapiens
ggccagctgccaccagccctat

SEQ ID NO: 9269210 - DNA, 22 bp, Homo sapiens
ggccagctgctcagtgtctctg

SEQ ID NO: 9269211 - DNA, 22 bp, Homo sapiens
ggcccagcgaggccacctacag

SEQ ID NO: 9269212 - DNA, 22 bp, Homo sapiens
ggcccagcgaggccacctacag

SEQ ID NO: 9269213 - DNA, 22 bp, Homo sapiens
ggcccagctctattgaattaca

SEQ ID NO: 9269214 - DNA, 22 bp, Homo sapiens
ggccagctggatgtgggtgacg

SEQ ID NO: 9269215 - DNA, 22 bp, Homo sapiens
ggccagctggatgtgggtgacg

SEQ ID NO: 9269216 - DNA, 22 bp, Homo sapiens
ggctgcctctggaagctggaga

SEQ ID NO: 9269217 - DNA, 22 bp, Homo sapiens
ggctgcctctgatgtgcagacg

SEQ ID NO: 9269218 - DNA, 22 bp, Homo sapiens
ggctgcctgaggcagtgagaga

SEQ ID NO: 9269219 - DNA, 22 bp, Homo sapiens
ggctgcctgaggcagtgagaga

SEQ ID NO: 9269220 - DNA, 22 bp, Homo sapiens
ggctgcctgccgcccacttggc

SEQ ID NO: 9269221 - DNA, 22 bp, Homo sapiens
ggctggagatatgtctggaaca

SEQ ID NO: 9269222 - DNA, 22 bp, Homo sapiens
ggctggagatatgtctggaaca

SEQ ID NO: 9269223 - DNA, 22 bp, Homo sapiens
ggctggagatatgtctggaaca

SEQ ID NO: 9269224 - DNA, 22 bp, Homo sapiens
ggctggagacaacgtcctgccc

SEQ ID NO: 9269225 - DNA, 22 bp, Homo sapiens
ggctggagatatgtctggaaca

SEQ ID NO: 9269226 - DNA, 22 bp, Homo sapiens
ggctggaggagaatgggtgtga

SEQ ID NO: 9269227 - DNA, 22 bp, Homo sapiens
ggctggaggagaatgggtgtga

SEQ ID NO: 9269228 - DNA, 19 bp, Homo sapiens
ggctggagtggccatctgt

SEQ ID NO: 9269229 - DNA, 22 bp, Homo sapiens
ggctggagtgggctccagagtt

SEQ ID NO: 9269230 - DNA, 22 bp, Homo sapiens
ggctggagtgggctccagagtt

SEQ ID NO: 9269231 - DNA, 22 bp, Homo sapiens
ggctggagtgggctccagagtt

SEQ ID NO: 9269232 - DNA, 22 bp, Homo sapiens
ggctggagtgggctccagagtt

SEQ ID NO: 9269233 - DNA, 17 bp, Homo sapiens
ggctggaggggacccgg

SEQ ID NO: 9269234 - DNA, 22 bp, Homo sapiens
ggctggaggtagaagaacactt

SEQ ID NO: 9269235 - DNA, 22 bp, Homo sapiens
ggctggaggagaatgggtgtga

SEQ ID NO: 9269236 - DNA, 19 bp, Homo sapiens
ggctggagtggccatctgt

SEQ ID NO: 9269237 - DNA, 22 bp, Homo sapiens
ggctggaggtagaagaacactt

SEQ ID NO: 9269238 - DNA, 22 bp, Homo sapiens
ggctggaggtagaagaacactt

SEQ ID NO: 9269239 - DNA, 19 bp, Homo sapiens
ggctggagtggccatctgt

SEQ ID NO: 9269240 - DNA, 22 bp, Homo sapiens
ggctggcagtgtgagagaggga

SEQ ID NO: 9269241 - DNA, 17 bp, Homo sapiens
ggctgcagtccaggagg

SEQ ID NO: 9269242 - DNA, 17 bp, Homo sapiens
ggctgcagtccaggagg

SEQ ID NO: 9269243 - DNA, 17 bp, Homo sapiens
ggctgcagtccaggagg

SEQ ID NO: 9269244 - DNA, 17 bp, Homo sapiens
ggctgcagtccaggagg

SEQ ID NO: 9269245 - DNA, 22 bp, Homo sapiens
ggctgcaggttggttggcagct

SEQ ID NO: 9269246 - DNA, 22 bp, Homo sapiens
ggctgcagggcagctggtgtgg

SEQ ID NO: 9269247 - DNA, 22 bp, Homo sapiens
ggctgcagggcagctggtgtgg

SEQ ID NO: 9269248 - DNA, 22 bp, Homo sapiens
ggctgcaggttggttggcagct

SEQ ID NO: 9269249 - DNA, 22 bp, Homo sapiens
ggctgcaggttggttggcagct

SEQ ID NO: 9269250 - DNA, 22 bp, Homo sapiens
ggctgcaggttggttggcagct

SEQ ID NO: 9269251 - DNA, 21 bp, Homo sapiens
ggctgcagggagccctggggt

SEQ ID NO: 9269252 - DNA, 21 bp, Homo sapiens
ggctgcagggagccctggggt

SEQ ID NO: 9269253 - DNA, 22 bp, Homo sapiens
ggctgcaggcagggtatccact

SEQ ID NO: 9269254 - DNA, 22 bp, Homo sapiens
ggctgcaggcagggtatccact

SEQ ID NO: 9269255 - DNA, 22 bp, Homo sapiens
ggctgcaggcttccctccagca

SEQ ID NO: 9269256 - DNA, 22 bp, Homo sapiens
ggctgcaggcagggtatccact

SEQ ID NO: 9269257 - DNA, 22 bp, Homo sapiens
ggctgcaggcagggtatccact

SEQ ID NO: 9269258 - DNA, 22 bp, Homo sapiens
ggctgccaggagaagctcagtg

SEQ ID NO: 9269259 - DNA, 22 bp, Homo sapiens
ggctgccagcactggtgtagag

SEQ ID NO: 9269260 - DNA, 22 bp, Homo sapiens
ggctgccaggagaagctcagtg

SEQ ID NO: 9269261 - DNA, 22 bp, Homo sapiens
ggctgccacgtcgagggtccaa

SEQ ID NO: 9269262 - DNA, 22 bp, Homo sapiens
ggctgcagtttgtcttttgctt

SEQ ID NO: 9269263 - DNA, 22 bp, Homo sapiens
ggctgcagtttgtcttttgctt

SEQ ID NO: 9269264 - DNA, 22 bp, Homo sapiens
ggctgcagttgtgtgaaggccg

SEQ ID NO: 9269265 - DNA, 22 bp, Homo sapiens
ggctgcagttgtgtgaaggccg

SEQ ID NO: 9269266 - DNA, 22 bp, Homo sapiens
ggctgcagttgtgtgaaggccg

SEQ ID NO: 9269267 - DNA, 22 bp, Homo sapiens
ggctgcagttgtgtgaaggccg

SEQ ID NO: 9269268 - DNA, 22 bp, Homo sapiens
ggctgccagtgagtgcagaccg

SEQ ID NO: 9269269 - DNA, 22 bp, Homo sapiens
ggctgccagtgagtgcagaccg

SEQ ID NO: 9269270 - DNA, 22 bp, Homo sapiens
ggctgccaggagggaggccagt

SEQ ID NO: 9269271 - DNA, 22 bp, Homo sapiens
ggctgcctcccaggagaatctg

SEQ ID NO: 9269272 - DNA, 22 bp, Homo sapiens
ggctgcctcctgctgggctgga

SEQ ID NO: 9269273 - DNA, 22 bp, Homo sapiens
gggaagagggagctggaatgat

SEQ ID NO: 9269274 - DNA, 22 bp, Homo sapiens
gggaagagggagctggaatgat

SEQ ID NO: 9269275 - DNA, 22 bp, Homo sapiens
gggaagagggagctggaatgat

SEQ ID NO: 9269276 - DNA, 22 bp, Homo sapiens
ggctgtggggccgggtacagtg

SEQ ID NO: 9269277 - DNA, 22 bp, Homo sapiens
ggctgtggggccgggtacagtg

SEQ ID NO: 9269278 - DNA, 22 bp, Homo sapiens
ggctgtggggaccaacaggact

SEQ ID NO: 9269279 - DNA, 22 bp, Homo sapiens
ggctgtgggatgcataggagct

SEQ ID NO: 9269280 - DNA, 22 bp, Homo sapiens
ggctgtgggatgcataggagct

SEQ ID NO: 9269281 - DNA, 22 bp, Homo sapiens
ggctgtgggatgcataggagct

SEQ ID NO: 9269282 - DNA, 22 bp, Homo sapiens
ggctgtggcagctggaagtggt

SEQ ID NO: 9269283 - DNA, 22 bp, Homo sapiens
ggctgtggcagctggaagtggt

SEQ ID NO: 9269284 - DNA, 22 bp, Homo sapiens
ggctgtggagctgcagagttgg

SEQ ID NO: 9269285 - DNA, 22 bp, Homo sapiens
ggctgtggcattaggtgaggcc

SEQ ID NO: 9269286 - DNA, 22 bp, Homo sapiens
ggctgtggccagcggggctgag

SEQ ID NO: 9269287 - DNA, 22 bp, Homo sapiens
ggctgtggcagctggaagtggt

SEQ ID NO: 9269288 - DNA, 22 bp, Homo sapiens
ggctgtggcagctggaagtggt

SEQ ID NO: 9269289 - DNA, 22 bp, Homo sapiens
ggctgtggcagctggaagtggt

SEQ ID NO: 9269290 - DNA, 18 bp, Homo sapiens
ggctgtgcgtggaggctg

SEQ ID NO: 9269291 - DNA, 22 bp, Homo sapiens
ggctgtgcgggcagccgtggga

SEQ ID NO: 9269292 - DNA, 22 bp, Homo sapiens
ggctgtgcgggcagccgtggga

SEQ ID NO: 9269293 - DNA, 18 bp, Homo sapiens
ggctgtgcgtggaggctg

SEQ ID NO: 9269294 - DNA, 22 bp, Homo sapiens
ggctgtgctgagggggaagccc

SEQ ID NO: 9269295 - DNA, 22 bp, Homo sapiens
gggaagatagtgttgagggccc

SEQ ID NO: 9269296 - DNA, 22 bp, Homo sapiens
gggaagatagtgttgagggccc

SEQ ID NO: 9269297 - DNA, 22 bp, Homo sapiens
gggaagatagtgttgagggccc

SEQ ID NO: 9269298 - DNA, 22 bp, Homo sapiens
gggaagcagcattgtgctggct

SEQ ID NO: 9269299 - DNA, 22 bp, Homo sapiens
gggaagagtaactagcccatgt

SEQ ID NO: 9269300 - DNA, 22 bp, Homo sapiens
gggaaggcagtgtctggttgaa

SEQ ID NO: 9269301 - DNA, 18 bp, Homo sapiens
gggaagccgggaagccgg

SEQ ID NO: 9269302 - DNA, 22 bp, Homo sapiens
gggaagccatgctcagaggtac

SEQ ID NO: 9269303 - DNA, 22 bp, Homo sapiens
gggaaggcaccatggtgttcca

SEQ ID NO: 9269304 - DNA, 23 bp, Homo sapiens
gggagccaggacctcgcgcccca

SEQ ID NO: 9269305 - DNA, 23 bp, Homo sapiens
gggagccatgggtggtcatggag

SEQ ID NO: 9269306 - DNA, 22 bp, Homo sapiens
gggagccagcagggcatggagc

SEQ ID NO: 9269307 - DNA, 23 bp, Homo sapiens
gggagatgggaaatgaaggctct

SEQ ID NO: 9269308 - DNA, 22 bp, Homo sapiens
gggagccacagtgaggtgcatg

SEQ ID NO: 9269309 - DNA, 22 bp, Homo sapiens
gggagccacagtttatagtgat

SEQ ID NO: 9269310 - DNA, 22 bp, Homo sapiens
gggagatggctcagaggccgcg

SEQ ID NO: 9269311 - DNA, 22 bp, Homo sapiens
gggagatgactcagtgacctcg

SEQ ID NO: 9269312 - DNA, 22 bp, Homo sapiens
gggagatggctcagaggccgcg

SEQ ID NO: 9269313 - DNA, 22 bp, Homo sapiens
gggcagagactcagaaacagaa

SEQ ID NO: 9269314 - DNA, 22 bp, Homo sapiens
gggcagagactcagaaacagaa

SEQ ID NO: 9269315 - DNA, 22 bp, Homo sapiens
gggcagagactcagaaacagaa

SEQ ID NO: 9269316 - DNA, 22 bp, Homo sapiens
gggcagagactcagaaacagaa

SEQ ID NO: 9269317 - DNA, 22 bp, Homo sapiens
gggcagagagctggaactcctt

SEQ ID NO: 9269318 - DNA, 22 bp, Homo sapiens
gggcactgtacactgtgcatgg

SEQ ID NO: 9269319 - DNA, 22 bp, Homo sapiens
gggcactgtgctaggtgctgag

SEQ ID NO: 9269320 - DNA, 22 bp, Homo sapiens
gggcactgtacactgtgcatgg

SEQ ID NO: 9269321 - DNA, 22 bp, Homo sapiens
gggcactggtgctgccatcttg

SEQ ID NO: 9269322 - DNA, 22 bp, Homo sapiens
gggcagagagctggaactcctt

SEQ ID NO: 9269323 - DNA, 22 bp, Homo sapiens
gggcagagagctggaactcctt

SEQ ID NO: 9269324 - DNA, 22 bp, Homo sapiens
gggcagagagctggaactcctt

SEQ ID NO: 9269325 - DNA, 22 bp, Homo sapiens
gggcagagagctggaactcctt

SEQ ID NO: 9269326 - DNA, 20 bp, Homo sapiens
gggcagagccagccagtccc

SEQ ID NO: 9269327 - DNA, 20 bp, Homo sapiens
gggcagagccagccagtccc

SEQ ID NO: 9269328 - DNA, 22 bp, Homo sapiens
gggcagaggctctggcccatcc

SEQ ID NO: 9269329 - DNA, 22 bp, Homo sapiens
gggcagaggctctggcccatcc

SEQ ID NO: 9269330 - DNA, 21 bp, Homo sapiens
gggcagaggggcctcctgggt

SEQ ID NO: 9269331 - DNA, 21 bp, Homo sapiens
gggcagaggggcctcctgggt

SEQ ID NO: 9269332 - DNA, 22 bp, Homo sapiens
gggcagaggctctggcccatcc

SEQ ID NO: 9269333 - DNA, 21 bp, Homo sapiens
gggcagaggggcctcctgggt

SEQ ID NO: 9269334 - DNA, 21 bp, Homo sapiens
gggcagaggggcctcctgggt

SEQ ID NO: 9269335 - DNA, 17 bp, Homo sapiens
gggcagggactcctggg

SEQ ID NO: 9269336 - DNA, 21 bp, Homo sapiens
gggcaggtctctgatgtcaac

SEQ ID NO: 9269337 - DNA, 17 bp, Homo sapiens
gggcagggactcctggg

SEQ ID NO: 9269338 - DNA, 22 bp, Homo sapiens
gggcaggtgattttggctccat

SEQ ID NO: 9269339 - DNA, 22 bp, Homo sapiens
gggcaggtgccagctccctgtc

SEQ ID NO: 9269340 - DNA, 22 bp, Homo sapiens
gggagtggttgatggtgaaaat

SEQ ID NO: 9269341 - DNA, 20 bp, Homo sapiens
gggagtggtggtagcctgtg

SEQ ID NO: 9269342 - DNA, 22 bp, Homo sapiens
gggagtgggtttggcctaggcc

SEQ ID NO: 9269343 - DNA, 22 bp, Homo sapiens
gggagtggattatgtggaccca

SEQ ID NO: 9269344 - DNA, 22 bp, Homo sapiens
gggagtggggcttaccttgaag

SEQ ID NO: 9269345 - DNA, 22 bp, Homo sapiens
gggataggagattgggagtgtt

SEQ ID NO: 9269346 - DNA, 22 bp, Homo sapiens
gggataggaaacttaggtacac

SEQ ID NO: 9269347 - DNA, 22 bp, Homo sapiens
gggataggaaacttaggtacac

SEQ ID NO: 9269348 - DNA, 22 bp, Homo sapiens
gggataggtttggaagaggtgg

SEQ ID NO: 9269349 - DNA, 22 bp, Homo sapiens
gggaggttgaggctgcagtgag

SEQ ID NO: 9269350 - DNA, 22 bp, Homo sapiens
gggaggttgaggctgcagtgag

SEQ ID NO: 9269351 - DNA, 22 bp, Homo sapiens
gggaggttgaggctgcagtgag

SEQ ID NO: 9269352 - DNA, 22 bp, Homo sapiens
gggagtggagagcaatggatga

SEQ ID NO: 9269353 - DNA, 22 bp, Homo sapiens
gggagcgggactgcgcaggctt

SEQ ID NO: 9269354 - DNA, 22 bp, Homo sapiens
gggagctcgtgcgcccaggtgc

SEQ ID NO: 9269355 - DNA, 22 bp, Homo sapiens
gggagctcgtgcgcccaggtgc

SEQ ID NO: 9269356 - DNA, 22 bp, Homo sapiens
gggcccttcagcttcctctgca

SEQ ID NO: 9269357 - DNA, 22 bp, Homo sapiens
gggccctggggcctgatttgca

SEQ ID NO: 9269358 - DNA, 22 bp, Homo sapiens
gggccctggggcctgatttgca

SEQ ID NO: 9269359 - DNA, 22 bp, Homo sapiens
gggccctggggcctgatttgca

SEQ ID NO: 9269360 - DNA, 20 bp, Homo sapiens
gggctaggtagccatttggc

SEQ ID NO: 9269361 - DNA, 18 bp, Homo sapiens
gggctcacacaggtcatc

SEQ ID NO: 9269362 - DNA, 22 bp, Homo sapiens
gggccctgggattcagagcaag

SEQ ID NO: 9269363 - DNA, 22 bp, Homo sapiens
gggccctgggattcagagcaag

SEQ ID NO: 9269364 - DNA, 22 bp, Homo sapiens
gggccctgccccgtggctctga

SEQ ID NO: 9269365 - DNA, 22 bp, Homo sapiens
gggccctgccccgtggctctga

SEQ ID NO: 9269366 - DNA, 22 bp, Homo sapiens
gggcccagtaccctctgccaag

SEQ ID NO: 9269367 - DNA, 22 bp, Homo sapiens
gggcccaggcctccttccttcc

SEQ ID NO: 9269368 - DNA, 22 bp, Homo sapiens
gggcccagtaccctctgccaag

SEQ ID NO: 9269369 - DNA, 22 bp, Homo sapiens
gggccccaagaacctcctcctg

SEQ ID NO: 9269370 - DNA, 22 bp, Homo sapiens
gggccccactggggctgcctgc

SEQ ID NO: 9269371 - DNA, 22 bp, Homo sapiens
gggccccagtcctcccacgtgg

SEQ ID NO: 9269372 - DNA, 22 bp, Homo sapiens
gggcaggtgcccagggccagag

SEQ ID NO: 9269373 - DNA, 22 bp, Homo sapiens
gggcaggtggcctcttgtacta

SEQ ID NO: 9269374 - DNA, 22 bp, Homo sapiens
gggcaggtggcagggtctctgg

SEQ ID NO: 9269375 - DNA, 22 bp, Homo sapiens
gggcaggtgtgcagagctgttg

SEQ ID NO: 9269376 - DNA, 22 bp, Homo sapiens
gggcaggtgtttccaaggtgag

SEQ ID NO: 9269377 - DNA, 22 bp, Homo sapiens
gggctctggatggagcctgcag

SEQ ID NO: 9269378 - DNA, 22 bp, Homo sapiens
gggctccaaccccagtgaactc

SEQ ID NO: 9269379 - DNA, 22 bp, Homo sapiens
gggctccaaaatcctgtagcct

SEQ ID NO: 9269380 - DNA, 22 bp, Homo sapiens
gggctccaaaatcctgtagcct

SEQ ID NO: 9269381 - DNA, 22 bp, Homo sapiens
gggctcagctccttccttccta

SEQ ID NO: 9269382 - DNA, 22 bp, Homo sapiens
gggctcagctgggcgtgctggt

SEQ ID NO: 9269383 - DNA, 22 bp, Homo sapiens
gggctcagttctgcttcatgct

SEQ ID NO: 9269384 - DNA, 22 bp, Homo sapiens
gggctcaggagtttgaggctgc

SEQ ID NO: 9269385 - DNA, 22 bp, Homo sapiens
gggctcagacatccctcctgga

SEQ ID NO: 9269386 - DNA, 21 bp, Homo sapiens
gggtggggttccagccttttc

SEQ ID NO: 9269387 - DNA, 22 bp, Homo sapiens
gggtggagaggctaagtccagt

SEQ ID NO: 9269388 - DNA, 22 bp, Homo sapiens
gggtggagccagttgactctgt

SEQ ID NO: 9269389 - DNA, 22 bp, Homo sapiens
gggtggagccagttgactctgt

SEQ ID NO: 9269390 - DNA, 22 bp, Homo sapiens
gggtggagagaaagaaacgtga

SEQ ID NO: 9269391 - DNA, 22 bp, Homo sapiens
gggtggagaggctaagtccagt

SEQ ID NO: 9269392 - DNA, 22 bp, Homo sapiens
gggtggtgtattagagctgcag

SEQ ID NO: 9269393 - DNA, 22 bp, Homo sapiens
gggtggtggcggaggctccagg

SEQ ID NO: 9269394 - DNA, 22 bp, Homo sapiens
gggtggtggccagcagtgggca

SEQ ID NO: 9269395 - DNA, 22 bp, Homo sapiens
gggtggtgagatgtagctgatg

SEQ ID NO: 9269396 - DNA, 16 bp, Homo sapiens
gggtggtcttggagac

SEQ ID NO: 9269397 - DNA, 22 bp, Homo sapiens
gggtggtctggcaggctggaaa

SEQ ID NO: 9269398 - DNA, 22 bp, Homo sapiens
gggtggtgagatgtagctgatg

SEQ ID NO: 9269399 - DNA, 22 bp, Homo sapiens
gggtgcagcagagctcctctgt

SEQ ID NO: 9269400 - DNA, 18 bp, Homo sapiens
gggtgcaggcactgactg

SEQ ID NO: 9269401 - DNA, 22 bp, Homo sapiens
gggtgcaggcagcccaggcagg

SEQ ID NO: 9269402 - DNA, 18 bp, Homo sapiens
gggtgcaggcactgactg

SEQ ID NO: 9269403 - DNA, 22 bp, Homo sapiens
gggtgctttggctcacgcctgt

SEQ ID NO: 9269404 - DNA, 21 bp, Homo sapiens
gggtgctgtggtcatgcagga

SEQ ID NO: 9269405 - DNA, 22 bp, Homo sapiens
gggtgcaggcagcccaggcagg

SEQ ID NO: 9269406 - DNA, 22 bp, Homo sapiens
gggtgaggagctgccagtcatg

SEQ ID NO: 9269407 - DNA, 20 bp, Homo sapiens
gggtgaggatggagaatttg

SEQ ID NO: 9269408 - DNA, 22 bp, Homo sapiens
gggtgaggcccatttgaggcca

SEQ ID NO: 9269409 - DNA, 22 bp, Homo sapiens
gggtgagggatgagccttcttc

SEQ ID NO: 9269410 - DNA, 22 bp, Homo sapiens
gggtgagggatgagccttcttc

SEQ ID NO: 9269411 - DNA, 22 bp, Homo sapiens
gggtgcagcagagctcctctgt

SEQ ID NO: 9269412 - DNA, 22 bp, Homo sapiens
ggggcccctcggacacgtgcgg

SEQ ID NO: 9269413 - DNA, 22 bp, Homo sapiens
ggggcccttgtggctgcaggcc

SEQ ID NO: 9269414 - DNA, 22 bp, Homo sapiens
ggggcccagggcagcagtgcag

SEQ ID NO: 9269415 - DNA, 22 bp, Homo sapiens
ggggcccagcacccctcctcgc

SEQ ID NO: 9269416 - DNA, 22 bp, Homo sapiens
ggggtagggcgattgctgcttt

SEQ ID NO: 9269417 - DNA, 22 bp, Homo sapiens
ggggtagggtgattgtgaagta

SEQ ID NO: 9269418 - DNA, 22 bp, Homo sapiens
ggggtagggcgattgctgcttt

SEQ ID NO: 9269419 - DNA, 22 bp, Homo sapiens
ggggccagatatcactaaggtt

SEQ ID NO: 9269420 - DNA, 22 bp, Homo sapiens
ggggccagatatcactaaggtt

SEQ ID NO: 9269421 - DNA, 22 bp, Homo sapiens
ggggccagcttcgcgtgctctt

SEQ ID NO: 9269422 - DNA, 22 bp, Homo sapiens
ggggccagcttcgcgtgctctt

SEQ ID NO: 9269423 - DNA, 22 bp, Homo sapiens
ggggccagcactgtgcctttgt

SEQ ID NO: 9269424 - DNA, 22 bp, Homo sapiens
ggggccagcactgtgcctttgt

SEQ ID NO: 9269425 - DNA, 22 bp, Homo sapiens
ggggccagcaatgttgaggaat

SEQ ID NO: 9269426 - DNA, 22 bp, Homo sapiens
ggggccagcaatgttgaggaat

SEQ ID NO: 9269427 - DNA, 22 bp, Homo sapiens
ggggccaggtccagcttccaaa

SEQ ID NO: 9269428 - DNA, 22 bp, Homo sapiens
ggggccaggtccagcttccaaa

SEQ ID NO: 9269429 - DNA, 20 bp, Homo sapiens
ggggcccaagccctcttgcc

SEQ ID NO: 9269430 - DNA, 22 bp, Homo sapiens
ggggccagtaggagtgatgtac

SEQ ID NO: 9269431 - DNA, 22 bp, Homo sapiens
ggggccagtaggagtgatgtac

SEQ ID NO: 9269432 - DNA, 19 bp, Homo sapiens
ggggtggctggggctccag

SEQ ID NO: 9269433 - DNA, 22 bp, Homo sapiens
ggggtgggagtgccatccttga

SEQ ID NO: 9269434 - DNA, 22 bp, Homo sapiens
ggggtgggagtgccatccttga

SEQ ID NO: 9269435 - DNA, 22 bp, Homo sapiens
ggggtgggcgtgcagggacacc

SEQ ID NO: 9269436 - DNA, 22 bp, Homo sapiens
ggggtgggagtgccatccttga

SEQ ID NO: 9269437 - DNA, 22 bp, Homo sapiens
ggggtgggagtgccatccttga

SEQ ID NO: 9269438 - DNA, 22 bp, Homo sapiens
ggggtggccctaccctctggaa

SEQ ID NO: 9269439 - DNA, 22 bp, Homo sapiens
ggggtggattcctacaggtcca

SEQ ID NO: 9269440 - DNA, 22 bp, Homo sapiens
ggggtggattcctacaggtcca

SEQ ID NO: 9269441 - DNA, 22 bp, Homo sapiens
ggggtggattcctacaggtcca

SEQ ID NO: 9269442 - DNA, 22 bp, Homo sapiens
ggggtggatttcaggcggtgtc

SEQ ID NO: 9269443 - DNA, 22 bp, Homo sapiens
ggggtggagatggtggcccttt

SEQ ID NO: 9269444 - DNA, 22 bp, Homo sapiens
ggggtggagatggtggcccttt

SEQ ID NO: 9269445 - DNA, 22 bp, Homo sapiens
ggggtggagctaaatgtctact

SEQ ID NO: 9269446 - DNA, 22 bp, Homo sapiens
ggggtggatcaggcaggcccag

SEQ ID NO: 9269447 - DNA, 22 bp, Homo sapiens
ggggaggacctttccaaggctt

SEQ ID NO: 9269448 - DNA, 22 bp, Homo sapiens
ggggaggagccatgtaactagt

SEQ ID NO: 9269449 - DNA, 22 bp, Homo sapiens
ggggaggagtgtacaggtttat

SEQ ID NO: 9269450 - DNA, 22 bp, Homo sapiens
ggggaggaagctggaacacggg

SEQ ID NO: 9269451 - DNA, 22 bp, Homo sapiens
ggggaggaagctggaacacggg

SEQ ID NO: 9269452 - DNA, 22 bp, Homo sapiens
ggggaggaagctggaacacggg

SEQ ID NO: 9269453 - DNA, 22 bp, Homo sapiens
ggggaggaagctctcagttcca

SEQ ID NO: 9269454 - DNA, 22 bp, Homo sapiens
ggggaggaagctggaacacggg

SEQ ID NO: 9269455 - DNA, 22 bp, Homo sapiens
ggggaggaagctggaacacggg

SEQ ID NO: 9269456 - DNA, 19 bp, Homo sapiens
ggggagaactagagacagc

SEQ ID NO: 9269457 - DNA, 22 bp, Homo sapiens
ggggagaattaccaaaagcgct

SEQ ID NO: 9269458 - DNA, 22 bp, Homo sapiens
ggggagaattaccaaaagcgct

SEQ ID NO: 9269459 - DNA, 22 bp, Homo sapiens
ggggagaattacatggcgtgga

SEQ ID NO: 9269460 - DNA, 22 bp, Homo sapiens
ggggagaataaatcagatttta

SEQ ID NO: 9269461 - DNA, 22 bp, Homo sapiens
ggggccagagaggacccaggtg

SEQ ID NO: 9269462 - DNA, 22 bp, Homo sapiens
ggggccagatatcactaaggtt

SEQ ID NO: 9269463 - DNA, 22 bp, Homo sapiens
ggggccagagaggacccaggtg

SEQ ID NO: 9269464 - DNA, 22 bp, Homo sapiens
ggggccagagaggacccaggtg

SEQ ID NO: 9269465 - DNA, 20 bp, Homo sapiens
ggggcaggtttttatggcta

SEQ ID NO: 9269466 - DNA, 20 bp, Homo sapiens
ggggcaggtttttatggcta

SEQ ID NO: 9269467 - DNA, 22 bp, Homo sapiens
ggggcagggaggttatcgccga

SEQ ID NO: 9269468 - DNA, 22 bp, Homo sapiens
ggggcaggaggtgttctctttt

SEQ ID NO: 9269469 - DNA, 22 bp, Homo sapiens
ggggcagggaggttatcgccga

SEQ ID NO: 9269470 - DNA, 22 bp, Homo sapiens
ggggcaggaggtgttctctttt

SEQ ID NO: 9269471 - DNA, 19 bp, Homo sapiens
ggggaggtattgttttcat

SEQ ID NO: 9269472 - DNA, 16 bp, Homo sapiens
gggctgggggattctg

SEQ ID NO: 9269473 - DNA, 22 bp, Homo sapiens
gggctggtctggcttagtcagg

SEQ ID NO: 9269474 - DNA, 22 bp, Homo sapiens
gggctgtgtgcccacttcccat

SEQ ID NO: 9269475 - DNA, 22 bp, Homo sapiens
gggctggtctggcttagtcagg

SEQ ID NO: 9269476 - DNA, 22 bp, Homo sapiens
gggctggtgaggctgccctgca

SEQ ID NO: 9269477 - DNA, 22 bp, Homo sapiens
gggctctgggattcagagcaag

SEQ ID NO: 9269478 - DNA, 19 bp, Homo sapiens
gggctctggcctcagtggg

SEQ ID NO: 9269479 - DNA, 22 bp, Homo sapiens
gggcttaaggccagtgtgcttt

SEQ ID NO: 9269480 - DNA, 22 bp, Homo sapiens
gggcttcaaaattggcactctt

SEQ ID NO: 9269481 - DNA, 22 bp, Homo sapiens
gggcttctagaatttctgatat

SEQ ID NO: 9269482 - DNA, 22 bp, Homo sapiens
gggcttctattcaagtctgttt

SEQ ID NO: 9269483 - DNA, 22 bp, Homo sapiens
gggcttctggctactgtatgag

SEQ ID NO: 9269484 - DNA, 22 bp, Homo sapiens
gggcttctgggcaccactccct

SEQ ID NO: 9269485 - DNA, 22 bp, Homo sapiens
gggcttctgctcttttggtgct

SEQ ID NO: 9269486 - DNA, 22 bp, Homo sapiens
gggcttctctttagtgagctga

SEQ ID NO: 9269487 - DNA, 22 bp, Homo sapiens
gggcttctctttagtgagctga

SEQ ID NO: 9269488 - DNA, 22 bp, Homo sapiens
gggcttctctgggagtcctggt

SEQ ID NO: 9269489 - DNA, 22 bp, Homo sapiens
gggcttctccctaaggactctg

SEQ ID NO: 9269490 - DNA, 22 bp, Homo sapiens
ggtggatgctgactgttctgct

SEQ ID NO: 9269491 - DNA, 22 bp, Homo sapiens
ggtggagtaattcgcagaggtt

SEQ ID NO: 9269492 - DNA, 22 bp, Homo sapiens
ggtggagctggaccaggagagg

SEQ ID NO: 9269493 - DNA, 22 bp, Homo sapiens
ggtggagctatacgggatggct

SEQ ID NO: 9269494 - DNA, 22 bp, Homo sapiens
ggtggagctggaccaggagagg

SEQ ID NO: 9269495 - DNA, 22 bp, Homo sapiens
ggtggcagaataattgaaggtc

SEQ ID NO: 9269496 - DNA, 22 bp, Homo sapiens
ggtggcagaataattgaaggtc

SEQ ID NO: 9269497 - DNA, 22 bp, Homo sapiens
ggtggcagagacataggacata

SEQ ID NO: 9269498 - DNA, 19 bp, Homo sapiens
ggtggcagaacgtgggtcc

SEQ ID NO: 9269499 - DNA, 22 bp, Homo sapiens
ggtggcagagaggaggtagttt

SEQ ID NO: 9269500 - DNA, 22 bp, Homo sapiens
ggtggcagagacataggacata

SEQ ID NO: 9269501 - DNA, 22 bp, Homo sapiens
ggtgggcaggcgaggcccaggt

SEQ ID NO: 9269502 - DNA, 22 bp, Homo sapiens
ggtgggcaggcgaggcccaggt

SEQ ID NO: 9269503 - DNA, 22 bp, Homo sapiens
ggtggggcctgctccagcggcc

SEQ ID NO: 9269504 - DNA, 22 bp, Homo sapiens
ggtggggcctgctccagcggcc

SEQ ID NO: 9269505 - DNA, 22 bp, Homo sapiens
ggtggggccctggcactggtat

SEQ ID NO: 9269506 - DNA, 22 bp, Homo sapiens
ggtggggccctggcactggtat

SEQ ID NO: 9269507 - DNA, 22 bp, Homo sapiens
ggtggggccctggcactggtat

SEQ ID NO: 9269508 - DNA, 22 bp, Homo sapiens
ggtgggtgagccctgggagctg

SEQ ID NO: 9269509 - DNA, 22 bp, Homo sapiens
ggtgggtgagccctgggagctg

SEQ ID NO: 9269510 - DNA, 22 bp, Homo sapiens
ggtggggattcctgatcactgt

SEQ ID NO: 9269511 - DNA, 22 bp, Homo sapiens
ggtggggagtcaggcattcttg

SEQ ID NO: 9269512 - DNA, 22 bp, Homo sapiens
ggtgggcaggtcactctgcctc

SEQ ID NO: 9269513 - DNA, 22 bp, Homo sapiens
ggtgggcaggtcactctgcctc

SEQ ID NO: 9269514 - DNA, 22 bp, Homo sapiens
ggttattttggttgtctaaggc

SEQ ID NO: 9269515 - DNA, 23 bp, Homo sapiens
ggttatttgcatcctgtaattat

SEQ ID NO: 9269516 - DNA, 22 bp, Homo sapiens
ggttatttttgattctgtggat

SEQ ID NO: 9269517 - DNA, 22 bp, Homo sapiens
ggttatcatagttgttatcagg

SEQ ID NO: 9269518 - DNA, 22 bp, Homo sapiens
ggttaggatcagatcctggagg

SEQ ID NO: 9269519 - DNA, 22 bp, Homo sapiens
ggtggtggagccagctgggagt

SEQ ID NO: 9269520 - DNA, 22 bp, Homo sapiens
ggtggtggagccagctgggagt

SEQ ID NO: 9269521 - DNA, 22 bp, Homo sapiens
ggtggtggagccagctgggagt

SEQ ID NO: 9269522 - DNA, 19 bp, Homo sapiens
ggtgtttcttcattttcca

SEQ ID NO: 9269523 - DNA, 19 bp, Homo sapiens
ggttaatgttaggatactt

SEQ ID NO: 9269524 - DNA, 22 bp, Homo sapiens
ggttaaaaataatttacttggc

SEQ ID NO: 9269525 - DNA, 21 bp, Homo sapiens
ggttaaaagacacatctgttt

SEQ ID NO: 9269526 - DNA, 22 bp, Homo sapiens
ggttaaaatctaaaatgtgact

SEQ ID NO: 9269527 - DNA, 22 bp, Homo sapiens
ggttggtaactccctgtgcagt

SEQ ID NO: 9269528 - DNA, 22 bp, Homo sapiens
ggttggtgagtgcagggtgtta

SEQ ID NO: 9269529 - DNA, 22 bp, Homo sapiens
ggttggggcgagctggaggccc

SEQ ID NO: 9269530 - DNA, 22 bp, Homo sapiens
ggttggggcgagctggaggccc

SEQ ID NO: 9269531 - DNA, 22 bp, Homo sapiens
ggttggggcgagctggaggccc

SEQ ID NO: 9269532 - DNA, 19 bp, Homo sapiens
ggttggagaagagcggccc

SEQ ID NO: 9269533 - DNA, 19 bp, Homo sapiens
ggttggagaagagcggccc

SEQ ID NO: 9269534 - DNA, 23 bp, Homo sapiens
ggttggctgtacccaggctccct

SEQ ID NO: 9269535 - DNA, 22 bp, Homo sapiens
gtaattttggagtataacctgg

SEQ ID NO: 9269536 - DNA, 22 bp, Homo sapiens
gtaatttaattctctgacttga

SEQ ID NO: 9269537 - DNA, 21 bp, Homo sapiens
ggttggtgtgtccagtggcca

SEQ ID NO: 9269538 - DNA, 23 bp, Homo sapiens
ggtcccagtggagaggcctcacc

SEQ ID NO: 9269539 - DNA, 22 bp, Homo sapiens
ggtcccagttgcccaggtcagg

SEQ ID NO: 9269540 - DNA, 22 bp, Homo sapiens
ggtcccaggttgacagggagac

SEQ ID NO: 9269541 - DNA, 22 bp, Homo sapiens
ggtcccaggctgcgggctggtg

SEQ ID NO: 9269542 - DNA, 22 bp, Homo sapiens
ggtcccagtcctctccctgcta

SEQ ID NO: 9269543 - DNA, 22 bp, Homo sapiens
ggtccctgcccaaagcccttgg

SEQ ID NO: 9269544 - DNA, 20 bp, Homo sapiens
ggtccctgccctctgtcatc

SEQ ID NO: 9269545 - DNA, 22 bp, Homo sapiens
ggtccctgcctgaggctggcct

SEQ ID NO: 9269546 - DNA, 22 bp, Homo sapiens
gggttgaggcggatgtcggcgg

SEQ ID NO: 9269547 - DNA, 22 bp, Homo sapiens
gggtgtcctgtgccaagctggg

SEQ ID NO: 9269548 - DNA, 22 bp, Homo sapiens
gggttggattacttagggagaa

SEQ ID NO: 9269549 - DNA, 22 bp, Homo sapiens
gggttggattacttagggagaa

SEQ ID NO: 9269550 - DNA, 22 bp, Homo sapiens
gggttggatcctggtggctgcc

SEQ ID NO: 9269551 - DNA, 22 bp, Homo sapiens
gggttggcatcagggttctgtg

SEQ ID NO: 9269552 - DNA, 22 bp, Homo sapiens
gggttgggactgtcatctggag

SEQ ID NO: 9269553 - DNA, 22 bp, Homo sapiens
ggtcccagctgctcaagaggct

SEQ ID NO: 9269554 - DNA, 22 bp, Homo sapiens
ggtaaaaatcacaaatacttta

SEQ ID NO: 9269555 - DNA, 22 bp, Homo sapiens
gggttggggcccagcagtctgc

SEQ ID NO: 9269556 - DNA, 22 bp, Homo sapiens
gggttggggcccagcagtctgc

SEQ ID NO: 9269557 - DNA, 22 bp, Homo sapiens
gggttttatggttcacttgcaa

SEQ ID NO: 9269558 - DNA, 22 bp, Homo sapiens
ggtcccagctggtcactgtcag

SEQ ID NO: 9269559 - DNA, 22 bp, Homo sapiens
ggtcccaggaatctgtgttcta

SEQ ID NO: 9269560 - DNA, 22 bp, Homo sapiens
ggtcccaggaagtgcggcggcg

SEQ ID NO: 9269561 - DNA, 22 bp, Homo sapiens
ggtcccaggagaataggtgcaa

SEQ ID NO: 9269562 - DNA, 22 bp, Homo sapiens
ggtcccaggctccctcttgtcc

SEQ ID NO: 9269563 - DNA, 22 bp, Homo sapiens
ggtcccaggattggttgcgcag

SEQ ID NO: 9269564 - DNA, 22 bp, Homo sapiens
ggtggaaggcctggaaggaggc

SEQ ID NO: 9269565 - DNA, 22 bp, Homo sapiens
ggtggaaggcctggaaggaggc

SEQ ID NO: 9269566 - DNA, 22 bp, Homo sapiens
ggtggaaggcagcagtctcagg

SEQ ID NO: 9269567 - DNA, 17 bp, Homo sapiens
ggtggaagtttctagtt

SEQ ID NO: 9269568 - DNA, 22 bp, Homo sapiens
ggtggacaaatgaatgactgaa

SEQ ID NO: 9269569 - DNA, 22 bp, Homo sapiens
ggtggacagtgttagctctggg

SEQ ID NO: 9269570 - DNA, 22 bp, Homo sapiens
ggtggacagtgttagctctggg

SEQ ID NO: 9269571 - DNA, 22 bp, Homo sapiens
ggtgagggagtggaacgaggtg

SEQ ID NO: 9269572 - DNA, 22 bp, Homo sapiens
ggtgagggagtggaacgaggtg

SEQ ID NO: 9269573 - DNA, 18 bp, Homo sapiens
ggtgagggagctggaagc

SEQ ID NO: 9269574 - DNA, 18 bp, Homo sapiens
ggtgagggagctggaagc

SEQ ID NO: 9269575 - DNA, 22 bp, Homo sapiens
ggtgagcagctgtctgtatgga

SEQ ID NO: 9269576 - DNA, 22 bp, Homo sapiens
ggtgagcactgccctgggtctc

SEQ ID NO: 9269577 - DNA, 22 bp, Homo sapiens
ggtgaggaaagatggtgacagt

SEQ ID NO: 9269578 - DNA, 22 bp, Homo sapiens
ggtgaggaaagatggtgacagt

SEQ ID NO: 9269579 - DNA, 22 bp, Homo sapiens
ggtgaggaattggggactgacc

SEQ ID NO: 9269580 - DNA, 22 bp, Homo sapiens
ggtgaggaattggggactgacc

SEQ ID NO: 9269581 - DNA, 22 bp, Homo sapiens
ggtgaggaattggggactgacc

SEQ ID NO: 9269582 - DNA, 22 bp, Homo sapiens
ggtgagaggcagtgctgtggaa

SEQ ID NO: 9269583 - DNA, 22 bp, Homo sapiens
ggtccctgctgaagccttggtg

SEQ ID NO: 9269584 - DNA, 22 bp, Homo sapiens
ggtccctggaaggccaagcttg

SEQ ID NO: 9269585 - DNA, 21 bp, Homo sapiens
ggtgacacgtggccccgctct

SEQ ID NO: 9269586 - DNA, 22 bp, Homo sapiens
gtacaacaggattgatgtacca

SEQ ID NO: 9269587 - DNA, 22 bp, Homo sapiens
gtacaagttctactctataaat

SEQ ID NO: 9269588 - DNA, 22 bp, Homo sapiens
gtacaataactagtcttatagt

SEQ ID NO: 9269589 - DNA, 22 bp, Homo sapiens
gtacaaatgcaggtttgttaca

SEQ ID NO: 9269590 - DNA, 22 bp, Homo sapiens
gtacaaaagttattgcggtttt

SEQ ID NO: 9269591 - DNA, 22 bp, Homo sapiens
gtagtcccagctaccccggagg

SEQ ID NO: 9269592 - DNA, 22 bp, Homo sapiens
gtagtcacaaaccattcatatg

SEQ ID NO: 9269593 - DNA, 22 bp, Homo sapiens
gtagtattttctgtgatgtagg

SEQ ID NO: 9269594 - DNA, 22 bp, Homo sapiens
gtagtcacaaaccattcatatg

SEQ ID NO: 9269595 - DNA, 22 bp, Homo sapiens
gtagtggagtctcctgtcctgg

SEQ ID NO: 9269596 - DNA, 22 bp, Homo sapiens
gtagtctgaacagtaattttgt

SEQ ID NO: 9269597 - DNA, 22 bp, Homo sapiens
gtagtaaagcaggttttgctgt

SEQ ID NO: 9269598 - DNA, 22 bp, Homo sapiens
gtagtaaagcggaaagggtgat

SEQ ID NO: 9269599 - DNA, 22 bp, Homo sapiens
gtaggtgagtgggagaagaggc

SEQ ID NO: 9269600 - DNA, 22 bp, Homo sapiens
gtaggcagataggagtgcagcc

SEQ ID NO: 9269601 - DNA, 22 bp, Homo sapiens
gtaggcagataggagtgcagcc

SEQ ID NO: 9269602 - DNA, 22 bp, Homo sapiens
gtaggcagaccagtggatgggt

SEQ ID NO: 9269603 - DNA, 22 bp, Homo sapiens
gtaggcagaataattcctcctt

SEQ ID NO: 9269604 - DNA, 22 bp, Homo sapiens
gtagggttggagagcacaacca

SEQ ID NO: 9269605 - DNA, 22 bp, Homo sapiens
gtaggggtgctgagatctggaa

SEQ ID NO: 9269606 - DNA, 22 bp, Homo sapiens
gtacaatagcagttttcccttt

SEQ ID NO: 9269607 - DNA, 22 bp, Homo sapiens
gtacaatagcagttttcccttt

SEQ ID NO: 9269608 - DNA, 22 bp, Homo sapiens
gtacaatagtccctgtttggat

SEQ ID NO: 9269609 - DNA, 22 bp, Homo sapiens
gtattttcatgatttcagacca

SEQ ID NO: 9269610 - DNA, 22 bp, Homo sapiens
gtatttttaggtaaggaaagta

SEQ ID NO: 9269611 - DNA, 22 bp, Homo sapiens
gtattttatggcctggggccta

SEQ ID NO: 9269612 - DNA, 22 bp, Homo sapiens
gtatacatagatgatgaacaag

SEQ ID NO: 9269613 - DNA, 22 bp, Homo sapiens
gtatacatacttctagattaaa

SEQ ID NO: 9269614 - DNA, 22 bp, Homo sapiens
gtatttccctgagttctgtgag

SEQ ID NO: 9269615 - DNA, 22 bp, Homo sapiens
gtatacatagatgatgaacaag

SEQ ID NO: 9269616 - DNA, 22 bp, Homo sapiens
gtatttcccccagactccctgg

SEQ ID NO: 9269617 - DNA, 22 bp, Homo sapiens
gtatttcctatagtgagggcct

SEQ ID NO: 9269618 - DNA, 22 bp, Homo sapiens
gtatttcctcgcttgtgggatt

SEQ ID NO: 9269619 - DNA, 22 bp, Homo sapiens
gtattttatggcatgcagtggc

SEQ ID NO: 9269620 - DNA, 22 bp, Homo sapiens
gtattttatggcatgcagtggc

SEQ ID NO: 9269621 - DNA, 20 bp, Homo sapiens
gtataagatttcacacatta

SEQ ID NO: 9269622 - DNA, 22 bp, Homo sapiens
gtataaagtataagcttgtttt

SEQ ID NO: 9269623 - DNA, 22 bp, Homo sapiens
gtatacagatacttagacgtgc

SEQ ID NO: 9269624 - DNA, 22 bp, Homo sapiens
gtatacaatacacaatgctctg

SEQ ID NO: 9269625 - DNA, 22 bp, Homo sapiens
gtagttctgcagtgtcacctga

SEQ ID NO: 9269626 - DNA, 22 bp, Homo sapiens
gtataaacatggagtgcattct

SEQ ID NO: 9269627 - DNA, 22 bp, Homo sapiens
gtatttttagtagagtcggggt

SEQ ID NO: 9269628 - DNA, 22 bp, Homo sapiens
gtatttttcagttaggagctta

SEQ ID NO: 9269629 - DNA, 22 bp, Homo sapiens
gtatttttcagttaggagctta

SEQ ID NO: 9269630 - DNA, 22 bp, Homo sapiens
gtatttttcagttaggagctta

SEQ ID NO: 9269631 - DNA, 22 bp, Homo sapiens
gtatttttaggtaaggaaagta

SEQ ID NO: 9269632 - DNA, 22 bp, Homo sapiens
gtatttttaggtaaggaaagta

SEQ ID NO: 9269633 - DNA, 22 bp, Homo sapiens
gtatttttagtagagtcggggt

SEQ ID NO: 9269634 - DNA, 22 bp, Homo sapiens
gtatttttcattccaagtgaga

SEQ ID NO: 9269635 - DNA, 22 bp, Homo sapiens
gtatttttcattccaagtgaga

SEQ ID NO: 9269636 - DNA, 22 bp, Homo sapiens
gtcaaaaagtagtcatttctgt

SEQ ID NO: 9269637 - DNA, 22 bp, Homo sapiens
gtcaaaacaaagttaagaattc

SEQ ID NO: 9269638 - DNA, 22 bp, Homo sapiens
gtcaaaaagtagtcatttctgt

SEQ ID NO: 9269639 - DNA, 22 bp, Homo sapiens
gtatttttcattccaagtgaga

SEQ ID NO: 9269640 - DNA, 22 bp, Homo sapiens
gtcaaaatgagctttgttattg

SEQ ID NO: 9269641 - DNA, 22 bp, Homo sapiens
gtcacccactccctgctgctgt

SEQ ID NO: 9269642 - DNA, 19 bp, Homo sapiens
gtccagcctttgggtctta

SEQ ID NO: 9269643 - DNA, 22 bp, Homo sapiens
gtcagaggaggctgagtaggaa

SEQ ID NO: 9269644 - DNA, 18 bp, Homo sapiens
gtcacctggatcagatta

SEQ ID NO: 9269645 - DNA, 22 bp, Homo sapiens
gtcactgcctcttaactttttc

SEQ ID NO: 9269646 - DNA, 22 bp, Homo sapiens
gtcagaaaccagtcaaacaaga

SEQ ID NO: 9269647 - DNA, 22 bp, Homo sapiens
gtccaggccatggtggacacag

SEQ ID NO: 9269648 - DNA, 22 bp, Homo sapiens
gtcctctgcttcatgccctgat

SEQ ID NO: 9269649 - DNA, 22 bp, Homo sapiens
gtcctctgggcagctgccccac

SEQ ID NO: 9269650 - DNA, 22 bp, Homo sapiens
gtcctctgggagccttgagcct

SEQ ID NO: 9269651 - DNA, 22 bp, Homo sapiens
gtcctctgggagccttgagcct

SEQ ID NO: 9269652 - DNA, 22 bp, Homo sapiens
gtcctggcttagttcgctgtaa

SEQ ID NO: 9269653 - DNA, 22 bp, Homo sapiens
gtcctgggaactggacagctaa

SEQ ID NO: 9269654 - DNA, 22 bp, Homo sapiens
gtcctggattgaacataggcag

SEQ ID NO: 9269655 - DNA, 22 bp, Homo sapiens
gtcctctgtagggctgggccac

SEQ ID NO: 9269656 - DNA, 22 bp, Homo sapiens
gtcctctggtgaaagcattccc

SEQ ID NO: 9269657 - DNA, 22 bp, Homo sapiens
gtcctgcacatggagggcaatg

SEQ ID NO: 9269658 - DNA, 22 bp, Homo sapiens
gtctccagatatcctacacaac

SEQ ID NO: 9269659 - DNA, 22 bp, Homo sapiens
gtctccagaggttacatcctgt

SEQ ID NO: 9269660 - DNA, 22 bp, Homo sapiens
gtctccagaggttacatcctgt

SEQ ID NO: 9269661 - DNA, 22 bp, Homo sapiens
gtctccagaagcctagacagcc

SEQ ID NO: 9269662 - DNA, 22 bp, Homo sapiens
gtctataagcaggggaaaactt

SEQ ID NO: 9269663 - DNA, 22 bp, Homo sapiens
gtctatgatattttgttatagc

SEQ ID NO: 9269664 - DNA, 22 bp, Homo sapiens
gtctatgatattttgttatagc

SEQ ID NO: 9269665 - DNA, 22 bp, Homo sapiens
gtctatgatattttgttatagc

SEQ ID NO: 9269666 - DNA, 20 bp, Homo sapiens
gtctacacgggcagtgtaga

SEQ ID NO: 9269667 - DNA, 23 bp, Homo sapiens
gtctttatagtggggcactttgt

SEQ ID NO: 9269668 - DNA, 22 bp, Homo sapiens
gtctttatatttactaaagaat

SEQ ID NO: 9269669 - DNA, 20 bp, Homo sapiens
gtctttatgttttatgacct

SEQ ID NO: 9269670 - DNA, 22 bp, Homo sapiens
gtcttgtttgggatgtggatgg

SEQ ID NO: 9269671 - DNA, 20 bp, Homo sapiens
gtcttgtagctcaagttatt

SEQ ID NO: 9269672 - DNA, 22 bp, Homo sapiens
gtctttagagctcctggcatct

SEQ ID NO: 9269673 - DNA, 22 bp, Homo sapiens
gtctttagttgaaacatgtggt

SEQ ID NO: 9269674 - DNA, 22 bp, Homo sapiens
gtctccagtgttcaggtgactg

SEQ ID NO: 9269675 - DNA, 22 bp, Homo sapiens
gtctccagtgttcaggtgactg

SEQ ID NO: 9269676 - DNA, 22 bp, Homo sapiens
gtctccagggctgctggcgcct

SEQ ID NO: 9269677 - DNA, 22 bp, Homo sapiens
gtctccagggacacactagccg

SEQ ID NO: 9269678 - DNA, 22 bp, Homo sapiens
gtctccagggctgctggcgcct

SEQ ID NO: 9269679 - DNA, 22 bp, Homo sapiens
gtctccagttacagcagccagg

SEQ ID NO: 9269680 - DNA, 22 bp, Homo sapiens
gtctccagttacagcagccagg

SEQ ID NO: 9269681 - DNA, 21 bp, Homo sapiens
gtcttttaagtgaagagaggc

SEQ ID NO: 9269682 - DNA, 22 bp, Homo sapiens
gtctttctatgcatagagcaga

SEQ ID NO: 9269683 - DNA, 22 bp, Homo sapiens
gtctttctatgcatagagcaga

SEQ ID NO: 9269684 - DNA, 22 bp, Homo sapiens
gtctttctatgatgaactgttg

SEQ ID NO: 9269685 - DNA, 21 bp, Homo sapiens
gtctttctacctctatgtggc

SEQ ID NO: 9269686 - DNA, 22 bp, Homo sapiens
gtcttttttacaccttacatca

SEQ ID NO: 9269687 - DNA, 22 bp, Homo sapiens
gtcttttttacaccttacatca

SEQ ID NO: 9269688 - DNA, 22 bp, Homo sapiens
gtcttttttacaccttacatca

SEQ ID NO: 9269689 - DNA, 22 bp, Homo sapiens
gtgaaaaatcatcatgacttga

SEQ ID NO: 9269690 - DNA, 22 bp, Homo sapiens
gtgaggactggtaaggactgca

SEQ ID NO: 9269691 - DNA, 22 bp, Homo sapiens
gtgaggagggctggtcccaggc

SEQ ID NO: 9269692 - DNA, 22 bp, Homo sapiens
gtgaggagggctggtcccaggc

SEQ ID NO: 9269693 - DNA, 22 bp, Homo sapiens
gtgaggagctgacactggggtg

SEQ ID NO: 9269694 - DNA, 22 bp, Homo sapiens
gtgaggagctctttgactcacg

SEQ ID NO: 9269695 - DNA, 22 bp, Homo sapiens
gtgaggagctgacactggggtg

SEQ ID NO: 9269696 - DNA, 22 bp, Homo sapiens
gtgagcagttgtataaagactt

SEQ ID NO: 9269697 - DNA, 22 bp, Homo sapiens
gtgagccgagtatagttcatag

SEQ ID NO: 9269698 - DNA, 22 bp, Homo sapiens
gtgagctggaatagtggagaaa

SEQ ID NO: 9269699 - DNA, 22 bp, Homo sapiens
gtgagctgttggagtggcagag

SEQ ID NO: 9269700 - DNA, 22 bp, Homo sapiens
gtgagctggaatagtggagaaa

SEQ ID NO: 9269701 - DNA, 22 bp, Homo sapiens
gtgagctggaatagtggagaaa

SEQ ID NO: 9269702 - DNA, 22 bp, Homo sapiens
gtgagctgggtgaatggtaggg

SEQ ID NO: 9269703 - DNA, 22 bp, Homo sapiens
gtgcccacgaggccaggctggt

SEQ ID NO: 9269704 - DNA, 22 bp, Homo sapiens
gtgccaggtgctaagctgtgct

SEQ ID NO: 9269705 - DNA, 22 bp, Homo sapiens
gtgccagggggcactgaacaga

SEQ ID NO: 9269706 - DNA, 22 bp, Homo sapiens
gtgccagggggcactgaacaga

SEQ ID NO: 9269707 - DNA, 18 bp, Homo sapiens
gtgccaggaggcgcagcc

SEQ ID NO: 9269708 - DNA, 22 bp, Homo sapiens
gtgccaggcccagggagcgggg

SEQ ID NO: 9269709 - DNA, 22 bp, Homo sapiens
gtgccagggagtggaggagctt

SEQ ID NO: 9269710 - DNA, 22 bp, Homo sapiens
gtgctgccggcatagcagtgaa

SEQ ID NO: 9269711 - DNA, 22 bp, Homo sapiens
gtgctgcctgccagcttctggg

SEQ ID NO: 9269712 - DNA, 22 bp, Homo sapiens
gtgctgaagtgaaattcatcaa

SEQ ID NO: 9269713 - DNA, 22 bp, Homo sapiens
gtgcccaggcccaaggcaccac

SEQ ID NO: 9269714 - DNA, 22 bp, Homo sapiens
gtgcccaggcccaaggcaccac

SEQ ID NO: 9269715 - DNA, 22 bp, Homo sapiens
gtgctgaattgtgctctttaca

SEQ ID NO: 9269716 - DNA, 22 bp, Homo sapiens
gtgctgaatccactcttaggaa

SEQ ID NO: 9269717 - DNA, 22 bp, Homo sapiens
gtgctgacaggagcctggcggt

SEQ ID NO: 9269718 - DNA, 22 bp, Homo sapiens
gtgctgagtgcagagtgcagag

SEQ ID NO: 9269719 - DNA, 22 bp, Homo sapiens
gtgctgagaacaaaagtggaca

SEQ ID NO: 9269720 - DNA, 20 bp, Homo sapiens
gtgctgagtgaaatgagatt

SEQ ID NO: 9269721 - DNA, 20 bp, Homo sapiens
gtgctgagtgaaatgagatt

SEQ ID NO: 9269722 - DNA, 17 bp, Homo sapiens
gtgcagggatgaaggat

SEQ ID NO: 9269723 - DNA, 22 bp, Homo sapiens
gtgcagggcagccgaatgggct

SEQ ID NO: 9269724 - DNA, 22 bp, Homo sapiens
gtgcagggcaggtgtccttcca

SEQ ID NO: 9269725 - DNA, 22 bp, Homo sapiens
gtgcagggctggcaccggaggc

SEQ ID NO: 9269726 - DNA, 22 bp, Homo sapiens
gtgcagggctggcaccggaggc

SEQ ID NO: 9269727 - DNA, 22 bp, Homo sapiens
gtgccagcagttatggtgattt

SEQ ID NO: 9269728 - DNA, 22 bp, Homo sapiens
gtgccagcagttatggtgattt

SEQ ID NO: 9269729 - DNA, 22 bp, Homo sapiens
gtgcaggggatcaggttgcagc

SEQ ID NO: 9269730 - DNA, 22 bp, Homo sapiens
gtgcagggtagcgacggcagga

SEQ ID NO: 9269731 - DNA, 22 bp, Homo sapiens
gtgcaggggcctccccttgctg

SEQ ID NO: 9269732 - DNA, 22 bp, Homo sapiens
gtgaggcagcaggagcctctgt

SEQ ID NO: 9269733 - DNA, 22 bp, Homo sapiens
gtgaggcaggcattctcctttc

SEQ ID NO: 9269734 - DNA, 22 bp, Homo sapiens
gtgaggcagggaaagaggataa

SEQ ID NO: 9269735 - DNA, 22 bp, Homo sapiens
gtgcagcaaactagtgcgaggg

SEQ ID NO: 9269736 - DNA, 22 bp, Homo sapiens
gtgcagcaaagtttgagatata

SEQ ID NO: 9269737 - DNA, 22 bp, Homo sapiens
gtgaggagtctgaagcacataa

SEQ ID NO: 9269738 - DNA, 22 bp, Homo sapiens
gtgaggatcaaatgaaatagca

SEQ ID NO: 9269739 - DNA, 22 bp, Homo sapiens
gtgaggatgcagatgagggcct

SEQ ID NO: 9269740 - DNA, 22 bp, Homo sapiens
gtgaggattgctctggagaatt

SEQ ID NO: 9269741 - DNA, 22 bp, Homo sapiens
gtgaggcagaagttccctttta

SEQ ID NO: 9269742 - DNA, 20 bp, Homo sapiens
gtgcagcacttgggggtagg

SEQ ID NO: 9269743 - DNA, 22 bp, Homo sapiens
gtgcaggaggtaacatagcaaa

SEQ ID NO: 9269744 - DNA, 22 bp, Homo sapiens
gtgcaggatctcagaacaagtg

SEQ ID NO: 9269745 - DNA, 22 bp, Homo sapiens
gtgcaggatgttgggaatcagg

SEQ ID NO: 9269746 - DNA, 22 bp, Homo sapiens
gtgcaggatttatagcccagct

SEQ ID NO: 9269747 - DNA, 22 bp, Homo sapiens
gtgcaggcattgggctagccat

SEQ ID NO: 9269748 - DNA, 22 bp, Homo sapiens
gtgcagggagcccagaaggtcc

SEQ ID NO: 9269749 - DNA, 19 bp, Homo sapiens
gcatttcaggcatgtttgc

SEQ ID NO: 9269750 - DNA, 22 bp, Homo sapiens
gcattgattctgaagtgaaatg

SEQ ID NO: 9269751 - DNA, 22 bp, Homo sapiens
gcattgatctttattctgcttt

SEQ ID NO: 9269752 - DNA, 22 bp, Homo sapiens
gcatttaaatttgaacttcaga

SEQ ID NO: 9269753 - DNA, 22 bp, Homo sapiens
gcatttaaatttgaacttcaga

SEQ ID NO: 9269754 - DNA, 22 bp, Homo sapiens
gccacctccttattccacctgt

SEQ ID NO: 9269755 - DNA, 22 bp, Homo sapiens
gccacctcggctttctctgctc

SEQ ID NO: 9269756 - DNA, 22 bp, Homo sapiens
gccacctctctcttgactcgag

SEQ ID NO: 9269757 - DNA, 22 bp, Homo sapiens
gccacctgtttcgcttgcccag

SEQ ID NO: 9269758 - DNA, 22 bp, Homo sapiens
gccacctggacagctgtgccct

SEQ ID NO: 9269759 - DNA, 22 bp, Homo sapiens
gcattaatgtaagacccactcc

SEQ ID NO: 9269760 - DNA, 22 bp, Homo sapiens
gcattagaaactattgctgcaa

SEQ ID NO: 9269761 - DNA, 19 bp, Homo sapiens
gcataaaatgtcaatgtgt

SEQ ID NO: 9269762 - DNA, 19 bp, Homo sapiens
gcataaaatgtcaatgtgt

SEQ ID NO: 9269763 - DNA, 19 bp, Homo sapiens
gcataaaatgtcaatgtgt

SEQ ID NO: 9269764 - DNA, 22 bp, Homo sapiens
gcagttttattatgatggaaat

SEQ ID NO: 9269765 - DNA, 22 bp, Homo sapiens
gcagttttagagctttaagatg

SEQ ID NO: 9269766 - DNA, 22 bp, Homo sapiens
gcattgaatcctatcaggcaaa

SEQ ID NO: 9269767 - DNA, 20 bp, Homo sapiens
gcattgagtatagacagatg

SEQ ID NO: 9269768 - DNA, 22 bp, Homo sapiens
gcattgagtccactctgtcttt

SEQ ID NO: 9269769 - DNA, 22 bp, Homo sapiens
gcattcttcgaagtaagtagtg

SEQ ID NO: 9269770 - DNA, 22 bp, Homo sapiens
gcattcttggtatgaaggacag

SEQ ID NO: 9269771 - DNA, 22 bp, Homo sapiens
gcattcttcgaagtaagtagtg

SEQ ID NO: 9269772 - DNA, 23 bp, Homo sapiens
gcagtgtttgcttcatcttatcc

SEQ ID NO: 9269773 - DNA, 22 bp, Homo sapiens
gcagtgtttggatccatagcga

SEQ ID NO: 9269774 - DNA, 22 bp, Homo sapiens
gcagtgtttcagtgctttttct

SEQ ID NO: 9269775 - DNA, 22 bp, Homo sapiens
gcagtgtttcccagagatggaa

SEQ ID NO: 9269776 - DNA, 22 bp, Homo sapiens
gcagtgtttacatattagaaac

SEQ ID NO: 9269777 - DNA, 22 bp, Homo sapiens
gcagtgtttcaaatcaaaggca

SEQ ID NO: 9269778 - DNA, 22 bp, Homo sapiens
gcagtgttgttaaaagattaga

SEQ ID NO: 9269779 - DNA, 22 bp, Homo sapiens
gcagtgttgtgatccaggtctt

SEQ ID NO: 9269780 - DNA, 22 bp, Homo sapiens
gcagtgttgctaggtgcggtga

SEQ ID NO: 9269781 - DNA, 22 bp, Homo sapiens
gcaggtggaagcagcagactca

SEQ ID NO: 9269782 - DNA, 22 bp, Homo sapiens
gcagtgttggtttgctctgcag

SEQ ID NO: 9269783 - DNA, 22 bp, Homo sapiens
gcagtgttggcaggatggggct

SEQ ID NO: 9269784 - DNA, 22 bp, Homo sapiens
gcaggtgattcaccctgggcct

SEQ ID NO: 9269785 - DNA, 18 bp, Homo sapiens
gcaggtgccactgctgtt

SEQ ID NO: 9269786 - DNA, 18 bp, Homo sapiens
gcaggtgccactgctgtt

SEQ ID NO: 9269787 - DNA, 18 bp, Homo sapiens
gcaggtgccactgctgtt

SEQ ID NO: 9269788 - DNA, 22 bp, Homo sapiens
gcagtgtttgtgttctcacatg

SEQ ID NO: 9269789 - DNA, 22 bp, Homo sapiens
gcagtgttttacagaccagcat

SEQ ID NO: 9269790 - DNA, 22 bp, Homo sapiens
gcagtgtttttcaatgcttcca

SEQ ID NO: 9269791 - DNA, 22 bp, Homo sapiens
gcagttaaaaataaaccttcat

SEQ ID NO: 9269792 - DNA, 17 bp, Homo sapiens
gcagttaaattaagatg

SEQ ID NO: 9269793 - DNA, 23 bp, Homo sapiens
gcagttagtccactttgcagaga

SEQ ID NO: 9269794 - DNA, 22 bp, Homo sapiens
gccagagacacttggaggtaga

SEQ ID NO: 9269795 - DNA, 22 bp, Homo sapiens
gccagacactcccctgggcagg

SEQ ID NO: 9269796 - DNA, 22 bp, Homo sapiens
gccagaagcacatgagaggtga

SEQ ID NO: 9269797 - DNA, 22 bp, Homo sapiens
gccagaaggggtggatccaggc

SEQ ID NO: 9269798 - DNA, 22 bp, Homo sapiens
gccagaagactggagtcagctg

SEQ ID NO: 9269799 - DNA, 22 bp, Homo sapiens
gccagctggtaggcacctagcc

SEQ ID NO: 9269800 - DNA, 22 bp, Homo sapiens
gccagctggtaggcacctagcc

SEQ ID NO: 9269801 - DNA, 21 bp, Homo sapiens
gccagctgggtcttgcaggag

SEQ ID NO: 9269802 - DNA, 22 bp, Homo sapiens
gccagctgaggccgtgcaggct

SEQ ID NO: 9269803 - DNA, 22 bp, Homo sapiens
gccagctgtaagctggggtgat

SEQ ID NO: 9269804 - DNA, 22 bp, Homo sapiens
gccagctgtaggtggtgggttg

SEQ ID NO: 9269805 - DNA, 22 bp, Homo sapiens
gccagctgtctaagagagtaaa

SEQ ID NO: 9269806 - DNA, 22 bp, Homo sapiens
gccagctgtgcttttcctaaaa

SEQ ID NO: 9269807 - DNA, 22 bp, Homo sapiens
gccaggcatgtcctctgcagaa

SEQ ID NO: 9269808 - DNA, 20 bp, Homo sapiens
gcccaagcgccggccgcaga

SEQ ID NO: 9269809 - DNA, 22 bp, Homo sapiens
gcccaagctggactgcagtggc

SEQ ID NO: 9269810 - DNA, 22 bp, Homo sapiens
gcccaagccggagctgggagag

SEQ ID NO: 9269811 - DNA, 22 bp, Homo sapiens
gcccaagccgccttccagagac

SEQ ID NO: 9269812 - DNA, 20 bp, Homo sapiens
gcccaaggtccagaaggggg

SEQ ID NO: 9269813 - DNA, 20 bp, Homo sapiens
gcccaaggtccagaaggggg

SEQ ID NO: 9269814 - DNA, 22 bp, Homo sapiens
gcccaaggtcacacacaggaag

SEQ ID NO: 9269815 - DNA, 22 bp, Homo sapiens
gcccaaggtcacacacaggaag

SEQ ID NO: 9269816 - DNA, 22 bp, Homo sapiens
gcccaaggtatatcagagacag

SEQ ID NO: 9269817 - DNA, 22 bp, Homo sapiens
gccaggctctcagtgactgccc

SEQ ID NO: 9269818 - DNA, 21 bp, Homo sapiens
gccatttcacacagacatttg

SEQ ID NO: 9269819 - DNA, 23 bp, Homo sapiens
gccaggctccggtctgtggccac

SEQ ID NO: 9269820 - DNA, 23 bp, Homo sapiens
gccaggctccggtctgtggccac

SEQ ID NO: 9269821 - DNA, 22 bp, Homo sapiens
gcccaaagagctttgatctcag

SEQ ID NO: 9269822 - DNA, 22 bp, Homo sapiens
gcccaaagccagtgtgctctcc

SEQ ID NO: 9269823 - DNA, 22 bp, Homo sapiens
gcccaaagtcactcagctagga

SEQ ID NO: 9269824 - DNA, 22 bp, Homo sapiens
gcccaagatctggagctgcagg

SEQ ID NO: 9269825 - DNA, 22 bp, Homo sapiens
gcccaagatcacactggaaatc

SEQ ID NO: 9269826 - DNA, 22 bp, Homo sapiens
gcccaagagagcgaaggttggc

SEQ ID NO: 9269827 - DNA, 23 bp, Homo sapiens
gccaggctccggtctgtggccac

SEQ ID NO: 9269828 - DNA, 23 bp, Homo sapiens
gccaggctccggtctgtggccac

SEQ ID NO: 9269829 - DNA, 22 bp, Homo sapiens
gccaggctccccggatccctgg

SEQ ID NO: 9269830 - DNA, 22 bp, Homo sapiens
gccaggctccccggatccctgg

SEQ ID NO: 9269831 - DNA, 22 bp, Homo sapiens
gccaggctccccggatccctgg

SEQ ID NO: 9269832 - DNA, 22 bp, Homo sapiens
gccaggctccccggatccctgg

SEQ ID NO: 9269833 - DNA, 22 bp, Homo sapiens
gccaggctccccggatccctgg

SEQ ID NO: 9269834 - DNA, 22 bp, Homo sapiens
gccaggctccaggccctcctga

SEQ ID NO: 9269835 - DNA, 22 bp, Homo sapiens
gccaggctccaggccctcctga

SEQ ID NO: 9269836 - DNA, 22 bp, Homo sapiens
gccaggctcagtagcgattcct

SEQ ID NO: 9269837 - DNA, 22 bp, Homo sapiens
gccaggctccaggccctcctga

SEQ ID NO: 9269838 - DNA, 22 bp, Homo sapiens
gccaggctccaggccctcctga

SEQ ID NO: 9269839 - DNA, 22 bp, Homo sapiens
gccaggctccaggccctcctga

SEQ ID NO: 9269840 - DNA, 19 bp, Homo sapiens
gccaggctccatagccggc

SEQ ID NO: 9269841 - DNA, 19 bp, Homo sapiens
gccaggctccatagccggc

SEQ ID NO: 9269842 - DNA, 19 bp, Homo sapiens
gccaggctccatagccggc

SEQ ID NO: 9269843 - DNA, 22 bp, Homo sapiens
gccaggctaagaaaggtgtgat

SEQ ID NO: 9269844 - DNA, 22 bp, Homo sapiens
gccaggcattattccgatccct

SEQ ID NO: 9269845 - DNA, 22 bp, Homo sapiens
gccaggctcagtagcgattcct

SEQ ID NO: 9269846 - DNA, 22 bp, Homo sapiens
gccaggctcagtagcgattcct

SEQ ID NO: 9269847 - DNA, 22 bp, Homo sapiens
gccaggctcagcagtcaacctg

SEQ ID NO: 9269848 - DNA, 22 bp, Homo sapiens
gccaggctcagcagtcaacctg

SEQ ID NO: 9269849 - DNA, 22 bp, Homo sapiens
gccaggctaagaaaggtgtgat

SEQ ID NO: 9269850 - DNA, 22 bp, Homo sapiens
gccaggctcagcagtcaacctg

SEQ ID NO: 9269851 - DNA, 22 bp, Homo sapiens
gccaggctaagaaaggtgtgat

SEQ ID NO: 9269852 - DNA, 22 bp, Homo sapiens
gccaggctaagaaaggtgtgat

SEQ ID NO: 9269853 - DNA, 22 bp, Homo sapiens
gccaggctaagaaaggtgtgat

SEQ ID NO: 9269854 - DNA, 22 bp, Homo sapiens
gcctggagacagcagaggcggc

SEQ ID NO: 9269855 - DNA, 22 bp, Homo sapiens
gcctggagaattaaaaggaagg

SEQ ID NO: 9269856 - DNA, 22 bp, Homo sapiens
gcctggagacaaggacaaaggg

SEQ ID NO: 9269857 - DNA, 22 bp, Homo sapiens
gcctggagaagatggaactagc

SEQ ID NO: 9269858 - DNA, 22 bp, Homo sapiens
gcctggagaaaggaaggtggga

SEQ ID NO: 9269859 - DNA, 21 bp, Homo sapiens
gcctgcagttttgaagccctt

SEQ ID NO: 9269860 - DNA, 22 bp, Homo sapiens
gcctgcagtgagtgcagaaggt

SEQ ID NO: 9269861 - DNA, 22 bp, Homo sapiens
gcctgcagtgagtgcagaaggt

SEQ ID NO: 9269862 - DNA, 23 bp, Homo sapiens
gcctggagaaaagctgcagttca

SEQ ID NO: 9269863 - DNA, 23 bp, Homo sapiens
gcctggagaaaagctgcagttca

SEQ ID NO: 9269864 - DNA, 22 bp, Homo sapiens
gcctgcagggcctgggcctacc

SEQ ID NO: 9269865 - DNA, 22 bp, Homo sapiens
gcctgcagggtgatgggctgcc

SEQ ID NO: 9269866 - DNA, 22 bp, Homo sapiens
gcctgcagggtgatgggctgcc

SEQ ID NO: 9269867 - DNA, 22 bp, Homo sapiens
gcctggagtgcagtggcgtgat

SEQ ID NO: 9269868 - DNA, 22 bp, Homo sapiens
gcctggagtggacttggcccct

SEQ ID NO: 9269869 - DNA, 22 bp, Homo sapiens
gcctggagtgcagtggcgtgat

SEQ ID NO: 9269870 - DNA, 22 bp, Homo sapiens
gcctggagtggacttggcccct

SEQ ID NO: 9269871 - DNA, 16 bp, Homo sapiens
gcctggagtggcaggg

SEQ ID NO: 9269872 - DNA, 22 bp, Homo sapiens
gcctggagcccagtgtggggct

SEQ ID NO: 9269873 - DNA, 22 bp, Homo sapiens
gcctggagcccagtgtggggct

SEQ ID NO: 9269874 - DNA, 22 bp, Homo sapiens
gcctggagtagcatggcaagcc

SEQ ID NO: 9269875 - DNA, 22 bp, Homo sapiens
gcctggagagcactgtgcgctt

SEQ ID NO: 9269876 - DNA, 22 bp, Homo sapiens
gcctggagcagacgtgtcccgg

SEQ ID NO: 9269877 - DNA, 22 bp, Homo sapiens
gcctggagaggaagccggtgga

SEQ ID NO: 9269878 - DNA, 22 bp, Homo sapiens
gcctggagaggaagccggtgga

SEQ ID NO: 9269879 - DNA, 22 bp, Homo sapiens
gcctccctgagtcacccaagca

SEQ ID NO: 9269880 - DNA, 22 bp, Homo sapiens
gcctccctggcccacagcagcg

SEQ ID NO: 9269881 - DNA, 22 bp, Homo sapiens
gcctccctccaccactgcaggt

SEQ ID NO: 9269882 - DNA, 18 bp, Homo sapiens
gcctccctggctacactt

SEQ ID NO: 9269883 - DNA, 22 bp, Homo sapiens
gcctccctgttcttccacaata

SEQ ID NO: 9269884 - DNA, 22 bp, Homo sapiens
gcctgagggctcctagcaggct

SEQ ID NO: 9269885 - DNA, 22 bp, Homo sapiens
gcctgagggctcctagcaggct

SEQ ID NO: 9269886 - DNA, 22 bp, Homo sapiens
gcctgagggctcctagcaggct

SEQ ID NO: 9269887 - DNA, 22 bp, Homo sapiens
gcctgagggctcctagcaggct

SEQ ID NO: 9269888 - DNA, 22 bp, Homo sapiens
gcctgaggaatgctcctgactt

SEQ ID NO: 9269889 - DNA, 22 bp, Homo sapiens
gcctgcaagatggctggtcact

SEQ ID NO: 9269890 - DNA, 19 bp, Homo sapiens
gcctgcagaaaaggcaggg

SEQ ID NO: 9269891 - DNA, 22 bp, Homo sapiens
gcctgcagaactgtgaggcaat

SEQ ID NO: 9269892 - DNA, 20 bp, Homo sapiens
gcctgcagagaaggtcagag

SEQ ID NO: 9269893 - DNA, 22 bp, Homo sapiens
gcctgcagaggtgctgctagct

SEQ ID NO: 9269894 - DNA, 22 bp, Homo sapiens
gcctgcagcccctctgcagtag

SEQ ID NO: 9269895 - DNA, 22 bp, Homo sapiens
gcctgcagggcctgggcctacc

SEQ ID NO: 9269896 - DNA, 22 bp, Homo sapiens
gcctgcagcctcagagaatttt

SEQ ID NO: 9269897 - DNA, 22 bp, Homo sapiens
gcctcagtctcccgagtagctg

SEQ ID NO: 9269898 - DNA, 22 bp, Homo sapiens
gcctcaggtgcatctctcattc

SEQ ID NO: 9269899 - DNA, 22 bp, Homo sapiens
gcctcagtgtcctcctccatgt

SEQ ID NO: 9269900 - DNA, 22 bp, Homo sapiens
gcctcagtgatatgtgggacaa

SEQ ID NO: 9269901 - DNA, 22 bp, Homo sapiens
gcctcagttgatctgtgtgagc

SEQ ID NO: 9269902 - DNA, 19 bp, Homo sapiens
gcctcatttccacctcccc

SEQ ID NO: 9269903 - DNA, 20 bp, Homo sapiens
gcctccacactcacccctta

SEQ ID NO: 9269904 - DNA, 22 bp, Homo sapiens
gcctcagggggagaggccagct

SEQ ID NO: 9269905 - DNA, 22 bp, Homo sapiens
gcctcaggtaaaacttgagttt

SEQ ID NO: 9269906 - DNA, 22 bp, Homo sapiens
gcctcaggtaaaacttgagttt

SEQ ID NO: 9269907 - DNA, 22 bp, Homo sapiens
gccctgctgtcttcagagtata

SEQ ID NO: 9269908 - DNA, 23 bp, Homo sapiens
gccctgctgggacctcctgctac

SEQ ID NO: 9269909 - DNA, 22 bp, Homo sapiens
gccctgctctggtctctgcccg

SEQ ID NO: 9269910 - DNA, 17 bp, Homo sapiens
gccctgcctgctgccct

SEQ ID NO: 9269911 - DNA, 22 bp, Homo sapiens
gcccacagctcgttcctctcct

SEQ ID NO: 9269912 - DNA, 22 bp, Homo sapiens
gcccacagctcgttcctctcct

SEQ ID NO: 9269913 - DNA, 22 bp, Homo sapiens
gcccacagaggcaccaccaggc

SEQ ID NO: 9269914 - DNA, 22 bp, Homo sapiens
gcccacagaggcaccaccaggc

SEQ ID NO: 9269915 - DNA, 22 bp, Homo sapiens
gcccacaggggacctggtggct

SEQ ID NO: 9269916 - DNA, 22 bp, Homo sapiens
gcccacaggggacctggtggct

SEQ ID NO: 9269917 - DNA, 22 bp, Homo sapiens
gcccaaggtcccatggcagcac

SEQ ID NO: 9269918 - DNA, 22 bp, Homo sapiens
gcccacacaccagctcaggagg

SEQ ID NO: 9269919 - DNA, 22 bp, Homo sapiens
gcccctccatccatcaccgggg

SEQ ID NO: 9269920 - DNA, 22 bp, Homo sapiens
gccccaggtggtaaacctaaga

SEQ ID NO: 9269921 - DNA, 22 bp, Homo sapiens
gcccctctccttgtgcacctgc

SEQ ID NO: 9269922 - DNA, 19 bp, Homo sapiens
gccctgagtaagctaggag

SEQ ID NO: 9269923 - DNA, 22 bp, Homo sapiens
gcaggtgaatgatggactagga

SEQ ID NO: 9269924 - DNA, 22 bp, Homo sapiens
gcaggtgaatgatggactagga

SEQ ID NO: 9269925 - DNA, 19 bp, Homo sapiens
gcagggtgttgactgtccc

SEQ ID NO: 9269926 - DNA, 19 bp, Homo sapiens
gcaggtcattaggctaggt

SEQ ID NO: 9269927 - DNA, 22 bp, Homo sapiens
gcaggtagtgatcgagggtgac

SEQ ID NO: 9269928 - DNA, 22 bp, Homo sapiens
gcaggtctagaagctgcctctg

SEQ ID NO: 9269929 - DNA, 22 bp, Homo sapiens
gcagggtgtgtctcatacagtt

SEQ ID NO: 9269930 - DNA, 19 bp, Homo sapiens
gcagggtgttgactgtccc

SEQ ID NO: 9269931 - DNA, 22 bp, Homo sapiens
gcagggccagtgcagagaggaa

SEQ ID NO: 9269932 - DNA, 22 bp, Homo sapiens
gcagggccagtgcagagaggaa

SEQ ID NO: 9269933 - DNA, 22 bp, Homo sapiens
gcagggccaggtacaagaagca

SEQ ID NO: 9269934 - DNA, 22 bp, Homo sapiens
gcagggccagggctcaggctgt

SEQ ID NO: 9269935 - DNA, 22 bp, Homo sapiens
gcagggcagtaagagctagagt

SEQ ID NO: 9269936 - DNA, 22 bp, Homo sapiens
gcaggcctaagagaaggcattg

SEQ ID NO: 9269937 - DNA, 22 bp, Homo sapiens
gcaggccctcctctagcaaggc

SEQ ID NO: 9269938 - DNA, 22 bp, Homo sapiens
gcaggcccttagccttggtggg

SEQ ID NO: 9269939 - DNA, 22 bp, Homo sapiens
gcagggcagctgaagctaggtg

SEQ ID NO: 9269940 - DNA, 22 bp, Homo sapiens
gcagggcagctgaagctaggtg

SEQ ID NO: 9269941 - DNA, 22 bp, Homo sapiens
gcagggcagcttagtccctgtc

SEQ ID NO: 9269942 - DNA, 22 bp, Homo sapiens
gcagggcagctcactgtggttc

SEQ ID NO: 9269943 - DNA, 22 bp, Homo sapiens
gcaggccattcaggagatgtgc

SEQ ID NO: 9269944 - DNA, 22 bp, Homo sapiens
gcaggccagctgtgcagatggg

SEQ ID NO: 9269945 - DNA, 22 bp, Homo sapiens
gcaggccagctgtgcagatggg

SEQ ID NO: 9269946 - DNA, 22 bp, Homo sapiens
gcaggccactgtctcctctggg

SEQ ID NO: 9269947 - DNA, 22 bp, Homo sapiens
gcaggccacagtggagtctctg

SEQ ID NO: 9269948 - DNA, 22 bp, Homo sapiens
gcaggccaagccctcgcagaga

SEQ ID NO: 9269949 - DNA, 22 bp, Homo sapiens
gcaggcatggtcgctgccaggt

SEQ ID NO: 9269950 - DNA, 22 bp, Homo sapiens
gcaggcagtttgcttttccctc

SEQ ID NO: 9269951 - DNA, 22 bp, Homo sapiens
gcaggcagttgcagttttctag

SEQ ID NO: 9269952 - DNA, 22 bp, Homo sapiens
gcagctgtcactttcacaatgc

SEQ ID NO: 9269953 - DNA, 17 bp, Homo sapiens
gcagccagtgcagcagg

SEQ ID NO: 9269954 - DNA, 17 bp, Homo sapiens
gcagccagtgcagcagg

SEQ ID NO: 9269955 - DNA, 17 bp, Homo sapiens
gcagccagtgcagcagg

SEQ ID NO: 9269956 - DNA, 22 bp, Homo sapiens
gcagcccaatggactgagacag

SEQ ID NO: 9269957 - DNA, 22 bp, Homo sapiens
gcagctggctcagagaggtggg

SEQ ID NO: 9269958 - DNA, 22 bp, Homo sapiens
gcagctgggacactgaggccag

SEQ ID NO: 9269959 - DNA, 22 bp, Homo sapiens
gcagctggggaggtcgtgggga

SEQ ID NO: 9269960 - DNA, 22 bp, Homo sapiens
gcagctgggccccagcctctcc

SEQ ID NO: 9269961 - DNA, 22 bp, Homo sapiens
gcagctgggccccagcctctcc

SEQ ID NO: 9269962 - DNA, 22 bp, Homo sapiens
gcagctggggccacacttaggc

SEQ ID NO: 9269963 - DNA, 22 bp, Homo sapiens
gcagctggggccacacttaggc

SEQ ID NO: 9269964 - DNA, 21 bp, Homo sapiens
gcagctggtctcagagcttgc

SEQ ID NO: 9269965 - DNA, 22 bp, Homo sapiens
gcagctggtctggcctagagta

SEQ ID NO: 9269966 - DNA, 22 bp, Homo sapiens
gcagctggtgcaaatgtcactc

SEQ ID NO: 9269967 - DNA, 23 bp, Homo sapiens
gcagctggttagaagggaaggag

SEQ ID NO: 9269968 - DNA, 23 bp, Homo sapiens
gcagctggttagaagggaaggag

SEQ ID NO: 9269969 - DNA, 22 bp, Homo sapiens
gcagcagcaggcgctcggccgt

SEQ ID NO: 9269970 - DNA, 22 bp, Homo sapiens
gcagcagaaggccaaggggagc

SEQ ID NO: 9269971 - DNA, 22 bp, Homo sapiens
gcagcagaaggccaaggggagc

SEQ ID NO: 9269972 - DNA, 22 bp, Homo sapiens
gcagcactgatcctaaacttag

SEQ ID NO: 9269973 - DNA, 22 bp, Homo sapiens
gcagcaatcttcacagtgtcat

SEQ ID NO: 9269974 - DNA, 22 bp, Homo sapiens
gcagcaagaggtttctgttgac

SEQ ID NO: 9269975 - DNA, 22 bp, Homo sapiens
gcagcaagtctagtttgtaggc

SEQ ID NO: 9269976 - DNA, 22 bp, Homo sapiens
gcagcagcccagggctctcaga

SEQ ID NO: 9269977 - DNA, 22 bp, Homo sapiens
gcagccaccctcaaggctgaat

SEQ ID NO: 9269978 - DNA, 21 bp, Homo sapiens
gcagccacagccaccaagcta

SEQ ID NO: 9269979 - DNA, 22 bp, Homo sapiens
gcagcagcccagggctctcaga

SEQ ID NO: 9269980 - DNA, 22 bp, Homo sapiens
gcagcagcccagggctctcaga

SEQ ID NO: 9269981 - DNA, 22 bp, Homo sapiens
gcagccagaagactcagaacaa

SEQ ID NO: 9269982 - DNA, 22 bp, Homo sapiens
gcagccactctcattccacgtg

SEQ ID NO: 9269983 - DNA, 22 bp, Homo sapiens
gcagccaccctcaaggctgaat

SEQ ID NO: 9269984 - DNA, 22 bp, Homo sapiens
gcagccactagttttcctgttt

SEQ ID NO: 9269985 - DNA, 22 bp, Homo sapiens
gcagccaggaaagctggaccct

SEQ ID NO: 9269986 - DNA, 22 bp, Homo sapiens
gcagccaggaaagctggaccct

SEQ ID NO: 9269987 - DNA, 21 bp, Homo sapiens
gcagccagccgagaccatgcc

SEQ ID NO: 9269988 - DNA, 22 bp, Homo sapiens
gcagccagcccctctgacctct

SEQ ID NO: 9269989 - DNA, 22 bp, Homo sapiens
gcagccagcccctctgacctct

SEQ ID NO: 9269990 - DNA, 22 bp, Homo sapiens
gcagccagcccctctgacctct

SEQ ID NO: 9269991 - DNA, 21 bp, Homo sapiens
gcagccagacgggattcagtt

SEQ ID NO: 9269992 - DNA, 21 bp, Homo sapiens
gcagccagacgggattcagtt

SEQ ID NO: 9269993 - DNA, 22 bp, Homo sapiens
gcagccagaagactcagaacaa

SEQ ID NO: 9269994 - DNA, 22 bp, Homo sapiens
gcacatggtaggcatttgatgt

SEQ ID NO: 9269995 - DNA, 22 bp, Homo sapiens
gcacatggacaatggaggtgca

SEQ ID NO: 9269996 - DNA, 22 bp, Homo sapiens
gcacatggacaatggaggtgca

SEQ ID NO: 9269997 - DNA, 22 bp, Homo sapiens
gcacagagtcactagctaagca

SEQ ID NO: 9269998 - DNA, 22 bp, Homo sapiens
gcacagcacagcaacatgtttt

SEQ ID NO: 9269999 - DNA, 20 bp, Homo sapiens
gcacatgcaacttttattta

SEQ ID NO: 9270000 - DNA, 22 bp, Homo sapiens
gcacagagacagtcctgagatc

SEQ ID NO: 9270001 - DNA, 22 bp, Homo sapiens
gcacagagacagtcctgagatc

SEQ ID NO: 9270002 - DNA, 20 bp, Homo sapiens
gcacagagatgagcaaagta

SEQ ID NO: 9270003 - DNA, 22 bp, Homo sapiens
gagtagggatgctggtgactcc

SEQ ID NO: 9270004 - DNA, 22 bp, Homo sapiens
gagtagacattaaattacactg

SEQ ID NO: 9270005 - DNA, 22 bp, Homo sapiens
gagtagggtttccaggttagag

SEQ ID NO: 9270006 - DNA, 22 bp, Homo sapiens
gcaaggagactgtagggccaag

SEQ ID NO: 9270007 - DNA, 22 bp, Homo sapiens
gagtcacaaaagatgcccaggg

SEQ ID NO: 9270008 - DNA, 22 bp, Homo sapiens
gagtcaacaagtcagatctcac

SEQ ID NO: 9270009 - DNA, 22 bp, Homo sapiens
gcaaggagcctggaggtgagtg

SEQ ID NO: 9270010 - DNA, 22 bp, Homo sapiens
gcaaggaggctggtggaggaag

SEQ ID NO: 9270011 - DNA, 22 bp, Homo sapiens
gcaaggaggctggtggaggaag

SEQ ID NO: 9270012 - DNA, 22 bp, Homo sapiens
gcaaggagcctggaggtgagtg

SEQ ID NO: 9270013 - DNA, 22 bp, Homo sapiens
gcaaggagcctggaggtgagtg

SEQ ID NO: 9270014 - DNA, 20 bp, Homo sapiens
gcaaggcacagtgaggaggg

SEQ ID NO: 9270015 - DNA, 20 bp, Homo sapiens
gcaaggcacagtgaggaggg

SEQ ID NO: 9270016 - DNA, 22 bp, Homo sapiens
gcaaggcagcgcggagtagcta

SEQ ID NO: 9270017 - DNA, 18 bp, Homo sapiens
gcaaggctcaggccaggc

SEQ ID NO: 9270018 - DNA, 22 bp, Homo sapiens
gcaaggcagtcctggggccctg

SEQ ID NO: 9270019 - DNA, 22 bp, Homo sapiens
gcaataaacatgtttgatgcgc

SEQ ID NO: 9270020 - DNA, 22 bp, Homo sapiens
gcaataaagtagcagctcatca

SEQ ID NO: 9270021 - DNA, 22 bp, Homo sapiens
gcaataaataacatggaagaca

SEQ ID NO: 9270022 - DNA, 22 bp, Homo sapiens
gcaatacagtaggtttattggt

SEQ ID NO: 9270023 - DNA, 22 bp, Homo sapiens
gcaataaataacatggaagaca

SEQ ID NO: 9270024 - DNA, 22 bp, Homo sapiens
gcagacaggcccagtggaggga

SEQ ID NO: 9270025 - DNA, 22 bp, Homo sapiens
gcagacaggcccagtggaggga

SEQ ID NO: 9270026 - DNA, 22 bp, Homo sapiens
gcagacaggcccagtggaggga

SEQ ID NO: 9270027 - DNA, 22 bp, Homo sapiens
gcagacagccagactgcactgg

SEQ ID NO: 9270028 - DNA, 22 bp, Homo sapiens
gcagacagccagactgcactgg

SEQ ID NO: 9270029 - DNA, 22 bp, Homo sapiens
gcagacagccagactgcactgg

SEQ ID NO: 9270030 - DNA, 22 bp, Homo sapiens
gcagacagcatgttgggctatt

SEQ ID NO: 9270031 - DNA, 22 bp, Homo sapiens
gcagacagcatgttgggctatt

SEQ ID NO: 9270032 - DNA, 22 bp, Homo sapiens
gcagacagatgagggtgctggg

SEQ ID NO: 9270033 - DNA, 23 bp, Homo sapiens
gcagacagagcagactaagacaa

SEQ ID NO: 9270034 - DNA, 23 bp, Homo sapiens
gcagacagagcagactaagacaa

SEQ ID NO: 9270035 - DNA, 22 bp, Homo sapiens
gcagacagactgcagtgatttt

SEQ ID NO: 9270036 - DNA, 22 bp, Homo sapiens
gcagaagggaataaggagcttt

SEQ ID NO: 9270037 - DNA, 22 bp, Homo sapiens
gcacccagaggtcagcagtgct

SEQ ID NO: 9270038 - DNA, 22 bp, Homo sapiens
gcacccagagggcagggtctcc

SEQ ID NO: 9270039 - DNA, 22 bp, Homo sapiens
gcaccaggaggcccttctcatc

SEQ ID NO: 9270040 - DNA, 22 bp, Homo sapiens
gcaccagctgctgggttctaga

SEQ ID NO: 9270041 - DNA, 22 bp, Homo sapiens
gcaccagctgccttctgtgccc

SEQ ID NO: 9270042 - DNA, 22 bp, Homo sapiens
gcacccagatagcaaggattag

SEQ ID NO: 9270043 - DNA, 22 bp, Homo sapiens
gcacccagaggtcagcagtgct

SEQ ID NO: 9270044 - DNA, 22 bp, Homo sapiens
gcacccagaggtcagcagtgct

SEQ ID NO: 9270045 - DNA, 22 bp, Homo sapiens
gcacccagaggtcagcagtgct

SEQ ID NO: 9270046 - DNA, 22 bp, Homo sapiens
gcacccagccagcatctcagag

SEQ ID NO: 9270047 - DNA, 22 bp, Homo sapiens
gcacccagccagcatctcagag

SEQ ID NO: 9270048 - DNA, 22 bp, Homo sapiens
gcacccagccagcatctcagag

SEQ ID NO: 9270049 - DNA, 22 bp, Homo sapiens
gcacccagatattgccttgacc

SEQ ID NO: 9270050 - DNA, 21 bp, Homo sapiens
gcacccagccggttctcccag

SEQ ID NO: 9270051 - DNA, 22 bp, Homo sapiens
gcacccagcccagggcgtgatg

SEQ ID NO: 9270052 - DNA, 20 bp, Homo sapiens
gcacccagcttcttgttcta

SEQ ID NO: 9270053 - DNA, 20 bp, Homo sapiens
gcacccagcttcttgttcta

SEQ ID NO: 9270054 - DNA, 20 bp, Homo sapiens
gcacccagcttcttgttcta

SEQ ID NO: 9270055 - DNA, 22 bp, Homo sapiens
gcagaaggatccgcaggtgcaa

SEQ ID NO: 9270056 - DNA, 22 bp, Homo sapiens
gcagaaggatccgcaggtgcaa

SEQ ID NO: 9270057 - DNA, 18 bp, Homo sapiens
gcagagtgcgtctctgtg

SEQ ID NO: 9270058 - DNA, 22 bp, Homo sapiens
gcagagtgctgtcgtacgcccc

SEQ ID NO: 9270059 - DNA, 22 bp, Homo sapiens
gcagagtgccgagatggaagcg

SEQ ID NO: 9270060 - DNA, 22 bp, Homo sapiens
gcagagtgaggaagagcttcca

SEQ ID NO: 9270061 - DNA, 22 bp, Homo sapiens
gcagagtgagatatgaacccag

SEQ ID NO: 9270062 - DNA, 22 bp, Homo sapiens
gcagagtgagccgaggctgctc

SEQ ID NO: 9270063 - DNA, 22 bp, Homo sapiens
gcagagtgagatatgaacccag

SEQ ID NO: 9270064 - DNA, 22 bp, Homo sapiens
gcagcaagaataatttgggtag

SEQ ID NO: 9270065 - DNA, 22 bp, Homo sapiens
gcagagtgggagcccagggctg

SEQ ID NO: 9270066 - DNA, 22 bp, Homo sapiens
gcagacagggctacagaggtac

SEQ ID NO: 9270067 - DNA, 22 bp, Homo sapiens
gcagaggtgagtttctcagctg

SEQ ID NO: 9270068 - DNA, 22 bp, Homo sapiens
gcagaggtgtcaccttccagga

SEQ ID NO: 9270069 - DNA, 22 bp, Homo sapiens
gcagaggtggcatctgggctct

SEQ ID NO: 9270070 - DNA, 22 bp, Homo sapiens
gcagaggtggcatctgggctct

SEQ ID NO: 9270071 - DNA, 22 bp, Homo sapiens
gcagagtgaagcagtatggaaa

SEQ ID NO: 9270072 - DNA, 22 bp, Homo sapiens
gcagagtctgggcagcctccat

SEQ ID NO: 9270073 - DNA, 22 bp, Homo sapiens
gcagagtcaggattccatccca

SEQ ID NO: 9270074 - DNA, 23 bp, Homo sapiens
gcagaggtttttcagtatggttt

SEQ ID NO: 9270075 - DNA, 23 bp, Homo sapiens
gctgaggtacatttacaggaaga

SEQ ID NO: 9270076 - DNA, 23 bp, Homo sapiens
gctgaggtacatttacaggaaga

SEQ ID NO: 9270077 - DNA, 22 bp, Homo sapiens
gctgagggggaaggaaagctga

SEQ ID NO: 9270078 - DNA, 20 bp, Homo sapiens
gctgaggggtctatggcata

SEQ ID NO: 9270079 - DNA, 22 bp, Homo sapiens
gctgagggctgtaacagcagag

SEQ ID NO: 9270080 - DNA, 22 bp, Homo sapiens
gctgagggctgtaacagcagag

SEQ ID NO: 9270081 - DNA, 22 bp, Homo sapiens
gctctgtggtggggcagagttt

SEQ ID NO: 9270082 - DNA, 20 bp, Homo sapiens
gctctgtggtttgagtctcc

SEQ ID NO: 9270083 - DNA, 22 bp, Homo sapiens
gctctgtggtggggcagagttt

SEQ ID NO: 9270084 - DNA, 18 bp, Homo sapiens
gctgaggtggtgtcagag

SEQ ID NO: 9270085 - DNA, 18 bp, Homo sapiens
gctgaggtggtgtcagag

SEQ ID NO: 9270086 - DNA, 22 bp, Homo sapiens
gctgaggtgtcaccttgctggg

SEQ ID NO: 9270087 - DNA, 22 bp, Homo sapiens
gctgaggtgtcaccttgctggg

SEQ ID NO: 9270088 - DNA, 22 bp, Homo sapiens
gctgaggtttcaggagtggcag

SEQ ID NO: 9270089 - DNA, 22 bp, Homo sapiens
gctgaggtggctgccttagtaa

SEQ ID NO: 9270090 - DNA, 22 bp, Homo sapiens
gctgaggtggctgccttagtaa

SEQ ID NO: 9270091 - DNA, 22 bp, Homo sapiens
gctgaggtggtgatggttcatc

SEQ ID NO: 9270092 - DNA, 22 bp, Homo sapiens
gctgaggtggctgccttagtaa

SEQ ID NO: 9270093 - DNA, 18 bp, Homo sapiens
gctgaggtggtgtcagag

SEQ ID NO: 9270094 - DNA, 22 bp, Homo sapiens
gctgaggtggtgatggttcatc

SEQ ID NO: 9270095 - DNA, 22 bp, Homo sapiens
gctgaggttttctgcctgctca

SEQ ID NO: 9270096 - DNA, 22 bp, Homo sapiens
gctgagtatacagactatgtta

SEQ ID NO: 9270097 - DNA, 22 bp, Homo sapiens
gctgagtcagattgcagtcttg

SEQ ID NO: 9270098 - DNA, 22 bp, Homo sapiens
gctgagtcagattgcagtcttg

SEQ ID NO: 9270099 - DNA, 22 bp, Homo sapiens
gctgagtcttgagcactgagca

SEQ ID NO: 9270100 - DNA, 20 bp, Homo sapiens
gctgaggtttcttcctatat

SEQ ID NO: 9270101 - DNA, 22 bp, Homo sapiens
gctgaggtttcaggagtggcag

SEQ ID NO: 9270102 - DNA, 22 bp, Homo sapiens
gctgaggttttctgcctgctca

SEQ ID NO: 9270103 - DNA, 20 bp, Homo sapiens
gctgaggtttcttcctatat

SEQ ID NO: 9270104 - DNA, 22 bp, Homo sapiens
gctgaggtttcaggagtggcag

SEQ ID NO: 9270105 - DNA, 17 bp, Homo sapiens
gctgagtgcagggagtc

SEQ ID NO: 9270106 - DNA, 22 bp, Homo sapiens
gctgagtgattgatattttagt

SEQ ID NO: 9270107 - DNA, 22 bp, Homo sapiens
gctgagttgaaagcagaggata

SEQ ID NO: 9270108 - DNA, 22 bp, Homo sapiens
gctgagttgaaagcagaggata

SEQ ID NO: 9270109 - DNA, 22 bp, Homo sapiens
gctgagtgtaatgatggcagag

SEQ ID NO: 9270110 - DNA, 22 bp, Homo sapiens
gctgagtgtaatgatggcagag

SEQ ID NO: 9270111 - DNA, 22 bp, Homo sapiens
gctgagtgaggtccagagcttg

SEQ ID NO: 9270112 - DNA, 22 bp, Homo sapiens
gctgagtgaggaaaaggttata

SEQ ID NO: 9270113 - DNA, 22 bp, Homo sapiens
gctgagtgaggctgtcaaaatg

SEQ ID NO: 9270114 - DNA, 22 bp, Homo sapiens
gctgagtgaggtccagagcttg

SEQ ID NO: 9270115 - DNA, 22 bp, Homo sapiens
gctgagtgaggtccagagcttg

SEQ ID NO: 9270116 - DNA, 22 bp, Homo sapiens
gctgagtgattcatacgctgct

SEQ ID NO: 9270117 - DNA, 22 bp, Homo sapiens
gctgagtgattgatattttagt

SEQ ID NO: 9270118 - DNA, 17 bp, Homo sapiens
gctgagtgcagggagtc

SEQ ID NO: 9270119 - DNA, 18 bp, Homo sapiens
gctgcaggcgcctgcggt

SEQ ID NO: 9270120 - DNA, 22 bp, Homo sapiens
gctgagttgaaagcagaggata

SEQ ID NO: 9270121 - DNA, 22 bp, Homo sapiens
gctgataaatagttgatgtacc

SEQ ID NO: 9270122 - DNA, 22 bp, Homo sapiens
gctgcaggcagaatctcccaat

SEQ ID NO: 9270123 - DNA, 22 bp, Homo sapiens
gctgcaggatgaggctctgctc

SEQ ID NO: 9270124 - DNA, 22 bp, Homo sapiens
gctgcaggcagaatctcccaat

SEQ ID NO: 9270125 - DNA, 22 bp, Homo sapiens
gctgcaggcattttcctgggca

SEQ ID NO: 9270126 - DNA, 22 bp, Homo sapiens
gctgcagggaatgtatggattt

SEQ ID NO: 9270127 - DNA, 22 bp, Homo sapiens
gctgcaggctgtggcaggggag

SEQ ID NO: 9270128 - DNA, 22 bp, Homo sapiens
gctgcaggctctgcaggaattg

SEQ ID NO: 9270129 - DNA, 22 bp, Homo sapiens
gctgcaggctctgcaggaattg

SEQ ID NO: 9270130 - DNA, 22 bp, Homo sapiens
gctgcaggctgtggcaggggag

SEQ ID NO: 9270131 - DNA, 22 bp, Homo sapiens
gctgcaggcggccgtggtggcg

SEQ ID NO: 9270132 - DNA, 22 bp, Homo sapiens
gctgcaggggggtctggacttg

SEQ ID NO: 9270133 - DNA, 22 bp, Homo sapiens
gctgcctccaatctgtgccccg

SEQ ID NO: 9270134 - DNA, 22 bp, Homo sapiens
gctgcagggctctcacaggggg

SEQ ID NO: 9270135 - DNA, 21 bp, Homo sapiens
gctgcagggcccagggcaccc

SEQ ID NO: 9270136 - DNA, 21 bp, Homo sapiens
gctgcagggcccagggcaccc

SEQ ID NO: 9270137 - DNA, 21 bp, Homo sapiens
gctgcagggcccagggcaccc

SEQ ID NO: 9270138 - DNA, 21 bp, Homo sapiens
gctgcagggcccagggcaccc

SEQ ID NO: 9270139 - DNA, 22 bp, Homo sapiens
gctgcagggagctggaaggctc

SEQ ID NO: 9270140 - DNA, 22 bp, Homo sapiens
gctgcagggagctggaaggctc

SEQ ID NO: 9270141 - DNA, 22 bp, Homo sapiens
gctgcagggagctggaaggctc

SEQ ID NO: 9270142 - DNA, 22 bp, Homo sapiens
gctgcagggagctggaaggctc

SEQ ID NO: 9270143 - DNA, 22 bp, Homo sapiens
gctgcagggagctggaaggctc

SEQ ID NO: 9270144 - DNA, 22 bp, Homo sapiens
gctgcctccactggctcccagt

SEQ ID NO: 9270145 - DNA, 22 bp, Homo sapiens
gctgcctcccagagccctgcag

SEQ ID NO: 9270146 - DNA, 22 bp, Homo sapiens
gctgcctcccagagccctgcag

SEQ ID NO: 9270147 - DNA, 22 bp, Homo sapiens
gctgcctccgccggctccacag

SEQ ID NO: 9270148 - DNA, 22 bp, Homo sapiens
gctgcctcccccatggctggaa

SEQ ID NO: 9270149 - DNA, 22 bp, Homo sapiens
gctgcctctgcacagctcactc

SEQ ID NO: 9270150 - DNA, 22 bp, Homo sapiens
gctgcctctgcgactctgggcg

SEQ ID NO: 9270151 - DNA, 22 bp, Homo sapiens
gctgcctctgcgactctgggcg

SEQ ID NO: 9270152 - DNA, 23 bp, Homo sapiens
gctgcctcctacaaaagcccagc

SEQ ID NO: 9270153 - DNA, 22 bp, Homo sapiens
gctgcctcctgaaagcgctctg

SEQ ID NO: 9270154 - DNA, 22 bp, Homo sapiens
gctgcctcctgaaagcgctctg

SEQ ID NO: 9270155 - DNA, 22 bp, Homo sapiens
gctgcctctcctgagttgacag

SEQ ID NO: 9270156 - DNA, 22 bp, Homo sapiens
gctgcctcctgagatttgggca

SEQ ID NO: 9270157 - DNA, 22 bp, Homo sapiens
gctggaggtagggaggtcctgt

SEQ ID NO: 9270158 - DNA, 22 bp, Homo sapiens
gctggaggtttcacctgagttt

SEQ ID NO: 9270159 - DNA, 22 bp, Homo sapiens
gctggaggtttcacctgagttt

SEQ ID NO: 9270160 - DNA, 22 bp, Homo sapiens
gctggagtaggaccatgcttga

SEQ ID NO: 9270161 - DNA, 22 bp, Homo sapiens
gctggagtacatctttggcggc

SEQ ID NO: 9270162 - DNA, 19 bp, Homo sapiens
gctggagtcacttttgaga

SEQ ID NO: 9270163 - DNA, 22 bp, Homo sapiens
gctggagtccagtggcatgatc

SEQ ID NO: 9270164 - DNA, 22 bp, Homo sapiens
gctggagtatctggggaaggag

SEQ ID NO: 9270165 - DNA, 22 bp, Homo sapiens
gctggagtgcagttgcacagtc

SEQ ID NO: 9270166 - DNA, 22 bp, Homo sapiens
gctggagtgagtatgtgtagtc

SEQ ID NO: 9270167 - DNA, 22 bp, Homo sapiens
gctggagtgctgaggtgcagtg

SEQ ID NO: 9270168 - DNA, 22 bp, Homo sapiens
gctggagttagaactagcctgg

SEQ ID NO: 9270169 - DNA, 22 bp, Homo sapiens
gctggagtgctggagtgcagtg

SEQ ID NO: 9270170 - DNA, 22 bp, Homo sapiens
gctggagtctacattcaagaat

SEQ ID NO: 9270171 - DNA, 22 bp, Homo sapiens
gctggagtctggaggtgtgcca

SEQ ID NO: 9270172 - DNA, 16 bp, Homo sapiens
gctggagtcctggagc

SEQ ID NO: 9270173 - DNA, 22 bp, Homo sapiens
gctggagtccagtggtatgatc

SEQ ID NO: 9270174 - DNA, 22 bp, Homo sapiens
gctggagtccctgcctttcctt

SEQ ID NO: 9270175 - DNA, 22 bp, Homo sapiens
gctggagtgatgcctgtgtctc

SEQ ID NO: 9270176 - DNA, 22 bp, Homo sapiens
gctggagtcttgaaagtggact

SEQ ID NO: 9270177 - DNA, 22 bp, Homo sapiens
gctggagtgagggaccatattt

SEQ ID NO: 9270178 - DNA, 22 bp, Homo sapiens
gctggagttggcaaggcatgta

SEQ ID NO: 9270179 - DNA, 22 bp, Homo sapiens
gctggagttgtgggtttactaa

SEQ ID NO: 9270180 - DNA, 22 bp, Homo sapiens
gctggagttggcaaggcatgta

SEQ ID NO: 9270181 - DNA, 22 bp, Homo sapiens
gctggagttaggtgggcttgaa

SEQ ID NO: 9270182 - DNA, 22 bp, Homo sapiens
gctggcaggtccaagatagagc

SEQ ID NO: 9270183 - DNA, 22 bp, Homo sapiens
gctggccaaagtgtacctggag

SEQ ID NO: 9270184 - DNA, 22 bp, Homo sapiens
gctggagctgcagcctgggcct

SEQ ID NO: 9270185 - DNA, 22 bp, Homo sapiens
gctggagctgcagcctgggcct

SEQ ID NO: 9270186 - DNA, 22 bp, Homo sapiens
gctggagcttgagaggacaggg

SEQ ID NO: 9270187 - DNA, 22 bp, Homo sapiens
gctggaggggtaataggatggg

SEQ ID NO: 9270188 - DNA, 22 bp, Homo sapiens
gctggagcttgagaggacaggg

SEQ ID NO: 9270189 - DNA, 22 bp, Homo sapiens
gctgctggggccttccctcggg

SEQ ID NO: 9270190 - DNA, 22 bp, Homo sapiens
gctgctgcttgaaggctcggag

SEQ ID NO: 9270191 - DNA, 23 bp, Homo sapiens
gctgcctctgttggtcttcagtt

SEQ ID NO: 9270192 - DNA, 22 bp, Homo sapiens
gctgcctctgtagctttggacc

SEQ ID NO: 9270193 - DNA, 22 bp, Homo sapiens
gctgcctgaagtgtctacactg

SEQ ID NO: 9270194 - DNA, 22 bp, Homo sapiens
gctctctgcctttctcaatgac

SEQ ID NO: 9270195 - DNA, 22 bp, Homo sapiens
gctctctggaaggtatcattat

SEQ ID NO: 9270196 - DNA, 22 bp, Homo sapiens
gctctctggaaggtatcattat

SEQ ID NO: 9270197 - DNA, 22 bp, Homo sapiens
gctctctggaggccatggacag

SEQ ID NO: 9270198 - DNA, 22 bp, Homo sapiens
gctctctggaggccatggacag

SEQ ID NO: 9270199 - DNA, 22 bp, Homo sapiens
gctctctggttccagtcaggaa

SEQ ID NO: 9270200 - DNA, 22 bp, Homo sapiens
gctctctgggtgtgtctagata

SEQ ID NO: 9270201 - DNA, 22 bp, Homo sapiens
gctctctgggtggtgggcaaca

SEQ ID NO: 9270202 - DNA, 22 bp, Homo sapiens
gctctctggctagtccatcggg

SEQ ID NO: 9270203 - DNA, 22 bp, Homo sapiens
gctctctggctagtccatcggg

SEQ ID NO: 9270204 - DNA, 22 bp, Homo sapiens
gctctcttgacagcttgctgtt

SEQ ID NO: 9270205 - DNA, 22 bp, Homo sapiens
gctctctgttattaagatcttt

SEQ ID NO: 9270206 - DNA, 22 bp, Homo sapiens
gctctgggtagccactgcctgg

SEQ ID NO: 9270207 - DNA, 22 bp, Homo sapiens
gctctgggtagccactgcctgg

SEQ ID NO: 9270208 - DNA, 22 bp, Homo sapiens
gctctgggtagccactgcctgg

SEQ ID NO: 9270209 - DNA, 22 bp, Homo sapiens
gctctggttctcttagagtagt

SEQ ID NO: 9270210 - DNA, 22 bp, Homo sapiens
gctctgtcttcagcacacagta

SEQ ID NO: 9270211 - DNA, 22 bp, Homo sapiens
gctctgtccagcgtgcacagaa

SEQ ID NO: 9270212 - DNA, 22 bp, Homo sapiens
gctctgtcaacagctagctgtg

SEQ ID NO: 9270213 - DNA, 22 bp, Homo sapiens
gctctgtcaacagctagctgtg

SEQ ID NO: 9270214 - DNA, 22 bp, Homo sapiens
gctctgtcattttgcagacact

SEQ ID NO: 9270215 - DNA, 22 bp, Homo sapiens
gctctgtgaccttaggcaagtt

SEQ ID NO: 9270216 - DNA, 22 bp, Homo sapiens
gctctgtgagtattggccctgg

SEQ ID NO: 9270217 - DNA, 22 bp, Homo sapiens
gctctgtgagccacttgatgta

SEQ ID NO: 9270218 - DNA, 22 bp, Homo sapiens
gctctgtgagccacttgatgta

SEQ ID NO: 9270219 - DNA, 22 bp, Homo sapiens
gctctgtgctagaactaagaat

SEQ ID NO: 9270220 - DNA, 22 bp, Homo sapiens
gctctgtgccagggctgggcca

SEQ ID NO: 9270221 - DNA, 20 bp, Homo sapiens
gctctgtgctggcggaggct

SEQ ID NO: 9270222 - DNA, 22 bp, Homo sapiens
gctctgtggcaggaggtcttgt

SEQ ID NO: 9270223 - DNA, 22 bp, Homo sapiens
gctctgtgccacatgcagtgtt

SEQ ID NO: 9270224 - DNA, 22 bp, Homo sapiens
gctctgtgccacatgcagtgtt

SEQ ID NO: 9270225 - DNA, 19 bp, Homo sapiens
gctctgtgatgctgagggg

SEQ ID NO: 9270226 - DNA, 22 bp, Homo sapiens
gctcccagcattgctgctgaat

SEQ ID NO: 9270227 - DNA, 22 bp, Homo sapiens
gctcccagcattgctgctgaat

SEQ ID NO: 9270228 - DNA, 22 bp, Homo sapiens
gctcccagcattgctgctgaat

SEQ ID NO: 9270229 - DNA, 22 bp, Homo sapiens
gctcccagcattgcttcccagg

SEQ ID NO: 9270230 - DNA, 20 bp, Homo sapiens
gctcccagcctgcagtcccc

SEQ ID NO: 9270231 - DNA, 22 bp, Homo sapiens
gctcccaggaagagaagggcca

SEQ ID NO: 9270232 - DNA, 22 bp, Homo sapiens
gctcccagctggagcctcaaca

SEQ ID NO: 9270233 - DNA, 22 bp, Homo sapiens
gctcccagctggagcctcaaca

SEQ ID NO: 9270234 - DNA, 22 bp, Homo sapiens
gctccctcccaccagcctgcag

SEQ ID NO: 9270235 - DNA, 22 bp, Homo sapiens
gctccctcccaccagcctgcag

SEQ ID NO: 9270236 - DNA, 22 bp, Homo sapiens
gctcccaggatgaggagccagg

SEQ ID NO: 9270237 - DNA, 22 bp, Homo sapiens
gctccccaggctggtcccctcg

SEQ ID NO: 9270238 - DNA, 22 bp, Homo sapiens
gctccctctgctcaggcacttg

SEQ ID NO: 9270239 - DNA, 21 bp, Homo sapiens
gctctccagggccagcccagg

SEQ ID NO: 9270240 - DNA, 22 bp, Homo sapiens
gctccctctgctcaggcacttg

SEQ ID NO: 9270241 - DNA, 22 bp, Homo sapiens
gctccctcccaccagcctgcag

SEQ ID NO: 9270242 - DNA, 22 bp, Homo sapiens
gctctcctgtgcagatgctgct

SEQ ID NO: 9270243 - DNA, 19 bp, Homo sapiens
gctctccctctcagttgag

SEQ ID NO: 9270244 - DNA, 22 bp, Homo sapiens
gctctccaggtctcatgcactg

SEQ ID NO: 9270245 - DNA, 22 bp, Homo sapiens
gctctcccgcagcctggtgggc

SEQ ID NO: 9270246 - DNA, 22 bp, Homo sapiens
gctctctgaggtgctggcagag

SEQ ID NO: 9270247 - DNA, 22 bp, Homo sapiens
gctctctgcaagtcagcagcct

SEQ ID NO: 9270248 - DNA, 22 bp, Homo sapiens
gctctctgcagcctccttggag

SEQ ID NO: 9270249 - DNA, 22 bp, Homo sapiens
gctctctgcagcctccttggag

SEQ ID NO: 9270250 - DNA, 21 bp, Homo sapiens
gctctctgcatggtggctcag

SEQ ID NO: 9270251 - DNA, 21 bp, Homo sapiens
gctctctgcatggtggctcag

SEQ ID NO: 9270252 - DNA, 22 bp, Homo sapiens
gctctctgccatatgaggatac

SEQ ID NO: 9270253 - DNA, 22 bp, Homo sapiens
gctctcctgtgcagatgctgct

SEQ ID NO: 9270254 - DNA, 22 bp, Homo sapiens
gctctctgaggtgctggcagag

SEQ ID NO: 9270255 - DNA, 22 bp, Homo sapiens
gctctctgaggtgctggcagag

SEQ ID NO: 9270256 - DNA, 22 bp, Homo sapiens
gctctctgaggtgctggcagag

SEQ ID NO: 9270257 - DNA, 22 bp, Homo sapiens
gctagctttataatgctgggcg

SEQ ID NO: 9270258 - DNA, 22 bp, Homo sapiens
gctaggagattgagctctgaag

SEQ ID NO: 9270259 - DNA, 22 bp, Homo sapiens
gctagaaatcgacttcagaatt

SEQ ID NO: 9270260 - DNA, 19 bp, Homo sapiens
gctaggctggccttgaggg

SEQ ID NO: 9270261 - DNA, 22 bp, Homo sapiens
gctaggctgtgtttcagaccct

SEQ ID NO: 9270262 - DNA, 22 bp, Homo sapiens
gctaggctgtgtttcagaccct

SEQ ID NO: 9270263 - DNA, 22 bp, Homo sapiens
gctaggctcggaagcagcaggg

SEQ ID NO: 9270264 - DNA, 22 bp, Homo sapiens
gctaggctcggaagcagcaggg

SEQ ID NO: 9270265 - DNA, 22 bp, Homo sapiens
gctaggtctgtgcgcagccgct

SEQ ID NO: 9270266 - DNA, 22 bp, Homo sapiens
gctaggcttcaaaatctccctg

SEQ ID NO: 9270267 - DNA, 22 bp, Homo sapiens
gcctggagttcagccaagtccc

SEQ ID NO: 9270268 - DNA, 22 bp, Homo sapiens
gcctggagttcagccaagtccc

SEQ ID NO: 9270269 - DNA, 20 bp, Homo sapiens
gcctggcacccggggctggc

SEQ ID NO: 9270270 - DNA, 20 bp, Homo sapiens
gcctggcacccggggctggc

SEQ ID NO: 9270271 - DNA, 22 bp, Homo sapiens
gcctggagtggtcctgctgccc

SEQ ID NO: 9270272 - DNA, 22 bp, Homo sapiens
gcctggcactcactgaagaggc

SEQ ID NO: 9270273 - DNA, 22 bp, Homo sapiens
gcctggcactcactgaagaggc

SEQ ID NO: 9270274 - DNA, 22 bp, Homo sapiens
gcctggcagattgacatagcca

SEQ ID NO: 9270275 - DNA, 22 bp, Homo sapiens
gcctggcaggcctcatgagggg

SEQ ID NO: 9270276 - DNA, 20 bp, Homo sapiens
gctcagggcctgggtctgga

SEQ ID NO: 9270277 - DNA, 20 bp, Homo sapiens
gctcagggcctgggtctgga

SEQ ID NO: 9270278 - DNA, 22 bp, Homo sapiens
gctagtgagctctttgtcatct

SEQ ID NO: 9270279 - DNA, 23 bp, Homo sapiens
gctaggtgcttccacacgtgctg

SEQ ID NO: 9270280 - DNA, 22 bp, Homo sapiens
gctaggtgcagcagacagctta

SEQ ID NO: 9270281 - DNA, 22 bp, Homo sapiens
gctcccagatttcagccttgtg

SEQ ID NO: 9270282 - DNA, 22 bp, Homo sapiens
gctcccagatttcagccttgtg

SEQ ID NO: 9270283 - DNA, 22 bp, Homo sapiens
gctcccagatttcagccttgtg

SEQ ID NO: 9270284 - DNA, 22 bp, Homo sapiens
gctcccagcaattgaggcagcc

SEQ ID NO: 9270285 - DNA, 22 bp, Homo sapiens
gctcccagcaattgaggcagcc

SEQ ID NO: 9270286 - DNA, 22 bp, Homo sapiens
gctcccagcaattgaggcagcc

SEQ ID NO: 9270287 - DNA, 22 bp, Homo sapiens
gctcccagatttcagccttgtg

SEQ ID NO: 9270288 - DNA, 22 bp, Homo sapiens
gctcccagactgaccagaggtg

SEQ ID NO: 9270289 - DNA, 22 bp, Homo sapiens
gctcccagactgaccagaggtg

SEQ ID NO: 9270290 - DNA, 23 bp, Homo sapiens
gctcatcaggcttagagtcaagg

SEQ ID NO: 9270291 - DNA, 23 bp, Homo sapiens
gctcatcaggcttagagtcaagg

SEQ ID NO: 9270292 - DNA, 22 bp, Homo sapiens
gctcagttatccgtgtgtgact

SEQ ID NO: 9270293 - DNA, 22 bp, Homo sapiens
ggagaaagctgtagtggaatgt

SEQ ID NO: 9270294 - DNA, 22 bp, Homo sapiens
ggagaaagctgtagtggaatgt

SEQ ID NO: 9270295 - DNA, 22 bp, Homo sapiens
ggacttggggaaggcacagtta

SEQ ID NO: 9270296 - DNA, 22 bp, Homo sapiens
ggagaaagaagacgaacattgt

SEQ ID NO: 9270297 - DNA, 22 bp, Homo sapiens
ggagaaaattgatgaagttggc

SEQ ID NO: 9270298 - DNA, 22 bp, Homo sapiens
ggactgggaatcagggagatgc

SEQ ID NO: 9270299 - DNA, 22 bp, Homo sapiens
ggactgggtcactaagatagta

SEQ ID NO: 9270300 - DNA, 22 bp, Homo sapiens
ggactggactctcaggctcaca

SEQ ID NO: 9270301 - DNA, 22 bp, Homo sapiens
ggactgggtcactaagatagta

SEQ ID NO: 9270302 - DNA, 22 bp, Homo sapiens
ggacaggccgcctcggtggggg

SEQ ID NO: 9270303 - DNA, 22 bp, Homo sapiens
ggacaggccgcctcggtggggg

SEQ ID NO: 9270304 - DNA, 22 bp, Homo sapiens
ggacaggcgcagggccaaggaa

SEQ ID NO: 9270305 - DNA, 22 bp, Homo sapiens
ggacaggctgcatctgagcatg

SEQ ID NO: 9270306 - DNA, 22 bp, Homo sapiens
ggacaggcccggggagcctgga

SEQ ID NO: 9270307 - DNA, 22 bp, Homo sapiens
ggacaggccgcctcggtggggg

SEQ ID NO: 9270308 - DNA, 22 bp, Homo sapiens
ggacaggccctctggtcagctt

SEQ ID NO: 9270309 - DNA, 22 bp, Homo sapiens
ggacaggggcgtggggattgtt

SEQ ID NO: 9270310 - DNA, 19 bp, Homo sapiens
ggacagggggagcttttat

SEQ ID NO: 9270311 - DNA, 22 bp, Homo sapiens
ggacagggctcttggcactcct

SEQ ID NO: 9270312 - DNA, 22 bp, Homo sapiens
ggacaggggcgtggggattgtt

SEQ ID NO: 9270313 - DNA, 22 bp, Homo sapiens
ggacagggatcattatctgagc

SEQ ID NO: 9270314 - DNA, 23 bp, Homo sapiens
ggacagggccctgccctatggcc

SEQ ID NO: 9270315 - DNA, 18 bp, Homo sapiens
ggaaggagtggaccccag

SEQ ID NO: 9270316 - DNA, 22 bp, Homo sapiens
ggaaggagtctttaacacccat

SEQ ID NO: 9270317 - DNA, 22 bp, Homo sapiens
ggaaggagtctttaacacccat

SEQ ID NO: 9270318 - DNA, 18 bp, Homo sapiens
ggaaggagtggaccccag

SEQ ID NO: 9270319 - DNA, 22 bp, Homo sapiens
ggaaggaggggcaaagcagttc

SEQ ID NO: 9270320 - DNA, 22 bp, Homo sapiens
ggaaggaggggcaaagcagttc

SEQ ID NO: 9270321 - DNA, 22 bp, Homo sapiens
ggaaggaggggcaaagcagttc

SEQ ID NO: 9270322 - DNA, 22 bp, Homo sapiens
ggaaggagggcggcaatgatga

SEQ ID NO: 9270323 - DNA, 22 bp, Homo sapiens
ggaaggagggcggcaatgatga

SEQ ID NO: 9270324 - DNA, 22 bp, Homo sapiens
ggaaggaggggcaaagcagttc

SEQ ID NO: 9270325 - DNA, 22 bp, Homo sapiens
ggaaggaggatgctctggcctt

SEQ ID NO: 9270326 - DNA, 22 bp, Homo sapiens
ggaaggagccatatcatatcca

SEQ ID NO: 9270327 - DNA, 22 bp, Homo sapiens
ggaaggaggatgctctggcctt

SEQ ID NO: 9270328 - DNA, 19 bp, Homo sapiens
ggaaggagagaaatgcatg

SEQ ID NO: 9270329 - DNA, 19 bp, Homo sapiens
ggaaggagagaaatgcatg

SEQ ID NO: 9270330 - DNA, 22 bp, Homo sapiens
ggaaggagcatttgccagttta

SEQ ID NO: 9270331 - DNA, 19 bp, Homo sapiens
ggaaggagagaaatgcatg

SEQ ID NO: 9270332 - DNA, 22 bp, Homo sapiens
ggaaggagcatttgccagttta

SEQ ID NO: 9270333 - DNA, 22 bp, Homo sapiens
ggaaggagcatttgccagttta

SEQ ID NO: 9270334 - DNA, 22 bp, Homo sapiens
ggaaaaatgacacatatctcaa

SEQ ID NO: 9270335 - DNA, 22 bp, Homo sapiens
ggaaaaatgacacatatctcaa

SEQ ID NO: 9270336 - DNA, 22 bp, Homo sapiens
ggaaaaatagagtatactttaa

SEQ ID NO: 9270337 - DNA, 22 bp, Homo sapiens
ggaaaaacagtctttattattt

SEQ ID NO: 9270338 - DNA, 22 bp, Homo sapiens
ggaaggctttgtagaagtgcca

SEQ ID NO: 9270339 - DNA, 22 bp, Homo sapiens
ggaaggctctgttccttgactt

SEQ ID NO: 9270340 - DNA, 22 bp, Homo sapiens
ggaagggaaaattcattcggct

SEQ ID NO: 9270341 - DNA, 22 bp, Homo sapiens
ggacaggatgctgaagatgaag

SEQ ID NO: 9270342 - DNA, 22 bp, Homo sapiens
ggacaggatgctgaagatgaag

SEQ ID NO: 9270343 - DNA, 22 bp, Homo sapiens
ggacaggatgctgaagatgaag

SEQ ID NO: 9270344 - DNA, 22 bp, Homo sapiens
ggacaggataagagacactgcc

SEQ ID NO: 9270345 - DNA, 22 bp, Homo sapiens
ggacaggagtgaggcgggttcc

SEQ ID NO: 9270346 - DNA, 22 bp, Homo sapiens
ggacagagggttgacagagtat

SEQ ID NO: 9270347 - DNA, 18 bp, Homo sapiens
ggagcccagaggacagga

SEQ ID NO: 9270348 - DNA, 18 bp, Homo sapiens
ggagcccagaggacagga

SEQ ID NO: 9270349 - DNA, 18 bp, Homo sapiens
ggagcccagaggtgagtt

SEQ ID NO: 9270350 - DNA, 22 bp, Homo sapiens
ggagccagtatttagtggtctt

SEQ ID NO: 9270351 - DNA, 22 bp, Homo sapiens
ggagccagtatttagtggtctt

SEQ ID NO: 9270352 - DNA, 18 bp, Homo sapiens
ggagccagtctgtctctg

SEQ ID NO: 9270353 - DNA, 22 bp, Homo sapiens
ggagccagtgccctctggtgga

SEQ ID NO: 9270354 - DNA, 22 bp, Homo sapiens
ggagccagtttagacctcagtt

SEQ ID NO: 9270355 - DNA, 18 bp, Homo sapiens
ggagcccagaggtgagtt

SEQ ID NO: 9270356 - DNA, 22 bp, Homo sapiens
ggagcccagtcggggtgtaggt

SEQ ID NO: 9270357 - DNA, 22 bp, Homo sapiens
ggagcctggagtttctgatggg

SEQ ID NO: 9270358 - DNA, 22 bp, Homo sapiens
ggagccctcaccggcgagtgcc

SEQ ID NO: 9270359 - DNA, 19 bp, Homo sapiens
ggagcctggagcacgtgcc

SEQ ID NO: 9270360 - DNA, 19 bp, Homo sapiens
ggagcctggagcacgtgcc

SEQ ID NO: 9270361 - DNA, 22 bp, Homo sapiens
ggagcctggcccggcccttggc

SEQ ID NO: 9270362 - DNA, 23 bp, Homo sapiens
ggagcctggcatatgagacgcat

SEQ ID NO: 9270363 - DNA, 22 bp, Homo sapiens
ggagcctggcaatgctgcgtcc

SEQ ID NO: 9270364 - DNA, 22 bp, Homo sapiens
ggagcctggcaatgctgcgtcc

SEQ ID NO: 9270365 - DNA, 22 bp, Homo sapiens
ggagcctggcaatgctgcgtcc

SEQ ID NO: 9270366 - DNA, 22 bp, Homo sapiens
ggagaagcagcttcttgatgaa

SEQ ID NO: 9270367 - DNA, 22 bp, Homo sapiens
ggagaagcagcttcttgatgaa

SEQ ID NO: 9270368 - DNA, 22 bp, Homo sapiens
ggagccagggaagctgcttcct

SEQ ID NO: 9270369 - DNA, 22 bp, Homo sapiens
ggagccagtatttagtggtctt

SEQ ID NO: 9270370 - DNA, 22 bp, Homo sapiens
ggagaactccaaatccatattt

SEQ ID NO: 9270371 - DNA, 19 bp, Homo sapiens
ggagcttggtggctgtggc

SEQ ID NO: 9270372 - DNA, 21 bp, Homo sapiens
ggaggaaaaaggaatgacttg

SEQ ID NO: 9270373 - DNA, 22 bp, Homo sapiens
ggaggaggcggcagaagttcct

SEQ ID NO: 9270374 - DNA, 22 bp, Homo sapiens
ggagctgttatggcataagcat

SEQ ID NO: 9270375 - DNA, 22 bp, Homo sapiens
ggagctgttcaggactgcttca

SEQ ID NO: 9270376 - DNA, 22 bp, Homo sapiens
ggagctgttgattgtttgagga

SEQ ID NO: 9270377 - DNA, 22 bp, Homo sapiens
ggagctgttggcagctatcttg

SEQ ID NO: 9270378 - DNA, 22 bp, Homo sapiens
ggagctgttgcgcatgcgctcg

SEQ ID NO: 9270379 - DNA, 22 bp, Homo sapiens
ggagctgttgcgcatgcgctcg

SEQ ID NO: 9270380 - DNA, 22 bp, Homo sapiens
ggaggaggggtgactgaatgct

SEQ ID NO: 9270381 - DNA, 22 bp, Homo sapiens
ggaggaggggtgactgaatgct

SEQ ID NO: 9270382 - DNA, 22 bp, Homo sapiens
ggaggaggcggcagaagttcct

SEQ ID NO: 9270383 - DNA, 22 bp, Homo sapiens
ggagctggggttggcatcttcc

SEQ ID NO: 9270384 - DNA, 22 bp, Homo sapiens
ggagctgtaacgagccattgct

SEQ ID NO: 9270385 - DNA, 22 bp, Homo sapiens
ggagctggtcagccttgagcat

SEQ ID NO: 9270386 - DNA, 22 bp, Homo sapiens
ggagctgtgttatccattccca

SEQ ID NO: 9270387 - DNA, 22 bp, Homo sapiens
ggagctgtgctgggtgatcagg

SEQ ID NO: 9270388 - DNA, 22 bp, Homo sapiens
ggagctgttaaatgcagaattt

SEQ ID NO: 9270389 - DNA, 22 bp, Homo sapiens
ggagctgtgggacgctgtccca

SEQ ID NO: 9270390 - DNA, 22 bp, Homo sapiens
ggagctgtgttatccattccca

SEQ ID NO: 9270391 - DNA, 22 bp, Homo sapiens
ggagctgtctgtagggcacagg

SEQ ID NO: 9270392 - DNA, 22 bp, Homo sapiens
ggagctgtctgtagggcacagg

SEQ ID NO: 9270393 - DNA, 22 bp, Homo sapiens
ggagctgtaacgagccattgct

SEQ ID NO: 9270394 - DNA, 22 bp, Homo sapiens
ggagctgtagatcagctaatct

SEQ ID NO: 9270395 - DNA, 22 bp, Homo sapiens
ggagctgtgcagtgactacaga

SEQ ID NO: 9270396 - DNA, 22 bp, Homo sapiens
ggagctggctacagagaactcc

SEQ ID NO: 9270397 - DNA, 22 bp, Homo sapiens
ggagctggccgcctatgtgcag

SEQ ID NO: 9270398 - DNA, 20 bp, Homo sapiens
ggagctgccctgggctggag

SEQ ID NO: 9270399 - DNA, 22 bp, Homo sapiens
ggagctgcatttagggagcctt

SEQ ID NO: 9270400 - DNA, 22 bp, Homo sapiens
ggagcctggcctggctctgtgt

SEQ ID NO: 9270401 - DNA, 22 bp, Homo sapiens
ggagcctgggcattagtaattt

SEQ ID NO: 9270402 - DNA, 22 bp, Homo sapiens
ggagcctggcctggctctgtgt

SEQ ID NO: 9270403 - DNA, 22 bp, Homo sapiens
ggagcctggtatagtgttgcat

SEQ ID NO: 9270404 - DNA, 22 bp, Homo sapiens
ggagctgcatttagggagcctt

SEQ ID NO: 9270405 - DNA, 22 bp, Homo sapiens
ggagctgggaccctgtcatctg

SEQ ID NO: 9270406 - DNA, 22 bp, Homo sapiens
ggagctgggaccctgtcatctg

SEQ ID NO: 9270407 - DNA, 22 bp, Homo sapiens
ggagctggctacagagaactcc

SEQ ID NO: 9270408 - DNA, 22 bp, Homo sapiens
gcttggaagtaggattgggaga

SEQ ID NO: 9270409 - DNA, 22 bp, Homo sapiens
gcttggaagtaggattgggaga

SEQ ID NO: 9270410 - DNA, 22 bp, Homo sapiens
gcttggaagtaggattgggaga

SEQ ID NO: 9270411 - DNA, 22 bp, Homo sapiens
gcttaaacccaggaagttgtgg

SEQ ID NO: 9270412 - DNA, 21 bp, Homo sapiens
gcttggttttggttacttgcc

SEQ ID NO: 9270413 - DNA, 22 bp, Homo sapiens
gcttggttactgatggaaagga

SEQ ID NO: 9270414 - DNA, 18 bp, Homo sapiens
gcttggtttccacaaacc

SEQ ID NO: 9270415 - DNA, 22 bp, Homo sapiens
gcttggcagggcctgctggagc

SEQ ID NO: 9270416 - DNA, 22 bp, Homo sapiens
gctttaatgcaatttcacctca

SEQ ID NO: 9270417 - DNA, 22 bp, Homo sapiens
gctttaatgcttcgtggggcca

SEQ ID NO: 9270418 - DNA, 22 bp, Homo sapiens
gctttaatgaagtcacgcaaag

SEQ ID NO: 9270419 - DNA, 22 bp, Homo sapiens
gctttaaatggcttgcccaagt

SEQ ID NO: 9270420 - DNA, 22 bp, Homo sapiens
gctttaaacctctactctgtcc

SEQ ID NO: 9270421 - DNA, 22 bp, Homo sapiens
gctgtgtgttcaataatgtgat

SEQ ID NO: 9270422 - DNA, 22 bp, Homo sapiens
gctgtgttgggaatcatgtggg

SEQ ID NO: 9270423 - DNA, 22 bp, Homo sapiens
gctgtgttggtgaagctgtagc

SEQ ID NO: 9270424 - DNA, 21 bp, Homo sapiens
gctgttgcccgccgcctcttc

SEQ ID NO: 9270425 - DNA, 22 bp, Homo sapiens
gctgtgtgctgggcatggcact

SEQ ID NO: 9270426 - DNA, 22 bp, Homo sapiens
gctgtgtgctcacgtagtggaa

SEQ ID NO: 9270427 - DNA, 22 bp, Homo sapiens
gctgtgtgctcacgtagtggaa

SEQ ID NO: 9270428 - DNA, 22 bp, Homo sapiens
gctgtgtgctgggcatggcact

SEQ ID NO: 9270429 - DNA, 22 bp, Homo sapiens
gcttaaaagccacttagtctat

SEQ ID NO: 9270430 - DNA, 22 bp, Homo sapiens
gcttaaaatccatgatttttac

SEQ ID NO: 9270431 - DNA, 22 bp, Homo sapiens
gctgtttctggttctgttccta

SEQ ID NO: 9270432 - DNA, 22 bp, Homo sapiens
gctgtttctgagtagctaggct

SEQ ID NO: 9270433 - DNA, 22 bp, Homo sapiens
gctgtttcgggtggaggtggag

SEQ ID NO: 9270434 - DNA, 22 bp, Homo sapiens
gctgtttctaccagaagaatca

SEQ ID NO: 9270435 - DNA, 22 bp, Homo sapiens
gctgtttccagttacgtggata

SEQ ID NO: 9270436 - DNA, 22 bp, Homo sapiens
gctgtttccatttaagtgaatc

SEQ ID NO: 9270437 - DNA, 22 bp, Homo sapiens
gctttgtgtagaaggaggatgg

SEQ ID NO: 9270438 - DNA, 22 bp, Homo sapiens
gcttttctccttagtgtccctg

SEQ ID NO: 9270439 - DNA, 22 bp, Homo sapiens
gcttttcatagataaaattcta

SEQ ID NO: 9270440 - DNA, 22 bp, Homo sapiens
gcttttctagctagaacatccg

SEQ ID NO: 9270441 - DNA, 20 bp, Homo sapiens
gctttttctaatagcagtcc

SEQ ID NO: 9270442 - DNA, 22 bp, Homo sapiens
gctttttcaaatgaaagctggt

SEQ ID NO: 9270443 - DNA, 22 bp, Homo sapiens
gcttttggccagatggggaaac

SEQ ID NO: 9270444 - DNA, 22 bp, Homo sapiens
gcttttgtcattcaaatgctct

SEQ ID NO: 9270445 - DNA, 22 bp, Homo sapiens
gcttttgtgagattaagctact

SEQ ID NO: 9270446 - DNA, 22 bp, Homo sapiens
gctttggtcaggtgtccagccc

SEQ ID NO: 9270447 - DNA, 22 bp, Homo sapiens
gctttgtgaattattactcaca

SEQ ID NO: 9270448 - DNA, 22 bp, Homo sapiens
gctttgtgaattattactcaca

SEQ ID NO: 9270449 - DNA, 22 bp, Homo sapiens
gctttatccgcttgacccttac

SEQ ID NO: 9270450 - DNA, 22 bp, Homo sapiens
gctggccacattgtgccgtcct

SEQ ID NO: 9270451 - DNA, 19 bp, Homo sapiens
gctggccacgccccagttg

SEQ ID NO: 9270452 - DNA, 22 bp, Homo sapiens
gctggccacactgctgatggag

SEQ ID NO: 9270453 - DNA, 22 bp, Homo sapiens
gctggccacactgctgatggag

SEQ ID NO: 9270454 - DNA, 22 bp, Homo sapiens
gctggccacagatccccaggga

SEQ ID NO: 9270455 - DNA, 22 bp, Homo sapiens
gctggtccaattatgaactgtt

SEQ ID NO: 9270456 - DNA, 22 bp, Homo sapiens
gctggtccactccctggaggct

SEQ ID NO: 9270457 - DNA, 22 bp, Homo sapiens
gctgtacattctgcacaggccc

SEQ ID NO: 9270458 - DNA, 22 bp, Homo sapiens
gctgtacattctgcacaggccc

SEQ ID NO: 9270459 - DNA, 23 bp, Homo sapiens
gctgtacaggaaccagtttggag

SEQ ID NO: 9270460 - DNA, 23 bp, Homo sapiens
gctgtcagttgtttttgtctcta

SEQ ID NO: 9270461 - DNA, 22 bp, Homo sapiens
gctgtcagtgaggtgagacatg

SEQ ID NO: 9270462 - DNA, 22 bp, Homo sapiens
gctgtcaggaacatgccttggt

SEQ ID NO: 9270463 - DNA, 22 bp, Homo sapiens
gctgtcaggccatgtgggcctt

SEQ ID NO: 9270464 - DNA, 22 bp, Homo sapiens
gctgtcactctccggccttccc

SEQ ID NO: 9270465 - DNA, 22 bp, Homo sapiens
gctgtcactcaccaggcctgca

SEQ ID NO: 9270466 - DNA, 22 bp, Homo sapiens
gctgtcagaaggtgaagggtaa

SEQ ID NO: 9270467 - DNA, 22 bp, Homo sapiens
gctgtcagcgcccaaggagctc

SEQ ID NO: 9270468 - DNA, 22 bp, Homo sapiens
gctgtcacaagcatctggggca

SEQ ID NO: 9270469 - DNA, 22 bp, Homo sapiens
gctgtcacacatggccccagct

SEQ ID NO: 9270470 - DNA, 22 bp, Homo sapiens
gctgtcacacatgggatctcag

SEQ ID NO: 9270471 - DNA, 22 bp, Homo sapiens
gctgtcacatcaaggcactaaa

SEQ ID NO: 9270472 - DNA, 22 bp, Homo sapiens
gctgtcacatttggagcactgg

SEQ ID NO: 9270473 - DNA, 22 bp, Homo sapiens
gctgtcaccaaagcaggcactg

SEQ ID NO: 9270474 - DNA, 22 bp, Homo sapiens
gctgtattcctgcactgtatag

SEQ ID NO: 9270475 - DNA, 22 bp, Homo sapiens
gctgtatttaacaactggctca

SEQ ID NO: 9270476 - DNA, 22 bp, Homo sapiens
gctgtatttattttctagggtt

SEQ ID NO: 9270477 - DNA, 22 bp, Homo sapiens
gctgtcacaaatatttctcagc

SEQ ID NO: 9270478 - DNA, 22 bp, Homo sapiens
gctgtagatggactggcatcca

SEQ ID NO: 9270479 - DNA, 22 bp, Homo sapiens
gctgtaggtaaggatggcaaag

SEQ ID NO: 9270480 - DNA, 22 bp, Homo sapiens
gctgtagtgaatggccgcgttc

SEQ ID NO: 9270481 - DNA, 22 bp, Homo sapiens
gctgtatgtgaggccacagtga

SEQ ID NO: 9270482 - DNA, 22 bp, Homo sapiens
gctgtatgtgaggccacagtga

SEQ ID NO: 9270483 - DNA, 19 bp, Homo sapiens
gctgtgtgaccttgggcaa

SEQ ID NO: 9270484 - DNA, 22 bp, Homo sapiens
gctgtgtgactgagagcctggc

SEQ ID NO: 9270485 - DNA, 22 bp, Homo sapiens
gctgtgtgactgagagcctggc

SEQ ID NO: 9270486 - DNA, 22 bp, Homo sapiens
gctgtgtgactgagagcctggc

SEQ ID NO: 9270487 - DNA, 22 bp, Homo sapiens
gctgtgtgacctgggcaagtct

SEQ ID NO: 9270488 - DNA, 19 bp, Homo sapiens
gctgtgtgaccttgggcaa

SEQ ID NO: 9270489 - DNA, 22 bp, Homo sapiens
gctgtgtgctcacgtagtggaa

SEQ ID NO: 9270490 - DNA, 22 bp, Homo sapiens
gctgtgtgctaggatatgtttt

SEQ ID NO: 9270491 - DNA, 22 bp, Homo sapiens
gctgtgtgctaggatatgtttt

SEQ ID NO: 9270492 - DNA, 22 bp, Homo sapiens
gctgtgtgccaggggaaggctg

SEQ ID NO: 9270493 - DNA, 22 bp, Homo sapiens
gctgtgtgccaggggaaggctg

SEQ ID NO: 9270494 - DNA, 22 bp, Homo sapiens
gctgtctgtctctgtcccacca

SEQ ID NO: 9270495 - DNA, 22 bp, Homo sapiens
gctgtctgggttgagggccctg

SEQ ID NO: 9270496 - DNA, 22 bp, Homo sapiens
gctgtctggaggctctgaggga

SEQ ID NO: 9270497 - DNA, 22 bp, Homo sapiens
gctgtctggatatcttggaatt

SEQ ID NO: 9270498 - DNA, 22 bp, Homo sapiens
gctgtctggcatggcgtggctg

SEQ ID NO: 9270499 - DNA, 22 bp, Homo sapiens
gctgtcctggggagggagaatg

SEQ ID NO: 9270500 - DNA, 22 bp, Homo sapiens
gctgtctcatacaaggccctgc

SEQ ID NO: 9270501 - DNA, 22 bp, Homo sapiens
gctgtctcatacaaggccctgc

SEQ ID NO: 9270502 - DNA, 22 bp, Homo sapiens
gctgtctgctgggtcgctcagg

SEQ ID NO: 9270503 - DNA, 22 bp, Homo sapiens
gctgtctgctgtgcactgagca

SEQ ID NO: 9270504 - DNA, 22 bp, Homo sapiens
gctgtcccgctgacttccagct

SEQ ID NO: 9270505 - DNA, 23 bp, Homo sapiens
gctgtcagttgtttttgtctcta

SEQ ID NO: 9270506 - DNA, 22 bp, Homo sapiens
gctgtccacctccagagcctta

SEQ ID NO: 9270507 - DNA, 22 bp, Homo sapiens
gctgtcagttttacccacagac

SEQ ID NO: 9270508 - DNA, 22 bp, Homo sapiens
gctgtccaggagtgcagagatt

SEQ ID NO: 9270509 - DNA, 22 bp, Homo sapiens
gctgtccagagcatgggagcaa

SEQ ID NO: 9270510 - DNA, 22 bp, Homo sapiens
gctgtccatccacttcccagcg

SEQ ID NO: 9270511 - DNA, 22 bp, Homo sapiens
gctgtccatgtctggcctcagt

SEQ ID NO: 9270512 - DNA, 22 bp, Homo sapiens
gctgtcccatggttgcaagatg

SEQ ID NO: 9270513 - DNA, 22 bp, Homo sapiens
gctgtcccgaacccctggtaat

SEQ ID NO: 9270514 - DNA, 22 bp, Homo sapiens
tttttataactcttttgtgaca

SEQ ID NO: 9270515 - DNA, 22 bp, Homo sapiens
tttttataactcttttgtgaca

SEQ ID NO: 9270516 - DNA, 23 bp, Homo sapiens
tttttagttacacctctgccacc

SEQ ID NO: 9270517 - DNA, 22 bp, Homo sapiens
tttttacctggaggataaatgt

SEQ ID NO: 9270518 - DNA, 22 bp, Homo sapiens
tttttagccaagccataggtct

SEQ ID NO: 9270519 - DNA, 22 bp, Homo sapiens
ttttgtttaaaatcctggatgg

SEQ ID NO: 9270520 - DNA, 22 bp, Homo sapiens
ttttgtttaaaatcctggatgg

SEQ ID NO: 9270521 - DNA, 22 bp, Homo sapiens
ttttgtttgtgtccactgcagt

SEQ ID NO: 9270522 - DNA, 22 bp, Homo sapiens
tttttacacttagcattgagcg

SEQ ID NO: 9270523 - DNA, 22 bp, Homo sapiens
tttttacacttagcattgagcg

SEQ ID NO: 9270524 - DNA, 22 bp, Homo sapiens
tttttacacttagcattgagcg

SEQ ID NO: 9270525 - DNA, 22 bp, Homo sapiens
tttttacagtcatggtcactca

SEQ ID NO: 9270526 - DNA, 22 bp, Homo sapiens
tttttatactttgctcaagatt

SEQ ID NO: 9270527 - DNA, 22 bp, Homo sapiens
tttttatcttgtatgtgtctct

SEQ ID NO: 9270528 - DNA, 22 bp, Homo sapiens
tttttatgcctacgctgaaaag

SEQ ID NO: 9270529 - DNA, 22 bp, Homo sapiens
tttttcaagacaacctgcatgt

SEQ ID NO: 9270530 - DNA, 22 bp, Homo sapiens
tttttatctacagattctcagc

SEQ ID NO: 9270531 - DNA, 22 bp, Homo sapiens
tttttatctacagattctcagc

SEQ ID NO: 9270532 - DNA, 22 bp, Homo sapiens
tttttcatattcccctctctgg

SEQ ID NO: 9270533 - DNA, 22 bp, Homo sapiens
tttttcatctgattgataactc

SEQ ID NO: 9270534 - DNA, 22 bp, Homo sapiens
tttttcatctgattgataactc

SEQ ID NO: 9270535 - DNA, 22 bp, Homo sapiens
tttggtaatgtttcattgcaga

SEQ ID NO: 9270536 - DNA, 22 bp, Homo sapiens
tttggtctggaatcttcagggt

SEQ ID NO: 9270537 - DNA, 22 bp, Homo sapiens
tttgcttgttcaagatttctgt

SEQ ID NO: 9270538 - DNA, 22 bp, Homo sapiens
tttgcttgttcaagatttctgt

SEQ ID NO: 9270539 - DNA, 22 bp, Homo sapiens
tttgcttgttcaagatttctgt

SEQ ID NO: 9270540 - DNA, 22 bp, Homo sapiens
tttgcttgttcaagatttctgt

SEQ ID NO: 9270541 - DNA, 22 bp, Homo sapiens
tttgatttactggatattctca

SEQ ID NO: 9270542 - DNA, 18 bp, Homo sapiens
tttgctttccttcttcag

SEQ ID NO: 9270543 - DNA, 18 bp, Homo sapiens
tttgctttccttcttcag

SEQ ID NO: 9270544 - DNA, 22 bp, Homo sapiens
tttgctttctgttgaacagagt

SEQ ID NO: 9270545 - DNA, 22 bp, Homo sapiens
tttgctttgggaggttgtctgg

SEQ ID NO: 9270546 - DNA, 22 bp, Homo sapiens
tttgctttgactgtcagcaagt

SEQ ID NO: 9270547 - DNA, 22 bp, Homo sapiens
tttgatttactggatattctca

SEQ ID NO: 9270548 - DNA, 22 bp, Homo sapiens
tttgatgatgatgataaagttt

SEQ ID NO: 9270549 - DNA, 22 bp, Homo sapiens
tttgatgagtttaataacagcc

SEQ ID NO: 9270550 - DNA, 19 bp, Homo sapiens
tttgatgagaatttaagca

SEQ ID NO: 9270551 - DNA, 22 bp, Homo sapiens
tttgatgaacctatataatttg

SEQ ID NO: 9270552 - DNA, 22 bp, Homo sapiens
tttgagtgcccatgtttcccag

SEQ ID NO: 9270553 - DNA, 22 bp, Homo sapiens
tttgagtctgcttccattttca

SEQ ID NO: 9270554 - DNA, 22 bp, Homo sapiens
tttgaggttagctagcagatca

SEQ ID NO: 9270555 - DNA, 22 bp, Homo sapiens
tttgaggaagatcggagggaaa

SEQ ID NO: 9270556 - DNA, 22 bp, Homo sapiens
tttgacagcagataaaataaaa

SEQ ID NO: 9270557 - DNA, 22 bp, Homo sapiens
tttgatagggaagtaagaatga

SEQ ID NO: 9270558 - DNA, 19 bp, Homo sapiens
tttgatatctgaattatgc

SEQ ID NO: 9270559 - DNA, 19 bp, Homo sapiens
tttgatatctgaattatgc

SEQ ID NO: 9270560 - DNA, 22 bp, Homo sapiens
tttgatatgcaaaattatggac

SEQ ID NO: 9270561 - DNA, 22 bp, Homo sapiens
tttgatgaaagctactatttac

SEQ ID NO: 9270562 - DNA, 22 bp, Homo sapiens
tttgatctatgcgtggtttccc

SEQ ID NO: 9270563 - DNA, 22 bp, Homo sapiens
tttgatccgttgctggtgagga

SEQ ID NO: 9270564 - DNA, 21 bp, Homo sapiens
tttctttctggctctcacagt

SEQ ID NO: 9270565 - DNA, 22 bp, Homo sapiens
tttcttttacagtgtggctatt

SEQ ID NO: 9270566 - DNA, 22 bp, Homo sapiens
tttcttttccaatatccctact

SEQ ID NO: 9270567 - DNA, 22 bp, Homo sapiens
tttgaaagcaccatttgagtag

SEQ ID NO: 9270568 - DNA, 22 bp, Homo sapiens
tttcttttgccctgtgggttag

SEQ ID NO: 9270569 - DNA, 21 bp, Homo sapiens
tttccctcattgtgttggcac

SEQ ID NO: 9270570 - DNA, 22 bp, Homo sapiens
tttccctacttgtaactggaaa

SEQ ID NO: 9270571 - DNA, 22 bp, Homo sapiens
tttcccctcagtactaaacata

SEQ ID NO: 9270572 - DNA, 22 bp, Homo sapiens
tttccctctgtgccagcttctc

SEQ ID NO: 9270573 - DNA, 22 bp, Homo sapiens
tttccctctgtgccagcttctc

SEQ ID NO: 9270574 - DNA, 22 bp, Homo sapiens
tttcctaacacaatgcatgaga

SEQ ID NO: 9270575 - DNA, 19 bp, Homo sapiens
tttcctaaaaagctgtgct

SEQ ID NO: 9270576 - DNA, 22 bp, Homo sapiens
tttccctttgcactctacaatt

SEQ ID NO: 9270577 - DNA, 22 bp, Homo sapiens
tttcccttgaataaagatatct

SEQ ID NO: 9270578 - DNA, 22 bp, Homo sapiens
tttcctctaaacgcatttgctt

SEQ ID NO: 9270579 - DNA, 22 bp, Homo sapiens
tttcctcctagcctccagccgc

SEQ ID NO: 9270580 - DNA, 22 bp, Homo sapiens
tttcctcctagcctccagccgc

SEQ ID NO: 9270581 - DNA, 22 bp, Homo sapiens
tttcctcagaagtgtctactat

SEQ ID NO: 9270582 - DNA, 22 bp, Homo sapiens
tttcctctccggggcctccagg

SEQ ID NO: 9270583 - DNA, 22 bp, Homo sapiens
tttcctctgactgctcccctgc

SEQ ID NO: 9270584 - DNA, 22 bp, Homo sapiens
tttcctctgagtgagctgggag

SEQ ID NO: 9270585 - DNA, 22 bp, Homo sapiens
tttgaatgagaattattgtcat

SEQ ID NO: 9270586 - DNA, 22 bp, Homo sapiens
tttgacagagttgtgaggattt

SEQ ID NO: 9270587 - DNA, 22 bp, Homo sapiens
tttgaatatcacaaactttcaa

SEQ ID NO: 9270588 - DNA, 22 bp, Homo sapiens
tttgaatatacttcaaacaaag

SEQ ID NO: 9270589 - DNA, 22 bp, Homo sapiens
tttgaagagccacagtgaaatt

SEQ ID NO: 9270590 - DNA, 22 bp, Homo sapiens
tttgaatagggctttgcaggga

SEQ ID NO: 9270591 - DNA, 22 bp, Homo sapiens
tttgaaagcctggcttttctct

SEQ ID NO: 9270592 - DNA, 21 bp, Homo sapiens
tttgaaagccctatgttttca

SEQ ID NO: 9270593 - DNA, 21 bp, Homo sapiens
tttgaaagctacatctatagc

SEQ ID NO: 9270594 - DNA, 19 bp, Homo sapiens
tttgaaaggattgttattt

SEQ ID NO: 9270595 - DNA, 22 bp, Homo sapiens
tttgaaagggttatgagactga

SEQ ID NO: 9270596 - DNA, 22 bp, Homo sapiens
tttgaaaggagctttatccaga

SEQ ID NO: 9270597 - DNA, 22 bp, Homo sapiens
tttgaaaggagctttatccaga

SEQ ID NO: 9270598 - DNA, 22 bp, Homo sapiens
ttttatgtgctggactggcagt

SEQ ID NO: 9270599 - DNA, 22 bp, Homo sapiens
ttttatgtgctggactggcagt

SEQ ID NO: 9270600 - DNA, 22 bp, Homo sapiens
ttttatgtaatccttactgtcg

SEQ ID NO: 9270601 - DNA, 22 bp, Homo sapiens
ttttatgtaatccttactgtcg

SEQ ID NO: 9270602 - DNA, 22 bp, Homo sapiens
ttttatgagaatgcgccacttg

SEQ ID NO: 9270603 - DNA, 18 bp, Homo sapiens
ttttaatttcaggggtgg

SEQ ID NO: 9270604 - DNA, 22 bp, Homo sapiens
ttttaattgcaattatggtccc

SEQ ID NO: 9270605 - DNA, 18 bp, Homo sapiens
ttttaatttcaggggtgg

SEQ ID NO: 9270606 - DNA, 22 bp, Homo sapiens
ttttatgagtgtccctctgtgg

SEQ ID NO: 9270607 - DNA, 22 bp, Homo sapiens
ttttatgattgagctggctaca

SEQ ID NO: 9270608 - DNA, 21 bp, Homo sapiens
ttttatgcataggaaatatat

SEQ ID NO: 9270609 - DNA, 22 bp, Homo sapiens
ttttatgcaagttatgattaaa

SEQ ID NO: 9270610 - DNA, 22 bp, Homo sapiens
ttttaattcaaagtgaatagtg

SEQ ID NO: 9270611 - DNA, 22 bp, Homo sapiens
ttttaatgtgctctgcaatgat

SEQ ID NO: 9270612 - DNA, 22 bp, Homo sapiens
ttttaatgtgctctgcaatgat

SEQ ID NO: 9270613 - DNA, 22 bp, Homo sapiens
ttttaatgggcgactattatgg

SEQ ID NO: 9270614 - DNA, 22 bp, Homo sapiens
ttttaatgggcgactattatgg

SEQ ID NO: 9270615 - DNA, 22 bp, Homo sapiens
tttgttcaatccagacaatagc

SEQ ID NO: 9270616 - DNA, 22 bp, Homo sapiens
ttttaaatctccagttgacccc

SEQ ID NO: 9270617 - DNA, 22 bp, Homo sapiens
ttttaacttaaaatacatagat

SEQ ID NO: 9270618 - DNA, 22 bp, Homo sapiens
ttttaacttaaaatacatagat

SEQ ID NO: 9270619 - DNA, 22 bp, Homo sapiens
ttttaacactcagcactatctc

SEQ ID NO: 9270620 - DNA, 22 bp, Homo sapiens
ttttaagaaatgtatgactgtc

SEQ ID NO: 9270621 - DNA, 21 bp, Homo sapiens
ttttaacaaggatttccctag

SEQ ID NO: 9270622 - DNA, 22 bp, Homo sapiens
ttttaacactcagcactatctc

SEQ ID NO: 9270623 - DNA, 22 bp, Homo sapiens
tttgtgttgtacttctgtgcat

SEQ ID NO: 9270624 - DNA, 22 bp, Homo sapiens
tttgtgtttatgaagttattct

SEQ ID NO: 9270625 - DNA, 22 bp, Homo sapiens
tttgtgtttatgaagttattct

SEQ ID NO: 9270626 - DNA, 22 bp, Homo sapiens
tttgtgtttatgaagttattct

SEQ ID NO: 9270627 - DNA, 22 bp, Homo sapiens
tttgtgttaaatgttaaattca

SEQ ID NO: 9270628 - DNA, 22 bp, Homo sapiens
tttgtgttaaatgttaaattca

SEQ ID NO: 9270629 - DNA, 22 bp, Homo sapiens
tttgtgttaaatgttaaattca

SEQ ID NO: 9270630 - DNA, 22 bp, Homo sapiens
tttgtgttgtacttctgtgcat

SEQ ID NO: 9270631 - DNA, 22 bp, Homo sapiens
tttgtgttggaagaaatgctac

SEQ ID NO: 9270632 - DNA, 22 bp, Homo sapiens
tttgtgttggaagaaatgctac

SEQ ID NO: 9270633 - DNA, 22 bp, Homo sapiens
tttgtgttttcactagcagtgt

SEQ ID NO: 9270634 - DNA, 22 bp, Homo sapiens
tttgtgttttcccatactattg

SEQ ID NO: 9270635 - DNA, 22 bp, Homo sapiens
tttgttaaaatgcagattctgt

SEQ ID NO: 9270636 - DNA, 22 bp, Homo sapiens
tttgttaaaatgcagattctgt

SEQ ID NO: 9270637 - DNA, 22 bp, Homo sapiens
tttgttaaatatttattgagtg

SEQ ID NO: 9270638 - DNA, 22 bp, Homo sapiens
tttgttataacaataaaaagtc

SEQ ID NO: 9270639 - DNA, 22 bp, Homo sapiens
tttgttcaacaggtgaaataga

SEQ ID NO: 9270640 - DNA, 22 bp, Homo sapiens
tttgtgtcgtcactgtcttctc

SEQ ID NO: 9270641 - DNA, 22 bp, Homo sapiens
tttgtaaagtctgttctgagtt

SEQ ID NO: 9270642 - DNA, 22 bp, Homo sapiens
ttttattgcaataaagtgtgta

SEQ ID NO: 9270643 - DNA, 22 bp, Homo sapiens
ttttattggagtgataccaagc

SEQ ID NO: 9270644 - DNA, 22 bp, Homo sapiens
ttttattggagtgataccaagc

SEQ ID NO: 9270645 - DNA, 22 bp, Homo sapiens
ttttattggagtgataccaagc

SEQ ID NO: 9270646 - DNA, 22 bp, Homo sapiens
ttttattggagtgataccaagc

SEQ ID NO: 9270647 - DNA, 22 bp, Homo sapiens
ttttattgcaataaagtgtgta

SEQ ID NO: 9270648 - DNA, 22 bp, Homo sapiens
ttttattgcaataaagtgtgta

SEQ ID NO: 9270649 - DNA, 22 bp, Homo sapiens
ttttattgcaataaagtgtgta

SEQ ID NO: 9270650 - DNA, 22 bp, Homo sapiens
ttttattatctttgaatgggac

SEQ ID NO: 9270651 - DNA, 21 bp, Homo sapiens
ttttattgatgaatggccact

SEQ ID NO: 9270652 - DNA, 21 bp, Homo sapiens
ttttattgatgaatggccact

SEQ ID NO: 9270653 - DNA, 22 bp, Homo sapiens
ttttatgtgtgaaatgctgtct

SEQ ID NO: 9270654 - DNA, 22 bp, Homo sapiens
ttttatgtgtcaaagcagtggt

SEQ ID NO: 9270655 - DNA, 22 bp, Homo sapiens
ttttatgttcctctttatgcga

SEQ ID NO: 9270656 - DNA, 22 bp, Homo sapiens
ttttatgttcctctttatgcga

SEQ ID NO: 9270657 - DNA, 22 bp, Homo sapiens
ttttatgttcctctttatgcga

SEQ ID NO: 9270658 - DNA, 22 bp, Homo sapiens
ttttattagtggctagatgggg

SEQ ID NO: 9270659 - DNA, 22 bp, Homo sapiens
ttttattagtggctagatgggg

SEQ ID NO: 9270660 - DNA, 22 bp, Homo sapiens
ttttatgttcctgaagctatct

SEQ ID NO: 9270661 - DNA, 22 bp, Homo sapiens
ttttatgttcctgaagctatct

SEQ ID NO: 9270662 - DNA, 22 bp, Homo sapiens
ttttatgttgctataataggta

SEQ ID NO: 9270663 - DNA, 22 bp, Homo sapiens
ttttatgttgctataataggta

SEQ ID NO: 9270664 - DNA, 22 bp, Homo sapiens
ttttcacacaaggtgataagtt

SEQ ID NO: 9270665 - DNA, 22 bp, Homo sapiens
ttttattggagtgataccaagc

SEQ ID NO: 9270666 - DNA, 22 bp, Homo sapiens
ttttattggagtgataccaagc

SEQ ID NO: 9270667 - DNA, 22 bp, Homo sapiens
ttttcacacaaggtgataagtt

SEQ ID NO: 9270668 - DNA, 22 bp, Homo sapiens
ttttcacacaaggtgataagtt

SEQ ID NO: 9270669 - DNA, 22 bp, Homo sapiens
ttttcatctctgctttgtacct

SEQ ID NO: 9270670 - DNA, 22 bp, Homo sapiens
ttttcatagtaatggtgcatgt

SEQ ID NO: 9270671 - DNA, 22 bp, Homo sapiens
ttttcatgtcatgtccttgagg

SEQ ID NO: 9270672 - DNA, 22 bp, Homo sapiens
ttttcatgtgatgtgacatttc

SEQ ID NO: 9270673 - DNA, 22 bp, Homo sapiens
ttttcatgtcatgtccttgagg

SEQ ID NO: 9270674 - DNA, 22 bp, Homo sapiens
ttttcattgtaaatcaggaaac

SEQ ID NO: 9270675 - DNA, 22 bp, Homo sapiens
ttttcatgttccttgttaagtg

SEQ ID NO: 9270676 - DNA, 22 bp, Homo sapiens
ttttcattagaatgactgagaa

SEQ ID NO: 9270677 - DNA, 22 bp, Homo sapiens
ttttcattgttcctcgagcatt

SEQ ID NO: 9270678 - DNA, 22 bp, Homo sapiens
ttttcattgttactatgagcta

SEQ ID NO: 9270679 - DNA, 22 bp, Homo sapiens
ttttctattcattgtctatggt

SEQ ID NO: 9270680 - DNA, 22 bp, Homo sapiens
ttttcatttacattagggaaga

SEQ ID NO: 9270681 - DNA, 22 bp, Homo sapiens
ttttcatttttgtagatgcaag

SEQ ID NO: 9270682 - DNA, 22 bp, Homo sapiens
ttttcatttttgtagatgcaag

SEQ ID NO: 9270683 - DNA, 22 bp, Homo sapiens
ttttctcttccctctggacctg

SEQ ID NO: 9270684 - DNA, 22 bp, Homo sapiens
ttttctcagctgcactgtatta

SEQ ID NO: 9270685 - DNA, 22 bp, Homo sapiens
ttttctcagctgcactgtatta

SEQ ID NO: 9270686 - DNA, 22 bp, Homo sapiens
ttttctgaagtttaagacattt

SEQ ID NO: 9270687 - DNA, 22 bp, Homo sapiens
ttttctgaagtttaagacattt

SEQ ID NO: 9270688 - DNA, 22 bp, Homo sapiens
ttttctgaagtttaagacattt

SEQ ID NO: 9270689 - DNA, 22 bp, Homo sapiens
ttttctgacctatctacattta

SEQ ID NO: 9270690 - DNA, 22 bp, Homo sapiens
ttttctgacctatctacattta

SEQ ID NO: 9270691 - DNA, 22 bp, Homo sapiens
ttttctgaagtttaagacattt

SEQ ID NO: 9270692 - DNA, 22 bp, Homo sapiens
ttttctcttgttaatgtactga

SEQ ID NO: 9270693 - DNA, 22 bp, Homo sapiens
ttttctcttgttaatgtactga

SEQ ID NO: 9270694 - DNA, 22 bp, Homo sapiens
ttttctcttgttaatgtactga

SEQ ID NO: 9270695 - DNA, 22 bp, Homo sapiens
ttttctgtttacagagggacct

SEQ ID NO: 9270696 - DNA, 22 bp, Homo sapiens
ttttctgtgtatccaggcttcc

SEQ ID NO: 9270697 - DNA, 22 bp, Homo sapiens
ttttctgtattattgtgcttca

SEQ ID NO: 9270698 - DNA, 22 bp, Homo sapiens
ttttctgtattattgtgcttca

SEQ ID NO: 9270699 - DNA, 22 bp, Homo sapiens
ttttctgagctcagtgacttac

SEQ ID NO: 9270700 - DNA, 22 bp, Homo sapiens
ttttctgagctcagtgacttac

SEQ ID NO: 9270701 - DNA, 22 bp, Homo sapiens
ttttctgacctatctacattta

SEQ ID NO: 9270702 - DNA, 22 bp, Homo sapiens
ttttctgactctattgaggtat

SEQ ID NO: 9270703 - DNA, 22 bp, Homo sapiens
ttttcttatggtgaagcacaaa

SEQ ID NO: 9270704 - DNA, 22 bp, Homo sapiens
ttttcttactgtctgtgatcct

SEQ ID NO: 9270705 - DNA, 22 bp, Homo sapiens
ttttctgtttgcttcaagacat

SEQ ID NO: 9270706 - DNA, 22 bp, Homo sapiens
ttctctggaaggctctacggga

SEQ ID NO: 9270707 - DNA, 22 bp, Homo sapiens
ttctctggaactgaaacaagat

SEQ ID NO: 9270708 - DNA, 22 bp, Homo sapiens
ttctctgagtacgtttcagtgt

SEQ ID NO: 9270709 - DNA, 22 bp, Homo sapiens
ttctctgatcttgctagactga

SEQ ID NO: 9270710 - DNA, 22 bp, Homo sapiens
ttctctgacccccttaaatatt

SEQ ID NO: 9270711 - DNA, 22 bp, Homo sapiens
ttctctgagatagactaagtgg

SEQ ID NO: 9270712 - DNA, 22 bp, Homo sapiens
ttctctcttccagttcccactt

SEQ ID NO: 9270713 - DNA, 22 bp, Homo sapiens
ttctctgaaggccatgctcact

SEQ ID NO: 9270714 - DNA, 22 bp, Homo sapiens
ttctctgaaggccatgctcact

SEQ ID NO: 9270715 - DNA, 22 bp, Homo sapiens
ttctctctgtggtcccattttg

SEQ ID NO: 9270716 - DNA, 22 bp, Homo sapiens
ttctctcttactgccatgctgt

SEQ ID NO: 9270717 - DNA, 22 bp, Homo sapiens
ttctctcttactgccatgctgt

SEQ ID NO: 9270718 - DNA, 22 bp, Homo sapiens
ttctctaatggtgatgattaga

SEQ ID NO: 9270719 - DNA, 22 bp, Homo sapiens
ttctctaagccttagtttcttc

SEQ ID NO: 9270720 - DNA, 22 bp, Homo sapiens
ttctctaagccttagtttcttc

SEQ ID NO: 9270721 - DNA, 22 bp, Homo sapiens
ttctctaggttttagatgaaga

SEQ ID NO: 9270722 - DNA, 22 bp, Homo sapiens
ttctctaggagttctgggatca

SEQ ID NO: 9270723 - DNA, 20 bp, Homo sapiens
ttctctagccttcccctggg

SEQ ID NO: 9270724 - DNA, 19 bp, Homo sapiens
ttctctattatgtcttctc

SEQ ID NO: 9270725 - DNA, 22 bp, Homo sapiens
ttctctcctacccagtatccat

SEQ ID NO: 9270726 - DNA, 22 bp, Homo sapiens
ttctctcctacccagtatccat

SEQ ID NO: 9270727 - DNA, 22 bp, Homo sapiens
ttctctcccatgaagcttctat

SEQ ID NO: 9270728 - DNA, 22 bp, Homo sapiens
ttctctcccatgaagcttctat

SEQ ID NO: 9270729 - DNA, 22 bp, Homo sapiens
ttctctctgagagcatctggaa

SEQ ID NO: 9270730 - DNA, 21 bp, Homo sapiens
ttctctccatatgcccagccc

SEQ ID NO: 9270731 - DNA, 22 bp, Homo sapiens
ttctctccagtcctggattctg

SEQ ID NO: 9270732 - DNA, 22 bp, Homo sapiens
ttctctcattcaaattaaagtg

SEQ ID NO: 9270733 - DNA, 22 bp, Homo sapiens
ttctccaagatgaagctgtgta

SEQ ID NO: 9270734 - DNA, 22 bp, Homo sapiens
ttctccagacaacagagggtga

SEQ ID NO: 9270735 - DNA, 22 bp, Homo sapiens
ttctccacccactcttttgttg

SEQ ID NO: 9270736 - DNA, 23 bp, Homo sapiens
ttctcctgaggaagcagggactg

SEQ ID NO: 9270737 - DNA, 22 bp, Homo sapiens
ttctcctgagttcccaggtcta

SEQ ID NO: 9270738 - DNA, 22 bp, Homo sapiens
ttctcctctgttggccttccct

SEQ ID NO: 9270739 - DNA, 22 bp, Homo sapiens
ttctccagaccactgcctctgt

SEQ ID NO: 9270740 - DNA, 22 bp, Homo sapiens
ttctccagaccactgcctctgt

SEQ ID NO: 9270741 - DNA, 22 bp, Homo sapiens
ttctccagaccttgtgactatg

SEQ ID NO: 9270742 - DNA, 22 bp, Homo sapiens
ttctccagaccctcctgcagac

SEQ ID NO: 9270743 - DNA, 22 bp, Homo sapiens
ttctccagaccctcctgcagac

SEQ ID NO: 9270744 - DNA, 21 bp, Homo sapiens
ttctcagatcgagtagtgaga

SEQ ID NO: 9270745 - DNA, 22 bp, Homo sapiens
ttctcagatccatcagaagtcc

SEQ ID NO: 9270746 - DNA, 22 bp, Homo sapiens
ttccttgttctacatccctgcc

SEQ ID NO: 9270747 - DNA, 22 bp, Homo sapiens
ttccttgttcctaggagatcaa

SEQ ID NO: 9270748 - DNA, 22 bp, Homo sapiens
ttccttgtgtaaactctccatc

SEQ ID NO: 9270749 - DNA, 22 bp, Homo sapiens
ttccttgttaatagtgtctgga

SEQ ID NO: 9270750 - DNA, 22 bp, Homo sapiens
ttccttgggtgcctacttagag

SEQ ID NO: 9270751 - DNA, 22 bp, Homo sapiens
ttccttggtacagagtagcttt

SEQ ID NO: 9270752 - DNA, 22 bp, Homo sapiens
ttctcagattccccttttaata

SEQ ID NO: 9270753 - DNA, 22 bp, Homo sapiens
ttctcagatgattcagataaac

SEQ ID NO: 9270754 - DNA, 22 bp, Homo sapiens
ttcctggtgagatttcgttctg

SEQ ID NO: 9270755 - DNA, 22 bp, Homo sapiens
ttcctggtgacctcactggtag

SEQ ID NO: 9270756 - DNA, 22 bp, Homo sapiens
ttcctggtgacctcactggtag

SEQ ID NO: 9270757 - DNA, 22 bp, Homo sapiens
ttcctggtgacctcactggtag

SEQ ID NO: 9270758 - DNA, 22 bp, Homo sapiens
ttcctggtttatacctgtatca

SEQ ID NO: 9270759 - DNA, 22 bp, Homo sapiens
ttcctggttggattctgattaa

SEQ ID NO: 9270760 - DNA, 22 bp, Homo sapiens
ttcctggtcccgttcttcactg

SEQ ID NO: 9270761 - DNA, 22 bp, Homo sapiens
ttcctggtcctattatatacac

SEQ ID NO: 9270762 - DNA, 22 bp, Homo sapiens
ttcctggtctgtgccattcaga

SEQ ID NO: 9270763 - DNA, 22 bp, Homo sapiens
ttcctggtaaattatgtccagg

SEQ ID NO: 9270764 - DNA, 22 bp, Homo sapiens
ttcctggtaaattatgtccagg

SEQ ID NO: 9270765 - DNA, 22 bp, Homo sapiens
ttcctggtaacaatctcaaagt

SEQ ID NO: 9270766 - DNA, 22 bp, Homo sapiens
ttcctggtagtaagacatctgg

SEQ ID NO: 9270767 - DNA, 22 bp, Homo sapiens
ttcctggggtactggagaaaat

SEQ ID NO: 9270768 - DNA, 22 bp, Homo sapiens
ttcctggggtgaagatattttt

SEQ ID NO: 9270769 - DNA, 22 bp, Homo sapiens
ttcctggggggatagatttcac

SEQ ID NO: 9270770 - DNA, 22 bp, Homo sapiens
ttcctggggcttagcaatggag

SEQ ID NO: 9270771 - DNA, 22 bp, Homo sapiens
ttcctgggggcagcagtcttga

SEQ ID NO: 9270772 - DNA, 22 bp, Homo sapiens
ttcctgggggcagcagtcttga

SEQ ID NO: 9270773 - DNA, 22 bp, Homo sapiens
ttcctggggctccagctaccag

SEQ ID NO: 9270774 - DNA, 22 bp, Homo sapiens
ttcctgggtggtcctggtagag

SEQ ID NO: 9270775 - DNA, 19 bp, Homo sapiens
ttcctggggttccattgtg

SEQ ID NO: 9270776 - DNA, 19 bp, Homo sapiens
ttcctggggttccattgtg

SEQ ID NO: 9270777 - DNA, 22 bp, Homo sapiens
ttcctgggttgtgcattgtaca

SEQ ID NO: 9270778 - DNA, 22 bp, Homo sapiens
ttcctgggttccctctcattct

SEQ ID NO: 9270779 - DNA, 22 bp, Homo sapiens
ttccttggaagggtaattgcaa

SEQ ID NO: 9270780 - DNA, 22 bp, Homo sapiens
ttccttggagcgctaaagctct

SEQ ID NO: 9270781 - DNA, 22 bp, Homo sapiens
ttccttggccccatgcccaggg

SEQ ID NO: 9270782 - DNA, 22 bp, Homo sapiens
ttccttggccacactggtgctt

SEQ ID NO: 9270783 - DNA, 22 bp, Homo sapiens
ttccttggagttaagaccctgg

SEQ ID NO: 9270784 - DNA, 22 bp, Homo sapiens
ttccttggagtcaaacagggag

SEQ ID NO: 9270785 - DNA, 22 bp, Homo sapiens
ttccttgaaagtttgaactgac

SEQ ID NO: 9270786 - DNA, 22 bp, Homo sapiens
ttccttcttttacaccataaat

SEQ ID NO: 9270787 - DNA, 22 bp, Homo sapiens
ttccttgaatgagtcatggaaa

SEQ ID NO: 9270788 - DNA, 22 bp, Homo sapiens
ttccttctttgtggtagaaagt

SEQ ID NO: 9270789 - DNA, 22 bp, Homo sapiens
ttccttcttttacaccataaat

SEQ ID NO: 9270790 - DNA, 22 bp, Homo sapiens
ttccttgaccactgcataatga

SEQ ID NO: 9270791 - DNA, 22 bp, Homo sapiens
ttccttgagaaaggcacaagtt

SEQ ID NO: 9270792 - DNA, 22 bp, Homo sapiens
ttccttgagaaaggcacaagtt

SEQ ID NO: 9270793 - DNA, 22 bp, Homo sapiens
ttccttcttcctttagtaacca

SEQ ID NO: 9270794 - DNA, 22 bp, Homo sapiens
ttccttcttgtaatgatctgcc

SEQ ID NO: 9270795 - DNA, 22 bp, Homo sapiens
ttccttcttcctttagtaacca

SEQ ID NO: 9270796 - DNA, 22 bp, Homo sapiens
ttccttcttgtaatgatctgcc

SEQ ID NO: 9270797 - DNA, 22 bp, Homo sapiens
ttccttcttccaaacccatcat

SEQ ID NO: 9270798 - DNA, 22 bp, Homo sapiens
ttccttcttccaaacccatcat

SEQ ID NO: 9270799 - DNA, 22 bp, Homo sapiens
ttccttcttccaaacccatcat

SEQ ID NO: 9270800 - DNA, 22 bp, Homo sapiens
ttccttcttccagaggctgccc

SEQ ID NO: 9270801 - DNA, 22 bp, Homo sapiens
ttccttcttccagaggctgccc

SEQ ID NO: 9270802 - DNA, 22 bp, Homo sapiens
ttccttcttcattgtgttacag

SEQ ID NO: 9270803 - DNA, 22 bp, Homo sapiens
ttccttctggaggctccagggg

SEQ ID NO: 9270804 - DNA, 22 bp, Homo sapiens
ttccttctggaggctccagggg

SEQ ID NO: 9270805 - DNA, 22 bp, Homo sapiens
ttccttctggaggctccagggg

SEQ ID NO: 9270806 - DNA, 22 bp, Homo sapiens
ttccttctggaagcttcagggg

SEQ ID NO: 9270807 - DNA, 22 bp, Homo sapiens
ttccttctggaagcttcagggg

SEQ ID NO: 9270808 - DNA, 22 bp, Homo sapiens
ttccttctggagcccggggagc

SEQ ID NO: 9270809 - DNA, 18 bp, Homo sapiens
ttccttctgatgtatatg

SEQ ID NO: 9270810 - DNA, 22 bp, Homo sapiens
ttccagttcttctgtaagcact

SEQ ID NO: 9270811 - DNA, 22 bp, Homo sapiens
ttccagttggagcctgccttta

SEQ ID NO: 9270812 - DNA, 22 bp, Homo sapiens
ttccagttctgggctggctgct

SEQ ID NO: 9270813 - DNA, 22 bp, Homo sapiens
ttccagttggcactgcaattta

SEQ ID NO: 9270814 - DNA, 22 bp, Homo sapiens
ttccagttgtcataaagctagg

SEQ ID NO: 9270815 - DNA, 17 bp, Homo sapiens
ttccagtttagtattgt

SEQ ID NO: 9270816 - DNA, 22 bp, Homo sapiens
ttcctgagaaatttgtacctgg

SEQ ID NO: 9270817 - DNA, 22 bp, Homo sapiens
ttcctgagaaatttgtacctgg

SEQ ID NO: 9270818 - DNA, 22 bp, Homo sapiens
ttcctgagaacatggcagctta

SEQ ID NO: 9270819 - DNA, 22 bp, Homo sapiens
ttcctgagaccctcacagtgat

SEQ ID NO: 9270820 - DNA, 22 bp, Homo sapiens
ttcctgagcaccagacactgca

SEQ ID NO: 9270821 - DNA, 22 bp, Homo sapiens
ttcctgaatcccaaggagagct

SEQ ID NO: 9270822 - DNA, 22 bp, Homo sapiens
ttcctgatgcacacagtcattt

SEQ ID NO: 9270823 - DNA, 22 bp, Homo sapiens
ttcctgagtcgccgagtctatg

SEQ ID NO: 9270824 - DNA, 22 bp, Homo sapiens
ttcctgatcccccaggacaaag

SEQ ID NO: 9270825 - DNA, 22 bp, Homo sapiens
ttcctgaggctcatcggagtcg

SEQ ID NO: 9270826 - DNA, 22 bp, Homo sapiens
ttcctgagggacttttgagatt

SEQ ID NO: 9270827 - DNA, 22 bp, Homo sapiens
ttcctgagggccccagaggagg

SEQ ID NO: 9270828 - DNA, 22 bp, Homo sapiens
ttcctgagggccccagaggagg

SEQ ID NO: 9270829 - DNA, 22 bp, Homo sapiens
ttcctgagtcccgggtaaagat

SEQ ID NO: 9270830 - DNA, 22 bp, Homo sapiens
ttcctgaggtgattctaatgtg

SEQ ID NO: 9270831 - DNA, 22 bp, Homo sapiens
ttcctgaggtgattctaatgtg

SEQ ID NO: 9270832 - DNA, 21 bp, Homo sapiens
ttcctggggacttccgtggga

SEQ ID NO: 9270833 - DNA, 22 bp, Homo sapiens
ttcctggggcgactgtatctga

SEQ ID NO: 9270834 - DNA, 22 bp, Homo sapiens
ttcctgcctacatgccttatgc

SEQ ID NO: 9270835 - DNA, 22 bp, Homo sapiens
ttcctgcctacatgccttatgc

SEQ ID NO: 9270836 - DNA, 22 bp, Homo sapiens
ttcctgcccctgagagctccca

SEQ ID NO: 9270837 - DNA, 22 bp, Homo sapiens
ttcctgctccatttgctgagct

SEQ ID NO: 9270838 - DNA, 22 bp, Homo sapiens
ttcctggaaattatgctcacct

SEQ ID NO: 9270839 - DNA, 22 bp, Homo sapiens
ttcctgctccatttgctgagct

SEQ ID NO: 9270840 - DNA, 22 bp, Homo sapiens
ttcttcaaagatgtctgttgga

SEQ ID NO: 9270841 - DNA, 22 bp, Homo sapiens
ttcttcaaaatccagcatgatt

SEQ ID NO: 9270842 - DNA, 22 bp, Homo sapiens
ttcttattcttgaaatgtggga

SEQ ID NO: 9270843 - DNA, 22 bp, Homo sapiens
ttcttatttcccccttcatcat

SEQ ID NO: 9270844 - DNA, 22 bp, Homo sapiens
ttcttattttcctgaggaagaa

SEQ ID NO: 9270845 - DNA, 22 bp, Homo sapiens
ttcttcaaccatctacataaac

SEQ ID NO: 9270846 - DNA, 22 bp, Homo sapiens
ttcttcaaccatctacataaac

SEQ ID NO: 9270847 - DNA, 22 bp, Homo sapiens
ttcttcaaatagcagggagtca

SEQ ID NO: 9270848 - DNA, 22 bp, Homo sapiens
ttcttcaattattggaaagaaa

SEQ ID NO: 9270849 - DNA, 22 bp, Homo sapiens
ttcttcaatgtgccctgttttc

SEQ ID NO: 9270850 - DNA, 22 bp, Homo sapiens
ttcttcaattttccatatactg

SEQ ID NO: 9270851 - DNA, 22 bp, Homo sapiens
ttcttttctgcagctggtattt

SEQ ID NO: 9270852 - DNA, 22 bp, Homo sapiens
ttcttttcttggcaggagtaga

SEQ ID NO: 9270853 - DNA, 22 bp, Homo sapiens
ttcttttctgcagctggtattt

SEQ ID NO: 9270854 - DNA, 22 bp, Homo sapiens
ttcttttctgcagctggtattt

SEQ ID NO: 9270855 - DNA, 22 bp, Homo sapiens
ttcttttctgcagctggtattt

SEQ ID NO: 9270856 - DNA, 22 bp, Homo sapiens
ttcttttaatgttctgaagttt

SEQ ID NO: 9270857 - DNA, 22 bp, Homo sapiens
ttcttttaatgttctgaagttt

SEQ ID NO: 9270858 - DNA, 22 bp, Homo sapiens
ttcttttaatgttctgaagttt

SEQ ID NO: 9270859 - DNA, 22 bp, Homo sapiens
ttcttttaaaagagagcagaaa

SEQ ID NO: 9270860 - DNA, 20 bp, Homo sapiens
ttctttgttccttacatttg

SEQ ID NO: 9270861 - DNA, 20 bp, Homo sapiens
ttctttgttccttacatttg

SEQ ID NO: 9270862 - DNA, 20 bp, Homo sapiens
ttctttgttccttacatttg

SEQ ID NO: 9270863 - DNA, 20 bp, Homo sapiens
ttctttgttccttacatttg

SEQ ID NO: 9270864 - DNA, 23 bp, Homo sapiens
ttctttgtggataatctccagtg

SEQ ID NO: 9270865 - DNA, 23 bp, Homo sapiens
ttctttgtggataatctccagtg

SEQ ID NO: 9270866 - DNA, 22 bp, Homo sapiens
ttcttttctttaggcattgtgt

SEQ ID NO: 9270867 - DNA, 22 bp, Homo sapiens
ttgaaaggcctgtttatccagc

SEQ ID NO: 9270868 - DNA, 22 bp, Homo sapiens
ttgaaaggcacaggcacctggg

SEQ ID NO: 9270869 - DNA, 22 bp, Homo sapiens
ttgaaaggaatacagaggccta

SEQ ID NO: 9270870 - DNA, 22 bp, Homo sapiens
ttgaaatatttgggagtgtttg

SEQ ID NO: 9270871 - DNA, 22 bp, Homo sapiens
ttgaaagggttaaagtggtaaa

SEQ ID NO: 9270872 - DNA, 22 bp, Homo sapiens
ttgaaagggatatatctttctg

SEQ ID NO: 9270873 - DNA, 22 bp, Homo sapiens
ttgaaaggcctgtttatccagc

SEQ ID NO: 9270874 - DNA, 22 bp, Homo sapiens
ttgaaatgaaatatttaagctc

SEQ ID NO: 9270875 - DNA, 22 bp, Homo sapiens
ttgaaatgctctttggaatcta

SEQ ID NO: 9270876 - DNA, 22 bp, Homo sapiens
ttgaaatggcagcagctgacct

SEQ ID NO: 9270877 - DNA, 19 bp, Homo sapiens
ttgaaattgtttgatatgg

SEQ ID NO: 9270878 - DNA, 22 bp, Homo sapiens
ttgaacaatttggtatacaaac

SEQ ID NO: 9270879 - DNA, 22 bp, Homo sapiens
ttgaacattaacttcagtctat

SEQ ID NO: 9270880 - DNA, 22 bp, Homo sapiens
ttctggaagtgttagaatctgg

SEQ ID NO: 9270881 - DNA, 22 bp, Homo sapiens
ttctggaatatttgacacaatt

SEQ ID NO: 9270882 - DNA, 18 bp, Homo sapiens
ttctctggtggatgttat

SEQ ID NO: 9270883 - DNA, 22 bp, Homo sapiens
ttctctggggacttggttggag

SEQ ID NO: 9270884 - DNA, 16 bp, Homo sapiens
ttctctggggttgtgc

SEQ ID NO: 9270885 - DNA, 22 bp, Homo sapiens
ttctctgggttaggggaactat

SEQ ID NO: 9270886 - DNA, 19 bp, Homo sapiens
ttctctggactagatgctg

SEQ ID NO: 9270887 - DNA, 22 bp, Homo sapiens
ttctctggacagtgaagagagg

SEQ ID NO: 9270888 - DNA, 22 bp, Homo sapiens
ttctctgggatctggcaaaagg

SEQ ID NO: 9270889 - DNA, 22 bp, Homo sapiens
ttctctgggatctggcaaaagg

SEQ ID NO: 9270890 - DNA, 22 bp, Homo sapiens
ttctctgggacaggaacagttt

SEQ ID NO: 9270891 - DNA, 22 bp, Homo sapiens
ttctgtaagctaccaagtttgt

SEQ ID NO: 9270892 - DNA, 22 bp, Homo sapiens
ttctggagccgggcctgggcag

SEQ ID NO: 9270893 - DNA, 19 bp, Homo sapiens
ttctggacagcagaaacca

SEQ ID NO: 9270894 - DNA, 22 bp, Homo sapiens
ttctggaatgcctgttctaatt

SEQ ID NO: 9270895 - DNA, 22 bp, Homo sapiens
ttctgtaattctgttagtttca

SEQ ID NO: 9270896 - DNA, 22 bp, Homo sapiens
ttctgtctctgtgtttacatta

SEQ ID NO: 9270897 - DNA, 22 bp, Homo sapiens
ttctgtctggaaaaggacatag

SEQ ID NO: 9270898 - DNA, 22 bp, Homo sapiens
ttctgtctctgtgtttacatta

SEQ ID NO: 9270899 - DNA, 22 bp, Homo sapiens
ttctgtctgtaaacttctcaat

SEQ ID NO: 9270900 - DNA, 22 bp, Homo sapiens
ttctgtctgtaaacttctcaat

SEQ ID NO: 9270901 - DNA, 22 bp, Homo sapiens
ttctgtgaatcttttttcccac

SEQ ID NO: 9270902 - DNA, 22 bp, Homo sapiens
ttctgtgaatcttttttcccac

SEQ ID NO: 9270903 - DNA, 22 bp, Homo sapiens
ttctgtggcagtttgggaggtg

SEQ ID NO: 9270904 - DNA, 22 bp, Homo sapiens
ttctgtgtgccagagttgtgct

SEQ ID NO: 9270905 - DNA, 22 bp, Homo sapiens
ttctgtgtcttcttgttctgtg

SEQ ID NO: 9270906 - DNA, 22 bp, Homo sapiens
ttcttagttcaactaaaattta

SEQ ID NO: 9270907 - DNA, 22 bp, Homo sapiens
ttcttatgttcacataattcca

SEQ ID NO: 9270908 - DNA, 22 bp, Homo sapiens
ttctgtgtgccagagttgtgct

SEQ ID NO: 9270909 - DNA, 22 bp, Homo sapiens
ttctgtgtgccagagttgtgct

SEQ ID NO: 9270910 - DNA, 22 bp, Homo sapiens
ttctgtgtgggtagctcctgtt

SEQ ID NO: 9270911 - DNA, 22 bp, Homo sapiens
ttctgtgtgcttactggtgttc

SEQ ID NO: 9270912 - DNA, 22 bp, Homo sapiens
ttctgtgtgtctcagcaagctg

SEQ ID NO: 9270913 - DNA, 19 bp, Homo sapiens
ttctgtgttaattccttta

SEQ ID NO: 9270914 - DNA, 22 bp, Homo sapiens
ttctgtgttgtgacattctaga

SEQ ID NO: 9270915 - DNA, 22 bp, Homo sapiens
ttcttacattactttacatgtg

SEQ ID NO: 9270916 - DNA, 22 bp, Homo sapiens
ttcttacattactttacatgtg

SEQ ID NO: 9270917 - DNA, 22 bp, Homo sapiens
ttcttacattactttacatgtg

SEQ ID NO: 9270918 - DNA, 22 bp, Homo sapiens
ttcttactagtatgtttcagca

SEQ ID NO: 9270919 - DNA, 22 bp, Homo sapiens
ttcttacattagtctgtgcttt

SEQ ID NO: 9270920 - DNA, 22 bp, Homo sapiens
ttcataatcaccaaaaactgga

SEQ ID NO: 9270921 - DNA, 22 bp, Homo sapiens
ttcataatcaccaaaaactgga

SEQ ID NO: 9270922 - DNA, 22 bp, Homo sapiens
ttcatacaatgggatattatga

SEQ ID NO: 9270923 - DNA, 22 bp, Homo sapiens
ttcattgatttccttggaataa

SEQ ID NO: 9270924 - DNA, 22 bp, Homo sapiens
ttcattgcattccagcctgggt

SEQ ID NO: 9270925 - DNA, 22 bp, Homo sapiens
ttcattgtactttaagagatgc

SEQ ID NO: 9270926 - DNA, 22 bp, Homo sapiens
ttcattgtactttaagagatgc

SEQ ID NO: 9270927 - DNA, 22 bp, Homo sapiens
ttcattgtgaacacattctgcc

SEQ ID NO: 9270928 - DNA, 22 bp, Homo sapiens
ttcattgtgaacacattctgcc

SEQ ID NO: 9270929 - DNA, 22 bp, Homo sapiens
ttcatttaatttgtgtattaac

SEQ ID NO: 9270930 - DNA, 22 bp, Homo sapiens
ttcatttaatttgtgtattaac

SEQ ID NO: 9270931 - DNA, 22 bp, Homo sapiens
ttcatttgcactggattactgg

SEQ ID NO: 9270932 - DNA, 23 bp, Homo sapiens
ttcatttaggagttcataagagc

SEQ ID NO: 9270933 - DNA, 23 bp, Homo sapiens
ttcatttaggagttcataagagc

SEQ ID NO: 9270934 - DNA, 22 bp, Homo sapiens
ttcagtttgtttgactgttaga

SEQ ID NO: 9270935 - DNA, 22 bp, Homo sapiens
ttcagtttgctacaagcaacat

SEQ ID NO: 9270936 - DNA, 22 bp, Homo sapiens
ttcagtttatacctgttgatta

SEQ ID NO: 9270937 - DNA, 22 bp, Homo sapiens
ttcagtttcaaatcctggatgc

SEQ ID NO: 9270938 - DNA, 22 bp, Homo sapiens
ttcagttttctttagaatgtag

SEQ ID NO: 9270939 - DNA, 22 bp, Homo sapiens
ttcagttttattgtactgctat

SEQ ID NO: 9270940 - DNA, 21 bp, Homo sapiens
ttcataaaccattctcatgca

SEQ ID NO: 9270941 - DNA, 19 bp, Homo sapiens
ttcataacttttatatcct

SEQ ID NO: 9270942 - DNA, 21 bp, Homo sapiens
ttcataaaccattctcatgca

SEQ ID NO: 9270943 - DNA, 22 bp, Homo sapiens
ttcataaacaactgatggtaat

SEQ ID NO: 9270944 - DNA, 22 bp, Homo sapiens
ttcagttttctttagaatgtag

SEQ ID NO: 9270945 - DNA, 22 bp, Homo sapiens
ttcagttttctttagaatgtag

SEQ ID NO: 9270946 - DNA, 22 bp, Homo sapiens
ttcagttccttatcatagggtt

SEQ ID NO: 9270947 - DNA, 22 bp, Homo sapiens
ttcagttcacatgtatcatggc

SEQ ID NO: 9270948 - DNA, 22 bp, Homo sapiens
ttcagtgtgtgatacctgctgt

SEQ ID NO: 9270949 - DNA, 22 bp, Homo sapiens
ttccagttcagatgcaacaggg

SEQ ID NO: 9270950 - DNA, 22 bp, Homo sapiens
ttccagttcagatgcaacaggg

SEQ ID NO: 9270951 - DNA, 22 bp, Homo sapiens
ttccagtgactaagcttctgct

SEQ ID NO: 9270952 - DNA, 23 bp, Homo sapiens
ttccagtgagactgagaggtctt

SEQ ID NO: 9270953 - DNA, 22 bp, Homo sapiens
ttccagtgaccatagagtatgg

SEQ ID NO: 9270954 - DNA, 22 bp, Homo sapiens
ttccagtcaagtaagaatatct

SEQ ID NO: 9270955 - DNA, 22 bp, Homo sapiens
ttccagtgaaacatgaggtgtg

SEQ ID NO: 9270956 - DNA, 22 bp, Homo sapiens
ttccaggcacatcccaactcca

SEQ ID NO: 9270957 - DNA, 22 bp, Homo sapiens
ttcattttctttcacgctgctg

SEQ ID NO: 9270958 - DNA, 22 bp, Homo sapiens
ttcatttgtccaaatactatgt

SEQ ID NO: 9270959 - DNA, 22 bp, Homo sapiens
ttcatttgtctgctatagatcc

SEQ ID NO: 9270960 - DNA, 22 bp, Homo sapiens
ttcatttgtctgctatagatcc

SEQ ID NO: 9270961 - DNA, 22 bp, Homo sapiens
ttcatttgggatgagtcagaag

SEQ ID NO: 9270962 - DNA, 22 bp, Homo sapiens
ttcacaattaactttatactta

SEQ ID NO: 9270963 - DNA, 22 bp, Homo sapiens
ttcacaataggagcatgcaaat

SEQ ID NO: 9270964 - DNA, 22 bp, Homo sapiens
ttcacaataggagcatgcaaat

SEQ ID NO: 9270965 - DNA, 22 bp, Homo sapiens
ttcacaatgccttgttgatggt

SEQ ID NO: 9270966 - DNA, 22 bp, Homo sapiens
ttcacaatgccttgttgatggt

SEQ ID NO: 9270967 - DNA, 22 bp, Homo sapiens
ttcacaatctggcttagcattg

SEQ ID NO: 9270968 - DNA, 22 bp, Homo sapiens
ttcaaagataatgtagcatttt

SEQ ID NO: 9270969 - DNA, 22 bp, Homo sapiens
ttcacagatgtattggaactcc

SEQ ID NO: 9270970 - DNA, 22 bp, Homo sapiens
ttcacagatgtattggaactcc

SEQ ID NO: 9270971 - DNA, 21 bp, Homo sapiens
ttcacagatgggaaaactgag

SEQ ID NO: 9270972 - DNA, 22 bp, Homo sapiens
ttcacagatgagaaaattgagg

SEQ ID NO: 9270973 - DNA, 18 bp, Homo sapiens
ttcacagatccacaggaa

SEQ ID NO: 9270974 - DNA, 20 bp, Homo sapiens
ttcacagaggactcaggtca

SEQ ID NO: 9270975 - DNA, 22 bp, Homo sapiens
ttcacagagcactgccaagtac

SEQ ID NO: 9270976 - DNA, 21 bp, Homo sapiens
ttcagcaagcactctggacac

SEQ ID NO: 9270977 - DNA, 22 bp, Homo sapiens
ttcagcaagtgtctctactgtc

SEQ ID NO: 9270978 - DNA, 22 bp, Homo sapiens
ttcagcacaagactagacaggt

SEQ ID NO: 9270979 - DNA, 22 bp, Homo sapiens
ttcagcaccctctgaggcatcc

SEQ ID NO: 9270980 - DNA, 22 bp, Homo sapiens
ttcagcacagttcaagatggta

SEQ ID NO: 9270981 - DNA, 22 bp, Homo sapiens
ttcagcaccacttccagagaag

SEQ ID NO: 9270982 - DNA, 22 bp, Homo sapiens
ttcagcactggacagcgagtct

SEQ ID NO: 9270983 - DNA, 22 bp, Homo sapiens
ttcagcactgttatggatttgc

SEQ ID NO: 9270984 - DNA, 22 bp, Homo sapiens
ttcagcactgactgagtggtta

SEQ ID NO: 9270985 - DNA, 22 bp, Homo sapiens
ttcagcacctggaatagcacct

SEQ ID NO: 9270986 - DNA, 22 bp, Homo sapiens
ttcagcactttgttttgctcat

SEQ ID NO: 9270987 - DNA, 18 bp, Homo sapiens
ttcagcagcagacacact

SEQ ID NO: 9270988 - DNA, 22 bp, Homo sapiens
ttcagtgtcacaagagcaagcc

SEQ ID NO: 9270989 - DNA, 22 bp, Homo sapiens
ttcagagccacttcaagtctaa

SEQ ID NO: 9270990 - DNA, 22 bp, Homo sapiens
ttcagagcatctctaaagccag

SEQ ID NO: 9270991 - DNA, 22 bp, Homo sapiens
ttcagagatgacacctggtgtt

SEQ ID NO: 9270992 - DNA, 22 bp, Homo sapiens
ttcacaggcttggaggtggggg

SEQ ID NO: 9270993 - DNA, 22 bp, Homo sapiens
ttcacaggagggtggatgcatg

SEQ ID NO: 9270994 - DNA, 22 bp, Homo sapiens
ttcacagggccactggcaggag

SEQ ID NO: 9270995 - DNA, 22 bp, Homo sapiens
ttcacagggcagcagctgagcc

SEQ ID NO: 9270996 - DNA, 22 bp, Homo sapiens
ttaggaaaatggagtcctttta

SEQ ID NO: 9270997 - DNA, 19 bp, Homo sapiens
ttaggaaaccactttcctt

SEQ ID NO: 9270998 - DNA, 19 bp, Homo sapiens
ttaggaaaccactttcctt

SEQ ID NO: 9270999 - DNA, 22 bp, Homo sapiens
ttaggaaaagaagacatttcta

SEQ ID NO: 9271000 - DNA, 22 bp, Homo sapiens
ttaggaaaagaagacatttcta

SEQ ID NO: 9271001 - DNA, 21 bp, Homo sapiens
ttagctttctagaatctttgt

SEQ ID NO: 9271002 - DNA, 20 bp, Homo sapiens
ttagctttggcaatagtgac

SEQ ID NO: 9271003 - DNA, 22 bp, Homo sapiens
ttaggaaatcactttgctcacc

SEQ ID NO: 9271004 - DNA, 22 bp, Homo sapiens
ttatacatgtgttttgagatga

SEQ ID NO: 9271005 - DNA, 22 bp, Homo sapiens
ttaggaaagggttttctaacag

SEQ ID NO: 9271006 - DNA, 22 bp, Homo sapiens
ttaggaaagggttttctaacag

SEQ ID NO: 9271007 - DNA, 22 bp, Homo sapiens
ttaggaaacgctgctattgact

SEQ ID NO: 9271008 - DNA, 22 bp, Homo sapiens
ttatagatgccttgagtaaatg

SEQ ID NO: 9271009 - DNA, 22 bp, Homo sapiens
ttatagaatggtggattttctg

SEQ ID NO: 9271010 - DNA, 22 bp, Homo sapiens
ttatagaacggttctgtgcaaa

SEQ ID NO: 9271011 - DNA, 22 bp, Homo sapiens
ttataggaaaagttctagaaaa

SEQ ID NO: 9271012 - DNA, 22 bp, Homo sapiens
ttatagtattaggtactcaaca

SEQ ID NO: 9271013 - DNA, 22 bp, Homo sapiens
ttatataactcaggtgggctca

SEQ ID NO: 9271014 - DNA, 22 bp, Homo sapiens
ttatataaagataacttttctt

SEQ ID NO: 9271015 - DNA, 22 bp, Homo sapiens
ttatagttatgaaagactgagg

SEQ ID NO: 9271016 - DNA, 22 bp, Homo sapiens
ttatataaagataacttttctt

SEQ ID NO: 9271017 - DNA, 22 bp, Homo sapiens
ttatataaagataacttttctt

SEQ ID NO: 9271018 - DNA, 22 bp, Homo sapiens
ttatataaagataacttttctt

SEQ ID NO: 9271019 - DNA, 22 bp, Homo sapiens
ttagctgtggaagcttcagcca

SEQ ID NO: 9271020 - DNA, 22 bp, Homo sapiens
ttagctgagattaagtgaactt

SEQ ID NO: 9271021 - DNA, 22 bp, Homo sapiens
ttagctgactgtgtgatttggc

SEQ ID NO: 9271022 - DNA, 22 bp, Homo sapiens
ttagctgaaaaaattcatgcaa

SEQ ID NO: 9271023 - DNA, 22 bp, Homo sapiens
ttagcttaattaaataatcagt

SEQ ID NO: 9271024 - DNA, 22 bp, Homo sapiens
ttagccttagaagcttagcaaa

SEQ ID NO: 9271025 - DNA, 22 bp, Homo sapiens
ttagccattttattcagcaggt

SEQ ID NO: 9271026 - DNA, 22 bp, Homo sapiens
ttagccatttgaggtcttcatt

SEQ ID NO: 9271027 - DNA, 22 bp, Homo sapiens
ttagctcagaaaatttaaactt

SEQ ID NO: 9271028 - DNA, 22 bp, Homo sapiens
ttagccaggggagcagcttgtc

SEQ ID NO: 9271029 - DNA, 22 bp, Homo sapiens
tcctgctggactctgagtacaa

SEQ ID NO: 9271030 - DNA, 22 bp, Homo sapiens
tcctgctggaagtagggaatga

SEQ ID NO: 9271031 - DNA, 21 bp, Homo sapiens
tcctgctgctcctgtcgtgtt

SEQ ID NO: 9271032 - DNA, 21 bp, Homo sapiens
tcctgctgctcctgtcgtgtt

SEQ ID NO: 9271033 - DNA, 22 bp, Homo sapiens
ttagccagtgaaatggagaaat

SEQ ID NO: 9271034 - DNA, 18 bp, Homo sapiens
tcctgcctgtgccccagg

SEQ ID NO: 9271035 - DNA, 18 bp, Homo sapiens
tcctgcctgtgccccagg

SEQ ID NO: 9271036 - DNA, 18 bp, Homo sapiens
tcctgcctgtgccccagg

SEQ ID NO: 9271037 - DNA, 22 bp, Homo sapiens
tcctgcctgtttacctgtactt

SEQ ID NO: 9271038 - DNA, 22 bp, Homo sapiens
tcctgcctgtttacctgtactt

SEQ ID NO: 9271039 - DNA, 22 bp, Homo sapiens
tcctgcctgtttacctgtactt

SEQ ID NO: 9271040 - DNA, 22 bp, Homo sapiens
tcctgcctgtttacctgtactt

SEQ ID NO: 9271041 - DNA, 19 bp, Homo sapiens
tcctgcctggggccgcctg

SEQ ID NO: 9271042 - DNA, 19 bp, Homo sapiens
tcctgcctggggccgcctg

SEQ ID NO: 9271043 - DNA, 19 bp, Homo sapiens
tcctgcctggggccgcctg

SEQ ID NO: 9271044 - DNA, 18 bp, Homo sapiens
tcctgcctgcgggctccc

SEQ ID NO: 9271045 - DNA, 18 bp, Homo sapiens
tcctgcctgcgggctccc

SEQ ID NO: 9271046 - DNA, 18 bp, Homo sapiens
tcctgcctgcgggctccc

SEQ ID NO: 9271047 - DNA, 22 bp, Homo sapiens
tcctgcctgcaatcccagcact

SEQ ID NO: 9271048 - DNA, 22 bp, Homo sapiens
tcctgcctgtttacctgtactt

SEQ ID NO: 9271049 - DNA, 22 bp, Homo sapiens
tcctgccttagagcaaggaaaa

SEQ ID NO: 9271050 - DNA, 20 bp, Homo sapiens
tcctgctgaccttcacaagc

SEQ ID NO: 9271051 - DNA, 22 bp, Homo sapiens
tcctgctgagcatgttctgccc

SEQ ID NO: 9271052 - DNA, 22 bp, Homo sapiens
tcctgctgctcacctttttgtc

SEQ ID NO: 9271053 - DNA, 22 bp, Homo sapiens
ttattgaaatggaagctataac

SEQ ID NO: 9271054 - DNA, 22 bp, Homo sapiens
ttattcttttctccagaatccc

SEQ ID NO: 9271055 - DNA, 22 bp, Homo sapiens
ttattgaagcaagcttttctga

SEQ ID NO: 9271056 - DNA, 21 bp, Homo sapiens
ttattgaatgtttaccgtgtg

SEQ ID NO: 9271057 - DNA, 22 bp, Homo sapiens
ttattgactcccagcttttcca

SEQ ID NO: 9271058 - DNA, 22 bp, Homo sapiens
ttattgaaggaactgaaataaa

SEQ ID NO: 9271059 - DNA, 22 bp, Homo sapiens
ttattgactgaaatgagagtga

SEQ ID NO: 9271060 - DNA, 22 bp, Homo sapiens
ttattgacttgtttgtcctggt

SEQ ID NO: 9271061 - DNA, 22 bp, Homo sapiens
ttattgacttgtttgtcctggt

SEQ ID NO: 9271062 - DNA, 22 bp, Homo sapiens
ttattgtagcactttggcagtg

SEQ ID NO: 9271063 - DNA, 17 bp, Homo sapiens
ttattgtcaaggttcca

SEQ ID NO: 9271064 - DNA, 22 bp, Homo sapiens
ttattgtcaaaaacaggacact

SEQ ID NO: 9271065 - DNA, 22 bp, Homo sapiens
ttattgtaggcctattgtagaa

SEQ ID NO: 9271066 - DNA, 22 bp, Homo sapiens
ttattgtaggcctattgtagaa

SEQ ID NO: 9271067 - DNA, 22 bp, Homo sapiens
ttattgctgctaacattttatg

SEQ ID NO: 9271068 - DNA, 22 bp, Homo sapiens
ttattggaaaagggctgtaatt

SEQ ID NO: 9271069 - DNA, 22 bp, Homo sapiens
ttattgtgtcttggtttatctt

SEQ ID NO: 9271070 - DNA, 22 bp, Homo sapiens
ttcaaacactggcttagccaat

SEQ ID NO: 9271071 - DNA, 22 bp, Homo sapiens
ttcaaacagatgactctgctct

SEQ ID NO: 9271072 - DNA, 22 bp, Homo sapiens
ttcaaacagatgactctgctct

SEQ ID NO: 9271073 - DNA, 22 bp, Homo sapiens
ttcaaacagtgtagaatatatg

SEQ ID NO: 9271074 - DNA, 22 bp, Homo sapiens
ttcaaactcttgctctgctagt

SEQ ID NO: 9271075 - DNA, 22 bp, Homo sapiens
ttcaaactagttaaaagtcaga

SEQ ID NO: 9271076 - DNA, 22 bp, Homo sapiens
ttatatctttttacatctctcc

SEQ ID NO: 9271077 - DNA, 22 bp, Homo sapiens
ttatatgagtatcatatcactt

SEQ ID NO: 9271078 - DNA, 22 bp, Homo sapiens
ttatatgagtatcatatcactt

SEQ ID NO: 9271079 - DNA, 22 bp, Homo sapiens
ttattaagtgcctacaataaag

SEQ ID NO: 9271080 - DNA, 22 bp, Homo sapiens
ttattaagtgcctacaataaag

SEQ ID NO: 9271081 - DNA, 22 bp, Homo sapiens
ttattaagtgcctacaataaag

SEQ ID NO: 9271082 - DNA, 22 bp, Homo sapiens
ttattaagtgcgtactgtatgc

SEQ ID NO: 9271083 - DNA, 22 bp, Homo sapiens
ttattaatacatgcacctgcat

SEQ ID NO: 9271084 - DNA, 22 bp, Homo sapiens
ttattacaatgcagaaaataga

SEQ ID NO: 9271085 - DNA, 22 bp, Homo sapiens
ttattatagattatgcaagatt

SEQ ID NO: 9271086 - DNA, 22 bp, Homo sapiens
ttattatagattatgcaagatt

SEQ ID NO: 9271087 - DNA, 22 bp, Homo sapiens
ttattataatgagggataaaaa

SEQ ID NO: 9271088 - DNA, 22 bp, Homo sapiens
ttattatggtatttctttgcag

SEQ ID NO: 9271089 - DNA, 22 bp, Homo sapiens
ttattatgccattacctccctg

SEQ ID NO: 9271090 - DNA, 22 bp, Homo sapiens
ttattatggcagttttctaggt

SEQ ID NO: 9271091 - DNA, 22 bp, Homo sapiens
ttattctttaaacatatatgtt

SEQ ID NO: 9271092 - DNA, 22 bp, Homo sapiens
ttattatgtggatgaaagatgt

SEQ ID NO: 9271093 - DNA, 22 bp, Homo sapiens
ttattatgtgctagagaatgta

SEQ ID NO: 9271094 - DNA, 22 bp, Homo sapiens
ttattatgtggatgaaagatgt

SEQ ID NO: 9271095 - DNA, 22 bp, Homo sapiens
ttattatgtggatgaaagatgt

SEQ ID NO: 9271096 - DNA, 22 bp, Homo sapiens
ttattactgtattaatccagag

SEQ ID NO: 9271097 - DNA, 22 bp, Homo sapiens
ttattataatgagggataaaaa

SEQ ID NO: 9271098 - DNA, 22 bp, Homo sapiens
ttattataatgagggataaaaa

SEQ ID NO: 9271099 - DNA, 22 bp, Homo sapiens
ttattagctgggcttcagggtg

SEQ ID NO: 9271100 - DNA, 22 bp, Homo sapiens
tttcaacagaatatgatcagag

SEQ ID NO: 9271101 - DNA, 22 bp, Homo sapiens
tttcaacagatctgtcttcagg

SEQ ID NO: 9271102 - DNA, 23 bp, Homo sapiens
tttcaacaatgcttagagaaaac

SEQ ID NO: 9271103 - DNA, 22 bp, Homo sapiens
tttcaaaggttttgtcatgtct

SEQ ID NO: 9271104 - DNA, 22 bp, Homo sapiens
tttcaaaggtggaagagtgaat

SEQ ID NO: 9271105 - DNA, 22 bp, Homo sapiens
tttcaaaggtggaagagtgaat

SEQ ID NO: 9271106 - DNA, 22 bp, Homo sapiens
tttattgacccaaagcgagagt

SEQ ID NO: 9271107 - DNA, 22 bp, Homo sapiens
tttattgagcacccgttgtgcg

SEQ ID NO: 9271108 - DNA, 22 bp, Homo sapiens
tttattgacttcagtgagtctt

SEQ ID NO: 9271109 - DNA, 22 bp, Homo sapiens
tttattgacttcagtgagtctt

SEQ ID NO: 9271110 - DNA, 22 bp, Homo sapiens
tttattgagtatctactatgtg

SEQ ID NO: 9271111 - DNA, 20 bp, Homo sapiens
tttattgagcacgtactgtg

SEQ ID NO: 9271112 - DNA, 22 bp, Homo sapiens
tttattgcatacacaaatgtca

SEQ ID NO: 9271113 - DNA, 22 bp, Homo sapiens
tttcaaagggaagttatgaagt

SEQ ID NO: 9271114 - DNA, 22 bp, Homo sapiens
tttattgcactgtctcaatacc

SEQ ID NO: 9271115 - DNA, 22 bp, Homo sapiens
tttattctagctcagaatagtt

SEQ ID NO: 9271116 - DNA, 21 bp, Homo sapiens
tttattctcagatacagggag

SEQ ID NO: 9271117 - DNA, 22 bp, Homo sapiens
tttattgaattgtaaccctatt

SEQ ID NO: 9271118 - DNA, 22 bp, Homo sapiens
tttattgaacacttgcactggc

SEQ ID NO: 9271119 - DNA, 22 bp, Homo sapiens
tttattctgtgctacatgaaga

SEQ ID NO: 9271120 - DNA, 22 bp, Homo sapiens
tttcaagaagcaaattaaagtc

SEQ ID NO: 9271121 - DNA, 22 bp, Homo sapiens
tttcaagaattgaagaggattt

SEQ ID NO: 9271122 - DNA, 22 bp, Homo sapiens
tttcaagactcattgagtattg

SEQ ID NO: 9271123 - DNA, 22 bp, Homo sapiens
tttcaagcagcgtgaaaaacga

SEQ ID NO: 9271124 - DNA, 22 bp, Homo sapiens
tttcaagagcaggaaaaaggtc

SEQ ID NO: 9271125 - DNA, 22 bp, Homo sapiens
tttcaagagcaggaaaaaggtc

SEQ ID NO: 9271126 - DNA, 22 bp, Homo sapiens
tttcaagaagcaaattaaagtc

SEQ ID NO: 9271127 - DNA, 22 bp, Homo sapiens
tttcaactcatgctaaaggaag

SEQ ID NO: 9271128 - DNA, 22 bp, Homo sapiens
tttcaacagctctcaaatgatc

SEQ ID NO: 9271129 - DNA, 22 bp, Homo sapiens
tttcaacaggatgataataggc

SEQ ID NO: 9271130 - DNA, 23 bp, Homo sapiens
tttcaacaggcagagaagactta

SEQ ID NO: 9271131 - DNA, 23 bp, Homo sapiens
tttcaacaggcagagaagactta

SEQ ID NO: 9271132 - DNA, 22 bp, Homo sapiens
tttcaacatacctcagtgtatg

SEQ ID NO: 9271133 - DNA, 22 bp, Homo sapiens
tttcaacatcacctagcagttc

SEQ ID NO: 9271134 - DNA, 22 bp, Homo sapiens
tttcacagatcctacagcttgt

SEQ ID NO: 9271135 - DNA, 23 bp, Homo sapiens
tttcacagaaggattgtagggcc

SEQ ID NO: 9271136 - DNA, 22 bp, Homo sapiens
tttcacagaaagaagctagttt

SEQ ID NO: 9271137 - DNA, 20 bp, Homo sapiens
tttcacaatgaacatgtctc

SEQ ID NO: 9271138 - DNA, 23 bp, Homo sapiens
tttcacaatgagcattacagaat

SEQ ID NO: 9271139 - DNA, 23 bp, Homo sapiens
tttcacaatgagcattacagaat

SEQ ID NO: 9271140 - DNA, 23 bp, Homo sapiens
tttcacaatgagcattacagaat

SEQ ID NO: 9271141 - DNA, 22 bp, Homo sapiens
tttcacaattttaaggagcaaa

SEQ ID NO: 9271142 - DNA, 22 bp, Homo sapiens
tttcacactagtcagaatacca

SEQ ID NO: 9271143 - DNA, 22 bp, Homo sapiens
tttcagaaagctgaacatatga

SEQ ID NO: 9271144 - DNA, 22 bp, Homo sapiens
tttcagaaagctgaacatatga

SEQ ID NO: 9271145 - DNA, 22 bp, Homo sapiens
tttcagaaagctgaacatatga

SEQ ID NO: 9271146 - DNA, 22 bp, Homo sapiens
tttcagaatatcgattcagtga

SEQ ID NO: 9271147 - DNA, 22 bp, Homo sapiens
tttcagaaatggcactgaaatc

SEQ ID NO: 9271148 - DNA, 22 bp, Homo sapiens
tttcagaaatggcactgaaatc

SEQ ID NO: 9271149 - DNA, 22 bp, Homo sapiens
tttcagaaatggcactgaaatc

SEQ ID NO: 9271150 - DNA, 22 bp, Homo sapiens
tttcagaaagcatcatcaaagt

SEQ ID NO: 9271151 - DNA, 22 bp, Homo sapiens
tttcagaaagcatcatcaaagt

SEQ ID NO: 9271152 - DNA, 22 bp, Homo sapiens
tttcagaaagcatcatcaaagt

SEQ ID NO: 9271153 - DNA, 22 bp, Homo sapiens
tttcagaaaacttatcatcagt

SEQ ID NO: 9271154 - DNA, 22 bp, Homo sapiens
tttcagagagatcaacatagct

SEQ ID NO: 9271155 - DNA, 22 bp, Homo sapiens
tttcacagctgggtggcagagt

SEQ ID NO: 9271156 - DNA, 22 bp, Homo sapiens
tttcacagctgggaagagatat

SEQ ID NO: 9271157 - DNA, 22 bp, Homo sapiens
tttcacagcatataggtgtact

SEQ ID NO: 9271158 - DNA, 20 bp, Homo sapiens
tttcactggcttgataaggt

SEQ ID NO: 9271159 - DNA, 22 bp, Homo sapiens
tttcacctcagtctttttatat

SEQ ID NO: 9271160 - DNA, 22 bp, Homo sapiens
tttcactgttaggagtatgcta

SEQ ID NO: 9271161 - DNA, 22 bp, Homo sapiens
tttcacatttgttttaagaagt

SEQ ID NO: 9271162 - DNA, 23 bp, Homo sapiens
tttcacagcttttattctgcatc

SEQ ID NO: 9271163 - DNA, 22 bp, Homo sapiens
tttcatgcacaaatgagcaagg

SEQ ID NO: 9271164 - DNA, 22 bp, Homo sapiens
tttcatgattaacttagtgaat

SEQ ID NO: 9271165 - DNA, 22 bp, Homo sapiens
tttcatgatccatttacaaaat

SEQ ID NO: 9271166 - DNA, 22 bp, Homo sapiens
tttcatcttgattctatatggc

SEQ ID NO: 9271167 - DNA, 22 bp, Homo sapiens
tttcatcttgattctatatggc

SEQ ID NO: 9271168 - DNA, 22 bp, Homo sapiens
tttcatgaggggcaaaatctca

SEQ ID NO: 9271169 - DNA, 22 bp, Homo sapiens
tttcatgaggggcaaaatctca

SEQ ID NO: 9271170 - DNA, 22 bp, Homo sapiens
tttcatgaggggcaaaatctca

SEQ ID NO: 9271171 - DNA, 22 bp, Homo sapiens
tttcatcttccttggcataggt

SEQ ID NO: 9271172 - DNA, 22 bp, Homo sapiens
tttcatcttccttggcataggt

SEQ ID NO: 9271173 - DNA, 22 bp, Homo sapiens
tttcatgtatttcccaaagctt

SEQ ID NO: 9271174 - DNA, 22 bp, Homo sapiens
tttcatgtcattccatttcaga

SEQ ID NO: 9271175 - DNA, 22 bp, Homo sapiens
tttcatgtatttcccaaagctt

SEQ ID NO: 9271176 - DNA, 22 bp, Homo sapiens
tttcatgtacttttttgataga

SEQ ID NO: 9271177 - DNA, 22 bp, Homo sapiens
tttcccagttccctgctctata

SEQ ID NO: 9271178 - DNA, 21 bp, Homo sapiens
tttcccagcagagatagctgg

SEQ ID NO: 9271179 - DNA, 22 bp, Homo sapiens
tttcattgatgggtgatagaaa

SEQ ID NO: 9271180 - DNA, 22 bp, Homo sapiens
tttcattgcagagtctgtgtgc

SEQ ID NO: 9271181 - DNA, 22 bp, Homo sapiens
tttcattatacagcttcataaa

SEQ ID NO: 9271182 - DNA, 22 bp, Homo sapiens
tttcattatacagcttcataaa

SEQ ID NO: 9271183 - DNA, 21 bp, Homo sapiens
tttcattgaatgagataaggt

SEQ ID NO: 9271184 - DNA, 22 bp, Homo sapiens
tttcattgaactaaagaatctg

SEQ ID NO: 9271185 - DNA, 22 bp, Homo sapiens
tttcattgagaatataagattt

SEQ ID NO: 9271186 - DNA, 22 bp, Homo sapiens
tttcattgagaatataagattt

SEQ ID NO: 9271187 - DNA, 21 bp, Homo sapiens
tttcattgaatgagataaggt

SEQ ID NO: 9271188 - DNA, 22 bp, Homo sapiens
tttcattgagactatagacatc

SEQ ID NO: 9271189 - DNA, 22 bp, Homo sapiens
tttcattgagactatagacatc

SEQ ID NO: 9271190 - DNA, 22 bp, Homo sapiens
tttacagggttcaagaatgaaa

SEQ ID NO: 9271191 - DNA, 22 bp, Homo sapiens
tttacagggttcaagaatgaaa

SEQ ID NO: 9271192 - DNA, 23 bp, Homo sapiens
tttacagggcactcttatgcagc

SEQ ID NO: 9271193 - DNA, 22 bp, Homo sapiens
tttacagtccccaggtgaggat

SEQ ID NO: 9271194 - DNA, 23 bp, Homo sapiens
tttacagggcactcttatgcagc

SEQ ID NO: 9271195 - DNA, 19 bp, Homo sapiens
tttacagggaatggagacc

SEQ ID NO: 9271196 - DNA, 22 bp, Homo sapiens
tttacagggaatattttggctt

SEQ ID NO: 9271197 - DNA, 22 bp, Homo sapiens
tttacagggaatattttggctt

SEQ ID NO: 9271198 - DNA, 22 bp, Homo sapiens
tttacaggaagctgaaaaacat

SEQ ID NO: 9271199 - DNA, 22 bp, Homo sapiens
tttacaggaagctgaaaaacat

SEQ ID NO: 9271200 - DNA, 22 bp, Homo sapiens
tttacaggattaccctggctgc

SEQ ID NO: 9271201 - DNA, 22 bp, Homo sapiens
tttacaggattaccctggctgc

SEQ ID NO: 9271202 - DNA, 22 bp, Homo sapiens
tttaatgtagcgtgaaatgatt

SEQ ID NO: 9271203 - DNA, 22 bp, Homo sapiens
tttaatgatagtcttacgaaaa

SEQ ID NO: 9271204 - DNA, 22 bp, Homo sapiens
tttaaggagctactcaccgtca

SEQ ID NO: 9271205 - DNA, 22 bp, Homo sapiens
tttaaggaggggctcacgtggg

SEQ ID NO: 9271206 - DNA, 22 bp, Homo sapiens
tttaaggatgatgtgatatata

SEQ ID NO: 9271207 - DNA, 22 bp, Homo sapiens
tttaaggaaaaaatgtacttag

SEQ ID NO: 9271208 - DNA, 22 bp, Homo sapiens
tttaatctattccctaaacacc

SEQ ID NO: 9271209 - DNA, 22 bp, Homo sapiens
tttaatcttcaaaatagtctta

SEQ ID NO: 9271210 - DNA, 22 bp, Homo sapiens
tttaatgaataattcaaatctg

SEQ ID NO: 9271211 - DNA, 22 bp, Homo sapiens
tttaaggatgtaaaggaagaag

SEQ ID NO: 9271212 - DNA, 22 bp, Homo sapiens
tttaaggtggacatctaagtca

SEQ ID NO: 9271213 - DNA, 22 bp, Homo sapiens
tttaaatgtgttcttagtagct

SEQ ID NO: 9271214 - DNA, 22 bp, Homo sapiens
tttaaatgtgttcttagtagct

SEQ ID NO: 9271215 - DNA, 22 bp, Homo sapiens
tttaagatggtattttataaag

SEQ ID NO: 9271216 - DNA, 22 bp, Homo sapiens
tttaaataggactcctgggggt

SEQ ID NO: 9271217 - DNA, 22 bp, Homo sapiens
tttaaagtggtccatttcagaa

SEQ ID NO: 9271218 - DNA, 22 bp, Homo sapiens
tttaaatgcagacgttgattca

SEQ ID NO: 9271219 - DNA, 22 bp, Homo sapiens
tttaaatgcagacgttgattca

SEQ ID NO: 9271220 - DNA, 22 bp, Homo sapiens
tttaaataggactcctgggggt

SEQ ID NO: 9271221 - DNA, 22 bp, Homo sapiens
tttaaataggactcctgggggt

SEQ ID NO: 9271222 - DNA, 22 bp, Homo sapiens
ttgtgtgtactggttatgggca

SEQ ID NO: 9271223 - DNA, 22 bp, Homo sapiens
ttgtgtgtactggttatgggca

SEQ ID NO: 9271224 - DNA, 22 bp, Homo sapiens
ttgtgtgtagactcagccattg

SEQ ID NO: 9271225 - DNA, 17 bp, Homo sapiens
ttgtgtgtagttctgat

SEQ ID NO: 9271226 - DNA, 17 bp, Homo sapiens
ttgtgtgtagttctgat

SEQ ID NO: 9271227 - DNA, 22 bp, Homo sapiens
tttaaagaaattcctcatcttt

SEQ ID NO: 9271228 - DNA, 17 bp, Homo sapiens
tttaaactactacaagg

SEQ ID NO: 9271229 - DNA, 22 bp, Homo sapiens
tttaaagaaattcctcatcttt

SEQ ID NO: 9271230 - DNA, 22 bp, Homo sapiens
tttaaactgttgattttatgaa

SEQ ID NO: 9271231 - DNA, 22 bp, Homo sapiens
tttaaactaacagtacacgttg

SEQ ID NO: 9271232 - DNA, 22 bp, Homo sapiens
tttatccagaatcaggattttt

SEQ ID NO: 9271233 - DNA, 22 bp, Homo sapiens
tttatcatcttgtttttaaagc

SEQ ID NO: 9271234 - DNA, 22 bp, Homo sapiens
tttatcatcttgtttttaaagc

SEQ ID NO: 9271235 - DNA, 22 bp, Homo sapiens
tttatcacagaataagaagtca

SEQ ID NO: 9271236 - DNA, 22 bp, Homo sapiens
tttatccatatcattaaaatct

SEQ ID NO: 9271237 - DNA, 22 bp, Homo sapiens
tttatccatcatctgctgaagg

SEQ ID NO: 9271238 - DNA, 22 bp, Homo sapiens
tttatccattcaccagttgaac

SEQ ID NO: 9271239 - DNA, 22 bp, Homo sapiens
tttatctcttttgaccaagatt

SEQ ID NO: 9271240 - DNA, 22 bp, Homo sapiens
tttatctattgtattgttgatg

SEQ ID NO: 9271241 - DNA, 22 bp, Homo sapiens
tttatctgaggaaagcagacaa

SEQ ID NO: 9271242 - DNA, 22 bp, Homo sapiens
tttatctgagctgatagatagt

SEQ ID NO: 9271243 - DNA, 22 bp, Homo sapiens
tttatctgagctgatagatagt

SEQ ID NO: 9271244 - DNA, 22 bp, Homo sapiens
tttatctgagctgatagatagt

SEQ ID NO: 9271245 - DNA, 22 bp, Homo sapiens
tttatatagagatttgtgcatg

SEQ ID NO: 9271246 - DNA, 22 bp, Homo sapiens
tttatattgtaaaaatggttct

SEQ ID NO: 9271247 - DNA, 22 bp, Homo sapiens
tttatattgtaaaaatggttct

SEQ ID NO: 9271248 - DNA, 22 bp, Homo sapiens
tttatattgtaaaaatggttct

SEQ ID NO: 9271249 - DNA, 22 bp, Homo sapiens
tttagcatccaaggttatgact

SEQ ID NO: 9271250 - DNA, 22 bp, Homo sapiens
tttagcatatcctataaaacta

SEQ ID NO: 9271251 - DNA, 22 bp, Homo sapiens
tttagcagagcatatgatatcc

SEQ ID NO: 9271252 - DNA, 22 bp, Homo sapiens
tttaccaaatagattatgtcag

SEQ ID NO: 9271253 - DNA, 20 bp, Homo sapiens
tttacattttgaaacagtga

SEQ ID NO: 9271254 - DNA, 20 bp, Homo sapiens
tttacattttgaaacagtga

SEQ ID NO: 9271255 - DNA, 20 bp, Homo sapiens
tttacattttgaaacagtga

SEQ ID NO: 9271256 - DNA, 22 bp, Homo sapiens
tttacagtctgtctagcaatgt

SEQ ID NO: 9271257 - DNA, 22 bp, Homo sapiens
tttaccaagctttaattacata

SEQ ID NO: 9271258 - DNA, 23 bp, Homo sapiens
tttaccagaatagcaggggagag

SEQ ID NO: 9271259 - DNA, 22 bp, Homo sapiens
tttagaagacagatgcacagcc

SEQ ID NO: 9271260 - DNA, 22 bp, Homo sapiens
tttagataatgctcaagcaatt

SEQ ID NO: 9271261 - DNA, 22 bp, Homo sapiens
tttagagtccctttctcaccac

SEQ ID NO: 9271262 - DNA, 22 bp, Homo sapiens
tttagagttggtcccctgtgag

SEQ ID NO: 9271263 - DNA, 22 bp, Homo sapiens
tttagagagtgtaaaaatatat

SEQ ID NO: 9271264 - DNA, 21 bp, Homo sapiens
tttagaggacacagggaggca

SEQ ID NO: 9271265 - DNA, 22 bp, Homo sapiens
tttagaggaggaagaaattttg

SEQ ID NO: 9271266 - DNA, 22 bp, Homo sapiens
tttagaggcatcttgcttttct

SEQ ID NO: 9271267 - DNA, 22 bp, Homo sapiens
tttagaggggaaagtggctggt

SEQ ID NO: 9271268 - DNA, 22 bp, Homo sapiens
tttagaggttagaggctgatag

SEQ ID NO: 9271269 - DNA, 22 bp, Homo sapiens
tttagagtaaaaactgtgacct

SEQ ID NO: 9271270 - DNA, 22 bp, Homo sapiens
tttagagtcattttatattgac

SEQ ID NO: 9271271 - DNA, 22 bp, Homo sapiens
ttgcattagtgtcataaggtgg

SEQ ID NO: 9271272 - DNA, 22 bp, Homo sapiens
ttgctctgattaggtggaaaca

SEQ ID NO: 9271273 - DNA, 22 bp, Homo sapiens
ttgctctgaacccagggcacca

SEQ ID NO: 9271274 - DNA, 22 bp, Homo sapiens
ttgctgaagttgctcagctcca

SEQ ID NO: 9271275 - DNA, 22 bp, Homo sapiens
ttgctgaatgcaagttggatag

SEQ ID NO: 9271276 - DNA, 22 bp, Homo sapiens
ttgctgaagtgaaggtatgttt

SEQ ID NO: 9271277 - DNA, 22 bp, Homo sapiens
ttgctgaagttaatgcttgcaa

SEQ ID NO: 9271278 - DNA, 22 bp, Homo sapiens
ttgctgaagttaatgcttgcaa

SEQ ID NO: 9271279 - DNA, 19 bp, Homo sapiens
ttgctgaaggaagcctctg

SEQ ID NO: 9271280 - DNA, 22 bp, Homo sapiens
ttgctgaagctgccaaaccagt

SEQ ID NO: 9271281 - DNA, 22 bp, Homo sapiens
ttgctgaagaaaaaatatgtta

SEQ ID NO: 9271282 - DNA, 22 bp, Homo sapiens
ttgctgaagtatgaaaaagaca

SEQ ID NO: 9271283 - DNA, 22 bp, Homo sapiens
ttgctgaaggcctcttggggtt

SEQ ID NO: 9271284 - DNA, 22 bp, Homo sapiens
ttgctgaagtattgtgaatcct

SEQ ID NO: 9271285 - DNA, 22 bp, Homo sapiens
ttgctgaagtattgtgaatcct

SEQ ID NO: 9271286 - DNA, 22 bp, Homo sapiens
ttgctgaaaggtagctgtgtgg

SEQ ID NO: 9271287 - DNA, 22 bp, Homo sapiens
ttgctgaaaggtagctgtgtgg

SEQ ID NO: 9271288 - DNA, 22 bp, Homo sapiens
ttgctgaaagtggcaagaagta

SEQ ID NO: 9271289 - DNA, 22 bp, Homo sapiens
ttgctgaaatctatgacatcct

SEQ ID NO: 9271290 - DNA, 22 bp, Homo sapiens
ttgctgaaccctgccctctaat

SEQ ID NO: 9271291 - DNA, 22 bp, Homo sapiens
ttgctgaagaaaaaatatgtta

SEQ ID NO: 9271292 - DNA, 22 bp, Homo sapiens
ttgctgaaaacaggtcatcagg

SEQ ID NO: 9271293 - DNA, 22 bp, Homo sapiens
ttgctgaaaagctggcctttgt

SEQ ID NO: 9271294 - DNA, 22 bp, Homo sapiens
ttgctgaaaacagtgggtattg

SEQ ID NO: 9271295 - DNA, 22 bp, Homo sapiens
ttgctgaattgaatcctttggt

SEQ ID NO: 9271296 - DNA, 22 bp, Homo sapiens
ttgctgttttacatctggtggg

SEQ ID NO: 9271297 - DNA, 22 bp, Homo sapiens
ttgcttatttgattaaatgtct

SEQ ID NO: 9271298 - DNA, 22 bp, Homo sapiens
ttgcttagcgactccccttcct

SEQ ID NO: 9271299 - DNA, 22 bp, Homo sapiens
ttgcttatagagagtttcatac

SEQ ID NO: 9271300 - DNA, 23 bp, Homo sapiens
ttgcttagagacctcctcatcag

SEQ ID NO: 9271301 - DNA, 23 bp, Homo sapiens
ttgcttagagacctcctcatcag

SEQ ID NO: 9271302 - DNA, 22 bp, Homo sapiens
ttgctttccgtcatgtgctaat

SEQ ID NO: 9271303 - DNA, 22 bp, Homo sapiens
ttgcttcagaagttctgcttgt

SEQ ID NO: 9271304 - DNA, 22 bp, Homo sapiens
ttgctttattgggtttactgcc

SEQ ID NO: 9271305 - DNA, 22 bp, Homo sapiens
ttggaaacgtcaccttttcctt

SEQ ID NO: 9271306 - DNA, 22 bp, Homo sapiens
ttggaaagtttttactgaagac

SEQ ID NO: 9271307 - DNA, 22 bp, Homo sapiens
ttggaacaatcacatccttgct

SEQ ID NO: 9271308 - DNA, 22 bp, Homo sapiens
ttggaatttagggaatattcat

SEQ ID NO: 9271309 - DNA, 22 bp, Homo sapiens
ttggaattgaggatttacatag

SEQ ID NO: 9271310 - DNA, 22 bp, Homo sapiens
ttggaattcctgttgtttcgtc

SEQ ID NO: 9271311 - DNA, 21 bp, Homo sapiens
ttggaatttgggagctatgtg

SEQ ID NO: 9271312 - DNA, 22 bp, Homo sapiens
ttgcagatgaagaaagtggtag

SEQ ID NO: 9271313 - DNA, 22 bp, Homo sapiens
ttgcagggaaatagaaataaac

SEQ ID NO: 9271314 - DNA, 22 bp, Homo sapiens
ttgcagggaaacagtttaggaa

SEQ ID NO: 9271315 - DNA, 22 bp, Homo sapiens
ttgcagggataaaacaagtgaa

SEQ ID NO: 9271316 - DNA, 23 bp, Homo sapiens
ttgcagggatggagttcaaaatg

SEQ ID NO: 9271317 - DNA, 22 bp, Homo sapiens
ttgcagggattaccttattttt

SEQ ID NO: 9271318 - DNA, 22 bp, Homo sapiens
ttgcagggaaatcagtgaggat

SEQ ID NO: 9271319 - DNA, 22 bp, Homo sapiens
ttgcagggacctgcagaaagct

SEQ ID NO: 9271320 - DNA, 22 bp, Homo sapiens
ttgcagggacctgcagaaagct

SEQ ID NO: 9271321 - DNA, 22 bp, Homo sapiens
ttgcagggttgaccaataggct

SEQ ID NO: 9271322 - DNA, 22 bp, Homo sapiens
ttgcagggttgacactgcctgc

SEQ ID NO: 9271323 - DNA, 22 bp, Homo sapiens
ttgcagggttaaagtaaggtag

SEQ ID NO: 9271324 - DNA, 22 bp, Homo sapiens
ttgcagttaaaaatcattagtt

SEQ ID NO: 9271325 - DNA, 22 bp, Homo sapiens
ttgcagtcacactctaaagtag

SEQ ID NO: 9271326 - DNA, 22 bp, Homo sapiens
ttgcagttgcatatgcccctac

SEQ ID NO: 9271327 - DNA, 22 bp, Homo sapiens
ttgcagggccttggcttcttcc

SEQ ID NO: 9271328 - DNA, 22 bp, Homo sapiens
ttgcagggcttggggattacag

SEQ ID NO: 9271329 - DNA, 22 bp, Homo sapiens
ttgcagggctggaacatggaat

SEQ ID NO: 9271330 - DNA, 22 bp, Homo sapiens
ttgcagggcaggaccatggaca

SEQ ID NO: 9271331 - DNA, 22 bp, Homo sapiens
ttgcagggcaaatggtcagata

SEQ ID NO: 9271332 - DNA, 22 bp, Homo sapiens
ttgcagggcaggaccatggaca

SEQ ID NO: 9271333 - DNA, 22 bp, Homo sapiens
ttgcagggcatctatgtctggt

SEQ ID NO: 9271334 - DNA, 22 bp, Homo sapiens
ttgcagggcatcgcgtacttct

SEQ ID NO: 9271335 - DNA, 22 bp, Homo sapiens
ttgcagggtcccagaggcctgg

SEQ ID NO: 9271336 - DNA, 22 bp, Homo sapiens
ttgcagggtacattcttagaat

SEQ ID NO: 9271337 - DNA, 22 bp, Homo sapiens
ttgcagggtcctgtggctctcc

SEQ ID NO: 9271338 - DNA, 22 bp, Homo sapiens
ttgcaggggaaggagcagagct

SEQ ID NO: 9271339 - DNA, 22 bp, Homo sapiens
ttgcaggggaaggagcagagct

SEQ ID NO: 9271340 - DNA, 22 bp, Homo sapiens
ttgcaggggagaggaacaaaca

SEQ ID NO: 9271341 - DNA, 22 bp, Homo sapiens
ttgacaaagtttagtaataatc

SEQ ID NO: 9271342 - DNA, 22 bp, Homo sapiens
ttgacaaagtttagtaataatc

SEQ ID NO: 9271343 - DNA, 22 bp, Homo sapiens
ttgacaaatacccattagacca

SEQ ID NO: 9271344 - DNA, 22 bp, Homo sapiens
ttgacaatccctgttagaagtg

SEQ ID NO: 9271345 - DNA, 22 bp, Homo sapiens
ttgacaaatacccattagacca

SEQ ID NO: 9271346 - DNA, 22 bp, Homo sapiens
ttgacaagtaatacttaaatta

SEQ ID NO: 9271347 - DNA, 22 bp, Homo sapiens
ttgacaatgtcctttgaatttc

SEQ ID NO: 9271348 - DNA, 22 bp, Homo sapiens
ttgacaatgtcctttgaatttc

SEQ ID NO: 9271349 - DNA, 22 bp, Homo sapiens
ttgacaatgtcctttgaatttc

SEQ ID NO: 9271350 - DNA, 22 bp, Homo sapiens
ttgacaaaacaacacagatttc

SEQ ID NO: 9271351 - DNA, 22 bp, Homo sapiens
ttgacaaaaacctcatttcacc

SEQ ID NO: 9271352 - DNA, 22 bp, Homo sapiens
ttgacaaaaataacacagcata

SEQ ID NO: 9271353 - DNA, 22 bp, Homo sapiens
ttgacaaaaacctcatttcacc

SEQ ID NO: 9271354 - DNA, 22 bp, Homo sapiens
ttgacaaaggaccttgctattt

SEQ ID NO: 9271355 - DNA, 22 bp, Homo sapiens
ttgacaaaggaccttgctattt

SEQ ID NO: 9271356 - DNA, 22 bp, Homo sapiens
ttgacaaaggctgagaggaaaa

SEQ ID NO: 9271357 - DNA, 22 bp, Homo sapiens
ttgacaaagatatattcatgct

SEQ ID NO: 9271358 - DNA, 22 bp, Homo sapiens
ttgacaaaggaattgaatctct

SEQ ID NO: 9271359 - DNA, 22 bp, Homo sapiens
ttgacaaaggaattgaatctct

SEQ ID NO: 9271360 - DNA, 22 bp, Homo sapiens
ttgacaaaggaattgaatctct

SEQ ID NO: 9271361 - DNA, 22 bp, Homo sapiens
ttgacactaagatttccaaaca

SEQ ID NO: 9271362 - DNA, 21 bp, Homo sapiens
ttgacaggaaagaggggagat

SEQ ID NO: 9271363 - DNA, 22 bp, Homo sapiens
ttgcaattgctatggagagcgt

SEQ ID NO: 9271364 - DNA, 22 bp, Homo sapiens
ttgcagagtggttgtgaggatt

SEQ ID NO: 9271365 - DNA, 22 bp, Homo sapiens
ttgcagaggcaaaaatgaactc

SEQ ID NO: 9271366 - DNA, 22 bp, Homo sapiens
ttgcagagatcagcaggtttga

SEQ ID NO: 9271367 - DNA, 22 bp, Homo sapiens
ttgcagagatcagcaggtttga

SEQ ID NO: 9271368 - DNA, 22 bp, Homo sapiens
ttgcagagccatgaggctggct

SEQ ID NO: 9271369 - DNA, 22 bp, Homo sapiens
ttgcagagcagtaggaatatag

SEQ ID NO: 9271370 - DNA, 22 bp, Homo sapiens
ttgcagaagggcacagtgatca

SEQ ID NO: 9271371 - DNA, 22 bp, Homo sapiens
ttgcagagaggttaggaactca

SEQ ID NO: 9271372 - DNA, 22 bp, Homo sapiens
ttgcagacttacttcgagaaat

SEQ ID NO: 9271373 - DNA, 22 bp, Homo sapiens
ttgcagacccttactgctagag

SEQ ID NO: 9271374 - DNA, 22 bp, Homo sapiens
ttgcagaatacttattctgtat

SEQ ID NO: 9271375 - DNA, 22 bp, Homo sapiens
ttgtacaagtattatgtgaaca

SEQ ID NO: 9271376 - DNA, 22 bp, Homo sapiens
ttgtacaagttttgagcttaag

SEQ ID NO: 9271377 - DNA, 22 bp, Homo sapiens
ttgtacaagtattatgtgaaca

SEQ ID NO: 9271378 - DNA, 22 bp, Homo sapiens
ttgtatttcgatgcacgtgtag

SEQ ID NO: 9271379 - DNA, 22 bp, Homo sapiens
ttgtatttcgatgcacgtgtag

SEQ ID NO: 9271380 - DNA, 23 bp, Homo sapiens
ttgtatttttagtagagacaggg

SEQ ID NO: 9271381 - DNA, 22 bp, Homo sapiens
ttgtatttctccactttctgtt

SEQ ID NO: 9271382 - DNA, 22 bp, Homo sapiens
ttgtacagggaagtaatacaag

SEQ ID NO: 9271383 - DNA, 22 bp, Homo sapiens
ttgtacaggttcctagggtgga

SEQ ID NO: 9271384 - DNA, 22 bp, Homo sapiens
ttgtaacaaagacactccaaaa

SEQ ID NO: 9271385 - DNA, 22 bp, Homo sapiens
ttgtaacaatctgtcataaatg

SEQ ID NO: 9271386 - DNA, 21 bp, Homo sapiens
ttgtaaatggctttttccttc

SEQ ID NO: 9271387 - DNA, 22 bp, Homo sapiens
ttgtaaatgaccttttctaatt

SEQ ID NO: 9271388 - DNA, 22 bp, Homo sapiens
ttgtaacagctgtttatatagt

SEQ ID NO: 9271389 - DNA, 22 bp, Homo sapiens
ttgtaacacttttctattaata

SEQ ID NO: 9271390 - DNA, 22 bp, Homo sapiens
ttgtaacacttttctattaata

SEQ ID NO: 9271391 - DNA, 22 bp, Homo sapiens
ttgtaacaggtactaaataact

SEQ ID NO: 9271392 - DNA, 22 bp, Homo sapiens
ttgtaaatagtagtaagatgcc

SEQ ID NO: 9271393 - DNA, 22 bp, Homo sapiens
ttgtaaatagtagtaagatgcc

SEQ ID NO: 9271394 - DNA, 22 bp, Homo sapiens
ttgtaaatgaccttttctaatt

SEQ ID NO: 9271395 - DNA, 22 bp, Homo sapiens
ttgtaaatgaccttttctaatt

SEQ ID NO: 9271396 - DNA, 22 bp, Homo sapiens
ttgtaaacttgtttgaaggtat

SEQ ID NO: 9271397 - DNA, 22 bp, Homo sapiens
ttgtcacatgtagttcattctc

SEQ ID NO: 9271398 - DNA, 22 bp, Homo sapiens
ttgtcattggggttatttgtta

SEQ ID NO: 9271399 - DNA, 22 bp, Homo sapiens
ttgtccaaggtcccacagttag

SEQ ID NO: 9271400 - DNA, 22 bp, Homo sapiens
ttgtcatgatccttctgttagg

SEQ ID NO: 9271401 - DNA, 23 bp, Homo sapiens
ttgtccagctggtttgggccaca

SEQ ID NO: 9271402 - DNA, 22 bp, Homo sapiens
ttgtccattttattggatggtg

SEQ ID NO: 9271403 - DNA, 22 bp, Homo sapiens
ttgtcctgcaacctcacatggc

SEQ ID NO: 9271404 - DNA, 23 bp, Homo sapiens
ttgtcctgccgatctctgagaat

SEQ ID NO: 9271405 - DNA, 22 bp, Homo sapiens
ttgtcctgcaacctcacatggc

SEQ ID NO: 9271406 - DNA, 22 bp, Homo sapiens
ttgtcctgaggactgttatcag

SEQ ID NO: 9271407 - DNA, 22 bp, Homo sapiens
ttgtcctgtcaggctgggggct

SEQ ID NO: 9271408 - DNA, 22 bp, Homo sapiens
ttgtcctgtgatttcagggcct

SEQ ID NO: 9271409 - DNA, 22 bp, Homo sapiens
ttgtcctggaggttaatagagt

SEQ ID NO: 9271410 - DNA, 22 bp, Homo sapiens
ttgtcctggaggttaatagagt

SEQ ID NO: 9271411 - DNA, 22 bp, Homo sapiens
ttgtcctgtgtctgtttggatt

SEQ ID NO: 9271412 - DNA, 22 bp, Homo sapiens
ttgtcctgttacttgtttggat

SEQ ID NO: 9271413 - DNA, 22 bp, Homo sapiens
ttgtgggatctccctgttgctc

SEQ ID NO: 9271414 - DNA, 22 bp, Homo sapiens
ttgtgggatggctcttcccaaa

SEQ ID NO: 9271415 - DNA, 22 bp, Homo sapiens
ttgtgtccccctttgagagcca

SEQ ID NO: 9271416 - DNA, 22 bp, Homo sapiens
ttgtgtcatgttccattgaaaa

SEQ ID NO: 9271417 - DNA, 22 bp, Homo sapiens
ttgtgtcctgatttgacacaat

SEQ ID NO: 9271418 - DNA, 22 bp, Homo sapiens
ttgtgtctgggggagtgacatc

SEQ ID NO: 9271419 - DNA, 22 bp, Homo sapiens
ttgtgtctgggggagtgacatc

SEQ ID NO: 9271420 - DNA, 22 bp, Homo sapiens
ttgtgtctaaataaggagacct

SEQ ID NO: 9271421 - DNA, 18 bp, Homo sapiens
ttggacctgtgtcagggc

SEQ ID NO: 9271422 - DNA, 22 bp, Homo sapiens
ttggagatatcacaccttcaca

SEQ ID NO: 9271423 - DNA, 22 bp, Homo sapiens
ttggagatatcacaccttcaca

SEQ ID NO: 9271424 - DNA, 22 bp, Homo sapiens
ttggaggaaattgcttttgtgg

SEQ ID NO: 9271425 - DNA, 22 bp, Homo sapiens
ttggcaggaatattgcagaggt

SEQ ID NO: 9271426 - DNA, 23 bp, Homo sapiens
ttggcagcgggtcaggctgtggg

SEQ ID NO: 9271427 - DNA, 22 bp, Homo sapiens
ttggcagggctgcttgtctagg

SEQ ID NO: 9271428 - DNA, 22 bp, Homo sapiens
ttgggcaggtgtggctctcctt

SEQ ID NO: 9271429 - DNA, 22 bp, Homo sapiens
ttgggcagtctggctgcagagt

SEQ ID NO: 9271430 - DNA, 22 bp, Homo sapiens
ttgggcagtctggctgcagagt

SEQ ID NO: 9271431 - DNA, 22 bp, Homo sapiens
ttgggcagtgattagttcatga

SEQ ID NO: 9271432 - DNA, 17 bp, Homo sapiens
ttgggagagaaaggtat

SEQ ID NO: 9271433 - DNA, 22 bp, Homo sapiens
ttgggaagtttaatgacagact

SEQ ID NO: 9271434 - DNA, 22 bp, Homo sapiens
ttgggacagaaaaggagaagat

SEQ ID NO: 9271435 - DNA, 22 bp, Homo sapiens
ttgggaaggcgtggaagcagaa

SEQ ID NO: 9271436 - DNA, 22 bp, Homo sapiens
ttggccaggtccatttctccat

SEQ ID NO: 9271437 - DNA, 22 bp, Homo sapiens
ttggccagcgacgaccttctta

SEQ ID NO: 9271438 - DNA, 22 bp, Homo sapiens
ttggccagtgaaccaggcctgg

SEQ ID NO: 9271439 - DNA, 22 bp, Homo sapiens
aatcacaattacttttgcacca

SEQ ID NO: 9271440 - DNA, 22 bp, Homo sapiens
aatcacacaaaggcaacttttg

SEQ ID NO: 9271441 - DNA, 22 bp, Homo sapiens
aatcacagaaggcagtcttcta

SEQ ID NO: 9271442 - DNA, 22 bp, Homo sapiens
aatcacatagccatctctttga

SEQ ID NO: 9271443 - DNA, 22 bp, Homo sapiens
aatcacatagccatctctttga

SEQ ID NO: 9271444 - DNA, 22 bp, Homo sapiens
aatcacatcactgagaatgagg

SEQ ID NO: 9271445 - DNA, 22 bp, Homo sapiens
aatcacaggcatagattgctcc

SEQ ID NO: 9271446 - DNA, 20 bp, Homo sapiens
aatcacagttaactctttct

SEQ ID NO: 9271447 - DNA, 22 bp, Homo sapiens
aatcacagtgggtactagattg

SEQ ID NO: 9271448 - DNA, 22 bp, Homo sapiens
agaaaggaggaagaatgacctc

SEQ ID NO: 9271449 - DNA, 22 bp, Homo sapiens
agaaaggagaccagctctgccc

SEQ ID NO: 9271450 - DNA, 22 bp, Homo sapiens
agaaaggagcaccgtgggggat

SEQ ID NO: 9271451 - DNA, 22 bp, Homo sapiens
agaaaggagaccagctctgccc

SEQ ID NO: 9271452 - DNA, 22 bp, Homo sapiens
agaaagcttatgaatgggcaag

SEQ ID NO: 9271453 - DNA, 22 bp, Homo sapiens
agaaagcttatgaatgggcaag

SEQ ID NO: 9271454 - DNA, 22 bp, Homo sapiens
agaaagcttatgaatgggcaag

SEQ ID NO: 9271455 - DNA, 22 bp, Homo sapiens
agaaagcttatgaatgggcaag

SEQ ID NO: 9271456 - DNA, 22 bp, Homo sapiens
agaaagctggagtcaagcagag

SEQ ID NO: 9271457 - DNA, 22 bp, Homo sapiens
agaaactgacaggaaatgaatt

SEQ ID NO: 9271458 - DNA, 22 bp, Homo sapiens
aatctacatttcagttttgccc

SEQ ID NO: 9271459 - DNA, 22 bp, Homo sapiens
aatctaagccaccagtagtttc

SEQ ID NO: 9271460 - DNA, 22 bp, Homo sapiens
aatctacatagagatcaaatga

SEQ ID NO: 9271461 - DNA, 22 bp, Homo sapiens
agaaagggagcgtggatcaatt

SEQ ID NO: 9271462 - DNA, 22 bp, Homo sapiens
aatccttatataatgccttcca

SEQ ID NO: 9271463 - DNA, 22 bp, Homo sapiens
aatcgcaattacttttgcacca

SEQ ID NO: 9271464 - DNA, 22 bp, Homo sapiens
aatcgcttggtaattttaaaag

SEQ ID NO: 9271465 - DNA, 22 bp, Homo sapiens
aatcggttgaacccaggaagtg

SEQ ID NO: 9271466 - DNA, 22 bp, Homo sapiens
aatagcttatgggatagatgtt

SEQ ID NO: 9271467 - DNA, 22 bp, Homo sapiens
aatagcttattgacagtgaatt

SEQ ID NO: 9271468 - DNA, 22 bp, Homo sapiens
aatagcttggacccattgcttt

SEQ ID NO: 9271469 - DNA, 22 bp, Homo sapiens
aataggaaaatatttaacaaga

SEQ ID NO: 9271470 - DNA, 22 bp, Homo sapiens
aatagctgggaggcacattcat

SEQ ID NO: 9271471 - DNA, 23 bp, Homo sapiens
aatagctggtaatgatagcacaa

SEQ ID NO: 9271472 - DNA, 22 bp, Homo sapiens
aatagcttagtcctgattctgt

SEQ ID NO: 9271473 - DNA, 20 bp, Homo sapiens
aatagctgagggcaagagta

SEQ ID NO: 9271474 - DNA, 17 bp, Homo sapiens
aatagctgctcagagag

SEQ ID NO: 9271475 - DNA, 17 bp, Homo sapiens
aatagctgctcagagag

SEQ ID NO: 9271476 - DNA, 22 bp, Homo sapiens
aatagctgattaatgtactacc

SEQ ID NO: 9271477 - DNA, 22 bp, Homo sapiens
aatagctgcataaagtatagaa

SEQ ID NO: 9271478 - DNA, 22 bp, Homo sapiens
aatagcatgcatcctgcataga

SEQ ID NO: 9271479 - DNA, 22 bp, Homo sapiens
aatagcatgttaataaccagag

SEQ ID NO: 9271480 - DNA, 22 bp, Homo sapiens
aatagcatgttcatgataaaat

SEQ ID NO: 9271481 - DNA, 22 bp, Homo sapiens
aatagcatgtaagtttaaaaga

SEQ ID NO: 9271482 - DNA, 22 bp, Homo sapiens
aatagcatgtaagtttaaaaga

SEQ ID NO: 9271483 - DNA, 22 bp, Homo sapiens
aatagcatgttcatgataaaat

SEQ ID NO: 9271484 - DNA, 22 bp, Homo sapiens
actttgttttatagcacataag

SEQ ID NO: 9271485 - DNA, 22 bp, Homo sapiens
actttgttgatgaaatagtttt

SEQ ID NO: 9271486 - DNA, 22 bp, Homo sapiens
actttgttgaagaatatgttag

SEQ ID NO: 9271487 - DNA, 22 bp, Homo sapiens
actttgttcctttcacaaagaa

SEQ ID NO: 9271488 - DNA, 22 bp, Homo sapiens
actttgacagcattttaattat

SEQ ID NO: 9271489 - DNA, 22 bp, Homo sapiens
acttttcaaatgggaaactcag

SEQ ID NO: 9271490 - DNA, 22 bp, Homo sapiens
acttttcaaatgggaaactcag

SEQ ID NO: 9271491 - DNA, 22 bp, Homo sapiens
acttttatcaaggaagtgatct

SEQ ID NO: 9271492 - DNA, 22 bp, Homo sapiens
acttttatcaaggaagtgatct

SEQ ID NO: 9271493 - DNA, 22 bp, Homo sapiens
agaagcagctttcaaggtgatt

SEQ ID NO: 9271494 - DNA, 22 bp, Homo sapiens
agaagccaccagctgaggaaga

SEQ ID NO: 9271495 - DNA, 22 bp, Homo sapiens
agaagccaccagctgaggaaga

SEQ ID NO: 9271496 - DNA, 22 bp, Homo sapiens
agaagccaccagctgaggaaga

SEQ ID NO: 9271497 - DNA, 22 bp, Homo sapiens
aatgaatgaaccacatataaca

SEQ ID NO: 9271498 - DNA, 22 bp, Homo sapiens
agaagccactggaggttgagat

SEQ ID NO: 9271499 - DNA, 22 bp, Homo sapiens
agaagccagaatattcatggat

SEQ ID NO: 9271500 - DNA, 22 bp, Homo sapiens
agaagccagaggcagtgggtac

SEQ ID NO: 9271501 - DNA, 22 bp, Homo sapiens
agaagccactggaggttgagat

SEQ ID NO: 9271502 - DNA, 18 bp, Homo sapiens
agaagccacgaggagtcc

SEQ ID NO: 9271503 - DNA, 22 bp, Homo sapiens
aatgaataacaatcctctggag

SEQ ID NO: 9271504 - DNA, 22 bp, Homo sapiens
aatgaagattatggtgattaag

SEQ ID NO: 9271505 - DNA, 22 bp, Homo sapiens
aatgaagataaaatgggatgga

SEQ ID NO: 9271506 - DNA, 22 bp, Homo sapiens
aatgaagcaagctgctgtgttt

SEQ ID NO: 9271507 - DNA, 22 bp, Homo sapiens
aatgaagcagtccatctgctct

SEQ ID NO: 9271508 - DNA, 22 bp, Homo sapiens
aatgaagcagtccatctgctct

SEQ ID NO: 9271509 - DNA, 22 bp, Homo sapiens
aatgaagccaggtagaagagaa

SEQ ID NO: 9271510 - DNA, 22 bp, Homo sapiens
agaacgaatgcttcagctctag

SEQ ID NO: 9271511 - DNA, 22 bp, Homo sapiens
agaactattgcaataacaagaa

SEQ ID NO: 9271512 - DNA, 22 bp, Homo sapiens
agaacaattgccccaaagcttg

SEQ ID NO: 9271513 - DNA, 22 bp, Homo sapiens
agaacacacgtcagagtttcct

SEQ ID NO: 9271514 - DNA, 22 bp, Homo sapiens
aatgaacttcagtgatttctgg

SEQ ID NO: 9271515 - DNA, 22 bp, Homo sapiens
aatgaagaaatggacatcttta

SEQ ID NO: 9271516 - DNA, 22 bp, Homo sapiens
aatgaagaaatggacatcttta

SEQ ID NO: 9271517 - DNA, 22 bp, Homo sapiens
aatgaactggatcagggtttct

SEQ ID NO: 9271518 - DNA, 22 bp, Homo sapiens
aatgaactggagaacaatgacc

SEQ ID NO: 9271519 - DNA, 22 bp, Homo sapiens
agaagaaagattgaaggttcct

SEQ ID NO: 9271520 - DNA, 22 bp, Homo sapiens
agaagaaagattgaaggttcct

SEQ ID NO: 9271521 - DNA, 22 bp, Homo sapiens
agaagaaactgtcggggatatt

SEQ ID NO: 9271522 - DNA, 22 bp, Homo sapiens
agaagaaagattgaaggttcct

SEQ ID NO: 9271523 - DNA, 22 bp, Homo sapiens
agaacttttggagacttttagt

SEQ ID NO: 9271524 - DNA, 22 bp, Homo sapiens
agaagaaactgtcggggatatt

SEQ ID NO: 9271525 - DNA, 19 bp, Homo sapiens
aatgcctcaaattgggaga

SEQ ID NO: 9271526 - DNA, 22 bp, Homo sapiens
aatgccattccatcacacacct

SEQ ID NO: 9271527 - DNA, 22 bp, Homo sapiens
aatgccagtgtgttgattccag

SEQ ID NO: 9271528 - DNA, 22 bp, Homo sapiens
aatgccactaaatctgtgaata

SEQ ID NO: 9271529 - DNA, 22 bp, Homo sapiens
aatgccaacttggatatacatt

SEQ ID NO: 9271530 - DNA, 22 bp, Homo sapiens
aatgcatacgtgtttgtggcaa

SEQ ID NO: 9271531 - DNA, 22 bp, Homo sapiens
aatgcataccatgtcatctttg

SEQ ID NO: 9271532 - DNA, 22 bp, Homo sapiens
aatgcattctcggtttgtgtgt

SEQ ID NO: 9271533 - DNA, 22 bp, Homo sapiens
aatgcattagctacatatgtct

SEQ ID NO: 9271534 - DNA, 22 bp, Homo sapiens
agaagccagcttcagctgcccg

SEQ ID NO: 9271535 - DNA, 22 bp, Homo sapiens
agaagccagcttcagctgcccg

SEQ ID NO: 9271536 - DNA, 22 bp, Homo sapiens
agaagccagtcgctctcccgca

SEQ ID NO: 9271537 - DNA, 22 bp, Homo sapiens
agaagccagattgtagtgggac

SEQ ID NO: 9271538 - DNA, 22 bp, Homo sapiens
agaagcttgaaggagcagtgac

SEQ ID NO: 9271539 - DNA, 22 bp, Homo sapiens
agaaggaaggaagcattctgtt

SEQ ID NO: 9271540 - DNA, 22 bp, Homo sapiens
agaaggaagccaggagggtgca

SEQ ID NO: 9271541 - DNA, 22 bp, Homo sapiens
agaaggaaggctgagtgctgat

SEQ ID NO: 9271542 - DNA, 18 bp, Homo sapiens
aatgcaatgtatttgcag

SEQ ID NO: 9271543 - DNA, 22 bp, Homo sapiens
aatgcacaaaaattgtatgtaa

SEQ ID NO: 9271544 - DNA, 22 bp, Homo sapiens
aataatacatgagattaatgtt

SEQ ID NO: 9271545 - DNA, 22 bp, Homo sapiens
aataatagcagagtttacaatc

SEQ ID NO: 9271546 - DNA, 22 bp, Homo sapiens
aataatagcagagtttacaatc

SEQ ID NO: 9271547 - DNA, 22 bp, Homo sapiens
aataatagcagagtttacaatc

SEQ ID NO: 9271548 - DNA, 22 bp, Homo sapiens
actggggagagtcatgccagca

SEQ ID NO: 9271549 - DNA, 22 bp, Homo sapiens
actggggaatggaactgggaat

SEQ ID NO: 9271550 - DNA, 22 bp, Homo sapiens
actgggcaccatcatgagatgg

SEQ ID NO: 9271551 - DNA, 22 bp, Homo sapiens
actgggcaccatcatgagatag

SEQ ID NO: 9271552 - DNA, 22 bp, Homo sapiens
actgggcaataaattcagagaa

SEQ ID NO: 9271553 - DNA, 22 bp, Homo sapiens
actgggattacaggtgggagtc

SEQ ID NO: 9271554 - DNA, 22 bp, Homo sapiens
actgggattacaggtgggagtc

SEQ ID NO: 9271555 - DNA, 22 bp, Homo sapiens
actgggcaaggatatgatgggt

SEQ ID NO: 9271556 - DNA, 22 bp, Homo sapiens
actgggattacaggtgggagtc

SEQ ID NO: 9271557 - DNA, 22 bp, Homo sapiens
aataagttgcctgttgaatcat

SEQ ID NO: 9271558 - DNA, 22 bp, Homo sapiens
aataagttgcctgttgaatcat

SEQ ID NO: 9271559 - DNA, 22 bp, Homo sapiens
aataagtgatgatgagtcactc

SEQ ID NO: 9271560 - DNA, 22 bp, Homo sapiens
aataagtgagtttagcaagttt

SEQ ID NO: 9271561 - DNA, 22 bp, Homo sapiens
aataagctgctaggaacttagt

SEQ ID NO: 9271562 - DNA, 22 bp, Homo sapiens
aataagctgctaggaacttagt

SEQ ID NO: 9271563 - DNA, 19 bp, Homo sapiens
aataagcttgggtaaaact

SEQ ID NO: 9271564 - DNA, 22 bp, Homo sapiens
aataagctggagctatattgag

SEQ ID NO: 9271565 - DNA, 19 bp, Homo sapiens
aataagcttgggtaaaact

SEQ ID NO: 9271566 - DNA, 22 bp, Homo sapiens
actgggaggcatctggagctga

SEQ ID NO: 9271567 - DNA, 22 bp, Homo sapiens
aataaaatggtcagttttctca

SEQ ID NO: 9271568 - DNA, 22 bp, Homo sapiens
actgggagggtcttgaagaggg

SEQ ID NO: 9271569 - DNA, 22 bp, Homo sapiens
actgggagggtcttgaagaggg

SEQ ID NO: 9271570 - DNA, 22 bp, Homo sapiens
actgggagggtcttgaagaggg

SEQ ID NO: 9271571 - DNA, 22 bp, Homo sapiens
actgggagtcatgaggaaggag

SEQ ID NO: 9271572 - DNA, 22 bp, Homo sapiens
aataaaatgaactggtagagtt

SEQ ID NO: 9271573 - DNA, 22 bp, Homo sapiens
aataaaatgaactggtagagtt

SEQ ID NO: 9271574 - DNA, 22 bp, Homo sapiens
aataaaatgaactggtagagtt

SEQ ID NO: 9271575 - DNA, 22 bp, Homo sapiens
aagtttttcacattgctgttgt

SEQ ID NO: 9271576 - DNA, 22 bp, Homo sapiens
aagtttttggtagagaaaagta

SEQ ID NO: 9271577 - DNA, 21 bp, Homo sapiens
aataaaacagttggtgtcaat

SEQ ID NO: 9271578 - DNA, 22 bp, Homo sapiens
actgtcgattatgatgagtcag

SEQ ID NO: 9271579 - DNA, 22 bp, Homo sapiens
actgtctcctcatcatgcctgg

SEQ ID NO: 9271580 - DNA, 22 bp, Homo sapiens
actgtcctgaatactgcatgac

SEQ ID NO: 9271581 - DNA, 18 bp, Homo sapiens
actgtctctgagagtggt

SEQ ID NO: 9271582 - DNA, 22 bp, Homo sapiens
actgtctgagctgattgagcta

SEQ ID NO: 9271583 - DNA, 22 bp, Homo sapiens
actgtctctctagcagttcagg

SEQ ID NO: 9271584 - DNA, 22 bp, Homo sapiens
actgtctctctagcagttcagg

SEQ ID NO: 9271585 - DNA, 22 bp, Homo sapiens
aatagcataagatgtcaaatag

SEQ ID NO: 9271586 - DNA, 22 bp, Homo sapiens
aatagcatcctaaaacatactt

SEQ ID NO: 9271587 - DNA, 22 bp, Homo sapiens
aatagcatcctgtatctcttcc

SEQ ID NO: 9271588 - DNA, 22 bp, Homo sapiens
actgtacacattcgtcaagact

SEQ ID NO: 9271589 - DNA, 22 bp, Homo sapiens
actgtacatatggattctaaga

SEQ ID NO: 9271590 - DNA, 22 bp, Homo sapiens
actgtcattaatgaatgtaata

SEQ ID NO: 9271591 - DNA, 21 bp, Homo sapiens
actgtcatttgcttagggagg

SEQ ID NO: 9271592 - DNA, 22 bp, Homo sapiens
actgtccattcactcatattca

SEQ ID NO: 9271593 - DNA, 22 bp, Homo sapiens
actgtaatggtggatccatgtc

SEQ ID NO: 9271594 - DNA, 22 bp, Homo sapiens
actgtaattatctgaacgtgca

SEQ ID NO: 9271595 - DNA, 22 bp, Homo sapiens
actgtaattggattgtctgact

SEQ ID NO: 9271596 - DNA, 22 bp, Homo sapiens
actgtaatattttaagatgtct

SEQ ID NO: 9271597 - DNA, 22 bp, Homo sapiens
aagtgtttggggatcattttaa

SEQ ID NO: 9271598 - DNA, 22 bp, Homo sapiens
aagtgtttcttggaatgttgcg

SEQ ID NO: 9271599 - DNA, 22 bp, Homo sapiens
actctttacttaaactctaagt

SEQ ID NO: 9271600 - DNA, 22 bp, Homo sapiens
actctttacttaaactctaagt

SEQ ID NO: 9271601 - DNA, 22 bp, Homo sapiens
actcttgtctcaacttttgtat

SEQ ID NO: 9271602 - DNA, 22 bp, Homo sapiens
actcttgtctcaacttttgtat

SEQ ID NO: 9271603 - DNA, 22 bp, Homo sapiens
aagtgttctacactttgacctt

SEQ ID NO: 9271604 - DNA, 22 bp, Homo sapiens
aagtgtttccattgtgcaggct

SEQ ID NO: 9271605 - DNA, 22 bp, Homo sapiens
aagtgtggggtctcagagctga

SEQ ID NO: 9271606 - DNA, 22 bp, Homo sapiens
aagtgtggggtctcagagctga

SEQ ID NO: 9271607 - DNA, 22 bp, Homo sapiens
aagtgtgggactagggctccag

SEQ ID NO: 9271608 - DNA, 22 bp, Homo sapiens
aagtgtgggaagtaggtggcga

SEQ ID NO: 9271609 - DNA, 22 bp, Homo sapiens
aagtgtcttttagccactttta

SEQ ID NO: 9271610 - DNA, 22 bp, Homo sapiens
aagtgtggtttaggcatctttt

SEQ ID NO: 9271611 - DNA, 22 bp, Homo sapiens
aagtgtgttgactgaattgggg

SEQ ID NO: 9271612 - DNA, 22 bp, Homo sapiens
acctgcctcagtgcagctggat

SEQ ID NO: 9271613 - DNA, 22 bp, Homo sapiens
acctgcctcagtgcagctggat

SEQ ID NO: 9271614 - DNA, 22 bp, Homo sapiens
acctgcctatggagccacatgg

SEQ ID NO: 9271615 - DNA, 22 bp, Homo sapiens
acctgcctatggagccacatgg

SEQ ID NO: 9271616 - DNA, 22 bp, Homo sapiens
acctgcctctaagcagcaggtg

SEQ ID NO: 9271617 - DNA, 22 bp, Homo sapiens
acctgcctcagtgcagctggat

SEQ ID NO: 9271618 - DNA, 22 bp, Homo sapiens
acctgcctcagtgcagctggat

SEQ ID NO: 9271619 - DNA, 22 bp, Homo sapiens
aagtgtctgctggctctaccct

SEQ ID NO: 9271620 - DNA, 22 bp, Homo sapiens
aagttcccgaggaccacagttg

SEQ ID NO: 9271621 - DNA, 22 bp, Homo sapiens
aagttcctcaaataaaacatga

SEQ ID NO: 9271622 - DNA, 22 bp, Homo sapiens
aagttcctcttctctgcaggga

SEQ ID NO: 9271623 - DNA, 22 bp, Homo sapiens
aagttcctatatccaaatacag

SEQ ID NO: 9271624 - DNA, 22 bp, Homo sapiens
aagttcatcttacctagatttt

SEQ ID NO: 9271625 - DNA, 22 bp, Homo sapiens
actgaaaaagtatgattcactg

SEQ ID NO: 9271626 - DNA, 22 bp, Homo sapiens
actgaaaaagacatcttggtaa

SEQ ID NO: 9271627 - DNA, 18 bp, Homo sapiens
actctttctgcccacagg

SEQ ID NO: 9271628 - DNA, 22 bp, Homo sapiens
actctttagaggtacatctctt

SEQ ID NO: 9271629 - DNA, 22 bp, Homo sapiens
aagttcctgggccaagtccagg

SEQ ID NO: 9271630 - DNA, 22 bp, Homo sapiens
aagttcctgggccaagtccagg

SEQ ID NO: 9271631 - DNA, 22 bp, Homo sapiens
aagttcctgttactccccagaa

SEQ ID NO: 9271632 - DNA, 22 bp, Homo sapiens
aagttccttagccttagggctt

SEQ ID NO: 9271633 - DNA, 22 bp, Homo sapiens
actgcagcctttgggctcataa

SEQ ID NO: 9271634 - DNA, 22 bp, Homo sapiens
actgcagccttgaactctgggc

SEQ ID NO: 9271635 - DNA, 22 bp, Homo sapiens
actgcaggagacacagctgctg

SEQ ID NO: 9271636 - DNA, 22 bp, Homo sapiens
actgcaggccttggtgccagca

SEQ ID NO: 9271637 - DNA, 22 bp, Homo sapiens
actgcaggagacacagctgctg

SEQ ID NO: 9271638 - DNA, 22 bp, Homo sapiens
actgcaggagacacagctgctg

SEQ ID NO: 9271639 - DNA, 20 bp, Homo sapiens
aagttttctccaaatacagt

SEQ ID NO: 9271640 - DNA, 22 bp, Homo sapiens
actgcatgctttacatgacatg

SEQ ID NO: 9271641 - DNA, 22 bp, Homo sapiens
actgcatctgaaacatgggtca

SEQ ID NO: 9271642 - DNA, 21 bp, Homo sapiens
actgcatctgaagtcccagga

SEQ ID NO: 9271643 - DNA, 22 bp, Homo sapiens
actgcagggcatcctggccaag

SEQ ID NO: 9271644 - DNA, 22 bp, Homo sapiens
acatgacagtgactttataaga

SEQ ID NO: 9271645 - DNA, 22 bp, Homo sapiens
acatgcatactgctgccaacgc

SEQ ID NO: 9271646 - DNA, 22 bp, Homo sapiens
acatgcatacacgtacatacct

SEQ ID NO: 9271647 - DNA, 21 bp, Homo sapiens
acatgcatagagagatttctg

SEQ ID NO: 9271648 - DNA, 22 bp, Homo sapiens
acatgcatatacttaaatatgt

SEQ ID NO: 9271649 - DNA, 22 bp, Homo sapiens
acatgcatatacttaaatatgt

SEQ ID NO: 9271650 - DNA, 22 bp, Homo sapiens
acatcctcggggaaaggcactg

SEQ ID NO: 9271651 - DNA, 22 bp, Homo sapiens
acatcctgaagtcagtcatttg

SEQ ID NO: 9271652 - DNA, 22 bp, Homo sapiens
acatccgcaggttataaagccc

SEQ ID NO: 9271653 - DNA, 22 bp, Homo sapiens
acatcccttgctcggggcccct

SEQ ID NO: 9271654 - DNA, 22 bp, Homo sapiens
acatcctcccgatctactggct

SEQ ID NO: 9271655 - DNA, 22 bp, Homo sapiens
acatcctcccgatctactggct

SEQ ID NO: 9271656 - DNA, 22 bp, Homo sapiens
acatctagactcttgccctctt

SEQ ID NO: 9271657 - DNA, 22 bp, Homo sapiens
acatctatttttttctgtccat

SEQ ID NO: 9271658 - DNA, 22 bp, Homo sapiens
acatctcacttctttgaaggct

SEQ ID NO: 9271659 - DNA, 22 bp, Homo sapiens
acatgaatatatgaagttcaac

SEQ ID NO: 9271660 - DNA, 22 bp, Homo sapiens
acatgaatgaagactttacaat

SEQ ID NO: 9271661 - DNA, 22 bp, Homo sapiens
acatctcagaactgagtaaccg

SEQ ID NO: 9271662 - DNA, 22 bp, Homo sapiens
acatctcagaactgagtaaccg

SEQ ID NO: 9271663 - DNA, 22 bp, Homo sapiens
aaggccagattcactttacaat

SEQ ID NO: 9271664 - DNA, 22 bp, Homo sapiens
aaggccagcagtttgagaccag

SEQ ID NO: 9271665 - DNA, 22 bp, Homo sapiens
aaggccagcctgagagctaaca

SEQ ID NO: 9271666 - DNA, 22 bp, Homo sapiens
aaggccagccctaatgatgctc

SEQ ID NO: 9271667 - DNA, 22 bp, Homo sapiens
acatcccacagaaacatacata

SEQ ID NO: 9271668 - DNA, 22 bp, Homo sapiens
aaggcatgtgtcctcagagaga

SEQ ID NO: 9271669 - DNA, 22 bp, Homo sapiens
aaggcaaatgtgttcttttagt

SEQ ID NO: 9271670 - DNA, 22 bp, Homo sapiens
aaggcaatgactgatttagaat

SEQ ID NO: 9271671 - DNA, 22 bp, Homo sapiens
aaggcaatgtaaattacagctt

SEQ ID NO: 9271672 - DNA, 22 bp, Homo sapiens
aaggcaattggcttgtataaga

SEQ ID NO: 9271673 - DNA, 20 bp, Homo sapiens
aagcttcacttcatttgatc

SEQ ID NO: 9271674 - DNA, 22 bp, Homo sapiens
aagcttcaggcccacccatgtc

SEQ ID NO: 9271675 - DNA, 22 bp, Homo sapiens
aagcttcagtggactgtagtgt

SEQ ID NO: 9271676 - DNA, 22 bp, Homo sapiens
aagcttcagtggactgtagtgt

SEQ ID NO: 9271677 - DNA, 22 bp, Homo sapiens
aagcttcagttctggggcaatg

SEQ ID NO: 9271678 - DNA, 22 bp, Homo sapiens
aagcttcatatatgtgtgagtc

SEQ ID NO: 9271679 - DNA, 22 bp, Homo sapiens
aagcttcagtgtgagcatgtaa

SEQ ID NO: 9271680 - DNA, 22 bp, Homo sapiens
aagcttcaatgagataattgtt

SEQ ID NO: 9271681 - DNA, 22 bp, Homo sapiens
aagcttaggtacagaagttaag

SEQ ID NO: 9271682 - DNA, 22 bp, Homo sapiens
aagcttatatcagaacaatgct

SEQ ID NO: 9271683 - DNA, 22 bp, Homo sapiens
aagcttcacattgaacttgggt

SEQ ID NO: 9271684 - DNA, 22 bp, Homo sapiens
aagcttacagttccacgtagca

SEQ ID NO: 9271685 - DNA, 22 bp, Homo sapiens
aagctgttttggccttagttga

SEQ ID NO: 9271686 - DNA, 22 bp, Homo sapiens
aagctgttggcagatagctctg

SEQ ID NO: 9271687 - DNA, 22 bp, Homo sapiens
aagctgttgaagtaattcagcc

SEQ ID NO: 9271688 - DNA, 22 bp, Homo sapiens
aagctgttgccctgctctttct

SEQ ID NO: 9271689 - DNA, 22 bp, Homo sapiens
aagctgttctctaagtttcatg

SEQ ID NO: 9271690 - DNA, 22 bp, Homo sapiens
aagctgttctgaatcagtaagt

SEQ ID NO: 9271691 - DNA, 23 bp, Homo sapiens
aagcttccttgactggcccctag

SEQ ID NO: 9271692 - DNA, 22 bp, Homo sapiens
aagcttcttagaatgcatgtgc

SEQ ID NO: 9271693 - DNA, 21 bp, Homo sapiens
aagcttccaaactgctggact

SEQ ID NO: 9271694 - DNA, 22 bp, Homo sapiens
aagcttcatttcaactcagggg

SEQ ID NO: 9271695 - DNA, 22 bp, Homo sapiens
aagcttcatctgatgccgaact

SEQ ID NO: 9271696 - DNA, 20 bp, Homo sapiens
aagcttccaggatctggtgt

SEQ ID NO: 9271697 - DNA, 23 bp, Homo sapiens
aagcttccttcacgtctcctggg

SEQ ID NO: 9271698 - DNA, 22 bp, Homo sapiens
aagcttcctgcatgggactgct

SEQ ID NO: 9271699 - DNA, 22 bp, Homo sapiens
aagcttcctgaatgctcattta

SEQ ID NO: 9271700 - DNA, 22 bp, Homo sapiens
aagcttcttagaatgcatgtgc

SEQ ID NO: 9271701 - DNA, 22 bp, Homo sapiens
aaggaagaagggaagttactta

SEQ ID NO: 9271702 - DNA, 22 bp, Homo sapiens
aagctgttaatggcttgcagct

SEQ ID NO: 9271703 - DNA, 22 bp, Homo sapiens
aagctgtgtaagttgcttggtt

SEQ ID NO: 9271704 - DNA, 22 bp, Homo sapiens
aagctgtgtattacagaatatt

SEQ ID NO: 9271705 - DNA, 22 bp, Homo sapiens
aagctgtgaagagcaagtgagg

SEQ ID NO: 9271706 - DNA, 22 bp, Homo sapiens
aagctgtgagctggatgctcca

SEQ ID NO: 9271707 - DNA, 22 bp, Homo sapiens
aagctgtggcttggaggaaaca

SEQ ID NO: 9271708 - DNA, 22 bp, Homo sapiens
acagctggacaggggagagttt

SEQ ID NO: 9271709 - DNA, 22 bp, Homo sapiens
acagctggaggccccattgtcc

SEQ ID NO: 9271710 - DNA, 22 bp, Homo sapiens
acagctggaggtctgtgagcac

SEQ ID NO: 9271711 - DNA, 22 bp, Homo sapiens
acagctggaggggctgcagagg

SEQ ID NO: 9271712 - DNA, 22 bp, Homo sapiens
acagctggaggggctgcagagg

SEQ ID NO: 9271713 - DNA, 22 bp, Homo sapiens
aagctggatgtaggatccccct

SEQ ID NO: 9271714 - DNA, 22 bp, Homo sapiens
acagctggagtgaggatggagt

SEQ ID NO: 9271715 - DNA, 22 bp, Homo sapiens
acagctggagtgaggatggagt

SEQ ID NO: 9271716 - DNA, 22 bp, Homo sapiens
aagctggagagtttcacagatg

SEQ ID NO: 9271717 - DNA, 22 bp, Homo sapiens
acagctggagtgaggatggagt

SEQ ID NO: 9271718 - DNA, 22 bp, Homo sapiens
aaggacaggcacagtggtggag

SEQ ID NO: 9271719 - DNA, 22 bp, Homo sapiens
aaggacaggcacagtggtggag

SEQ ID NO: 9271720 - DNA, 22 bp, Homo sapiens
aaggacagagagccattccaga

SEQ ID NO: 9271721 - DNA, 22 bp, Homo sapiens
aaggacaggagaaaacgggatc

SEQ ID NO: 9271722 - DNA, 19 bp, Homo sapiens
aaggacacaacagagatag

SEQ ID NO: 9271723 - DNA, 22 bp, Homo sapiens
aaggacagaaacagattgctgg

SEQ ID NO: 9271724 - DNA, 22 bp, Homo sapiens
aaggacagaaacagattgctgg

SEQ ID NO: 9271725 - DNA, 22 bp, Homo sapiens
aaggattgtctggctatttatg

SEQ ID NO: 9271726 - DNA, 22 bp, Homo sapiens
aaggagggaaagcagtgcttct

SEQ ID NO: 9271727 - DNA, 22 bp, Homo sapiens
aaggaatcacttctttaaatga

SEQ ID NO: 9271728 - DNA, 22 bp, Homo sapiens
aaggaagggaaatagtgatgtc

SEQ ID NO: 9271729 - DNA, 22 bp, Homo sapiens
aaggaagggaaatagtgatgtc

SEQ ID NO: 9271730 - DNA, 22 bp, Homo sapiens
aaggaaggaattgatcatgcgc

SEQ ID NO: 9271731 - DNA, 22 bp, Homo sapiens
aaggaagggaaatagtgatgtc

SEQ ID NO: 9271732 - DNA, 22 bp, Homo sapiens
aagggaggtaaagctatttaaa

SEQ ID NO: 9271733 - DNA, 20 bp, Homo sapiens
aagggagaataatgattgta

SEQ ID NO: 9271734 - DNA, 22 bp, Homo sapiens
aagggagacagttgtgtgagga

SEQ ID NO: 9271735 - DNA, 22 bp, Homo sapiens
aagggcagaatagagaagatgg

SEQ ID NO: 9271736 - DNA, 22 bp, Homo sapiens
acatttcagatgtaatgtgatg

SEQ ID NO: 9271737 - DNA, 22 bp, Homo sapiens
acatttcagattcatgaagtga

SEQ ID NO: 9271738 - DNA, 20 bp, Homo sapiens
aagggcagagggaacagact

SEQ ID NO: 9271739 - DNA, 22 bp, Homo sapiens
aagggcagaatagagaagatgg

SEQ ID NO: 9271740 - DNA, 22 bp, Homo sapiens
acatttcagcgtgcatgacatg

SEQ ID NO: 9271741 - DNA, 22 bp, Homo sapiens
acatttcagattcatgaagtga

SEQ ID NO: 9271742 - DNA, 22 bp, Homo sapiens
acatttcagattcatgaagtga

SEQ ID NO: 9271743 - DNA, 22 bp, Homo sapiens
acatttcagtaagtgttaattt

SEQ ID NO: 9271744 - DNA, 22 bp, Homo sapiens
acatttcagtaagtgttaattt

SEQ ID NO: 9271745 - DNA, 22 bp, Homo sapiens
acatttcagtgagctattgaag

SEQ ID NO: 9271746 - DNA, 22 bp, Homo sapiens
acatttcagtgagctattgaag

SEQ ID NO: 9271747 - DNA, 22 bp, Homo sapiens
acatttcagtgagctattgaag

SEQ ID NO: 9271748 - DNA, 22 bp, Homo sapiens
aagggctgcaatccaaaacact

SEQ ID NO: 9271749 - DNA, 22 bp, Homo sapiens
aagggctggagaggaaaggttg

SEQ ID NO: 9271750 - DNA, 22 bp, Homo sapiens
aagggctgggtctggttaaccc

SEQ ID NO: 9271751 - DNA, 19 bp, Homo sapiens
aagggctgggcacctcact

SEQ ID NO: 9271752 - DNA, 22 bp, Homo sapiens
aagggctggccctgggaagagt

SEQ ID NO: 9271753 - DNA, 18 bp, Homo sapiens
aagggctggcctttggag

SEQ ID NO: 9271754 - DNA, 22 bp, Homo sapiens
aagggctggccctgggaagagt

SEQ ID NO: 9271755 - DNA, 22 bp, Homo sapiens
aagggctggccctgggaagagt

SEQ ID NO: 9271756 - DNA, 22 bp, Homo sapiens
aagggctggccacattctgggt

SEQ ID NO: 9271757 - DNA, 22 bp, Homo sapiens
aagggctggccacattctgggt

SEQ ID NO: 9271758 - DNA, 22 bp, Homo sapiens
aagggctggatctctctgagca

SEQ ID NO: 9271759 - DNA, 22 bp, Homo sapiens
aagggctggatctctctgagca

SEQ ID NO: 9271760 - DNA, 22 bp, Homo sapiens
accagagggagacttcctcttc

SEQ ID NO: 9271761 - DNA, 22 bp, Homo sapiens
accagagtaatgtgtggaaatt

SEQ ID NO: 9271762 - DNA, 22 bp, Homo sapiens
accagagggcaaaccccagtgt

SEQ ID NO: 9271763 - DNA, 22 bp, Homo sapiens
accagaggaggaattaccttcc

SEQ ID NO: 9271764 - DNA, 20 bp, Homo sapiens
accagaggaaagagcagtga

SEQ ID NO: 9271765 - DNA, 22 bp, Homo sapiens
accagaggctctgccacctcca

SEQ ID NO: 9271766 - DNA, 22 bp, Homo sapiens
accagaggctctgccacctcca

SEQ ID NO: 9271767 - DNA, 22 bp, Homo sapiens
accagaggaagggaatctcaag

SEQ ID NO: 9271768 - DNA, 22 bp, Homo sapiens
accagaggaagggaatctcaag

SEQ ID NO: 9271769 - DNA, 20 bp, Homo sapiens
accagaggaaagagcagtga

SEQ ID NO: 9271770 - DNA, 20 bp, Homo sapiens
accagaggaaagagcagtga

SEQ ID NO: 9271771 - DNA, 22 bp, Homo sapiens
accagagctggctctgagcacc

SEQ ID NO: 9271772 - DNA, 22 bp, Homo sapiens
accagagcttacatgctagaaa

SEQ ID NO: 9271773 - DNA, 22 bp, Homo sapiens
aaggggaaaaagtgttaggagt

SEQ ID NO: 9271774 - DNA, 22 bp, Homo sapiens
accagcacctgataggcagtaa

SEQ ID NO: 9271775 - DNA, 22 bp, Homo sapiens
accagagggcaaaccccagtgt

SEQ ID NO: 9271776 - DNA, 22 bp, Homo sapiens
accagagttttattagttctaa

SEQ ID NO: 9271777 - DNA, 22 bp, Homo sapiens
aaggggggcacctgcatgcccg

SEQ ID NO: 9271778 - DNA, 22 bp, Homo sapiens
aagggggcggcagccagtggaa

SEQ ID NO: 9271779 - DNA, 22 bp, Homo sapiens
aaggggtgagcagaggcttcgc

SEQ ID NO: 9271780 - DNA, 22 bp, Homo sapiens
aaggggtgggcattagagcagt

SEQ ID NO: 9271781 - DNA, 22 bp, Homo sapiens
aagggtggatttctgagctcta

SEQ ID NO: 9271782 - DNA, 22 bp, Homo sapiens
aagggtgggcaccgccaggtca

SEQ ID NO: 9271783 - DNA, 22 bp, Homo sapiens
aagggtggatttctgagctcta

SEQ ID NO: 9271784 - DNA, 22 bp, Homo sapiens
aagggtgggccctggcagccat

SEQ ID NO: 9271785 - DNA, 22 bp, Homo sapiens
aagggtgggcaccgccaggtca

SEQ ID NO: 9271786 - DNA, 22 bp, Homo sapiens
aagggtggtgtaggagatcaaa

SEQ ID NO: 9271787 - DNA, 22 bp, Homo sapiens
aagggttgaagataaataaggt

SEQ ID NO: 9271788 - DNA, 22 bp, Homo sapiens
aagggttgcaaggtcagaggaa

SEQ ID NO: 9271789 - DNA, 22 bp, Homo sapiens
aagggttggggaagagcaaatt

SEQ ID NO: 9271790 - DNA, 22 bp, Homo sapiens
acccaggatgataatgttcaca

SEQ ID NO: 9271791 - DNA, 22 bp, Homo sapiens
aaggtacagggaaggagcaaga

SEQ ID NO: 9271792 - DNA, 22 bp, Homo sapiens
aaggtacagaaattaacaagga

SEQ ID NO: 9271793 - DNA, 19 bp, Homo sapiens
acctctgagaatgccagtc

SEQ ID NO: 9271794 - DNA, 22 bp, Homo sapiens
acctctgaagggccaagcaatg

SEQ ID NO: 9271795 - DNA, 22 bp, Homo sapiens
aaggtgtcaccagattggcagg

SEQ ID NO: 9271796 - DNA, 22 bp, Homo sapiens
acccagggcagccagcggggag

SEQ ID NO: 9271797 - DNA, 22 bp, Homo sapiens
acccagggcagccagcggggag

SEQ ID NO: 9271798 - DNA, 22 bp, Homo sapiens
acccagggccacagcccgcagt

SEQ ID NO: 9271799 - DNA, 22 bp, Homo sapiens
acccagggctcaagcgtaggca

SEQ ID NO: 9271800 - DNA, 22 bp, Homo sapiens
acccagggagtgctcctgttct

SEQ ID NO: 9271801 - DNA, 22 bp, Homo sapiens
acccagggctcaagcgtaggca

SEQ ID NO: 9271802 - DNA, 22 bp, Homo sapiens
acccagggctcaagcgtaggca

SEQ ID NO: 9271803 - DNA, 22 bp, Homo sapiens
acccagggctcaagcgtaggca

SEQ ID NO: 9271804 - DNA, 22 bp, Homo sapiens
acccagggcttaaggcggtgca

SEQ ID NO: 9271805 - DNA, 21 bp, Homo sapiens
acccaggggaagcagaaactg

SEQ ID NO: 9271806 - DNA, 22 bp, Homo sapiens
acccaggggcagccttgctgtg

SEQ ID NO: 9271807 - DNA, 22 bp, Homo sapiens
aaggtggttgtaggctggtctg

SEQ ID NO: 9271808 - DNA, 22 bp, Homo sapiens
acccaggggcagccttgctgtg

SEQ ID NO: 9271809 - DNA, 22 bp, Homo sapiens
acccaggggcgaagctggccac

SEQ ID NO: 9271810 - DNA, 22 bp, Homo sapiens
acccaggggcgaagctggccac

SEQ ID NO: 9271811 - DNA, 22 bp, Homo sapiens
acccaggggcgaagctggccac

SEQ ID NO: 9271812 - DNA, 19 bp, Homo sapiens
acccaggggtttatgtgtg

SEQ ID NO: 9271813 - DNA, 22 bp, Homo sapiens
acccagggtagaacctcagagc

SEQ ID NO: 9271814 - DNA, 22 bp, Homo sapiens
acccagggtagaacctcagagc

SEQ ID NO: 9271815 - DNA, 20 bp, Homo sapiens
aagtccctaagtctctggcc

SEQ ID NO: 9271816 - DNA, 22 bp, Homo sapiens
acctgcctagttggttctgccc

SEQ ID NO: 9271817 - DNA, 22 bp, Homo sapiens
acctgccctggaggaagatatt

SEQ ID NO: 9271818 - DNA, 22 bp, Homo sapiens
aagtcctttaatatcacatagt

SEQ ID NO: 9271819 - DNA, 22 bp, Homo sapiens
aagtccttggagaatagaaagg

SEQ ID NO: 9271820 - DNA, 22 bp, Homo sapiens
acctgcctagttggttctgccc

SEQ ID NO: 9271821 - DNA, 22 bp, Homo sapiens
acctgcctatcagctgcctgct

SEQ ID NO: 9271822 - DNA, 22 bp, Homo sapiens
acctgcctagttggttctgccc

SEQ ID NO: 9271823 - DNA, 22 bp, Homo sapiens
acctgcctatcagctgcctgct

SEQ ID NO: 9271824 - DNA, 22 bp, Homo sapiens
acctgcctatggagccacatgg

SEQ ID NO: 9271825 - DNA, 22 bp, Homo sapiens
acctgcctatcagctgcctgct

SEQ ID NO: 9271826 - DNA, 22 bp, Homo sapiens
aagtatattttttgaagcatat

SEQ ID NO: 9271827 - DNA, 22 bp, Homo sapiens
aagtatatactaaatgttaatc

SEQ ID NO: 9271828 - DNA, 22 bp, Homo sapiens
aagtaggaatccgaatgagtag

SEQ ID NO: 9271829 - DNA, 22 bp, Homo sapiens
aagtagcaatctcattagttgg

SEQ ID NO: 9271830 - DNA, 22 bp, Homo sapiens
aagtatactgaaggtatccagg

SEQ ID NO: 9271831 - DNA, 22 bp, Homo sapiens
aagtatatactaaatgttaatc

SEQ ID NO: 9271832 - DNA, 22 bp, Homo sapiens
acactgttccacactaagaagg

SEQ ID NO: 9271833 - DNA, 22 bp, Homo sapiens
acactgttccacactaagaagg

SEQ ID NO: 9271834 - DNA, 22 bp, Homo sapiens
agccacagtctgatgcctgaga

SEQ ID NO: 9271835 - DNA, 23 bp, Homo sapiens
acacttcacccattgtgatagga

SEQ ID NO: 9271836 - DNA, 22 bp, Homo sapiens
agccacagtctgatgcctgaga

SEQ ID NO: 9271837 - DNA, 22 bp, Homo sapiens
agccagagatccatccctagga

SEQ ID NO: 9271838 - DNA, 22 bp, Homo sapiens
agccagagctgatgtcattctc

SEQ ID NO: 9271839 - DNA, 22 bp, Homo sapiens
agccagagattgagatgcaggc

SEQ ID NO: 9271840 - DNA, 22 bp, Homo sapiens
agccagagattgagatgcaggc

SEQ ID NO: 9271841 - DNA, 22 bp, Homo sapiens
agccagaggaacttgatgactg

SEQ ID NO: 9271842 - DNA, 22 bp, Homo sapiens
agccagagctgatgtcattctc

SEQ ID NO: 9271843 - DNA, 22 bp, Homo sapiens
agccagaggaacttgatgactg

SEQ ID NO: 9271844 - DNA, 22 bp, Homo sapiens
agccagaggccagcctgcctca

SEQ ID NO: 9271845 - DNA, 22 bp, Homo sapiens
agccagaggccagcctgcctca

SEQ ID NO: 9271846 - DNA, 22 bp, Homo sapiens
agccagaggccagcctgcctca

SEQ ID NO: 9271847 - DNA, 22 bp, Homo sapiens
agccagaggtcatgagcacagg

SEQ ID NO: 9271848 - DNA, 22 bp, Homo sapiens
agccagaggtcatgagcacagg

SEQ ID NO: 9271849 - DNA, 22 bp, Homo sapiens
agccagctggagaccactgttt

SEQ ID NO: 9271850 - DNA, 22 bp, Homo sapiens
agccagctggtgggtcagctgg

SEQ ID NO: 9271851 - DNA, 22 bp, Homo sapiens
agccagctggtgggtcagctgg

SEQ ID NO: 9271852 - DNA, 22 bp, Homo sapiens
agccagctgcctttcacatctg

SEQ ID NO: 9271853 - DNA, 22 bp, Homo sapiens
agccagctggagaccactgttt

SEQ ID NO: 9271854 - DNA, 22 bp, Homo sapiens
agccagctgcctttcacatctg

SEQ ID NO: 9271855 - DNA, 19 bp, Homo sapiens
agccagagtggcccagggg

SEQ ID NO: 9271856 - DNA, 22 bp, Homo sapiens
agccagaggtcatgagcacagg

SEQ ID NO: 9271857 - DNA, 22 bp, Homo sapiens
agccagctgttctggggcagca

SEQ ID NO: 9271858 - DNA, 22 bp, Homo sapiens
agccaggaagagaggcctcacc

SEQ ID NO: 9271859 - DNA, 22 bp, Homo sapiens
agccaggaagagaggcctcacc

SEQ ID NO: 9271860 - DNA, 22 bp, Homo sapiens
agccagctgtgggctcaggcgg

SEQ ID NO: 9271861 - DNA, 22 bp, Homo sapiens
agccagctgtgggctcaggcgg

SEQ ID NO: 9271862 - DNA, 22 bp, Homo sapiens
agccagctgtgtggtcaggcaa

SEQ ID NO: 9271863 - DNA, 22 bp, Homo sapiens
acacccagattatgcacacaaa

SEQ ID NO: 9271864 - DNA, 22 bp, Homo sapiens
acacccagattatgcacacaaa

SEQ ID NO: 9271865 - DNA, 22 bp, Homo sapiens
acacccagagcgccagtgccga

SEQ ID NO: 9271866 - DNA, 22 bp, Homo sapiens
acacccagagcgccagtgccga

SEQ ID NO: 9271867 - DNA, 22 bp, Homo sapiens
acacccagagcgccagtgccga

SEQ ID NO: 9271868 - DNA, 22 bp, Homo sapiens
acaccatggttcccaaactgtg

SEQ ID NO: 9271869 - DNA, 22 bp, Homo sapiens
acaccagggcctagccagggcg

SEQ ID NO: 9271870 - DNA, 22 bp, Homo sapiens
acaccagggcctagccagggcg

SEQ ID NO: 9271871 - DNA, 22 bp, Homo sapiens
acaccagggcctagccagggcg

SEQ ID NO: 9271872 - DNA, 22 bp, Homo sapiens
agcaggtgtagggctctttgta

SEQ ID NO: 9271873 - DNA, 22 bp, Homo sapiens
agcaggtgtatataaggctgag

SEQ ID NO: 9271874 - DNA, 22 bp, Homo sapiens
agcaggtgtatcggtcacctac

SEQ ID NO: 9271875 - DNA, 22 bp, Homo sapiens
agcaggtgtatataaggctgag

SEQ ID NO: 9271876 - DNA, 22 bp, Homo sapiens
agcaggtggtaggcagtcagca

SEQ ID NO: 9271877 - DNA, 22 bp, Homo sapiens
acacccagctgggccacctcca

SEQ ID NO: 9271878 - DNA, 22 bp, Homo sapiens
acacccagctgggccacctcca

SEQ ID NO: 9271879 - DNA, 22 bp, Homo sapiens
acacccagcttttgaatgccct

SEQ ID NO: 9271880 - DNA, 22 bp, Homo sapiens
agcatttacctcaatgcatctg

SEQ ID NO: 9271881 - DNA, 22 bp, Homo sapiens
agccaaggactcagtggtaggc

SEQ ID NO: 9271882 - DNA, 18 bp, Homo sapiens
agccaaggaggaggagga

SEQ ID NO: 9271883 - DNA, 18 bp, Homo sapiens
agccaaggaggaggagga

SEQ ID NO: 9271884 - DNA, 22 bp, Homo sapiens
agccaaggagtgcaggtggctt

SEQ ID NO: 9271885 - DNA, 22 bp, Homo sapiens
agccaaggagtgcaggtggctt

SEQ ID NO: 9271886 - DNA, 22 bp, Homo sapiens
agccaaggcagctagagctctg

SEQ ID NO: 9271887 - DNA, 22 bp, Homo sapiens
agccaagggtcagctgcacaga

SEQ ID NO: 9271888 - DNA, 22 bp, Homo sapiens
agccaaggtatcatgagaggca

SEQ ID NO: 9271889 - DNA, 22 bp, Homo sapiens
agccaagggtcagctgcacaga

SEQ ID NO: 9271890 - DNA, 22 bp, Homo sapiens
agccaaggtcgccccagggcaa

SEQ ID NO: 9271891 - DNA, 22 bp, Homo sapiens
agcaggctttcaagagtcttct

SEQ ID NO: 9271892 - DNA, 22 bp, Homo sapiens
agcaggctttcaagagtcttct

SEQ ID NO: 9271893 - DNA, 22 bp, Homo sapiens
agcaggcttgttatgtctgaga

SEQ ID NO: 9271894 - DNA, 22 bp, Homo sapiens
agcaggcttgttatgtctgaga

SEQ ID NO: 9271895 - DNA, 22 bp, Homo sapiens
agcagggacatggcatctctcc

SEQ ID NO: 9271896 - DNA, 22 bp, Homo sapiens
acacatcatgccaagtttcacc

SEQ ID NO: 9271897 - DNA, 22 bp, Homo sapiens
acacatctatattgcatctgca

SEQ ID NO: 9271898 - DNA, 22 bp, Homo sapiens
acacatctatctctacacaagg

SEQ ID NO: 9271899 - DNA, 22 bp, Homo sapiens
acacatcagcctcagctttggg

SEQ ID NO: 9271900 - DNA, 22 bp, Homo sapiens
acacatatgtggcaactgtaga

SEQ ID NO: 9271901 - DNA, 22 bp, Homo sapiens
acacacacaagcaggttgtgga

SEQ ID NO: 9271902 - DNA, 22 bp, Homo sapiens
acacacacaagcaggttgtgga

SEQ ID NO: 9271903 - DNA, 18 bp, Homo sapiens
acacacacacctgtgtat

SEQ ID NO: 9271904 - DNA, 18 bp, Homo sapiens
acacacacacctgtgtat

SEQ ID NO: 9271905 - DNA, 22 bp, Homo sapiens
acacagtatgcatctagaaatt

SEQ ID NO: 9271906 - DNA, 22 bp, Homo sapiens
acacagtatgcatctagaaatt

SEQ ID NO: 9271907 - DNA, 22 bp, Homo sapiens
acacagtattacaataggtgct

SEQ ID NO: 9271908 - DNA, 22 bp, Homo sapiens
acacagtattacaataggtgct

SEQ ID NO: 9271909 - DNA, 22 bp, Homo sapiens
acacagtatcaaatttcatctt

SEQ ID NO: 9271910 - DNA, 22 bp, Homo sapiens
acacagtatgaaaagtctagtt

SEQ ID NO: 9271911 - DNA, 22 bp, Homo sapiens
acacagtatgaaaagtctagtt

SEQ ID NO: 9271912 - DNA, 18 bp, Homo sapiens
acacagtggatgcctggt

SEQ ID NO: 9271913 - DNA, 22 bp, Homo sapiens
acacagtattgtgactataact

SEQ ID NO: 9271914 - DNA, 22 bp, Homo sapiens
acacagtattgtgactataact

SEQ ID NO: 9271915 - DNA, 22 bp, Homo sapiens
acacagtgtcagggcaggggcc

SEQ ID NO: 9271916 - DNA, 22 bp, Homo sapiens
acacagtgtgtgcagtcggacg

SEQ ID NO: 9271917 - DNA, 22 bp, Homo sapiens
acacagtgtcttaggtagtgtc

SEQ ID NO: 9271918 - DNA, 22 bp, Homo sapiens
acacaagattgtgtattgaatt

SEQ ID NO: 9271919 - DNA, 22 bp, Homo sapiens
acacaataaatttatcctttga

SEQ ID NO: 9271920 - DNA, 22 bp, Homo sapiens
acacaatacagggctcaaaata

SEQ ID NO: 9271921 - DNA, 22 bp, Homo sapiens
acacaagtccctccatactctc

SEQ ID NO: 9271922 - DNA, 22 bp, Homo sapiens
acacaagtccctccatactctc

SEQ ID NO: 9271923 - DNA, 22 bp, Homo sapiens
acacaagtgaatattttaagga

SEQ ID NO: 9271924 - DNA, 22 bp, Homo sapiens
acacaatacagggctcaaaata

SEQ ID NO: 9271925 - DNA, 23 bp, Homo sapiens
acacaatagagtactattcagcc

SEQ ID NO: 9271926 - DNA, 23 bp, Homo sapiens
acacaatagagtactattcagcc

SEQ ID NO: 9271927 - DNA, 22 bp, Homo sapiens
acacacaactcattgtgtaata

SEQ ID NO: 9271928 - DNA, 22 bp, Homo sapiens
acacaatgtcatcataatgtca

SEQ ID NO: 9271929 - DNA, 22 bp, Homo sapiens
acacaatgcatatttttccaga

SEQ ID NO: 9271930 - DNA, 22 bp, Homo sapiens
acagcagtgcacagagaaccct

SEQ ID NO: 9271931 - DNA, 22 bp, Homo sapiens
acagcagtcagtgaatatttaa

SEQ ID NO: 9271932 - DNA, 22 bp, Homo sapiens
acagcaggttttaactttgaag

SEQ ID NO: 9271933 - DNA, 21 bp, Homo sapiens
acagcagggctggcatgacag

SEQ ID NO: 9271934 - DNA, 17 bp, Homo sapiens
acagcagggaagtgttg

SEQ ID NO: 9271935 - DNA, 22 bp, Homo sapiens
acagcagggaatatgggaattg

SEQ ID NO: 9271936 - DNA, 22 bp, Homo sapiens
acagcaggcatgaatgacactg

SEQ ID NO: 9271937 - DNA, 22 bp, Homo sapiens
acagcaggcccatactggaagg

SEQ ID NO: 9271938 - DNA, 22 bp, Homo sapiens
acagcaggcccatactggaagg

SEQ ID NO: 9271939 - DNA, 17 bp, Homo sapiens
acagcaggcccggaggg

SEQ ID NO: 9271940 - DNA, 22 bp, Homo sapiens
agctgagttaattcatcactta

SEQ ID NO: 9271941 - DNA, 22 bp, Homo sapiens
agctgaggttgaagagtgaacg

SEQ ID NO: 9271942 - DNA, 22 bp, Homo sapiens
agctgaggttgaagagtgaacg

SEQ ID NO: 9271943 - DNA, 22 bp, Homo sapiens
agctgaggttagtataaatgtg

SEQ ID NO: 9271944 - DNA, 22 bp, Homo sapiens
agctgaggttagtataaatgtg

SEQ ID NO: 9271945 - DNA, 21 bp, Homo sapiens
agctgaggtaaggcaagagag

SEQ ID NO: 9271946 - DNA, 21 bp, Homo sapiens
agctgaggtaaggcaagagag

SEQ ID NO: 9271947 - DNA, 21 bp, Homo sapiens
agctgaggtaaggcaagagag

SEQ ID NO: 9271948 - DNA, 21 bp, Homo sapiens
agctgaggtaaggcaagagag

SEQ ID NO: 9271949 - DNA, 23 bp, Homo sapiens
agctgaggtgcagatccaaagaa

SEQ ID NO: 9271950 - DNA, 23 bp, Homo sapiens
agctgaggtgcagatccaaagaa

SEQ ID NO: 9271951 - DNA, 23 bp, Homo sapiens
agctgaggtgcagatccaaagaa

SEQ ID NO: 9271952 - DNA, 22 bp, Homo sapiens
agctgaggttagtataaatgtg

SEQ ID NO: 9271953 - DNA, 23 bp, Homo sapiens
agctgaggtgcagatccaaagaa

SEQ ID NO: 9271954 - DNA, 22 bp, Homo sapiens
agctgagggcaggatggggtga

SEQ ID NO: 9271955 - DNA, 22 bp, Homo sapiens
agctgagggcaggatggggtga

SEQ ID NO: 9271956 - DNA, 22 bp, Homo sapiens
agctgagggcaggatggggtga

SEQ ID NO: 9271957 - DNA, 18 bp, Homo sapiens
agctgaggggactgaaga

SEQ ID NO: 9271958 - DNA, 18 bp, Homo sapiens
agctgaggggactgaaga

SEQ ID NO: 9271959 - DNA, 22 bp, Homo sapiens
agctgagggttcggtgtccaca

SEQ ID NO: 9271960 - DNA, 21 bp, Homo sapiens
agctgaggtaaggcaagagag

SEQ ID NO: 9271961 - DNA, 22 bp, Homo sapiens
agctgagggttcggtgtccaca

SEQ ID NO: 9271962 - DNA, 22 bp, Homo sapiens
agctgagggttcggtgtccaca

SEQ ID NO: 9271963 - DNA, 22 bp, Homo sapiens
acagcagcgtcaacttaaaatt

SEQ ID NO: 9271964 - DNA, 22 bp, Homo sapiens
agctgagaggtggcaagctgta

SEQ ID NO: 9271965 - DNA, 22 bp, Homo sapiens
agctgagggcaggatggggtga

SEQ ID NO: 9271966 - DNA, 22 bp, Homo sapiens
agctgagcacattcaaacaggt

SEQ ID NO: 9271967 - DNA, 22 bp, Homo sapiens
acagcagatctggctacaggtt

SEQ ID NO: 9271968 - DNA, 22 bp, Homo sapiens
acagcagagtgtgagatagcca

SEQ ID NO: 9271969 - DNA, 22 bp, Homo sapiens
acagcagagtgtgagatagcca

SEQ ID NO: 9271970 - DNA, 22 bp, Homo sapiens
acagatactcagctctatgctt

SEQ ID NO: 9271971 - DNA, 22 bp, Homo sapiens
acagatactcagctctatgctt

SEQ ID NO: 9271972 - DNA, 22 bp, Homo sapiens
acagataatttaattaatgcat

SEQ ID NO: 9271973 - DNA, 22 bp, Homo sapiens
acagatatatgattgtgtaaat

SEQ ID NO: 9271974 - DNA, 22 bp, Homo sapiens
acagatataaactatagtagtg

SEQ ID NO: 9271975 - DNA, 22 bp, Homo sapiens
acagcagatttccctgggctcc

SEQ ID NO: 9271976 - DNA, 22 bp, Homo sapiens
acagcagcaatagcagtgacat

SEQ ID NO: 9271977 - DNA, 21 bp, Homo sapiens
acagcagcaatctgtctttcc

SEQ ID NO: 9271978 - DNA, 22 bp, Homo sapiens
acagcagcactattgacatttt

SEQ ID NO: 9271979 - DNA, 22 bp, Homo sapiens
acagcagcctgcagccctgtgt

SEQ ID NO: 9271980 - DNA, 22 bp, Homo sapiens
acagcagccttgttggtttcga

SEQ ID NO: 9271981 - DNA, 22 bp, Homo sapiens
acagcagccttgttggtttcga

SEQ ID NO: 9271982 - DNA, 20 bp, Homo sapiens
acagcagccttgctagaaac

SEQ ID NO: 9271983 - DNA, 22 bp, Homo sapiens
acagcagcagaccagcatatgt

SEQ ID NO: 9271984 - DNA, 22 bp, Homo sapiens
acagcagcactattgacatttt

SEQ ID NO: 9271985 - DNA, 22 bp, Homo sapiens
acagcagcataaactgactaag

SEQ ID NO: 9271986 - DNA, 22 bp, Homo sapiens
acagaggtcatggagagttctc

SEQ ID NO: 9271987 - DNA, 22 bp, Homo sapiens
agctaaatgttgcttaaaattt

SEQ ID NO: 9271988 - DNA, 22 bp, Homo sapiens
agctaaatgcatttcaagactg

SEQ ID NO: 9271989 - DNA, 22 bp, Homo sapiens
acagataattagcataaatgct

SEQ ID NO: 9271990 - DNA, 22 bp, Homo sapiens
agcgtgtggagaactaagcaga

SEQ ID NO: 9271991 - DNA, 23 bp, Homo sapiens
acagaggcttaaatgagtggcag

SEQ ID NO: 9271992 - DNA, 22 bp, Homo sapiens
acagaggccgcctctctcacgg

SEQ ID NO: 9271993 - DNA, 22 bp, Homo sapiens
acagaggccccgtgggagagcc

SEQ ID NO: 9271994 - DNA, 22 bp, Homo sapiens
acagaggtaggacatgagatat

SEQ ID NO: 9271995 - DNA, 22 bp, Homo sapiens
acagaggtcacctttgtatctt

SEQ ID NO: 9271996 - DNA, 19 bp, Homo sapiens
acagagggcaactgagaaa

SEQ ID NO: 9271997 - DNA, 22 bp, Homo sapiens
acagagggggccttggagtgca

SEQ ID NO: 9271998 - DNA, 22 bp, Homo sapiens
acagaggggtcacagcctgaag

SEQ ID NO: 9271999 - DNA, 22 bp, Homo sapiens
acagaattaacatttgatgaat

SEQ ID NO: 9272000 - DNA, 22 bp, Homo sapiens
acagagctgtacatgtgccatg

SEQ ID NO: 9272001 - DNA, 22 bp, Homo sapiens
acagaggcagtgtgagatactg

SEQ ID NO: 9272002 - DNA, 20 bp, Homo sapiens
acagaatatgctggttgtgg

SEQ ID NO: 9272003 - DNA, 22 bp, Homo sapiens
acagaatattggttactgttgc

SEQ ID NO: 9272004 - DNA, 22 bp, Homo sapiens
acagaatgcgtagtgcatgttg

SEQ ID NO: 9272005 - DNA, 22 bp, Homo sapiens
acagaatgcgtagtgcatgttg

SEQ ID NO: 9272006 - DNA, 22 bp, Homo sapiens
acagaatgcgtagtgcatgttg

SEQ ID NO: 9272007 - DNA, 22 bp, Homo sapiens
acagaagtgagtggcaagaact

SEQ ID NO: 9272008 - DNA, 21 bp, Homo sapiens
acagaagtggcttggtctcag

SEQ ID NO: 9272009 - DNA, 22 bp, Homo sapiens
acagaagtggcttcaaagagca

SEQ ID NO: 9272010 - DNA, 22 bp, Homo sapiens
acagaataaggtttatctctcc

SEQ ID NO: 9272011 - DNA, 22 bp, Homo sapiens
acagaataactcttgcttgagt

SEQ ID NO: 9272012 - DNA, 19 bp, Homo sapiens
acagaagcatagaaaagga

SEQ ID NO: 9272013 - DNA, 22 bp, Homo sapiens
agcaaagtccagtctgtgtaca

SEQ ID NO: 9272014 - DNA, 21 bp, Homo sapiens
agcaaaggcaggagaggtttc

SEQ ID NO: 9272015 - DNA, 22 bp, Homo sapiens
agcaaataaagacaattatgtc

SEQ ID NO: 9272016 - DNA, 18 bp, Homo sapiens
agattttgagaaatacaa

SEQ ID NO: 9272017 - DNA, 22 bp, Homo sapiens
acaacattcttaaatacactga

SEQ ID NO: 9272018 - DNA, 22 bp, Homo sapiens
acaacattcttaaatacactga

SEQ ID NO: 9272019 - DNA, 22 bp, Homo sapiens
acaacattatacatagaaagct

SEQ ID NO: 9272020 - DNA, 18 bp, Homo sapiens
agcaaatattaagtgcat

SEQ ID NO: 9272021 - DNA, 19 bp, Homo sapiens
acaataactcattgattgc

SEQ ID NO: 9272022 - DNA, 19 bp, Homo sapiens
acaataactcattgattgc

SEQ ID NO: 9272023 - DNA, 22 bp, Homo sapiens
agcaaatacttgaataaaaaga

SEQ ID NO: 9272024 - DNA, 22 bp, Homo sapiens
agcaaatacatttttagcataa

SEQ ID NO: 9272025 - DNA, 19 bp, Homo sapiens
agcaaatataatagtgttc

SEQ ID NO: 9272026 - DNA, 22 bp, Homo sapiens
agcaaggcagtcagctggctgg

SEQ ID NO: 9272027 - DNA, 22 bp, Homo sapiens
acaatagaaggaaactgacata

SEQ ID NO: 9272028 - DNA, 19 bp, Homo sapiens
acaatagaaaagtcttttg

SEQ ID NO: 9272029 - DNA, 19 bp, Homo sapiens
acaatagaaaagtcttttg

SEQ ID NO: 9272030 - DNA, 20 bp, Homo sapiens
acaatacaggttgtgtctga

SEQ ID NO: 9272031 - DNA, 22 bp, Homo sapiens
acaataagtattgggcttttga

SEQ ID NO: 9272032 - DNA, 22 bp, Homo sapiens
acaataatgtattgccaaaagt

SEQ ID NO: 9272033 - DNA, 22 bp, Homo sapiens
acacaaattgtaggataattgc

SEQ ID NO: 9272034 - DNA, 22 bp, Homo sapiens
agcacagggcccagcctaggcc

SEQ ID NO: 9272035 - DNA, 22 bp, Homo sapiens
agcacaggtaatacagagtaac

SEQ ID NO: 9272036 - DNA, 22 bp, Homo sapiens
acaatttttcaaagaagcttat

SEQ ID NO: 9272037 - DNA, 22 bp, Homo sapiens
agcacagggacaatgccaggtg

SEQ ID NO: 9272038 - DNA, 22 bp, Homo sapiens
agcacaggctttggtgtgaggg

SEQ ID NO: 9272039 - DNA, 22 bp, Homo sapiens
agcacagggcccagcctaggcc

SEQ ID NO: 9272040 - DNA, 22 bp, Homo sapiens
agcacagggcccagcctaggcc

SEQ ID NO: 9272041 - DNA, 22 bp, Homo sapiens
agcacagggcccagcctaggcc

SEQ ID NO: 9272042 - DNA, 22 bp, Homo sapiens
agcacaggctttggtgtgaggg

SEQ ID NO: 9272043 - DNA, 22 bp, Homo sapiens
agcacaggctttggtgtgaggg

SEQ ID NO: 9272044 - DNA, 22 bp, Homo sapiens
agcacaggacgtagagcttgga

SEQ ID NO: 9272045 - DNA, 22 bp, Homo sapiens
agcacaggctttggtgtgaggg

SEQ ID NO: 9272046 - DNA, 22 bp, Homo sapiens
agcacaggacgtagagcttgga

SEQ ID NO: 9272047 - DNA, 22 bp, Homo sapiens
agcacagaaagcacatttgaaa

SEQ ID NO: 9272048 - DNA, 22 bp, Homo sapiens
agcacacagtcttccttcctcc

SEQ ID NO: 9272049 - DNA, 22 bp, Homo sapiens
agcacacatcacttctgctcat

SEQ ID NO: 9272050 - DNA, 22 bp, Homo sapiens
agcacacatcacttctgctcat

SEQ ID NO: 9272051 - DNA, 19 bp, Homo sapiens
agcacagacaagaccagca

SEQ ID NO: 9272052 - DNA, 22 bp, Homo sapiens
agcacaggaacatggagatggg

SEQ ID NO: 9272053 - DNA, 22 bp, Homo sapiens
agcacaggaccaaggaagctgt

SEQ ID NO: 9272054 - DNA, 22 bp, Homo sapiens
agcacaggaacatggagatggg

SEQ ID NO: 9272055 - DNA, 22 bp, Homo sapiens
agcacaggaacatggagatggg

SEQ ID NO: 9272056 - DNA, 22 bp, Homo sapiens
agcacacaggacttgattcatg

SEQ ID NO: 9272057 - DNA, 22 bp, Homo sapiens
agcacacaggacttgattcatg

SEQ ID NO: 9272058 - DNA, 22 bp, Homo sapiens
agcacacaggccacctccactt

SEQ ID NO: 9272059 - DNA, 22 bp, Homo sapiens
agcacacagtattagccattgt

SEQ ID NO: 9272060 - DNA, 22 bp, Homo sapiens
agcacacagtattagccattgt

SEQ ID NO: 9272061 - DNA, 22 bp, Homo sapiens
agatgctgctccacaggccagg

SEQ ID NO: 9272062 - DNA, 22 bp, Homo sapiens
agatgctgcctctcctcacaag

SEQ ID NO: 9272063 - DNA, 22 bp, Homo sapiens
agatgctgccaggcccctcagt

SEQ ID NO: 9272064 - DNA, 22 bp, Homo sapiens
acaacagagctggactgagagg

SEQ ID NO: 9272065 - DNA, 23 bp, Homo sapiens
acaacaggaaatcagacctgaac

SEQ ID NO: 9272066 - DNA, 22 bp, Homo sapiens
acaacagtaggaaaacatgtct

SEQ ID NO: 9272067 - DNA, 21 bp, Homo sapiens
agatgcagtttgcaggtgggt

SEQ ID NO: 9272068 - DNA, 22 bp, Homo sapiens
agatgcatgtttatgtctttcc

SEQ ID NO: 9272069 - DNA, 21 bp, Homo sapiens
agatgcagttatgagatgcag

SEQ ID NO: 9272070 - DNA, 22 bp, Homo sapiens
agatgcagatttggattcagga

SEQ ID NO: 9272071 - DNA, 22 bp, Homo sapiens
agatgcagtggttaacaataca

SEQ ID NO: 9272072 - DNA, 22 bp, Homo sapiens
agatgcagacttggttcaggca

SEQ ID NO: 9272073 - DNA, 22 bp, Homo sapiens
agatgcagagtttgctgtggac

SEQ ID NO: 9272074 - DNA, 22 bp, Homo sapiens
agatctttagtgaagctaaatc

SEQ ID NO: 9272075 - DNA, 22 bp, Homo sapiens
agatgcagaaaaactaagtgat

SEQ ID NO: 9272076 - DNA, 22 bp, Homo sapiens
acaaagtttgtggtattccaag

SEQ ID NO: 9272077 - DNA, 22 bp, Homo sapiens
acaaagtttgtggtattccaag

SEQ ID NO: 9272078 - DNA, 22 bp, Homo sapiens
acaaagttattctttcagagga

SEQ ID NO: 9272079 - DNA, 22 bp, Homo sapiens
acaaagtgctgacattacaggc

SEQ ID NO: 9272080 - DNA, 19 bp, Homo sapiens
acaaagtgcgtgctctttt

SEQ ID NO: 9272081 - DNA, 22 bp, Homo sapiens
aatttgattccctgcacctgtt

SEQ ID NO: 9272082 - DNA, 22 bp, Homo sapiens
aatttgcatgatgagaacaata

SEQ ID NO: 9272083 - DNA, 21 bp, Homo sapiens
aatttgctaagcaaaggagca

SEQ ID NO: 9272084 - DNA, 22 bp, Homo sapiens
aatttgatgagtttgtaagtct

SEQ ID NO: 9272085 - DNA, 18 bp, Homo sapiens
aatttctttgacaactta

SEQ ID NO: 9272086 - DNA, 22 bp, Homo sapiens
aatttcttgggagctcagagaa

SEQ ID NO: 9272087 - DNA, 22 bp, Homo sapiens
aatttcttgggagctcagagaa

SEQ ID NO: 9272088 - DNA, 22 bp, Homo sapiens
agagttaggtccagaatgttgc

SEQ ID NO: 9272089 - DNA, 22 bp, Homo sapiens
agagttaagctttgcctaaaga

SEQ ID NO: 9272090 - DNA, 22 bp, Homo sapiens
agagttaaataagcattaactt

SEQ ID NO: 9272091 - DNA, 22 bp, Homo sapiens
agagtgtggaaatgttcagagt

SEQ ID NO: 9272092 - DNA, 22 bp, Homo sapiens
agagtgtaccaaatatcctaca

SEQ ID NO: 9272093 - DNA, 22 bp, Homo sapiens
agagtgtgtggggctgaggtca

SEQ ID NO: 9272094 - DNA, 22 bp, Homo sapiens
agagtgtgtctatggaaggggt

SEQ ID NO: 9272095 - DNA, 22 bp, Homo sapiens
agagtgtgtctatggaaggggt

SEQ ID NO: 9272096 - DNA, 22 bp, Homo sapiens
agagtgttatttgctctgtatt

SEQ ID NO: 9272097 - DNA, 22 bp, Homo sapiens
aatttggtgtcttagtttccct

SEQ ID NO: 9272098 - DNA, 23 bp, Homo sapiens
aatttggttgatgaaagcattgt

SEQ ID NO: 9272099 - DNA, 20 bp, Homo sapiens
agagtgggtgtcacaggctg

SEQ ID NO: 9272100 - DNA, 22 bp, Homo sapiens
agagtgggttataggcagactt

SEQ ID NO: 9272101 - DNA, 22 bp, Homo sapiens
agagtgtaataagggcaagggc

SEQ ID NO: 9272102 - DNA, 22 bp, Homo sapiens
aatgtataaccataggaaattt

SEQ ID NO: 9272103 - DNA, 22 bp, Homo sapiens
aatgtataatatttaatgcttt

SEQ ID NO: 9272104 - DNA, 22 bp, Homo sapiens
agacatggatttcttacataaa

SEQ ID NO: 9272105 - DNA, 22 bp, Homo sapiens
agacatgtcaccaattcttact

SEQ ID NO: 9272106 - DNA, 22 bp, Homo sapiens
agacatggtttattttaatggt

SEQ ID NO: 9272107 - DNA, 20 bp, Homo sapiens
agacatggtagtgattcagg

SEQ ID NO: 9272108 - DNA, 22 bp, Homo sapiens
aatgtatgtgcatcatttacat

SEQ ID NO: 9272109 - DNA, 20 bp, Homo sapiens
aatgtatattttatgccagg

SEQ ID NO: 9272110 - DNA, 20 bp, Homo sapiens
aatgtatattttatgccagg

SEQ ID NO: 9272111 - DNA, 20 bp, Homo sapiens
aatgtatattttatgccagg

SEQ ID NO: 9272112 - DNA, 20 bp, Homo sapiens
aatgtatatgtgaccccaaa

SEQ ID NO: 9272113 - DNA, 22 bp, Homo sapiens
aatgctacagaagtgatcttgg

SEQ ID NO: 9272114 - DNA, 22 bp, Homo sapiens
aatgctatcggctctaagcatg

SEQ ID NO: 9272115 - DNA, 22 bp, Homo sapiens
aatgctcaaaatgtttcatcta

SEQ ID NO: 9272116 - DNA, 22 bp, Homo sapiens
aatgctctctgccatagctaac

SEQ ID NO: 9272117 - DNA, 22 bp, Homo sapiens
agacatgccaagaaacccagtg

SEQ ID NO: 9272118 - DNA, 22 bp, Homo sapiens
agacatgccaagaaacccagtg

SEQ ID NO: 9272119 - DNA, 19 bp, Homo sapiens
agacatgagacacaggatg

SEQ ID NO: 9272120 - DNA, 22 bp, Homo sapiens
agacatgcaataatgtgcactc

SEQ ID NO: 9272121 - DNA, 22 bp, Homo sapiens
aatgctgagtcctgtgagtctt

SEQ ID NO: 9272122 - DNA, 22 bp, Homo sapiens
agacaggtaaatagagatgctg

SEQ ID NO: 9272123 - DNA, 22 bp, Homo sapiens
agagaagggggaaagatctcac

SEQ ID NO: 9272124 - DNA, 22 bp, Homo sapiens
agagaaggggtaaagagtcctg

SEQ ID NO: 9272125 - DNA, 22 bp, Homo sapiens
aatgtgtagcatttaatgcagt

SEQ ID NO: 9272126 - DNA, 22 bp, Homo sapiens
agagaagggcctgtatgtaatc

SEQ ID NO: 9272127 - DNA, 21 bp, Homo sapiens
agagaagggattccaggccct

SEQ ID NO: 9272128 - DNA, 21 bp, Homo sapiens
aatgtgtgctatttatctttt

SEQ ID NO: 9272129 - DNA, 22 bp, Homo sapiens
aatgtgttactgtgtaagagca

SEQ ID NO: 9272130 - DNA, 22 bp, Homo sapiens
agagatttacacatgccttttc

SEQ ID NO: 9272131 - DNA, 22 bp, Homo sapiens
aatgtgtatactggcaattaag

SEQ ID NO: 9272132 - DNA, 22 bp, Homo sapiens
agagcaagtgacagaaacaggg

SEQ ID NO: 9272133 - DNA, 22 bp, Homo sapiens
agagatttctactgcactcttt

SEQ ID NO: 9272134 - DNA, 22 bp, Homo sapiens
agagatttctactgcactcttt

SEQ ID NO: 9272135 - DNA, 22 bp, Homo sapiens
agagatttctactgcactcttt

SEQ ID NO: 9272136 - DNA, 22 bp, Homo sapiens
agagatttgtcaatgatttcca

SEQ ID NO: 9272137 - DNA, 20 bp, Homo sapiens
agagattttagtagccacag

SEQ ID NO: 9272138 - DNA, 22 bp, Homo sapiens
agagatttgtcaatgatttcca

SEQ ID NO: 9272139 - DNA, 22 bp, Homo sapiens
agagcaaagggacatggaagag

SEQ ID NO: 9272140 - DNA, 22 bp, Homo sapiens
agagcaaatagagaagccagct

SEQ ID NO: 9272141 - DNA, 22 bp, Homo sapiens
agagctgctcagatgtcactgc

SEQ ID NO: 9272142 - DNA, 22 bp, Homo sapiens
aattcatactctatattgcttt

SEQ ID NO: 9272143 - DNA, 22 bp, Homo sapiens
aattcatagcaacaaagaccca

SEQ ID NO: 9272144 - DNA, 22 bp, Homo sapiens
aattcatatggatatgctagta

SEQ ID NO: 9272145 - DNA, 22 bp, Homo sapiens
aattccaaatgttttcaatcca

SEQ ID NO: 9272146 - DNA, 22 bp, Homo sapiens
aattccaaatgttttcaatcca

SEQ ID NO: 9272147 - DNA, 22 bp, Homo sapiens
aattcatccatgaacaattcca

SEQ ID NO: 9272148 - DNA, 22 bp, Homo sapiens
aattcattaagaaagagctaaa

SEQ ID NO: 9272149 - DNA, 22 bp, Homo sapiens
aattcattgccagaatctatga

SEQ ID NO: 9272150 - DNA, 22 bp, Homo sapiens
agagctgccgagctggggccat

SEQ ID NO: 9272151 - DNA, 22 bp, Homo sapiens
agagctgcagggtggacccagg

SEQ ID NO: 9272152 - DNA, 22 bp, Homo sapiens
agagctgcccacacagcagatt

SEQ ID NO: 9272153 - DNA, 22 bp, Homo sapiens
agagctgcagggtggacccagg

SEQ ID NO: 9272154 - DNA, 22 bp, Homo sapiens
agagctgcacctatgcagacct

SEQ ID NO: 9272155 - DNA, 22 bp, Homo sapiens
agagctgcaatttcatgtggtg

SEQ ID NO: 9272156 - DNA, 22 bp, Homo sapiens
agagctgagcaccaagcatggt

SEQ ID NO: 9272157 - DNA, 22 bp, Homo sapiens
agagctgagaatgtggcttcct

SEQ ID NO: 9272158 - DNA, 22 bp, Homo sapiens
agagctgagaatgtggcttcct

SEQ ID NO: 9272159 - DNA, 22 bp, Homo sapiens
agagctgagcaccaagcatggt

SEQ ID NO: 9272160 - DNA, 22 bp, Homo sapiens
agagctgaggatccagctgagc

SEQ ID NO: 9272161 - DNA, 22 bp, Homo sapiens
agagctgaggatccagctgagc

SEQ ID NO: 9272162 - DNA, 22 bp, Homo sapiens
agagctgaggatccagctgagc

SEQ ID NO: 9272163 - DNA, 22 bp, Homo sapiens
agagcctggctcccagctaccg

SEQ ID NO: 9272164 - DNA, 22 bp, Homo sapiens
agagcctggcaaaaggtcctgc

SEQ ID NO: 9272165 - DNA, 22 bp, Homo sapiens
agagctgaattcaagtgctggc

SEQ ID NO: 9272166 - DNA, 22 bp, Homo sapiens
agagctgaattcaagtgctggc

SEQ ID NO: 9272167 - DNA, 22 bp, Homo sapiens
aattacacagggatcacttttt

SEQ ID NO: 9272168 - DNA, 23 bp, Homo sapiens
aattacaaccaagaactggaagg

SEQ ID NO: 9272169 - DNA, 22 bp, Homo sapiens
aattaattcagtttttaaggga

SEQ ID NO: 9272170 - DNA, 22 bp, Homo sapiens
aattaacagagggcttattact

SEQ ID NO: 9272171 - DNA, 22 bp, Homo sapiens
aattaacagagggcttattact

SEQ ID NO: 9272172 - DNA, 22 bp, Homo sapiens
aattaagaaaatgttttatgat

SEQ ID NO: 9272173 - DNA, 22 bp, Homo sapiens
aattaagaaaatgttttatgat

SEQ ID NO: 9272174 - DNA, 22 bp, Homo sapiens
aattaagagagagttgaagcaa

SEQ ID NO: 9272175 - DNA, 22 bp, Homo sapiens
aattaagtcacacacctaaacc

SEQ ID NO: 9272176 - DNA, 22 bp, Homo sapiens
aattaatatttgtggaattaat

SEQ ID NO: 9272177 - DNA, 22 bp, Homo sapiens
agaggcaaaaatctatggcaac

SEQ ID NO: 9272178 - DNA, 22 bp, Homo sapiens
agaggattttaaaagcatatgt

SEQ ID NO: 9272179 - DNA, 20 bp, Homo sapiens
agaggatttatgtggatgtg

SEQ ID NO: 9272180 - DNA, 22 bp, Homo sapiens
aatttcctgggataaaaagcca

SEQ ID NO: 9272181 - DNA, 22 bp, Homo sapiens
agaggatgattttaaggacact

SEQ ID NO: 9272182 - DNA, 22 bp, Homo sapiens
agaggaggtggtgatgctttaa

SEQ ID NO: 9272183 - DNA, 22 bp, Homo sapiens
agagctgggtggtggtgactca

SEQ ID NO: 9272184 - DNA, 22 bp, Homo sapiens
aattccagctgattgactttcc

SEQ ID NO: 9272185 - DNA, 22 bp, Homo sapiens
aattccacagctgcacagaggt

SEQ ID NO: 9272186 - DNA, 22 bp, Homo sapiens
aattccaacagacaaagttaga

SEQ ID NO: 9272187 - DNA, 22 bp, Homo sapiens
aattccaacagacaaagttaga

SEQ ID NO: 9272188 - DNA, 22 bp, Homo sapiens
aattccaagtagcatcccatca

SEQ ID NO: 9272189 - DNA, 22 bp, Homo sapiens
agaggaagtaatcaggacctgc

SEQ ID NO: 9272190 - DNA, 22 bp, Homo sapiens
agaggaagtaatcaggacctgc

SEQ ID NO: 9272191 - DNA, 22 bp, Homo sapiens
agaggaagtaatcaggacctgc

SEQ ID NO: 9272192 - DNA, 22 bp, Homo sapiens
agaggaataaatttctgtagtg

SEQ ID NO: 9272193 - DNA, 21 bp, Homo sapiens
agaggaagtgattggtctggc

SEQ ID NO: 9272194 - DNA, 22 bp, Homo sapiens
agaggaatctgtctagacacaa

SEQ ID NO: 9272195 - DNA, 22 bp, Homo sapiens
aagggcaggcacccaccctcac

SEQ ID NO: 9272196 - DNA, 22 bp, Homo sapiens
aagggcaggagaagacggatat

SEQ ID NO: 9272197 - DNA, 22 bp, Homo sapiens
aagggcaggagaagacggatat

SEQ ID NO: 9272198 - DNA, 22 bp, Homo sapiens
aagggcaggagaagacggatat

SEQ ID NO: 9272199 - DNA, 22 bp, Homo sapiens
aagggcaggaaaagatggatgt

SEQ ID NO: 9272200 - DNA, 22 bp, Homo sapiens
aagggcaggaaaagatggatgt

SEQ ID NO: 9272201 - DNA, 22 bp, Homo sapiens
aagggaggggatgtaagcctgg

SEQ ID NO: 9272202 - DNA, 22 bp, Homo sapiens
aaggctgacgtttgtgtttatt

SEQ ID NO: 9272203 - DNA, 22 bp, Homo sapiens
aaggctgaccagtttacacttt

SEQ ID NO: 9272204 - DNA, 22 bp, Homo sapiens
aaggctgaccagtttacacttt

SEQ ID NO: 9272205 - DNA, 22 bp, Homo sapiens
aaggctgaccagtttacacttt

SEQ ID NO: 9272206 - DNA, 22 bp, Homo sapiens
aaggctgaattcaagggtaggc

SEQ ID NO: 9272207 - DNA, 22 bp, Homo sapiens
aaggctgactcaacagggggcc

SEQ ID NO: 9272208 - DNA, 22 bp, Homo sapiens
aaggctgacgtttgtgtttatt

SEQ ID NO: 9272209 - DNA, 22 bp, Homo sapiens
aaggctgagacagcacaggtcc

SEQ ID NO: 9272210 - DNA, 22 bp, Homo sapiens
aaggctgagagtcacagtccta

SEQ ID NO: 9272211 - DNA, 22 bp, Homo sapiens
aaggctgagacagcacaggtcc

SEQ ID NO: 9272212 - DNA, 22 bp, Homo sapiens
aaggctgagacagcacaggtcc

SEQ ID NO: 9272213 - DNA, 21 bp, Homo sapiens
aaggctgagacaactcaggag

SEQ ID NO: 9272214 - DNA, 22 bp, Homo sapiens
aaggctgagagtcacagtccta

SEQ ID NO: 9272215 - DNA, 22 bp, Homo sapiens
aagggaggccagaggttttgca

SEQ ID NO: 9272216 - DNA, 22 bp, Homo sapiens
aaggcccagcgtgacctcagtg

SEQ ID NO: 9272217 - DNA, 22 bp, Homo sapiens
aaggctgaattcaagggtaggc

SEQ ID NO: 9272218 - DNA, 22 bp, Homo sapiens
aaggctgaaagaccttgaacct

SEQ ID NO: 9272219 - DNA, 22 bp, Homo sapiens
aaggcccttccaccagtcctcg

SEQ ID NO: 9272220 - DNA, 22 bp, Homo sapiens
aaggcccttcggcttcctcagc

SEQ ID NO: 9272221 - DNA, 22 bp, Homo sapiens
aaggccagtggataaaacctct

SEQ ID NO: 9272222 - DNA, 22 bp, Homo sapiens
aaggcccacagaactgtctcca

SEQ ID NO: 9272223 - DNA, 22 bp, Homo sapiens
aaggagtctgggccattcagag

SEQ ID NO: 9272224 - DNA, 22 bp, Homo sapiens
aaggagtctgggccattcagag

SEQ ID NO: 9272225 - DNA, 22 bp, Homo sapiens
aaggagggttcccaggtcctgg

SEQ ID NO: 9272226 - DNA, 22 bp, Homo sapiens
aaggagggttcccaggtcctgg

SEQ ID NO: 9272227 - DNA, 22 bp, Homo sapiens
aaggatacttttagagcctgag

SEQ ID NO: 9272228 - DNA, 22 bp, Homo sapiens
aaggcactgaacttaaattctg

SEQ ID NO: 9272229 - DNA, 22 bp, Homo sapiens
aaggcactgaaaaattgtgtgt

SEQ ID NO: 9272230 - DNA, 22 bp, Homo sapiens
aaggcactgactgtgcagggga

SEQ ID NO: 9272231 - DNA, 22 bp, Homo sapiens
aaggcactgaacttaaattctg

SEQ ID NO: 9272232 - DNA, 22 bp, Homo sapiens
aaggatcaagtggattttctta

SEQ ID NO: 9272233 - DNA, 22 bp, Homo sapiens
aaggcactagcagaattagtga

SEQ ID NO: 9272234 - DNA, 22 bp, Homo sapiens
aaggagggaaagcagtgcttct

SEQ ID NO: 9272235 - DNA, 22 bp, Homo sapiens
aaggagaagtctgttgagattg

SEQ ID NO: 9272236 - DNA, 16 bp, Homo sapiens
aaggagggaagagaat

SEQ ID NO: 9272237 - DNA, 22 bp, Homo sapiens
aaggagggttcccaggtcctgg

SEQ ID NO: 9272238 - DNA, 18 bp, Homo sapiens
aaatggcacacagacctg

SEQ ID NO: 9272239 - DNA, 22 bp, Homo sapiens
aaatggcactttgacagcctgc

SEQ ID NO: 9272240 - DNA, 18 bp, Homo sapiens
aaatggcacacagacctg

SEQ ID NO: 9272241 - DNA, 22 bp, Homo sapiens
aaatggcaatttagtttattta

SEQ ID NO: 9272242 - DNA, 22 bp, Homo sapiens
aaatggcaacagaagggagttc

SEQ ID NO: 9272243 - DNA, 22 bp, Homo sapiens
aaatggcaatcagcagaagcta

SEQ ID NO: 9272244 - DNA, 22 bp, Homo sapiens
aaatggcaatcagcagaagcta

SEQ ID NO: 9272245 - DNA, 22 bp, Homo sapiens
aaatggcaatcagcagaagcta

SEQ ID NO: 9272246 - DNA, 22 bp, Homo sapiens
aaatggaatgtgtttataattc

SEQ ID NO: 9272247 - DNA, 22 bp, Homo sapiens
aacagtgtttttcttcagcact

SEQ ID NO: 9272248 - DNA, 22 bp, Homo sapiens
aacagtgtcaggattacagata

SEQ ID NO: 9272249 - DNA, 22 bp, Homo sapiens
aacagtgtgtacacatcatagg

SEQ ID NO: 9272250 - DNA, 22 bp, Homo sapiens
aagtgctcccatatcctgccct

SEQ ID NO: 9272251 - DNA, 23 bp, Homo sapiens
aagtgctcagtggacagcattgc

SEQ ID NO: 9272252 - DNA, 22 bp, Homo sapiens
aagtgctgagactacaggcatg

SEQ ID NO: 9272253 - DNA, 22 bp, Homo sapiens
aagtgctgggattacaggcatg

SEQ ID NO: 9272254 - DNA, 22 bp, Homo sapiens
aagtgctgggattataggcatg

SEQ ID NO: 9272255 - DNA, 22 bp, Homo sapiens
aagtgctgggattacaggtgtc

SEQ ID NO: 9272256 - DNA, 22 bp, Homo sapiens
aagtgctgggattacaggtgtg

SEQ ID NO: 9272257 - DNA, 22 bp, Homo sapiens
aagtgaaacatgtatctcttta

SEQ ID NO: 9272258 - DNA, 22 bp, Homo sapiens
aagtgaaacatgtatctcttta

SEQ ID NO: 9272259 - DNA, 22 bp, Homo sapiens
aagtgcctgacctagcctggag

SEQ ID NO: 9272260 - DNA, 22 bp, Homo sapiens
aagtctgatcatttcttctata

SEQ ID NO: 9272261 - DNA, 22 bp, Homo sapiens
aagtcttatttgtcatgtatgt

SEQ ID NO: 9272262 - DNA, 22 bp, Homo sapiens
aagtcttaggcattttatttct

SEQ ID NO: 9272263 - DNA, 22 bp, Homo sapiens
aagtcttaaccaaataaatgtt

SEQ ID NO: 9272264 - DNA, 22 bp, Homo sapiens
aagtcttacagacaagctgaag

SEQ ID NO: 9272265 - DNA, 22 bp, Homo sapiens
aagtcttagcaactatcgcttt

SEQ ID NO: 9272266 - DNA, 22 bp, Homo sapiens
aagtcttagcaactatcgcttt

SEQ ID NO: 9272267 - DNA, 22 bp, Homo sapiens
aagggctggaatatctcttaga

SEQ ID NO: 9272268 - DNA, 22 bp, Homo sapiens
aagggctggaatatctcttaga

SEQ ID NO: 9272269 - DNA, 22 bp, Homo sapiens
aaggtgtcggcagagccgcttc

SEQ ID NO: 9272270 - DNA, 22 bp, Homo sapiens
aaggtgtcgggttagctcagcc

SEQ ID NO: 9272271 - DNA, 22 bp, Homo sapiens
aaggtgtgaagagatgggaaga

SEQ ID NO: 9272272 - DNA, 22 bp, Homo sapiens
aaggtgttcaggttttcccatt

SEQ ID NO: 9272273 - DNA, 22 bp, Homo sapiens
aagggctgcaatccaaaacact

SEQ ID NO: 9272274 - DNA, 22 bp, Homo sapiens
aagggctgcaatccaaaacact

SEQ ID NO: 9272275 - DNA, 22 bp, Homo sapiens
aagggctgcatttgatgtgtca

SEQ ID NO: 9272276 - DNA, 22 bp, Homo sapiens
aagggctgcatttgatgtgtca

SEQ ID NO: 9272277 - DNA, 22 bp, Homo sapiens
aagggctgctgtagaagcagag

SEQ ID NO: 9272278 - DNA, 22 bp, Homo sapiens
aagggctgctgtagaagcagag

SEQ ID NO: 9272279 - DNA, 22 bp, Homo sapiens
aagggctggaatatctcttaga

SEQ ID NO: 9272280 - DNA, 22 bp, Homo sapiens
aagggctgccagggggtgccag

SEQ ID NO: 9272281 - DNA, 22 bp, Homo sapiens
aagggctgccagggggtgccag

SEQ ID NO: 9272282 - DNA, 22 bp, Homo sapiens
aagggctgccagggggtgccag

SEQ ID NO: 9272283 - DNA, 22 bp, Homo sapiens
aagtctgagagaaactctctca

SEQ ID NO: 9272284 - DNA, 22 bp, Homo sapiens
aagtacaacgcatacagagaaa

SEQ ID NO: 9272285 - DNA, 21 bp, Homo sapiens
aagtaatgtgtctcttctacc

SEQ ID NO: 9272286 - DNA, 22 bp, Homo sapiens
aagtaactaaagatatccattt

SEQ ID NO: 9272287 - DNA, 22 bp, Homo sapiens
aagtaactaaagatatccattt

SEQ ID NO: 9272288 - DNA, 22 bp, Homo sapiens
aagtaacttatttgcaaacagg

SEQ ID NO: 9272289 - DNA, 22 bp, Homo sapiens
aagtaacttatttgcaaacagg

SEQ ID NO: 9272290 - DNA, 23 bp, Homo sapiens
aaggtgtttgttttcagaaagca

SEQ ID NO: 9272291 - DNA, 23 bp, Homo sapiens
aaggtgttctgtatttaactcag

SEQ ID NO: 9272292 - DNA, 22 bp, Homo sapiens
aagtaacatctgaacatgatgt

SEQ ID NO: 9272293 - DNA, 22 bp, Homo sapiens
aatgcttccaaaataccaagcc

SEQ ID NO: 9272294 - DNA, 22 bp, Homo sapiens
aacttggtaccaccttctgaag

SEQ ID NO: 9272295 - DNA, 22 bp, Homo sapiens
aatgctttcaaaaatgtgcagt

SEQ ID NO: 9272296 - DNA, 22 bp, Homo sapiens
aacttcatttataatgtcatta

SEQ ID NO: 9272297 - DNA, 22 bp, Homo sapiens
aacttcatttataatgtcatta

SEQ ID NO: 9272298 - DNA, 22 bp, Homo sapiens
aacttcattcctttttatgact

SEQ ID NO: 9272299 - DNA, 22 bp, Homo sapiens
aatgctttagcagtgattagtg

SEQ ID NO: 9272300 - DNA, 22 bp, Homo sapiens
aacttcattcctttttatgact

SEQ ID NO: 9272301 - DNA, 22 bp, Homo sapiens
aatgctgtcttagcatgaaagc

SEQ ID NO: 9272302 - DNA, 22 bp, Homo sapiens
aatgctgtccaataggaacata

SEQ ID NO: 9272303 - DNA, 22 bp, Homo sapiens
aatgcataatggtttgtgacaa

SEQ ID NO: 9272304 - DNA, 22 bp, Homo sapiens
aatgcagtgagccattaaatgg

SEQ ID NO: 9272305 - DNA, 22 bp, Homo sapiens
aatgcagtttcatttgtagaat

SEQ ID NO: 9272306 - DNA, 22 bp, Homo sapiens
aatgcagtttcatttgtagaat

SEQ ID NO: 9272307 - DNA, 22 bp, Homo sapiens
aatgcagtttcatttgtagaat

SEQ ID NO: 9272308 - DNA, 22 bp, Homo sapiens
aatgcagttgaatttgggtatg

SEQ ID NO: 9272309 - DNA, 19 bp, Homo sapiens
aatgcttaggacagtgcct

SEQ ID NO: 9272310 - DNA, 22 bp, Homo sapiens
aatgcttataacgttagaatgt

SEQ ID NO: 9272311 - DNA, 19 bp, Homo sapiens
aatgcttaggacagtgcct

SEQ ID NO: 9272312 - DNA, 22 bp, Homo sapiens
aatgcttaattcaatactgtgt

SEQ ID NO: 9272313 - DNA, 22 bp, Homo sapiens
aatgcttatacctaatgatctt

SEQ ID NO: 9272314 - DNA, 22 bp, Homo sapiens
aatgcttatgggttccataata

SEQ ID NO: 9272315 - DNA, 20 bp, Homo sapiens
aacttgttttgttttctaat

SEQ ID NO: 9272316 - DNA, 20 bp, Homo sapiens
aacttgttttgttttctaat

SEQ ID NO: 9272317 - DNA, 22 bp, Homo sapiens
aactttaaaaaatatgtctgtt

SEQ ID NO: 9272318 - DNA, 22 bp, Homo sapiens
aactttaaaaaatatgtctgtt

SEQ ID NO: 9272319 - DNA, 22 bp, Homo sapiens
aacttgtaggactgcactgtag

SEQ ID NO: 9272320 - DNA, 23 bp, Homo sapiens
aactttactattttgaataatgc

SEQ ID NO: 9272321 - DNA, 22 bp, Homo sapiens
aactttaaagaggaggcttggg

SEQ ID NO: 9272322 - DNA, 22 bp, Homo sapiens
aactttaaggctataaattatg

SEQ ID NO: 9272323 - DNA, 22 bp, Homo sapiens
aactttaaggctataaattatg

SEQ ID NO: 9272324 - DNA, 22 bp, Homo sapiens
aactttaaggctataaattatg

SEQ ID NO: 9272325 - DNA, 22 bp, Homo sapiens
aactttacttgaaagaacatgt

SEQ ID NO: 9272326 - DNA, 22 bp, Homo sapiens
aatgtaaacagcaagagaaggg

SEQ ID NO: 9272327 - DNA, 22 bp, Homo sapiens
aatgtaaagttgggcacaaatg

SEQ ID NO: 9272328 - DNA, 18 bp, Homo sapiens
aatgaaatgtacaccttt

SEQ ID NO: 9272329 - DNA, 22 bp, Homo sapiens
aatgatgaactcagagggaacc

SEQ ID NO: 9272330 - DNA, 22 bp, Homo sapiens
aatgcacaaaggtgtctattgc

SEQ ID NO: 9272331 - DNA, 22 bp, Homo sapiens
aatgcacctaccttgattctgc

SEQ ID NO: 9272332 - DNA, 22 bp, Homo sapiens
aatgcaccttggcagggattca

SEQ ID NO: 9272333 - DNA, 22 bp, Homo sapiens
aatgcagagtaaatatttaatt

SEQ ID NO: 9272334 - DNA, 22 bp, Homo sapiens
aatgcagattcttattctgtag

SEQ ID NO: 9272335 - DNA, 22 bp, Homo sapiens
aatctgagggaacttgaactcc

SEQ ID NO: 9272336 - DNA, 22 bp, Homo sapiens
aatctgaatatttatgtgtatt

SEQ ID NO: 9272337 - DNA, 22 bp, Homo sapiens
aatctgtaacattcaataaaga

SEQ ID NO: 9272338 - DNA, 22 bp, Homo sapiens
aatctgtattgctcatacttga

SEQ ID NO: 9272339 - DNA, 22 bp, Homo sapiens
aatgaaactgtatatagactgt

SEQ ID NO: 9272340 - DNA, 22 bp, Homo sapiens
aatgaaatctgctgggtaaaga

SEQ ID NO: 9272341 - DNA, 22 bp, Homo sapiens
aagttaagcatggccatgtgac

SEQ ID NO: 9272342 - DNA, 22 bp, Homo sapiens
aagttaagggtcccagtctgtt

SEQ ID NO: 9272343 - DNA, 22 bp, Homo sapiens
aagttacacattttcattgtaa

SEQ ID NO: 9272344 - DNA, 22 bp, Homo sapiens
aagttacagattgggagcagag

SEQ ID NO: 9272345 - DNA, 22 bp, Homo sapiens
aagttacaagactaaatggaag

SEQ ID NO: 9272346 - DNA, 22 bp, Homo sapiens
aagttacacagagttggaggct

SEQ ID NO: 9272347 - DNA, 22 bp, Homo sapiens
aacagtttatgataaattctta

SEQ ID NO: 9272348 - DNA, 22 bp, Homo sapiens
aacagtttatcaagtttttaca

SEQ ID NO: 9272349 - DNA, 22 bp, Homo sapiens
aacagtttatcaagtttttaca

SEQ ID NO: 9272350 - DNA, 22 bp, Homo sapiens
aacagtttatgagatatgctat

SEQ ID NO: 9272351 - DNA, 22 bp, Homo sapiens
aagttacagttattatttaaaa

SEQ ID NO: 9272352 - DNA, 22 bp, Homo sapiens
aagttacagttggaactgtgaa

SEQ ID NO: 9272353 - DNA, 22 bp, Homo sapiens
aataagaacttgtctctggcag

SEQ ID NO: 9272354 - DNA, 22 bp, Homo sapiens
aataagaattgccagatttgaa

SEQ ID NO: 9272355 - DNA, 22 bp, Homo sapiens
aagttacataaatgtcctctag

SEQ ID NO: 9272356 - DNA, 22 bp, Homo sapiens
aagttacatattcttgggctat

SEQ ID NO: 9272357 - DNA, 22 bp, Homo sapiens
aagttacagttatgaaactcac

SEQ ID NO: 9272358 - DNA, 22 bp, Homo sapiens
aagttacagttacagaatggag

SEQ ID NO: 9272359 - DNA, 22 bp, Homo sapiens
aagttacagttaggggtgatga

SEQ ID NO: 9272360 - DNA, 22 bp, Homo sapiens
aagttacaggagaaagagatca

SEQ ID NO: 9272361 - DNA, 22 bp, Homo sapiens
aagttacagtctgcttgctgac

SEQ ID NO: 9272362 - DNA, 22 bp, Homo sapiens
aagttacagtcagaggttaaca

SEQ ID NO: 9272363 - DNA, 22 bp, Homo sapiens
aataatcttgactactgaatca

SEQ ID NO: 9272364 - DNA, 22 bp, Homo sapiens
aataatgataatggttatagct

SEQ ID NO: 9272365 - DNA, 22 bp, Homo sapiens
aataatattcctctgtgtgcgt

SEQ ID NO: 9272366 - DNA, 22 bp, Homo sapiens
aataatatttgaagcttcaaag

SEQ ID NO: 9272367 - DNA, 22 bp, Homo sapiens
aataatctccctttttgtatgt

SEQ ID NO: 9272368 - DNA, 22 bp, Homo sapiens
aataatgtaggatgataaatga

SEQ ID NO: 9272369 - DNA, 22 bp, Homo sapiens
aataatgtaggatgataaatga

SEQ ID NO: 9272370 - DNA, 22 bp, Homo sapiens
aataatgtaggatgataaatga

SEQ ID NO: 9272371 - DNA, 22 bp, Homo sapiens
aataatgtctgctattttaaaa

SEQ ID NO: 9272372 - DNA, 22 bp, Homo sapiens
aataatgtctatggttccaaaa

SEQ ID NO: 9272373 - DNA, 22 bp, Homo sapiens
aataatgtctatggttccaaaa

SEQ ID NO: 9272374 - DNA, 22 bp, Homo sapiens
aataatgtctgctattttaaaa

SEQ ID NO: 9272375 - DNA, 23 bp, Homo sapiens
aataatgtcttgtgctctcactt

SEQ ID NO: 9272376 - DNA, 22 bp, Homo sapiens
aatacagcagatggagacaaat

SEQ ID NO: 9272377 - DNA, 22 bp, Homo sapiens
aataatgtctttggcttgacca

SEQ ID NO: 9272378 - DNA, 22 bp, Homo sapiens
aatatccattgggagcaaatgg

SEQ ID NO: 9272379 - DNA, 22 bp, Homo sapiens
aatatccaggtagatgtcttct

SEQ ID NO: 9272380 - DNA, 22 bp, Homo sapiens
aatatccacttcaatacaggca

SEQ ID NO: 9272381 - DNA, 22 bp, Homo sapiens
aatatcatctctcttttctgca

SEQ ID NO: 9272382 - DNA, 22 bp, Homo sapiens
aatatcagtatattgtatcagt

SEQ ID NO: 9272383 - DNA, 22 bp, Homo sapiens
aatacataataagttttgtctg

SEQ ID NO: 9272384 - DNA, 19 bp, Homo sapiens
aatacagtgttatagaatt

SEQ ID NO: 9272385 - DNA, 19 bp, Homo sapiens
aatacagtgttatagaatt

SEQ ID NO: 9272386 - DNA, 19 bp, Homo sapiens
aatacagtgttatagaatt

SEQ ID NO: 9272387 - DNA, 22 bp, Homo sapiens
aatacagtaggtaatagttcat

SEQ ID NO: 9272388 - DNA, 22 bp, Homo sapiens
aatacagtgaaagtgagcaagg

SEQ ID NO: 9272389 - DNA, 22 bp, Homo sapiens
aatacagtaggtaatagttcat

SEQ ID NO: 9272390 - DNA, 22 bp, Homo sapiens
aatatttccaaggcctgtcagg

SEQ ID NO: 9272391 - DNA, 22 bp, Homo sapiens
aatatttctccttcgttatagc

SEQ ID NO: 9272392 - DNA, 22 bp, Homo sapiens
aatatttctccttcgttatagc

SEQ ID NO: 9272393 - DNA, 22 bp, Homo sapiens
aatatttctccttcgttatagc

SEQ ID NO: 9272394 - DNA, 22 bp, Homo sapiens
aatatttctggtgcttctcact

SEQ ID NO: 9272395 - DNA, 22 bp, Homo sapiens
aatattgagaaccagcatgttt

SEQ ID NO: 9272396 - DNA, 22 bp, Homo sapiens
aatatctggagatgctttttgt

SEQ ID NO: 9272397 - DNA, 22 bp, Homo sapiens
aatatctgtctctaatgcatat

SEQ ID NO: 9272398 - DNA, 22 bp, Homo sapiens
aatatctgtggccatacaattt

SEQ ID NO: 9272399 - DNA, 22 bp, Homo sapiens
aatattgagaaccagcatgttt

SEQ ID NO: 9272400 - DNA, 22 bp, Homo sapiens
aagcagtgatgcatacagctgt

SEQ ID NO: 9272401 - DNA, 22 bp, Homo sapiens
aagcagtgttcccagctggccc

SEQ ID NO: 9272402 - DNA, 22 bp, Homo sapiens
aagcagtgcgctcatctaaggg

SEQ ID NO: 9272403 - DNA, 22 bp, Homo sapiens
aagcagttaatgttttgtcaat

SEQ ID NO: 9272404 - DNA, 22 bp, Homo sapiens
aagcataaaacgttacaacatg

SEQ ID NO: 9272405 - DNA, 22 bp, Homo sapiens
aagcataacttgctgcacatag

SEQ ID NO: 9272406 - DNA, 22 bp, Homo sapiens
aagcataaaacgttacaacatg

SEQ ID NO: 9272407 - DNA, 22 bp, Homo sapiens
acagcaggaagctggagggaaa

SEQ ID NO: 9272408 - DNA, 22 bp, Homo sapiens
acagcagggggagctgttggac

SEQ ID NO: 9272409 - DNA, 21 bp, Homo sapiens
acagcagggctggcatgacag

SEQ ID NO: 9272410 - DNA, 19 bp, Homo sapiens
acagcaggtgtggggataa

SEQ ID NO: 9272411 - DNA, 22 bp, Homo sapiens
aagcaggtaaatatgtttccct

SEQ ID NO: 9272412 - DNA, 22 bp, Homo sapiens
aagcaggtaaatatgtttccct

SEQ ID NO: 9272413 - DNA, 22 bp, Homo sapiens
aagcagggtgtcttgacccatg

SEQ ID NO: 9272414 - DNA, 22 bp, Homo sapiens
aagcaggttacatacattatct

SEQ ID NO: 9272415 - DNA, 22 bp, Homo sapiens
aagcaggttatgaaatatagaa

SEQ ID NO: 9272416 - DNA, 18 bp, Homo sapiens
aagcagggtccattgtgc

SEQ ID NO: 9272417 - DNA, 22 bp, Homo sapiens
aagcagggctccctggggactc

SEQ ID NO: 9272418 - DNA, 22 bp, Homo sapiens
acagagcaattcttgggtgttt

SEQ ID NO: 9272419 - DNA, 22 bp, Homo sapiens
aagcaggaaggagcccagggca

SEQ ID NO: 9272420 - DNA, 21 bp, Homo sapiens
aagcaggacatatgatgccct

SEQ ID NO: 9272421 - DNA, 22 bp, Homo sapiens
aagcaggcttggtgtggccgct

SEQ ID NO: 9272422 - DNA, 21 bp, Homo sapiens
aagcaggctgtaatcatgtgg

SEQ ID NO: 9272423 - DNA, 22 bp, Homo sapiens
aagcccagtaccttcagtgagg

SEQ ID NO: 9272424 - DNA, 22 bp, Homo sapiens
aagcccagcatccctgcaccag

SEQ ID NO: 9272425 - DNA, 22 bp, Homo sapiens
aagcccagctgaaagcattttt

SEQ ID NO: 9272426 - DNA, 22 bp, Homo sapiens
acagctggacaggggagagttt

SEQ ID NO: 9272427 - DNA, 22 bp, Homo sapiens
acagccaggacttggccctctt

SEQ ID NO: 9272428 - DNA, 22 bp, Homo sapiens
acagccaggaattctggagaag

SEQ ID NO: 9272429 - DNA, 21 bp, Homo sapiens
acagccaggaacatgaggggc

SEQ ID NO: 9272430 - DNA, 22 bp, Homo sapiens
acagccaggaattctggagaag

SEQ ID NO: 9272431 - DNA, 22 bp, Homo sapiens
acagccagatctgagagatctt

SEQ ID NO: 9272432 - DNA, 22 bp, Homo sapiens
acagcaggttacagtggcacag

SEQ ID NO: 9272433 - DNA, 23 bp, Homo sapiens
acagccaggatgggagcagaagc

SEQ ID NO: 9272434 - DNA, 22 bp, Homo sapiens
acagccaggaggaactcagtga

SEQ ID NO: 9272435 - DNA, 22 bp, Homo sapiens
aagcccagatgtgagaactgag

SEQ ID NO: 9272436 - DNA, 22 bp, Homo sapiens
acagccagggacatacaatggt

SEQ ID NO: 9272437 - DNA, 22 bp, Homo sapiens
acagagatgtggatgagggatt

SEQ ID NO: 9272438 - DNA, 22 bp, Homo sapiens
acagagcaactttatttcatgg

SEQ ID NO: 9272439 - DNA, 22 bp, Homo sapiens
acagagcaataacagggagagg

SEQ ID NO: 9272440 - DNA, 22 bp, Homo sapiens
acagagatggcacagagaaggt

SEQ ID NO: 9272441 - DNA, 22 bp, Homo sapiens
acagactgattcattgctcagg

SEQ ID NO: 9272442 - DNA, 22 bp, Homo sapiens
acagacctctagattacatttg

SEQ ID NO: 9272443 - DNA, 22 bp, Homo sapiens
acagaccaagtttccagcaggt

SEQ ID NO: 9272444 - DNA, 23 bp, Homo sapiens
acagaaagttctgctggacagag

SEQ ID NO: 9272445 - DNA, 23 bp, Homo sapiens
acagacattccataatgtacacc

SEQ ID NO: 9272446 - DNA, 23 bp, Homo sapiens
acagacattccataatgtacacc

SEQ ID NO: 9272447 - DNA, 23 bp, Homo sapiens
acagacattccataatgtacacc

SEQ ID NO: 9272448 - DNA, 23 bp, Homo sapiens
acagacattccataatgtacacc

SEQ ID NO: 9272449 - DNA, 23 bp, Homo sapiens
acagacaacactgatgagagaaa

SEQ ID NO: 9272450 - DNA, 22 bp, Homo sapiens
acagacattttaattattaaat

SEQ ID NO: 9272451 - DNA, 22 bp, Homo sapiens
acagaccaaaaaaggatattgg

SEQ ID NO: 9272452 - DNA, 22 bp, Homo sapiens
acagaccaagtttccagcaggt

SEQ ID NO: 9272453 - DNA, 19 bp, Homo sapiens
acagacatttgcaattagc

SEQ ID NO: 9272454 - DNA, 22 bp, Homo sapiens
acagacatttaataaatgctga

SEQ ID NO: 9272455 - DNA, 20 bp, Homo sapiens
acacatatagcagcataaac

SEQ ID NO: 9272456 - DNA, 22 bp, Homo sapiens
acacatagaaaataaatagtta

SEQ ID NO: 9272457 - DNA, 20 bp, Homo sapiens
acacatagataagaagctga

SEQ ID NO: 9272458 - DNA, 22 bp, Homo sapiens
acacataagcctaatcatctcc

SEQ ID NO: 9272459 - DNA, 22 bp, Homo sapiens
aagatacagtgaaagggcattg

SEQ ID NO: 9272460 - DNA, 18 bp, Homo sapiens
acacttcctggtggtgtg

SEQ ID NO: 9272461 - DNA, 18 bp, Homo sapiens
acacttcctggtggtgtg

SEQ ID NO: 9272462 - DNA, 18 bp, Homo sapiens
acacttcctggtggtgtg

SEQ ID NO: 9272463 - DNA, 22 bp, Homo sapiens
acacttctattccctgcacaaa

SEQ ID NO: 9272464 - DNA, 22 bp, Homo sapiens
acacttctcccatctcctgttg

SEQ ID NO: 9272465 - DNA, 22 bp, Homo sapiens
acacttctttgtcacctgcttc

SEQ ID NO: 9272466 - DNA, 22 bp, Homo sapiens
acacttcagctccacaaacatt

SEQ ID NO: 9272467 - DNA, 22 bp, Homo sapiens
acacttcatagcaaggttggag

SEQ ID NO: 9272468 - DNA, 20 bp, Homo sapiens
acacttgacaccagaaatgg

SEQ ID NO: 9272469 - DNA, 22 bp, Homo sapiens
acacttggagcaacacttatgg

SEQ ID NO: 9272470 - DNA, 22 bp, Homo sapiens
acactttaagcatttcacactg

SEQ ID NO: 9272471 - DNA, 22 bp, Homo sapiens
acaatgtcaaaataggaaacat

SEQ ID NO: 9272472 - DNA, 21 bp, Homo sapiens
acaatgtcaaggtcagacatt

SEQ ID NO: 9272473 - DNA, 22 bp, Homo sapiens
acaatgtcacctctcatgtttt

SEQ ID NO: 9272474 - DNA, 22 bp, Homo sapiens
acaatgtagttgtcatgagaca

SEQ ID NO: 9272475 - DNA, 22 bp, Homo sapiens
acaatgtaggagtatgacagta

SEQ ID NO: 9272476 - DNA, 22 bp, Homo sapiens
acaatgtagagtaaaatatgtt

SEQ ID NO: 9272477 - DNA, 22 bp, Homo sapiens
acaatgtctcatattcgtgttc

SEQ ID NO: 9272478 - DNA, 23 bp, Homo sapiens
acaatgtctgttcataaaatacc

SEQ ID NO: 9272479 - DNA, 22 bp, Homo sapiens
acaatatttgggggcagtttgt

SEQ ID NO: 9272480 - DNA, 22 bp, Homo sapiens
acaatattgtacccagaagttt

SEQ ID NO: 9272481 - DNA, 22 bp, Homo sapiens
acaatagagttctcataggaca

SEQ ID NO: 9272482 - DNA, 22 bp, Homo sapiens
acaataggtgtccaattaacaa

SEQ ID NO: 9272483 - DNA, 22 bp, Homo sapiens
acaatagtcaatgcacgtcatt

SEQ ID NO: 9272484 - DNA, 22 bp, Homo sapiens
acaatagacccatgacacatac

SEQ ID NO: 9272485 - DNA, 22 bp, Homo sapiens
acaaatttgaatcctgacttct

SEQ ID NO: 9272486 - DNA, 22 bp, Homo sapiens
acaaatttgaatcctgacttct

SEQ ID NO: 9272487 - DNA, 22 bp, Homo sapiens
acaaatttggtgagagtaaata

SEQ ID NO: 9272488 - DNA, 22 bp, Homo sapiens
acaaatttcataggcaaatttt

SEQ ID NO: 9272489 - DNA, 22 bp, Homo sapiens
aagagtttccatgctctgtgct

SEQ ID NO: 9272490 - DNA, 22 bp, Homo sapiens
aagataatattcattaactaga

SEQ ID NO: 9272491 - DNA, 22 bp, Homo sapiens
aagataatgtgtctgtctttgc

SEQ ID NO: 9272492 - DNA, 22 bp, Homo sapiens
aagatacaccaagagcctagta

SEQ ID NO: 9272493 - DNA, 22 bp, Homo sapiens
aagatacaccaagagcctagta

SEQ ID NO: 9272494 - DNA, 22 bp, Homo sapiens
acacagcaaggtctgactttgg

SEQ ID NO: 9272495 - DNA, 17 bp, Homo sapiens
acacagccaggttctcc

SEQ ID NO: 9272496 - DNA, 22 bp, Homo sapiens
acacagctagtgagtggcagag

SEQ ID NO: 9272497 - DNA, 22 bp, Homo sapiens
acacagctcacaacgtgtgcat

SEQ ID NO: 9272498 - DNA, 22 bp, Homo sapiens
acacagctatggggtaggaaac

SEQ ID NO: 9272499 - DNA, 22 bp, Homo sapiens
acacagctagtgagtggcagag

SEQ ID NO: 9272500 - DNA, 22 bp, Homo sapiens
acacagcttcaaagtctaattc

SEQ ID NO: 9272501 - DNA, 22 bp, Homo sapiens
acacagctgtgcagttttttca

SEQ ID NO: 9272502 - DNA, 22 bp, Homo sapiens
acacagctttcagtcattatct

SEQ ID NO: 9272503 - DNA, 22 bp, Homo sapiens
acacagagcaaatcatgacaga

SEQ ID NO: 9272504 - DNA, 22 bp, Homo sapiens
acacagagccagggaatacagt

SEQ ID NO: 9272505 - DNA, 22 bp, Homo sapiens
acacagagccaaaccatatcac

SEQ ID NO: 9272506 - DNA, 22 bp, Homo sapiens
acacagagctggaactgcttca

SEQ ID NO: 9272507 - DNA, 22 bp, Homo sapiens
acacagagcttctcaactggga

SEQ ID NO: 9272508 - DNA, 22 bp, Homo sapiens
acacagcaacttgcagtatgga

SEQ ID NO: 9272509 - DNA, 22 bp, Homo sapiens
acacagcaacttgcagtatgga

SEQ ID NO: 9272510 - DNA, 22 bp, Homo sapiens
acacagaagctttttctattcc

SEQ ID NO: 9272511 - DNA, 22 bp, Homo sapiens
acacagaagatctcttaatgct

SEQ ID NO: 9272512 - DNA, 22 bp, Homo sapiens
acacacatgcctttcctaagta

SEQ ID NO: 9272513 - DNA, 22 bp, Homo sapiens
acacacatgcctttcctaagta

SEQ ID NO: 9272514 - DNA, 22 bp, Homo sapiens
acacagaagctttttctattcc

SEQ ID NO: 9272515 - DNA, 17 bp, Homo sapiens
acacagagattaacaca

SEQ ID NO: 9272516 - DNA, 22 bp, Homo sapiens
acaaatatttactgaatccact

SEQ ID NO: 9272517 - DNA, 22 bp, Homo sapiens
acaaatatttactgaatccact

SEQ ID NO: 9272518 - DNA, 22 bp, Homo sapiens
acaaagctagagaagagaattg

SEQ ID NO: 9272519 - DNA, 22 bp, Homo sapiens
acaaagctagagaagagaattg

SEQ ID NO: 9272520 - DNA, 22 bp, Homo sapiens
aagaatcattgtaaagttctgt

SEQ ID NO: 9272521 - DNA, 22 bp, Homo sapiens
acaaattgggtatgagctaaga

SEQ ID NO: 9272522 - DNA, 22 bp, Homo sapiens
acaaatgaatcatacataatgt

SEQ ID NO: 9272523 - DNA, 22 bp, Homo sapiens
acaaatgaatcatacataatgt

SEQ ID NO: 9272524 - DNA, 22 bp, Homo sapiens
acaaatgaacatataagcttga

SEQ ID NO: 9272525 - DNA, 22 bp, Homo sapiens
acaaatctgttttatagacttt

SEQ ID NO: 9272526 - DNA, 22 bp, Homo sapiens
acaaatgaacatataagcttga

SEQ ID NO: 9272527 - DNA, 22 bp, Homo sapiens
acaaaagtgagtgtgtctcaga

SEQ ID NO: 9272528 - DNA, 22 bp, Homo sapiens
acaaaagaataagatgagtcat

SEQ ID NO: 9272529 - DNA, 22 bp, Homo sapiens
aagaatatagattttttgaagt

SEQ ID NO: 9272530 - DNA, 22 bp, Homo sapiens
aagaatatctgttttatttagg

SEQ ID NO: 9272531 - DNA, 22 bp, Homo sapiens
aagaatatagattttttgaagt

SEQ ID NO: 9272532 - DNA, 22 bp, Homo sapiens
aagaaccaaaatgaagctaggt

SEQ ID NO: 9272533 - DNA, 22 bp, Homo sapiens
aagaactatctctggctgtagg

SEQ ID NO: 9272534 - DNA, 22 bp, Homo sapiens
aagaacattttgtagaatgaca

SEQ ID NO: 9272535 - DNA, 22 bp, Homo sapiens
aagaacattgatattgtctatg

SEQ ID NO: 9272536 - DNA, 22 bp, Homo sapiens
aagaacattgatattgtctatg

SEQ ID NO: 9272537 - DNA, 22 bp, Homo sapiens
aagaacattttgtagaatgaca

SEQ ID NO: 9272538 - DNA, 22 bp, Homo sapiens
aagaacattttgtagaatgaca

SEQ ID NO: 9272539 - DNA, 22 bp, Homo sapiens
aatgtacaagggttccagtttt

SEQ ID NO: 9272540 - DNA, 22 bp, Homo sapiens
aagaacatgttaaaagattcac

SEQ ID NO: 9272541 - DNA, 22 bp, Homo sapiens
aattttatctctaagcaggctt

SEQ ID NO: 9272542 - DNA, 22 bp, Homo sapiens
aattttatctctaagcaggctt

SEQ ID NO: 9272543 - DNA, 22 bp, Homo sapiens
aattttatctctaagcaggctt

SEQ ID NO: 9272544 - DNA, 22 bp, Homo sapiens
acaaaacagtgttcctgcccct

SEQ ID NO: 9272545 - DNA, 22 bp, Homo sapiens
aagaagatggttaactttcagt

SEQ ID NO: 9272546 - DNA, 23 bp, Homo sapiens
aagaactttggtcctgcagagtc

SEQ ID NO: 9272547 - DNA, 22 bp, Homo sapiens
aagaagaagtgttatttttaga

SEQ ID NO: 9272548 - DNA, 22 bp, Homo sapiens
aagaagagaaatgtgctgctgg

SEQ ID NO: 9272549 - DNA, 22 bp, Homo sapiens
aagaactttaaagcacttatga

SEQ ID NO: 9272550 - DNA, 22 bp, Homo sapiens
aagaacttcctaatatattttc

SEQ ID NO: 9272551 - DNA, 22 bp, Homo sapiens
aagaactttaaagcacttatga

SEQ ID NO: 9272552 - DNA, 22 bp, Homo sapiens
aagaactgtatcaagatgtagt

SEQ ID NO: 9272553 - DNA, 22 bp, Homo sapiens
aagaactgtgctccaggctcca

SEQ ID NO: 9272554 - DNA, 22 bp, Homo sapiens
aaaatttccaccatctttgtgt

SEQ ID NO: 9272555 - DNA, 22 bp, Homo sapiens
aaaattgtcgaacagtagtaac

SEQ ID NO: 9272556 - DNA, 22 bp, Homo sapiens
aaaattgtgaaggtttctgaaa

SEQ ID NO: 9272557 - DNA, 22 bp, Homo sapiens
aaaattgtcagaagttgatctt

SEQ ID NO: 9272558 - DNA, 22 bp, Homo sapiens
aaaattgtcgaacagtagtaac

SEQ ID NO: 9272559 - DNA, 22 bp, Homo sapiens
aaaattttcagcttgacttgat

SEQ ID NO: 9272560 - DNA, 22 bp, Homo sapiens
aaaattttcagcttgacttgat

SEQ ID NO: 9272561 - DNA, 22 bp, Homo sapiens
aaaattttgccctatccttcat

SEQ ID NO: 9272562 - DNA, 22 bp, Homo sapiens
aaaattttactggtgtttcctt

SEQ ID NO: 9272563 - DNA, 22 bp, Homo sapiens
aaaattttactggtgtttcctt

SEQ ID NO: 9272564 - DNA, 22 bp, Homo sapiens
aaagccagggacagtgtgcatg

SEQ ID NO: 9272565 - DNA, 22 bp, Homo sapiens
aaagctatagggtcaagcattt

SEQ ID NO: 9272566 - DNA, 22 bp, Homo sapiens
aaagctatttattacagagaat

SEQ ID NO: 9272567 - DNA, 22 bp, Homo sapiens
aaagctatttattacagagaat

SEQ ID NO: 9272568 - DNA, 22 bp, Homo sapiens
aaagctatgaggcatgcatttc

SEQ ID NO: 9272569 - DNA, 22 bp, Homo sapiens
aaagctatgaggcatgcatttc

SEQ ID NO: 9272570 - DNA, 22 bp, Homo sapiens
aaagctcacagtaatacaaggc

SEQ ID NO: 9272571 - DNA, 22 bp, Homo sapiens
aaagctcttaatgagattatcc

SEQ ID NO: 9272572 - DNA, 22 bp, Homo sapiens
aaaggagaaaacatacaggact

SEQ ID NO: 9272573 - DNA, 22 bp, Homo sapiens
aaaggagacagtcttacctgga

SEQ ID NO: 9272574 - DNA, 22 bp, Homo sapiens
aaaggttaaggtgttcaagaaa

SEQ ID NO: 9272575 - DNA, 22 bp, Homo sapiens
aaagttttattcaagcattagt

SEQ ID NO: 9272576 - DNA, 22 bp, Homo sapiens
aaagttttattcaagcattagt

SEQ ID NO: 9272577 - DNA, 22 bp, Homo sapiens
aaagttttattcaagcattagt

SEQ ID NO: 9272578 - DNA, 22 bp, Homo sapiens
aaagttttattcaagcattagt

SEQ ID NO: 9272579 - DNA, 19 bp, Homo sapiens
aaagttttattctcatttg

SEQ ID NO: 9272580 - DNA, 22 bp, Homo sapiens
aaagtttttaagcaagaccctt

SEQ ID NO: 9272581 - DNA, 22 bp, Homo sapiens
aaagttttgttgattgtggaat

SEQ ID NO: 9272582 - DNA, 22 bp, Homo sapiens
aaagttttgttgattgtggaat

SEQ ID NO: 9272583 - DNA, 22 bp, Homo sapiens
aaagttttctgccttcattaga

SEQ ID NO: 9272584 - DNA, 22 bp, Homo sapiens
aaagttttctgccttcattaga

SEQ ID NO: 9272585 - DNA, 22 bp, Homo sapiens
aaagttcattgatgactgaggt

SEQ ID NO: 9272586 - DNA, 22 bp, Homo sapiens
aaagtcatctaggagcagattt

SEQ ID NO: 9272587 - DNA, 22 bp, Homo sapiens
aaagtacatgtttggccatttg

SEQ ID NO: 9272588 - DNA, 22 bp, Homo sapiens
aaagtcaggctgtgtacctaac

SEQ ID NO: 9272589 - DNA, 22 bp, Homo sapiens
aaagtcagttggccagatcact

SEQ ID NO: 9272590 - DNA, 22 bp, Homo sapiens
aaagtacagatggtgaggttgg

SEQ ID NO: 9272591 - DNA, 22 bp, Homo sapiens
aaagtacaatattgagattgat

SEQ ID NO: 9272592 - DNA, 22 bp, Homo sapiens
aaagtacaatattgagattgat

SEQ ID NO: 9272593 - DNA, 22 bp, Homo sapiens
aaagtacaaggaaaggatctga

SEQ ID NO: 9272594 - DNA, 22 bp, Homo sapiens
aaaggttagacagctctgcata

SEQ ID NO: 9272595 - DNA, 22 bp, Homo sapiens
aaagacacacagccagcaagtg

SEQ ID NO: 9272596 - DNA, 23 bp, Homo sapiens
aaatgtgagggaaaatctttctg

SEQ ID NO: 9272597 - DNA, 22 bp, Homo sapiens
aaatgtgagactgagttttcct

SEQ ID NO: 9272598 - DNA, 22 bp, Homo sapiens
aaatgtctttcaatagagaaat

SEQ ID NO: 9272599 - DNA, 22 bp, Homo sapiens
aaatgtctttcaatagagaaat

SEQ ID NO: 9272600 - DNA, 22 bp, Homo sapiens
aaatgtctttgagtatttctgc

SEQ ID NO: 9272601 - DNA, 22 bp, Homo sapiens
aaatgtgacagatgcagtacag

SEQ ID NO: 9272602 - DNA, 22 bp, Homo sapiens
aaagacatcagaaccagctgag

SEQ ID NO: 9272603 - DNA, 22 bp, Homo sapiens
aaagacatatttctaagtttat

SEQ ID NO: 9272604 - DNA, 22 bp, Homo sapiens
aaagacagtggattcaaaatcc

SEQ ID NO: 9272605 - DNA, 22 bp, Homo sapiens
aaagacagatggcaaggatgat

SEQ ID NO: 9272606 - DNA, 22 bp, Homo sapiens
aaagacagatggcaaggatgat

SEQ ID NO: 9272607 - DNA, 22 bp, Homo sapiens
aaagacacatgtctcttagatt

SEQ ID NO: 9272608 - DNA, 22 bp, Homo sapiens
aaacttcaaggatttgcaaatc

SEQ ID NO: 9272609 - DNA, 22 bp, Homo sapiens
aaacttcaaggatttgcaaatc

SEQ ID NO: 9272610 - DNA, 22 bp, Homo sapiens
aaacttcagggaataaaagagt

SEQ ID NO: 9272611 - DNA, 22 bp, Homo sapiens
aaacttcatggataatataaag

SEQ ID NO: 9272612 - DNA, 17 bp, Homo sapiens
aaacttcattctcagga

SEQ ID NO: 9272613 - DNA, 22 bp, Homo sapiens
aaacttcagtgaatgacttatg

SEQ ID NO: 9272614 - DNA, 22 bp, Homo sapiens
aaatgtctgagacttctgaact

SEQ ID NO: 9272615 - DNA, 22 bp, Homo sapiens
aaatggtgtttctaatgctaga

SEQ ID NO: 9272616 - DNA, 22 bp, Homo sapiens
aaatgtctttatctcatgtaac

SEQ ID NO: 9272617 - DNA, 23 bp, Homo sapiens
aaatgtcttctagctcttgagaa

SEQ ID NO: 9272618 - DNA, 22 bp, Homo sapiens
aaatgtctgtatgagaaagaga

SEQ ID NO: 9272619 - DNA, 22 bp, Homo sapiens
aaatgtctgttagtcatatcat

SEQ ID NO: 9272620 - DNA, 22 bp, Homo sapiens
aaatgtctgttagtcatatcat

SEQ ID NO: 9272621 - DNA, 22 bp, Homo sapiens
aaatgaactcaatgatctccca

SEQ ID NO: 9272622 - DNA, 22 bp, Homo sapiens
aaatgaactcttcctgcatccc

SEQ ID NO: 9272623 - DNA, 21 bp, Homo sapiens
aaatgaatgtggtagtgcaag

SEQ ID NO: 9272624 - DNA, 21 bp, Homo sapiens
aaatgaatgtggtagtgcaag

SEQ ID NO: 9272625 - DNA, 22 bp, Homo sapiens
aaatgacactaggctttttgca

SEQ ID NO: 9272626 - DNA, 22 bp, Homo sapiens
aaatgacactaggctttttgca

SEQ ID NO: 9272627 - DNA, 22 bp, Homo sapiens
aaatgacactaggctttttgca

SEQ ID NO: 9272628 - DNA, 22 bp, Homo sapiens
aaatgacaataaaagtccatgc

SEQ ID NO: 9272629 - DNA, 22 bp, Homo sapiens
aaatgacaataaaagtccatgc

SEQ ID NO: 9272630 - DNA, 22 bp, Homo sapiens
aaatgacactcattcagtgtca

SEQ ID NO: 9272631 - DNA, 22 bp, Homo sapiens
aaatgacactcattcagtgtca

SEQ ID NO: 9272632 - DNA, 22 bp, Homo sapiens
aaatgacagagtaagctgttta

SEQ ID NO: 9272633 - DNA, 22 bp, Homo sapiens
aaatgacagagtaagctgttta

SEQ ID NO: 9272634 - DNA, 22 bp, Homo sapiens
aaatacagagttgcttaaaagc

SEQ ID NO: 9272635 - DNA, 22 bp, Homo sapiens
aaatacagatagatttaaccca

SEQ ID NO: 9272636 - DNA, 22 bp, Homo sapiens
aaataaaggtccactttagggc

SEQ ID NO: 9272637 - DNA, 22 bp, Homo sapiens
aaataaaggtccactttagggc

SEQ ID NO: 9272638 - DNA, 22 bp, Homo sapiens
aaataacagtcagggacaacat

SEQ ID NO: 9272639 - DNA, 22 bp, Homo sapiens
aaatacacgtacatgtgtaaaa

SEQ ID NO: 9272640 - DNA, 22 bp, Homo sapiens
aaaacattctgtgaactctcaa

SEQ ID NO: 9272641 - DNA, 22 bp, Homo sapiens
aaaacatgtccatacagaaact

SEQ ID NO: 9272642 - DNA, 22 bp, Homo sapiens
aaaacattttactgccatctca

SEQ ID NO: 9272643 - DNA, 22 bp, Homo sapiens
aaaacattttactgccatctca

SEQ ID NO: 9272644 - DNA, 22 bp, Homo sapiens
aaaacattgaattgcacactat

SEQ ID NO: 9272645 - DNA, 22 bp, Homo sapiens
aaaacattgaattgcacactat

SEQ ID NO: 9272646 - DNA, 22 bp, Homo sapiens
aaaagagtgactgataagtata

SEQ ID NO: 9272647 - DNA, 22 bp, Homo sapiens
aaaaccaggcgtttcctattat

SEQ ID NO: 9272648 - DNA, 22 bp, Homo sapiens
aaaagaggttaaccaggtgtgt

SEQ ID NO: 9272649 - DNA, 22 bp, Homo sapiens
aaaagaggttaaccaggtgtgt

SEQ ID NO: 9272650 - DNA, 22 bp, Homo sapiens
aaaagaggttaaccaggtgtgt

SEQ ID NO: 9272651 - DNA, 22 bp, Homo sapiens
aaaaccagacactgtttctggg

SEQ ID NO: 9272652 - DNA, 22 bp, Homo sapiens
aaaaccaagttttccttagtct

SEQ ID NO: 9272653 - DNA, 22 bp, Homo sapiens
aaaagcaagaggctggattaaa

SEQ ID NO: 9272654 - DNA, 22 bp, Homo sapiens
aaaagcaaggcagtctgtctga

SEQ ID NO: 9272655 - DNA, 22 bp, Homo sapiens
aaaagcaagttgcctaggttga

SEQ ID NO: 9272656 - DNA, 22 bp, Homo sapiens
aaaaatctatgactgcttctcc

SEQ ID NO: 9272657 - DNA, 22 bp, Homo sapiens
aaaagagtgtttcaactttggc

SEQ ID NO: 9272658 - DNA, 22 bp, Homo sapiens
aaaagcaagaggctggattaaa

SEQ ID NO: 9272659 - DNA, 22 bp, Homo sapiens
aaaagagtgactgataagtata

SEQ ID NO: 9272660 - DNA, 20 bp, Homo sapiens
aaaagagtgcttcaactgct

SEQ ID NO: 9272661 - DNA, 22 bp, Homo sapiens
aaaaatttatggttcttctctg

SEQ ID NO: 9272662 - DNA, 22 bp, Homo sapiens
aaaaattgctgagaacggaatt

SEQ ID NO: 9272663 - DNA, 22 bp, Homo sapiens
aaaaatttatggttcttctctg

SEQ ID NO: 9272664 - DNA, 22 bp, Homo sapiens
aaaagccaaggtcctcttcaga

SEQ ID NO: 9272665 - DNA, 20 bp, Homo sapiens
aaaagcagccagagatggta

SEQ ID NO: 9272666 - DNA, 22 bp, Homo sapiens
aaaagcagttatctgggaggaa

SEQ ID NO: 9272667 - DNA, 22 bp, Homo sapiens
aaaagcaggtactcagcttggg

SEQ ID NO: 9272668 - DNA, 22 bp, Homo sapiens
aaaagcagttatctgggaggaa

SEQ ID NO: 9272669 - DNA, 22 bp, Homo sapiens
aaaagcagtttatagtcagttg

SEQ ID NO: 9272670 - DNA, 22 bp, Homo sapiens
aaaagcagagactctggagcta

SEQ ID NO: 9272671 - DNA, 20 bp, Homo sapiens
aaaagcagccagagatggta

SEQ ID NO: 9272672 - DNA, 22 bp, Homo sapiens
aaaagcagatctccaaagtcta

SEQ ID NO: 9272673 - DNA, 22 bp, Homo sapiens
aaaagcagagactctggagcta

SEQ ID NO: 9272674 - DNA, 22 bp, Homo sapiens
aaaagcaattgcgggttttgcc

SEQ ID NO: 9272675 - DNA, 22 bp, Homo sapiens
aaaagcaagttgcctaggttga

SEQ ID NO: 9272676 - DNA, 22 bp, Homo sapiens
aaaacagtttaggcatcacagt

SEQ ID NO: 9272677 - DNA, 22 bp, Homo sapiens
aaaacagtttaggcatcacagt

SEQ ID NO: 9272678 - DNA, 22 bp, Homo sapiens
aaaacagtttaggcatcacagt

SEQ ID NO: 9272679 - DNA, 22 bp, Homo sapiens
aaaacagttataaacagagtca

SEQ ID NO: 9272680 - DNA, 22 bp, Homo sapiens
aaaacagttataaacagagtca

SEQ ID NO: 9272681 - DNA, 22 bp, Homo sapiens
aaaacaggagttttggtaggct

SEQ ID NO: 9272682 - DNA, 22 bp, Homo sapiens
aaaacacaagaagcagggtaca

SEQ ID NO: 9272683 - DNA, 22 bp, Homo sapiens
aaaacacaagaagcagggtaca

SEQ ID NO: 9272684 - DNA, 22 bp, Homo sapiens
aaaacacactggaccaatttaa

SEQ ID NO: 9272685 - DNA, 22 bp, Homo sapiens
aaaacactgcaaagctgattgg

SEQ ID NO: 9272686 - DNA, 22 bp, Homo sapiens
aaaacacactggaccaatttaa

SEQ ID NO: 9272687 - DNA, 22 bp, Homo sapiens
aaaacactgcaaagctgattgg

SEQ ID NO: 9272688 - DNA, 22 bp, Homo sapiens
aaaacactgcaaagctgattgg

SEQ ID NO: 9272689 - DNA, 22 bp, Homo sapiens
aaaacagaggtgcctgggccca

SEQ ID NO: 9272690 - DNA, 23 bp, Homo sapiens
aaaacagcttcctccagtggctc

SEQ ID NO: 9272691 - DNA, 22 bp, Homo sapiens
aaaacagacagccagtgtagag

SEQ ID NO: 9272692 - DNA, 22 bp, Homo sapiens
aaaacagacagccagtgtagag

SEQ ID NO: 9272693 - DNA, 22 bp, Homo sapiens
aaaacactgcctgcttgactga

SEQ ID NO: 9272694 - DNA, 22 bp, Homo sapiens
aaaacactgcctgcttgactga

SEQ ID NO: 9272695 - DNA, 22 bp, Homo sapiens
aaaatgcatgagaatgtgctcg

SEQ ID NO: 9272696 - DNA, 22 bp, Homo sapiens
aaaatgcatgagaatgtgctcg

SEQ ID NO: 9272697 - DNA, 18 bp, Homo sapiens
aaaatgcaggcgacatgg

SEQ ID NO: 9272698 - DNA, 18 bp, Homo sapiens
aaaatgcaggcgacatgg

SEQ ID NO: 9272699 - DNA, 18 bp, Homo sapiens
aaaatgcaggcgacatgg

SEQ ID NO: 9272700 - DNA, 22 bp, Homo sapiens
aaaatgtaaagcttgagtgtag

SEQ ID NO: 9272701 - DNA, 20 bp, Homo sapiens
aaaatgatgggcagggcagg

SEQ ID NO: 9272702 - DNA, 22 bp, Homo sapiens
aaaatgcaaacctacctacata

SEQ ID NO: 9272703 - DNA, 22 bp, Homo sapiens
aaaatgatgctgtaatttggca

SEQ ID NO: 9272704 - DNA, 22 bp, Homo sapiens
aaaatgatatcctgacttttat

SEQ ID NO: 9272705 - DNA, 22 bp, Homo sapiens
aaaatgatatcctgacttttat

SEQ ID NO: 9272706 - DNA, 22 bp, Homo sapiens
aaaatgatatcctgacttttat

SEQ ID NO: 9272707 - DNA, 22 bp, Homo sapiens
aaagcagcggtgtctttactgc

SEQ ID NO: 9272708 - DNA, 22 bp, Homo sapiens
aaagcagctgctctggccttga

SEQ ID NO: 9272709 - DNA, 22 bp, Homo sapiens
aaagcagccacagagagagcgt

SEQ ID NO: 9272710 - DNA, 22 bp, Homo sapiens
aaagcagcagcacctgcatttc

SEQ ID NO: 9272711 - DNA, 22 bp, Homo sapiens
aaagcagcagcacgtggaagag

SEQ ID NO: 9272712 - DNA, 21 bp, Homo sapiens
aaaatgtagacttttccctga

SEQ ID NO: 9272713 - DNA, 22 bp, Homo sapiens
aaagcaatggcacatgatggta

SEQ ID NO: 9272714 - DNA, 22 bp, Homo sapiens
aaagcaatggatgagaatctgt

SEQ ID NO: 9272715 - DNA, 22 bp, Homo sapiens
aaagcaatggatgagaatctgt

SEQ ID NO: 9272716 - DNA, 22 bp, Homo sapiens
aaaagctctttctgctgtagat

SEQ ID NO: 9272717 - DNA, 22 bp, Homo sapiens
aaaagctctttctgctgtagat

SEQ ID NO: 9272718 - DNA, 22 bp, Homo sapiens
aaaagctttgttaataggtttg

SEQ ID NO: 9272719 - DNA, 22 bp, Homo sapiens
aaaaggacaagctttggagtta

SEQ ID NO: 9272720 - DNA, 22 bp, Homo sapiens
aaaagttacctctgtaatataa

SEQ ID NO: 9272721 - DNA, 22 bp, Homo sapiens
aaaagtttaagactcattctag

SEQ ID NO: 9272722 - DNA, 22 bp, Homo sapiens
aaaagtttaagactcattctag

SEQ ID NO: 9272723 - DNA, 22 bp, Homo sapiens
aaaataacttctactatttgca

SEQ ID NO: 9272724 - DNA, 22 bp, Homo sapiens
aaaataacttctactatttgca

SEQ ID NO: 9272725 - DNA, 22 bp, Homo sapiens
aaaataacttctactatttgca

SEQ ID NO: 9272726 - DNA, 22 bp, Homo sapiens
aaaataacttctactatttgca

SEQ ID NO: 9272727 - DNA, 22 bp, Homo sapiens
aaaataacttctactatttgca

SEQ ID NO: 9272728 - DNA, 22 bp, Homo sapiens
aaaataacttctactatttgca

SEQ ID NO: 9272729 - DNA, 18 bp, Homo sapiens
aaaataacaaagttggct

SEQ ID NO: 9272730 - DNA, 21 bp, Homo sapiens
aaaagtttgacaggaaaggga

SEQ ID NO: 9272731 - DNA, 22 bp, Homo sapiens
aaaagtttgtgcaaacactcag

SEQ ID NO: 9272732 - DNA, 22 bp, Homo sapiens
aaaatactgtggagtgttgaaa

SEQ ID NO: 9272733 - DNA, 22 bp, Homo sapiens
aaaatactactgtcttcttccc

SEQ ID NO: 9272734 - DNA, 22 bp, Homo sapiens
aaaatgagatacagtttgaaag

SEQ ID NO: 9272735 - DNA, 22 bp, Homo sapiens
aaaatgagcatattgatccttt

SEQ ID NO: 9272736 - DNA, 22 bp, Homo sapiens
aaagtcctgactgcaggggatg

SEQ ID NO: 9272737 - DNA, 22 bp, Homo sapiens
aaagtcctagcgatccacagaa

SEQ ID NO: 9272738 - DNA, 22 bp, Homo sapiens
aaagtcctgttaactgttaaca

SEQ ID NO: 9272739 - DNA, 22 bp, Homo sapiens
aaagtccttgcagtttcctctt

SEQ ID NO: 9272740 - DNA, 22 bp, Homo sapiens
aaagtcctttttgccatgcaag

SEQ ID NO: 9272741 - DNA, 20 bp, Homo sapiens
aaagtctgtttatctctgga

SEQ ID NO: 9272742 - DNA, 20 bp, Homo sapiens
aaagtcttatggttaatttt

SEQ ID NO: 9272743 - DNA, 22 bp, Homo sapiens
aaagtctttattttgtatcttt

SEQ ID NO: 9272744 - DNA, 22 bp, Homo sapiens
aacttccttctagttcatatgt

SEQ ID NO: 9272745 - DNA, 22 bp, Homo sapiens
aacttccttctagttcatatgt

SEQ ID NO: 9272746 - DNA, 22 bp, Homo sapiens
aacttccaacccagaagcctaa

SEQ ID NO: 9272747 - DNA, 22 bp, Homo sapiens
aacttccaggccttgaattatt

SEQ ID NO: 9272748 - DNA, 22 bp, Homo sapiens
aacttcttggtcctgagctgtt

SEQ ID NO: 9272749 - DNA, 22 bp, Homo sapiens
aaagttctagagttgcaagaga

SEQ ID NO: 9272750 - DNA, 22 bp, Homo sapiens
aaagttctattggatagtgctg

SEQ ID NO: 9272751 - DNA, 22 bp, Homo sapiens
aaagttctgggggtgtttctgg

SEQ ID NO: 9272752 - DNA, 22 bp, Homo sapiens
aaagttcttcatttttattgga

SEQ ID NO: 9272753 - DNA, 22 bp, Homo sapiens
aaagttctggcattttctgtct

SEQ ID NO: 9272754 - DNA, 22 bp, Homo sapiens
aaagggagcatggctgcaggga

SEQ ID NO: 9272755 - DNA, 22 bp, Homo sapiens
aaagggagcatggctgcaggga

SEQ ID NO: 9272756 - DNA, 22 bp, Homo sapiens
aaagggaggggcgataagccgg

SEQ ID NO: 9272757 - DNA, 22 bp, Homo sapiens
aaagggaggggcgataagccgg

SEQ ID NO: 9272758 - DNA, 22 bp, Homo sapiens
aaagggaatgtgtaggacatgt

SEQ ID NO: 9272759 - DNA, 22 bp, Homo sapiens
aaaggctccttctcccatgacc

SEQ ID NO: 9272760 - DNA, 22 bp, Homo sapiens
aaaggctcatacagaaaataca

SEQ ID NO: 9272761 - DNA, 22 bp, Homo sapiens
aacatgaagttttctatagtga

SEQ ID NO: 9272762 - DNA, 22 bp, Homo sapiens
aacatgatgtattttcttgtct

SEQ ID NO: 9272763 - DNA, 21 bp, Homo sapiens
aacatgatatgtgtatggatt

SEQ ID NO: 9272764 - DNA, 22 bp, Homo sapiens
aacatgatgacattgtaagctt

SEQ ID NO: 9272765 - DNA, 22 bp, Homo sapiens
aacatgatgacaaaggtatatt

SEQ ID NO: 9272766 - DNA, 22 bp, Homo sapiens
aacatgatgacaaaggtatatt

SEQ ID NO: 9272767 - DNA, 22 bp, Homo sapiens
aacatgatttcatgcatttaga

SEQ ID NO: 9272768 - DNA, 22 bp, Homo sapiens
aacatgatttagtataatgcag

SEQ ID NO: 9272769 - DNA, 22 bp, Homo sapiens
aacatgattggaaaatgctgtc

SEQ ID NO: 9272770 - DNA, 22 bp, Homo sapiens
aaaggcatgcctccatttctat

SEQ ID NO: 9272771 - DNA, 22 bp, Homo sapiens
aaaggcatgattaattctgtgt

SEQ ID NO: 9272772 - DNA, 22 bp, Homo sapiens
aacatgatttagtataatgcag

SEQ ID NO: 9272773 - DNA, 22 bp, Homo sapiens
aaagcagtgcaccttaattgat

SEQ ID NO: 9272774 - DNA, 22 bp, Homo sapiens
aaagcagtctcagacttaagca

SEQ ID NO: 9272775 - DNA, 22 bp, Homo sapiens
aaagcagtctgttttaacctga

SEQ ID NO: 9272776 - DNA, 22 bp, Homo sapiens
aaagcagtcactccagtgtgat

SEQ ID NO: 9272777 - DNA, 22 bp, Homo sapiens
aaagcagtccttcccttaaggt

SEQ ID NO: 9272778 - DNA, 20 bp, Homo sapiens
aaagcagtatgcaagtagag

SEQ ID NO: 9272779 - DNA, 22 bp, Homo sapiens
aaagcagtatgaaaggcaataa

SEQ ID NO: 9272780 - DNA, 22 bp, Homo sapiens
aaagcagtagttttcaaatagt

SEQ ID NO: 9272781 - DNA, 22 bp, Homo sapiens
aaagcagtataagtaacggaag

SEQ ID NO: 9272782 - DNA, 22 bp, Homo sapiens
aaagcagtatagtggaagggct

SEQ ID NO: 9272783 - DNA, 22 bp, Homo sapiens
aaagcagtatattggtagttgt

SEQ ID NO: 9272784 - DNA, 22 bp, Homo sapiens
aaagcagcaagtatttgttact

SEQ ID NO: 9272785 - DNA, 22 bp, Homo sapiens
aaagcagcaagtatttgttact

SEQ ID NO: 9272786 - DNA, 22 bp, Homo sapiens
aaattgtaggatcacatgacct

SEQ ID NO: 9272787 - DNA, 22 bp, Homo sapiens
aaattggattttaaactgttgg

SEQ ID NO: 9272788 - DNA, 22 bp, Homo sapiens
aaattgctctttaaaagtactg

SEQ ID NO: 9272789 - DNA, 22 bp, Homo sapiens
aaattgctgacacttgaccatt

SEQ ID NO: 9272790 - DNA, 22 bp, Homo sapiens
aaattgctgaccaagtatattc

SEQ ID NO: 9272791 - DNA, 22 bp, Homo sapiens
aaattccattaggaaacttcca

SEQ ID NO: 9272792 - DNA, 22 bp, Homo sapiens
aaattccattatgataatttcg

SEQ ID NO: 9272793 - DNA, 22 bp, Homo sapiens
aaattccattatgataatttcg

SEQ ID NO: 9272794 - DNA, 22 bp, Homo sapiens
aaattccagttcttttacctgc

SEQ ID NO: 9272795 - DNA, 22 bp, Homo sapiens
aaattccagcaacaccttttta

SEQ ID NO: 9272796 - DNA, 22 bp, Homo sapiens
aaattccagttcttttacctgc

SEQ ID NO: 9272797 - DNA, 22 bp, Homo sapiens
aaattccagaaactcagtatat

SEQ ID NO: 9272798 - DNA, 22 bp, Homo sapiens
aaattccagaaactcagtatat

SEQ ID NO: 9272799 - DNA, 22 bp, Homo sapiens
aaattccagaaactcagtatat

SEQ ID NO: 9272800 - DNA, 22 bp, Homo sapiens
aaattcagcatcctgcactgga

SEQ ID NO: 9272801 - DNA, 22 bp, Homo sapiens
aaattcagttcctcagccacat

SEQ ID NO: 9272802 - DNA, 22 bp, Homo sapiens
aaattagatcagtggattttct

SEQ ID NO: 9272803 - DNA, 22 bp, Homo sapiens
aaattagatcagtggattttct

SEQ ID NO: 9272804 - DNA, 22 bp, Homo sapiens
aaattcatttttcttagtgtgc

SEQ ID NO: 9272805 - DNA, 22 bp, Homo sapiens
aaattccaccagaatcagtaat

SEQ ID NO: 9272806 - DNA, 22 bp, Homo sapiens
aaattcatatgttgaaatgcta

SEQ ID NO: 9272807 - DNA, 22 bp, Homo sapiens
aaattcagttttaataatcact

SEQ ID NO: 9272808 - DNA, 22 bp, Homo sapiens
aaagcatgtgaatagaatatgg

SEQ ID NO: 9272809 - DNA, 22 bp, Homo sapiens
aaagcatggttaaagacagtgg

SEQ ID NO: 9272810 - DNA, 22 bp, Homo sapiens
aaagcatggcatgaagaacatg

SEQ ID NO: 9272811 - DNA, 22 bp, Homo sapiens
aaagcatgattagatagatgat

SEQ ID NO: 9272812 - DNA, 22 bp, Homo sapiens
aaagcatggcatgaagaacatg

SEQ ID NO: 9272813 - DNA, 22 bp, Homo sapiens
aaagcatgctactttatatagg

SEQ ID NO: 9272814 - DNA, 22 bp, Homo sapiens
aaagcagtgctgtgagaacact

SEQ ID NO: 9272815 - DNA, 22 bp, Homo sapiens
aaagcagtgctgtgagaacact

SEQ ID NO: 9272816 - DNA, 21 bp, Homo sapiens
aaagcagttcttcctgcctct

SEQ ID NO: 9272817 - DNA, 19 bp, Homo sapiens
aaagcagtgcatcctcttt

SEQ ID NO: 9272818 - DNA, 21 bp, Homo sapiens
aaagcatcacgaacatttggg

SEQ ID NO: 9272819 - DNA, 22 bp, Homo sapiens
aaagcatgactcaagaattact

SEQ ID NO: 9272820 - DNA, 22 bp, Homo sapiens
aaagcatgactcaagaattact

SEQ ID NO: 9272821 - DNA, 22 bp, Homo sapiens
aaagcatgactcaagaattact

SEQ ID NO: 9272822 - DNA, 22 bp, Homo sapiens
aaagccaaatgaaagatggttc

SEQ ID NO: 9272823 - DNA, 22 bp, Homo sapiens
aaagccaagctgggaaggcagg

SEQ ID NO: 9272824 - DNA, 23 bp, Homo sapiens
aaagccaagtcagtctactggaa

SEQ ID NO: 9272825 - DNA, 23 bp, Homo sapiens
aaagccaagtcagtctactggaa

SEQ ID NO: 9272826 - DNA, 20 bp, Homo sapiens
aaaggaatatatgaagtata

SEQ ID NO: 9272827 - DNA, 22 bp, Homo sapiens
aaaggaatattcaaaacagtca

SEQ ID NO: 9272828 - DNA, 22 bp, Homo sapiens
aaaggaggccacatggctagga

SEQ ID NO: 9272829 - DNA, 22 bp, Homo sapiens
aaaggaggccacatggctagga

SEQ ID NO: 9272830 - DNA, 22 bp, Homo sapiens
aaaggataaggttatcaatttt

SEQ ID NO: 9272831 - DNA, 22 bp, Homo sapiens
aaaggcactgatcttatccagt

SEQ ID NO: 9272832 - DNA, 22 bp, Homo sapiens
aaaggcactggatagctgggga

SEQ ID NO: 9272833 - DNA, 20 bp, Homo sapiens
aaaggcacagcaacagagct

SEQ ID NO: 9272834 - DNA, 22 bp, Homo sapiens
aaaggcactagaagttaccttt

SEQ ID NO: 9272835 - DNA, 22 bp, Homo sapiens
aacatgaaagttgctaagtgca

SEQ ID NO: 9272836 - DNA, 22 bp, Homo sapiens
aacatgaaggtaggatggtttt

SEQ ID NO: 9272837 - DNA, 22 bp, Homo sapiens
aacatgaaacccaaacagaata

SEQ ID NO: 9272838 - DNA, 22 bp, Homo sapiens
aaatgactaatgatcctgggca

SEQ ID NO: 9272839 - DNA, 23 bp, Homo sapiens
aaatgacatatggtttctgaagg

SEQ ID NO: 9272840 - DNA, 23 bp, Homo sapiens
aaatgacatatggtttctgaagg

SEQ ID NO: 9272841 - DNA, 22 bp, Homo sapiens
aaatgatagtatggaactagga

SEQ ID NO: 9272842 - DNA, 22 bp, Homo sapiens
aaatgatagtatggaactagga

SEQ ID NO: 9272843 - DNA, 22 bp, Homo sapiens
aaatcagagtagaattgagcca

SEQ ID NO: 9272844 - DNA, 22 bp, Homo sapiens
aaatcagagtctgattttaagg

SEQ ID NO: 9272845 - DNA, 22 bp, Homo sapiens
aaatcagagtctgattttaagg

SEQ ID NO: 9272846 - DNA, 22 bp, Homo sapiens
aaatgaacagttgcattctctg

SEQ ID NO: 9272847 - DNA, 22 bp, Homo sapiens
aaatgaacatcaagaatagcct

SEQ ID NO: 9272848 - DNA, 22 bp, Homo sapiens
aaatcagacacagtgaaagtta

SEQ ID NO: 9272849 - DNA, 22 bp, Homo sapiens
aaatcagaggcaacaactactt

SEQ ID NO: 9272850 - DNA, 22 bp, Homo sapiens
aaatcagaggtcagctgtacca

SEQ ID NO: 9272851 - DNA, 22 bp, Homo sapiens
aaatcagagaatatatttagaa

SEQ ID NO: 9272852 - DNA, 22 bp, Homo sapiens
aaatcagacttgaattttcatc

SEQ ID NO: 9272853 - DNA, 22 bp, Homo sapiens
aaatcagacttgaattttcatc

SEQ ID NO: 9272854 - DNA, 19 bp, Homo sapiens
aaatcagaatctgcatttt

SEQ ID NO: 9272855 - DNA, 22 bp, Homo sapiens
aaatcagaaaatatggagagga

SEQ ID NO: 9272856 - DNA, 23 bp, Homo sapiens
aaatattcttttttagtaagtgc

SEQ ID NO: 9272857 - DNA, 23 bp, Homo sapiens
aaatattcttttttagtaagtgc

SEQ ID NO: 9272858 - DNA, 22 bp, Homo sapiens
aaatattggtaggatgcttgtt

SEQ ID NO: 9272859 - DNA, 22 bp, Homo sapiens
aaatattggtaggatgcttgtt

SEQ ID NO: 9272860 - DNA, 22 bp, Homo sapiens
aaatattgttttggtaagcttc

SEQ ID NO: 9272861 - DNA, 22 bp, Homo sapiens
aaatatttgtctgaggcggttg

SEQ ID NO: 9272862 - DNA, 22 bp, Homo sapiens
aaatcaaaagacatgtgtttta

SEQ ID NO: 9272863 - DNA, 17 bp, Homo sapiens
aaatcactgtcagttca

SEQ ID NO: 9272864 - DNA, 17 bp, Homo sapiens
aaatcactgtcagttca

SEQ ID NO: 9272865 - DNA, 22 bp, Homo sapiens
aaatcactgattaaagttagaa

SEQ ID NO: 9272866 - DNA, 22 bp, Homo sapiens
aaatcacttaaatggcttattt

SEQ ID NO: 9272867 - DNA, 22 bp, Homo sapiens
aaatcactgttattgatcttaa

SEQ ID NO: 9272868 - DNA, 22 bp, Homo sapiens
aaatcactaagttatagtgtgg

SEQ ID NO: 9272869 - DNA, 22 bp, Homo sapiens
aaatcactaagttatagtgtgg

SEQ ID NO: 9272870 - DNA, 22 bp, Homo sapiens
aaatcactaagttatagtgtgg

SEQ ID NO: 9272871 - DNA, 22 bp, Homo sapiens
aaatgctgtagatcagtgagtt

SEQ ID NO: 9272872 - DNA, 22 bp, Homo sapiens
aaatgctgtaactgatattctg

SEQ ID NO: 9272873 - DNA, 22 bp, Homo sapiens
aaatgccaggattattagaggc

SEQ ID NO: 9272874 - DNA, 22 bp, Homo sapiens
aaatgctgggaaccattggatc

SEQ ID NO: 9272875 - DNA, 22 bp, Homo sapiens
aaatgctgcagctagtgtgttt

SEQ ID NO: 9272876 - DNA, 22 bp, Homo sapiens
aaatgcttagaggtgttcaaat

SEQ ID NO: 9272877 - DNA, 22 bp, Homo sapiens
aaatgcttagaggtgttcaaat

SEQ ID NO: 9272878 - DNA, 22 bp, Homo sapiens
aaatgcttgctcttgattattt

SEQ ID NO: 9272879 - DNA, 22 bp, Homo sapiens
aaatgcttgtaaattttccatg

SEQ ID NO: 9272880 - DNA, 20 bp, Homo sapiens
aaatgcttttgacacatatt

SEQ ID NO: 9272881 - DNA, 22 bp, Homo sapiens
aaatggaaaatgctgttttggt

SEQ ID NO: 9272882 - DNA, 22 bp, Homo sapiens
aaatgcaaggccatgtgaagga

SEQ ID NO: 9272883 - DNA, 22 bp, Homo sapiens
aaatgatgctcacagattagtg

SEQ ID NO: 9272884 - DNA, 22 bp, Homo sapiens
aaatgatggaaatgaggctgaa

SEQ ID NO: 9272885 - DNA, 20 bp, Homo sapiens
aaatgatgggaataatctat

SEQ ID NO: 9272886 - DNA, 22 bp, Homo sapiens
aaatgatgttataagaccagga

SEQ ID NO: 9272887 - DNA, 22 bp, Homo sapiens
aaatgcacacaccaggaaacta

SEQ ID NO: 9272888 - DNA, 22 bp, Homo sapiens
aaatgcacacaccaggaaacta

SEQ ID NO: 9272889 - DNA, 22 bp, Homo sapiens
aaatgcaattgtatgtactcca

SEQ ID NO: 9272890 - DNA, 22 bp, Homo sapiens
aaatgcaattgtatgtactcca

SEQ ID NO: 9272891 - DNA, 22 bp, Homo sapiens
aaatgcacaaagattttgcact

SEQ ID NO: 9272892 - DNA, 22 bp, Homo sapiens
aagaagcattctttcattggtt

SEQ ID NO: 9272893 - DNA, 22 bp, Homo sapiens
aagaagcaggtcacagacaggg

SEQ ID NO: 9272894 - DNA, 22 bp, Homo sapiens
aagaagctgtagggattaactc

SEQ ID NO: 9272895 - DNA, 22 bp, Homo sapiens
aaagttgttcagtaagaaactc

SEQ ID NO: 9272896 - DNA, 22 bp, Homo sapiens
aaagttgcagtgaaataaggct

SEQ ID NO: 9272897 - DNA, 23 bp, Homo sapiens
aaagttgatttgcagtttaagag

SEQ ID NO: 9272898 - DNA, 22 bp, Homo sapiens
aaagttgcaggtggtgagaggt

SEQ ID NO: 9272899 - DNA, 22 bp, Homo sapiens
aaagttgagttttatgtgttac

SEQ ID NO: 9272900 - DNA, 22 bp, Homo sapiens
aaagttgataaggtatcgtagt

SEQ ID NO: 9272901 - DNA, 21 bp, Homo sapiens
aaagttgatttagattggtga

SEQ ID NO: 9272902 - DNA, 22 bp, Homo sapiens
aagaaggtgtggaaagatgctc

SEQ ID NO: 9272903 - DNA, 22 bp, Homo sapiens
aagaaggcggaccagaagggag

SEQ ID NO: 9272904 - DNA, 22 bp, Homo sapiens
aaatacataaaggttgtaccag

SEQ ID NO: 9272905 - DNA, 22 bp, Homo sapiens
aaatacatacactgtacgtggc

SEQ ID NO: 9272906 - DNA, 22 bp, Homo sapiens
aagagagaactcccttcgccag

SEQ ID NO: 9272907 - DNA, 22 bp, Homo sapiens
aagagagaactcccttcgccag

SEQ ID NO: 9272908 - DNA, 22 bp, Homo sapiens
aaatacagtggcagcagataat

SEQ ID NO: 9272909 - DNA, 22 bp, Homo sapiens
aagagttttagacaaactgatt

SEQ ID NO: 9272910 - DNA, 22 bp, Homo sapiens
aagagttttctataatcttggc

SEQ ID NO: 9272911 - DNA, 22 bp, Homo sapiens
aagagtttgggcaagtcataaa

SEQ ID NO: 9272912 - DNA, 22 bp, Homo sapiens
aagagtttgacctgtgccatcc

SEQ ID NO: 9272913 - DNA, 22 bp, Homo sapiens
aagagtttgtcagatctgcacg

SEQ ID NO: 9272914 - DNA, 22 bp, Homo sapiens
aaatatgagagtaggagtttgg

SEQ ID NO: 9272915 - DNA, 22 bp, Homo sapiens
aaatatgactagaatgccaggt

SEQ ID NO: 9272916 - DNA, 22 bp, Homo sapiens
aaatatagtaaatgcatagttc

SEQ ID NO: 9272917 - DNA, 22 bp, Homo sapiens
aaatatagtgacacttatagtc

SEQ ID NO: 9272918 - DNA, 22 bp, Homo sapiens
aaatatagtgacacttatagtc

SEQ ID NO: 9272919 - DNA, 22 bp, Homo sapiens
aaatatagtgacacttatagtc

SEQ ID NO: 9272920 - DNA, 22 bp, Homo sapiens
aagagtttctgggtcaaggatt

SEQ ID NO: 9272921 - DNA, 22 bp, Homo sapiens
aagagtttctttattaaccttt

SEQ ID NO: 9272922 - DNA, 22 bp, Homo sapiens
aagagtttctttattaaccttt

SEQ ID NO: 9272923 - DNA, 22 bp, Homo sapiens
aagagtttctgggtcaaggatt

SEQ ID NO: 9272924 - DNA, 22 bp, Homo sapiens
aagagtttctgattcagtaggt

SEQ ID NO: 9272925 - DNA, 19 bp, Homo sapiens
aaatatcagagagatgata

SEQ ID NO: 9272926 - DNA, 22 bp, Homo sapiens
aaatatactagatgatgaccca

SEQ ID NO: 9272927 - DNA, 22 bp, Homo sapiens
aaatatagcaattatgcctact

SEQ ID NO: 9272928 - DNA, 22 bp, Homo sapiens
aaatataatttctgcctcaata

SEQ ID NO: 9272929 - DNA, 22 bp, Homo sapiens
aaatataccagttgcctgcatc

SEQ ID NO: 9272930 - DNA, 22 bp, Homo sapiens
aagagagagcattcttctgtta

SEQ ID NO: 9272931 - DNA, 22 bp, Homo sapiens
aagagagagcattcttctgtta

SEQ ID NO: 9272932 - DNA, 22 bp, Homo sapiens
aagagagagcattcttctgtta

SEQ ID NO: 9272933 - DNA, 22 bp, Homo sapiens
aagagagagtgcgctcacagaa

SEQ ID NO: 9272934 - DNA, 22 bp, Homo sapiens
aagagagagtgcgctcacagaa

SEQ ID NO: 9272935 - DNA, 22 bp, Homo sapiens
aagagagaccatgggggacagg

SEQ ID NO: 9272936 - DNA, 22 bp, Homo sapiens
aagagagaccatgggggacagg

SEQ ID NO: 9272937 - DNA, 22 bp, Homo sapiens
aagagagaagtctctctggttc

SEQ ID NO: 9272938 - DNA, 22 bp, Homo sapiens
aagagagaagtctctctggttc

SEQ ID NO: 9272939 - DNA, 22 bp, Homo sapiens
agcaggctaagggacctgttta

SEQ ID NO: 9272940 - DNA, 22 bp, Homo sapiens
agcaggctaatcttgctgaaca

SEQ ID NO: 9272941 - DNA, 20 bp, Homo sapiens
cacaggctatatgagagcca

SEQ ID NO: 9272942 - DNA, 20 bp, Homo sapiens
cacaggctatatgagagcca

SEQ ID NO: 9272943 - DNA, 18 bp, Homo sapiens
cacaggctcccagtgagg

SEQ ID NO: 9272944 - DNA, 18 bp, Homo sapiens
cacaggctcccagtgagg

SEQ ID NO: 9272945 - DNA, 22 bp, Homo sapiens
cacaggctccggccttgcagcc

SEQ ID NO: 9272946 - DNA, 22 bp, Homo sapiens
cacaggctccggccttgcagcc

SEQ ID NO: 9272947 - DNA, 18 bp, Homo sapiens
cacaggctcccagtgagg

SEQ ID NO: 9272948 - DNA, 22 bp, Homo sapiens
cacatgtcctggcgctgagccc

SEQ ID NO: 9272949 - DNA, 22 bp, Homo sapiens
cacatgtcctgggaaaataact

SEQ ID NO: 9272950 - DNA, 22 bp, Homo sapiens
cacatgtcctggcgctgagccc

SEQ ID NO: 9272951 - DNA, 22 bp, Homo sapiens
cacatgtagtaagcaggcaatg

SEQ ID NO: 9272952 - DNA, 22 bp, Homo sapiens
cacatgtacagaagcaggctgg

SEQ ID NO: 9272953 - DNA, 22 bp, Homo sapiens
cacatgggcgtaatgtccatgg

SEQ ID NO: 9272954 - DNA, 22 bp, Homo sapiens
cacatggcagaatcatgcatct

SEQ ID NO: 9272955 - DNA, 22 bp, Homo sapiens
cacaggctgcccgcagctggga

SEQ ID NO: 9272956 - DNA, 22 bp, Homo sapiens
cacatgaacatgctggaaaagc

SEQ ID NO: 9272957 - DNA, 22 bp, Homo sapiens
cacaggctgcccgcagctggga

SEQ ID NO: 9272958 - DNA, 22 bp, Homo sapiens
cacaggctctccagggcctgga

SEQ ID NO: 9272959 - DNA, 22 bp, Homo sapiens
cacaggctctccagggcctgga

SEQ ID NO: 9272960 - DNA, 22 bp, Homo sapiens
cacaggctcttctcacttgatt

SEQ ID NO: 9272961 - DNA, 22 bp, Homo sapiens
cacatgcttagatttcagtgga

SEQ ID NO: 9272962 - DNA, 22 bp, Homo sapiens
cacatggaagagatacagtgag

SEQ ID NO: 9272963 - DNA, 22 bp, Homo sapiens
cacatgcttcttttgattatga

SEQ ID NO: 9272964 - DNA, 22 bp, Homo sapiens
agcaggtggccacgaggaggag

SEQ ID NO: 9272965 - DNA, 22 bp, Homo sapiens
agcaggtggccacgaggaggag

SEQ ID NO: 9272966 - DNA, 22 bp, Homo sapiens
agcaggtggcctcctgtctgtc

SEQ ID NO: 9272967 - DNA, 22 bp, Homo sapiens
agcaggtgggcatgaaagctga

SEQ ID NO: 9272968 - DNA, 22 bp, Homo sapiens
cactgaaatcgaaaaatgtagg

SEQ ID NO: 9272969 - DNA, 22 bp, Homo sapiens
agcaggtgggatcaagctggca

SEQ ID NO: 9272970 - DNA, 22 bp, Homo sapiens
cactaggctggagtgcagtggc

SEQ ID NO: 9272971 - DNA, 22 bp, Homo sapiens
agcaggtggatttagacgggag

SEQ ID NO: 9272972 - DNA, 22 bp, Homo sapiens
cactaggctggagtgcagtggc

SEQ ID NO: 9272973 - DNA, 22 bp, Homo sapiens
cactaggcgccgggtggctgtg

SEQ ID NO: 9272974 - DNA, 22 bp, Homo sapiens
cactaagatttaaagtattagt

SEQ ID NO: 9272975 - DNA, 19 bp, Homo sapiens
cactaagatgagatatagc

SEQ ID NO: 9272976 - DNA, 22 bp, Homo sapiens
cactacaggggtccacagctga

SEQ ID NO: 9272977 - DNA, 22 bp, Homo sapiens
cactacagaatcaaatacgggc

SEQ ID NO: 9272978 - DNA, 22 bp, Homo sapiens
cacctgagtgtcagtattctca

SEQ ID NO: 9272979 - DNA, 22 bp, Homo sapiens
cacatttaagtgcttgttcaga

SEQ ID NO: 9272980 - DNA, 22 bp, Homo sapiens
cacatttaagtgcttgttcaga

SEQ ID NO: 9272981 - DNA, 22 bp, Homo sapiens
cacgtccacccaggctgcccag

SEQ ID NO: 9272982 - DNA, 22 bp, Homo sapiens
cacgtccacccaggctgcccag

SEQ ID NO: 9272983 - DNA, 22 bp, Homo sapiens
cacgggagacgtgatcttggac

SEQ ID NO: 9272984 - DNA, 22 bp, Homo sapiens
cacgggtggaatcagggactcc

SEQ ID NO: 9272985 - DNA, 22 bp, Homo sapiens
cacatttaagcagatgtggacc

SEQ ID NO: 9272986 - DNA, 22 bp, Homo sapiens
cacatttaagcagatgtggacc

SEQ ID NO: 9272987 - DNA, 22 bp, Homo sapiens
cacatttaaaggttgaagctga

SEQ ID NO: 9272988 - DNA, 22 bp, Homo sapiens
cacatttaaaaaatccacgatc

SEQ ID NO: 9272989 - DNA, 22 bp, Homo sapiens
cactgcacttcagcctgggtga

SEQ ID NO: 9272990 - DNA, 19 bp, Homo sapiens
agcattaggcaaattttga

SEQ ID NO: 9272991 - DNA, 22 bp, Homo sapiens
agcattaggtgtgtttcagagg

SEQ ID NO: 9272992 - DNA, 22 bp, Homo sapiens
cactgcacttcagcctgggtga

SEQ ID NO: 9272993 - DNA, 22 bp, Homo sapiens
cactgcacttcagcctgggtga

SEQ ID NO: 9272994 - DNA, 22 bp, Homo sapiens
cactgcacttcagcctgggtga

SEQ ID NO: 9272995 - DNA, 22 bp, Homo sapiens
agcatttatttcttagaaattg

SEQ ID NO: 9272996 - DNA, 22 bp, Homo sapiens
cactgcactccatcctgggaaa

SEQ ID NO: 9272997 - DNA, 22 bp, Homo sapiens
cactgcactccatcctgggaaa

SEQ ID NO: 9272998 - DNA, 22 bp, Homo sapiens
cactgcactccatcctgggaaa

SEQ ID NO: 9272999 - DNA, 22 bp, Homo sapiens
cactgcactccatcctgggaaa

SEQ ID NO: 9273000 - DNA, 22 bp, Homo sapiens
cactgcactccatcctgggaaa

SEQ ID NO: 9273001 - DNA, 22 bp, Homo sapiens
cactgcactccagcccgggcaa

SEQ ID NO: 9273002 - DNA, 22 bp, Homo sapiens
cactgcactccagcccgggcaa

SEQ ID NO: 9273003 - DNA, 22 bp, Homo sapiens
cactgcactccagcccgggcaa

SEQ ID NO: 9273004 - DNA, 22 bp, Homo sapiens
cactgcactccagcccgggcaa

SEQ ID NO: 9273005 - DNA, 22 bp, Homo sapiens
cactgcaacctccacctcctgg

SEQ ID NO: 9273006 - DNA, 22 bp, Homo sapiens
cactgcaacctccacctcctgg

SEQ ID NO: 9273007 - DNA, 22 bp, Homo sapiens
cactgcaacctccacctcctgg

SEQ ID NO: 9273008 - DNA, 22 bp, Homo sapiens
cactgcaacctccagctctcag

SEQ ID NO: 9273009 - DNA, 22 bp, Homo sapiens
cactgcaacctccacctcctgg

SEQ ID NO: 9273010 - DNA, 22 bp, Homo sapiens
cactgcactccagcccgggcaa

SEQ ID NO: 9273011 - DNA, 22 bp, Homo sapiens
cactgcactccagcccgggcaa

SEQ ID NO: 9273012 - DNA, 22 bp, Homo sapiens
cactgcaatgtctacctcctgg

SEQ ID NO: 9273013 - DNA, 22 bp, Homo sapiens
cactgcaatctccatctcctgg

SEQ ID NO: 9273014 - DNA, 22 bp, Homo sapiens
agccaaaacatgtgagttttga

SEQ ID NO: 9273015 - DNA, 17 bp, Homo sapiens
agcatttgtgttaacag

SEQ ID NO: 9273016 - DNA, 20 bp, Homo sapiens
cactgggctggagtcagggc

SEQ ID NO: 9273017 - DNA, 22 bp, Homo sapiens
cactgggctttgtagttagcat

SEQ ID NO: 9273018 - DNA, 22 bp, Homo sapiens
cagaaacatgtataaagttgta

SEQ ID NO: 9273019 - DNA, 22 bp, Homo sapiens
agccaaagatcagtgtgcaagt

SEQ ID NO: 9273020 - DNA, 22 bp, Homo sapiens
agccaacacatgtaaatgcacc

SEQ ID NO: 9273021 - DNA, 22 bp, Homo sapiens
cagaaagacctgggctcaagag

SEQ ID NO: 9273022 - DNA, 22 bp, Homo sapiens
cagaaagacctgggctcaagag

SEQ ID NO: 9273023 - DNA, 20 bp, Homo sapiens
cagaaagaaggtagattttt

SEQ ID NO: 9273024 - DNA, 22 bp, Homo sapiens
cagaaacatgtataaagttgta

SEQ ID NO: 9273025 - DNA, 22 bp, Homo sapiens
cagaaacatgtataaagttgta

SEQ ID NO: 9273026 - DNA, 22 bp, Homo sapiens
cagaaacctgtctggagtggga

SEQ ID NO: 9273027 - DNA, 22 bp, Homo sapiens
cagaaaccaaatgggatgggga

SEQ ID NO: 9273028 - DNA, 22 bp, Homo sapiens
cagaaacctccctgaatatttt

SEQ ID NO: 9273029 - DNA, 22 bp, Homo sapiens
cagaaacttctggtgtcaaata

SEQ ID NO: 9273030 - DNA, 22 bp, Homo sapiens
cacagctgccctactccatgtg

SEQ ID NO: 9273031 - DNA, 22 bp, Homo sapiens
cacagctgccctaactgtactc

SEQ ID NO: 9273032 - DNA, 22 bp, Homo sapiens
cacagctgccctactccatgtg

SEQ ID NO: 9273033 - DNA, 22 bp, Homo sapiens
cacagctgccatggctgcactt

SEQ ID NO: 9273034 - DNA, 22 bp, Homo sapiens
cacagctgccatggctgcactt

SEQ ID NO: 9273035 - DNA, 22 bp, Homo sapiens
cacagctgccatgcagtcagtg

SEQ ID NO: 9273036 - DNA, 22 bp, Homo sapiens
cacagaaatattgtgtcccttg

SEQ ID NO: 9273037 - DNA, 22 bp, Homo sapiens
cacagaaatattgtgtcccttg

SEQ ID NO: 9273038 - DNA, 22 bp, Homo sapiens
cacagcagccagaacatttttg

SEQ ID NO: 9273039 - DNA, 22 bp, Homo sapiens
cacagctggggaagctgaggcc

SEQ ID NO: 9273040 - DNA, 20 bp, Homo sapiens
cacaggaaagctactcagtt

SEQ ID NO: 9273041 - DNA, 22 bp, Homo sapiens
cacaggaaaataaaagatctaa

SEQ ID NO: 9273042 - DNA, 20 bp, Homo sapiens
cacaggaaagctactcagtt

SEQ ID NO: 9273043 - DNA, 20 bp, Homo sapiens
cacaggaaagctactcagtt

SEQ ID NO: 9273044 - DNA, 22 bp, Homo sapiens
agcaggcaggcccagcggctgg

SEQ ID NO: 9273045 - DNA, 22 bp, Homo sapiens
cacaggaagaggtatacaattc

SEQ ID NO: 9273046 - DNA, 22 bp, Homo sapiens
cacaggaaatgattctgcagca

SEQ ID NO: 9273047 - DNA, 22 bp, Homo sapiens
cacacatgaatccctagtacct

SEQ ID NO: 9273048 - DNA, 22 bp, Homo sapiens
cacacatgaagttgctgagcta

SEQ ID NO: 9273049 - DNA, 22 bp, Homo sapiens
cacacatgcatgtaagacctct

SEQ ID NO: 9273050 - DNA, 22 bp, Homo sapiens
cacacatgagtctccccattgg

SEQ ID NO: 9273051 - DNA, 22 bp, Homo sapiens
cacacatgacccacttttaccg

SEQ ID NO: 9273052 - DNA, 22 bp, Homo sapiens
cacacatgtctctccatgctct

SEQ ID NO: 9273053 - DNA, 22 bp, Homo sapiens
cacacatgtctctccatgctct

SEQ ID NO: 9273054 - DNA, 22 bp, Homo sapiens
cacagaaaaaggcttgaaaatc

SEQ ID NO: 9273055 - DNA, 22 bp, Homo sapiens
cacactttgtgctaatctattt

SEQ ID NO: 9273056 - DNA, 22 bp, Homo sapiens
cacacatgtctctccatgctct

SEQ ID NO: 9273057 - DNA, 22 bp, Homo sapiens
cacactttcaggtcctctttgc

SEQ ID NO: 9273058 - DNA, 22 bp, Homo sapiens
cacactgttgaggacgagatgt

SEQ ID NO: 9273059 - DNA, 22 bp, Homo sapiens
cacacatgtgtgcagcttagaa

SEQ ID NO: 9273060 - DNA, 22 bp, Homo sapiens
caatttcttgttaattctcagg

SEQ ID NO: 9273061 - DNA, 22 bp, Homo sapiens
caatttgccctgttaaattttc

SEQ ID NO: 9273062 - DNA, 22 bp, Homo sapiens
caatttcttgttaattctcagg

SEQ ID NO: 9273063 - DNA, 22 bp, Homo sapiens
caatttctggaactaattctga

SEQ ID NO: 9273064 - DNA, 22 bp, Homo sapiens
caatttctggaactaattctga

SEQ ID NO: 9273065 - DNA, 22 bp, Homo sapiens
caatttctctttatatctcaca

SEQ ID NO: 9273066 - DNA, 22 bp, Homo sapiens
caatttctggaactaattctga

SEQ ID NO: 9273067 - DNA, 22 bp, Homo sapiens
caattttactcttcctcttcca

SEQ ID NO: 9273068 - DNA, 22 bp, Homo sapiens
caattttattggtccaaataca

SEQ ID NO: 9273069 - DNA, 22 bp, Homo sapiens
caatttttaaactatgaagttg

SEQ ID NO: 9273070 - DNA, 22 bp, Homo sapiens
caatttttaaactatgaagttg

SEQ ID NO: 9273071 - DNA, 22 bp, Homo sapiens
caatttttgtacttatagtact

SEQ ID NO: 9273072 - DNA, 22 bp, Homo sapiens
cacacagaaccgctcgccactt

SEQ ID NO: 9273073 - DNA, 20 bp, Homo sapiens
caaggggagtagtatgggcc

SEQ ID NO: 9273074 - DNA, 22 bp, Homo sapiens
caagggctgctatcagctactg

SEQ ID NO: 9273075 - DNA, 22 bp, Homo sapiens
caagggaattgtgtgtgagagg

SEQ ID NO: 9273076 - DNA, 22 bp, Homo sapiens
caagggagttactgagggcggg

SEQ ID NO: 9273077 - DNA, 22 bp, Homo sapiens
caagggagttactgagggcggg

SEQ ID NO: 9273078 - DNA, 22 bp, Homo sapiens
caagggagttgctgcatgcagg

SEQ ID NO: 9273079 - DNA, 22 bp, Homo sapiens
caattaaagaagacctgcctca

SEQ ID NO: 9273080 - DNA, 21 bp, Homo sapiens
caattacagatggctcagggg

SEQ ID NO: 9273081 - DNA, 22 bp, Homo sapiens
caattacatttattgagcattc

SEQ ID NO: 9273082 - DNA, 22 bp, Homo sapiens
caattatatttagaatgataca

SEQ ID NO: 9273083 - DNA, 22 bp, Homo sapiens
caagtcctctggtttcaaatag

SEQ ID NO: 9273084 - DNA, 22 bp, Homo sapiens
caagtctagcttggtcacttgg

SEQ ID NO: 9273085 - DNA, 22 bp, Homo sapiens
caatgattctgcaactgtgtgc

SEQ ID NO: 9273086 - DNA, 22 bp, Homo sapiens
caagtctgtctgctcctgtgtg

SEQ ID NO: 9273087 - DNA, 22 bp, Homo sapiens
caagcttgtttctcctgggggt

SEQ ID NO: 9273088 - DNA, 22 bp, Homo sapiens
caagctgggtgcgggcagtata

SEQ ID NO: 9273089 - DNA, 22 bp, Homo sapiens
caagctggtatcagctagagcg

SEQ ID NO: 9273090 - DNA, 22 bp, Homo sapiens
caaggaaaacagatgatcaaca

SEQ ID NO: 9273091 - DNA, 22 bp, Homo sapiens
caaggaaaagaagtatttcaga

SEQ ID NO: 9273092 - DNA, 22 bp, Homo sapiens
caagcagaggtttatgtattag

SEQ ID NO: 9273093 - DNA, 22 bp, Homo sapiens
caagctggaggttggagctact

SEQ ID NO: 9273094 - DNA, 22 bp, Homo sapiens
caagctggctgggagaggcacg

SEQ ID NO: 9273095 - DNA, 22 bp, Homo sapiens
agcaatttcccatctcttctgc

SEQ ID NO: 9273096 - DNA, 22 bp, Homo sapiens
agcagagaagacacaggcttca

SEQ ID NO: 9273097 - DNA, 22 bp, Homo sapiens
agcagaccaggagtgcacaggt

SEQ ID NO: 9273098 - DNA, 22 bp, Homo sapiens
agcagacatggcttggatgtgg

SEQ ID NO: 9273099 - DNA, 22 bp, Homo sapiens
agcagagaagacacaggcttca

SEQ ID NO: 9273100 - DNA, 22 bp, Homo sapiens
agcagagacatgaaatatgctt

SEQ ID NO: 9273101 - DNA, 22 bp, Homo sapiens
caaggaaggagagatgatgggt

SEQ ID NO: 9273102 - DNA, 21 bp, Homo sapiens
agcagacagcccaagaaaatc

SEQ ID NO: 9273103 - DNA, 22 bp, Homo sapiens
agcagacatatctcatgtcaca

SEQ ID NO: 9273104 - DNA, 22 bp, Homo sapiens
agcagacatatctcatgtcaca

SEQ ID NO: 9273105 - DNA, 22 bp, Homo sapiens
agctctggcactggcgcgggat

SEQ ID NO: 9273106 - DNA, 22 bp, Homo sapiens
agctgagcatttgatccacctc

SEQ ID NO: 9273107 - DNA, 22 bp, Homo sapiens
agctgagccagcagcaacagga

SEQ ID NO: 9273108 - DNA, 22 bp, Homo sapiens
agctgagccagcagcaacagga

SEQ ID NO: 9273109 - DNA, 22 bp, Homo sapiens
agctctgggagtagttccacct

SEQ ID NO: 9273110 - DNA, 22 bp, Homo sapiens
agctctgggagtagttccacct

SEQ ID NO: 9273111 - DNA, 22 bp, Homo sapiens
agctgaagacctcaagtaagag

SEQ ID NO: 9273112 - DNA, 22 bp, Homo sapiens
agctgagctgcagatgactgta

SEQ ID NO: 9273113 - DNA, 22 bp, Homo sapiens
agctgagctgcagatgactgta

SEQ ID NO: 9273114 - DNA, 17 bp, Homo sapiens
agctgagctggccaggg

SEQ ID NO: 9273115 - DNA, 17 bp, Homo sapiens
agctgagctggccaggg

SEQ ID NO: 9273116 - DNA, 22 bp, Homo sapiens
agctgagctcaggctgatgtaa

SEQ ID NO: 9273117 - DNA, 22 bp, Homo sapiens
agctgagctagtagttccagtg

SEQ ID NO: 9273118 - DNA, 22 bp, Homo sapiens
agctgagctcaggctgatgtaa

SEQ ID NO: 9273119 - DNA, 22 bp, Homo sapiens
agctgagccagcagcaacagga

SEQ ID NO: 9273120 - DNA, 21 bp, Homo sapiens
agctgagcccagaagactggt

SEQ ID NO: 9273121 - DNA, 21 bp, Homo sapiens
agctgagcccagaagactggt

SEQ ID NO: 9273122 - DNA, 22 bp, Homo sapiens
agctgaggaggaatgatgggta

SEQ ID NO: 9273123 - DNA, 22 bp, Homo sapiens
agctgaggaggaatgatgggta

SEQ ID NO: 9273124 - DNA, 22 bp, Homo sapiens
agctgaggaggaatgatgggta

SEQ ID NO: 9273125 - DNA, 22 bp, Homo sapiens
agctgaggacgtgaagggcggc

SEQ ID NO: 9273126 - DNA, 22 bp, Homo sapiens
agctgaggaataataacaaggt

SEQ ID NO: 9273127 - DNA, 22 bp, Homo sapiens
agctgaggaataataacaaggt

SEQ ID NO: 9273128 - DNA, 22 bp, Homo sapiens
agctgaggacgtgaagggcggc

SEQ ID NO: 9273129 - DNA, 22 bp, Homo sapiens
agctgaggacgtgaagggcggc

SEQ ID NO: 9273130 - DNA, 22 bp, Homo sapiens
cagctggcagccctggccctgc

SEQ ID NO: 9273131 - DNA, 22 bp, Homo sapiens
cagctggcagaacctgcatcca

SEQ ID NO: 9273132 - DNA, 22 bp, Homo sapiens
cagctggcaagtggagcagggt

SEQ ID NO: 9273133 - DNA, 22 bp, Homo sapiens
cagctggcaagtggagcagggt

SEQ ID NO: 9273134 - DNA, 22 bp, Homo sapiens
cagctggatgggagaccatgtt

SEQ ID NO: 9273135 - DNA, 20 bp, Homo sapiens
agctgaggcacctgaggtta

SEQ ID NO: 9273136 - DNA, 20 bp, Homo sapiens
agctgaggcacctgaggtta

SEQ ID NO: 9273137 - DNA, 20 bp, Homo sapiens
agctgaggcacctgaggtta

SEQ ID NO: 9273138 - DNA, 20 bp, Homo sapiens
agctgaggcacctgaggtta

SEQ ID NO: 9273139 - DNA, 20 bp, Homo sapiens
agctgaggcacctgaggtta

SEQ ID NO: 9273140 - DNA, 22 bp, Homo sapiens
cagctgctttcagcaggaggga

SEQ ID NO: 9273141 - DNA, 22 bp, Homo sapiens
cagctgagcatcactagtctgg

SEQ ID NO: 9273142 - DNA, 22 bp, Homo sapiens
cagctgagagtagaaatggagg

SEQ ID NO: 9273143 - DNA, 22 bp, Homo sapiens
cagctgagagtagaaatggagg

SEQ ID NO: 9273144 - DNA, 18 bp, Homo sapiens
cagctgccagctcatgga

SEQ ID NO: 9273145 - DNA, 18 bp, Homo sapiens
cagctgccagctcatgga

SEQ ID NO: 9273146 - DNA, 18 bp, Homo sapiens
cagctgccagctcatgga

SEQ ID NO: 9273147 - DNA, 22 bp, Homo sapiens
cagctgccagcttctctccatc

SEQ ID NO: 9273148 - DNA, 22 bp, Homo sapiens
cagctgccatgacatgtcctgc

SEQ ID NO: 9273149 - DNA, 22 bp, Homo sapiens
cagctgcccaggccacctggag

SEQ ID NO: 9273150 - DNA, 22 bp, Homo sapiens
cagctgcccaagccccagatgt

SEQ ID NO: 9273151 - DNA, 22 bp, Homo sapiens
agctctggagccggaggatttc

SEQ ID NO: 9273152 - DNA, 22 bp, Homo sapiens
agctctggaataatgatgtgat

SEQ ID NO: 9273153 - DNA, 22 bp, Homo sapiens
cagctgccccataaatcacagt

SEQ ID NO: 9273154 - DNA, 22 bp, Homo sapiens
cagctgcccatcctgggaaatg

SEQ ID NO: 9273155 - DNA, 22 bp, Homo sapiens
cagctgccccgctggctgacca

SEQ ID NO: 9273156 - DNA, 22 bp, Homo sapiens
cagcgcagtgtaggtggggggc

SEQ ID NO: 9273157 - DNA, 22 bp, Homo sapiens
cagcgcctcctggacctcctct

SEQ ID NO: 9273158 - DNA, 22 bp, Homo sapiens
cagcctttgaacttcagaggtt

SEQ ID NO: 9273159 - DNA, 22 bp, Homo sapiens
cagcgctggggtaggagcacct

SEQ ID NO: 9273160 - DNA, 22 bp, Homo sapiens
cagcgctggggtaggagcacct

SEQ ID NO: 9273161 - DNA, 22 bp, Homo sapiens
cagcggaggacagatgggagct

SEQ ID NO: 9273162 - DNA, 22 bp, Homo sapiens
cagcggggcctgtgctggggag

SEQ ID NO: 9273163 - DNA, 22 bp, Homo sapiens
cagcggccggtgaggaagggga

SEQ ID NO: 9273164 - DNA, 22 bp, Homo sapiens
cagctgagagtagaaatggagg

SEQ ID NO: 9273165 - DNA, 22 bp, Homo sapiens
cagccttcgacagttggagtag

SEQ ID NO: 9273166 - DNA, 22 bp, Homo sapiens
cagcctctgagccttggcagat

SEQ ID NO: 9273167 - DNA, 22 bp, Homo sapiens
agcgcgctctaggacaccgcgg

SEQ ID NO: 9273168 - DNA, 22 bp, Homo sapiens
agcgcgctgtcagactggctcg

SEQ ID NO: 9273169 - DNA, 22 bp, Homo sapiens
agcgcgctcgatggtttccgcg

SEQ ID NO: 9273170 - DNA, 22 bp, Homo sapiens
agcgcaggaacacgtctgcctt

SEQ ID NO: 9273171 - DNA, 22 bp, Homo sapiens
agcgccactgcactccagcctg

SEQ ID NO: 9273172 - DNA, 22 bp, Homo sapiens
agcgagtgggtcagcgttgcag

SEQ ID NO: 9273173 - DNA, 22 bp, Homo sapiens
agcgagtgggtcagcgttgcag

SEQ ID NO: 9273174 - DNA, 22 bp, Homo sapiens
agcgagggaggtctgaggacag

SEQ ID NO: 9273175 - DNA, 22 bp, Homo sapiens
cagcatggtgccagtgagtcca

SEQ ID NO: 9273176 - DNA, 22 bp, Homo sapiens
cagcatggtgccagtgagtcca

SEQ ID NO: 9273177 - DNA, 22 bp, Homo sapiens
cagcatggggcttggagtcagc

SEQ ID NO: 9273178 - DNA, 22 bp, Homo sapiens
cagcatggtggagctgctcttt

SEQ ID NO: 9273179 - DNA, 22 bp, Homo sapiens
cagcactgcttcgcagccaggg

SEQ ID NO: 9273180 - DNA, 22 bp, Homo sapiens
cagcactgcttcgcagccaggg

SEQ ID NO: 9273181 - DNA, 22 bp, Homo sapiens
cagcatggagacaaagtgggca

SEQ ID NO: 9273182 - DNA, 22 bp, Homo sapiens
cagcatggggatcactgtaggc

SEQ ID NO: 9273183 - DNA, 22 bp, Homo sapiens
cagcatggcttgagtgtttcct

SEQ ID NO: 9273184 - DNA, 22 bp, Homo sapiens
cagcatggcttgagtgtttcct

SEQ ID NO: 9273185 - DNA, 22 bp, Homo sapiens
cagcagaaaatgtgggtgattt

SEQ ID NO: 9273186 - DNA, 22 bp, Homo sapiens
cagccagctggcactgtgagta

SEQ ID NO: 9273187 - DNA, 22 bp, Homo sapiens
cagccagctggcactgtgagta

SEQ ID NO: 9273188 - DNA, 22 bp, Homo sapiens
cagccagtggttgaagatgcag

SEQ ID NO: 9273189 - DNA, 22 bp, Homo sapiens
cagccagtgtgaccgaggagga

SEQ ID NO: 9273190 - DNA, 22 bp, Homo sapiens
cagccagtgtgaccgaggagga

SEQ ID NO: 9273191 - DNA, 22 bp, Homo sapiens
cagcccaaagccccaggctaga

SEQ ID NO: 9273192 - DNA, 23 bp, Homo sapiens
cagcccaaagagagagctacttt

SEQ ID NO: 9273193 - DNA, 22 bp, Homo sapiens
cagcccacgtcagggccactca

SEQ ID NO: 9273194 - DNA, 22 bp, Homo sapiens
cagcccacctggcacgtgtgtt

SEQ ID NO: 9273195 - DNA, 22 bp, Homo sapiens
cagcctctaagcacagcctctc

SEQ ID NO: 9273196 - DNA, 22 bp, Homo sapiens
cagcctcctgggacactcaccg

SEQ ID NO: 9273197 - DNA, 22 bp, Homo sapiens
cagcctctaagcacagcctctc

SEQ ID NO: 9273198 - DNA, 22 bp, Homo sapiens
cagcctcctgggacactcaccg

SEQ ID NO: 9273199 - DNA, 22 bp, Homo sapiens
cagcccagtgcatttgtgtact

SEQ ID NO: 9273200 - DNA, 22 bp, Homo sapiens
cagaggtgctggagtgagtcct

SEQ ID NO: 9273201 - DNA, 22 bp, Homo sapiens
cagagtgaaataggggatcaag

SEQ ID NO: 9273202 - DNA, 21 bp, Homo sapiens
cagaggtggcctgacctctga

SEQ ID NO: 9273203 - DNA, 20 bp, Homo sapiens
cagaggagtacatatgttca

SEQ ID NO: 9273204 - DNA, 22 bp, Homo sapiens
cagagtgaacagtgggatgtgc

SEQ ID NO: 9273205 - DNA, 22 bp, Homo sapiens
cagagtgaaataggggatcaag

SEQ ID NO: 9273206 - DNA, 18 bp, Homo sapiens
cagaggagagacattcag

SEQ ID NO: 9273207 - DNA, 17 bp, Homo sapiens
cagaggagctttggggg

SEQ ID NO: 9273208 - DNA, 22 bp, Homo sapiens
cagaggaggccaccgcataggc

SEQ ID NO: 9273209 - DNA, 22 bp, Homo sapiens
cagaggaggcggtatacactgc

SEQ ID NO: 9273210 - DNA, 22 bp, Homo sapiens
cagaggaggcggtatacactgc

SEQ ID NO: 9273211 - DNA, 22 bp, Homo sapiens
cagaggaggcggtatacactgc

SEQ ID NO: 9273212 - DNA, 22 bp, Homo sapiens
cagagtggagatgtgtgtggaa

SEQ ID NO: 9273213 - DNA, 22 bp, Homo sapiens
cagagtggagtttttcagcggg

SEQ ID NO: 9273214 - DNA, 22 bp, Homo sapiens
cagagtggcatgaatgaagcct

SEQ ID NO: 9273215 - DNA, 22 bp, Homo sapiens
agccctcctggggccacgctgg

SEQ ID NO: 9273216 - DNA, 22 bp, Homo sapiens
cagagtggcgaccccctcagct

SEQ ID NO: 9273217 - DNA, 22 bp, Homo sapiens
agccctctctatggccctcttg

SEQ ID NO: 9273218 - DNA, 22 bp, Homo sapiens
agccctgagccagcctggtcag

SEQ ID NO: 9273219 - DNA, 22 bp, Homo sapiens
agcccttagtacatttctcaag

SEQ ID NO: 9273220 - DNA, 21 bp, Homo sapiens
agcccttaggacataagagag

SEQ ID NO: 9273221 - DNA, 22 bp, Homo sapiens
cagatctgctcctctgtccatg

SEQ ID NO: 9273222 - DNA, 21 bp, Homo sapiens
cagatctgtaggtactaccat

SEQ ID NO: 9273223 - DNA, 22 bp, Homo sapiens
cagatctgagccaagctcgatg

SEQ ID NO: 9273224 - DNA, 22 bp, Homo sapiens
cagatctgtttgccagatcagc

SEQ ID NO: 9273225 - DNA, 22 bp, Homo sapiens
cagatctgctcctctgtccatg

SEQ ID NO: 9273226 - DNA, 22 bp, Homo sapiens
cagatctgtttgccagatcagc

SEQ ID NO: 9273227 - DNA, 22 bp, Homo sapiens
cagatgaactgtgactgaaaat

SEQ ID NO: 9273228 - DNA, 22 bp, Homo sapiens
cagatgaactgtgactgaaaat

SEQ ID NO: 9273229 - DNA, 22 bp, Homo sapiens
agcctggaagaacctgaagtct

SEQ ID NO: 9273230 - DNA, 22 bp, Homo sapiens
agcctggaagaacctgaagtct

SEQ ID NO: 9273231 - DNA, 22 bp, Homo sapiens
agcctgagtgcttaggactgtt

SEQ ID NO: 9273232 - DNA, 22 bp, Homo sapiens
cagcactgctgctgtacacaca

SEQ ID NO: 9273233 - DNA, 18 bp, Homo sapiens
agcctggagggttgaagt

SEQ ID NO: 9273234 - DNA, 22 bp, Homo sapiens
agcctggaggccaggagacagt

SEQ ID NO: 9273235 - DNA, 19 bp, Homo sapiens
agcctggagggctggtcac

SEQ ID NO: 9273236 - DNA, 19 bp, Homo sapiens
agcctggagggctggtcac

SEQ ID NO: 9273237 - DNA, 22 bp, Homo sapiens
agcctggagaagatgtgtattg

SEQ ID NO: 9273238 - DNA, 22 bp, Homo sapiens
agcctggacagctacggagaac

SEQ ID NO: 9273239 - DNA, 22 bp, Homo sapiens
agcctggaattaaggaaatgca

SEQ ID NO: 9273240 - DNA, 22 bp, Homo sapiens
agcctggagaggcgccatacac

SEQ ID NO: 9273241 - DNA, 22 bp, Homo sapiens
agcctggagaggcgccatacac

SEQ ID NO: 9273242 - DNA, 22 bp, Homo sapiens
agcctggaggaggagttgagca

SEQ ID NO: 9273243 - DNA, 22 bp, Homo sapiens
agcctggagcttgagttatgag

SEQ ID NO: 9273244 - DNA, 22 bp, Homo sapiens
agcccttggtattttccgatcc

SEQ ID NO: 9273245 - DNA, 22 bp, Homo sapiens
agcctagggggtcctgggccac

SEQ ID NO: 9273246 - DNA, 22 bp, Homo sapiens
agcctaggaggttggggctgca

SEQ ID NO: 9273247 - DNA, 22 bp, Homo sapiens
agcctaggtctgggtctagcag

SEQ ID NO: 9273248 - DNA, 22 bp, Homo sapiens
agcctagggttctgatgtcact

SEQ ID NO: 9273249 - DNA, 22 bp, Homo sapiens
agcctaggtttccgattctctt

SEQ ID NO: 9273250 - DNA, 22 bp, Homo sapiens
agcctattccaggatgagctca

SEQ ID NO: 9273251 - DNA, 18 bp, Homo sapiens
cagatccaggcagctatt

SEQ ID NO: 9273252 - DNA, 23 bp, Homo sapiens
agccagggcactggtggagattg

SEQ ID NO: 9273253 - DNA, 22 bp, Homo sapiens
agccagggacgctgcaggctac

SEQ ID NO: 9273254 - DNA, 22 bp, Homo sapiens
agccagggatgcagcacagtga

SEQ ID NO: 9273255 - DNA, 22 bp, Homo sapiens
cagagcaccagtgggagacaag

SEQ ID NO: 9273256 - DNA, 22 bp, Homo sapiens
agccaggggagtcagctgctgg

SEQ ID NO: 9273257 - DNA, 22 bp, Homo sapiens
cagagcaccagtgggagacaag

SEQ ID NO: 9273258 - DNA, 22 bp, Homo sapiens
cagagcagggtgcaccttgggc

SEQ ID NO: 9273259 - DNA, 22 bp, Homo sapiens
cagagcagggtgcaccttgggc

SEQ ID NO: 9273260 - DNA, 22 bp, Homo sapiens
agccagggctgcgagcagacag

SEQ ID NO: 9273261 - DNA, 16 bp, Homo sapiens
agccaggctgcctcgg

SEQ ID NO: 9273262 - DNA, 16 bp, Homo sapiens
agccaggctgcctcgg

SEQ ID NO: 9273263 - DNA, 22 bp, Homo sapiens
agccaggctgcagttggctggc

SEQ ID NO: 9273264 - DNA, 22 bp, Homo sapiens
agccaggctgcagttggctggc

SEQ ID NO: 9273265 - DNA, 22 bp, Homo sapiens
agccagggaagaggcctacctc

SEQ ID NO: 9273266 - DNA, 22 bp, Homo sapiens
agccagggacgctgcaggctac

SEQ ID NO: 9273267 - DNA, 22 bp, Homo sapiens
agccaagagctcacctcgtgtg

SEQ ID NO: 9273268 - DNA, 22 bp, Homo sapiens
agccaacttagaagaaatttga

SEQ ID NO: 9273269 - DNA, 22 bp, Homo sapiens
agccaactaggagattaaggta

SEQ ID NO: 9273270 - DNA, 22 bp, Homo sapiens
agccaagcaccactggcactcg

SEQ ID NO: 9273271 - DNA, 22 bp, Homo sapiens
agccaagcactcaactcctgga

SEQ ID NO: 9273272 - DNA, 22 bp, Homo sapiens
cagagctgttgcggggcttggc

SEQ ID NO: 9273273 - DNA, 22 bp, Homo sapiens
cagagctgttgcggggcttggc

SEQ ID NO: 9273274 - DNA, 22 bp, Homo sapiens
cagagcttaaaactccatggaa

SEQ ID NO: 9273275 - DNA, 22 bp, Homo sapiens
cagagctgttgcggggcttggc

SEQ ID NO: 9273276 - DNA, 20 bp, Homo sapiens
cagagctgttatggatgatg

SEQ ID NO: 9273277 - DNA, 22 bp, Homo sapiens
cagagctgtgataaatagatat

SEQ ID NO: 9273278 - DNA, 22 bp, Homo sapiens
cagagctgttactattcatgaa

SEQ ID NO: 9273279 - DNA, 22 bp, Homo sapiens
cagagctgtccaaaccctgaca

SEQ ID NO: 9273280 - DNA, 21 bp, Homo sapiens
cagagctgtccaaaccctgac

SEQ ID NO: 9273281 - DNA, 22 bp, Homo sapiens
cagagctgtccaaaccctgaca

SEQ ID NO: 9273282 - DNA, 22 bp, Homo sapiens
cagagctgtccaaaccctgaca

SEQ ID NO: 9273283 - DNA, 22 bp, Homo sapiens
cagagccatcccagcctgtggt

SEQ ID NO: 9273284 - DNA, 22 bp, Homo sapiens
cagagccatccaggtgcctgtt

SEQ ID NO: 9273285 - DNA, 22 bp, Homo sapiens
cagagccatccaggtgcctgtt

SEQ ID NO: 9273286 - DNA, 23 bp, Homo sapiens
cagagctggctcagagctgcctg

SEQ ID NO: 9273287 - DNA, 23 bp, Homo sapiens
cagagctggctcagagctgcctg

SEQ ID NO: 9273288 - DNA, 23 bp, Homo sapiens
cagagctggctcagagctgcctg

SEQ ID NO: 9273289 - DNA, 21 bp, Homo sapiens
cagagctgtccaaaccctgac

SEQ ID NO: 9273290 - DNA, 21 bp, Homo sapiens
cagagctgtccaaaccctgac

SEQ ID NO: 9273291 - DNA, 22 bp, Homo sapiens
cagagcagtccttgtcaatcag

SEQ ID NO: 9273292 - DNA, 22 bp, Homo sapiens
cagagcagtctggagatccagc

SEQ ID NO: 9273293 - DNA, 18 bp, Homo sapiens
cagagcagtatgaatgtt

SEQ ID NO: 9273294 - DNA, 22 bp, Homo sapiens
cagagcagtaaatctggggcac

SEQ ID NO: 9273295 - DNA, 22 bp, Homo sapiens
cagagcagtaaatctggggcac

SEQ ID NO: 9273296 - DNA, 22 bp, Homo sapiens
cagagcaggtatctttggtgaa

SEQ ID NO: 9273297 - DNA, 22 bp, Homo sapiens
cagagccaggcctgccctcttt

SEQ ID NO: 9273298 - DNA, 18 bp, Homo sapiens
cagagcagtatgaatgtt

SEQ ID NO: 9273299 - DNA, 22 bp, Homo sapiens
cagagcagtctggagatccagc

SEQ ID NO: 9273300 - DNA, 22 bp, Homo sapiens
cagagcagtctggagatccagc

SEQ ID NO: 9273301 - DNA, 22 bp, Homo sapiens
cagagccagtcagtcagaaact

SEQ ID NO: 9273302 - DNA, 22 bp, Homo sapiens
attttgtgaaccctcaagcaat

SEQ ID NO: 9273303 - DNA, 22 bp, Homo sapiens
attttgtgaaccctcaagcaat

SEQ ID NO: 9273304 - DNA, 22 bp, Homo sapiens
attttgttaatgtcaccgtgct

SEQ ID NO: 9273305 - DNA, 22 bp, Homo sapiens
attttgtggcagatgcagaacc

SEQ ID NO: 9273306 - DNA, 22 bp, Homo sapiens
attttgttatcagggctttgca

SEQ ID NO: 9273307 - DNA, 22 bp, Homo sapiens
attttgttgaggtaattgtcaa

SEQ ID NO: 9273308 - DNA, 22 bp, Homo sapiens
attttgttataggagctgaaat

SEQ ID NO: 9273309 - DNA, 22 bp, Homo sapiens
attttgttataggagctgaaat

SEQ ID NO: 9273310 - DNA, 22 bp, Homo sapiens
attttgttatagaactctgtga

SEQ ID NO: 9273311 - DNA, 22 bp, Homo sapiens
attttgttatagaactctgtga

SEQ ID NO: 9273312 - DNA, 22 bp, Homo sapiens
attttttcagattgagtgttaa

SEQ ID NO: 9273313 - DNA, 22 bp, Homo sapiens
attttttcagattgagtgttaa

SEQ ID NO: 9273314 - DNA, 22 bp, Homo sapiens
attttttatataccaaggtggg

SEQ ID NO: 9273315 - DNA, 22 bp, Homo sapiens
attttttatataccaaggtggg

SEQ ID NO: 9273316 - DNA, 22 bp, Homo sapiens
attttgttgatggtggagtagc

SEQ ID NO: 9273317 - DNA, 22 bp, Homo sapiens
agcaagatgaaggattcaagac

SEQ ID NO: 9273318 - DNA, 22 bp, Homo sapiens
agcaagatgcaaacatccgtcc

SEQ ID NO: 9273319 - DNA, 20 bp, Homo sapiens
agcaagagtgtacctggcca

SEQ ID NO: 9273320 - DNA, 22 bp, Homo sapiens
agcaagatgcattatttcttat

SEQ ID NO: 9273321 - DNA, 22 bp, Homo sapiens
attttttcccagttagccagga

SEQ ID NO: 9273322 - DNA, 22 bp, Homo sapiens
attttttctgtaaactggcctt

SEQ ID NO: 9273323 - DNA, 22 bp, Homo sapiens
attttttctgtaaactggcctt

SEQ ID NO: 9273324 - DNA, 23 bp, Homo sapiens
attttttgtctttgtaactagat

SEQ ID NO: 9273325 - DNA, 23 bp, Homo sapiens
attttttgtctttgtaactagat

SEQ ID NO: 9273326 - DNA, 22 bp, Homo sapiens
agcaaggggcagtgaaagtgtg

SEQ ID NO: 9273327 - DNA, 22 bp, Homo sapiens
agcaagtgtaagaatgcagaat

SEQ ID NO: 9273328 - DNA, 22 bp, Homo sapiens
agcaataaatgtaaaggttaag

SEQ ID NO: 9273329 - DNA, 23 bp, Homo sapiens
agcaataagaagggatacatgtg

SEQ ID NO: 9273330 - DNA, 22 bp, Homo sapiens
agcaatgaccagtgatcttgta

SEQ ID NO: 9273331 - DNA, 22 bp, Homo sapiens
agcaatgactaaggcactttgg

SEQ ID NO: 9273332 - DNA, 23 bp, Homo sapiens
agcaatgctgggagactctgtaa

SEQ ID NO: 9273333 - DNA, 22 bp, Homo sapiens
agcaatgcttattgctgactat

SEQ ID NO: 9273334 - DNA, 22 bp, Homo sapiens
agcaatgctaccgggtgattcg

SEQ ID NO: 9273335 - DNA, 22 bp, Homo sapiens
agcaatgcaatcttaaccttga

SEQ ID NO: 9273336 - DNA, 22 bp, Homo sapiens
agcaatgcaatcttaaccttga

SEQ ID NO: 9273337 - DNA, 22 bp, Homo sapiens
caaagtttggctctcatgacat

SEQ ID NO: 9273338 - DNA, 22 bp, Homo sapiens
caaagttttagtaaacatatat

SEQ ID NO: 9273339 - DNA, 22 bp, Homo sapiens
caaataagcaattccattcttc

SEQ ID NO: 9273340 - DNA, 22 bp, Homo sapiens
caaagtttaaagtagatttcag

SEQ ID NO: 9273341 - DNA, 22 bp, Homo sapiens
caaagtgctgggattacaggtg

SEQ ID NO: 9273342 - DNA, 22 bp, Homo sapiens
caaagtgctgggattacaggct

SEQ ID NO: 9273343 - DNA, 22 bp, Homo sapiens
caaacattttgagtggtttctg

SEQ ID NO: 9273344 - DNA, 22 bp, Homo sapiens
caaacattttctacttccagga

SEQ ID NO: 9273345 - DNA, 22 bp, Homo sapiens
caaacatttgttggaacccctg

SEQ ID NO: 9273346 - DNA, 22 bp, Homo sapiens
caaacattgggggcttcaacac

SEQ ID NO: 9273347 - DNA, 22 bp, Homo sapiens
caaacattgggggcttcaacac

SEQ ID NO: 9273348 - DNA, 22 bp, Homo sapiens
caaacattgggggcttcaacac

SEQ ID NO: 9273349 - DNA, 22 bp, Homo sapiens
caaacattgctaccagaggttt

SEQ ID NO: 9273350 - DNA, 22 bp, Homo sapiens
caaacatttgacttctctcagg

SEQ ID NO: 9273351 - DNA, 22 bp, Homo sapiens
caaacatttgacttctctcagg

SEQ ID NO: 9273352 - DNA, 22 bp, Homo sapiens
caaacatttgacttctctcagg

SEQ ID NO: 9273353 - DNA, 22 bp, Homo sapiens
caaacattgctaccagaggttt

SEQ ID NO: 9273354 - DNA, 23 bp, Homo sapiens
agcaataagaagggatacatgtg

SEQ ID NO: 9273355 - DNA, 22 bp, Homo sapiens
agattgctttccaaaagcgttg

SEQ ID NO: 9273356 - DNA, 22 bp, Homo sapiens
agattggtgttgcagaaccatg

SEQ ID NO: 9273357 - DNA, 22 bp, Homo sapiens
agattcattatcttctttgtac

SEQ ID NO: 9273358 - DNA, 22 bp, Homo sapiens
agattcctcagtcatgaagcct

SEQ ID NO: 9273359 - DNA, 22 bp, Homo sapiens
agattcgaaacctttaggtctt

SEQ ID NO: 9273360 - DNA, 22 bp, Homo sapiens
agattctaccagagctagtttg

SEQ ID NO: 9273361 - DNA, 22 bp, Homo sapiens
agattcaggcatgtcttcattt

SEQ ID NO: 9273362 - DNA, 22 bp, Homo sapiens
agattcaggactggccacagcc

SEQ ID NO: 9273363 - DNA, 22 bp, Homo sapiens
agattcatgggaaagctttagg

SEQ ID NO: 9273364 - DNA, 21 bp, Homo sapiens
agattcataatctgtaaaatg

SEQ ID NO: 9273365 - DNA, 22 bp, Homo sapiens
agattcattaggagacattcag

SEQ ID NO: 9273366 - DNA, 22 bp, Homo sapiens
agattcatgggaaagctttagg

SEQ ID NO: 9273367 - DNA, 22 bp, Homo sapiens
agattcatgggtctaaccagtg

SEQ ID NO: 9273368 - DNA, 22 bp, Homo sapiens
agattcattgtggatattttct

SEQ ID NO: 9273369 - DNA, 22 bp, Homo sapiens
agattcattgctttaggcattg

SEQ ID NO: 9273370 - DNA, 22 bp, Homo sapiens
agattcattattaatgtgatct

SEQ ID NO: 9273371 - DNA, 22 bp, Homo sapiens
agatgatggccatgtcctctcc

SEQ ID NO: 9273372 - DNA, 22 bp, Homo sapiens
agatgatggccatgtcctctcc

SEQ ID NO: 9273373 - DNA, 22 bp, Homo sapiens
attttctgtaactatttctata

SEQ ID NO: 9273374 - DNA, 20 bp, Homo sapiens
attttggtgaacacagcttc

SEQ ID NO: 9273375 - DNA, 21 bp, Homo sapiens
attttgtacatagaatttgtc

SEQ ID NO: 9273376 - DNA, 22 bp, Homo sapiens
agatttatgtggtcacactcag

SEQ ID NO: 9273377 - DNA, 22 bp, Homo sapiens
agatttatgtggtcacactcag

SEQ ID NO: 9273378 - DNA, 22 bp, Homo sapiens
agatttagtggtggaattttgg

SEQ ID NO: 9273379 - DNA, 22 bp, Homo sapiens
agatttaaatttgctacaattc

SEQ ID NO: 9273380 - DNA, 22 bp, Homo sapiens
atttacaggacagcttggcatt

SEQ ID NO: 9273381 - DNA, 22 bp, Homo sapiens
atttacaggacagcttggcatt

SEQ ID NO: 9273382 - DNA, 23 bp, Homo sapiens
atttacagctgtgtgagcaagtt

SEQ ID NO: 9273383 - DNA, 22 bp, Homo sapiens
atttacaggacagcttggcatt

SEQ ID NO: 9273384 - DNA, 22 bp, Homo sapiens
atttacagccttgccatctata

SEQ ID NO: 9273385 - DNA, 22 bp, Homo sapiens
atttacagccttgaaaacagca

SEQ ID NO: 9273386 - DNA, 22 bp, Homo sapiens
atttacagccttgaaaacagca

SEQ ID NO: 9273387 - DNA, 22 bp, Homo sapiens
atttacagccttgaaaacagca

SEQ ID NO: 9273388 - DNA, 22 bp, Homo sapiens
atttacagatgatgctatttga

SEQ ID NO: 9273389 - DNA, 22 bp, Homo sapiens
atttcttttcaagagggtgctt

SEQ ID NO: 9273390 - DNA, 22 bp, Homo sapiens
atttcttttcaagagggtgctt

SEQ ID NO: 9273391 - DNA, 23 bp, Homo sapiens
atttgaaactttcttgtttccag

SEQ ID NO: 9273392 - DNA, 22 bp, Homo sapiens
atttcttttcaagagggtgctt

SEQ ID NO: 9273393 - DNA, 22 bp, Homo sapiens
atttcttgattccaccagtgaa

SEQ ID NO: 9273394 - DNA, 22 bp, Homo sapiens
atttctcttcctcctagggttg

SEQ ID NO: 9273395 - DNA, 22 bp, Homo sapiens
atttcttgcccctgctccctga

SEQ ID NO: 9273396 - DNA, 22 bp, Homo sapiens
atttctttctggccacggtttt

SEQ ID NO: 9273397 - DNA, 22 bp, Homo sapiens
atttctcttagcaagacattac

SEQ ID NO: 9273398 - DNA, 22 bp, Homo sapiens
atttctcttagcaagacattac

SEQ ID NO: 9273399 - DNA, 22 bp, Homo sapiens
atttctcttagcaagacattac

SEQ ID NO: 9273400 - DNA, 22 bp, Homo sapiens
atttacaggtagaattttaagt

SEQ ID NO: 9273401 - DNA, 22 bp, Homo sapiens
atttacaggtagaattttaagt

SEQ ID NO: 9273402 - DNA, 22 bp, Homo sapiens
atttgaaatcccttctactgta

SEQ ID NO: 9273403 - DNA, 22 bp, Homo sapiens
atttgaatggcttaacacaacg

SEQ ID NO: 9273404 - DNA, 22 bp, Homo sapiens
agatgaggggtagaaaggactt

SEQ ID NO: 9273405 - DNA, 23 bp, Homo sapiens
agatgaggcttctccatgttggt

SEQ ID NO: 9273406 - DNA, 22 bp, Homo sapiens
attcaaaagaccatgcagactc

SEQ ID NO: 9273407 - DNA, 22 bp, Homo sapiens
attcccaggtaaaagtagagct

SEQ ID NO: 9273408 - DNA, 22 bp, Homo sapiens
attctaaatgtaatttagaatt

SEQ ID NO: 9273409 - DNA, 22 bp, Homo sapiens
attctaaatcagagagctctgt

SEQ ID NO: 9273410 - DNA, 20 bp, Homo sapiens
attctaaagctctgctcttt

SEQ ID NO: 9273411 - DNA, 22 bp, Homo sapiens
attcgcgggcctggagggtggg

SEQ ID NO: 9273412 - DNA, 22 bp, Homo sapiens
attctaaagcttgtggagctta

SEQ ID NO: 9273413 - DNA, 22 bp, Homo sapiens
attctaatgccctggccccagc

SEQ ID NO: 9273414 - DNA, 22 bp, Homo sapiens
attctaatggcagagactcctg

SEQ ID NO: 9273415 - DNA, 22 bp, Homo sapiens
attctaattagttctacatgtt

SEQ ID NO: 9273416 - DNA, 22 bp, Homo sapiens
attctctggctaaaacctgaag

SEQ ID NO: 9273417 - DNA, 22 bp, Homo sapiens
attctctgggttccagtaaatg

SEQ ID NO: 9273418 - DNA, 22 bp, Homo sapiens
attctctgaagtctttcagggc

SEQ ID NO: 9273419 - DNA, 22 bp, Homo sapiens
attgaaaaatgactattgctta

SEQ ID NO: 9273420 - DNA, 19 bp, Homo sapiens
attcttctcttcctgctgt

SEQ ID NO: 9273421 - DNA, 22 bp, Homo sapiens
attcttctgcctactttcatcc

SEQ ID NO: 9273422 - DNA, 22 bp, Homo sapiens
attcttctgcctactttcatcc

SEQ ID NO: 9273423 - DNA, 22 bp, Homo sapiens
attctctgtgcagatttaagac

SEQ ID NO: 9273424 - DNA, 22 bp, Homo sapiens
attctccttattctgaaaaaag

SEQ ID NO: 9273425 - DNA, 20 bp, Homo sapiens
attctacaagaataagcatg

SEQ ID NO: 9273426 - DNA, 22 bp, Homo sapiens
attctacaacccaataataatt

SEQ ID NO: 9273427 - DNA, 19 bp, Homo sapiens
attctccctagaattttga

SEQ ID NO: 9273428 - DNA, 22 bp, Homo sapiens
agaggccgggtgcctgctcaga

SEQ ID NO: 9273429 - DNA, 22 bp, Homo sapiens
agaggccctgggctggtgtgct

SEQ ID NO: 9273430 - DNA, 22 bp, Homo sapiens
agaggccggccgagcccatggg

SEQ ID NO: 9273431 - DNA, 19 bp, Homo sapiens
agaggcctcagcagctggc

SEQ ID NO: 9273432 - DNA, 22 bp, Homo sapiens
agaggcctccctcccagctggt

SEQ ID NO: 9273433 - DNA, 22 bp, Homo sapiens
agaggcctccgaaaggtgggct

SEQ ID NO: 9273434 - DNA, 22 bp, Homo sapiens
attatttctcactcacataata

SEQ ID NO: 9273435 - DNA, 22 bp, Homo sapiens
attatttctcactcacataata

SEQ ID NO: 9273436 - DNA, 22 bp, Homo sapiens
attatttctcactcacataata

SEQ ID NO: 9273437 - DNA, 22 bp, Homo sapiens
attattttatgtgcggcctgat

SEQ ID NO: 9273438 - DNA, 22 bp, Homo sapiens
attattttatgtgcggcctgat

SEQ ID NO: 9273439 - DNA, 22 bp, Homo sapiens
attattttatgtgcggcctgat

SEQ ID NO: 9273440 - DNA, 22 bp, Homo sapiens
attattttatgtgcggcctgat

SEQ ID NO: 9273441 - DNA, 22 bp, Homo sapiens
attatttgagttcctctctacc

SEQ ID NO: 9273442 - DNA, 22 bp, Homo sapiens
attatttgcttggctcatctaa

SEQ ID NO: 9273443 - DNA, 22 bp, Homo sapiens
agaggccagggacactgctcaa

SEQ ID NO: 9273444 - DNA, 22 bp, Homo sapiens
agaggaaaatgagttccagaat

SEQ ID NO: 9273445 - DNA, 23 bp, Homo sapiens
agagctttctaaaatgtaaatct

SEQ ID NO: 9273446 - DNA, 22 bp, Homo sapiens
agagctttgggacatttgctag

SEQ ID NO: 9273447 - DNA, 22 bp, Homo sapiens
agagcttttctgtaataacatc

SEQ ID NO: 9273448 - DNA, 22 bp, Homo sapiens
attaataaaataccactttgtt

SEQ ID NO: 9273449 - DNA, 22 bp, Homo sapiens
agagcttatatcttggccatcc

SEQ ID NO: 9273450 - DNA, 23 bp, Homo sapiens
agagcttagggaattcacatgag

SEQ ID NO: 9273451 - DNA, 22 bp, Homo sapiens
agagcttagaatttcagatgat

SEQ ID NO: 9273452 - DNA, 22 bp, Homo sapiens
agatacagcctgccaggttctt

SEQ ID NO: 9273453 - DNA, 22 bp, Homo sapiens
atttacagacgtggattagtgc

SEQ ID NO: 9273454 - DNA, 22 bp, Homo sapiens
agatacacagccctgccatcac

SEQ ID NO: 9273455 - DNA, 22 bp, Homo sapiens
agatacaccggaacctgaggct

SEQ ID NO: 9273456 - DNA, 22 bp, Homo sapiens
agatacacagaggtaaagatga

SEQ ID NO: 9273457 - DNA, 22 bp, Homo sapiens
agataattatttacttcaaagt

SEQ ID NO: 9273458 - DNA, 22 bp, Homo sapiens
agataattatgtcaatttcttg

SEQ ID NO: 9273459 - DNA, 22 bp, Homo sapiens
agataatttgagtaaattaatt

SEQ ID NO: 9273460 - DNA, 22 bp, Homo sapiens
agataatttgagtaaattaatt

SEQ ID NO: 9273461 - DNA, 22 bp, Homo sapiens
agatacaaaagataagatttag

SEQ ID NO: 9273462 - DNA, 22 bp, Homo sapiens
attgtggtgtcagttataggca

SEQ ID NO: 9273463 - DNA, 22 bp, Homo sapiens
attgttaaactgaagcattact

SEQ ID NO: 9273464 - DNA, 22 bp, Homo sapiens
attgttaaaaaggtggaaatgc

SEQ ID NO: 9273465 - DNA, 22 bp, Homo sapiens
attgttaaaaaggtggaaatgc

SEQ ID NO: 9273466 - DNA, 22 bp, Homo sapiens
attgttaaagtaataaccatgg

SEQ ID NO: 9273467 - DNA, 22 bp, Homo sapiens
attgttaataactattacattg

SEQ ID NO: 9273468 - DNA, 22 bp, Homo sapiens
attgttaaagtaataaccatgg

SEQ ID NO: 9273469 - DNA, 22 bp, Homo sapiens
attgtattagcacaatacaatt

SEQ ID NO: 9273470 - DNA, 22 bp, Homo sapiens
attgtatttccagcttgaatgt

SEQ ID NO: 9273471 - DNA, 22 bp, Homo sapiens
attgtatttccagcttgaatgt

SEQ ID NO: 9273472 - DNA, 22 bp, Homo sapiens
attgtatttccagcttgaatgt

SEQ ID NO: 9273473 - DNA, 14 bp, Homo sapiens
attgtgcatgccat

SEQ ID NO: 9273474 - DNA, 22 bp, Homo sapiens
attgaaaataaggccagaaaca

SEQ ID NO: 9273475 - DNA, 22 bp, Homo sapiens
attgaaaaattcacaattctgg

SEQ ID NO: 9273476 - DNA, 22 bp, Homo sapiens
attgaaaaatgactattgctta

SEQ ID NO: 9273477 - DNA, 22 bp, Homo sapiens
attgaaaaatgactattgctta

SEQ ID NO: 9273478 - DNA, 22 bp, Homo sapiens
attgaaaatataattctaggag

SEQ ID NO: 9273479 - DNA, 22 bp, Homo sapiens
attgaaaataaggccagaaaca

SEQ ID NO: 9273480 - DNA, 22 bp, Homo sapiens
attgaaaatataattctaggag

SEQ ID NO: 9273481 - DNA, 22 bp, Homo sapiens
attgaaagagaatgtagctctt

SEQ ID NO: 9273482 - DNA, 22 bp, Homo sapiens
attgaaagataggctactgtgg

SEQ ID NO: 9273483 - DNA, 22 bp, Homo sapiens
attgaaagataggctactgtgg

SEQ ID NO: 9273484 - DNA, 22 bp, Homo sapiens
attgaaaatgacatttgtgccc

SEQ ID NO: 9273485 - DNA, 22 bp, Homo sapiens
attgaaagcatggatttggatt

SEQ ID NO: 9273486 - DNA, 22 bp, Homo sapiens
attgaaagatatactgttctca

SEQ ID NO: 9273487 - DNA, 22 bp, Homo sapiens
attgaaagattttgggctcatg

SEQ ID NO: 9273488 - DNA, 22 bp, Homo sapiens
attgaaaggcaaagtaggaagc

SEQ ID NO: 9273489 - DNA, 22 bp, Homo sapiens
attgaaaggttttgagcagata

SEQ ID NO: 9273490 - DNA, 22 bp, Homo sapiens
attgaaagtcctatctaaggga

SEQ ID NO: 9273491 - DNA, 22 bp, Homo sapiens
attgagaaaataagtatggata

SEQ ID NO: 9273492 - DNA, 22 bp, Homo sapiens
attgagaaaattcgagcaagtt

SEQ ID NO: 9273493 - DNA, 22 bp, Homo sapiens
attgagaaatataatctggaaa

SEQ ID NO: 9273494 - DNA, 22 bp, Homo sapiens
attgagaagaaaatctaatata

SEQ ID NO: 9273495 - DNA, 22 bp, Homo sapiens
attgaggagcagagatggggta

SEQ ID NO: 9273496 - DNA, 22 bp, Homo sapiens
attgagaatccatttgagatga

SEQ ID NO: 9273497 - DNA, 22 bp, Homo sapiens
attgagaatattgtgacagtgt

SEQ ID NO: 9273498 - DNA, 22 bp, Homo sapiens
attgtataagtctatttacaat

SEQ ID NO: 9273499 - DNA, 22 bp, Homo sapiens
attgtataagtctatttacaat

SEQ ID NO: 9273500 - DNA, 22 bp, Homo sapiens
attgtataagtctatttacaat

SEQ ID NO: 9273501 - DNA, 22 bp, Homo sapiens
attgtataattgtattgccaaa

SEQ ID NO: 9273502 - DNA, 22 bp, Homo sapiens
attgtataattgtattgccaaa

SEQ ID NO: 9273503 - DNA, 22 bp, Homo sapiens
attgtatacaagcttaattgtt

SEQ ID NO: 9273504 - DNA, 22 bp, Homo sapiens
attgtatacaagcttaattgtt

SEQ ID NO: 9273505 - DNA, 22 bp, Homo sapiens
attgtataacagcatgtatttt

SEQ ID NO: 9273506 - DNA, 22 bp, Homo sapiens
attgtataacagcatgtatttt

SEQ ID NO: 9273507 - DNA, 22 bp, Homo sapiens
atgacatttatacagtgagctt

SEQ ID NO: 9273508 - DNA, 22 bp, Homo sapiens
atgacattgacagacctgctgc

SEQ ID NO: 9273509 - DNA, 22 bp, Homo sapiens
atgacccttactgcatcataca

SEQ ID NO: 9273510 - DNA, 22 bp, Homo sapiens
atgactaatggaaaatacaatg

SEQ ID NO: 9273511 - DNA, 22 bp, Homo sapiens
atgacaatacttcaataagctg

SEQ ID NO: 9273512 - DNA, 22 bp, Homo sapiens
atgacaatatagctttgatttt

SEQ ID NO: 9273513 - DNA, 23 bp, Homo sapiens
atcttacatatttagcacctgaa

SEQ ID NO: 9273514 - DNA, 22 bp, Homo sapiens
atcttacattccctcaccattt

SEQ ID NO: 9273515 - DNA, 23 bp, Homo sapiens
atcttacatatttagcacctgaa

SEQ ID NO: 9273516 - DNA, 22 bp, Homo sapiens
atcttaaacagaggaatgactt

SEQ ID NO: 9273517 - DNA, 22 bp, Homo sapiens
atcttaaacagaggaatgactt

SEQ ID NO: 9273518 - DNA, 22 bp, Homo sapiens
atcttacaattacaagacactc

SEQ ID NO: 9273519 - DNA, 22 bp, Homo sapiens
atcttacaattacaagacactc

SEQ ID NO: 9273520 - DNA, 22 bp, Homo sapiens
atcttacactgttgggtttctc

SEQ ID NO: 9273521 - DNA, 22 bp, Homo sapiens
atcttacacgataactgttagt

SEQ ID NO: 9273522 - DNA, 22 bp, Homo sapiens
atcttacagcagcaaggaagta

SEQ ID NO: 9273523 - DNA, 19 bp, Homo sapiens
atcttacagagcagagtac

SEQ ID NO: 9273524 - DNA, 19 bp, Homo sapiens
atcttacagagcagagtac

SEQ ID NO: 9273525 - DNA, 22 bp, Homo sapiens
atctgggctcgaatcctagctc

SEQ ID NO: 9273526 - DNA, 22 bp, Homo sapiens
atctggggaggtatctgtagtc

SEQ ID NO: 9273527 - DNA, 22 bp, Homo sapiens
atctggggtcagacagccctgg

SEQ ID NO: 9273528 - DNA, 22 bp, Homo sapiens
atctggggtcagacagccctgg

SEQ ID NO: 9273529 - DNA, 22 bp, Homo sapiens
atctgttgtttttcaccaccca

SEQ ID NO: 9273530 - DNA, 21 bp, Homo sapiens
atcttaaaaggtcttaacttt

SEQ ID NO: 9273531 - DNA, 21 bp, Homo sapiens
atcttaaaaggtcttaacttt

SEQ ID NO: 9273532 - DNA, 22 bp, Homo sapiens
atctgggagtcttggctctgct

SEQ ID NO: 9273533 - DNA, 22 bp, Homo sapiens
atgaggcaaggctggccgtgtt

SEQ ID NO: 9273534 - DNA, 22 bp, Homo sapiens
atgaggattaactgttgtcata

SEQ ID NO: 9273535 - DNA, 22 bp, Homo sapiens
atgaggcaaaggtggaggtggg

SEQ ID NO: 9273536 - DNA, 22 bp, Homo sapiens
atgaggcacatcacagccaatg

SEQ ID NO: 9273537 - DNA, 22 bp, Homo sapiens
atgatatagagagtagattaaa

SEQ ID NO: 9273538 - DNA, 22 bp, Homo sapiens
atgaggcacgtgttactggcct

SEQ ID NO: 9273539 - DNA, 22 bp, Homo sapiens
atgaggagaccaaggcctgatg

SEQ ID NO: 9273540 - DNA, 22 bp, Homo sapiens
atgagaaagagttgtatctaga

SEQ ID NO: 9273541 - DNA, 22 bp, Homo sapiens
atgacttctgctttacagagtt

SEQ ID NO: 9273542 - DNA, 22 bp, Homo sapiens
atgacttattacaagtcatatt

SEQ ID NO: 9273543 - DNA, 22 bp, Homo sapiens
atgattctggcaaatttattat

SEQ ID NO: 9273544 - DNA, 21 bp, Homo sapiens
atgattctgcaaatgagtagt

SEQ ID NO: 9273545 - DNA, 22 bp, Homo sapiens
atgattctctgctactctaaat

SEQ ID NO: 9273546 - DNA, 22 bp, Homo sapiens
atgattctcattttataaactt

SEQ ID NO: 9273547 - DNA, 22 bp, Homo sapiens
atgattctcattttataaactt

SEQ ID NO: 9273548 - DNA, 22 bp, Homo sapiens
atgattctaggcattgaagata

SEQ ID NO: 9273549 - DNA, 22 bp, Homo sapiens
atgatatatgtgttgagcttgc

SEQ ID NO: 9273550 - DNA, 22 bp, Homo sapiens
atgattcttttggatagatgat

SEQ ID NO: 9273551 - DNA, 22 bp, Homo sapiens
atgattctggtgagaatgagga

SEQ ID NO: 9273552 - DNA, 22 bp, Homo sapiens
atgattgaccatctgctgggct

SEQ ID NO: 9273553 - DNA, 22 bp, Homo sapiens
atgatttgttaacagacttaat

SEQ ID NO: 9273554 - DNA, 22 bp, Homo sapiens
atgctaaaaacttgatcattat

SEQ ID NO: 9273555 - DNA, 22 bp, Homo sapiens
atgctgaaaattggatttgaat

SEQ ID NO: 9273556 - DNA, 22 bp, Homo sapiens
atgctgaaatttattggtaagg

SEQ ID NO: 9273557 - DNA, 22 bp, Homo sapiens
atgctgaagagagaactactca

SEQ ID NO: 9273558 - DNA, 22 bp, Homo sapiens
atgctgaactgagatgtaactt

SEQ ID NO: 9273559 - DNA, 22 bp, Homo sapiens
atgctgaactgagatgtaactt

SEQ ID NO: 9273560 - DNA, 22 bp, Homo sapiens
atgctgaattgatgcgagggag

SEQ ID NO: 9273561 - DNA, 22 bp, Homo sapiens
atgctgacagactattaactat

SEQ ID NO: 9273562 - DNA, 22 bp, Homo sapiens
atgctgacttctctctgcagtg

SEQ ID NO: 9273563 - DNA, 21 bp, Homo sapiens
atgctgaatcttgttgtgctc

SEQ ID NO: 9273564 - DNA, 22 bp, Homo sapiens
atgctgaatgaaagaaattagt

SEQ ID NO: 9273565 - DNA, 22 bp, Homo sapiens
atgctgaagagtgcacaggcta

SEQ ID NO: 9273566 - DNA, 22 bp, Homo sapiens
atgctgaagagttcatgattat

SEQ ID NO: 9273567 - DNA, 22 bp, Homo sapiens
atgctgaaggtgaattgacaat

SEQ ID NO: 9273568 - DNA, 22 bp, Homo sapiens
atgctgatctgtaataagattt

SEQ ID NO: 9273569 - DNA, 22 bp, Homo sapiens
atgctgcagtcaggccagattg

SEQ ID NO: 9273570 - DNA, 22 bp, Homo sapiens
atgctgcagctgcaggatcaga

SEQ ID NO: 9273571 - DNA, 22 bp, Homo sapiens
atgcttaatgagggtatatatg

SEQ ID NO: 9273572 - DNA, 22 bp, Homo sapiens
atgctgagatcctcaggccaga

SEQ ID NO: 9273573 - DNA, 22 bp, Homo sapiens
atgctgagataaggctttagtc

SEQ ID NO: 9273574 - DNA, 22 bp, Homo sapiens
atgctgagactggagcagctgg

SEQ ID NO: 9273575 - DNA, 22 bp, Homo sapiens
atgctgagactggagcagctgg

SEQ ID NO: 9273576 - DNA, 22 bp, Homo sapiens
atgctgaggacaaagagatcaa

SEQ ID NO: 9273577 - DNA, 22 bp, Homo sapiens
atgctgagcagagctgacatgc

SEQ ID NO: 9273578 - DNA, 22 bp, Homo sapiens
atgctgagtgagtgaaacccag

SEQ ID NO: 9273579 - DNA, 22 bp, Homo sapiens
agagaaaagccatcccagccaa

SEQ ID NO: 9273580 - DNA, 22 bp, Homo sapiens
atgcttgaaaaccccatgaata

SEQ ID NO: 9273581 - DNA, 22 bp, Homo sapiens
agagaaacaggtcagctgggag

SEQ ID NO: 9273582 - DNA, 22 bp, Homo sapiens
agagaaatttccctgccttctg

SEQ ID NO: 9273583 - DNA, 22 bp, Homo sapiens
atgcttcttgtatttggctgac

SEQ ID NO: 9273584 - DNA, 22 bp, Homo sapiens
agagaacagacagatgcaatga

SEQ ID NO: 9273585 - DNA, 22 bp, Homo sapiens
agagaacacgtgcatctgcaat

SEQ ID NO: 9273586 - DNA, 22 bp, Homo sapiens
atgcttccaaggctaagacaag

SEQ ID NO: 9273587 - DNA, 22 bp, Homo sapiens
atgcttcagtgctaccttcaaa

SEQ ID NO: 9273588 - DNA, 22 bp, Homo sapiens
atgcttcagatttggggtatta

SEQ ID NO: 9273589 - DNA, 22 bp, Homo sapiens
atgccagcctctaagcacttta

SEQ ID NO: 9273590 - DNA, 22 bp, Homo sapiens
atgccaggaacaaacagtggtg

SEQ ID NO: 9273591 - DNA, 22 bp, Homo sapiens
atgccaggagatggagcagagt

SEQ ID NO: 9273592 - DNA, 22 bp, Homo sapiens
atgccactgcactccagcctag

SEQ ID NO: 9273593 - DNA, 22 bp, Homo sapiens
atgccacttcattccagcctcg

SEQ ID NO: 9273594 - DNA, 22 bp, Homo sapiens
atgcaaattgccataaagtggg

SEQ ID NO: 9273595 - DNA, 22 bp, Homo sapiens
agacagtgtgtgtatatatggt

SEQ ID NO: 9273596 - DNA, 22 bp, Homo sapiens
agacataagcgagcatcacagg

SEQ ID NO: 9273597 - DNA, 22 bp, Homo sapiens
atgccaggctgtttggcctcag

SEQ ID NO: 9273598 - DNA, 22 bp, Homo sapiens
atgccagtgttataaatagata

SEQ ID NO: 9273599 - DNA, 22 bp, Homo sapiens
agacagtggatcgggatgcact

SEQ ID NO: 9273600 - DNA, 23 bp, Homo sapiens
agacagtggccgagaggtactag

SEQ ID NO: 9273601 - DNA, 22 bp, Homo sapiens
atgccattgctttaaaattaag

SEQ ID NO: 9273602 - DNA, 22 bp, Homo sapiens
agacagtgctatcccatctgtg

SEQ ID NO: 9273603 - DNA, 22 bp, Homo sapiens
atggacagcaactggaagcttc

SEQ ID NO: 9273604 - DNA, 21 bp, Homo sapiens
atggacaattgagtgtctgtc

SEQ ID NO: 9273605 - DNA, 22 bp, Homo sapiens
atggacaatgtgaaactacaag

SEQ ID NO: 9273606 - DNA, 22 bp, Homo sapiens
agagaacatgacgtaatagtgg

SEQ ID NO: 9273607 - DNA, 22 bp, Homo sapiens
agagaagacttacagccacagt

SEQ ID NO: 9273608 - DNA, 22 bp, Homo sapiens
agagaactactttttatatgtg

SEQ ID NO: 9273609 - DNA, 22 bp, Homo sapiens
agagaacagcctcctagagaaa

SEQ ID NO: 9273610 - DNA, 22 bp, Homo sapiens
agagaacatattttgtatgatt

SEQ ID NO: 9273611 - DNA, 22 bp, Homo sapiens
atggacaggtactgcagtgggt

SEQ ID NO: 9273612 - DNA, 18 bp, Homo sapiens
atgggaggggccaagaga

SEQ ID NO: 9273613 - DNA, 18 bp, Homo sapiens
atgggaggggccaagaga

SEQ ID NO: 9273614 - DNA, 22 bp, Homo sapiens
atgggcagtaacagtggcagtc

SEQ ID NO: 9273615 - DNA, 22 bp, Homo sapiens
atgggcagttaggaggccagga

SEQ ID NO: 9273616 - DNA, 22 bp, Homo sapiens
atgggcagttaggaggccagga

SEQ ID NO: 9273617 - DNA, 22 bp, Homo sapiens
atgggcatgcttctagttgaaa

SEQ ID NO: 9273618 - DNA, 23 bp, Homo sapiens
atgggccaagcaagacccatgac

SEQ ID NO: 9273619 - DNA, 22 bp, Homo sapiens
atgggcagtgtattggaaggaa

SEQ ID NO: 9273620 - DNA, 22 bp, Homo sapiens
atgggcagttaggaggccagga

SEQ ID NO: 9273621 - DNA, 22 bp, Homo sapiens
atgggcagtaacagtggcagtc

SEQ ID NO: 9273622 - DNA, 22 bp, Homo sapiens
atgggcagtaacagtggcagtc

SEQ ID NO: 9273623 - DNA, 22 bp, Homo sapiens
atgtacatactgcattttcaaa

SEQ ID NO: 9273624 - DNA, 17 bp, Homo sapiens
agagagaaaagggccat

SEQ ID NO: 9273625 - DNA, 22 bp, Homo sapiens
agagactgtgccagccccatgc

SEQ ID NO: 9273626 - DNA, 22 bp, Homo sapiens
agagactttgtctattttgttc

SEQ ID NO: 9273627 - DNA, 22 bp, Homo sapiens
agagactgtgtccatcgtgcct

SEQ ID NO: 9273628 - DNA, 22 bp, Homo sapiens
agagactgcaatgagtggtagg

SEQ ID NO: 9273629 - DNA, 19 bp, Homo sapiens
atgggctatggtgctgttt

SEQ ID NO: 9273630 - DNA, 22 bp, Homo sapiens
atgggctaaacttagaggatat

SEQ ID NO: 9273631 - DNA, 22 bp, Homo sapiens
agagactggcttctaaaatggc

SEQ ID NO: 9273632 - DNA, 22 bp, Homo sapiens
agagactgcgtgtcagcgctgg

SEQ ID NO: 9273633 - DNA, 22 bp, Homo sapiens
agagatggcgtctcagagcctg

SEQ ID NO: 9273634 - DNA, 22 bp, Homo sapiens
agagatgggaaggcagacttca

SEQ ID NO: 9273635 - DNA, 18 bp, Homo sapiens
agagatgggagttggaaa

SEQ ID NO: 9273636 - DNA, 22 bp, Homo sapiens
agagatgggcgggggcttctgc

SEQ ID NO: 9273637 - DNA, 22 bp, Homo sapiens
agagatgggcgggggcttctgc

SEQ ID NO: 9273638 - DNA, 20 bp, Homo sapiens
agagatggggtatcaccgta

SEQ ID NO: 9273639 - DNA, 22 bp, Homo sapiens
atgtatatgcatgcattcaaag

SEQ ID NO: 9273640 - DNA, 22 bp, Homo sapiens
atgtagttagaagattcaaaca

SEQ ID NO: 9273641 - DNA, 22 bp, Homo sapiens
atgtagtttggggctagattta

SEQ ID NO: 9273642 - DNA, 22 bp, Homo sapiens
atgtataagtacacagtcggaa

SEQ ID NO: 9273643 - DNA, 22 bp, Homo sapiens
atgtataatgctaattagctag

SEQ ID NO: 9273644 - DNA, 22 bp, Homo sapiens
atgtataatgctaattagctag

SEQ ID NO: 9273645 - DNA, 22 bp, Homo sapiens
atgtataatgctaattagctag

SEQ ID NO: 9273646 - DNA, 22 bp, Homo sapiens
atgtatatgaagctagtatttt

SEQ ID NO: 9273647 - DNA, 22 bp, Homo sapiens
atgtatatgaagctagtatttt

SEQ ID NO: 9273648 - DNA, 23 bp, Homo sapiens
atgtgcaaagtgctacagtatag

SEQ ID NO: 9273649 - DNA, 21 bp, Homo sapiens
atgtgcagcaagcagcatgct

SEQ ID NO: 9273650 - DNA, 22 bp, Homo sapiens
atgtgattcccactgaatcact

SEQ ID NO: 9273651 - DNA, 22 bp, Homo sapiens
atgtgagtgctatgatagacag

SEQ ID NO: 9273652 - DNA, 22 bp, Homo sapiens
atgtcttgatattttactgttt

SEQ ID NO: 9273653 - DNA, 22 bp, Homo sapiens
agagattcatgtttactgtagg

SEQ ID NO: 9273654 - DNA, 22 bp, Homo sapiens
agagattctgtgtcaaaacgaa

SEQ ID NO: 9273655 - DNA, 22 bp, Homo sapiens
agagatgtcgccttgcccaggg

SEQ ID NO: 9273656 - DNA, 22 bp, Homo sapiens
agagatgttcattcagcatgtt

SEQ ID NO: 9273657 - DNA, 22 bp, Homo sapiens
agagattaagtcacttggtcag

SEQ ID NO: 9273658 - DNA, 22 bp, Homo sapiens
agagattagcctggattatgca

SEQ ID NO: 9273659 - DNA, 22 bp, Homo sapiens
agagatggtagaacagtcataa

SEQ ID NO: 9273660 - DNA, 22 bp, Homo sapiens
agagatggtagaacagtcataa

SEQ ID NO: 9273661 - DNA, 18 bp, Homo sapiens
agagatggtgtagagttt

SEQ ID NO: 9273662 - DNA, 18 bp, Homo sapiens
agagatggtgtagagttt

SEQ ID NO: 9273663 - DNA, 22 bp, Homo sapiens
atgttacacataggcataaatg

SEQ ID NO: 9273664 - DNA, 22 bp, Homo sapiens
atgttattttggaaaatacaaa

SEQ ID NO: 9273665 - DNA, 22 bp, Homo sapiens
atgttattttggaaaatacaaa

SEQ ID NO: 9273666 - DNA, 22 bp, Homo sapiens
atgttattttggaaaatacaaa

SEQ ID NO: 9273667 - DNA, 22 bp, Homo sapiens
atgttacagaaagcaaagatga

SEQ ID NO: 9273668 - DNA, 22 bp, Homo sapiens
agagccagcatttgacactggc

SEQ ID NO: 9273669 - DNA, 22 bp, Homo sapiens
agagccagcatttgacactggc

SEQ ID NO: 9273670 - DNA, 22 bp, Homo sapiens
agagccaggaagtggcgtgggg

SEQ ID NO: 9273671 - DNA, 22 bp, Homo sapiens
agagccaggaagtggcgtgggg

SEQ ID NO: 9273672 - DNA, 22 bp, Homo sapiens
agagccagcatttgggccctgc

SEQ ID NO: 9273673 - DNA, 22 bp, Homo sapiens
atgttctatatcattattgtga

SEQ ID NO: 9273674 - DNA, 19 bp, Homo sapiens
atgttctatcctccaagtt

SEQ ID NO: 9273675 - DNA, 22 bp, Homo sapiens
agagcctgttttgtgggagatg

SEQ ID NO: 9273676 - DNA, 22 bp, Homo sapiens
agagcgcactgtctgcaggcaa

SEQ ID NO: 9273677 - DNA, 22 bp, Homo sapiens
agagctaagaaacagaattgct

SEQ ID NO: 9273678 - DNA, 22 bp, Homo sapiens
atgttcctggtatatcatgacc

SEQ ID NO: 9273679 - DNA, 22 bp, Homo sapiens
atgttcctgatcctcgttctat

SEQ ID NO: 9273680 - DNA, 22 bp, Homo sapiens
atgttcaaactttttacacacc

SEQ ID NO: 9273681 - DNA, 22 bp, Homo sapiens
attaagtgactaaagtaatgct

SEQ ID NO: 9273682 - DNA, 22 bp, Homo sapiens
attaagtgactaaagtaatgct

SEQ ID NO: 9273683 - DNA, 18 bp, Homo sapiens
attaaggaattctttaga

SEQ ID NO: 9273684 - DNA, 22 bp, Homo sapiens
attaaggaagcctattctctcc

SEQ ID NO: 9273685 - DNA, 22 bp, Homo sapiens
attaaggaatgtaggcaagaag

SEQ ID NO: 9273686 - DNA, 22 bp, Homo sapiens
attaaggattatactctccttt

SEQ ID NO: 9273687 - DNA, 22 bp, Homo sapiens
attaaggaggtaaactatggtt

SEQ ID NO: 9273688 - DNA, 22 bp, Homo sapiens
attaaggagggctgggcatgat

SEQ ID NO: 9273689 - DNA, 22 bp, Homo sapiens
agagctctgcagctggcctcag

SEQ ID NO: 9273690 - DNA, 22 bp, Homo sapiens
agagctctgcagctggcctcag

SEQ ID NO: 9273691 - DNA, 22 bp, Homo sapiens
attaaatactgcaggctaagca

SEQ ID NO: 9273692 - DNA, 22 bp, Homo sapiens
attaaatactgcaggctaagca

SEQ ID NO: 9273693 - DNA, 22 bp, Homo sapiens
attaaggaacaaagccttttga

SEQ ID NO: 9273694 - DNA, 22 bp, Homo sapiens
attaagctctccaggaaatgta

SEQ ID NO: 9273695 - DNA, 22 bp, Homo sapiens
agagctcaagacgctcacagta

SEQ ID NO: 9273696 - DNA, 21 bp, Homo sapiens
agagctcaaggcaaaaataat

SEQ ID NO: 9273697 - DNA, 22 bp, Homo sapiens
aggggcaggtgctgcacttaga

SEQ ID NO: 9273698 - DNA, 22 bp, Homo sapiens
aggggcaggtgctgcacttaga

SEQ ID NO: 9273699 - DNA, 22 bp, Homo sapiens
aggggcagttccaagttttgtg

SEQ ID NO: 9273700 - DNA, 22 bp, Homo sapiens
aggggagcgacattccgtgccg

SEQ ID NO: 9273701 - DNA, 22 bp, Homo sapiens
aggggagcaacatagtcactct

SEQ ID NO: 9273702 - DNA, 22 bp, Homo sapiens
aggggagcaacatagtcactct

SEQ ID NO: 9273703 - DNA, 22 bp, Homo sapiens
aggggagcaaggccgtggtgta

SEQ ID NO: 9273704 - DNA, 22 bp, Homo sapiens
aggggagcaaggccgtggtgta

SEQ ID NO: 9273705 - DNA, 22 bp, Homo sapiens
aggggagcaaggccgtggtgta

SEQ ID NO: 9273706 - DNA, 22 bp, Homo sapiens
aggggagccagggctgcgagtt

SEQ ID NO: 9273707 - DNA, 22 bp, Homo sapiens
aggggagccgaggggcatctgt

SEQ ID NO: 9273708 - DNA, 22 bp, Homo sapiens
aggggagccgaggggcatctgt

SEQ ID NO: 9273709 - DNA, 22 bp, Homo sapiens
agggctgaagggaggtgctcat

SEQ ID NO: 9273710 - DNA, 22 bp, Homo sapiens
agggctgaagttatggctgagc

SEQ ID NO: 9273711 - DNA, 22 bp, Homo sapiens
agggctgaaacataatccttct

SEQ ID NO: 9273712 - DNA, 22 bp, Homo sapiens
agggctgaagggaggtgctcat

SEQ ID NO: 9273713 - DNA, 22 bp, Homo sapiens
agggctgaagggaggtgctcat

SEQ ID NO: 9273714 - DNA, 22 bp, Homo sapiens
agggctgacaaatggcagtgac

SEQ ID NO: 9273715 - DNA, 22 bp, Homo sapiens
agggctgacaaatggcagtgac

SEQ ID NO: 9273716 - DNA, 23 bp, Homo sapiens
agggctgaatgcagagaagcaga

SEQ ID NO: 9273717 - DNA, 23 bp, Homo sapiens
agggctgaatgcagagaagcaga

SEQ ID NO: 9273718 - DNA, 22 bp, Homo sapiens
agggctgacaaatggcagtgac

SEQ ID NO: 9273719 - DNA, 22 bp, Homo sapiens
agggctgacacaccttatcctc

SEQ ID NO: 9273720 - DNA, 22 bp, Homo sapiens
agggctgacaaatggcagtgac

SEQ ID NO: 9273721 - DNA, 22 bp, Homo sapiens
agggctgacagtaaaagtatga

SEQ ID NO: 9273722 - DNA, 22 bp, Homo sapiens
agggctgacagtgaggagtcaa

SEQ ID NO: 9273723 - DNA, 22 bp, Homo sapiens
agggctcagggcacgtcatcca

SEQ ID NO: 9273724 - DNA, 22 bp, Homo sapiens
agggctcagcatctcattctgt

SEQ ID NO: 9273725 - DNA, 20 bp, Homo sapiens
agggtcagtagcacagagct

SEQ ID NO: 9273726 - DNA, 22 bp, Homo sapiens
aggggttggatttggcctagag

SEQ ID NO: 9273727 - DNA, 22 bp, Homo sapiens
aggggttggacataagacagaa

SEQ ID NO: 9273728 - DNA, 22 bp, Homo sapiens
aggggtgtgcatcctggaggat

SEQ ID NO: 9273729 - DNA, 16 bp, Homo sapiens
acctccagtcaagggt

SEQ ID NO: 9273730 - DNA, 22 bp, Homo sapiens
acctccagctttttagagacat

SEQ ID NO: 9273731 - DNA, 22 bp, Homo sapiens
acctccaggaagctcttggtac

SEQ ID NO: 9273732 - DNA, 22 bp, Homo sapiens
acctcccagctctgagcttggg

SEQ ID NO: 9273733 - DNA, 22 bp, Homo sapiens
aggggtgacacatatcagtgca

SEQ ID NO: 9273734 - DNA, 22 bp, Homo sapiens
acctcccagaaagttttgcagg

SEQ ID NO: 9273735 - DNA, 20 bp, Homo sapiens
aggggtgatcgggtgacact

SEQ ID NO: 9273736 - DNA, 22 bp, Homo sapiens
aggggtgacacatatcagtgca

SEQ ID NO: 9273737 - DNA, 22 bp, Homo sapiens
aggggtgatttgggacaggaca

SEQ ID NO: 9273738 - DNA, 22 bp, Homo sapiens
aggggtgatttgggacaggaca

SEQ ID NO: 9273739 - DNA, 22 bp, Homo sapiens
aggggtgatttgggacaggaca

SEQ ID NO: 9273740 - DNA, 22 bp, Homo sapiens
aggggtggagagtgttgccagt

SEQ ID NO: 9273741 - DNA, 22 bp, Homo sapiens
aggggtggcctgccttactccc

SEQ ID NO: 9273742 - DNA, 22 bp, Homo sapiens
aggggccattgttctgcccgct

SEQ ID NO: 9273743 - DNA, 22 bp, Homo sapiens
aggggccatgtaagtgtatcac

SEQ ID NO: 9273744 - DNA, 21 bp, Homo sapiens
aggggcccttgccaggacgcc

SEQ ID NO: 9273745 - DNA, 21 bp, Homo sapiens
aggggcccttgccaggacgcc

SEQ ID NO: 9273746 - DNA, 22 bp, Homo sapiens
aggggccaccaccaaggaaggt

SEQ ID NO: 9273747 - DNA, 22 bp, Homo sapiens
aggggccaccaccaaggaaggt

SEQ ID NO: 9273748 - DNA, 22 bp, Homo sapiens
aggggccaccaccaaggaaggt

SEQ ID NO: 9273749 - DNA, 20 bp, Homo sapiens
aggggcctggaacaggcctt

SEQ ID NO: 9273750 - DNA, 22 bp, Homo sapiens
aggggcctcgcaggaccgctcc

SEQ ID NO: 9273751 - DNA, 22 bp, Homo sapiens
aggggcctcgcaggaccgctcc

SEQ ID NO: 9273752 - DNA, 22 bp, Homo sapiens
aggggcctcctcattggagtgt

SEQ ID NO: 9273753 - DNA, 22 bp, Homo sapiens
aggggcctcagcctcctggtca

SEQ ID NO: 9273754 - DNA, 21 bp, Homo sapiens
acctcaagcaacaaccaaggt

SEQ ID NO: 9273755 - DNA, 22 bp, Homo sapiens
accctttgtcaagcacagaaga

SEQ ID NO: 9273756 - DNA, 22 bp, Homo sapiens
acctcacaagtctctgtcagct

SEQ ID NO: 9273757 - DNA, 22 bp, Homo sapiens
acctcagagatacaaaccatgg

SEQ ID NO: 9273758 - DNA, 22 bp, Homo sapiens
acctcagaggaggctcctggct

SEQ ID NO: 9273759 - DNA, 22 bp, Homo sapiens
acctcagttcaattcagttaga

SEQ ID NO: 9273760 - DNA, 22 bp, Homo sapiens
agggccagatgaagccacaagc

SEQ ID NO: 9273761 - DNA, 22 bp, Homo sapiens
agggccagatgaagccacaagc

SEQ ID NO: 9273762 - DNA, 21 bp, Homo sapiens
agggccagatcaccaaggagc

SEQ ID NO: 9273763 - DNA, 21 bp, Homo sapiens
agggccagatcaccaaggagc

SEQ ID NO: 9273764 - DNA, 22 bp, Homo sapiens
agggccagatgaagccacaagc

SEQ ID NO: 9273765 - DNA, 22 bp, Homo sapiens
agggccagcactcctggcagga

SEQ ID NO: 9273766 - DNA, 22 bp, Homo sapiens
agggcatgctggaggagagaca

SEQ ID NO: 9273767 - DNA, 22 bp, Homo sapiens
agggccagccaggccctacaaa

SEQ ID NO: 9273768 - DNA, 22 bp, Homo sapiens
agggccagcccataatgccaaa

SEQ ID NO: 9273769 - DNA, 22 bp, Homo sapiens
agggccagcccataatgccaaa

SEQ ID NO: 9273770 - DNA, 22 bp, Homo sapiens
agggccagcccataatgccaaa

SEQ ID NO: 9273771 - DNA, 22 bp, Homo sapiens
agggccagcagcttggccaacc

SEQ ID NO: 9273772 - DNA, 22 bp, Homo sapiens
agggccagcagcttggccaacc

SEQ ID NO: 9273773 - DNA, 22 bp, Homo sapiens
agggccagccaggccctacaaa

SEQ ID NO: 9273774 - DNA, 22 bp, Homo sapiens
agggccagcactcctggcagga

SEQ ID NO: 9273775 - DNA, 22 bp, Homo sapiens
agggccagcactcctggcagga

SEQ ID NO: 9273776 - DNA, 22 bp, Homo sapiens
agggccagccccaccctctctg

SEQ ID NO: 9273777 - DNA, 22 bp, Homo sapiens
agggccagtaaatgtttcctca

SEQ ID NO: 9273778 - DNA, 22 bp, Homo sapiens
agggccagtaaatgtttcctca

SEQ ID NO: 9273779 - DNA, 22 bp, Homo sapiens
agggccagtaccaggtgggtgg

SEQ ID NO: 9273780 - DNA, 22 bp, Homo sapiens
agggccagtaccaggtgggtgg

SEQ ID NO: 9273781 - DNA, 22 bp, Homo sapiens
agggccagtaccaggtgggtgg

SEQ ID NO: 9273782 - DNA, 22 bp, Homo sapiens
agggccagtgggttgaaaggca

SEQ ID NO: 9273783 - DNA, 22 bp, Homo sapiens
agggccagtgggttgaaaggca

SEQ ID NO: 9273784 - DNA, 22 bp, Homo sapiens
agggccagtcgtgtattactgt

SEQ ID NO: 9273785 - DNA, 22 bp, Homo sapiens
agggccagtattaaggtaatta

SEQ ID NO: 9273786 - DNA, 22 bp, Homo sapiens
agggccagtattaaggtaatta

SEQ ID NO: 9273787 - DNA, 22 bp, Homo sapiens
agggccagtcgtgtattactgt

SEQ ID NO: 9273788 - DNA, 22 bp, Homo sapiens
agggccagttctacctctgaat

SEQ ID NO: 9273789 - DNA, 22 bp, Homo sapiens
agggcctgtcagcggtgtcctg

SEQ ID NO: 9273790 - DNA, 22 bp, Homo sapiens
agggcctggttctgtgtaggga

SEQ ID NO: 9273791 - DNA, 22 bp, Homo sapiens
agggccagttcagaggacatgg

SEQ ID NO: 9273792 - DNA, 22 bp, Homo sapiens
agggccagttcagaggacatgg

SEQ ID NO: 9273793 - DNA, 22 bp, Homo sapiens
agggccagttctacctctgaat

SEQ ID NO: 9273794 - DNA, 22 bp, Homo sapiens
agggaggtctggctgccctgag

SEQ ID NO: 9273795 - DNA, 20 bp, Homo sapiens
agggaggtgctgggcctgag

SEQ ID NO: 9273796 - DNA, 22 bp, Homo sapiens
agggaggtggttccccagtgga

SEQ ID NO: 9273797 - DNA, 22 bp, Homo sapiens
agggaggcattagctactgcga

SEQ ID NO: 9273798 - DNA, 22 bp, Homo sapiens
agggaggtaggagcttctagct

SEQ ID NO: 9273799 - DNA, 22 bp, Homo sapiens
agggaggtaggagcttctagct

SEQ ID NO: 9273800 - DNA, 22 bp, Homo sapiens
agggcacaagactctgagcccc

SEQ ID NO: 9273801 - DNA, 22 bp, Homo sapiens
agggcacagcctaaagcctatg

SEQ ID NO: 9273802 - DNA, 22 bp, Homo sapiens
agggaggatctgctccttgtct

SEQ ID NO: 9273803 - DNA, 22 bp, Homo sapiens
agggaggatctgctccttgtct

SEQ ID NO: 9273804 - DNA, 22 bp, Homo sapiens
accagagctcttcagcacagga

SEQ ID NO: 9273805 - DNA, 22 bp, Homo sapiens
accagagcagactactggaggt

SEQ ID NO: 9273806 - DNA, 22 bp, Homo sapiens
accagagactgcatttctctga

SEQ ID NO: 9273807 - DNA, 22 bp, Homo sapiens
accagagaatgtgcatctctaa

SEQ ID NO: 9273808 - DNA, 22 bp, Homo sapiens
accagagatggggcttctctgt

SEQ ID NO: 9273809 - DNA, 18 bp, Homo sapiens
acatttctctctgcgtga

SEQ ID NO: 9273810 - DNA, 22 bp, Homo sapiens
acatttctccttgcaggagtca

SEQ ID NO: 9273811 - DNA, 22 bp, Homo sapiens
acatttctcattctcccctaac

SEQ ID NO: 9273812 - DNA, 18 bp, Homo sapiens
acatttctccttctgacc

SEQ ID NO: 9273813 - DNA, 18 bp, Homo sapiens
acatttctccttctgacc

SEQ ID NO: 9273814 - DNA, 22 bp, Homo sapiens
acatttctcctacttgttattt

SEQ ID NO: 9273815 - DNA, 22 bp, Homo sapiens
acatttctccctgcatgcctgc

SEQ ID NO: 9273816 - DNA, 22 bp, Homo sapiens
acatttctcatctagtagagta

SEQ ID NO: 9273817 - DNA, 22 bp, Homo sapiens
aggctgcttcaatggataagat

SEQ ID NO: 9273818 - DNA, 22 bp, Homo sapiens
acatttctcagggagttttgct

SEQ ID NO: 9273819 - DNA, 22 bp, Homo sapiens
acatttctcagggagttttgct

SEQ ID NO: 9273820 - DNA, 22 bp, Homo sapiens
aggctgcttcagctgcagggag

SEQ ID NO: 9273821 - DNA, 21 bp, Homo sapiens
aggctgctggctcagggtcct

SEQ ID NO: 9273822 - DNA, 17 bp, Homo sapiens
aggctgctgggccaggg

SEQ ID NO: 9273823 - DNA, 17 bp, Homo sapiens
aggctgctgggccaggg

SEQ ID NO: 9273824 - DNA, 23 bp, Homo sapiens
aggctgcttactggtatcagagc

SEQ ID NO: 9273825 - DNA, 22 bp, Homo sapiens
aggctgctggcaggcgtggacg

SEQ ID NO: 9273826 - DNA, 22 bp, Homo sapiens
aggctgctgccttggagagtgt

SEQ ID NO: 9273827 - DNA, 22 bp, Homo sapiens
aggctgctgccttggagagtgt

SEQ ID NO: 9273828 - DNA, 22 bp, Homo sapiens
aggctctggagttagccaggca

SEQ ID NO: 9273829 - DNA, 22 bp, Homo sapiens
aggctgcagaacagtcaggtgc

SEQ ID NO: 9273830 - DNA, 22 bp, Homo sapiens
aggctgcagaacagtcaggtgc

SEQ ID NO: 9273831 - DNA, 22 bp, Homo sapiens
aggctctggcaacagctggtgt

SEQ ID NO: 9273832 - DNA, 22 bp, Homo sapiens
aggctgctctgcgaagtcagct

SEQ ID NO: 9273833 - DNA, 22 bp, Homo sapiens
aggctgctctgcgaagtcagct

SEQ ID NO: 9273834 - DNA, 22 bp, Homo sapiens
accactgcccatggtgaaaact

SEQ ID NO: 9273835 - DNA, 22 bp, Homo sapiens
accactggcctggtggggacca

SEQ ID NO: 9273836 - DNA, 22 bp, Homo sapiens
aggctgtgatgagcctcatgga

SEQ ID NO: 9273837 - DNA, 22 bp, Homo sapiens
aggctgtgattccaccactctc

SEQ ID NO: 9273838 - DNA, 22 bp, Homo sapiens
aggctgtgattccaccactctc

SEQ ID NO: 9273839 - DNA, 22 bp, Homo sapiens
accagaaaggatgcctccttcc

SEQ ID NO: 9273840 - DNA, 22 bp, Homo sapiens
accagaaaggaataatagaatt

SEQ ID NO: 9273841 - DNA, 22 bp, Homo sapiens
accactgtacagcagatatagt

SEQ ID NO: 9273842 - DNA, 22 bp, Homo sapiens
accactgtatctccagcacatt

SEQ ID NO: 9273843 - DNA, 22 bp, Homo sapiens
aggctgtgagcaagaacaccta

SEQ ID NO: 9273844 - DNA, 19 bp, Homo sapiens
aggctgtgagggaggactc

SEQ ID NO: 9273845 - DNA, 19 bp, Homo sapiens
aggctgtgagggaggactc

SEQ ID NO: 9273846 - DNA, 19 bp, Homo sapiens
aggctgtgaggggaaggaa

SEQ ID NO: 9273847 - DNA, 22 bp, Homo sapiens
aggctgggaaacctgaagttgt

SEQ ID NO: 9273848 - DNA, 22 bp, Homo sapiens
aggctggctttggtagcatggt

SEQ ID NO: 9273849 - DNA, 22 bp, Homo sapiens
aggctgggaaacctgaagttgt

SEQ ID NO: 9273850 - DNA, 22 bp, Homo sapiens
aggctctggacagtgaggagtt

SEQ ID NO: 9273851 - DNA, 22 bp, Homo sapiens
aggctctgacccatgggaccca

SEQ ID NO: 9273852 - DNA, 22 bp, Homo sapiens
aggctctgacccatgggaccca

SEQ ID NO: 9273853 - DNA, 22 bp, Homo sapiens
aggctctgacgtcacacgtggc

SEQ ID NO: 9273854 - DNA, 22 bp, Homo sapiens
aggctctggagtgtggtgctgg

SEQ ID NO: 9273855 - DNA, 22 bp, Homo sapiens
aggctctggagttagccaggca

SEQ ID NO: 9273856 - DNA, 22 bp, Homo sapiens
aggctctccagagagctgcttt

SEQ ID NO: 9273857 - DNA, 22 bp, Homo sapiens
acattaacaccgtgagtttggt

SEQ ID NO: 9273858 - DNA, 22 bp, Homo sapiens
acattaacaccataagtgtgtt

SEQ ID NO: 9273859 - DNA, 22 bp, Homo sapiens
acattaacactggtgctggtgt

SEQ ID NO: 9273860 - DNA, 22 bp, Homo sapiens
aggctccagtctcctctggcag

SEQ ID NO: 9273861 - DNA, 22 bp, Homo sapiens
aggctccttgttcatcatccat

SEQ ID NO: 9273862 - DNA, 22 bp, Homo sapiens
acattaaatttcatagtgatta

SEQ ID NO: 9273863 - DNA, 22 bp, Homo sapiens
acattaaatttcatagtgatta

SEQ ID NO: 9273864 - DNA, 22 bp, Homo sapiens
acattaaaatggagaattttga

SEQ ID NO: 9273865 - DNA, 22 bp, Homo sapiens
acattaaaatggagaattttga

SEQ ID NO: 9273866 - DNA, 22 bp, Homo sapiens
acattaaaaaatgttgcatgaa

SEQ ID NO: 9273867 - DNA, 22 bp, Homo sapiens
aggcagtgttcttctaagggca

SEQ ID NO: 9273868 - DNA, 22 bp, Homo sapiens
acatggctaaagcaagtctaga

SEQ ID NO: 9273869 - DNA, 20 bp, Homo sapiens
acatggcattcccacgtggt

SEQ ID NO: 9273870 - DNA, 22 bp, Homo sapiens
acatgtcaatttagtactctta

SEQ ID NO: 9273871 - DNA, 22 bp, Homo sapiens
acatgtatctgatctgcaattg

SEQ ID NO: 9273872 - DNA, 22 bp, Homo sapiens
acatgtatgtgtgcaaacacat

SEQ ID NO: 9273873 - DNA, 22 bp, Homo sapiens
acatgtattgacattatattct

SEQ ID NO: 9273874 - DNA, 22 bp, Homo sapiens
acatgtattgacattatattct

SEQ ID NO: 9273875 - DNA, 22 bp, Homo sapiens
acatgtacatacacatatgtaa

SEQ ID NO: 9273876 - DNA, 20 bp, Homo sapiens
acatgtactaatgaatacag

SEQ ID NO: 9273877 - DNA, 20 bp, Homo sapiens
acatgtactaatgaatacag

SEQ ID NO: 9273878 - DNA, 22 bp, Homo sapiens
aggctatttccactcttctcat

SEQ ID NO: 9273879 - DNA, 23 bp, Homo sapiens
acatgtggagagaacagatatct

SEQ ID NO: 9273880 - DNA, 22 bp, Homo sapiens
acatgtcttttaaagtctaata

SEQ ID NO: 9273881 - DNA, 22 bp, Homo sapiens
acatgtcttttaaagtctaata

SEQ ID NO: 9273882 - DNA, 21 bp, Homo sapiens
acatgtctctaatctcagtga

SEQ ID NO: 9273883 - DNA, 21 bp, Homo sapiens
acatgtctctaatctcagtga

SEQ ID NO: 9273884 - DNA, 20 bp, Homo sapiens
aggctcagctgagctcttgg

SEQ ID NO: 9273885 - DNA, 22 bp, Homo sapiens
acagtggctcatgcctgtcatc

SEQ ID NO: 9273886 - DNA, 22 bp, Homo sapiens
aggcaccgctcctcagtccaga

SEQ ID NO: 9273887 - DNA, 22 bp, Homo sapiens
aggcacctcagctgagcctggg

SEQ ID NO: 9273888 - DNA, 22 bp, Homo sapiens
aggcacctcttaggctgctact

SEQ ID NO: 9273889 - DNA, 17 bp, Homo sapiens
aggcacctcttcctgct

SEQ ID NO: 9273890 - DNA, 22 bp, Homo sapiens
acagtggatgtgatgtccaggt

SEQ ID NO: 9273891 - DNA, 22 bp, Homo sapiens
acagtggatgacatccttttgc

SEQ ID NO: 9273892 - DNA, 22 bp, Homo sapiens
acagtggatgtgatgtccaggt

SEQ ID NO: 9273893 - DNA, 22 bp, Homo sapiens
acagtggatatattaaatgaga

SEQ ID NO: 9273894 - DNA, 22 bp, Homo sapiens
acagtggagttggggtagccct

SEQ ID NO: 9273895 - DNA, 22 bp, Homo sapiens
acagtggagctcagatgaaaat

SEQ ID NO: 9273896 - DNA, 22 bp, Homo sapiens
acagtggaggccatatggtcct

SEQ ID NO: 9273897 - DNA, 22 bp, Homo sapiens
acagtggaagcatgatgctatc

SEQ ID NO: 9273898 - DNA, 22 bp, Homo sapiens
acagtggaagaagcactgaact

SEQ ID NO: 9273899 - DNA, 20 bp, Homo sapiens
acagtggaaattgatgtctg

SEQ ID NO: 9273900 - DNA, 22 bp, Homo sapiens
acagtggaaatgtgggagggga

SEQ ID NO: 9273901 - DNA, 22 bp, Homo sapiens
acagtggaatttgtagatgtgt

SEQ ID NO: 9273902 - DNA, 22 bp, Homo sapiens
acagtggaatggtgggcctgca

SEQ ID NO: 9273903 - DNA, 22 bp, Homo sapiens
acagtggagaaggcatgaggct

SEQ ID NO: 9273904 - DNA, 22 bp, Homo sapiens
acagtggagaaggcatgaggct

SEQ ID NO: 9273905 - DNA, 22 bp, Homo sapiens
acagtggagaagcaaatgcagt

SEQ ID NO: 9273906 - DNA, 22 bp, Homo sapiens
aggcactggtccattttctgca

SEQ ID NO: 9273907 - DNA, 22 bp, Homo sapiens
acagtgttctgaaagttgaggg

SEQ ID NO: 9273908 - DNA, 22 bp, Homo sapiens
acagtgttctcttcctgtatag

SEQ ID NO: 9273909 - DNA, 22 bp, Homo sapiens
aggcagaaaatagtcatccaaa

SEQ ID NO: 9273910 - DNA, 22 bp, Homo sapiens
aggcagaaaatagtcatccaaa

SEQ ID NO: 9273911 - DNA, 22 bp, Homo sapiens
acagtgttcctttgttgtgact

SEQ ID NO: 9273912 - DNA, 22 bp, Homo sapiens
acagtgttcacttaacaatgga

SEQ ID NO: 9273913 - DNA, 22 bp, Homo sapiens
acagtgttcacttaacaatgga

SEQ ID NO: 9273914 - DNA, 20 bp, Homo sapiens
acagtgttagttatcatctc

SEQ ID NO: 9273915 - DNA, 22 bp, Homo sapiens
acagtgttatttctgagtaatg

SEQ ID NO: 9273916 - DNA, 22 bp, Homo sapiens
acagtgttcactaaggttagct

SEQ ID NO: 9273917 - DNA, 22 bp, Homo sapiens
acagtgttcaaaccactaggct

SEQ ID NO: 9273918 - DNA, 20 bp, Homo sapiens
acagtgttaggtttttcctt

SEQ ID NO: 9273919 - DNA, 22 bp, Homo sapiens
acagtgttacttgatagtgtat

SEQ ID NO: 9273920 - DNA, 22 bp, Homo sapiens
aggcactgaaaggtggccagag

SEQ ID NO: 9273921 - DNA, 22 bp, Homo sapiens
aggcacgagcaatggccgagga

SEQ ID NO: 9273922 - DNA, 22 bp, Homo sapiens
aggcaccttgagagcaggagct

SEQ ID NO: 9273923 - DNA, 22 bp, Homo sapiens
aggcaccttgcggtccagtgaa

SEQ ID NO: 9273924 - DNA, 22 bp, Homo sapiens
aggcacctgaggtggccagcct

SEQ ID NO: 9273925 - DNA, 17 bp, Homo sapiens
aggaggccctggcgttt

SEQ ID NO: 9273926 - DNA, 22 bp, Homo sapiens
aggaggccgatttcagaggtcg

SEQ ID NO: 9273927 - DNA, 22 bp, Homo sapiens
acagtggaaagaacatggattt

SEQ ID NO: 9273928 - DNA, 22 bp, Homo sapiens
acagtggaaagaaacgaattag

SEQ ID NO: 9273929 - DNA, 22 bp, Homo sapiens
acagtgcttctgatatgatgcc

SEQ ID NO: 9273930 - DNA, 22 bp, Homo sapiens
acagtgcttttgttcctctcct

SEQ ID NO: 9273931 - DNA, 22 bp, Homo sapiens
acagtgcttggcacacagtaat

SEQ ID NO: 9273932 - DNA, 22 bp, Homo sapiens
acagtgcttagcacagagtaga

SEQ ID NO: 9273933 - DNA, 22 bp, Homo sapiens
acagtgctgtgcagtctgccct

SEQ ID NO: 9273934 - DNA, 22 bp, Homo sapiens
acagtgctgtctatctcactaa

SEQ ID NO: 9273935 - DNA, 22 bp, Homo sapiens
acagtgcttagcacagagtaga

SEQ ID NO: 9273936 - DNA, 19 bp, Homo sapiens
acagtgcttctgagtgagg

SEQ ID NO: 9273937 - DNA, 22 bp, Homo sapiens
aggaggccctagagctctagag

SEQ ID NO: 9273938 - DNA, 22 bp, Homo sapiens
aggaggcccctcctgggttgct

SEQ ID NO: 9273939 - DNA, 22 bp, Homo sapiens
aggaggccaggccctcaagcct

SEQ ID NO: 9273940 - DNA, 22 bp, Homo sapiens
acagtgaatgcccaagaaaagt

SEQ ID NO: 9273941 - DNA, 22 bp, Homo sapiens
acagtgaatgcccaagaaaagt

SEQ ID NO: 9273942 - DNA, 21 bp, Homo sapiens
acagtgagaaataaatggaaa

SEQ ID NO: 9273943 - DNA, 22 bp, Homo sapiens
acagtgagatccaagggcaggc

SEQ ID NO: 9273944 - DNA, 22 bp, Homo sapiens
acagtgagatccaagggcaggc

SEQ ID NO: 9273945 - DNA, 17 bp, Homo sapiens
acagtgagaagtcatct

SEQ ID NO: 9273946 - DNA, 22 bp, Homo sapiens
acagtgagcccactccaggaga

SEQ ID NO: 9273947 - DNA, 22 bp, Homo sapiens
acagtgagatccaagggcaggc

SEQ ID NO: 9273948 - DNA, 22 bp, Homo sapiens
acagtgagatccaagggcaggc

SEQ ID NO: 9273949 - DNA, 22 bp, Homo sapiens
acagtctggaggctgcttcatt

SEQ ID NO: 9273950 - DNA, 22 bp, Homo sapiens
acagtctggaagcagggggcaa

SEQ ID NO: 9273951 - DNA, 22 bp, Homo sapiens
acagtctgtcccccaggtgcta

SEQ ID NO: 9273952 - DNA, 22 bp, Homo sapiens
acagtgaataagacatgtgctt

SEQ ID NO: 9273953 - DNA, 23 bp, Homo sapiens
acagtgaaacacgcagtaagagt

SEQ ID NO: 9273954 - DNA, 22 bp, Homo sapiens
acagtgaaaagtagctaacaca

SEQ ID NO: 9273955 - DNA, 22 bp, Homo sapiens
acagtgaaaagtagctaacaca

SEQ ID NO: 9273956 - DNA, 21 bp, Homo sapiens
aggcagaaagagcccaggctg

SEQ ID NO: 9273957 - DNA, 22 bp, Homo sapiens
aggcagaaccagctgggacttt

SEQ ID NO: 9273958 - DNA, 22 bp, Homo sapiens
aggcagaatgttggaaaggaag

SEQ ID NO: 9273959 - DNA, 22 bp, Homo sapiens
aggcagaatgttggaaaggaag

SEQ ID NO: 9273960 - DNA, 22 bp, Homo sapiens
aggcagagaaaaaccagatatg

SEQ ID NO: 9273961 - DNA, 22 bp, Homo sapiens
aggcagatggtaactgtgatat

SEQ ID NO: 9273962 - DNA, 22 bp, Homo sapiens
aggcagagaaaaaccagatatg

SEQ ID NO: 9273963 - DNA, 22 bp, Homo sapiens
aggcagagaaaaaccagatatg

SEQ ID NO: 9273964 - DNA, 22 bp, Homo sapiens
aggcagcaaagaaatgatgctg

SEQ ID NO: 9273965 - DNA, 22 bp, Homo sapiens
aggcagcaagattatttaatcc

SEQ ID NO: 9273966 - DNA, 22 bp, Homo sapiens
aggcagcaaagaaatgatgctg

SEQ ID NO: 9273967 - DNA, 22 bp, Homo sapiens
aggcagcaatgaatgaaatgga

SEQ ID NO: 9273968 - DNA, 22 bp, Homo sapiens
aggcaggggagctggaagggta

SEQ ID NO: 9273969 - DNA, 18 bp, Homo sapiens
aggcaggtgctggaagtc

SEQ ID NO: 9273970 - DNA, 22 bp, Homo sapiens
aggcaggtgggagtgattcctt

SEQ ID NO: 9273971 - DNA, 22 bp, Homo sapiens
aggcaggtgggtcacttgagtc

SEQ ID NO: 9273972 - DNA, 22 bp, Homo sapiens
aggcaggtgttgggagacacca

SEQ ID NO: 9273973 - DNA, 22 bp, Homo sapiens
aggcaggttggtgagaagactg

SEQ ID NO: 9273974 - DNA, 22 bp, Homo sapiens
acatatatgtaaagtactttgt

SEQ ID NO: 9273975 - DNA, 22 bp, Homo sapiens
acatataagggatcagtgacag

SEQ ID NO: 9273976 - DNA, 22 bp, Homo sapiens
acatatatgtaaagtactttgt

SEQ ID NO: 9273977 - DNA, 22 bp, Homo sapiens
acatatattactagtaaagaca

SEQ ID NO: 9273978 - DNA, 22 bp, Homo sapiens
acatatattactagtaaagaca

SEQ ID NO: 9273979 - DNA, 22 bp, Homo sapiens
acatatatgtgcacatgtgcag

SEQ ID NO: 9273980 - DNA, 22 bp, Homo sapiens
acatatattactagtaaagaca

SEQ ID NO: 9273981 - DNA, 22 bp, Homo sapiens
acatctgagcaacagaacacta

SEQ ID NO: 9273982 - DNA, 22 bp, Homo sapiens
acatctgaaagggattgcagaa

SEQ ID NO: 9273983 - DNA, 22 bp, Homo sapiens
acatctgacatgatcttcagta

SEQ ID NO: 9273984 - DNA, 22 bp, Homo sapiens
acatctcatgaatgataaatca

SEQ ID NO: 9273985 - DNA, 22 bp, Homo sapiens
acatatattactagtaaagaca

SEQ ID NO: 9273986 - DNA, 22 bp, Homo sapiens
acatatattactagtaaagaca

SEQ ID NO: 9273987 - DNA, 22 bp, Homo sapiens
aggcagtgtattgctagcggct

SEQ ID NO: 9273988 - DNA, 22 bp, Homo sapiens
acatcttcactggtttctggaa

SEQ ID NO: 9273989 - DNA, 22 bp, Homo sapiens
acatctttatactagtccttga

SEQ ID NO: 9273990 - DNA, 20 bp, Homo sapiens
aggcagtgtagagatgagta

SEQ ID NO: 9273991 - DNA, 22 bp, Homo sapiens
acatctgtttgagaaaaagaag

SEQ ID NO: 9273992 - DNA, 22 bp, Homo sapiens
acatctgtttaacgaaggcatt

SEQ ID NO: 9273993 - DNA, 22 bp, Homo sapiens
acatctgtaatctagtcaaccc

SEQ ID NO: 9273994 - DNA, 22 bp, Homo sapiens
acatctgtcctctgcagagctc

SEQ ID NO: 9273995 - DNA, 22 bp, Homo sapiens
acaggattaataaaaaattgta

SEQ ID NO: 9273996 - DNA, 22 bp, Homo sapiens
agcttctttgtgggctccagaa

SEQ ID NO: 9273997 - DNA, 22 bp, Homo sapiens
acaggatcgccctgttgcccag

SEQ ID NO: 9273998 - DNA, 22 bp, Homo sapiens
agcttctttaattcagcatgat

SEQ ID NO: 9273999 - DNA, 22 bp, Homo sapiens
acaggatttcaccatgttggcc

SEQ ID NO: 9274000 - DNA, 22 bp, Homo sapiens
acaggattagcaagtaatcagg

SEQ ID NO: 9274001 - DNA, 22 bp, Homo sapiens
acaggattagtggatttgtctt

SEQ ID NO: 9274002 - DNA, 22 bp, Homo sapiens
acaggattactggattatgaca

SEQ ID NO: 9274003 - DNA, 22 bp, Homo sapiens
acaggcaagaggaaagcaagta

SEQ ID NO: 9274004 - DNA, 22 bp, Homo sapiens
acaggcaacttcaaatctcact

SEQ ID NO: 9274005 - DNA, 22 bp, Homo sapiens
acaggcacaccttcctgcaggc

SEQ ID NO: 9274006 - DNA, 22 bp, Homo sapiens
aggaaagaagtacattctcatg

SEQ ID NO: 9274007 - DNA, 22 bp, Homo sapiens
acaggagaaatctggtcaaaag

SEQ ID NO: 9274008 - DNA, 22 bp, Homo sapiens
agcttcttctattttggggcca

SEQ ID NO: 9274009 - DNA, 22 bp, Homo sapiens
agcttcttctgatttgtcagtc

SEQ ID NO: 9274010 - DNA, 22 bp, Homo sapiens
agcttcttcttggtctttccca

SEQ ID NO: 9274011 - DNA, 22 bp, Homo sapiens
agcttcttgaccaagcctgtaa

SEQ ID NO: 9274012 - DNA, 22 bp, Homo sapiens
agcttcttgacggatgttctgg

SEQ ID NO: 9274013 - DNA, 22 bp, Homo sapiens
acaggacaggctgggctagact

SEQ ID NO: 9274014 - DNA, 22 bp, Homo sapiens
acaggactgtggaaggatctct

SEQ ID NO: 9274015 - DNA, 22 bp, Homo sapiens
acagcagtgggttgccagtggg

SEQ ID NO: 9274016 - DNA, 22 bp, Homo sapiens
acagcagtttagaggacagcca

SEQ ID NO: 9274017 - DNA, 22 bp, Homo sapiens
acagcagttactgaaataaagt

SEQ ID NO: 9274018 - DNA, 22 bp, Homo sapiens
acagcagttaacgatcagactc

SEQ ID NO: 9274019 - DNA, 22 bp, Homo sapiens
acagccagaggagccaggctgg

SEQ ID NO: 9274020 - DNA, 22 bp, Homo sapiens
acagccagaggagccaggctgg

SEQ ID NO: 9274021 - DNA, 22 bp, Homo sapiens
acagccaaggaattaggaaggg

SEQ ID NO: 9274022 - DNA, 22 bp, Homo sapiens
acagcattgctccatctcaaga

SEQ ID NO: 9274023 - DNA, 21 bp, Homo sapiens
acagcatgtttgtgtgtttgc

SEQ ID NO: 9274024 - DNA, 22 bp, Homo sapiens
acaggacaactcagcagccagc

SEQ ID NO: 9274025 - DNA, 22 bp, Homo sapiens
acaggacaactcagcagccagc

SEQ ID NO: 9274026 - DNA, 22 bp, Homo sapiens
acaggaatttcctaatattcga

SEQ ID NO: 9274027 - DNA, 22 bp, Homo sapiens
acaggaagtgggaagaaacagg

SEQ ID NO: 9274028 - DNA, 22 bp, Homo sapiens
acaggaacgaatgtacattgtt

SEQ ID NO: 9274029 - DNA, 22 bp, Homo sapiens
acaggaactgttatctcagatg

SEQ ID NO: 9274030 - DNA, 23 bp, Homo sapiens
acagggctagctgacagtggtat

SEQ ID NO: 9274031 - DNA, 23 bp, Homo sapiens
acagggctagctgacagtggtat

SEQ ID NO: 9274032 - DNA, 22 bp, Homo sapiens
acagggctatattcctcagagc

SEQ ID NO: 9274033 - DNA, 22 bp, Homo sapiens
aggacagggattcaaactccca

SEQ ID NO: 9274034 - DNA, 22 bp, Homo sapiens
aggacaggtgtagtgggctctg

SEQ ID NO: 9274035 - DNA, 22 bp, Homo sapiens
aggacaggtgtagtgggctctg

SEQ ID NO: 9274036 - DNA, 22 bp, Homo sapiens
aggacaggtgtagtgggctctg

SEQ ID NO: 9274037 - DNA, 22 bp, Homo sapiens
aggacacaggtaagccagtgga

SEQ ID NO: 9274038 - DNA, 22 bp, Homo sapiens
aggacacaggtaagccagtgga

SEQ ID NO: 9274039 - DNA, 22 bp, Homo sapiens
acagggctatattcctcagagc

SEQ ID NO: 9274040 - DNA, 22 bp, Homo sapiens
aggactggtgccagacaaggta

SEQ ID NO: 9274041 - DNA, 22 bp, Homo sapiens
aggactggtgccagacaaggta

SEQ ID NO: 9274042 - DNA, 22 bp, Homo sapiens
aggactgggtgcagagggcatc

SEQ ID NO: 9274043 - DNA, 22 bp, Homo sapiens
aggactgggtgcagagggcatc

SEQ ID NO: 9274044 - DNA, 22 bp, Homo sapiens
aggactgggtgcagagggcatc

SEQ ID NO: 9274045 - DNA, 22 bp, Homo sapiens
aggactgatgatggtgctgaca

SEQ ID NO: 9274046 - DNA, 22 bp, Homo sapiens
aggactgatgatggtgctgaca

SEQ ID NO: 9274047 - DNA, 22 bp, Homo sapiens
aggactggcagtgtgaggggtc

SEQ ID NO: 9274048 - DNA, 22 bp, Homo sapiens
aggactggccctgaggggaggc

SEQ ID NO: 9274049 - DNA, 22 bp, Homo sapiens
aggactggcggtcggtggggat

SEQ ID NO: 9274050 - DNA, 22 bp, Homo sapiens
aggactggccctgaggggaggc

SEQ ID NO: 9274051 - DNA, 22 bp, Homo sapiens
aggacagtggcaaggcaggaca

SEQ ID NO: 9274052 - DNA, 22 bp, Homo sapiens
acagggcacctgaggtaggaag

SEQ ID NO: 9274053 - DNA, 21 bp, Homo sapiens
acaggctctggggatgctggg

SEQ ID NO: 9274054 - DNA, 19 bp, Homo sapiens
acagggcagcaataggata

SEQ ID NO: 9274055 - DNA, 22 bp, Homo sapiens
acagggcaggtggctactggtc

SEQ ID NO: 9274056 - DNA, 22 bp, Homo sapiens
acaggctctcagccagttggca

SEQ ID NO: 9274057 - DNA, 22 bp, Homo sapiens
acaggctctctattgagtgcag

SEQ ID NO: 9274058 - DNA, 22 bp, Homo sapiens
acagggcatgtgcaagagacat

SEQ ID NO: 9274059 - DNA, 21 bp, Homo sapiens
acagggcatgcagctggctgt

SEQ ID NO: 9274060 - DNA, 21 bp, Homo sapiens
acagggcatgcagctggctgt

SEQ ID NO: 9274061 - DNA, 21 bp, Homo sapiens
acagggcatgcagctggctgt

SEQ ID NO: 9274062 - DNA, 22 bp, Homo sapiens
acagggcagtgtcttgaaaaat

SEQ ID NO: 9274063 - DNA, 22 bp, Homo sapiens
acagggcatttcctctatgtgt

SEQ ID NO: 9274064 - DNA, 18 bp, Homo sapiens
acaggctattgcaggaga

SEQ ID NO: 9274065 - DNA, 22 bp, Homo sapiens
acaggccttggcaggcatgtga

SEQ ID NO: 9274066 - DNA, 22 bp, Homo sapiens
acaggcctggtgctgctgacag

SEQ ID NO: 9274067 - DNA, 22 bp, Homo sapiens
acaggcctgtgtgcacacgagg

SEQ ID NO: 9274068 - DNA, 22 bp, Homo sapiens
aggaaataagggcacttcagat

SEQ ID NO: 9274069 - DNA, 22 bp, Homo sapiens
aggaaagtggtgggaaatcagg

SEQ ID NO: 9274070 - DNA, 22 bp, Homo sapiens
aggaaaggttcagtgattgaaa

SEQ ID NO: 9274071 - DNA, 22 bp, Homo sapiens
aggaaaggttcagtgattgaaa

SEQ ID NO: 9274072 - DNA, 19 bp, Homo sapiens
aggaaaggtggccttagca

SEQ ID NO: 9274073 - DNA, 19 bp, Homo sapiens
aggaaaggtggccttagca

SEQ ID NO: 9274074 - DNA, 19 bp, Homo sapiens
aggaaaggtggccttagca

SEQ ID NO: 9274075 - DNA, 22 bp, Homo sapiens
aggaaaggggtaggtgtggacg

SEQ ID NO: 9274076 - DNA, 22 bp, Homo sapiens
aggaaaggggtaggtgtggacg

SEQ ID NO: 9274077 - DNA, 22 bp, Homo sapiens
aggaaaggtagcgtgccagcag

SEQ ID NO: 9274078 - DNA, 22 bp, Homo sapiens
aggaaaggtagcgtgccagcag

SEQ ID NO: 9274079 - DNA, 22 bp, Homo sapiens
aggaaaggtgagagcggccgcg

SEQ ID NO: 9274080 - DNA, 22 bp, Homo sapiens
aggaaaggtgagagcggccgcg

SEQ ID NO: 9274081 - DNA, 17 bp, Homo sapiens
agtgtgtgaaatggtgg

SEQ ID NO: 9274082 - DNA, 22 bp, Homo sapiens
agtgtgtactcatatacttcca

SEQ ID NO: 9274083 - DNA, 22 bp, Homo sapiens
agtgtgtacatttggtgcagtt

SEQ ID NO: 9274084 - DNA, 22 bp, Homo sapiens
agtgtgtagcatttggcaggca

SEQ ID NO: 9274085 - DNA, 23 bp, Homo sapiens
agtgtgtattgctgagggcagct

SEQ ID NO: 9274086 - DNA, 22 bp, Homo sapiens
agtgtggtcgggagcgcggggc

SEQ ID NO: 9274087 - DNA, 22 bp, Homo sapiens
agtgtgggtgagggaggccctc

SEQ ID NO: 9274088 - DNA, 22 bp, Homo sapiens
agtgtctttcatatcctccatc

SEQ ID NO: 9274089 - DNA, 22 bp, Homo sapiens
agtgtcttacatgaattgattt

SEQ ID NO: 9274090 - DNA, 22 bp, Homo sapiens
agtgggggctggctctgtctgt

SEQ ID NO: 9274091 - DNA, 21 bp, Homo sapiens
agtggggtctctgtggaggcc

SEQ ID NO: 9274092 - DNA, 22 bp, Homo sapiens
agtggggtcctcagtatggttc

SEQ ID NO: 9274093 - DNA, 22 bp, Homo sapiens
agtgggggccaacgagggcagc

SEQ ID NO: 9274094 - DNA, 22 bp, Homo sapiens
agtgggggccaacgagggcagc

SEQ ID NO: 9274095 - DNA, 22 bp, Homo sapiens
agtggggccggtgaggccgagg

SEQ ID NO: 9274096 - DNA, 22 bp, Homo sapiens
agtgggggcagagcctctctcg

SEQ ID NO: 9274097 - DNA, 22 bp, Homo sapiens
agtgggggcagagcctctctcg

SEQ ID NO: 9274098 - DNA, 22 bp, Homo sapiens
agtgtctgtgctttgcagcaaa

SEQ ID NO: 9274099 - DNA, 20 bp, Homo sapiens
agtgtctggtgcagggcctc

SEQ ID NO: 9274100 - DNA, 22 bp, Homo sapiens
agtgtctgaaccaccggggcat

SEQ ID NO: 9274101 - DNA, 22 bp, Homo sapiens
actggggcctcctccatgctct

SEQ ID NO: 9274102 - DNA, 22 bp, Homo sapiens
actggggcctcctccatgctct

SEQ ID NO: 9274103 - DNA, 22 bp, Homo sapiens
actggggcaggaaagtatgctg

SEQ ID NO: 9274104 - DNA, 22 bp, Homo sapiens
actggggcagtgggcagtggtt

SEQ ID NO: 9274105 - DNA, 22 bp, Homo sapiens
actggggcagtgggcagtggtt

SEQ ID NO: 9274106 - DNA, 22 bp, Homo sapiens
agttacaaacactatcagttct

SEQ ID NO: 9274107 - DNA, 22 bp, Homo sapiens
agttaatgagcattttggaatg

SEQ ID NO: 9274108 - DNA, 19 bp, Homo sapiens
agttaatgagcttttgatc

SEQ ID NO: 9274109 - DNA, 22 bp, Homo sapiens
actggtggctttcagacagaaa

SEQ ID NO: 9274110 - DNA, 22 bp, Homo sapiens
agttattttggaaaatgagtca

SEQ ID NO: 9274111 - DNA, 22 bp, Homo sapiens
agttacctttctgaaacttcgt

SEQ ID NO: 9274112 - DNA, 22 bp, Homo sapiens
agttacagctggcgtggggaaa

SEQ ID NO: 9274113 - DNA, 22 bp, Homo sapiens
agttacatgtgaatagaaagta

SEQ ID NO: 9274114 - DNA, 21 bp, Homo sapiens
agttacatgtatagataaagt

SEQ ID NO: 9274115 - DNA, 21 bp, Homo sapiens
agttacatgtatagataaagt

SEQ ID NO: 9274116 - DNA, 22 bp, Homo sapiens
agttacaaccatgacacaagca

SEQ ID NO: 9274117 - DNA, 22 bp, Homo sapiens
agtggcagagcaggtgctggaa

SEQ ID NO: 9274118 - DNA, 22 bp, Homo sapiens
agtggcagacacaatgtgggca

SEQ ID NO: 9274119 - DNA, 22 bp, Homo sapiens
agtgctttggtatagaactatt

SEQ ID NO: 9274120 - DNA, 20 bp, Homo sapiens
agtgctgtggctgaataaga

SEQ ID NO: 9274121 - DNA, 22 bp, Homo sapiens
agtgctgttaggttaatatagt

SEQ ID NO: 9274122 - DNA, 22 bp, Homo sapiens
agtgctgttggataatgctgtc

SEQ ID NO: 9274123 - DNA, 22 bp, Homo sapiens
agtgcttcttaaacctttctac

SEQ ID NO: 9274124 - DNA, 22 bp, Homo sapiens
agtgcttctggtgggcgtgagg

SEQ ID NO: 9274125 - DNA, 22 bp, Homo sapiens
agtgctttagaccttttggggt

SEQ ID NO: 9274126 - DNA, 22 bp, Homo sapiens
agtgctttatgttgttgtgcaa

SEQ ID NO: 9274127 - DNA, 22 bp, Homo sapiens
agtggcagagccaagtagagcc

SEQ ID NO: 9274128 - DNA, 22 bp, Homo sapiens
agtggcagagccaagatatgat

SEQ ID NO: 9274129 - DNA, 20 bp, Homo sapiens
agtgggagagggcagactgc

SEQ ID NO: 9274130 - DNA, 22 bp, Homo sapiens
agtgggagccagcagcttgggg

SEQ ID NO: 9274131 - DNA, 22 bp, Homo sapiens
agtgggagcggcagtcggggac

SEQ ID NO: 9274132 - DNA, 22 bp, Homo sapiens
agtgggagcggcagtcggggac

SEQ ID NO: 9274133 - DNA, 22 bp, Homo sapiens
agtgggagcggcagtcggggac

SEQ ID NO: 9274134 - DNA, 22 bp, Homo sapiens
agtgggaggaagtggtgatatt

SEQ ID NO: 9274135 - DNA, 22 bp, Homo sapiens
agtgggagcggcagtcggggac

SEQ ID NO: 9274136 - DNA, 22 bp, Homo sapiens
agtgggagccagcagcttgggg

SEQ ID NO: 9274137 - DNA, 22 bp, Homo sapiens
agtgggagccagcagcttgggg

SEQ ID NO: 9274138 - DNA, 22 bp, Homo sapiens
agtggggccgcggtcctgccct

SEQ ID NO: 9274139 - DNA, 22 bp, Homo sapiens
agtgggagggccatatggtgaa

SEQ ID NO: 9274140 - DNA, 22 bp, Homo sapiens
agtgggaggcggctgacgggcg

SEQ ID NO: 9274141 - DNA, 22 bp, Homo sapiens
agtgggaggcggctgacgggcg

SEQ ID NO: 9274142 - DNA, 22 bp, Homo sapiens
agtgggaggaagtggtgatatt

SEQ ID NO: 9274143 - DNA, 22 bp, Homo sapiens
agtgggaggaagtggtgatatt

SEQ ID NO: 9274144 - DNA, 22 bp, Homo sapiens
agtgggaggcggctgacgggcg

SEQ ID NO: 9274145 - DNA, 20 bp, Homo sapiens
agtgcaagaaagcacagctg

SEQ ID NO: 9274146 - DNA, 22 bp, Homo sapiens
agtgcaaagggatcagattggg

SEQ ID NO: 9274147 - DNA, 22 bp, Homo sapiens
agtgcaaagaaatcagctttgt

SEQ ID NO: 9274148 - DNA, 22 bp, Homo sapiens
agtgcaaagcagcctgtacacc

SEQ ID NO: 9274149 - DNA, 22 bp, Homo sapiens
agtgctgaagactggctaggga

SEQ ID NO: 9274150 - DNA, 23 bp, Homo sapiens
agtgctgaattgaaagctccagg

SEQ ID NO: 9274151 - DNA, 22 bp, Homo sapiens
agtgctgtccagtttcacaggt

SEQ ID NO: 9274152 - DNA, 22 bp, Homo sapiens
agtgctgtcccgacaactgagg

SEQ ID NO: 9274153 - DNA, 22 bp, Homo sapiens
agtgcaaaattcagaagcaatt

SEQ ID NO: 9274154 - DNA, 20 bp, Homo sapiens
agtgaggcagttcagtgggc

SEQ ID NO: 9274155 - DNA, 22 bp, Homo sapiens
agtgaggcaaagtgagaggcag

SEQ ID NO: 9274156 - DNA, 19 bp, Homo sapiens
agtgagcatccagagaggt

SEQ ID NO: 9274157 - DNA, 19 bp, Homo sapiens
agtgagcatccagagaggt

SEQ ID NO: 9274158 - DNA, 22 bp, Homo sapiens
agtgagcatccagagaggtggg

SEQ ID NO: 9274159 - DNA, 22 bp, Homo sapiens
agtgagcattcgtttggaaccc

SEQ ID NO: 9274160 - DNA, 23 bp, Homo sapiens
agtgagcagctgtagggcaagga

SEQ ID NO: 9274161 - DNA, 20 bp, Homo sapiens
agtgagattgctgctctagc

SEQ ID NO: 9274162 - DNA, 22 bp, Homo sapiens
agtccttgaatgttttgaaatc

SEQ ID NO: 9274163 - DNA, 21 bp, Homo sapiens
agtccttgaaactctttcttg

SEQ ID NO: 9274164 - DNA, 22 bp, Homo sapiens
aggtgccagatgcacagctgaa

SEQ ID NO: 9274165 - DNA, 22 bp, Homo sapiens
aggtgccaattttcagtgaaca

SEQ ID NO: 9274166 - DNA, 21 bp, Homo sapiens
aggtgccaaggagaagcaggc

SEQ ID NO: 9274167 - DNA, 21 bp, Homo sapiens
aggtgccaaggagaagcaggc

SEQ ID NO: 9274168 - DNA, 23 bp, Homo sapiens
aggtgccaactgagagctgagag

SEQ ID NO: 9274169 - DNA, 22 bp, Homo sapiens
aggtgcagtggctcatgcctgt

SEQ ID NO: 9274170 - DNA, 22 bp, Homo sapiens
aggtgcagtggctcatgcctgt

SEQ ID NO: 9274171 - DNA, 22 bp, Homo sapiens
agggtgcatgtttgcaagagtg

SEQ ID NO: 9274172 - DNA, 22 bp, Homo sapiens
agggtgccctggagccagttcc

SEQ ID NO: 9274173 - DNA, 22 bp, Homo sapiens
aggtgaggataggtggccaagg

SEQ ID NO: 9274174 - DNA, 22 bp, Homo sapiens
aggtgcaggagctgtgcaggga

SEQ ID NO: 9274175 - DNA, 19 bp, Homo sapiens
aggtgcaggtcacagggga

SEQ ID NO: 9274176 - DNA, 22 bp, Homo sapiens
agggtccatcaaggactgcaca

SEQ ID NO: 9274177 - DNA, 19 bp, Homo sapiens
agggtccagggagcggctc

SEQ ID NO: 9274178 - DNA, 22 bp, Homo sapiens
agggtcagtgatgagggagccc

SEQ ID NO: 9274179 - DNA, 22 bp, Homo sapiens
agggtcagttctgtgaggtgtt

SEQ ID NO: 9274180 - DNA, 23 bp, Homo sapiens
agggtgagcaagctatggagacc

SEQ ID NO: 9274181 - DNA, 23 bp, Homo sapiens
agggtgagcaagctatggagacc

SEQ ID NO: 9274182 - DNA, 23 bp, Homo sapiens
agggtgagcaagctatggagacc

SEQ ID NO: 9274183 - DNA, 22 bp, Homo sapiens
agggtgcagaaggagcctagga

SEQ ID NO: 9274184 - DNA, 22 bp, Homo sapiens
aggtggagacccagagaaggcg

SEQ ID NO: 9274185 - DNA, 22 bp, Homo sapiens
aggtggagacccagagaaggcg

SEQ ID NO: 9274186 - DNA, 16 bp, Homo sapiens
aggtggagaagttcac

SEQ ID NO: 9274187 - DNA, 22 bp, Homo sapiens
aggtggagacccagagaaggcg

SEQ ID NO: 9274188 - DNA, 22 bp, Homo sapiens
aggtggagacccagagaaggcg

SEQ ID NO: 9274189 - DNA, 22 bp, Homo sapiens
aggtggagaagagatgggcagt

SEQ ID NO: 9274190 - DNA, 22 bp, Homo sapiens
aggtggagaagagatgggcagt

SEQ ID NO: 9274191 - DNA, 22 bp, Homo sapiens
aggtggagaagagatgggcagt

SEQ ID NO: 9274192 - DNA, 22 bp, Homo sapiens
aggtggaaatggctttcctagg

SEQ ID NO: 9274193 - DNA, 22 bp, Homo sapiens
aggtggggttcagtctcagccg

SEQ ID NO: 9274194 - DNA, 22 bp, Homo sapiens
aggtggggaggagtgtctcttt

SEQ ID NO: 9274195 - DNA, 22 bp, Homo sapiens
aggtgggtatcatgagagatta

SEQ ID NO: 9274196 - DNA, 22 bp, Homo sapiens
aggtgggtatcatgagagatta

SEQ ID NO: 9274197 - DNA, 22 bp, Homo sapiens
aggtggtcttggcccacccagg

SEQ ID NO: 9274198 - DNA, 21 bp, Homo sapiens
aggtggtctgcagcagctgaa

SEQ ID NO: 9274199 - DNA, 22 bp, Homo sapiens
actcacaggactctgcatatag

SEQ ID NO: 9274200 - DNA, 23 bp, Homo sapiens
aggttctcttatcatctctgccc

SEQ ID NO: 9274201 - DNA, 22 bp, Homo sapiens
aggtgtcatttctctgcaggtg

SEQ ID NO: 9274202 - DNA, 22 bp, Homo sapiens
aggtgtccggctgcataatctt

SEQ ID NO: 9274203 - DNA, 22 bp, Homo sapiens
agtccagaccccggcagctggt

SEQ ID NO: 9274204 - DNA, 22 bp, Homo sapiens
agtccagagaggaggctgtgtg

SEQ ID NO: 9274205 - DNA, 21 bp, Homo sapiens
agtccaggaggaggccaggtt

SEQ ID NO: 9274206 - DNA, 22 bp, Homo sapiens
agtccttacacctggaacctat

SEQ ID NO: 9274207 - DNA, 18 bp, Homo sapiens
agtccttacgaggctata

SEQ ID NO: 9274208 - DNA, 22 bp, Homo sapiens
agtccttactcgggggcccaga

SEQ ID NO: 9274209 - DNA, 22 bp, Homo sapiens
agtccttagaacagtgcctggg

SEQ ID NO: 9274210 - DNA, 22 bp, Homo sapiens
agtccttagaacactgtatctg

SEQ ID NO: 9274211 - DNA, 22 bp, Homo sapiens
agtccttatgagatgctgcctt

SEQ ID NO: 9274212 - DNA, 22 bp, Homo sapiens
agtccttatgtggtggagagag

SEQ ID NO: 9274213 - DNA, 22 bp, Homo sapiens
actctgggccccaggtggagct

SEQ ID NO: 9274214 - DNA, 22 bp, Homo sapiens
actctggtctttctgaaagcaa

SEQ ID NO: 9274215 - DNA, 22 bp, Homo sapiens
agtcaggtgggggctgcagtgg

SEQ ID NO: 9274216 - DNA, 23 bp, Homo sapiens
agtcagtgtaagtttggaatgca

SEQ ID NO: 9274217 - DNA, 22 bp, Homo sapiens
agtcagtgtagaaagcccaggc

SEQ ID NO: 9274218 - DNA, 22 bp, Homo sapiens
agtcagtggctccgagcctggt

SEQ ID NO: 9274219 - DNA, 22 bp, Homo sapiens
agtcagtgaaggcattgctcaa

SEQ ID NO: 9274220 - DNA, 22 bp, Homo sapiens
agtcagtgaatggtgtatgcta

SEQ ID NO: 9274221 - DNA, 22 bp, Homo sapiens
agtcagtgaaaactagaatgtt

SEQ ID NO: 9274222 - DNA, 22 bp, Homo sapiens
agtaacatctttgacatttgtt

SEQ ID NO: 9274223 - DNA, 22 bp, Homo sapiens
actcagcttcctacagctagaa

SEQ ID NO: 9274224 - DNA, 22 bp, Homo sapiens
actcagcttcctacagctagaa

SEQ ID NO: 9274225 - DNA, 22 bp, Homo sapiens
agtaacagtaacatcttcctag

SEQ ID NO: 9274226 - DNA, 23 bp, Homo sapiens
agtaacatgcaaataacagtctg

SEQ ID NO: 9274227 - DNA, 22 bp, Homo sapiens
agtaacatgagtttttctaatg

SEQ ID NO: 9274228 - DNA, 22 bp, Homo sapiens
agtaacatgagtttttctaatg

SEQ ID NO: 9274229 - DNA, 22 bp, Homo sapiens
agtaagcaccgggatggtcaag

SEQ ID NO: 9274230 - DNA, 22 bp, Homo sapiens
agtaaggcatttttcatgttta

SEQ ID NO: 9274231 - DNA, 22 bp, Homo sapiens
agtaacatgctaatttgattat

SEQ ID NO: 9274232 - DNA, 22 bp, Homo sapiens
agtaacatttagcttctcactg

SEQ ID NO: 9274233 - DNA, 21 bp, Homo sapiens
agtaacattttgttgtttaca

SEQ ID NO: 9274234 - DNA, 22 bp, Homo sapiens
actcagctcaggagctggctgg

SEQ ID NO: 9274235 - DNA, 22 bp, Homo sapiens
actcagctaaactcagtctatg

SEQ ID NO: 9274236 - DNA, 22 bp, Homo sapiens
actcagctgatgaagcacaagt

SEQ ID NO: 9274237 - DNA, 22 bp, Homo sapiens
ataacactaaatgtatgtaaca

SEQ ID NO: 9274238 - DNA, 22 bp, Homo sapiens
ataaatttataattgtttcctg

SEQ ID NO: 9274239 - DNA, 20 bp, Homo sapiens
ataacaaggctctgcaagct

SEQ ID NO: 9274240 - DNA, 22 bp, Homo sapiens
ataaattatgaatggccctttt

SEQ ID NO: 9274241 - DNA, 22 bp, Homo sapiens
ataaattctctgatgtatagta

SEQ ID NO: 9274242 - DNA, 22 bp, Homo sapiens
ataaattatgaatggccctttt

SEQ ID NO: 9274243 - DNA, 21 bp, Homo sapiens
ataaattctgagaggctctgc

SEQ ID NO: 9274244 - DNA, 22 bp, Homo sapiens
ataaattctctgatgtatagta

SEQ ID NO: 9274245 - DNA, 19 bp, Homo sapiens
ataaataaaaagtgggaga

SEQ ID NO: 9274246 - DNA, 19 bp, Homo sapiens
ataaataaaaagtgggaga

SEQ ID NO: 9274247 - DNA, 19 bp, Homo sapiens
ataaataaaaagtgggaga

SEQ ID NO: 9274248 - DNA, 22 bp, Homo sapiens
agttctttgtcatctctggagt

SEQ ID NO: 9274249 - DNA, 22 bp, Homo sapiens
agttctttgtaaaaggtctcta

SEQ ID NO: 9274250 - DNA, 22 bp, Homo sapiens
agttcttttctagattctggat

SEQ ID NO: 9274251 - DNA, 22 bp, Homo sapiens
agttcttttgtgaacatatgct

SEQ ID NO: 9274252 - DNA, 22 bp, Homo sapiens
agttgaaggttggctgatccat

SEQ ID NO: 9274253 - DNA, 22 bp, Homo sapiens
agttgaaagccttatttctctg

SEQ ID NO: 9274254 - DNA, 22 bp, Homo sapiens
agttgaatatacttgctgttgc

SEQ ID NO: 9274255 - DNA, 22 bp, Homo sapiens
agttgaattatgagtgtctttg

SEQ ID NO: 9274256 - DNA, 22 bp, Homo sapiens
agttcagcttcccaggtcactg

SEQ ID NO: 9274257 - DNA, 22 bp, Homo sapiens
atacaatagtgtttgttttgag

SEQ ID NO: 9274258 - DNA, 22 bp, Homo sapiens
atacaatagtgtttgttttgag

SEQ ID NO: 9274259 - DNA, 22 bp, Homo sapiens
atacaatgaagtatagatgaaa

SEQ ID NO: 9274260 - DNA, 22 bp, Homo sapiens
atacaatgagtgagtgaatggg

SEQ ID NO: 9274261 - DNA, 22 bp, Homo sapiens
atacaatgggtgcaaagatgtg

SEQ ID NO: 9274262 - DNA, 22 bp, Homo sapiens
atacacacaatcaggttttgta

SEQ ID NO: 9274263 - DNA, 22 bp, Homo sapiens
atacacacgtgcacgtgggaaa

SEQ ID NO: 9274264 - DNA, 22 bp, Homo sapiens
atacacacatatgtgagttttg

SEQ ID NO: 9274265 - DNA, 22 bp, Homo sapiens
atacacactgctatcctttttt

SEQ ID NO: 9274266 - DNA, 22 bp, Homo sapiens
atacacagccattatgaattag

SEQ ID NO: 9274267 - DNA, 22 bp, Homo sapiens
atacacagctacattgaacaat

SEQ ID NO: 9274268 - DNA, 22 bp, Homo sapiens
atacacatttgctagagatggg

SEQ ID NO: 9274269 - DNA, 22 bp, Homo sapiens
atacacgtgccatgttggtgtg

SEQ ID NO: 9274270 - DNA, 22 bp, Homo sapiens
atacacgtgccatgttggtgtg

SEQ ID NO: 9274271 - DNA, 22 bp, Homo sapiens
ataaggaatgatgtatcagttt

SEQ ID NO: 9274272 - DNA, 22 bp, Homo sapiens
ataaggaacctgggcttaagag

SEQ ID NO: 9274273 - DNA, 22 bp, Homo sapiens
ataagctctggacagccacatt

SEQ ID NO: 9274274 - DNA, 22 bp, Homo sapiens
ataagcttcctgttagaaaccg

SEQ ID NO: 9274275 - DNA, 22 bp, Homo sapiens
ataagctttgctggagagacct

SEQ ID NO: 9274276 - DNA, 22 bp, Homo sapiens
ataagcttttgattcacttcag

SEQ ID NO: 9274277 - DNA, 22 bp, Homo sapiens
ataagcttttaaagctactttg

SEQ ID NO: 9274278 - DNA, 22 bp, Homo sapiens
ataagcttgatgtaactaacca

SEQ ID NO: 9274279 - DNA, 22 bp, Homo sapiens
atacaaagacaaatctcaatct

SEQ ID NO: 9274280 - DNA, 20 bp, Homo sapiens
actttacagagaagactgac

SEQ ID NO: 9274281 - DNA, 22 bp, Homo sapiens
atagaatagcatagaaaattga

SEQ ID NO: 9274282 - DNA, 22 bp, Homo sapiens
atagaatagcatagaaaattga

SEQ ID NO: 9274283 - DNA, 22 bp, Homo sapiens
actttactacatccacagatgg

SEQ ID NO: 9274284 - DNA, 22 bp, Homo sapiens
actttactcaacaaatatttat

SEQ ID NO: 9274285 - DNA, 22 bp, Homo sapiens
actttacatttgatctctctaa

SEQ ID NO: 9274286 - DNA, 22 bp, Homo sapiens
actttactccccaacataaatg

SEQ ID NO: 9274287 - DNA, 22 bp, Homo sapiens
actttactccccaacataaatg

SEQ ID NO: 9274288 - DNA, 22 bp, Homo sapiens
atagatgtacgtatgtaaatca

SEQ ID NO: 9274289 - DNA, 22 bp, Homo sapiens
atagcatataagttataaaact

SEQ ID NO: 9274290 - DNA, 22 bp, Homo sapiens
atagcattatttacaattagta

SEQ ID NO: 9274291 - DNA, 22 bp, Homo sapiens
atagcatttacttttcagaaat

SEQ ID NO: 9274292 - DNA, 22 bp, Homo sapiens
atactgttggcagcagaccaga

SEQ ID NO: 9274293 - DNA, 22 bp, Homo sapiens
atacacttgacctggagtgaag

SEQ ID NO: 9274294 - DNA, 22 bp, Homo sapiens
atactgtgtgtgctcaaggaat

SEQ ID NO: 9274295 - DNA, 22 bp, Homo sapiens
atacttaatgtcagtttgatgt

SEQ ID NO: 9274296 - DNA, 22 bp, Homo sapiens
atacttaactgtggagtcattg

SEQ ID NO: 9274297 - DNA, 22 bp, Homo sapiens
atacactggtttatgatattgt

SEQ ID NO: 9274298 - DNA, 22 bp, Homo sapiens
atacactgttcactagatcttc

SEQ ID NO: 9274299 - DNA, 22 bp, Homo sapiens
atagctttcttaaatatataaa

SEQ ID NO: 9274300 - DNA, 22 bp, Homo sapiens
atagctttcttaaatatataaa

SEQ ID NO: 9274301 - DNA, 22 bp, Homo sapiens
atagctttttgtcatagagtct

SEQ ID NO: 9274302 - DNA, 22 bp, Homo sapiens
atagccaggagatgatggggga

SEQ ID NO: 9274303 - DNA, 22 bp, Homo sapiens
atagccagcatatagcagggag

SEQ ID NO: 9274304 - DNA, 22 bp, Homo sapiens
atagctgtagaatgtatacaca

SEQ ID NO: 9274305 - DNA, 22 bp, Homo sapiens
atagcttacaggtgatatcagc

SEQ ID NO: 9274306 - DNA, 22 bp, Homo sapiens
atagttatgctctagacaagaa

SEQ ID NO: 9274307 - DNA, 22 bp, Homo sapiens
atagttataagaaaacgttgaa

SEQ ID NO: 9274308 - DNA, 22 bp, Homo sapiens
atagtgttttacttagacttct

SEQ ID NO: 9274309 - DNA, 22 bp, Homo sapiens
atagtgttgatagcagtggagt

SEQ ID NO: 9274310 - DNA, 22 bp, Homo sapiens
atagtgttacccttcttaaagt

SEQ ID NO: 9274311 - DNA, 22 bp, Homo sapiens
atagtgtcagaaaatcataaga

SEQ ID NO: 9274312 - DNA, 22 bp, Homo sapiens
ataggatgataaaattagaaac

SEQ ID NO: 9274313 - DNA, 22 bp, Homo sapiens
atagtgtgtaaagtgcagtgat

SEQ ID NO: 9274314 - DNA, 22 bp, Homo sapiens
ataggaatgtgatttataaatg

SEQ ID NO: 9274315 - DNA, 22 bp, Homo sapiens
atagttcctactttgcactaat

SEQ ID NO: 9274316 - DNA, 22 bp, Homo sapiens
atagttcactaatagcaaaagc

SEQ ID NO: 9274317 - DNA, 22 bp, Homo sapiens
atagttattagagaagctggta

SEQ ID NO: 9274318 - DNA, 22 bp, Homo sapiens
agaaaacttgtcacagctctca

SEQ ID NO: 9274319 - DNA, 22 bp, Homo sapiens
agaaaagaggctttctaagcat

SEQ ID NO: 9274320 - DNA, 17 bp, Homo sapiens
agaaaagagaccagcag

SEQ ID NO: 9274321 - DNA, 17 bp, Homo sapiens
agaaaagagaccagcag

SEQ ID NO: 9274322 - DNA, 17 bp, Homo sapiens
agaaaagagaccagcag

SEQ ID NO: 9274323 - DNA, 23 bp, Homo sapiens
agaaaagcttggacacatggcct

SEQ ID NO: 9274324 - DNA, 22 bp, Homo sapiens
agaagccatggtatgcaactac

SEQ ID NO: 9274325 - DNA, 21 bp, Homo sapiens
agaagccatgtggtggagaac

SEQ ID NO: 9274326 - DNA, 22 bp, Homo sapiens
agaagccatggtatgcaactac

SEQ ID NO: 9274327 - DNA, 22 bp, Homo sapiens
agaagccatagtctgggaggca

SEQ ID NO: 9274328 - DNA, 22 bp, Homo sapiens
agaagccatatttagggaggag

SEQ ID NO: 9274329 - DNA, 22 bp, Homo sapiens
agaagccaccagctgaggaaga

SEQ ID NO: 9274330 - DNA, 22 bp, Homo sapiens
atcctgggaatgggagggtcat

SEQ ID NO: 9274331 - DNA, 22 bp, Homo sapiens
atcctgggaagctgacattgaa

SEQ ID NO: 9274332 - DNA, 22 bp, Homo sapiens
agaagccatagtatctcagggt

SEQ ID NO: 9274333 - DNA, 22 bp, Homo sapiens
agaagccatagtctgggaggca

SEQ ID NO: 9274334 - DNA, 22 bp, Homo sapiens
atcctggccctcatgacccctt

SEQ ID NO: 9274335 - DNA, 22 bp, Homo sapiens
atcctgggaagctgacattgaa

SEQ ID NO: 9274336 - DNA, 22 bp, Homo sapiens
atcctgagttctcagagtctcc

SEQ ID NO: 9274337 - DNA, 22 bp, Homo sapiens
agaagccattccctgtaggctc

SEQ ID NO: 9274338 - DNA, 22 bp, Homo sapiens
agaagccattccctgtaggctc

SEQ ID NO: 9274339 - DNA, 22 bp, Homo sapiens
agaagccattccctgtaggctc

SEQ ID NO: 9274340 - DNA, 22 bp, Homo sapiens
agaagccatgtttagtaggatg

SEQ ID NO: 9274341 - DNA, 22 bp, Homo sapiens
agaagccatgtttagtaggatg

SEQ ID NO: 9274342 - DNA, 22 bp, Homo sapiens
agaagccattgaagcagacctc

SEQ ID NO: 9274343 - DNA, 22 bp, Homo sapiens
agaagccattctcagttcctga

SEQ ID NO: 9274344 - DNA, 22 bp, Homo sapiens
agaagcctcatcctctctagtg

SEQ ID NO: 9274345 - DNA, 21 bp, Homo sapiens
agaagcctgggtggaggtggg

SEQ ID NO: 9274346 - DNA, 21 bp, Homo sapiens
agaagccatttgttaggactt

SEQ ID NO: 9274347 - DNA, 22 bp, Homo sapiens
agaagctgacagatgcagcagg

SEQ ID NO: 9274348 - DNA, 20 bp, Homo sapiens
agaagctgatactgatggaa

SEQ ID NO: 9274349 - DNA, 22 bp, Homo sapiens
atctgcttttgagaatttactt

SEQ ID NO: 9274350 - DNA, 22 bp, Homo sapiens
agaagctgcgtttatttaaatc

SEQ ID NO: 9274351 - DNA, 22 bp, Homo sapiens
agaagctgcctacatgaccagc

SEQ ID NO: 9274352 - DNA, 22 bp, Homo sapiens
agaaatgtgagccccttatcaa

SEQ ID NO: 9274353 - DNA, 22 bp, Homo sapiens
agaagcacggttttgtctagca

SEQ ID NO: 9274354 - DNA, 22 bp, Homo sapiens
agaagcagttattttttgcaca

SEQ ID NO: 9274355 - DNA, 22 bp, Homo sapiens
agaagcattataacatgcaagg

SEQ ID NO: 9274356 - DNA, 22 bp, Homo sapiens
agaagcattatttaattttact

SEQ ID NO: 9274357 - DNA, 22 bp, Homo sapiens
agaagcattatttaattttact

SEQ ID NO: 9274358 - DNA, 20 bp, Homo sapiens
agaagcatcattctgatgtc

SEQ ID NO: 9274359 - DNA, 20 bp, Homo sapiens
agaagcatcattctgatgtc

SEQ ID NO: 9274360 - DNA, 22 bp, Homo sapiens
agaagcattatttaattttact

SEQ ID NO: 9274361 - DNA, 22 bp, Homo sapiens
agaagccaaatgccagtgacct

SEQ ID NO: 9274362 - DNA, 22 bp, Homo sapiens
agaagccaacagggcaggagag

SEQ ID NO: 9274363 - DNA, 22 bp, Homo sapiens
agaagccaaaggggccagatat

SEQ ID NO: 9274364 - DNA, 22 bp, Homo sapiens
agaagcattggaccaggggccc

SEQ ID NO: 9274365 - DNA, 20 bp, Homo sapiens
agaagcattcaaagaaaact

SEQ ID NO: 9274366 - DNA, 22 bp, Homo sapiens
agaaatagtcacattggaggaa

SEQ ID NO: 9274367 - DNA, 19 bp, Homo sapiens
agaaatagccttccttgtc

SEQ ID NO: 9274368 - DNA, 22 bp, Homo sapiens
agaaatagcagagtcaggcggg

SEQ ID NO: 9274369 - DNA, 19 bp, Homo sapiens
agaaatagccttccttgtc

SEQ ID NO: 9274370 - DNA, 20 bp, Homo sapiens
agaaatattgagttcagagg

SEQ ID NO: 9274371 - DNA, 22 bp, Homo sapiens
agaaatatgctgattagatgaa

SEQ ID NO: 9274372 - DNA, 22 bp, Homo sapiens
agaaatcaatatctatatgttg

SEQ ID NO: 9274373 - DNA, 22 bp, Homo sapiens
agaaatcaatgaagtctgctaa

SEQ ID NO: 9274374 - DNA, 22 bp, Homo sapiens
atcaatgttgggccaaagcaaa

SEQ ID NO: 9274375 - DNA, 22 bp, Homo sapiens
atcaatgttttgatagcccaga

SEQ ID NO: 9274376 - DNA, 22 bp, Homo sapiens
atcaagcatatataaaactgca

SEQ ID NO: 9274377 - DNA, 22 bp, Homo sapiens
atcaatatcagatcagacagga

SEQ ID NO: 9274378 - DNA, 22 bp, Homo sapiens
atcaatgacagttgaattctac

SEQ ID NO: 9274379 - DNA, 22 bp, Homo sapiens
atcaatgacagttgaattctac

SEQ ID NO: 9274380 - DNA, 22 bp, Homo sapiens
atcaagttctgtcacatttgtc

SEQ ID NO: 9274381 - DNA, 22 bp, Homo sapiens
atatagtgaaagtgatgtgtgg

SEQ ID NO: 9274382 - DNA, 22 bp, Homo sapiens
atatagtgagagattacagaag

SEQ ID NO: 9274383 - DNA, 22 bp, Homo sapiens
atatagtcaaacatatatgtgt

SEQ ID NO: 9274384 - DNA, 22 bp, Homo sapiens
atatagtttaagaaagtacagt

SEQ ID NO: 9274385 - DNA, 20 bp, Homo sapiens
agaaacatttcttgagaact

SEQ ID NO: 9274386 - DNA, 22 bp, Homo sapiens
atatagtttaagaaagtacagt

SEQ ID NO: 9274387 - DNA, 20 bp, Homo sapiens
agaaacatttcttgagaact

SEQ ID NO: 9274388 - DNA, 22 bp, Homo sapiens
agaaactgtgttactagaatgt

SEQ ID NO: 9274389 - DNA, 22 bp, Homo sapiens
agaaacttcagctattcttttg

SEQ ID NO: 9274390 - DNA, 22 bp, Homo sapiens
agaaacttcagctattcttttg

SEQ ID NO: 9274391 - DNA, 22 bp, Homo sapiens
agaaacttcagctattcttttg

SEQ ID NO: 9274392 - DNA, 22 bp, Homo sapiens
agaaactgcagctcagagaagt

SEQ ID NO: 9274393 - DNA, 22 bp, Homo sapiens
agaaaagggcaggagggataca

SEQ ID NO: 9274394 - DNA, 22 bp, Homo sapiens
atatagaaggtgctatttacat

SEQ ID NO: 9274395 - DNA, 22 bp, Homo sapiens
atatagaaggtgctatttacat

SEQ ID NO: 9274396 - DNA, 22 bp, Homo sapiens
atatagtaagcagtctgtaaat

SEQ ID NO: 9274397 - DNA, 22 bp, Homo sapiens
atataggttatcatatttgccc

SEQ ID NO: 9274398 - DNA, 22 bp, Homo sapiens
atatagtaagcagtctgtaaat

SEQ ID NO: 9274399 - DNA, 19 bp, Homo sapiens
atatagcattattcaattt

SEQ ID NO: 9274400 - DNA, 22 bp, Homo sapiens
atatagctgaggggtattataa

SEQ ID NO: 9274401 - DNA, 17 bp, Homo sapiens
agaaagaggatccacag

SEQ ID NO: 9274402 - DNA, 17 bp, Homo sapiens
agaaagaggatccacag

SEQ ID NO: 9274403 - DNA, 17 bp, Homo sapiens
agaaagaggatccacag

SEQ ID NO: 9274404 - DNA, 22 bp, Homo sapiens
agaaagagctcgggattaacag

SEQ ID NO: 9274405 - DNA, 22 bp, Homo sapiens
agaaagacaaaatgcagtggct

SEQ ID NO: 9274406 - DNA, 22 bp, Homo sapiens
agaaagacgtgatgaagaagta

SEQ ID NO: 9274407 - DNA, 22 bp, Homo sapiens
agaaagacaaaatgcagtggct

SEQ ID NO: 9274408 - DNA, 22 bp, Homo sapiens
atattaagatgctattggtttt

SEQ ID NO: 9274409 - DNA, 22 bp, Homo sapiens
atattaatgggatttagtcagg

SEQ ID NO: 9274410 - DNA, 22 bp, Homo sapiens
atattaatgggatttagtcagg

SEQ ID NO: 9274411 - DNA, 22 bp, Homo sapiens
atattaaaactatggttttcag

SEQ ID NO: 9274412 - DNA, 22 bp, Homo sapiens
atattaaaactatggttttcag

SEQ ID NO: 9274413 - DNA, 22 bp, Homo sapiens
atattaaatggattttgggagc

SEQ ID NO: 9274414 - DNA, 22 bp, Homo sapiens
cagaaagcagagctgagccttt

SEQ ID NO: 9274415 - DNA, 22 bp, Homo sapiens
cagaaagctctttcaatcttgc

SEQ ID NO: 9274416 - DNA, 22 bp, Homo sapiens
ggctgccctcggggtcgcaggc

SEQ ID NO: 9274417 - DNA, 22 bp, Homo sapiens
ggctgccctcgtctactgccca

SEQ ID NO: 9274418 - DNA, 22 bp, Homo sapiens
cagaaaataaagtttctacgca

SEQ ID NO: 9274419 - DNA, 22 bp, Homo sapiens
cagaaaataaacatttgtggaa

SEQ ID NO: 9274420 - DNA, 22 bp, Homo sapiens
cagaaaagggtgtttgttcagg

SEQ ID NO: 9274421 - DNA, 22 bp, Homo sapiens
ggctgccataactgataccata

SEQ ID NO: 9274422 - DNA, 22 bp, Homo sapiens
ggctgccataacagagtaccac

SEQ ID NO: 9274423 - DNA, 22 bp, Homo sapiens
cactttgtttattgtgcagtta

SEQ ID NO: 9274424 - DNA, 22 bp, Homo sapiens
cactttgtgtgggatcaggggt

SEQ ID NO: 9274425 - DNA, 17 bp, Homo sapiens
cactttgttgctgtggg

SEQ ID NO: 9274426 - DNA, 22 bp, Homo sapiens
cagaaaacctgactctagaact

SEQ ID NO: 9274427 - DNA, 22 bp, Homo sapiens
cagaaaacctgactctagaact

SEQ ID NO: 9274428 - DNA, 22 bp, Homo sapiens
ggctgtagttacctgatgaaat

SEQ ID NO: 9274429 - DNA, 22 bp, Homo sapiens
ggctgtaggttggtgctggaca

SEQ ID NO: 9274430 - DNA, 22 bp, Homo sapiens
ggctgtccacctaccatgccgg

SEQ ID NO: 9274431 - DNA, 22 bp, Homo sapiens
ggctgtccttggccaaggcact

SEQ ID NO: 9274432 - DNA, 22 bp, Homo sapiens
ggctgtgaaccctggcagtgtg

SEQ ID NO: 9274433 - DNA, 22 bp, Homo sapiens
ggctgtgaagtagcaggggcag

SEQ ID NO: 9274434 - DNA, 22 bp, Homo sapiens
ggctgtgtttctgtttgacatt

SEQ ID NO: 9274435 - DNA, 22 bp, Homo sapiens
ggctgttgacagacataggttt

SEQ ID NO: 9274436 - DNA, 22 bp, Homo sapiens
ggcttaaaaggaaaatgagagt

SEQ ID NO: 9274437 - DNA, 22 bp, Homo sapiens
cagaaagcttggtacaatatgc

SEQ ID NO: 9274438 - DNA, 18 bp, Homo sapiens
cagaaagttatttactct

SEQ ID NO: 9274439 - DNA, 23 bp, Homo sapiens
cagaaataaactggtttgtagat

SEQ ID NO: 9274440 - DNA, 23 bp, Homo sapiens
cagaaataaactggtttgtagat

SEQ ID NO: 9274441 - DNA, 22 bp, Homo sapiens
cagaaataaacttctcacatcg

SEQ ID NO: 9274442 - DNA, 22 bp, Homo sapiens
ggctgggaggatgacttgctac

SEQ ID NO: 9274443 - DNA, 22 bp, Homo sapiens
ggctgggaggatgacttgctac

SEQ ID NO: 9274444 - DNA, 22 bp, Homo sapiens
ggctgggaggatgacttgctac

SEQ ID NO: 9274445 - DNA, 22 bp, Homo sapiens
ggcctgagcagacagcatgatg

SEQ ID NO: 9274446 - DNA, 22 bp, Homo sapiens
ggcctgagcagacagcatgatg

SEQ ID NO: 9274447 - DNA, 21 bp, Homo sapiens
ggcctgagcacctgtccacct

SEQ ID NO: 9274448 - DNA, 21 bp, Homo sapiens
ggcctgagcacctgtccacct

SEQ ID NO: 9274449 - DNA, 20 bp, Homo sapiens
ggcctgagcatggctggcag

SEQ ID NO: 9274450 - DNA, 22 bp, Homo sapiens
ggcctgagcagacagcatgatg

SEQ ID NO: 9274451 - DNA, 22 bp, Homo sapiens
ggcctgagcagacagcatgatg

SEQ ID NO: 9274452 - DNA, 22 bp, Homo sapiens
ggcctgagcttgggcagcgtat

SEQ ID NO: 9274453 - DNA, 22 bp, Homo sapiens
ggcctgaggcaatagtcagaca

SEQ ID NO: 9274454 - DNA, 22 bp, Homo sapiens
ggcctgaggcaatagtcagaca

SEQ ID NO: 9274455 - DNA, 22 bp, Homo sapiens
ggcctgagctctggggaggcaa

SEQ ID NO: 9274456 - DNA, 22 bp, Homo sapiens
ggcctgagcttgggcagcgtat

SEQ ID NO: 9274457 - DNA, 22 bp, Homo sapiens
ggcctgagctctggggaggcaa

SEQ ID NO: 9274458 - DNA, 22 bp, Homo sapiens
ggcctgaggccaccagcagccc

SEQ ID NO: 9274459 - DNA, 22 bp, Homo sapiens
ggcctgaggcgtcccagctgtg

SEQ ID NO: 9274460 - DNA, 22 bp, Homo sapiens
ggcctgtctcacccccgggtgc

SEQ ID NO: 9274461 - DNA, 22 bp, Homo sapiens
ggcctgtccagcctgcctggct

SEQ ID NO: 9274462 - DNA, 22 bp, Homo sapiens
ggcctgtaatcccagctactca

SEQ ID NO: 9274463 - DNA, 22 bp, Homo sapiens
ggctcaatgcaacttctgcctc

SEQ ID NO: 9274464 - DNA, 22 bp, Homo sapiens
ggctcaatgcaacttctgcctc

SEQ ID NO: 9274465 - DNA, 22 bp, Homo sapiens
ggcctgtgtctgtgcctgtcct

SEQ ID NO: 9274466 - DNA, 22 bp, Homo sapiens
ggcctgtgggaggacagctggg

SEQ ID NO: 9274467 - DNA, 22 bp, Homo sapiens
ggcctgtgggaggacagctggg

SEQ ID NO: 9274468 - DNA, 22 bp, Homo sapiens
ggctcaggctggagtgcagtgg

SEQ ID NO: 9274469 - DNA, 19 bp, Homo sapiens
ggctcagggcgctgccgcc

SEQ ID NO: 9274470 - DNA, 22 bp, Homo sapiens
ggctcagggaatgaggaagaat

SEQ ID NO: 9274471 - DNA, 22 bp, Homo sapiens
ggctctggtgccctggctccca

SEQ ID NO: 9274472 - DNA, 22 bp, Homo sapiens
ggctctggtgagggtaggagat

SEQ ID NO: 9274473 - DNA, 22 bp, Homo sapiens
ggctctggtgtgaagcagcctc

SEQ ID NO: 9274474 - DNA, 22 bp, Homo sapiens
ggctgagccccctctgcgtagg

SEQ ID NO: 9274475 - DNA, 22 bp, Homo sapiens
ggctgagccccctctgcgtagg

SEQ ID NO: 9274476 - DNA, 22 bp, Homo sapiens
ggctctggtgccctggctccca

SEQ ID NO: 9274477 - DNA, 22 bp, Homo sapiens
ggctgagcctggagcatctggt

SEQ ID NO: 9274478 - DNA, 22 bp, Homo sapiens
ggctgagcctggagcatctggt

SEQ ID NO: 9274479 - DNA, 22 bp, Homo sapiens
ggctgagcgtggctgccgtggg

SEQ ID NO: 9274480 - DNA, 19 bp, Homo sapiens
ggctgagcgccttggctgc

SEQ ID NO: 9274481 - DNA, 22 bp, Homo sapiens
ggctgagctcaggggcagcagg

SEQ ID NO: 9274482 - DNA, 22 bp, Homo sapiens
ggctgaggcggcgatgcccttg

SEQ ID NO: 9274483 - DNA, 22 bp, Homo sapiens
ggctgaggcggcgatgcccttg

SEQ ID NO: 9274484 - DNA, 22 bp, Homo sapiens
ggctgaggcggcgatgcccttg

SEQ ID NO: 9274485 - DNA, 22 bp, Homo sapiens
ggctgaggcggcgatgcccttg

SEQ ID NO: 9274486 - DNA, 22 bp, Homo sapiens
ggctgagctcaggggcagcagg

SEQ ID NO: 9274487 - DNA, 22 bp, Homo sapiens
ggctgagcttatatatgtgctg

SEQ ID NO: 9274488 - DNA, 22 bp, Homo sapiens
ggctgaggcggcgatgcccttg

SEQ ID NO: 9274489 - DNA, 22 bp, Homo sapiens
ggctctggtcagtgaggggcct

SEQ ID NO: 9274490 - DNA, 22 bp, Homo sapiens
ggctctggtgagggtaggagat

SEQ ID NO: 9274491 - DNA, 22 bp, Homo sapiens
ggctctgggttctgcaatgcgt

SEQ ID NO: 9274492 - DNA, 22 bp, Homo sapiens
ggctccaggtgcatgccaggct

SEQ ID NO: 9274493 - DNA, 22 bp, Homo sapiens
ggctccaggtttaagggtatgt

SEQ ID NO: 9274494 - DNA, 22 bp, Homo sapiens
ggctccaggtgcatgccaggct

SEQ ID NO: 9274495 - DNA, 18 bp, Homo sapiens
ggctccagtcttcagtgg

SEQ ID NO: 9274496 - DNA, 22 bp, Homo sapiens
ggctccagggtacccctggatg

SEQ ID NO: 9274497 - DNA, 22 bp, Homo sapiens
ggctccagggtacccctggatg

SEQ ID NO: 9274498 - DNA, 22 bp, Homo sapiens
ggctccagggtctctccttgtg

SEQ ID NO: 9274499 - DNA, 22 bp, Homo sapiens
ggctccaggtacgtatgggagg

SEQ ID NO: 9274500 - DNA, 22 bp, Homo sapiens
ggctcaggttgggtcacatgac

SEQ ID NO: 9274501 - DNA, 22 bp, Homo sapiens
ggctcaggttaccagtccctcc

SEQ ID NO: 9274502 - DNA, 22 bp, Homo sapiens
ggcagggagtggagactcccta

SEQ ID NO: 9274503 - DNA, 22 bp, Homo sapiens
ggcagggcagcgctgattaggg

SEQ ID NO: 9274504 - DNA, 22 bp, Homo sapiens
ggcagggcaggaaagtcaggaa

SEQ ID NO: 9274505 - DNA, 22 bp, Homo sapiens
ggcagggcaggaaagtcaggaa

SEQ ID NO: 9274506 - DNA, 22 bp, Homo sapiens
ggcaggtgcccagagagcacga

SEQ ID NO: 9274507 - DNA, 22 bp, Homo sapiens
ggcaggtgccttctgtgctagc

SEQ ID NO: 9274508 - DNA, 22 bp, Homo sapiens
ggcaggtgcccagagagcacga

SEQ ID NO: 9274509 - DNA, 22 bp, Homo sapiens
ggcaggtgccagttggcttggg

SEQ ID NO: 9274510 - DNA, 22 bp, Homo sapiens
ggcaggtgcacctgagccatct

SEQ ID NO: 9274511 - DNA, 22 bp, Homo sapiens
ggcaggtgcacctgagccatct

SEQ ID NO: 9274512 - DNA, 22 bp, Homo sapiens
ggcaggtgcacctgagccatct

SEQ ID NO: 9274513 - DNA, 22 bp, Homo sapiens
ggcaggtgatctagagtcaata

SEQ ID NO: 9274514 - DNA, 22 bp, Homo sapiens
ggcaggtgatctagagtcaata

SEQ ID NO: 9274515 - DNA, 22 bp, Homo sapiens
ggcatttagttttcatattctg

SEQ ID NO: 9274516 - DNA, 22 bp, Homo sapiens
ggccaaaagcataatcctcaca

SEQ ID NO: 9274517 - DNA, 22 bp, Homo sapiens
ggccaaggatggtggctctggt

SEQ ID NO: 9274518 - DNA, 22 bp, Homo sapiens
ggccctgttagagctcccacaa

SEQ ID NO: 9274519 - DNA, 22 bp, Homo sapiens
ggccctgtggttttgcaaagtc

SEQ ID NO: 9274520 - DNA, 22 bp, Homo sapiens
ggccctgtggttttgcaaagtc

SEQ ID NO: 9274521 - DNA, 22 bp, Homo sapiens
ggcccttggagcctccacagtg

SEQ ID NO: 9274522 - DNA, 22 bp, Homo sapiens
ggcccttcctcttgtgctggca

SEQ ID NO: 9274523 - DNA, 22 bp, Homo sapiens
ggcccttcctgctctcttagct

SEQ ID NO: 9274524 - DNA, 22 bp, Homo sapiens
ggccctgtcctggctgtctccg

SEQ ID NO: 9274525 - DNA, 22 bp, Homo sapiens
ggccctgtcctggctgtctccg

SEQ ID NO: 9274526 - DNA, 22 bp, Homo sapiens
ggccctgtgatggatgtattag

SEQ ID NO: 9274527 - DNA, 22 bp, Homo sapiens
ggccactgctctccagcctggg

SEQ ID NO: 9274528 - DNA, 22 bp, Homo sapiens
ggccactgctctccagcctggg

SEQ ID NO: 9274529 - DNA, 22 bp, Homo sapiens
ggccactgccctggctacaccg

SEQ ID NO: 9274530 - DNA, 22 bp, Homo sapiens
ggccactgcctccgccatggct

SEQ ID NO: 9274531 - DNA, 23 bp, Homo sapiens
ggccactgaattttctgcatctt

SEQ ID NO: 9274532 - DNA, 22 bp, Homo sapiens
ggccggggcctgctcgcctgtg

SEQ ID NO: 9274533 - DNA, 22 bp, Homo sapiens
cacctgtacagggccgggctgg

SEQ ID NO: 9274534 - DNA, 22 bp, Homo sapiens
ggccggcctttgcgagcattct

SEQ ID NO: 9274535 - DNA, 22 bp, Homo sapiens
ggccgggcaggtctcagccagc

SEQ ID NO: 9274536 - DNA, 21 bp, Homo sapiens
caccttatagataaaattaga

SEQ ID NO: 9274537 - DNA, 22 bp, Homo sapiens
caccttgcattcttttaattta

SEQ ID NO: 9274538 - DNA, 22 bp, Homo sapiens
caccttgagggggaaaataatc

SEQ ID NO: 9274539 - DNA, 22 bp, Homo sapiens
cacctttaatgagcaccagccg

SEQ ID NO: 9274540 - DNA, 22 bp, Homo sapiens
cacctttgaccttgcagcgcac

SEQ ID NO: 9274541 - DNA, 22 bp, Homo sapiens
cacctttgcaaaccaaatctga

SEQ ID NO: 9274542 - DNA, 22 bp, Homo sapiens
cacgcacgctgggtggaggcgc

SEQ ID NO: 9274543 - DNA, 22 bp, Homo sapiens
cacgagggcacacgtgggaggg

SEQ ID NO: 9274544 - DNA, 22 bp, Homo sapiens
ggcaggcagtgtggtgtgaaac

SEQ ID NO: 9274545 - DNA, 22 bp, Homo sapiens
ggcaggcaggtcttcatggccc

SEQ ID NO: 9274546 - DNA, 22 bp, Homo sapiens
ggcaggcaggagcgtgcttggg

SEQ ID NO: 9274547 - DNA, 22 bp, Homo sapiens
ggcaggcaggagctctgtctcc

SEQ ID NO: 9274548 - DNA, 22 bp, Homo sapiens
ggcaggcaggagcgtgcttggg

SEQ ID NO: 9274549 - DNA, 22 bp, Homo sapiens
ggcaggcaggagcgtgcttggg

SEQ ID NO: 9274550 - DNA, 22 bp, Homo sapiens
ggcaggcatcatgtggtcatta

SEQ ID NO: 9274551 - DNA, 22 bp, Homo sapiens
ggcaggcatcatgtggtcatta

SEQ ID NO: 9274552 - DNA, 22 bp, Homo sapiens
ggcaggcatggggtctgccatt

SEQ ID NO: 9274553 - DNA, 22 bp, Homo sapiens
ggcaggcatggccactccctag

SEQ ID NO: 9274554 - DNA, 22 bp, Homo sapiens
cacatttacatataaaactttc

SEQ ID NO: 9274555 - DNA, 18 bp, Homo sapiens
cacatttacctggctccc

SEQ ID NO: 9274556 - DNA, 22 bp, Homo sapiens
cacatttagaggttagcatggt

SEQ ID NO: 9274557 - DNA, 22 bp, Homo sapiens
cacatttaggttcctatagcca

SEQ ID NO: 9274558 - DNA, 22 bp, Homo sapiens
cacatttatctgttctttctag

SEQ ID NO: 9274559 - DNA, 22 bp, Homo sapiens
cacatttatctgttctttctag

SEQ ID NO: 9274560 - DNA, 22 bp, Homo sapiens
cacatacttgtgtgtacatatg

SEQ ID NO: 9274561 - DNA, 22 bp, Homo sapiens
cacatacatacgtatgtataca

SEQ ID NO: 9274562 - DNA, 22 bp, Homo sapiens
cacatacaatggtgttatttgg

SEQ ID NO: 9274563 - DNA, 22 bp, Homo sapiens
cacataataaatgttcctgatg

SEQ ID NO: 9274564 - DNA, 22 bp, Homo sapiens
ggaggtggagctggaagttcca

SEQ ID NO: 9274565 - DNA, 22 bp, Homo sapiens
ggaggtgctggcggccagctct

SEQ ID NO: 9274566 - DNA, 22 bp, Homo sapiens
ggaggtggagctggaagttcca

SEQ ID NO: 9274567 - DNA, 22 bp, Homo sapiens
cacagtgttccagagcagtggt

SEQ ID NO: 9274568 - DNA, 22 bp, Homo sapiens
cacagtttggttttgctgtaat

SEQ ID NO: 9274569 - DNA, 22 bp, Homo sapiens
cacagttttatcttatactgat

SEQ ID NO: 9274570 - DNA, 22 bp, Homo sapiens
cacagtgtgggcatggtgcctg

SEQ ID NO: 9274571 - DNA, 22 bp, Homo sapiens
ggaggtggaggttgcagtgagc

SEQ ID NO: 9274572 - DNA, 22 bp, Homo sapiens
cacagggaaccaaggctgggcc

SEQ ID NO: 9274573 - DNA, 21 bp, Homo sapiens
ggaggtcccttctggtttcag

SEQ ID NO: 9274574 - DNA, 22 bp, Homo sapiens
cacagggaaccaaggctgggcc

SEQ ID NO: 9274575 - DNA, 22 bp, Homo sapiens
ggaggtgctggcggccagctct

SEQ ID NO: 9274576 - DNA, 22 bp, Homo sapiens
ggaggtgcagagtagggttggt

SEQ ID NO: 9274577 - DNA, 22 bp, Homo sapiens
ggaggtgctgatcccagtcaac

SEQ ID NO: 9274578 - DNA, 22 bp, Homo sapiens
ggaggtgaggccgtagggtgtg

SEQ ID NO: 9274579 - DNA, 22 bp, Homo sapiens
ggaggtgaggccgtagggtgtg

SEQ ID NO: 9274580 - DNA, 22 bp, Homo sapiens
cacagaggatgcccaagcgatc

SEQ ID NO: 9274581 - DNA, 22 bp, Homo sapiens
cacagaggatttttagggcagt

SEQ ID NO: 9274582 - DNA, 22 bp, Homo sapiens
cacagaggatttttagggcagt

SEQ ID NO: 9274583 - DNA, 22 bp, Homo sapiens
cacagaggatttttagggcagt

SEQ ID NO: 9274584 - DNA, 22 bp, Homo sapiens
cacagaggcatgaccctgccct

SEQ ID NO: 9274585 - DNA, 22 bp, Homo sapiens
cacagagctgaacctgggtcat

SEQ ID NO: 9274586 - DNA, 22 bp, Homo sapiens
cacagagagctacgtgcagcgt

SEQ ID NO: 9274587 - DNA, 22 bp, Homo sapiens
cacagaggactgtagcggggag

SEQ ID NO: 9274588 - DNA, 22 bp, Homo sapiens
cacagaggaatgcatcagcaga

SEQ ID NO: 9274589 - DNA, 22 bp, Homo sapiens
cacagaggaaatgactttctta

SEQ ID NO: 9274590 - DNA, 22 bp, Homo sapiens
ggactgggccaggggttggact

SEQ ID NO: 9274591 - DNA, 17 bp, Homo sapiens
ggactgggcggggcagg

SEQ ID NO: 9274592 - DNA, 22 bp, Homo sapiens
ggactgggccaggggttggact

SEQ ID NO: 9274593 - DNA, 22 bp, Homo sapiens
ggactgggattctggatctgct

SEQ ID NO: 9274594 - DNA, 22 bp, Homo sapiens
ggactgggattctggatctgct

SEQ ID NO: 9274595 - DNA, 22 bp, Homo sapiens
cacagaattttctctttacaat

SEQ ID NO: 9274596 - DNA, 22 bp, Homo sapiens
cacagacagtgtccctttgttg

SEQ ID NO: 9274597 - DNA, 22 bp, Homo sapiens
ggactgggagaatggaggcaag

SEQ ID NO: 9274598 - DNA, 22 bp, Homo sapiens
cacagagaaaatgttggtgctt

SEQ ID NO: 9274599 - DNA, 22 bp, Homo sapiens
ggactgggagaatggaggcaag

SEQ ID NO: 9274600 - DNA, 22 bp, Homo sapiens
cacacagctcaggggcactgcc

SEQ ID NO: 9274601 - DNA, 22 bp, Homo sapiens
cacacagctagtgacaggagaa

SEQ ID NO: 9274602 - DNA, 22 bp, Homo sapiens
cacacagctagtgacaggagaa

SEQ ID NO: 9274603 - DNA, 22 bp, Homo sapiens
cacacagctagtgacaggagaa

SEQ ID NO: 9274604 - DNA, 21 bp, Homo sapiens
cacacagctgcccttaggtag

SEQ ID NO: 9274605 - DNA, 22 bp, Homo sapiens
cacacaggaaaattggaattaa

SEQ ID NO: 9274606 - DNA, 22 bp, Homo sapiens
ggaagggcctcgggcgtgggac

SEQ ID NO: 9274607 - DNA, 22 bp, Homo sapiens
cacacagatggtaagggaggga

SEQ ID NO: 9274608 - DNA, 22 bp, Homo sapiens
cacacagatggtaagggaggga

SEQ ID NO: 9274609 - DNA, 22 bp, Homo sapiens
cacacagatggtaagggaggga

SEQ ID NO: 9274610 - DNA, 22 bp, Homo sapiens
cacacagacagctctctgaaga

SEQ ID NO: 9274611 - DNA, 22 bp, Homo sapiens
ggaaggggagctggaaagggta

SEQ ID NO: 9274612 - DNA, 20 bp, Homo sapiens
ggaaggggcaaagtgtgtga

SEQ ID NO: 9274613 - DNA, 20 bp, Homo sapiens
ggaaggggcaaagtgtgtga

SEQ ID NO: 9274614 - DNA, 20 bp, Homo sapiens
ggaaggggcaaagtgtgtga

SEQ ID NO: 9274615 - DNA, 22 bp, Homo sapiens
ggaaggggagctggaaagggta

SEQ ID NO: 9274616 - DNA, 22 bp, Homo sapiens
ggaaggggagctggaaagggta

SEQ ID NO: 9274617 - DNA, 22 bp, Homo sapiens
ggaaggggagctggaaagggta

SEQ ID NO: 9274618 - DNA, 22 bp, Homo sapiens
ggaaggggagctggaaagggta

SEQ ID NO: 9274619 - DNA, 22 bp, Homo sapiens
cacagaagtttcatagtctcga

SEQ ID NO: 9274620 - DNA, 21 bp, Homo sapiens
cacagaatatacattttagtt

SEQ ID NO: 9274621 - DNA, 22 bp, Homo sapiens
cacagaataattcacatggctc

SEQ ID NO: 9274622 - DNA, 22 bp, Homo sapiens
cacactgtctttcagaatggtt

SEQ ID NO: 9274623 - DNA, 22 bp, Homo sapiens
cacactgtctttatgagctgta

SEQ ID NO: 9274624 - DNA, 22 bp, Homo sapiens
cacactgtccccttctccccag

SEQ ID NO: 9274625 - DNA, 22 bp, Homo sapiens
cacagaagaatcatgctgtgtt

SEQ ID NO: 9274626 - DNA, 22 bp, Homo sapiens
ggagctggagagtacagagttt

SEQ ID NO: 9274627 - DNA, 22 bp, Homo sapiens
ggagctggagagtacagagttt

SEQ ID NO: 9274628 - DNA, 22 bp, Homo sapiens
ggagctggagagctagcctagg

SEQ ID NO: 9274629 - DNA, 22 bp, Homo sapiens
ggagctggcagcgcaacccaga

SEQ ID NO: 9274630 - DNA, 22 bp, Homo sapiens
ggagctggagagctagcctagg

SEQ ID NO: 9274631 - DNA, 22 bp, Homo sapiens
ggagctggagagtacagagttt

SEQ ID NO: 9274632 - DNA, 22 bp, Homo sapiens
ggagctgctttgatctgaagaa

SEQ ID NO: 9274633 - DNA, 22 bp, Homo sapiens
ggagcctgacagtgcccagcat

SEQ ID NO: 9274634 - DNA, 22 bp, Homo sapiens
ggagcctattattagcatggca

SEQ ID NO: 9274635 - DNA, 22 bp, Homo sapiens
ggagcctgaaaagtctgcattt

SEQ ID NO: 9274636 - DNA, 22 bp, Homo sapiens
ggagcctgcgggagctcccatt

SEQ ID NO: 9274637 - DNA, 22 bp, Homo sapiens
ggagcctgcgggagctcccatt

SEQ ID NO: 9274638 - DNA, 22 bp, Homo sapiens
ggagctgctcagagccagtccc

SEQ ID NO: 9274639 - DNA, 22 bp, Homo sapiens
ggagctgctccttcagccaagt

SEQ ID NO: 9274640 - DNA, 22 bp, Homo sapiens
cacagagtggaggcttggcctg

SEQ ID NO: 9274641 - DNA, 22 bp, Homo sapiens
cacagataaggatgttaatttt

SEQ ID NO: 9274642 - DNA, 22 bp, Homo sapiens
ggagccctgccctaggcagctc

SEQ ID NO: 9274643 - DNA, 22 bp, Homo sapiens
ggagccctgccctaggcagctc

SEQ ID NO: 9274644 - DNA, 22 bp, Homo sapiens
ggagccctgccctaggcagctc

SEQ ID NO: 9274645 - DNA, 22 bp, Homo sapiens
ggagccctgccctaggcagctc

SEQ ID NO: 9274646 - DNA, 22 bp, Homo sapiens
cacaggaattagcagcctaaaa

SEQ ID NO: 9274647 - DNA, 22 bp, Homo sapiens
cacaggaatgaacagggaaaga

SEQ ID NO: 9274648 - DNA, 22 bp, Homo sapiens
cacaggagaaaggggaagctcg

SEQ ID NO: 9274649 - DNA, 22 bp, Homo sapiens
ggaggcaggaaagacaggttca

SEQ ID NO: 9274650 - DNA, 22 bp, Homo sapiens
ggaggcagaatagagtgtgggt

SEQ ID NO: 9274651 - DNA, 22 bp, Homo sapiens
cacagcttgtttagtgactcac

SEQ ID NO: 9274652 - DNA, 22 bp, Homo sapiens
cacagctttgctttccttaata

SEQ ID NO: 9274653 - DNA, 22 bp, Homo sapiens
cacaggaagtggtcagtgccag

SEQ ID NO: 9274654 - DNA, 22 bp, Homo sapiens
cacaggaatcagcattaatggc

SEQ ID NO: 9274655 - DNA, 22 bp, Homo sapiens
ggaggccaaggaggagcttgcc

SEQ ID NO: 9274656 - DNA, 22 bp, Homo sapiens
ggaggccaaggagggcggatca

SEQ ID NO: 9274657 - DNA, 22 bp, Homo sapiens
ggaggccaaggcaggcggatca

SEQ ID NO: 9274658 - DNA, 20 bp, Homo sapiens
cacaggccttgtgagcagac

SEQ ID NO: 9274659 - DNA, 20 bp, Homo sapiens
cacaggctatatgagagcca

SEQ ID NO: 9274660 - DNA, 22 bp, Homo sapiens
ggaggccaaagtgtgggcggct

SEQ ID NO: 9274661 - DNA, 22 bp, Homo sapiens
ggaggccaaggaggagcttgcc

SEQ ID NO: 9274662 - DNA, 22 bp, Homo sapiens
ggaggcattatggggaagactt

SEQ ID NO: 9274663 - DNA, 22 bp, Homo sapiens
ggaggcatctctgtggctgtct

SEQ ID NO: 9274664 - DNA, 22 bp, Homo sapiens
ggaggcatctctgtggctgtct

SEQ ID NO: 9274665 - DNA, 22 bp, Homo sapiens
cacaggcttccagtccccagct

SEQ ID NO: 9274666 - DNA, 22 bp, Homo sapiens
cacaggcttccagtccccagct

SEQ ID NO: 9274667 - DNA, 22 bp, Homo sapiens
cacaggcttgtcagcatgaggc

SEQ ID NO: 9274668 - DNA, 22 bp, Homo sapiens
cacaggctgggaagcctaggcc

SEQ ID NO: 9274669 - DNA, 22 bp, Homo sapiens
cacaggcttttctgacataggc

SEQ ID NO: 9274670 - DNA, 22 bp, Homo sapiens
cacaggcttttctgacataggc

SEQ ID NO: 9274671 - DNA, 22 bp, Homo sapiens
cacaggcttgtcagcatgaggc

SEQ ID NO: 9274672 - DNA, 22 bp, Homo sapiens
cacaggcttgtcagcatgaggc

SEQ ID NO: 9274673 - DNA, 22 bp, Homo sapiens
cacaggcttgtcagcatgaggc

SEQ ID NO: 9274674 - DNA, 22 bp, Homo sapiens
cacaggcttgtcagcatgaggc

SEQ ID NO: 9274675 - DNA, 22 bp, Homo sapiens
gctttctgtaggtagttactgt

SEQ ID NO: 9274676 - DNA, 22 bp, Homo sapiens
gctttgacactcgcccagccct

SEQ ID NO: 9274677 - DNA, 21 bp, Homo sapiens
caatgtctgctctctgcctag

SEQ ID NO: 9274678 - DNA, 22 bp, Homo sapiens
caatgtcaaggagaccaaaacg

SEQ ID NO: 9274679 - DNA, 22 bp, Homo sapiens
caatgtatcaagaagcatcagt

SEQ ID NO: 9274680 - DNA, 22 bp, Homo sapiens
caatgtcagaattacagttgat

SEQ ID NO: 9274681 - DNA, 22 bp, Homo sapiens
caatgtctgaccgttttgccca

SEQ ID NO: 9274682 - DNA, 22 bp, Homo sapiens
caatgtcagtcaagcagcaaat

SEQ ID NO: 9274683 - DNA, 22 bp, Homo sapiens
caatgtcagagaagctcatatc

SEQ ID NO: 9274684 - DNA, 21 bp, Homo sapiens
gctttctgtggactctgcacc

SEQ ID NO: 9274685 - DNA, 22 bp, Homo sapiens
gctttctgtgcagtgaacacta

SEQ ID NO: 9274686 - DNA, 22 bp, Homo sapiens
gctttctgtggtgatgtaaagg

SEQ ID NO: 9274687 - DNA, 22 bp, Homo sapiens
gctttctggttctcaaagcact

SEQ ID NO: 9274688 - DNA, 18 bp, Homo sapiens
gctttctgtagaaaaggg

SEQ ID NO: 9274689 - DNA, 22 bp, Homo sapiens
gctttctggtttgtgctacagg

SEQ ID NO: 9274690 - DNA, 18 bp, Homo sapiens
gctttctgtgcagcggag

SEQ ID NO: 9274691 - DNA, 22 bp, Homo sapiens
gctttctggagcctgggggaac

SEQ ID NO: 9274692 - DNA, 22 bp, Homo sapiens
gctttctgctctgtaaaatggg

SEQ ID NO: 9274693 - DNA, 22 bp, Homo sapiens
gctttctgggctatagaacggg

SEQ ID NO: 9274694 - DNA, 22 bp, Homo sapiens
caataaagaagatttttgcaat

SEQ ID NO: 9274695 - DNA, 22 bp, Homo sapiens
caagttttgattttgcagtaaa

SEQ ID NO: 9274696 - DNA, 22 bp, Homo sapiens
caagttttgcatagttctgtat

SEQ ID NO: 9274697 - DNA, 21 bp, Homo sapiens
caataaactgcacattgagac

SEQ ID NO: 9274698 - DNA, 22 bp, Homo sapiens
caagtttgtgttctatcattct

SEQ ID NO: 9274699 - DNA, 22 bp, Homo sapiens
caagtttgctgatccttgtttt

SEQ ID NO: 9274700 - DNA, 22 bp, Homo sapiens
caagttttagaaatatctggat

SEQ ID NO: 9274701 - DNA, 22 bp, Homo sapiens
caagttttctgggttcagagca

SEQ ID NO: 9274702 - DNA, 22 bp, Homo sapiens
caagttttagcaagtggaaagg

SEQ ID NO: 9274703 - DNA, 22 bp, Homo sapiens
gctgttgcaatcaaggccatgg

SEQ ID NO: 9274704 - DNA, 22 bp, Homo sapiens
gctgttctgcgtcccaggctgg

SEQ ID NO: 9274705 - DNA, 22 bp, Homo sapiens
gctgttcacggaggaggatggg

SEQ ID NO: 9274706 - DNA, 22 bp, Homo sapiens
gctgttcagggcactcatgggc

SEQ ID NO: 9274707 - DNA, 22 bp, Homo sapiens
gctgttcccatgtggggctcag

SEQ ID NO: 9274708 - DNA, 22 bp, Homo sapiens
gctgttcctgcttagaggtcgg

SEQ ID NO: 9274709 - DNA, 22 bp, Homo sapiens
caagtcaactcaaattgttatc

SEQ ID NO: 9274710 - DNA, 22 bp, Homo sapiens
gctgtggcctggcgcagagctg

SEQ ID NO: 9274711 - DNA, 22 bp, Homo sapiens
gctgtggcctggcgcagagctg

SEQ ID NO: 9274712 - DNA, 22 bp, Homo sapiens
caagtcaagcatgcccttattt

SEQ ID NO: 9274713 - DNA, 22 bp, Homo sapiens
caaggtgccatgctgggcgggg

SEQ ID NO: 9274714 - DNA, 22 bp, Homo sapiens
caaggtttacattgggctatca

SEQ ID NO: 9274715 - DNA, 22 bp, Homo sapiens
caaggtgccatgctgggcgggg

SEQ ID NO: 9274716 - DNA, 22 bp, Homo sapiens
caaggtttactttatgatccag

SEQ ID NO: 9274717 - DNA, 22 bp, Homo sapiens
caaggtttctatgctcaaagga

SEQ ID NO: 9274718 - DNA, 22 bp, Homo sapiens
caaggtttcgagttcccaacca

SEQ ID NO: 9274719 - DNA, 22 bp, Homo sapiens
caaggttttggaagattttcgt

SEQ ID NO: 9274720 - DNA, 22 bp, Homo sapiens
caaggttttgcttgtaagggaa

SEQ ID NO: 9274721 - DNA, 22 bp, Homo sapiens
caaggtttgaaaacgccatggc

SEQ ID NO: 9274722 - DNA, 22 bp, Homo sapiens
caagtagaacagagctaccttg

SEQ ID NO: 9274723 - DNA, 22 bp, Homo sapiens
caagtaaagaatcacatttctt

SEQ ID NO: 9274724 - DNA, 22 bp, Homo sapiens
caagtaaagaatcacatttctt

SEQ ID NO: 9274725 - DNA, 22 bp, Homo sapiens
caaggcctcctgggcccagaga

SEQ ID NO: 9274726 - DNA, 22 bp, Homo sapiens
caaggcctgcctctggcagaaa

SEQ ID NO: 9274727 - DNA, 22 bp, Homo sapiens
caaggccagagccagcgataag

SEQ ID NO: 9274728 - DNA, 22 bp, Homo sapiens
caaggccagttcaccaagggca

SEQ ID NO: 9274729 - DNA, 22 bp, Homo sapiens
caaggccacgttctgcatgcgg

SEQ ID NO: 9274730 - DNA, 22 bp, Homo sapiens
gctggctggtccagcaggggct

SEQ ID NO: 9274731 - DNA, 22 bp, Homo sapiens
gctggctgtatcacctggccag

SEQ ID NO: 9274732 - DNA, 22 bp, Homo sapiens
gctggctgtatcacctggccag

SEQ ID NO: 9274733 - DNA, 22 bp, Homo sapiens
caagggtggtattgggagcata

SEQ ID NO: 9274734 - DNA, 19 bp, Homo sapiens
caagggttgggtctgtcat

SEQ ID NO: 9274735 - DNA, 20 bp, Homo sapiens
caagggtttgcattggcttt

SEQ ID NO: 9274736 - DNA, 22 bp, Homo sapiens
caagggtgaaggcagaggacat

SEQ ID NO: 9274737 - DNA, 22 bp, Homo sapiens
caagggtggtattgggagcata

SEQ ID NO: 9274738 - DNA, 22 bp, Homo sapiens
caaatgtaatggcaggttttgc

SEQ ID NO: 9274739 - DNA, 22 bp, Homo sapiens
caaatgtaatggcaggttttgc

SEQ ID NO: 9274740 - DNA, 22 bp, Homo sapiens
caaatgtaataaggagtttccc

SEQ ID NO: 9274741 - DNA, 22 bp, Homo sapiens
caaatgtaaattcttttgaagc

SEQ ID NO: 9274742 - DNA, 20 bp, Homo sapiens
caaatggcttttatttcctt

SEQ ID NO: 9274743 - DNA, 22 bp, Homo sapiens
caaatggctggcatccttctac

SEQ ID NO: 9274744 - DNA, 22 bp, Homo sapiens
caaatggtcatttctcttttgt

SEQ ID NO: 9274745 - DNA, 22 bp, Homo sapiens
caaatgtaaattcttttgaagc

SEQ ID NO: 9274746 - DNA, 22 bp, Homo sapiens
caagattctagttgaggttcaa

SEQ ID NO: 9274747 - DNA, 22 bp, Homo sapiens
caagattcagagtcttctaacc

SEQ ID NO: 9274748 - DNA, 22 bp, Homo sapiens
caagattcagccctcctgacct

SEQ ID NO: 9274749 - DNA, 22 bp, Homo sapiens
caagattcattttgtccttgtc

SEQ ID NO: 9274750 - DNA, 22 bp, Homo sapiens
caagcagccccaacatgaggat

SEQ ID NO: 9274751 - DNA, 22 bp, Homo sapiens
caagcagggatactgcagggag

SEQ ID NO: 9274752 - DNA, 22 bp, Homo sapiens
caaatgtattctcacttcaggg

SEQ ID NO: 9274753 - DNA, 22 bp, Homo sapiens
caaatgtattctcacttcaggg

SEQ ID NO: 9274754 - DNA, 22 bp, Homo sapiens
gctggaggatggactggaagaa

SEQ ID NO: 9274755 - DNA, 22 bp, Homo sapiens
gctggaggatggactggaagaa

SEQ ID NO: 9274756 - DNA, 22 bp, Homo sapiens
gctggaggatggactggaagaa

SEQ ID NO: 9274757 - DNA, 22 bp, Homo sapiens
caagcagggtttatgcatggag

SEQ ID NO: 9274758 - DNA, 22 bp, Homo sapiens
caagcatgtcttcttaagcaat

SEQ ID NO: 9274759 - DNA, 22 bp, Homo sapiens
caagcatactcattccagactc

SEQ ID NO: 9274760 - DNA, 22 bp, Homo sapiens
caagcagtcagcctgaagactg

SEQ ID NO: 9274761 - DNA, 22 bp, Homo sapiens
caagccagtcagctcagtagat

SEQ ID NO: 9274762 - DNA, 22 bp, Homo sapiens
gtgcccagttgaggccaggact

SEQ ID NO: 9274763 - DNA, 22 bp, Homo sapiens
gtgcccagttgaggccaggact

SEQ ID NO: 9274764 - DNA, 22 bp, Homo sapiens
gtgctgtgcgctttttctgtat

SEQ ID NO: 9274765 - DNA, 22 bp, Homo sapiens
gtgctgagtagaatgaatgcct

SEQ ID NO: 9274766 - DNA, 22 bp, Homo sapiens
gtgctgagtagaatgaatgcct

SEQ ID NO: 9274767 - DNA, 22 bp, Homo sapiens
gtgctgagtagaatgaatgcct

SEQ ID NO: 9274768 - DNA, 22 bp, Homo sapiens
gtgccctccgtgttcatagagc

SEQ ID NO: 9274769 - DNA, 22 bp, Homo sapiens
cagctaccatggtttgttccag

SEQ ID NO: 9274770 - DNA, 22 bp, Homo sapiens
cagctacagttccactgagcat

SEQ ID NO: 9274771 - DNA, 22 bp, Homo sapiens
cagctacagaggccacatggct

SEQ ID NO: 9274772 - DNA, 22 bp, Homo sapiens
cagctacacaccagaactatta

SEQ ID NO: 9274773 - DNA, 22 bp, Homo sapiens
cagctaggaaaccagagggcag

SEQ ID NO: 9274774 - DNA, 22 bp, Homo sapiens
cagctagtaaatggcaagacta

SEQ ID NO: 9274775 - DNA, 22 bp, Homo sapiens
gtgcccagtgcaggcccgcagg

SEQ ID NO: 9274776 - DNA, 22 bp, Homo sapiens
gtgcccagtaaatgaaagcttt

SEQ ID NO: 9274777 - DNA, 22 bp, Homo sapiens
gtgcccaggtgtccctgagaag

SEQ ID NO: 9274778 - DNA, 22 bp, Homo sapiens
cagctattccaggagtagaatc

SEQ ID NO: 9274779 - DNA, 22 bp, Homo sapiens
cagctattctctgaaatgaata

SEQ ID NO: 9274780 - DNA, 22 bp, Homo sapiens
cagctattattttctctaaatt

SEQ ID NO: 9274781 - DNA, 22 bp, Homo sapiens
cagcctggagccacagcccagg

SEQ ID NO: 9274782 - DNA, 22 bp, Homo sapiens
cagcctgctagggcaatgcctt

SEQ ID NO: 9274783 - DNA, 21 bp, Homo sapiens
cagcctgctgctccagggcca

SEQ ID NO: 9274784 - DNA, 22 bp, Homo sapiens
cagcctgggctccagagtccct

SEQ ID NO: 9274785 - DNA, 22 bp, Homo sapiens
cagcctggcctgggactgctga

SEQ ID NO: 9274786 - DNA, 22 bp, Homo sapiens
cagcctgtagaatacagtaaat

SEQ ID NO: 9274787 - DNA, 22 bp, Homo sapiens
cagccctgccatggagcctcct

SEQ ID NO: 9274788 - DNA, 22 bp, Homo sapiens
cagccctgcttccccgctagtt

SEQ ID NO: 9274789 - DNA, 22 bp, Homo sapiens
cagcctgagccttctgtagcaa

SEQ ID NO: 9274790 - DNA, 22 bp, Homo sapiens
cagcctgcaggaggccgtcagc

SEQ ID NO: 9274791 - DNA, 22 bp, Homo sapiens
cagcctgacaccagctttgggc

SEQ ID NO: 9274792 - DNA, 20 bp, Homo sapiens
cagcctgcatcatctgcagc

SEQ ID NO: 9274793 - DNA, 22 bp, Homo sapiens
cagcctgcagggctgcctgttg

SEQ ID NO: 9274794 - DNA, 20 bp, Homo sapiens
cagcctgcatcatctgcagc

SEQ ID NO: 9274795 - DNA, 22 bp, Homo sapiens
cagcctgcagggctgcctgttg

SEQ ID NO: 9274796 - DNA, 22 bp, Homo sapiens
cagcctgcagggctgcctgttg

SEQ ID NO: 9274797 - DNA, 22 bp, Homo sapiens
cagcctgcatttgtatctgtat

SEQ ID NO: 9274798 - DNA, 22 bp, Homo sapiens
cagcctgccctggaagcccagc

SEQ ID NO: 9274799 - DNA, 22 bp, Homo sapiens
cagcctgccctggaagcccagc

SEQ ID NO: 9274800 - DNA, 22 bp, Homo sapiens
cagcctgccgtcagccaggtag

SEQ ID NO: 9274801 - DNA, 20 bp, Homo sapiens
cagcctccactcactcagct

SEQ ID NO: 9274802 - DNA, 20 bp, Homo sapiens
cagcctccactcactcagct

SEQ ID NO: 9274803 - DNA, 23 bp, Homo sapiens
cagccctggagatgtgggaggca

SEQ ID NO: 9274804 - DNA, 22 bp, Homo sapiens
gtcccaggctccatggcagcca

SEQ ID NO: 9274805 - DNA, 22 bp, Homo sapiens
gtcccaggcttatgtggagctt

SEQ ID NO: 9274806 - DNA, 22 bp, Homo sapiens
gtctgcttttgttttactggta

SEQ ID NO: 9274807 - DNA, 22 bp, Homo sapiens
gtctcttttatggtgagttgat

SEQ ID NO: 9274808 - DNA, 22 bp, Homo sapiens
gtcccttcctcattccacttta

SEQ ID NO: 9274809 - DNA, 22 bp, Homo sapiens
gtcccttggctcacaaacagct

SEQ ID NO: 9274810 - DNA, 22 bp, Homo sapiens
cagccagggagggcaaatgaga

SEQ ID NO: 9274811 - DNA, 22 bp, Homo sapiens
cagccaggcctggtgaccaaag

SEQ ID NO: 9274812 - DNA, 22 bp, Homo sapiens
cagccaggcccccgagtcgttg

SEQ ID NO: 9274813 - DNA, 22 bp, Homo sapiens
gtctggagacttgggtcatcaa

SEQ ID NO: 9274814 - DNA, 22 bp, Homo sapiens
gtctggagagctgagcagagtt

SEQ ID NO: 9274815 - DNA, 22 bp, Homo sapiens
gtctggagccaccctaagcatt

SEQ ID NO: 9274816 - DNA, 22 bp, Homo sapiens
gtctggagccccagtcaatgag

SEQ ID NO: 9274817 - DNA, 22 bp, Homo sapiens
gtctggagagctgagcagagtt

SEQ ID NO: 9274818 - DNA, 22 bp, Homo sapiens
gtctggagccactgctgctgct

SEQ ID NO: 9274819 - DNA, 22 bp, Homo sapiens
gtctggacagcagcacctcggc

SEQ ID NO: 9274820 - DNA, 22 bp, Homo sapiens
gtctggaagaactagggatgtt

SEQ ID NO: 9274821 - DNA, 22 bp, Homo sapiens
cagcccaggctcagatgttggg

SEQ ID NO: 9274822 - DNA, 22 bp, Homo sapiens
cagccagggtcaggcagcttct

SEQ ID NO: 9274823 - DNA, 22 bp, Homo sapiens
cagccccttgtccggtagccac

SEQ ID NO: 9274824 - DNA, 22 bp, Homo sapiens
cagccccttcctggcatctgga

SEQ ID NO: 9274825 - DNA, 22 bp, Homo sapiens
cagcccctccctcaggcaggtg

SEQ ID NO: 9274826 - DNA, 22 bp, Homo sapiens
cagcccccatggggaggtcaag

SEQ ID NO: 9274827 - DNA, 22 bp, Homo sapiens
cagcccctcacagagctgtcct

SEQ ID NO: 9274828 - DNA, 22 bp, Homo sapiens
gtctgtctccctgtgactgaga

SEQ ID NO: 9274829 - DNA, 22 bp, Homo sapiens
gtctgtctctctccagagtgca

SEQ ID NO: 9274830 - DNA, 22 bp, Homo sapiens
gtctgtctgttgttgagaagca

SEQ ID NO: 9274831 - DNA, 22 bp, Homo sapiens
gtctgtggtccctgctggggac

SEQ ID NO: 9274832 - DNA, 22 bp, Homo sapiens
gtctgtgggccaaatacagccc

SEQ ID NO: 9274833 - DNA, 22 bp, Homo sapiens
cagccctcaggtcctcagcagc

SEQ ID NO: 9274834 - DNA, 22 bp, Homo sapiens
gtctgtcatctgagatggagtg

SEQ ID NO: 9274835 - DNA, 22 bp, Homo sapiens
gtcccagaaacatattgctggt

SEQ ID NO: 9274836 - DNA, 22 bp, Homo sapiens
cagcaggctctgagtggctgcc

SEQ ID NO: 9274837 - DNA, 22 bp, Homo sapiens
cagcaggctctgagtggctgcc

SEQ ID NO: 9274838 - DNA, 22 bp, Homo sapiens
cagcaggctgcgattgctcatt

SEQ ID NO: 9274839 - DNA, 22 bp, Homo sapiens
gtcccagcttcccactagcagc

SEQ ID NO: 9274840 - DNA, 22 bp, Homo sapiens
gtcccagagagcactagtccat

SEQ ID NO: 9274841 - DNA, 22 bp, Homo sapiens
gtcccagaggacagggtcacat

SEQ ID NO: 9274842 - DNA, 22 bp, Homo sapiens
gtcccagaggctttggccacag

SEQ ID NO: 9274843 - DNA, 22 bp, Homo sapiens
gtcccagaggacagggtcacat

SEQ ID NO: 9274844 - DNA, 22 bp, Homo sapiens
gtcccagatgtctggaactccc

SEQ ID NO: 9274845 - DNA, 22 bp, Homo sapiens
gtcccagatgtctggaactccc

SEQ ID NO: 9274846 - DNA, 22 bp, Homo sapiens
gtcccagaggctttggccacag

SEQ ID NO: 9274847 - DNA, 22 bp, Homo sapiens
gtcccaggcagagtcaggaggg

SEQ ID NO: 9274848 - DNA, 22 bp, Homo sapiens
gtcataaagcttgttgcattta

SEQ ID NO: 9274849 - DNA, 22 bp, Homo sapiens
gtcatcatttttagcatatggg

SEQ ID NO: 9274850 - DNA, 21 bp, Homo sapiens
gtcatccacctctcgggctct

SEQ ID NO: 9274851 - DNA, 20 bp, Homo sapiens
cagcaggctatggggcaccc

SEQ ID NO: 9274852 - DNA, 22 bp, Homo sapiens
gtcattataccattataattgt

SEQ ID NO: 9274853 - DNA, 22 bp, Homo sapiens
cagcaggcgttgggagaaagac

SEQ ID NO: 9274854 - DNA, 22 bp, Homo sapiens
cagcactaggatatacatttcc

SEQ ID NO: 9274855 - DNA, 22 bp, Homo sapiens
cagcactaatcctgcaatttct

SEQ ID NO: 9274856 - DNA, 22 bp, Homo sapiens
cagcacccctcctggctatgaa

SEQ ID NO: 9274857 - DNA, 22 bp, Homo sapiens
cagcaccctttccactgccttg

SEQ ID NO: 9274858 - DNA, 22 bp, Homo sapiens
cagcacctctgggtcttgtctt

SEQ ID NO: 9274859 - DNA, 22 bp, Homo sapiens
cagcagctgatggggaagtgat

SEQ ID NO: 9274860 - DNA, 22 bp, Homo sapiens
cagcagctgggaaggaggctga

SEQ ID NO: 9274861 - DNA, 22 bp, Homo sapiens
cagcagctgggaaggaggctga

SEQ ID NO: 9274862 - DNA, 22 bp, Homo sapiens
cagcagctgcgtgcccaggccg

SEQ ID NO: 9274863 - DNA, 20 bp, Homo sapiens
cagcaggaaaagtgcctcag

SEQ ID NO: 9274864 - DNA, 22 bp, Homo sapiens
cagcagctttgccaagtcagcc

SEQ ID NO: 9274865 - DNA, 22 bp, Homo sapiens
cagcagctttgccaagtcagcc

SEQ ID NO: 9274866 - DNA, 22 bp, Homo sapiens
cagcagcttctgttgatcagaa

SEQ ID NO: 9274867 - DNA, 22 bp, Homo sapiens
cagcagctggtgagacacagcc

SEQ ID NO: 9274868 - DNA, 22 bp, Homo sapiens
cagcagctggttatacctgtgg

SEQ ID NO: 9274869 - DNA, 22 bp, Homo sapiens
cagcagctggtgagacacagcc

SEQ ID NO: 9274870 - DNA, 22 bp, Homo sapiens
ggtgacctcacctggtcccacc

SEQ ID NO: 9274871 - DNA, 22 bp, Homo sapiens
ggtgacagttccggaggtacag

SEQ ID NO: 9274872 - DNA, 19 bp, Homo sapiens
ggtgaccacctggtcagtg

SEQ ID NO: 9274873 - DNA, 22 bp, Homo sapiens
ggtgacattatcattattttaa

SEQ ID NO: 9274874 - DNA, 22 bp, Homo sapiens
ggtctggaagcgtcccaaaggt

SEQ ID NO: 9274875 - DNA, 22 bp, Homo sapiens
ggtgacagcgggtcaagaggag

SEQ ID NO: 9274876 - DNA, 22 bp, Homo sapiens
ggtctgagatatttgttcagct

SEQ ID NO: 9274877 - DNA, 22 bp, Homo sapiens
ggtctgagcttgagcccatgct

SEQ ID NO: 9274878 - DNA, 22 bp, Homo sapiens
ggtctgaggtgggacccaggaa

SEQ ID NO: 9274879 - DNA, 22 bp, Homo sapiens
ggtctgaggtttgggattcact

SEQ ID NO: 9274880 - DNA, 22 bp, Homo sapiens
ggtctgaggctccaaggaggtg

SEQ ID NO: 9274881 - DNA, 22 bp, Homo sapiens
ggtctgaggtgggacccaggaa

SEQ ID NO: 9274882 - DNA, 22 bp, Homo sapiens
ggtctgagtggtgctgactcag

SEQ ID NO: 9274883 - DNA, 22 bp, Homo sapiens
ggtctgctttccttgccactgt

SEQ ID NO: 9274884 - DNA, 22 bp, Homo sapiens
ggtctgagtgccagggagagaa

SEQ ID NO: 9274885 - DNA, 22 bp, Homo sapiens
ggtctgagtagagggctggcga

SEQ ID NO: 9274886 - DNA, 22 bp, Homo sapiens
ggtctgagtgggcaggggccgg

SEQ ID NO: 9274887 - DNA, 22 bp, Homo sapiens
ggtctgagtgggcaggggccgg

SEQ ID NO: 9274888 - DNA, 22 bp, Homo sapiens
ggtctgagtggggcctgagatt

SEQ ID NO: 9274889 - DNA, 22 bp, Homo sapiens
cagcaagatttttaaagcaagg

SEQ ID NO: 9274890 - DNA, 22 bp, Homo sapiens
cagcaagatttttaaagcaagg

SEQ ID NO: 9274891 - DNA, 22 bp, Homo sapiens
cagcaagatttttaaagcaagg

SEQ ID NO: 9274892 - DNA, 22 bp, Homo sapiens
cagcaaagtaagctgacatgta

SEQ ID NO: 9274893 - DNA, 22 bp, Homo sapiens
cagcaaagtaagctgacatgta

SEQ ID NO: 9274894 - DNA, 22 bp, Homo sapiens
cagcaagacaaggaacaaactg

SEQ ID NO: 9274895 - DNA, 22 bp, Homo sapiens
cagcaagacaaggaacaaactg

SEQ ID NO: 9274896 - DNA, 22 bp, Homo sapiens
cagcaagacagtttcctaagtg

SEQ ID NO: 9274897 - DNA, 22 bp, Homo sapiens
ggtgagaaagggattcctgttc

SEQ ID NO: 9274898 - DNA, 17 bp, Homo sapiens
ggtgagacctcccactc

SEQ ID NO: 9274899 - DNA, 22 bp, Homo sapiens
ggtgacggggcccaggtttcct

SEQ ID NO: 9274900 - DNA, 22 bp, Homo sapiens
ggtgctggttcagggtggctgt

SEQ ID NO: 9274901 - DNA, 22 bp, Homo sapiens
cagcacacagtgactcgcacct

SEQ ID NO: 9274902 - DNA, 21 bp, Homo sapiens
cagcacagtactgggtcttgc

SEQ ID NO: 9274903 - DNA, 22 bp, Homo sapiens
ggtgctgcctatagtctgaaac

SEQ ID NO: 9274904 - DNA, 22 bp, Homo sapiens
ggtgctgacattcagagtctgg

SEQ ID NO: 9274905 - DNA, 22 bp, Homo sapiens
cagcacagtttcccccatgagc

SEQ ID NO: 9274906 - DNA, 22 bp, Homo sapiens
cagcacagtttcccccatgagc

SEQ ID NO: 9274907 - DNA, 22 bp, Homo sapiens
cagcacagtgaccagacccact

SEQ ID NO: 9274908 - DNA, 22 bp, Homo sapiens
cagcacagtagagtagttgtaa

SEQ ID NO: 9274909 - DNA, 22 bp, Homo sapiens
cagcacagtgaccagacccact

SEQ ID NO: 9274910 - DNA, 22 bp, Homo sapiens
cagcacagtgcagatgctgact

SEQ ID NO: 9274911 - DNA, 22 bp, Homo sapiens
cagcacatctccaagaatttct

SEQ ID NO: 9274912 - DNA, 22 bp, Homo sapiens
cagcacatgctcatcagggaag

SEQ ID NO: 9274913 - DNA, 22 bp, Homo sapiens
cagcacatcttctgatcttttg

SEQ ID NO: 9274914 - DNA, 19 bp, Homo sapiens
cagaggcaccaggtataga

SEQ ID NO: 9274915 - DNA, 22 bp, Homo sapiens
cagaggcacaagaaagcaaggc

SEQ ID NO: 9274916 - DNA, 22 bp, Homo sapiens
cagaggcacaagaaagcaaggc

SEQ ID NO: 9274917 - DNA, 22 bp, Homo sapiens
cagaggcacagcttcttttaat

SEQ ID NO: 9274918 - DNA, 19 bp, Homo sapiens
cagaggcaccaggtataga

SEQ ID NO: 9274919 - DNA, 22 bp, Homo sapiens
ggggagctgggaggtgagttac

SEQ ID NO: 9274920 - DNA, 22 bp, Homo sapiens
ggggagcaggctgggctgtctg

SEQ ID NO: 9274921 - DNA, 22 bp, Homo sapiens
ggggagcaatagttgaggtgtg

SEQ ID NO: 9274922 - DNA, 22 bp, Homo sapiens
ggggagcaatagttgaggtgtg

SEQ ID NO: 9274923 - DNA, 22 bp, Homo sapiens
ggggagcagaagcagcaacaac

SEQ ID NO: 9274924 - DNA, 22 bp, Homo sapiens
ggggagcaattgcccccttaga

SEQ ID NO: 9274925 - DNA, 18 bp, Homo sapiens
ggggagcagactgaactc

SEQ ID NO: 9274926 - DNA, 21 bp, Homo sapiens
cagaggggctagcctggctgc

SEQ ID NO: 9274927 - DNA, 22 bp, Homo sapiens
cagaggggataacaggtgtaga

SEQ ID NO: 9274928 - DNA, 22 bp, Homo sapiens
cagaggggataacaggtgtaga

SEQ ID NO: 9274929 - DNA, 22 bp, Homo sapiens
cagagggcttcaggttcaggat

SEQ ID NO: 9274930 - DNA, 22 bp, Homo sapiens
cagaggggtgtagagatcactg

SEQ ID NO: 9274931 - DNA, 22 bp, Homo sapiens
cagaggggctgacacccttggc

SEQ ID NO: 9274932 - DNA, 22 bp, Homo sapiens
cagagggtcaccaggaagtgca

SEQ ID NO: 9274933 - DNA, 22 bp, Homo sapiens
cagagggtgtgaaggggatgaa

SEQ ID NO: 9274934 - DNA, 23 bp, Homo sapiens
cagagggttccatggagcatggt

SEQ ID NO: 9274935 - DNA, 22 bp, Homo sapiens
cagagggctgccctgagttcgt

SEQ ID NO: 9274936 - DNA, 22 bp, Homo sapiens
cagagggctgccctgagttcgt

SEQ ID NO: 9274937 - DNA, 22 bp, Homo sapiens
cagagggcgtccgggttaactt

SEQ ID NO: 9274938 - DNA, 21 bp, Homo sapiens
cagagggccggcatgtggtct

SEQ ID NO: 9274939 - DNA, 22 bp, Homo sapiens
ggtcatctgcctccaaagcact

SEQ ID NO: 9274940 - DNA, 22 bp, Homo sapiens
ggtcataatggatttgctgttc

SEQ ID NO: 9274941 - DNA, 23 bp, Homo sapiens
cagagggttccatggagcatggt

SEQ ID NO: 9274942 - DNA, 22 bp, Homo sapiens
cagagggttgtcaggcgccttg

SEQ ID NO: 9274943 - DNA, 22 bp, Homo sapiens
cagaggtacaagctaagttggg

SEQ ID NO: 9274944 - DNA, 21 bp, Homo sapiens
cagagggtttctcaggtgttt

SEQ ID NO: 9274945 - DNA, 22 bp, Homo sapiens
cagaggtaccagcagcctctgg

SEQ ID NO: 9274946 - DNA, 22 bp, Homo sapiens
cagaggtacagccattgaagat

SEQ ID NO: 9274947 - DNA, 22 bp, Homo sapiens
cagaggtagcatgctgtggctt

SEQ ID NO: 9274948 - DNA, 22 bp, Homo sapiens
cagaggtagaaggcatgcagtg

SEQ ID NO: 9274949 - DNA, 22 bp, Homo sapiens
cagaggtagaactggccctcac

SEQ ID NO: 9274950 - DNA, 22 bp, Homo sapiens
cagaggtagaaggcatgcagtg

SEQ ID NO: 9274951 - DNA, 22 bp, Homo sapiens
cagagtctggactgcaggctcc

SEQ ID NO: 9274952 - DNA, 17 bp, Homo sapiens
cagagtctgtctgcatc

SEQ ID NO: 9274953 - DNA, 22 bp, Homo sapiens
cagagtcttgtgtgttcagccc

SEQ ID NO: 9274954 - DNA, 22 bp, Homo sapiens
ggtctgagagccactgaatccc

SEQ ID NO: 9274955 - DNA, 22 bp, Homo sapiens
ggtccacctccaagctggggac

SEQ ID NO: 9274956 - DNA, 23 bp, Homo sapiens
ggtccacccgagcctgcagcttc

SEQ ID NO: 9274957 - DNA, 22 bp, Homo sapiens
gggccagcagtatcggaggcat

SEQ ID NO: 9274958 - DNA, 22 bp, Homo sapiens
gggccagcagtatcggaggcat

SEQ ID NO: 9274959 - DNA, 22 bp, Homo sapiens
gggccagcctactgctagaccc

SEQ ID NO: 9274960 - DNA, 22 bp, Homo sapiens
gggccagagcttggcagctggg

SEQ ID NO: 9274961 - DNA, 22 bp, Homo sapiens
gggccagagcacagaggatgtt

SEQ ID NO: 9274962 - DNA, 22 bp, Homo sapiens
gggccagagcacagaggatgtt

SEQ ID NO: 9274963 - DNA, 22 bp, Homo sapiens
gggccagacctcttctcaggga

SEQ ID NO: 9274964 - DNA, 22 bp, Homo sapiens
gggccacggaaggaccagtggg

SEQ ID NO: 9274965 - DNA, 22 bp, Homo sapiens
gggcagtgtcggggcccaggga

SEQ ID NO: 9274966 - DNA, 22 bp, Homo sapiens
gggcagtgtcggggcccaggga

SEQ ID NO: 9274967 - DNA, 22 bp, Homo sapiens
gggctgaaaggccgcctcagat

SEQ ID NO: 9274968 - DNA, 22 bp, Homo sapiens
gggctgacaaccatctgacaag

SEQ ID NO: 9274969 - DNA, 22 bp, Homo sapiens
cagagcctcagaatcctgtgga

SEQ ID NO: 9274970 - DNA, 22 bp, Homo sapiens
cagagcctaaaacgactccact

SEQ ID NO: 9274971 - DNA, 22 bp, Homo sapiens
gggctgagaagttgatcccaag

SEQ ID NO: 9274972 - DNA, 22 bp, Homo sapiens
gggctgactcaaccttgcaaag

SEQ ID NO: 9274973 - DNA, 22 bp, Homo sapiens
gggctgagtgggcctcttactt

SEQ ID NO: 9274974 - DNA, 22 bp, Homo sapiens
cagaggagaattgcgggatcat

SEQ ID NO: 9274975 - DNA, 22 bp, Homo sapiens
cagaggagttcagtacacagcc

SEQ ID NO: 9274976 - DNA, 20 bp, Homo sapiens
cagaggcaaggagacttgga

SEQ ID NO: 9274977 - DNA, 22 bp, Homo sapiens
cagaggcaaaagaggtggaggt

SEQ ID NO: 9274978 - DNA, 20 bp, Homo sapiens
cagaggcaaggagacttgga

SEQ ID NO: 9274979 - DNA, 22 bp, Homo sapiens
gggctgaggggtatctcatggg

SEQ ID NO: 9274980 - DNA, 22 bp, Homo sapiens
gggctgaggggtatctcatggg

SEQ ID NO: 9274981 - DNA, 22 bp, Homo sapiens
gggctgaggggtatctcatggg

SEQ ID NO: 9274982 - DNA, 22 bp, Homo sapiens
gggctgagtcatctggggcctc

SEQ ID NO: 9274983 - DNA, 22 bp, Homo sapiens
gggctgaggggtatctcatggg

SEQ ID NO: 9274984 - DNA, 22 bp, Homo sapiens
gggctgagtcatctggggcctc

SEQ ID NO: 9274985 - DNA, 22 bp, Homo sapiens
gggctgagtgacctcaggccaa

SEQ ID NO: 9274986 - DNA, 22 bp, Homo sapiens
gggctgagtgacctcaggccaa

SEQ ID NO: 9274987 - DNA, 22 bp, Homo sapiens
gggctgagtgacctcaggccaa

SEQ ID NO: 9274988 - DNA, 22 bp, Homo sapiens
gggctgagtctgctgcctgtca

SEQ ID NO: 9274989 - DNA, 22 bp, Homo sapiens
gggctgagtctgctgcctgtca

SEQ ID NO: 9274990 - DNA, 22 bp, Homo sapiens
cagagcctctgccctgggcact

SEQ ID NO: 9274991 - DNA, 22 bp, Homo sapiens
cagagcctctcagccccttggg

SEQ ID NO: 9274992 - DNA, 22 bp, Homo sapiens
cagagcctgcctctggctgtgg

SEQ ID NO: 9274993 - DNA, 19 bp, Homo sapiens
cagagctgctggcctcgtc

SEQ ID NO: 9274994 - DNA, 22 bp, Homo sapiens
cagagctgcttcccagtttgtg

SEQ ID NO: 9274995 - DNA, 19 bp, Homo sapiens
cagagctgctggcctcgtc

SEQ ID NO: 9274996 - DNA, 22 bp, Homo sapiens
cagagctggctctgcatgtaca

SEQ ID NO: 9274997 - DNA, 23 bp, Homo sapiens
cagagctggctcagagctgcctg

SEQ ID NO: 9274998 - DNA, 22 bp, Homo sapiens
cagagctgggatcccatgggcg

SEQ ID NO: 9274999 - DNA, 23 bp, Homo sapiens
cagagctggcttcatgggtgtgc

SEQ ID NO: 9275000 - DNA, 23 bp, Homo sapiens
cagagctggcttcatgggtgtgc

SEQ ID NO: 9275001 - DNA, 22 bp, Homo sapiens
cagagctgggatcccatgggcg

SEQ ID NO: 9275002 - DNA, 22 bp, Homo sapiens
cagagctgggatcccatgggcg

SEQ ID NO: 9275003 - DNA, 22 bp, Homo sapiens
cagagctgggatcccatgggcg

SEQ ID NO: 9275004 - DNA, 22 bp, Homo sapiens
cagagctgggtttgggaaacct

SEQ ID NO: 9275005 - DNA, 22 bp, Homo sapiens
cagagctgggtttgggaaacct

SEQ ID NO: 9275006 - DNA, 22 bp, Homo sapiens
cagagctgggatcccatgggcg

SEQ ID NO: 9275007 - DNA, 22 bp, Homo sapiens
cagagctgggcatggtgaaagg

SEQ ID NO: 9275008 - DNA, 20 bp, Homo sapiens
ggcttagactgagttctcac

SEQ ID NO: 9275009 - DNA, 22 bp, Homo sapiens
ggcttcagaggggaggtagtgc

SEQ ID NO: 9275010 - DNA, 22 bp, Homo sapiens
ggcttcagaggggaggtagtgc

SEQ ID NO: 9275011 - DNA, 22 bp, Homo sapiens
cagacagggtcctgtccgtcac

SEQ ID NO: 9275012 - DNA, 22 bp, Homo sapiens
cagacagggtcctgtccgtcac

SEQ ID NO: 9275013 - DNA, 22 bp, Homo sapiens
cagacagggtcctgtccgtcac

SEQ ID NO: 9275014 - DNA, 22 bp, Homo sapiens
ggcttcagaagactggacaggt

SEQ ID NO: 9275015 - DNA, 22 bp, Homo sapiens
ggcttcaccaggtgcatgcatg

SEQ ID NO: 9275016 - DNA, 22 bp, Homo sapiens
cagacctcaaagctgcagtgct

SEQ ID NO: 9275017 - DNA, 22 bp, Homo sapiens
cagaccctcgggtgagttggcc

SEQ ID NO: 9275018 - DNA, 22 bp, Homo sapiens
cagacccaggatccaaatgttg

SEQ ID NO: 9275019 - DNA, 22 bp, Homo sapiens
cagaccagaaggaagccgacaa

SEQ ID NO: 9275020 - DNA, 22 bp, Homo sapiens
cagaccagtagggctcatccca

SEQ ID NO: 9275021 - DNA, 22 bp, Homo sapiens
cagaccagccatttgcctcttc

SEQ ID NO: 9275022 - DNA, 22 bp, Homo sapiens
cagacctgaggagcactgagcc

SEQ ID NO: 9275023 - DNA, 22 bp, Homo sapiens
cagacctgaggttgagtaccag

SEQ ID NO: 9275024 - DNA, 17 bp, Homo sapiens
cagacctctgtgaagcc

SEQ ID NO: 9275025 - DNA, 22 bp, Homo sapiens
cagacctggaaaacaggcttgc

SEQ ID NO: 9275026 - DNA, 20 bp, Homo sapiens
cagacctgcacccacttcga

SEQ ID NO: 9275027 - DNA, 23 bp, Homo sapiens
cagacctggcagtcatcctcaac

SEQ ID NO: 9275028 - DNA, 22 bp, Homo sapiens
cagacctggaaaacaggcttgc

SEQ ID NO: 9275029 - DNA, 19 bp, Homo sapiens
cagacctgtccagcctgtg

SEQ ID NO: 9275030 - DNA, 19 bp, Homo sapiens
cagacctgtccagcctgtg

SEQ ID NO: 9275031 - DNA, 19 bp, Homo sapiens
cagacctgtccagcctgtg

SEQ ID NO: 9275032 - DNA, 22 bp, Homo sapiens
cagactggccacatctgcactg

SEQ ID NO: 9275033 - DNA, 22 bp, Homo sapiens
cagactggccacatctgcactg

SEQ ID NO: 9275034 - DNA, 22 bp, Homo sapiens
cagactgagtggattaaacaat

SEQ ID NO: 9275035 - DNA, 22 bp, Homo sapiens
cagactggccacatctgcactg

SEQ ID NO: 9275036 - DNA, 22 bp, Homo sapiens
cagactggctgaaggccgagtg

SEQ ID NO: 9275037 - DNA, 22 bp, Homo sapiens
cagactgggctggtggaaagct

SEQ ID NO: 9275038 - DNA, 22 bp, Homo sapiens
gggcagagaaatggacagttgg

SEQ ID NO: 9275039 - DNA, 22 bp, Homo sapiens
gggcagagaaatggacagttgg

SEQ ID NO: 9275040 - DNA, 22 bp, Homo sapiens
cagagacaggatctcgaagact

SEQ ID NO: 9275041 - DNA, 22 bp, Homo sapiens
cagagacaggcttgccctccac

SEQ ID NO: 9275042 - DNA, 22 bp, Homo sapiens
gggcagtgggtggctgcagcct

SEQ ID NO: 9275043 - DNA, 22 bp, Homo sapiens
gggcagtgggtggctgcagcct

SEQ ID NO: 9275044 - DNA, 22 bp, Homo sapiens
gggcagtggttacacagctgag

SEQ ID NO: 9275045 - DNA, 22 bp, Homo sapiens
gggcagtggtccaggctacagc

SEQ ID NO: 9275046 - DNA, 20 bp, Homo sapiens
gggcagtggcgctatctcag

SEQ ID NO: 9275047 - DNA, 22 bp, Homo sapiens
gggcagtgggtggctgcagcct

SEQ ID NO: 9275048 - DNA, 22 bp, Homo sapiens
gggcagtgggaccaggcaccag

SEQ ID NO: 9275049 - DNA, 22 bp, Homo sapiens
gggcagtgggtggctgcagcct

SEQ ID NO: 9275050 - DNA, 22 bp, Homo sapiens
gggcagcagcaggaggtctctg

SEQ ID NO: 9275051 - DNA, 22 bp, Homo sapiens
gggcagcagagccctgccgagt

SEQ ID NO: 9275052 - DNA, 22 bp, Homo sapiens
gggcagcaggctccacgttcct

SEQ ID NO: 9275053 - DNA, 22 bp, Homo sapiens
gggcagcagttgccctaatcaa

SEQ ID NO: 9275054 - DNA, 22 bp, Homo sapiens
gggcagcatgaggaccctcatc

SEQ ID NO: 9275055 - DNA, 22 bp, Homo sapiens
gggcagcatcaggaggggcttt

SEQ ID NO: 9275056 - DNA, 22 bp, Homo sapiens
gggcagcatcaggaggggcttt

SEQ ID NO: 9275057 - DNA, 22 bp, Homo sapiens
gggcagcatcaggaggggcttt

SEQ ID NO: 9275058 - DNA, 22 bp, Homo sapiens
cagagacaggaatcagctgcag

SEQ ID NO: 9275059 - DNA, 22 bp, Homo sapiens
gggcagcattctgtgggcaggt

SEQ ID NO: 9275060 - DNA, 22 bp, Homo sapiens
gcctggattccttgtttctcag

SEQ ID NO: 9275061 - DNA, 22 bp, Homo sapiens
gcctggattccttgtttctcag

SEQ ID NO: 9275062 - DNA, 22 bp, Homo sapiens
gcctggagttgtggtgaagcca

SEQ ID NO: 9275063 - DNA, 22 bp, Homo sapiens
gcctggaggaatgtagctgagg

SEQ ID NO: 9275064 - DNA, 22 bp, Homo sapiens
gcctggaggaatgtagctgagg

SEQ ID NO: 9275065 - DNA, 22 bp, Homo sapiens
attttactactccaattaatga

SEQ ID NO: 9275066 - DNA, 22 bp, Homo sapiens
attttacttagtgtaatgtcca

SEQ ID NO: 9275067 - DNA, 22 bp, Homo sapiens
attttactactccaattaatga

SEQ ID NO: 9275068 - DNA, 22 bp, Homo sapiens
gcctggcacattgcagtggatt

SEQ ID NO: 9275069 - DNA, 22 bp, Homo sapiens
gcctggcacattgcagtggatt

SEQ ID NO: 9275070 - DNA, 22 bp, Homo sapiens
gcctggcaatggcctcaggaag

SEQ ID NO: 9275071 - DNA, 22 bp, Homo sapiens
gcctggcaaggccctgttgact

SEQ ID NO: 9275072 - DNA, 22 bp, Homo sapiens
gcctgagaaggataggaagcga

SEQ ID NO: 9275073 - DNA, 22 bp, Homo sapiens
gcctgagaaggacacagcaggt

SEQ ID NO: 9275074 - DNA, 22 bp, Homo sapiens
gcctgaagtttcatgcctctat

SEQ ID NO: 9275075 - DNA, 22 bp, Homo sapiens
gcctgacctcttctgccctggg

SEQ ID NO: 9275076 - DNA, 22 bp, Homo sapiens
gcctgagagttgaagttcagtg

SEQ ID NO: 9275077 - DNA, 22 bp, Homo sapiens
gcctgagagacccatggggcaa

SEQ ID NO: 9275078 - DNA, 22 bp, Homo sapiens
gcctgagagaactgaccaagag

SEQ ID NO: 9275079 - DNA, 22 bp, Homo sapiens
atttggaagaaatctgtcacag

SEQ ID NO: 9275080 - DNA, 22 bp, Homo sapiens
atttggaaggcgtttctctgta

SEQ ID NO: 9275081 - DNA, 22 bp, Homo sapiens
atttggaaggcgtttctctgta

SEQ ID NO: 9275082 - DNA, 22 bp, Homo sapiens
gcccccgaggaggtgatgtcgc

SEQ ID NO: 9275083 - DNA, 22 bp, Homo sapiens
gcccccagctctcaagctcaaa

SEQ ID NO: 9275084 - DNA, 22 bp, Homo sapiens
gcccccaggctctggagaacct

SEQ ID NO: 9275085 - DNA, 22 bp, Homo sapiens
gcccccaggcactacatgtgaa

SEQ ID NO: 9275086 - DNA, 22 bp, Homo sapiens
gcccccagaagggccacagatt

SEQ ID NO: 9275087 - DNA, 22 bp, Homo sapiens
gcccccagaagggccacagatt

SEQ ID NO: 9275088 - DNA, 22 bp, Homo sapiens
gcccccagaagggccacagatt

SEQ ID NO: 9275089 - DNA, 22 bp, Homo sapiens
gcccccagaagggccacagatt

SEQ ID NO: 9275090 - DNA, 22 bp, Homo sapiens
gcccccagaagggccacagatt

SEQ ID NO: 9275091 - DNA, 18 bp, Homo sapiens
gcccccagatgctactga

SEQ ID NO: 9275092 - DNA, 22 bp, Homo sapiens
gcccccagagaatgaggtacga

SEQ ID NO: 9275093 - DNA, 22 bp, Homo sapiens
gcccccagacctcagtgggctg

SEQ ID NO: 9275094 - DNA, 22 bp, Homo sapiens
atttgccttttaaactcacaat

SEQ ID NO: 9275095 - DNA, 22 bp, Homo sapiens
atttgctgagctcaaagaaaag

SEQ ID NO: 9275096 - DNA, 22 bp, Homo sapiens
atttgctgagctcaaagaaaag

SEQ ID NO: 9275097 - DNA, 22 bp, Homo sapiens
atttggaaacaattatattctt

SEQ ID NO: 9275098 - DNA, 22 bp, Homo sapiens
atttggaaatgcatctcttgag

SEQ ID NO: 9275099 - DNA, 22 bp, Homo sapiens
gcctaggagacaagcgtgaaag

SEQ ID NO: 9275100 - DNA, 22 bp, Homo sapiens
gcctaggagtacagaatggttt

SEQ ID NO: 9275101 - DNA, 22 bp, Homo sapiens
gcctaggagtggggatggcggt

SEQ ID NO: 9275102 - DNA, 22 bp, Homo sapiens
gcctaggggtaagagtactggc

SEQ ID NO: 9275103 - DNA, 22 bp, Homo sapiens
atttggaacaaatattagtaaa

SEQ ID NO: 9275104 - DNA, 22 bp, Homo sapiens
gcctcaaatgtggagcactatt

SEQ ID NO: 9275105 - DNA, 22 bp, Homo sapiens
gcctatggattggagaaggagc

SEQ ID NO: 9275106 - DNA, 19 bp, Homo sapiens
gcctctgagggcaggacac

SEQ ID NO: 9275107 - DNA, 19 bp, Homo sapiens
gcctctgagggcaggacac

SEQ ID NO: 9275108 - DNA, 22 bp, Homo sapiens
gcctcacatattcatggttact

SEQ ID NO: 9275109 - DNA, 22 bp, Homo sapiens
gcctgaagaacagctgtgagga

SEQ ID NO: 9275110 - DNA, 22 bp, Homo sapiens
gcctctgatggaggccagcgct

SEQ ID NO: 9275111 - DNA, 22 bp, Homo sapiens
gcccacagtctatcagtttgcg

SEQ ID NO: 9275112 - DNA, 22 bp, Homo sapiens
gcccacagtgtagcaggtactc

SEQ ID NO: 9275113 - DNA, 22 bp, Homo sapiens
gcccacagttaatgggggctct

SEQ ID NO: 9275114 - DNA, 22 bp, Homo sapiens
atttccatgtccaaaaattagt

SEQ ID NO: 9275115 - DNA, 22 bp, Homo sapiens
atttccattatcatgacaaatt

SEQ ID NO: 9275116 - DNA, 22 bp, Homo sapiens
atttctgtagtccacattcttt

SEQ ID NO: 9275117 - DNA, 22 bp, Homo sapiens
atttctcagttcctactgttta

SEQ ID NO: 9275118 - DNA, 22 bp, Homo sapiens
atttctgttgcttataaattac

SEQ ID NO: 9275119 - DNA, 22 bp, Homo sapiens
gccccaggttgcctgtcccagg

SEQ ID NO: 9275120 - DNA, 22 bp, Homo sapiens
atttctgtgcagtaaatggtga

SEQ ID NO: 9275121 - DNA, 22 bp, Homo sapiens
gccaggtggctgagcagctgca

SEQ ID NO: 9275122 - DNA, 22 bp, Homo sapiens
atttcatgttaactgaacagaa

SEQ ID NO: 9275123 - DNA, 22 bp, Homo sapiens
gccaggtggaggttgcagtgag

SEQ ID NO: 9275124 - DNA, 22 bp, Homo sapiens
gccaggtggaggttgcagtgag

SEQ ID NO: 9275125 - DNA, 22 bp, Homo sapiens
gccaggtgagaggactgaggct

SEQ ID NO: 9275126 - DNA, 22 bp, Homo sapiens
gccaggtgagaggactgaggct

SEQ ID NO: 9275127 - DNA, 22 bp, Homo sapiens
gccaggtgagaggactgaggct

SEQ ID NO: 9275128 - DNA, 22 bp, Homo sapiens
gccaggctggtgcaaggatatt

SEQ ID NO: 9275129 - DNA, 22 bp, Homo sapiens
gccaggctggtgcaaggatatt

SEQ ID NO: 9275130 - DNA, 22 bp, Homo sapiens
gccaggctggtgcaaggatatt

SEQ ID NO: 9275131 - DNA, 22 bp, Homo sapiens
gccaggctggtcttgaactcct

SEQ ID NO: 9275132 - DNA, 22 bp, Homo sapiens
gccaggctggtgcaaggatatt

SEQ ID NO: 9275133 - DNA, 22 bp, Homo sapiens
gccaggctggtcttgaactcct

SEQ ID NO: 9275134 - DNA, 22 bp, Homo sapiens
gccaggctggtcttgaactcct

SEQ ID NO: 9275135 - DNA, 22 bp, Homo sapiens
gccaggctggccagcaccttct

SEQ ID NO: 9275136 - DNA, 22 bp, Homo sapiens
gccaggctggggggagatgtct

SEQ ID NO: 9275137 - DNA, 22 bp, Homo sapiens
gccaggctggggggagatgtct

SEQ ID NO: 9275138 - DNA, 22 bp, Homo sapiens
gccaggctggtcttgaactcct

SEQ ID NO: 9275139 - DNA, 22 bp, Homo sapiens
gccaggctggccagcaccttct

SEQ ID NO: 9275140 - DNA, 22 bp, Homo sapiens
gccaggctggcaaaaggaaacc

SEQ ID NO: 9275141 - DNA, 22 bp, Homo sapiens
gccaggctggccagcaccttct

SEQ ID NO: 9275142 - DNA, 22 bp, Homo sapiens
gccaggctggccagcaccttct

SEQ ID NO: 9275143 - DNA, 22 bp, Homo sapiens
gccaggctggcaaaaggaaacc

SEQ ID NO: 9275144 - DNA, 22 bp, Homo sapiens
gccaggctggaaagaacagaca

SEQ ID NO: 9275145 - DNA, 22 bp, Homo sapiens
gccaggctgctggctgctgtcc

SEQ ID NO: 9275146 - DNA, 22 bp, Homo sapiens
gccaggctggaaagaacagaca

SEQ ID NO: 9275147 - DNA, 22 bp, Homo sapiens
gccaggctggcaaaaggaaacc

SEQ ID NO: 9275148 - DNA, 22 bp, Homo sapiens
gccaggctggaaagaacagaca

SEQ ID NO: 9275149 - DNA, 22 bp, Homo sapiens
gccacaggtactatgggagaga

SEQ ID NO: 9275150 - DNA, 22 bp, Homo sapiens
gccacaggtcggctagagggtc

SEQ ID NO: 9275151 - DNA, 22 bp, Homo sapiens
gccacaggtactatgggagaga

SEQ ID NO: 9275152 - DNA, 22 bp, Homo sapiens
gccacaggtactatgggagaga

SEQ ID NO: 9275153 - DNA, 22 bp, Homo sapiens
gccacagtcactgctgcagggg

SEQ ID NO: 9275154 - DNA, 22 bp, Homo sapiens
gccacaggtgggctctgggaaa

SEQ ID NO: 9275155 - DNA, 22 bp, Homo sapiens
gccacaggtggaattaagaaat

SEQ ID NO: 9275156 - DNA, 19 bp, Homo sapiens
gccaggcctggacctgcag

SEQ ID NO: 9275157 - DNA, 22 bp, Homo sapiens
gccaggctgctggctgctgtcc

SEQ ID NO: 9275158 - DNA, 22 bp, Homo sapiens
gccaggctgctggctgctgtcc

SEQ ID NO: 9275159 - DNA, 22 bp, Homo sapiens
caaatactgggtaagttaattt

SEQ ID NO: 9275160 - DNA, 18 bp, Homo sapiens
caaatactgttgtcttat

SEQ ID NO: 9275161 - DNA, 22 bp, Homo sapiens
caaatactctggatgtgtttgt

SEQ ID NO: 9275162 - DNA, 22 bp, Homo sapiens
caaatactgagtttattttcaa

SEQ ID NO: 9275163 - DNA, 22 bp, Homo sapiens
caaatactgagtttattttcaa

SEQ ID NO: 9275164 - DNA, 22 bp, Homo sapiens
caaatactttatatacttcaaa

SEQ ID NO: 9275165 - DNA, 21 bp, Homo sapiens
caaatacttagaaacttaaga

SEQ ID NO: 9275166 - DNA, 22 bp, Homo sapiens
caaatactttatatacttcaaa

SEQ ID NO: 9275167 - DNA, 22 bp, Homo sapiens
caaatagacaagatggcaggaa

SEQ ID NO: 9275168 - DNA, 22 bp, Homo sapiens
caaatagaaggtactcagagaa

SEQ ID NO: 9275169 - DNA, 22 bp, Homo sapiens
caaatagaactcacagacaaga

SEQ ID NO: 9275170 - DNA, 22 bp, Homo sapiens
caaatagaactcacagacaaga

SEQ ID NO: 9275171 - DNA, 22 bp, Homo sapiens
caaatagaactcacagacaaga

SEQ ID NO: 9275172 - DNA, 22 bp, Homo sapiens
caaagtgctggaattacaggtg

SEQ ID NO: 9275173 - DNA, 22 bp, Homo sapiens
caaatactaaacataagatttt

SEQ ID NO: 9275174 - DNA, 22 bp, Homo sapiens
caaataattactatcctcactt

SEQ ID NO: 9275175 - DNA, 22 bp, Homo sapiens
caaagctcatgctcttagccat

SEQ ID NO: 9275176 - DNA, 22 bp, Homo sapiens
caaagcctctgatttcacttgt

SEQ ID NO: 9275177 - DNA, 18 bp, Homo sapiens
caaagctcacgttccatc

SEQ ID NO: 9275178 - DNA, 22 bp, Homo sapiens
caaaggaaatactaatctggaa

SEQ ID NO: 9275179 - DNA, 22 bp, Homo sapiens
caaaggaaatactaatctggaa

SEQ ID NO: 9275180 - DNA, 22 bp, Homo sapiens
caaagctggaaaaggaggctgg

SEQ ID NO: 9275181 - DNA, 22 bp, Homo sapiens
caaagctggaaaaggaggctgg

SEQ ID NO: 9275182 - DNA, 22 bp, Homo sapiens
caaatagactctagaatttatt

SEQ ID NO: 9275183 - DNA, 22 bp, Homo sapiens
gctcttgggggacagatggagt

SEQ ID NO: 9275184 - DNA, 22 bp, Homo sapiens
gctcttgtcaaaaattagttga

SEQ ID NO: 9275185 - DNA, 18 bp, Homo sapiens
gctctttctgtctccagc

SEQ ID NO: 9275186 - DNA, 22 bp, Homo sapiens
gctcttgtcaaaaattagttga

SEQ ID NO: 9275187 - DNA, 22 bp, Homo sapiens
gctgacccctacaggttgtgtt

SEQ ID NO: 9275188 - DNA, 22 bp, Homo sapiens
gctgacagttactgctgtaaca

SEQ ID NO: 9275189 - DNA, 19 bp, Homo sapiens
gctgaaatcaaatttggaa

SEQ ID NO: 9275190 - DNA, 22 bp, Homo sapiens
gctgaaaaatagtgtcgtgttt

SEQ ID NO: 9275191 - DNA, 22 bp, Homo sapiens
gctgaaatcccagcattcccca

SEQ ID NO: 9275192 - DNA, 22 bp, Homo sapiens
gctgaaatgaaaacacaggtcg

SEQ ID NO: 9275193 - DNA, 22 bp, Homo sapiens
gctgacagagtgcctggcctca

SEQ ID NO: 9275194 - DNA, 22 bp, Homo sapiens
caaatgcatagtttataagaag

SEQ ID NO: 9275195 - DNA, 22 bp, Homo sapiens
caaatgcatagtttataagaag

SEQ ID NO: 9275196 - DNA, 22 bp, Homo sapiens
caaatgcatagaaagatgaaac

SEQ ID NO: 9275197 - DNA, 22 bp, Homo sapiens
caaatgatacctattactaggc

SEQ ID NO: 9275198 - DNA, 20 bp, Homo sapiens
gctgacccctgctgtcatgc

SEQ ID NO: 9275199 - DNA, 22 bp, Homo sapiens
caaatgcatgagaaataagagg

SEQ ID NO: 9275200 - DNA, 22 bp, Homo sapiens
caaatgcatgagaaataagagg

SEQ ID NO: 9275201 - DNA, 22 bp, Homo sapiens
caaatgctaacttctttccaaa

SEQ ID NO: 9275202 - DNA, 22 bp, Homo sapiens
caaatgctaacttctttccaaa

SEQ ID NO: 9275203 - DNA, 22 bp, Homo sapiens
caaatgctactaataggcaagt

SEQ ID NO: 9275204 - DNA, 22 bp, Homo sapiens
caaatggctggcatccttctac

SEQ ID NO: 9275205 - DNA, 22 bp, Homo sapiens
caaatggcaacaagaacactgg

SEQ ID NO: 9275206 - DNA, 22 bp, Homo sapiens
caaaagcagttctatctgagtt

SEQ ID NO: 9275207 - DNA, 22 bp, Homo sapiens
caaaagcagttctatctgagtt

SEQ ID NO: 9275208 - DNA, 22 bp, Homo sapiens
atttttgtatccccagctcctg

SEQ ID NO: 9275209 - DNA, 22 bp, Homo sapiens
atttttctctttccactgagat

SEQ ID NO: 9275210 - DNA, 22 bp, Homo sapiens
atttttctctttccactgagat

SEQ ID NO: 9275211 - DNA, 22 bp, Homo sapiens
atttttctctttccactgagat

SEQ ID NO: 9275212 - DNA, 19 bp, Homo sapiens
atttttcttcctctgtgca

SEQ ID NO: 9275213 - DNA, 19 bp, Homo sapiens
atttttcttcctctgtgca

SEQ ID NO: 9275214 - DNA, 22 bp, Homo sapiens
atttttgagctgtgaacatagc

SEQ ID NO: 9275215 - DNA, 22 bp, Homo sapiens
atttttctctccactccattaa

SEQ ID NO: 9275216 - DNA, 22 bp, Homo sapiens
atttttctctccactccattaa

SEQ ID NO: 9275217 - DNA, 22 bp, Homo sapiens
atttttctctccactccattaa

SEQ ID NO: 9275218 - DNA, 22 bp, Homo sapiens
atttttctctccactccattaa

SEQ ID NO: 9275219 - DNA, 22 bp, Homo sapiens
atttttctctcacacttaccag

SEQ ID NO: 9275220 - DNA, 22 bp, Homo sapiens
atttttctctcacacttaccag

SEQ ID NO: 9275221 - DNA, 22 bp, Homo sapiens
atttttccatgatacttatctg

SEQ ID NO: 9275222 - DNA, 22 bp, Homo sapiens
atttttccaattaggataaaga

SEQ ID NO: 9275223 - DNA, 22 bp, Homo sapiens
atttttccaattaggataaaga

SEQ ID NO: 9275224 - DNA, 22 bp, Homo sapiens
atttttatgacaaaccatcctc

SEQ ID NO: 9275225 - DNA, 22 bp, Homo sapiens
atttttatgacaaaccatcctc

SEQ ID NO: 9275226 - DNA, 22 bp, Homo sapiens
atttttatgacaaaccatcctc

SEQ ID NO: 9275227 - DNA, 22 bp, Homo sapiens
atttttatgacaaaccatcctc

SEQ ID NO: 9275228 - DNA, 22 bp, Homo sapiens
attttgtttcctttggagtaga

SEQ ID NO: 9275229 - DNA, 20 bp, Homo sapiens
attttgtttatgttcctctc

SEQ ID NO: 9275230 - DNA, 22 bp, Homo sapiens
attttagagctccaagtacagc

SEQ ID NO: 9275231 - DNA, 22 bp, Homo sapiens
attttagagaaacaaacgtagg

SEQ ID NO: 9275232 - DNA, 22 bp, Homo sapiens
attttgctttatgtaaatatgt

SEQ ID NO: 9275233 - DNA, 22 bp, Homo sapiens
attttagagaaacaaacgtagg

SEQ ID NO: 9275234 - DNA, 22 bp, Homo sapiens
attttagagaaacaaacgtagg

SEQ ID NO: 9275235 - DNA, 22 bp, Homo sapiens
attttactttgtgaatattgac

SEQ ID NO: 9275236 - DNA, 22 bp, Homo sapiens
attttactttgtgaatattgac

SEQ ID NO: 9275237 - DNA, 22 bp, Homo sapiens
attttacttcatttgaaatgcc

SEQ ID NO: 9275238 - DNA, 22 bp, Homo sapiens
caaacatagtgaagcaatgaca

SEQ ID NO: 9275239 - DNA, 22 bp, Homo sapiens
caaaattctgcatttctaataa

SEQ ID NO: 9275240 - DNA, 22 bp, Homo sapiens
caaaattagggagtgagctgga

SEQ ID NO: 9275241 - DNA, 22 bp, Homo sapiens
caaaattagaaatgcagctgtt

SEQ ID NO: 9275242 - DNA, 22 bp, Homo sapiens
caaaattagggagtgagctgga

SEQ ID NO: 9275243 - DNA, 22 bp, Homo sapiens
caaaattagggagtgagctgga

SEQ ID NO: 9275244 - DNA, 22 bp, Homo sapiens
caaaattctgcatttctaataa

SEQ ID NO: 9275245 - DNA, 22 bp, Homo sapiens
caaaatagatgttaacctggaa

SEQ ID NO: 9275246 - DNA, 22 bp, Homo sapiens
caaaatagatgttaacctggaa

SEQ ID NO: 9275247 - DNA, 22 bp, Homo sapiens
caaaatgatgtgattttattgt

SEQ ID NO: 9275248 - DNA, 22 bp, Homo sapiens
caaaattagaaatgcagctgtt

SEQ ID NO: 9275249 - DNA, 22 bp, Homo sapiens
caaagcaggcttgtcaaattgc

SEQ ID NO: 9275250 - DNA, 22 bp, Homo sapiens
caaagcagtattggattcttta

SEQ ID NO: 9275251 - DNA, 22 bp, Homo sapiens
caaagccatagagtagataaga

SEQ ID NO: 9275252 - DNA, 22 bp, Homo sapiens
caaagccaggctttctaatgta

SEQ ID NO: 9275253 - DNA, 22 bp, Homo sapiens
caaagcagttttaatcaagtag

SEQ ID NO: 9275254 - DNA, 21 bp, Homo sapiens
caaagccaggcaactctctcc

SEQ ID NO: 9275255 - DNA, 22 bp, Homo sapiens
caaagagtccagcaccctctcc

SEQ ID NO: 9275256 - DNA, 22 bp, Homo sapiens
caaacattcaagtacaagtctt

SEQ ID NO: 9275257 - DNA, 22 bp, Homo sapiens
caaacattcaagtacaagtctt

SEQ ID NO: 9275258 - DNA, 22 bp, Homo sapiens
gcagggctgcagagggcactgt

SEQ ID NO: 9275259 - DNA, 22 bp, Homo sapiens
gcagggctgcagagggcactgt

SEQ ID NO: 9275260 - DNA, 22 bp, Homo sapiens
gcagggctgcagagggcactgt

SEQ ID NO: 9275261 - DNA, 22 bp, Homo sapiens
gcagggctgcagagggcactgt

SEQ ID NO: 9275262 - DNA, 22 bp, Homo sapiens
gcagggctgggacttactggta

SEQ ID NO: 9275263 - DNA, 22 bp, Homo sapiens
gcagggctgggacttactggta

SEQ ID NO: 9275264 - DNA, 22 bp, Homo sapiens
gcagggctgctgaaacttgttt

SEQ ID NO: 9275265 - DNA, 22 bp, Homo sapiens
gcagggctgatgttattgacga

SEQ ID NO: 9275266 - DNA, 22 bp, Homo sapiens
gcagggctgatggcttccctca

SEQ ID NO: 9275267 - DNA, 22 bp, Homo sapiens
attgcaaagaaatacatgctta

SEQ ID NO: 9275268 - DNA, 22 bp, Homo sapiens
gcagggctgactcagccaccct

SEQ ID NO: 9275269 - DNA, 22 bp, Homo sapiens
attgatttctgcttactcactg

SEQ ID NO: 9275270 - DNA, 22 bp, Homo sapiens
gcaggcctgactgtagggggca

SEQ ID NO: 9275271 - DNA, 23 bp, Homo sapiens
attgaccagctgtctcattttca

SEQ ID NO: 9275272 - DNA, 22 bp, Homo sapiens
attgataaattgcaatggggct

SEQ ID NO: 9275273 - DNA, 22 bp, Homo sapiens
attgataaattgcaatggggct

SEQ ID NO: 9275274 - DNA, 22 bp, Homo sapiens
attgatatattatttctaactg

SEQ ID NO: 9275275 - DNA, 22 bp, Homo sapiens
gcagcgaggtgatgaaatagct

SEQ ID NO: 9275276 - DNA, 22 bp, Homo sapiens
gcagcgaggtgatgaaatagct

SEQ ID NO: 9275277 - DNA, 22 bp, Homo sapiens
gcagctgctggaagttcctgcc

SEQ ID NO: 9275278 - DNA, 22 bp, Homo sapiens
gcagctgctggaagttcctgcc

SEQ ID NO: 9275279 - DNA, 22 bp, Homo sapiens
attccttggaacagatgcgaag

SEQ ID NO: 9275280 - DNA, 22 bp, Homo sapiens
attccttgctctcatcaacctt

SEQ ID NO: 9275281 - DNA, 22 bp, Homo sapiens
attccttgctctcatcaacctt

SEQ ID NO: 9275282 - DNA, 22 bp, Homo sapiens
attccttgcacatcagatagtt

SEQ ID NO: 9275283 - DNA, 22 bp, Homo sapiens
attccttgcacatcagatagtt

SEQ ID NO: 9275284 - DNA, 22 bp, Homo sapiens
attccttctttgagaataagca

SEQ ID NO: 9275285 - DNA, 22 bp, Homo sapiens
gcagctggacccacacggctta

SEQ ID NO: 9275286 - DNA, 22 bp, Homo sapiens
gcagctgctgggatcatttagg

SEQ ID NO: 9275287 - DNA, 22 bp, Homo sapiens
attcttcttgagtcttggactc

SEQ ID NO: 9275288 - DNA, 22 bp, Homo sapiens
attcttcttgagtcttggactc

SEQ ID NO: 9275289 - DNA, 22 bp, Homo sapiens
attcttgcagtatacaactact

SEQ ID NO: 9275290 - DNA, 22 bp, Homo sapiens
attcttgggatgggtgtcacaa

SEQ ID NO: 9275291 - DNA, 21 bp, Homo sapiens
attcttggcttagctctctgg

SEQ ID NO: 9275292 - DNA, 22 bp, Homo sapiens
attcttggcccgtcctcacgca

SEQ ID NO: 9275293 - DNA, 22 bp, Homo sapiens
attcttggcaaggagatttaaa

SEQ ID NO: 9275294 - DNA, 22 bp, Homo sapiens
attccttgtatatctacatgca

SEQ ID NO: 9275295 - DNA, 22 bp, Homo sapiens
attccttgggctgccttattat

SEQ ID NO: 9275296 - DNA, 22 bp, Homo sapiens
attccttgtatatctacatgca

SEQ ID NO: 9275297 - DNA, 22 bp, Homo sapiens
attccttggcattctggacttg

SEQ ID NO: 9275298 - DNA, 22 bp, Homo sapiens
attccttggaacagatgcgaag

SEQ ID NO: 9275299 - DNA, 22 bp, Homo sapiens
attccttggcattctggacttg

SEQ ID NO: 9275300 - DNA, 22 bp, Homo sapiens
attccttgggaattattgaatg

SEQ ID NO: 9275301 - DNA, 22 bp, Homo sapiens
attccttgggctgccttattat

SEQ ID NO: 9275302 - DNA, 22 bp, Homo sapiens
attccttgggaattattgaatg

SEQ ID NO: 9275303 - DNA, 22 bp, Homo sapiens
attcttgtttaatttgcatccc

SEQ ID NO: 9275304 - DNA, 19 bp, Homo sapiens
attcttgttaagtgtcatc

SEQ ID NO: 9275305 - DNA, 22 bp, Homo sapiens
attcttgtaaattttgtgtgaa

SEQ ID NO: 9275306 - DNA, 22 bp, Homo sapiens
attctttaattcaattgaagga

SEQ ID NO: 9275307 - DNA, 22 bp, Homo sapiens
attctttaattcaattgaagga

SEQ ID NO: 9275308 - DNA, 22 bp, Homo sapiens
attctttaattcaattgaagga

SEQ ID NO: 9275309 - DNA, 22 bp, Homo sapiens
gcagtgttacttggagtactaa

SEQ ID NO: 9275310 - DNA, 22 bp, Homo sapiens
gcagtgttaccttgggctggtt

SEQ ID NO: 9275311 - DNA, 22 bp, Homo sapiens
gcagtgttaaacaactgctgct

SEQ ID NO: 9275312 - DNA, 22 bp, Homo sapiens
gcagtgttacctcttcagtggg

SEQ ID NO: 9275313 - DNA, 22 bp, Homo sapiens
gcagtgttaatgcgagtgttca

SEQ ID NO: 9275314 - DNA, 22 bp, Homo sapiens
gcagtgtgtgtccccacactgg

SEQ ID NO: 9275315 - DNA, 22 bp, Homo sapiens
gcagtgtgtgtccccacactgg

SEQ ID NO: 9275316 - DNA, 22 bp, Homo sapiens
gcagtgttacttggtttgcaga

SEQ ID NO: 9275317 - DNA, 22 bp, Homo sapiens
gcatacaaaggtttacaactga

SEQ ID NO: 9275318 - DNA, 22 bp, Homo sapiens
gcatacagagaggatgtggcat

SEQ ID NO: 9275319 - DNA, 22 bp, Homo sapiens
gcatacattgcaccctggtagt

SEQ ID NO: 9275320 - DNA, 20 bp, Homo sapiens
gcagtgtgtatgaatagctg

SEQ ID NO: 9275321 - DNA, 20 bp, Homo sapiens
gcagtgtgtatgaatagctg

SEQ ID NO: 9275322 - DNA, 22 bp, Homo sapiens
gcagtgtggccccagtatcacg

SEQ ID NO: 9275323 - DNA, 22 bp, Homo sapiens
gcagtgtgtggtgagggctgcc

SEQ ID NO: 9275324 - DNA, 22 bp, Homo sapiens
gcagtgtgtggtgagggctgcc

SEQ ID NO: 9275325 - DNA, 22 bp, Homo sapiens
gcagtgtgtctcttggcttcct

SEQ ID NO: 9275326 - DNA, 22 bp, Homo sapiens
gcagtgtgaccgagcttgcttc

SEQ ID NO: 9275327 - DNA, 22 bp, Homo sapiens
gcagtgtgaccgagcttgcttc

SEQ ID NO: 9275328 - DNA, 22 bp, Homo sapiens
gcagtgtgaccgagcttgcttc

SEQ ID NO: 9275329 - DNA, 22 bp, Homo sapiens
gcagtgcttgaagaggtggcca

SEQ ID NO: 9275330 - DNA, 23 bp, Homo sapiens
gcagtgcttggcacagctgggtc

SEQ ID NO: 9275331 - DNA, 20 bp, Homo sapiens
gcagtgctggtgcctctgct

SEQ ID NO: 9275332 - DNA, 22 bp, Homo sapiens
gcagggctgggatttgagccca

SEQ ID NO: 9275333 - DNA, 22 bp, Homo sapiens
attgtcatcgatgttagccagt

SEQ ID NO: 9275334 - DNA, 22 bp, Homo sapiens
attgtcatcgatgttagccagt

SEQ ID NO: 9275335 - DNA, 22 bp, Homo sapiens
attgtcagctcgaaatgcatca

SEQ ID NO: 9275336 - DNA, 18 bp, Homo sapiens
attgtcagaagtcatgtg

SEQ ID NO: 9275337 - DNA, 22 bp, Homo sapiens
attgtcacttaaaagtgcatgt

SEQ ID NO: 9275338 - DNA, 22 bp, Homo sapiens
attgtcattggcttctatgtct

SEQ ID NO: 9275339 - DNA, 22 bp, Homo sapiens
attgtcattccagtcattgtta

SEQ ID NO: 9275340 - DNA, 22 bp, Homo sapiens
attgtcattccagtcattgtta

SEQ ID NO: 9275341 - DNA, 22 bp, Homo sapiens
attgtcgtcaatggacacatag

SEQ ID NO: 9275342 - DNA, 22 bp, Homo sapiens
attgtacttttattacatgtag

SEQ ID NO: 9275343 - DNA, 22 bp, Homo sapiens
attgtacttttattacatgtag

SEQ ID NO: 9275344 - DNA, 22 bp, Homo sapiens
gcatattttcacaagctcttgg

SEQ ID NO: 9275345 - DNA, 17 bp, Homo sapiens
gcatcacagataacacg

SEQ ID NO: 9275346 - DNA, 22 bp, Homo sapiens
gcatatcagcatcaaaacacag

SEQ ID NO: 9275347 - DNA, 22 bp, Homo sapiens
gcatatcatgacttctatctta

SEQ ID NO: 9275348 - DNA, 22 bp, Homo sapiens
gcatattttcacaagctcttgg

SEQ ID NO: 9275349 - DNA, 22 bp, Homo sapiens
gccacagggcagatgcgcagag

SEQ ID NO: 9275350 - DNA, 22 bp, Homo sapiens
gccacagggcagatgcgcagag

SEQ ID NO: 9275351 - DNA, 22 bp, Homo sapiens
gccaagaaggtggggacatgca

SEQ ID NO: 9275352 - DNA, 22 bp, Homo sapiens
gccaactggctgatctcaaagc

SEQ ID NO: 9275353 - DNA, 22 bp, Homo sapiens
gccaacaggccttgctctgctc

SEQ ID NO: 9275354 - DNA, 22 bp, Homo sapiens
gccaaaggattctatggagata

SEQ ID NO: 9275355 - DNA, 22 bp, Homo sapiens
gccaaaggattctatggagata

SEQ ID NO: 9275356 - DNA, 22 bp, Homo sapiens
gccaaagctggaggtggaggtg

SEQ ID NO: 9275357 - DNA, 17 bp, Homo sapiens
gccaaagggttccaatc

SEQ ID NO: 9275358 - DNA, 22 bp, Homo sapiens
gccaaagtgctgctctttacca

SEQ ID NO: 9275359 - DNA, 22 bp, Homo sapiens
attgtcttctggtcttatcttt

SEQ ID NO: 9275360 - DNA, 22 bp, Homo sapiens
attgtctctttcaataacttgt

SEQ ID NO: 9275361 - DNA, 22 bp, Homo sapiens
attgtctttggtgcttccagga

SEQ ID NO: 9275362 - DNA, 20 bp, Homo sapiens
attgtgaatactgcatatgt

SEQ ID NO: 9275363 - DNA, 22 bp, Homo sapiens
gccaaagcagtcttgcctctgc

SEQ ID NO: 9275364 - DNA, 22 bp, Homo sapiens
gcattcctttataggaaaatgg

SEQ ID NO: 9275365 - DNA, 22 bp, Homo sapiens
gcattccttgttagcatttgat

SEQ ID NO: 9275366 - DNA, 22 bp, Homo sapiens
attgtgcaccaccttgtggcag

SEQ ID NO: 9275367 - DNA, 22 bp, Homo sapiens
attgtgcaatgttttacaattt

SEQ ID NO: 9275368 - DNA, 22 bp, Homo sapiens
attgtgcaatgttttacaattt

SEQ ID NO: 9275369 - DNA, 22 bp, Homo sapiens
attgtgcaaatattatctgtag

SEQ ID NO: 9275370 - DNA, 22 bp, Homo sapiens
attgtgcaaaacctcaggcctc

SEQ ID NO: 9275371 - DNA, 22 bp, Homo sapiens
attgtgaattgagagtacttct

SEQ ID NO: 9275372 - DNA, 22 bp, Homo sapiens
attgtgaatagtgccgcagtaa

SEQ ID NO: 9275373 - DNA, 22 bp, Homo sapiens
attagctttggtggaaaggagt

SEQ ID NO: 9275374 - DNA, 22 bp, Homo sapiens
attagctttggattcagaagat

SEQ ID NO: 9275375 - DNA, 22 bp, Homo sapiens
attagctttggattcagaagat

SEQ ID NO: 9275376 - DNA, 22 bp, Homo sapiens
attagctttaaaccacagcagt

SEQ ID NO: 9275377 - DNA, 22 bp, Homo sapiens
attagctttaaagactttgatt

SEQ ID NO: 9275378 - DNA, 22 bp, Homo sapiens
attagctttaaagactttgatt

SEQ ID NO: 9275379 - DNA, 22 bp, Homo sapiens
attagctttatttgaaatagga

SEQ ID NO: 9275380 - DNA, 22 bp, Homo sapiens
attagctttatttgaaatagga

SEQ ID NO: 9275381 - DNA, 20 bp, Homo sapiens
attaggattttaggtcatca

SEQ ID NO: 9275382 - DNA, 22 bp, Homo sapiens
attaggatttggtatggtcata

SEQ ID NO: 9275383 - DNA, 22 bp, Homo sapiens
attaggatgttcctatgcacat

SEQ ID NO: 9275384 - DNA, 22 bp, Homo sapiens
attaggatgtgtatattgtgtt

SEQ ID NO: 9275385 - DNA, 22 bp, Homo sapiens
attagcttatcacacaagctgc

SEQ ID NO: 9275386 - DNA, 22 bp, Homo sapiens
attagcttatcacacaagctgc

SEQ ID NO: 9275387 - DNA, 22 bp, Homo sapiens
attagcttaggcatgaagagaa

SEQ ID NO: 9275388 - DNA, 22 bp, Homo sapiens
attagcttaggcatgaagagaa

SEQ ID NO: 9275389 - DNA, 22 bp, Homo sapiens
attagcttagtgtttccgtaat

SEQ ID NO: 9275390 - DNA, 22 bp, Homo sapiens
attagcttctgaagcccttgaa

SEQ ID NO: 9275391 - DNA, 22 bp, Homo sapiens
attagcttcctatagtaagggg

SEQ ID NO: 9275392 - DNA, 22 bp, Homo sapiens
attagcttggtatgccataaag

SEQ ID NO: 9275393 - DNA, 20 bp, Homo sapiens
attagcttggagacagtggc

SEQ ID NO: 9275394 - DNA, 22 bp, Homo sapiens
attagcttctgtgcatggactt

SEQ ID NO: 9275395 - DNA, 22 bp, Homo sapiens
attagcttattgtaaggtgaaa

SEQ ID NO: 9275396 - DNA, 22 bp, Homo sapiens
attagcttatcccatttctgaa

SEQ ID NO: 9275397 - DNA, 22 bp, Homo sapiens
attagcttatcccatttctgaa

SEQ ID NO: 9275398 - DNA, 22 bp, Homo sapiens
attagcttcaaagccatcaacc

SEQ ID NO: 9275399 - DNA, 21 bp, Homo sapiens
attagcttcaaaagcttgtct

SEQ ID NO: 9275400 - DNA, 21 bp, Homo sapiens
attagcttcaaaagcttgtct

SEQ ID NO: 9275401 - DNA, 22 bp, Homo sapiens
attagcttattgtaaggtgaaa

SEQ ID NO: 9275402 - DNA, 22 bp, Homo sapiens
attaggattttgtccaagtagc

SEQ ID NO: 9275403 - DNA, 22 bp, Homo sapiens
attaggcatatatgcttttaat

SEQ ID NO: 9275404 - DNA, 22 bp, Homo sapiens
attaggcactagaatgtcaatt

SEQ ID NO: 9275405 - DNA, 22 bp, Homo sapiens
attaggcattatggggataagg

SEQ ID NO: 9275406 - DNA, 22 bp, Homo sapiens
attaggcattcatgcagctcct

SEQ ID NO: 9275407 - DNA, 22 bp, Homo sapiens
attagtattcagtttataacac

SEQ ID NO: 9275408 - DNA, 22 bp, Homo sapiens
attagtaaaacattgtatatgt

SEQ ID NO: 9275409 - DNA, 22 bp, Homo sapiens
attagtgtctgtgaataattct

SEQ ID NO: 9275410 - DNA, 22 bp, Homo sapiens
attagtgttcttatcttctagg

SEQ ID NO: 9275411 - DNA, 22 bp, Homo sapiens
attagtgtacatctcacacgca

SEQ ID NO: 9275412 - DNA, 22 bp, Homo sapiens
attagtgcccaggctgcctctt

SEQ ID NO: 9275413 - DNA, 20 bp, Homo sapiens
attagtgcatctggacatgc

SEQ ID NO: 9275414 - DNA, 22 bp, Homo sapiens
attatttccttgctttgaggaa

SEQ ID NO: 9275415 - DNA, 22 bp, Homo sapiens
attcaaattaagttaattcagc

SEQ ID NO: 9275416 - DNA, 22 bp, Homo sapiens
attcaaattaagttaattcagc

SEQ ID NO: 9275417 - DNA, 22 bp, Homo sapiens
attcaaattaagttaattcagc

SEQ ID NO: 9275418 - DNA, 22 bp, Homo sapiens
attcaaatgtcaaatccaccag

SEQ ID NO: 9275419 - DNA, 22 bp, Homo sapiens
gatttccttgcatattggtaat

SEQ ID NO: 9275420 - DNA, 22 bp, Homo sapiens
gatttcctagacatggggcaga

SEQ ID NO: 9275421 - DNA, 17 bp, Homo sapiens
gatttcctgaagttctt

SEQ ID NO: 9275422 - DNA, 22 bp, Homo sapiens
gatttcctcactaacatccatc

SEQ ID NO: 9275423 - DNA, 22 bp, Homo sapiens
gatttcctaatgtggatctctg

SEQ ID NO: 9275424 - DNA, 22 bp, Homo sapiens
gatttctcaatcctagtactat

SEQ ID NO: 9275425 - DNA, 22 bp, Homo sapiens
gatttctaaggaggctgaactt

SEQ ID NO: 9275426 - DNA, 22 bp, Homo sapiens
gatttctacttgaacttgctaa

SEQ ID NO: 9275427 - DNA, 23 bp, Homo sapiens
attacatgagcaaatatagctat

SEQ ID NO: 9275428 - DNA, 22 bp, Homo sapiens
attacatatgttggcaacattt

SEQ ID NO: 9275429 - DNA, 22 bp, Homo sapiens
attacatcagttgacatgtgag

SEQ ID NO: 9275430 - DNA, 22 bp, Homo sapiens
gatatgtttaatgcctcagtat

SEQ ID NO: 9275431 - DNA, 18 bp, Homo sapiens
gatatggaaggccatgcc

SEQ ID NO: 9275432 - DNA, 22 bp, Homo sapiens
gatatgtattgaatgatcattt

SEQ ID NO: 9275433 - DNA, 22 bp, Homo sapiens
gatattctatgtagaatgagct

SEQ ID NO: 9275434 - DNA, 22 bp, Homo sapiens
gatattctggtgaaacctttgg

SEQ ID NO: 9275435 - DNA, 22 bp, Homo sapiens
attacaatcgagagaaacaaat

SEQ ID NO: 9275436 - DNA, 22 bp, Homo sapiens
attacaatcgagagaaacaaat

SEQ ID NO: 9275437 - DNA, 22 bp, Homo sapiens
gcactagtctaggtgctaagat

SEQ ID NO: 9275438 - DNA, 22 bp, Homo sapiens
gcactagtcaagtgaacaattt

SEQ ID NO: 9275439 - DNA, 22 bp, Homo sapiens
gcactaaaccaacatgtaataa

SEQ ID NO: 9275440 - DNA, 22 bp, Homo sapiens
gcacggctaatttttgtatttt

SEQ ID NO: 9275441 - DNA, 22 bp, Homo sapiens
gcacggctaatttttgtatttt

SEQ ID NO: 9275442 - DNA, 22 bp, Homo sapiens
gcactagttctactgccagcaa

SEQ ID NO: 9275443 - DNA, 22 bp, Homo sapiens
gcactagtgttcttcagtaata

SEQ ID NO: 9275444 - DNA, 22 bp, Homo sapiens
attcacaatagcagcttgcatg

SEQ ID NO: 9275445 - DNA, 22 bp, Homo sapiens
gcacctggggtacacagctaca

SEQ ID NO: 9275446 - DNA, 22 bp, Homo sapiens
gcacggctaatttttgtatttt

SEQ ID NO: 9275447 - DNA, 22 bp, Homo sapiens
gcacctggtttatataatcata

SEQ ID NO: 9275448 - DNA, 22 bp, Homo sapiens
gcaccttggctttcttggtggc

SEQ ID NO: 9275449 - DNA, 22 bp, Homo sapiens
attcacatgcccaagcagcacc

SEQ ID NO: 9275450 - DNA, 22 bp, Homo sapiens
attcacctgttagtaaaaatct

SEQ ID NO: 9275451 - DNA, 22 bp, Homo sapiens
attcagaagcaatcacagtgag

SEQ ID NO: 9275452 - DNA, 22 bp, Homo sapiens
attcagaaatagaaaatttgat

SEQ ID NO: 9275453 - DNA, 20 bp, Homo sapiens
gcagcagacagacaggggac

SEQ ID NO: 9275454 - DNA, 21 bp, Homo sapiens
gcagcagaggcttgacagaca

SEQ ID NO: 9275455 - DNA, 22 bp, Homo sapiens
gcagcagaggccctactctttg

SEQ ID NO: 9275456 - DNA, 22 bp, Homo sapiens
attcagaatggcaaacttctag

SEQ ID NO: 9275457 - DNA, 22 bp, Homo sapiens
attcagaagcaatcacagtgag

SEQ ID NO: 9275458 - DNA, 22 bp, Homo sapiens
gcagcagagtttgggagatggt

SEQ ID NO: 9275459 - DNA, 22 bp, Homo sapiens
gcagcagagtttgggagatggt

SEQ ID NO: 9275460 - DNA, 22 bp, Homo sapiens
attcagttccttgtgattgtag

SEQ ID NO: 9275461 - DNA, 22 bp, Homo sapiens
attcagtttcaatcattgtagt

SEQ ID NO: 9275462 - DNA, 22 bp, Homo sapiens
attcataacggcaaatgtcacc

SEQ ID NO: 9275463 - DNA, 22 bp, Homo sapiens
attcatagctcagtacagactc

SEQ ID NO: 9275464 - DNA, 22 bp, Homo sapiens
attcatatcatagagttattga

SEQ ID NO: 9275465 - DNA, 22 bp, Homo sapiens
attcatcaactgatagccatag

SEQ ID NO: 9275466 - DNA, 22 bp, Homo sapiens
attcatctgtacttcaatatct

SEQ ID NO: 9275467 - DNA, 22 bp, Homo sapiens
attcatctatgactctaatgtg

SEQ ID NO: 9275468 - DNA, 22 bp, Homo sapiens
atgtctaaaagataaagtttaa

SEQ ID NO: 9275469 - DNA, 22 bp, Homo sapiens
atgtctatatagtcaataatca

SEQ ID NO: 9275470 - DNA, 19 bp, Homo sapiens
atgtctctgtagcacatac

SEQ ID NO: 9275471 - DNA, 22 bp, Homo sapiens
atgtctctctctgagtgccaga

SEQ ID NO: 9275472 - DNA, 22 bp, Homo sapiens
atgtctcagagtggtcactggg

SEQ ID NO: 9275473 - DNA, 22 bp, Homo sapiens
atgtctctcaggtttaacttta

SEQ ID NO: 9275474 - DNA, 22 bp, Homo sapiens
atgtccttccattttgatctgt

SEQ ID NO: 9275475 - DNA, 22 bp, Homo sapiens
atgtagaaagttattttactct

SEQ ID NO: 9275476 - DNA, 22 bp, Homo sapiens
atgtagaacaggttaatgacag

SEQ ID NO: 9275477 - DNA, 22 bp, Homo sapiens
atgtagaattccttctactttg

SEQ ID NO: 9275478 - DNA, 22 bp, Homo sapiens
atgtagagtagaatagtacaac

SEQ ID NO: 9275479 - DNA, 22 bp, Homo sapiens
atgtagagctccttgatcctcc

SEQ ID NO: 9275480 - DNA, 22 bp, Homo sapiens
atgtagatttgcttctcctgcc

SEQ ID NO: 9275481 - DNA, 20 bp, Homo sapiens
atgtagatgaaagcaaaggc

SEQ ID NO: 9275482 - DNA, 20 bp, Homo sapiens
atgtagatgaaagcaaaggc

SEQ ID NO: 9275483 - DNA, 22 bp, Homo sapiens
atgtagctgcagatgataatgc

SEQ ID NO: 9275484 - DNA, 22 bp, Homo sapiens
atgtcatgaaatgctactaact

SEQ ID NO: 9275485 - DNA, 22 bp, Homo sapiens
atgtagcatctatcctgataaa

SEQ ID NO: 9275486 - DNA, 22 bp, Homo sapiens
atgtcattgccaagatgctaat

SEQ ID NO: 9275487 - DNA, 22 bp, Homo sapiens
atgtcccagctgagagacaact

SEQ ID NO: 9275488 - DNA, 20 bp, Homo sapiens
atgtcctcagccactgccct

SEQ ID NO: 9275489 - DNA, 22 bp, Homo sapiens
atgtcccttgtctgtgatgtct

SEQ ID NO: 9275490 - DNA, 19 bp, Homo sapiens
gagggctcatttgaacaat

SEQ ID NO: 9275491 - DNA, 22 bp, Homo sapiens
gagggctctaccaagtaactct

SEQ ID NO: 9275492 - DNA, 22 bp, Homo sapiens
gagggctccattccccgtgccc

SEQ ID NO: 9275493 - DNA, 22 bp, Homo sapiens
gagggctccattccccgtgccc

SEQ ID NO: 9275494 - DNA, 22 bp, Homo sapiens
gagggctcctcacattctctat

SEQ ID NO: 9275495 - DNA, 22 bp, Homo sapiens
gagggctcctcacattctctat

SEQ ID NO: 9275496 - DNA, 22 bp, Homo sapiens
gagggctgaagattgtggcccc

SEQ ID NO: 9275497 - DNA, 20 bp, Homo sapiens
atgtctgaagtaatccattt

SEQ ID NO: 9275498 - DNA, 22 bp, Homo sapiens
atgtctgagtctgctccagttg

SEQ ID NO: 9275499 - DNA, 19 bp, Homo sapiens
atgtctctgtagcacatac

SEQ ID NO: 9275500 - DNA, 22 bp, Homo sapiens
gagggcgcttcagagagatgaa

SEQ ID NO: 9275501 - DNA, 22 bp, Homo sapiens
gagggcgcttcagagagatgaa

SEQ ID NO: 9275502 - DNA, 22 bp, Homo sapiens
gagggctcactgagaaagcagt

SEQ ID NO: 9275503 - DNA, 22 bp, Homo sapiens
gagggcagagacagtgattcac

SEQ ID NO: 9275504 - DNA, 22 bp, Homo sapiens
gagggcctggcacagggaggct

SEQ ID NO: 9275505 - DNA, 22 bp, Homo sapiens
gagggcctggcacagggaggct

SEQ ID NO: 9275506 - DNA, 22 bp, Homo sapiens
gaggtagggcagaggctgaatg

SEQ ID NO: 9275507 - DNA, 22 bp, Homo sapiens
atgtgagggctcaggctgactg

SEQ ID NO: 9275508 - DNA, 22 bp, Homo sapiens
atgtgagggaaatcagtcagaa

SEQ ID NO: 9275509 - DNA, 22 bp, Homo sapiens
gaggtggatgttgcagtgagct

SEQ ID NO: 9275510 - DNA, 20 bp, Homo sapiens
gaggtagggcttaaggcaag

SEQ ID NO: 9275511 - DNA, 22 bp, Homo sapiens
gaggtggatgttgcagtgagct

SEQ ID NO: 9275512 - DNA, 22 bp, Homo sapiens
atgtgagctccggcaggtggaa

SEQ ID NO: 9275513 - DNA, 20 bp, Homo sapiens
atgtgaagtaggaagggtgt

SEQ ID NO: 9275514 - DNA, 21 bp, Homo sapiens
atgtgaaatatcatcagagca

SEQ ID NO: 9275515 - DNA, 21 bp, Homo sapiens
atgtgaaatatcatcagagca

SEQ ID NO: 9275516 - DNA, 22 bp, Homo sapiens
atgtgaaatattaagccgagga

SEQ ID NO: 9275517 - DNA, 20 bp, Homo sapiens
atgtgaaagatcagttgtct

SEQ ID NO: 9275518 - DNA, 22 bp, Homo sapiens
atgtgaaatagctggatatgaa

SEQ ID NO: 9275519 - DNA, 22 bp, Homo sapiens
atgtgaaacgcaatgggatcat

SEQ ID NO: 9275520 - DNA, 22 bp, Homo sapiens
gaggtggcgcgccatccctgcc

SEQ ID NO: 9275521 - DNA, 22 bp, Homo sapiens
gaggtggcgcgccatccctgcc

SEQ ID NO: 9275522 - DNA, 22 bp, Homo sapiens
gaggtggcactgtgaggagcac

SEQ ID NO: 9275523 - DNA, 22 bp, Homo sapiens
gaggtggcactgtgaggagcac

SEQ ID NO: 9275524 - DNA, 20 bp, Homo sapiens
atgtgtcttagagcatcagg

SEQ ID NO: 9275525 - DNA, 22 bp, Homo sapiens
atgttcttctatctttattaaa

SEQ ID NO: 9275526 - DNA, 20 bp, Homo sapiens
atgttcttcatttaatgttc

SEQ ID NO: 9275527 - DNA, 22 bp, Homo sapiens
atgttgcacaaagtccatccat

SEQ ID NO: 9275528 - DNA, 22 bp, Homo sapiens
atgttctttcagccagtgcatc

SEQ ID NO: 9275529 - DNA, 22 bp, Homo sapiens
atgttcttgttcaaatgtcagt

SEQ ID NO: 9275530 - DNA, 20 bp, Homo sapiens
atgttgtttactcatagcat

SEQ ID NO: 9275531 - DNA, 22 bp, Homo sapiens
atgtttaaagggttgagaaata

SEQ ID NO: 9275532 - DNA, 22 bp, Homo sapiens
atgtttaaatttatagacagtg

SEQ ID NO: 9275533 - DNA, 22 bp, Homo sapiens
gatatcatatcagacaacctct

SEQ ID NO: 9275534 - DNA, 22 bp, Homo sapiens
gatatcatgggaaggtgtactt

SEQ ID NO: 9275535 - DNA, 22 bp, Homo sapiens
gatatgaagtggcattgtgaag

SEQ ID NO: 9275536 - DNA, 22 bp, Homo sapiens
gatatgcacattcaaaaattgc

SEQ ID NO: 9275537 - DNA, 22 bp, Homo sapiens
gatatgtaccacctcttaaaag

SEQ ID NO: 9275538 - DNA, 22 bp, Homo sapiens
gatatgtatgaggagtatgtat

SEQ ID NO: 9275539 - DNA, 22 bp, Homo sapiens
gataatttgatacctcaatcag

SEQ ID NO: 9275540 - DNA, 22 bp, Homo sapiens
gataattttggttccaggttgg

SEQ ID NO: 9275541 - DNA, 22 bp, Homo sapiens
gataattttggttccaggttgg

SEQ ID NO: 9275542 - DNA, 22 bp, Homo sapiens
gataattttagtctgaaaattg

SEQ ID NO: 9275543 - DNA, 22 bp, Homo sapiens
gataattttagtctgaaaattg

SEQ ID NO: 9275544 - DNA, 22 bp, Homo sapiens
gataatgtggatttattgtgat

SEQ ID NO: 9275545 - DNA, 22 bp, Homo sapiens
gataatgtgccgataatttcta

SEQ ID NO: 9275546 - DNA, 22 bp, Homo sapiens
gataatttaagtcttgggggct

SEQ ID NO: 9275547 - DNA, 22 bp, Homo sapiens
gataattataggctaagccact

SEQ ID NO: 9275548 - DNA, 22 bp, Homo sapiens
gataattataggctaagccact

SEQ ID NO: 9275549 - DNA, 22 bp, Homo sapiens
gataatttctccatctcaaggt

SEQ ID NO: 9275550 - DNA, 22 bp, Homo sapiens
atgggagaaacatcatgaggca

SEQ ID NO: 9275551 - DNA, 22 bp, Homo sapiens
atgggaatataattttagcaac

SEQ ID NO: 9275552 - DNA, 22 bp, Homo sapiens
atgggctgaaagagtaagctgt

SEQ ID NO: 9275553 - DNA, 22 bp, Homo sapiens
atgggctctatgtctaggagat

SEQ ID NO: 9275554 - DNA, 22 bp, Homo sapiens
atgggctgacaagacatgcata

SEQ ID NO: 9275555 - DNA, 22 bp, Homo sapiens
atgggctgacaagacatgcata

SEQ ID NO: 9275556 - DNA, 22 bp, Homo sapiens
atgggctgaggaagctcctgag

SEQ ID NO: 9275557 - DNA, 22 bp, Homo sapiens
atgggctgaggtgggatagaag

SEQ ID NO: 9275558 - DNA, 22 bp, Homo sapiens
atgggctgaggtgggatagaag

SEQ ID NO: 9275559 - DNA, 22 bp, Homo sapiens
atgggctgaggtgggatagaag

SEQ ID NO: 9275560 - DNA, 22 bp, Homo sapiens
atgggctgacccagtcgtggca

SEQ ID NO: 9275561 - DNA, 22 bp, Homo sapiens
atgggctgaggaagctcctgag

SEQ ID NO: 9275562 - DNA, 22 bp, Homo sapiens
atggggaagagccagtgagctg

SEQ ID NO: 9275563 - DNA, 22 bp, Homo sapiens
atggggagagaagggctgagct

SEQ ID NO: 9275564 - DNA, 22 bp, Homo sapiens
atggggaagagccagtgagctg

SEQ ID NO: 9275565 - DNA, 22 bp, Homo sapiens
atggggagagcctctgtcccca

SEQ ID NO: 9275566 - DNA, 22 bp, Homo sapiens
atggggagagcctctgtcccca

SEQ ID NO: 9275567 - DNA, 22 bp, Homo sapiens
atggggagagaagggctgagct

SEQ ID NO: 9275568 - DNA, 23 bp, Homo sapiens
atggggctcaacacttagtagct

SEQ ID NO: 9275569 - DNA, 22 bp, Homo sapiens
atggggagctcaccacctgttt

SEQ ID NO: 9275570 - DNA, 22 bp, Homo sapiens
atgggctgcttggcttccaccc

SEQ ID NO: 9275571 - DNA, 22 bp, Homo sapiens
atgggctggcagcctgaacagc

SEQ ID NO: 9275572 - DNA, 22 bp, Homo sapiens
atgggctgggaatacacagggg

SEQ ID NO: 9275573 - DNA, 22 bp, Homo sapiens
atgggctgcttctccagcacct

SEQ ID NO: 9275574 - DNA, 22 bp, Homo sapiens
atgggctgggaatacacagggg

SEQ ID NO: 9275575 - DNA, 22 bp, Homo sapiens
atgggctgggatctgagtgtca

SEQ ID NO: 9275576 - DNA, 22 bp, Homo sapiens
atgggctgggatctgagtgtca

SEQ ID NO: 9275577 - DNA, 22 bp, Homo sapiens
atgggctgggatctgagtgtca

SEQ ID NO: 9275578 - DNA, 22 bp, Homo sapiens
atgggctggggaagctcactcc

SEQ ID NO: 9275579 - DNA, 20 bp, Homo sapiens
atgggctggttaggaagtgt

SEQ ID NO: 9275580 - DNA, 20 bp, Homo sapiens
atgggctggttaggaagtgt

SEQ ID NO: 9275581 - DNA, 20 bp, Homo sapiens
atgggctggttaggaagtgt

SEQ ID NO: 9275582 - DNA, 22 bp, Homo sapiens
atgggctgtccattgctggctg

SEQ ID NO: 9275583 - DNA, 22 bp, Homo sapiens
atgggctgtcctagtccagccc

SEQ ID NO: 9275584 - DNA, 22 bp, Homo sapiens
gaggcagcattcgcatagacag

SEQ ID NO: 9275585 - DNA, 22 bp, Homo sapiens
gaggcagcatggtaccttggag

SEQ ID NO: 9275586 - DNA, 22 bp, Homo sapiens
gaggcagccagaggttctcatt

SEQ ID NO: 9275587 - DNA, 22 bp, Homo sapiens
gaggcagcctcagtggacctcg

SEQ ID NO: 9275588 - DNA, 22 bp, Homo sapiens
gaggcacatatatacagagccc

SEQ ID NO: 9275589 - DNA, 22 bp, Homo sapiens
gaggcacatatatacagagccc

SEQ ID NO: 9275590 - DNA, 22 bp, Homo sapiens
gaggcacatatatacagagccc

SEQ ID NO: 9275591 - DNA, 22 bp, Homo sapiens
gaggcagcatctatggtgggaa

SEQ ID NO: 9275592 - DNA, 22 bp, Homo sapiens
gaggcagcagggctggttcctt

SEQ ID NO: 9275593 - DNA, 22 bp, Homo sapiens
atggttaaattggttatttatg

SEQ ID NO: 9275594 - DNA, 22 bp, Homo sapiens
atggtggaagagcatcagaaag

SEQ ID NO: 9275595 - DNA, 18 bp, Homo sapiens
atggtctcatactgggag

SEQ ID NO: 9275596 - DNA, 22 bp, Homo sapiens
atggtctgaatgtgtgctccaa

SEQ ID NO: 9275597 - DNA, 22 bp, Homo sapiens
gaggagaatgcgcaccacatat

SEQ ID NO: 9275598 - DNA, 18 bp, Homo sapiens
atggtctcatactgggag

SEQ ID NO: 9275599 - DNA, 22 bp, Homo sapiens
gaggagaagctaagaaacacag

SEQ ID NO: 9275600 - DNA, 22 bp, Homo sapiens
gaggagaagctattggaaggac

SEQ ID NO: 9275601 - DNA, 22 bp, Homo sapiens
gaggagaaatttggggacctga

SEQ ID NO: 9275602 - DNA, 22 bp, Homo sapiens
gaggagaagctaagaaacacag

SEQ ID NO: 9275603 - DNA, 22 bp, Homo sapiens
atggcttgtctatgagtgctct

SEQ ID NO: 9275604 - DNA, 22 bp, Homo sapiens
atggcttggcaccatctccttg

SEQ ID NO: 9275605 - DNA, 22 bp, Homo sapiens
atggcttggcaccatctccttg

SEQ ID NO: 9275606 - DNA, 21 bp, Homo sapiens
atggcttctcaggtgcactga

SEQ ID NO: 9275607 - DNA, 22 bp, Homo sapiens
atggcttctcgctggcacctgt

SEQ ID NO: 9275608 - DNA, 22 bp, Homo sapiens
atggcttatggtaaatatttct

SEQ ID NO: 9275609 - DNA, 22 bp, Homo sapiens
atggcttatgaataacagtagg

SEQ ID NO: 9275610 - DNA, 22 bp, Homo sapiens
atggctggcatccaggtgggct

SEQ ID NO: 9275611 - DNA, 22 bp, Homo sapiens
atggccagagaaggcagggtca

SEQ ID NO: 9275612 - DNA, 21 bp, Homo sapiens
atggccactatggtgcagcag

SEQ ID NO: 9275613 - DNA, 22 bp, Homo sapiens
gagatgggcgagaaggtggact

SEQ ID NO: 9275614 - DNA, 22 bp, Homo sapiens
gagatggggaataggagcaagc

SEQ ID NO: 9275615 - DNA, 22 bp, Homo sapiens
gagatggggaataggagcaagc

SEQ ID NO: 9275616 - DNA, 22 bp, Homo sapiens
gagatggggtcagctgggacat

SEQ ID NO: 9275617 - DNA, 22 bp, Homo sapiens
atggcattcacatttccagaga

SEQ ID NO: 9275618 - DNA, 17 bp, Homo sapiens
gagatgggtggatcacc

SEQ ID NO: 9275619 - DNA, 17 bp, Homo sapiens
gagatgggtggatcacc

SEQ ID NO: 9275620 - DNA, 22 bp, Homo sapiens
gagatggggtcttgctatgttg

SEQ ID NO: 9275621 - DNA, 23 bp, Homo sapiens
gagatggctggttgtcctctgaa

SEQ ID NO: 9275622 - DNA, 22 bp, Homo sapiens
gagatgggcgagaaggtggact

SEQ ID NO: 9275623 - DNA, 22 bp, Homo sapiens
gagatgggcgagaaggtggact

SEQ ID NO: 9275624 - DNA, 22 bp, Homo sapiens
gagatggcttgctctcacgtgg

SEQ ID NO: 9275625 - DNA, 18 bp, Homo sapiens
atggaggcagagagctga

SEQ ID NO: 9275626 - DNA, 22 bp, Homo sapiens
atggagggaaaagtggagagcc

SEQ ID NO: 9275627 - DNA, 17 bp, Homo sapiens
atggaggcagacaggtc

SEQ ID NO: 9275628 - DNA, 22 bp, Homo sapiens
atggagggaaaagtggagagcc

SEQ ID NO: 9275629 - DNA, 21 bp, Homo sapiens
atggagggaccagggaagcag

SEQ ID NO: 9275630 - DNA, 22 bp, Homo sapiens
gagagagctctgtgcctgggat

SEQ ID NO: 9275631 - DNA, 23 bp, Homo sapiens
gagagagattgctaaaccactcc

SEQ ID NO: 9275632 - DNA, 22 bp, Homo sapiens
gagagaggcctccatgtactga

SEQ ID NO: 9275633 - DNA, 22 bp, Homo sapiens
gagagattaccacgcttcctga

SEQ ID NO: 9275634 - DNA, 22 bp, Homo sapiens
gactgggccaaggtcagcagct

SEQ ID NO: 9275635 - DNA, 22 bp, Homo sapiens
gactggggctctagccaggcct

SEQ ID NO: 9275636 - DNA, 22 bp, Homo sapiens
gagacagtggttgcagaagctc

SEQ ID NO: 9275637 - DNA, 22 bp, Homo sapiens
gactggggctctagccaggcct

SEQ ID NO: 9275638 - DNA, 22 bp, Homo sapiens
gacacatagatctatctcactc

SEQ ID NO: 9275639 - DNA, 22 bp, Homo sapiens
gacacagtttttctcacggtgg

SEQ ID NO: 9275640 - DNA, 22 bp, Homo sapiens
gacaccagcaaggctgtgagga

SEQ ID NO: 9275641 - DNA, 18 bp, Homo sapiens
gacaccagcctctgcccc

SEQ ID NO: 9275642 - DNA, 22 bp, Homo sapiens
gaccacagagcacggcctgctt

SEQ ID NO: 9275643 - DNA, 22 bp, Homo sapiens
atgctatgtaactggcagatag

SEQ ID NO: 9275644 - DNA, 22 bp, Homo sapiens
atgctattaatatccagtctga

SEQ ID NO: 9275645 - DNA, 22 bp, Homo sapiens
atgctattccagaatgtaaatt

SEQ ID NO: 9275646 - DNA, 22 bp, Homo sapiens
gacataaagttcttgcttgaat

SEQ ID NO: 9275647 - DNA, 22 bp, Homo sapiens
gacactctcctccagtggatag

SEQ ID NO: 9275648 - DNA, 22 bp, Homo sapiens
gacatttattagaaaactatca

SEQ ID NO: 9275649 - DNA, 22 bp, Homo sapiens
atgctcacttcagagaagatga

SEQ ID NO: 9275650 - DNA, 22 bp, Homo sapiens
atgctcagtagctggctgaccc

SEQ ID NO: 9275651 - DNA, 22 bp, Homo sapiens
atgctatttaccacacatcatt

SEQ ID NO: 9275652 - DNA, 22 bp, Homo sapiens
atgctcattttattgagaatga

SEQ ID NO: 9275653 - DNA, 22 bp, Homo sapiens
gaccctggagttagtcctgtgt

SEQ ID NO: 9275654 - DNA, 22 bp, Homo sapiens
gaccctggagccgtctgaggca

SEQ ID NO: 9275655 - DNA, 22 bp, Homo sapiens
gaccttgtgatccagccacctt

SEQ ID NO: 9275656 - DNA, 22 bp, Homo sapiens
gaccttgtgatccacctgcctt

SEQ ID NO: 9275657 - DNA, 22 bp, Homo sapiens
gaccttgtgatctgcccacctt

SEQ ID NO: 9275658 - DNA, 22 bp, Homo sapiens
gaccttgtgatccgcccgcctt

SEQ ID NO: 9275659 - DNA, 22 bp, Homo sapiens
gaccttgtgatccgcccgcctt

SEQ ID NO: 9275660 - DNA, 22 bp, Homo sapiens
gaccttgtgatccccctgcctt

SEQ ID NO: 9275661 - DNA, 22 bp, Homo sapiens
gactgggacaggacagacatct

SEQ ID NO: 9275662 - DNA, 22 bp, Homo sapiens
gactgggagggttcagctgggt

SEQ ID NO: 9275663 - DNA, 22 bp, Homo sapiens
gactggagtgcctccaggaaag

SEQ ID NO: 9275664 - DNA, 22 bp, Homo sapiens
gactggagcccccaaggacacc

SEQ ID NO: 9275665 - DNA, 21 bp, Homo sapiens
gactggagagaggaagtctgg

SEQ ID NO: 9275666 - DNA, 22 bp, Homo sapiens
gactggaatcccaggctctgtg

SEQ ID NO: 9275667 - DNA, 22 bp, Homo sapiens
gactggagataaaaccatgagt

SEQ ID NO: 9275668 - DNA, 22 bp, Homo sapiens
gacggagctggttgctgcggct

SEQ ID NO: 9275669 - DNA, 22 bp, Homo sapiens
gactggaaagcctgtcctcaga

SEQ ID NO: 9275670 - DNA, 22 bp, Homo sapiens
gactacaggccggcatcagaga

SEQ ID NO: 9275671 - DNA, 22 bp, Homo sapiens
gactacagatagccaattaagt

SEQ ID NO: 9275672 - DNA, 22 bp, Homo sapiens
gactaacagtctccgcttgaaa

SEQ ID NO: 9275673 - DNA, 22 bp, Homo sapiens
gacggggcagccagctggtggc

SEQ ID NO: 9275674 - DNA, 22 bp, Homo sapiens
gaaggctgtcagagaggagggc

SEQ ID NO: 9275675 - DNA, 22 bp, Homo sapiens
gaaggctgtcagagaggagggc

SEQ ID NO: 9275676 - DNA, 22 bp, Homo sapiens
gaaggctgtggctggtctcagt

SEQ ID NO: 9275677 - DNA, 22 bp, Homo sapiens
gaaggctgtttctggtagtgat

SEQ ID NO: 9275678 - DNA, 22 bp, Homo sapiens
gaacaaacacatcccagcagtg

SEQ ID NO: 9275679 - DNA, 22 bp, Homo sapiens
gaacaaacagtcaggacagtct

SEQ ID NO: 9275680 - DNA, 22 bp, Homo sapiens
gaacaaacagaagaggcggaac

SEQ ID NO: 9275681 - DNA, 22 bp, Homo sapiens
gaacaaacatttttggcagtat

SEQ ID NO: 9275682 - DNA, 19 bp, Homo sapiens
gaacaaacttaaacttttc

SEQ ID NO: 9275683 - DNA, 19 bp, Homo sapiens
gaacaaacttaaacttttc

SEQ ID NO: 9275684 - DNA, 22 bp, Homo sapiens
gaacaaactgggtcccaatgat

SEQ ID NO: 9275685 - DNA, 22 bp, Homo sapiens
gaacaactttgaaacatgaaga

SEQ ID NO: 9275686 - DNA, 22 bp, Homo sapiens
gaacaactcttcttgagagatg

SEQ ID NO: 9275687 - DNA, 22 bp, Homo sapiens
gaacaaatcccttcctgtctcc

SEQ ID NO: 9275688 - DNA, 22 bp, Homo sapiens
gaacaatacaggctttattcct

SEQ ID NO: 9275689 - DNA, 22 bp, Homo sapiens
gaacaaggattcccaaagaaga

SEQ ID NO: 9275690 - DNA, 22 bp, Homo sapiens
gaacaatagtggtaacaaagcc

SEQ ID NO: 9275691 - DNA, 22 bp, Homo sapiens
gaaggcaagatctcagtggagg

SEQ ID NO: 9275692 - DNA, 22 bp, Homo sapiens
gaaggctgctgggaagtgtggt

SEQ ID NO: 9275693 - DNA, 22 bp, Homo sapiens
gaaggctggaaggcaagtagga

SEQ ID NO: 9275694 - DNA, 22 bp, Homo sapiens
gaaggctggaaggcaagtagga

SEQ ID NO: 9275695 - DNA, 22 bp, Homo sapiens
gaaggctggctttctgagagca

SEQ ID NO: 9275696 - DNA, 22 bp, Homo sapiens
gaaggctggctttctgagagca

SEQ ID NO: 9275697 - DNA, 22 bp, Homo sapiens
gacaatgcagaagtacttgttc

SEQ ID NO: 9275698 - DNA, 22 bp, Homo sapiens
gacaatgcattgtgattgtgac

SEQ ID NO: 9275699 - DNA, 21 bp, Homo sapiens
gacaatgcagtcttttttgga

SEQ ID NO: 9275700 - DNA, 22 bp, Homo sapiens
gacaataagaaaagaggaggca

SEQ ID NO: 9275701 - DNA, 22 bp, Homo sapiens
gacaataagaacagatactgtg

SEQ ID NO: 9275702 - DNA, 22 bp, Homo sapiens
gaattttatcttattacttgca

SEQ ID NO: 9275703 - DNA, 22 bp, Homo sapiens
gacaataaagtgatacatggga

SEQ ID NO: 9275704 - DNA, 19 bp, Homo sapiens
gaattttaggacttcagca

SEQ ID NO: 9275705 - DNA, 22 bp, Homo sapiens
gaatcagactacaaatgacccc

SEQ ID NO: 9275706 - DNA, 22 bp, Homo sapiens
gaatatttttaaagggactaat

SEQ ID NO: 9275707 - DNA, 22 bp, Homo sapiens
gaatattttcagtacagatggt

SEQ ID NO: 9275708 - DNA, 22 bp, Homo sapiens
gaatattttcagtacagatggt

SEQ ID NO: 9275709 - DNA, 22 bp, Homo sapiens
gaatattttcagtacagatggt

SEQ ID NO: 9275710 - DNA, 22 bp, Homo sapiens
gaataatagcagaaattagcag

SEQ ID NO: 9275711 - DNA, 22 bp, Homo sapiens
gaataacattttttcctttaca

SEQ ID NO: 9275712 - DNA, 22 bp, Homo sapiens
gaagtcttttagcaaaacgaac

SEQ ID NO: 9275713 - DNA, 22 bp, Homo sapiens
gaataacattttttcctttaca

SEQ ID NO: 9275714 - DNA, 22 bp, Homo sapiens
gaataactgctatctttctggc

SEQ ID NO: 9275715 - DNA, 22 bp, Homo sapiens
gaataatagcagaaattagcag

SEQ ID NO: 9275716 - DNA, 22 bp, Homo sapiens
gaataatattgactttgcaggc

SEQ ID NO: 9275717 - DNA, 22 bp, Homo sapiens
gaataattgtgatgcttgaagt

SEQ ID NO: 9275718 - DNA, 22 bp, Homo sapiens
gaaatacagttgggaggaggta

SEQ ID NO: 9275719 - DNA, 22 bp, Homo sapiens
gaaatagacactttctatgaat

SEQ ID NO: 9275720 - DNA, 22 bp, Homo sapiens
gaaatagaagctgccaatttct

SEQ ID NO: 9275721 - DNA, 22 bp, Homo sapiens
gaaatagacactttctatgaat

SEQ ID NO: 9275722 - DNA, 22 bp, Homo sapiens
gaaatagaagctgccaatttct

SEQ ID NO: 9275723 - DNA, 22 bp, Homo sapiens
gaaatactgtaaagttattatt

SEQ ID NO: 9275724 - DNA, 22 bp, Homo sapiens
gaaatagaagctgccaatttct

SEQ ID NO: 9275725 - DNA, 22 bp, Homo sapiens
gaaaggtttggcttttcagtag

SEQ ID NO: 9275726 - DNA, 22 bp, Homo sapiens
gaaagtatttacattaacatct

SEQ ID NO: 9275727 - DNA, 22 bp, Homo sapiens
gaaatttattatctacatcatt

SEQ ID NO: 9275728 - DNA, 22 bp, Homo sapiens
atgatgctgtttatcatatact

SEQ ID NO: 9275729 - DNA, 22 bp, Homo sapiens
atgatgctgtttatcatatact

SEQ ID NO: 9275730 - DNA, 22 bp, Homo sapiens
atgatgctgttattatctatac

SEQ ID NO: 9275731 - DNA, 22 bp, Homo sapiens
atgatctcattctttcaaaggg

SEQ ID NO: 9275732 - DNA, 22 bp, Homo sapiens
atgatctgataatcatccacta

SEQ ID NO: 9275733 - DNA, 22 bp, Homo sapiens
atgatgaaaactgaaggttagg

SEQ ID NO: 9275734 - DNA, 22 bp, Homo sapiens
atgatgaaactaggaactagag

SEQ ID NO: 9275735 - DNA, 22 bp, Homo sapiens
atgatcagggcagaagcagaag

SEQ ID NO: 9275736 - DNA, 22 bp, Homo sapiens
gaaatatacatgaagtcggctg

SEQ ID NO: 9275737 - DNA, 19 bp, Homo sapiens
atgatacaggtgaaaattg

SEQ ID NO: 9275738 - DNA, 19 bp, Homo sapiens
atgatacaggtgaaaattg

SEQ ID NO: 9275739 - DNA, 22 bp, Homo sapiens
gaaatagaggacagctggatca

SEQ ID NO: 9275740 - DNA, 22 bp, Homo sapiens
gaaatagatctctgggatgcaa

SEQ ID NO: 9275741 - DNA, 22 bp, Homo sapiens
atgatcagcagttttcagtgtt

SEQ ID NO: 9275742 - DNA, 22 bp, Homo sapiens
atgatattttagtaaagtgata

SEQ ID NO: 9275743 - DNA, 22 bp, Homo sapiens
atgatatttgcaatgtgcttgc

SEQ ID NO: 9275744 - DNA, 22 bp, Homo sapiens
atgatatttgcaatgtgcttgc

SEQ ID NO: 9275745 - DNA, 22 bp, Homo sapiens
atgatattattctagcccagag

SEQ ID NO: 9275746 - DNA, 22 bp, Homo sapiens
gaaacatttgttgagtacttgc

SEQ ID NO: 9275747 - DNA, 22 bp, Homo sapiens
gaaacatttgttgagtacttgc

SEQ ID NO: 9275748 - DNA, 21 bp, Homo sapiens
atgacagatgctgcagatcgt

SEQ ID NO: 9275749 - DNA, 22 bp, Homo sapiens
atgacaggaggcagctgggcag

SEQ ID NO: 9275750 - DNA, 22 bp, Homo sapiens
atgacaggaggcagctgggcag

SEQ ID NO: 9275751 - DNA, 22 bp, Homo sapiens
atgacagtactggtgacaatac

SEQ ID NO: 9275752 - DNA, 22 bp, Homo sapiens
gaaagcagtatttagttctgtt

SEQ ID NO: 9275753 - DNA, 22 bp, Homo sapiens
atgacatgattctttctttcat

SEQ ID NO: 9275754 - DNA, 22 bp, Homo sapiens
gaaagcagtatttagttctgtt

SEQ ID NO: 9275755 - DNA, 22 bp, Homo sapiens
gaaagcataactaatatttatt

SEQ ID NO: 9275756 - DNA, 22 bp, Homo sapiens
gaaaggttgtaacaagactctt

SEQ ID NO: 9275757 - DNA, 22 bp, Homo sapiens
gaaaggtttcatctacttttca

SEQ ID NO: 9275758 - DNA, 22 bp, Homo sapiens
gaaaggtttaagtaggatttgt

SEQ ID NO: 9275759 - DNA, 22 bp, Homo sapiens
atgacataaagctatgctaggt

SEQ ID NO: 9275760 - DNA, 22 bp, Homo sapiens
atgacataagtgaaaaacatca

SEQ ID NO: 9275761 - DNA, 22 bp, Homo sapiens
atgacagtaggtaaatgatagc

SEQ ID NO: 9275762 - DNA, 22 bp, Homo sapiens
gaaacattcagtcaacagtgtt

SEQ ID NO: 9275763 - DNA, 22 bp, Homo sapiens
gaaacattcagtcaacagtgtt

SEQ ID NO: 9275764 - DNA, 22 bp, Homo sapiens
gaaacattgtgttctacagatt

SEQ ID NO: 9275765 - DNA, 20 bp, Homo sapiens
gaaacattggcagcaactga

SEQ ID NO: 9275766 - DNA, 20 bp, Homo sapiens
gaaacattggcagcaactga

SEQ ID NO: 9275767 - DNA, 22 bp, Homo sapiens
ctttcttgcataatttgaaacc

SEQ ID NO: 9275768 - DNA, 22 bp, Homo sapiens
ctttctttcgaagacgtgatta

SEQ ID NO: 9275769 - DNA, 22 bp, Homo sapiens
ctttcttgcataatttgaaacc

SEQ ID NO: 9275770 - DNA, 22 bp, Homo sapiens
ctttcttgcataatttgaaacc

SEQ ID NO: 9275771 - DNA, 22 bp, Homo sapiens
ctttcttggtcctgaagatggc

SEQ ID NO: 9275772 - DNA, 22 bp, Homo sapiens
ctttctttcgaagacgtgatta

SEQ ID NO: 9275773 - DNA, 22 bp, Homo sapiens
gaaacagtgagaacttttcctg

SEQ ID NO: 9275774 - DNA, 22 bp, Homo sapiens
gaaacagtcaactttctttccc

SEQ ID NO: 9275775 - DNA, 22 bp, Homo sapiens
cttcttgtcaatttgccattgt

SEQ ID NO: 9275776 - DNA, 22 bp, Homo sapiens
cttcttgtcagtgatttcttcc

SEQ ID NO: 9275777 - DNA, 22 bp, Homo sapiens
cttctttactttctagaaataa

SEQ ID NO: 9275778 - DNA, 22 bp, Homo sapiens
atctggagaataaatgtccaag

SEQ ID NO: 9275779 - DNA, 22 bp, Homo sapiens
atctggagtgggacacagaaat

SEQ ID NO: 9275780 - DNA, 22 bp, Homo sapiens
atctggagcttgttagatgttt

SEQ ID NO: 9275781 - DNA, 22 bp, Homo sapiens
ctttcctagaaatatatactta

SEQ ID NO: 9275782 - DNA, 22 bp, Homo sapiens
ctttcctagatggccatctttc

SEQ ID NO: 9275783 - DNA, 22 bp, Homo sapiens
ctttcctagtagttacagaatg

SEQ ID NO: 9275784 - DNA, 22 bp, Homo sapiens
ctttcccacgcagtggatgaga

SEQ ID NO: 9275785 - DNA, 22 bp, Homo sapiens
ctttcccagagtagttgatgct

SEQ ID NO: 9275786 - DNA, 22 bp, Homo sapiens
ctttcccttagccccattctat

SEQ ID NO: 9275787 - DNA, 22 bp, Homo sapiens
ctttcccttagccccattctat

SEQ ID NO: 9275788 - DNA, 22 bp, Homo sapiens
ctttccagtttctaagtacagt

SEQ ID NO: 9275789 - DNA, 22 bp, Homo sapiens
atctggctcacttagtctagga

SEQ ID NO: 9275790 - DNA, 22 bp, Homo sapiens
ctttcaactacatacaggcgat

SEQ ID NO: 9275791 - DNA, 23 bp, Homo sapiens
atgaagacccgtggtgtccccac

SEQ ID NO: 9275792 - DNA, 22 bp, Homo sapiens
atgaagacaggtctcatcacca

SEQ ID NO: 9275793 - DNA, 22 bp, Homo sapiens
ctttctcttgagcaagagctgt

SEQ ID NO: 9275794 - DNA, 22 bp, Homo sapiens
ctttctgaagtttaagttctaa

SEQ ID NO: 9275795 - DNA, 22 bp, Homo sapiens
ctttctgaagtttaagttctaa

SEQ ID NO: 9275796 - DNA, 22 bp, Homo sapiens
ctttcttaatttttaaggacac

SEQ ID NO: 9275797 - DNA, 22 bp, Homo sapiens
atgaagaaactgttctgggtgg

SEQ ID NO: 9275798 - DNA, 22 bp, Homo sapiens
atgaagaaaaatccagctgtcc

SEQ ID NO: 9275799 - DNA, 22 bp, Homo sapiens
atgaactttctttacagttttg

SEQ ID NO: 9275800 - DNA, 22 bp, Homo sapiens
atgaagacaaactgggtagaaa

SEQ ID NO: 9275801 - DNA, 22 bp, Homo sapiens
atgaagacaaactgggtagaaa

SEQ ID NO: 9275802 - DNA, 22 bp, Homo sapiens
atgaagacaaacgacgttgcaa

SEQ ID NO: 9275803 - DNA, 22 bp, Homo sapiens
atgaacatgtgactcagacctg

SEQ ID NO: 9275804 - DNA, 22 bp, Homo sapiens
atgaaaatgtacatgtgtataa

SEQ ID NO: 9275805 - DNA, 22 bp, Homo sapiens
atgaaaagttcgatctagaagg

SEQ ID NO: 9275806 - DNA, 22 bp, Homo sapiens
atgaaaatgtacatgtgtataa

SEQ ID NO: 9275807 - DNA, 22 bp, Homo sapiens
atgaaacaagggtattttctct

SEQ ID NO: 9275808 - DNA, 22 bp, Homo sapiens
atgaaacagagtacttaatata

SEQ ID NO: 9275809 - DNA, 22 bp, Homo sapiens
atgaaacagagtacttaatata

SEQ ID NO: 9275810 - DNA, 22 bp, Homo sapiens
atgaacatcggaaatgagactg

SEQ ID NO: 9275811 - DNA, 22 bp, Homo sapiens
atgaaattcatctgagaatgct

SEQ ID NO: 9275812 - DNA, 22 bp, Homo sapiens
atgaaattcatctgagaatgct

SEQ ID NO: 9275813 - DNA, 22 bp, Homo sapiens
ctgcaggggtgtcctgtattgg

SEQ ID NO: 9275814 - DNA, 20 bp, Homo sapiens
ctgcagggttagaggctcca

SEQ ID NO: 9275815 - DNA, 20 bp, Homo sapiens
ctgcagggtgagtgggcgat

SEQ ID NO: 9275816 - DNA, 22 bp, Homo sapiens
ctgcagggagaggggacagcct

SEQ ID NO: 9275817 - DNA, 22 bp, Homo sapiens
ctgcagagcaagtaacatcctc

SEQ ID NO: 9275818 - DNA, 22 bp, Homo sapiens
ctgcagagatgaagaaggtggc

SEQ ID NO: 9275819 - DNA, 22 bp, Homo sapiens
ctgcagagagtgccgggcagcc

SEQ ID NO: 9275820 - DNA, 22 bp, Homo sapiens
ctgcagagagtaactgaaatat

SEQ ID NO: 9275821 - DNA, 22 bp, Homo sapiens
ctgcagagacctaggtcaggtt

SEQ ID NO: 9275822 - DNA, 22 bp, Homo sapiens
ctgcagagaattgtggggcttc

SEQ ID NO: 9275823 - DNA, 22 bp, Homo sapiens
ctgcatcctggaaatagctaag

SEQ ID NO: 9275824 - DNA, 21 bp, Homo sapiens
ctgcatctcatagaacatgtc

SEQ ID NO: 9275825 - DNA, 22 bp, Homo sapiens
ctgcatcctaacctccatgcag

SEQ ID NO: 9275826 - DNA, 20 bp, Homo sapiens
ctgcagggttagaggctcca

SEQ ID NO: 9275827 - DNA, 22 bp, Homo sapiens
ctgcagggtttcgccagttgtg

SEQ ID NO: 9275828 - DNA, 22 bp, Homo sapiens
ctgcagggttcggagagttccc

SEQ ID NO: 9275829 - DNA, 22 bp, Homo sapiens
ctgcatgaagtcttttttatag

SEQ ID NO: 9275830 - DNA, 22 bp, Homo sapiens
ctgaggagctgaaggccctcca

SEQ ID NO: 9275831 - DNA, 22 bp, Homo sapiens
ctgaggagcgttggtcacgtgt

SEQ ID NO: 9275832 - DNA, 22 bp, Homo sapiens
ctgaggagctgaaggccctcca

SEQ ID NO: 9275833 - DNA, 22 bp, Homo sapiens
ctgaggagatccccccagaagt

SEQ ID NO: 9275834 - DNA, 22 bp, Homo sapiens
ctgaggagcagctggcccgcta

SEQ ID NO: 9275835 - DNA, 22 bp, Homo sapiens
agttatttaaaatgattgtcct

SEQ ID NO: 9275836 - DNA, 22 bp, Homo sapiens
agttatttaaaatgattgtcct

SEQ ID NO: 9275837 - DNA, 22 bp, Homo sapiens
agttattcatttattctgtaca

SEQ ID NO: 9275838 - DNA, 22 bp, Homo sapiens
agttattgagtatctataatgt

SEQ ID NO: 9275839 - DNA, 19 bp, Homo sapiens
agttattgatctattcagg

SEQ ID NO: 9275840 - DNA, 22 bp, Homo sapiens
agttatcccaaatgcaaaatgg

SEQ ID NO: 9275841 - DNA, 22 bp, Homo sapiens
agttatttactcctttgtctct

SEQ ID NO: 9275842 - DNA, 22 bp, Homo sapiens
ctgcaagccaagctgagagcct

SEQ ID NO: 9275843 - DNA, 21 bp, Homo sapiens
ctgcaagacatgctgttcttg

SEQ ID NO: 9275844 - DNA, 22 bp, Homo sapiens
ataaatgaacattcacagagct

SEQ ID NO: 9275845 - DNA, 22 bp, Homo sapiens
ataaatctcttaagactcaaca

SEQ ID NO: 9275846 - DNA, 22 bp, Homo sapiens
ataaatctcttaagactcaaca

SEQ ID NO: 9275847 - DNA, 22 bp, Homo sapiens
ctgcctctgcgtcccacagagt

SEQ ID NO: 9275848 - DNA, 22 bp, Homo sapiens
ctgcctctccccagagtggccc

SEQ ID NO: 9275849 - DNA, 22 bp, Homo sapiens
ataaatgattcagcaggaaata

SEQ ID NO: 9275850 - DNA, 22 bp, Homo sapiens
ataaatgattcagcaggaaata

SEQ ID NO: 9275851 - DNA, 22 bp, Homo sapiens
ataaatgaacattcacagagct

SEQ ID NO: 9275852 - DNA, 22 bp, Homo sapiens
ataaatgaacattcacagagct

SEQ ID NO: 9275853 - DNA, 22 bp, Homo sapiens
ctgcctctcagcctgaccgcca

SEQ ID NO: 9275854 - DNA, 22 bp, Homo sapiens
ctgcctctcagcctgaccgcca

SEQ ID NO: 9275855 - DNA, 22 bp, Homo sapiens
ctgcctctcagcctgaccgcca

SEQ ID NO: 9275856 - DNA, 22 bp, Homo sapiens
ctgcctctcagcctgaccgcca

SEQ ID NO: 9275857 - DNA, 22 bp, Homo sapiens
ctgcctctcaggtccctgagat

SEQ ID NO: 9275858 - DNA, 22 bp, Homo sapiens
ctgcctctcaggtccctgagat

SEQ ID NO: 9275859 - DNA, 22 bp, Homo sapiens
ctgcctctcaggtccctgagat

SEQ ID NO: 9275860 - DNA, 22 bp, Homo sapiens
ctgcctctccccagagtggccc

SEQ ID NO: 9275861 - DNA, 22 bp, Homo sapiens
ctgcctctccccagagtggccc

SEQ ID NO: 9275862 - DNA, 22 bp, Homo sapiens
ctgcctctcaggtccctgagat

SEQ ID NO: 9275863 - DNA, 22 bp, Homo sapiens
ataacagtgacctctcagcacc

SEQ ID NO: 9275864 - DNA, 22 bp, Homo sapiens
ataacatgacctgtgcttcaca

SEQ ID NO: 9275865 - DNA, 22 bp, Homo sapiens
ataacctaggagggtagaggta

SEQ ID NO: 9275866 - DNA, 22 bp, Homo sapiens
ataactctgtttttttcatgca

SEQ ID NO: 9275867 - DNA, 19 bp, Homo sapiens
ataactacattggctcagt

SEQ ID NO: 9275868 - DNA, 22 bp, Homo sapiens
ataactctgtttttttcatgca

SEQ ID NO: 9275869 - DNA, 22 bp, Homo sapiens
ataacctggtagtattaaatgt

SEQ ID NO: 9275870 - DNA, 22 bp, Homo sapiens
ataacgaaggctgatgcgggat

SEQ ID NO: 9275871 - DNA, 22 bp, Homo sapiens
ataaatgtttgttgaatgaata

SEQ ID NO: 9275872 - DNA, 22 bp, Homo sapiens
ataaatgtttgttgaatgaata

SEQ ID NO: 9275873 - DNA, 22 bp, Homo sapiens
ataaatgtgaattagagctttg

SEQ ID NO: 9275874 - DNA, 22 bp, Homo sapiens
ataaattaggatctggggttcc

SEQ ID NO: 9275875 - DNA, 22 bp, Homo sapiens
ataaattaggatctggggttcc

SEQ ID NO: 9275876 - DNA, 23 bp, Homo sapiens
ataaattactatctccctagagc

SEQ ID NO: 9275877 - DNA, 23 bp, Homo sapiens
ataaattactatctccctagagc

SEQ ID NO: 9275878 - DNA, 23 bp, Homo sapiens
ataaattactatctccctagagc

SEQ ID NO: 9275879 - DNA, 22 bp, Homo sapiens
ataacttgatgttatttgtcca

SEQ ID NO: 9275880 - DNA, 22 bp, Homo sapiens
ataacttgatgttatttgtcca

SEQ ID NO: 9275881 - DNA, 22 bp, Homo sapiens
ataactgcctgatgactctcaa

SEQ ID NO: 9275882 - DNA, 22 bp, Homo sapiens
ataacttaatgggtcatgctct

SEQ ID NO: 9275883 - DNA, 23 bp, Homo sapiens
ataactgagccgaggcttaagaa

SEQ ID NO: 9275884 - DNA, 17 bp, Homo sapiens
ataagacagaagacaat

SEQ ID NO: 9275885 - DNA, 17 bp, Homo sapiens
ataagacagaagacaat

SEQ ID NO: 9275886 - DNA, 22 bp, Homo sapiens
ataagacacgccccactcactc

SEQ ID NO: 9275887 - DNA, 22 bp, Homo sapiens
ataagacacgcaaataggtacg

SEQ ID NO: 9275888 - DNA, 22 bp, Homo sapiens
ataagaataattaagttagtcc

SEQ ID NO: 9275889 - DNA, 22 bp, Homo sapiens
ataagacacgcaaataggtacg

SEQ ID NO: 9275890 - DNA, 21 bp, Homo sapiens
ataagcatgctgattacattt

SEQ ID NO: 9275891 - DNA, 22 bp, Homo sapiens
ataagcatgttagaatatttga

SEQ ID NO: 9275892 - DNA, 22 bp, Homo sapiens
ataatttactaagctctacctt

SEQ ID NO: 9275893 - DNA, 22 bp, Homo sapiens
ataatttactaagctctacctt

SEQ ID NO: 9275894 - DNA, 22 bp, Homo sapiens
ataatttactaagctctacctt

SEQ ID NO: 9275895 - DNA, 22 bp, Homo sapiens
atacaaagctaaatatggtttc

SEQ ID NO: 9275896 - DNA, 22 bp, Homo sapiens
ataagcagggtcaaatgcctac

SEQ ID NO: 9275897 - DNA, 22 bp, Homo sapiens
ataagaggaattacagaagagg

SEQ ID NO: 9275898 - DNA, 22 bp, Homo sapiens
ataagagtcttgttttcttatt

SEQ ID NO: 9275899 - DNA, 22 bp, Homo sapiens
ataagaggaattacagaagagg

SEQ ID NO: 9275900 - DNA, 22 bp, Homo sapiens
atacaacagaaaatgattattc

SEQ ID NO: 9275901 - DNA, 22 bp, Homo sapiens
atacaaatttatagatgcattt

SEQ ID NO: 9275902 - DNA, 22 bp, Homo sapiens
atacaaatttatagatgcattt

SEQ ID NO: 9275903 - DNA, 22 bp, Homo sapiens
atacaaatttatagatgcattt

SEQ ID NO: 9275904 - DNA, 22 bp, Homo sapiens
atacaaattataggccccatcc

SEQ ID NO: 9275905 - DNA, 22 bp, Homo sapiens
atacaaaggaacacaggcatgt

SEQ ID NO: 9275906 - DNA, 22 bp, Homo sapiens
atacaaaggaacacaggcatgt

SEQ ID NO: 9275907 - DNA, 22 bp, Homo sapiens
atacaaattataggccccatcc

SEQ ID NO: 9275908 - DNA, 22 bp, Homo sapiens
atacaaatcctctgggatggta

SEQ ID NO: 9275909 - DNA, 22 bp, Homo sapiens
atacaaagtattgatcctgagt

SEQ ID NO: 9275910 - DNA, 22 bp, Homo sapiens
ctgctgaggtccttgctcagac

SEQ ID NO: 9275911 - DNA, 22 bp, Homo sapiens
ctgctgaggctccggaccaagt

SEQ ID NO: 9275912 - DNA, 22 bp, Homo sapiens
ctggaagtggggttggcttgaa

SEQ ID NO: 9275913 - DNA, 22 bp, Homo sapiens
ctggaagagcatttgcataggg

SEQ ID NO: 9275914 - DNA, 22 bp, Homo sapiens
ctggaagagcatttgcataggg

SEQ ID NO: 9275915 - DNA, 22 bp, Homo sapiens
ctgctgccaagggtgccacagg

SEQ ID NO: 9275916 - DNA, 22 bp, Homo sapiens
ctgctgcaggatgggcactctg

SEQ ID NO: 9275917 - DNA, 19 bp, Homo sapiens
ctggaatgagaacatgccc

SEQ ID NO: 9275918 - DNA, 22 bp, Homo sapiens
ctggaatgcggagagttggaga

SEQ ID NO: 9275919 - DNA, 22 bp, Homo sapiens
ctggagagaatgttcattgcag

SEQ ID NO: 9275920 - DNA, 22 bp, Homo sapiens
ctggagagaccgaaagaggctg

SEQ ID NO: 9275921 - DNA, 19 bp, Homo sapiens
atacagtaaggtgtttgcc

SEQ ID NO: 9275922 - DNA, 22 bp, Homo sapiens
atacagtaaccacattctatag

SEQ ID NO: 9275923 - DNA, 22 bp, Homo sapiens
atacagtagacaatctcatgaa

SEQ ID NO: 9275924 - DNA, 22 bp, Homo sapiens
atacagtaagtgtccctgaaac

SEQ ID NO: 9275925 - DNA, 22 bp, Homo sapiens
atacagtaatttgtaactcatc

SEQ ID NO: 9275926 - DNA, 22 bp, Homo sapiens
ctggagaagtactgagacattt

SEQ ID NO: 9275927 - DNA, 17 bp, Homo sapiens
ctggagaagcctgtgga

SEQ ID NO: 9275928 - DNA, 22 bp, Homo sapiens
ctggagacctctcctgagagtg

SEQ ID NO: 9275929 - DNA, 22 bp, Homo sapiens
ctggagacctctcctgagagtg

SEQ ID NO: 9275930 - DNA, 22 bp, Homo sapiens
atacagtgtactatttagcagt

SEQ ID NO: 9275931 - DNA, 22 bp, Homo sapiens
atacagtgccccttttcacatg

SEQ ID NO: 9275932 - DNA, 22 bp, Homo sapiens
atacagtggctgtgagctgggc

SEQ ID NO: 9275933 - DNA, 22 bp, Homo sapiens
atacagtgaatacttacagtgt

SEQ ID NO: 9275934 - DNA, 22 bp, Homo sapiens
atacagtgccccttttcacatg

SEQ ID NO: 9275935 - DNA, 22 bp, Homo sapiens
atacagtgcacaacctgtgcag

SEQ ID NO: 9275936 - DNA, 22 bp, Homo sapiens
atacagtataactaataaaccc

SEQ ID NO: 9275937 - DNA, 22 bp, Homo sapiens
atacagtattacctgttcagga

SEQ ID NO: 9275938 - DNA, 22 bp, Homo sapiens
atacatacgtacatacgtatgt

SEQ ID NO: 9275939 - DNA, 22 bp, Homo sapiens
atacatacatgtatgcacatac

SEQ ID NO: 9275940 - DNA, 22 bp, Homo sapiens
atacatacatgtatgcacatac

SEQ ID NO: 9275941 - DNA, 23 bp, Homo sapiens
atacatacagtcttactgacttt

SEQ ID NO: 9275942 - DNA, 22 bp, Homo sapiens
atacatacatgtacacataaat

SEQ ID NO: 9275943 - DNA, 22 bp, Homo sapiens
atacattcagcagtgctcatga

SEQ ID NO: 9275944 - DNA, 22 bp, Homo sapiens
atacattcctactgactagcta

SEQ ID NO: 9275945 - DNA, 22 bp, Homo sapiens
ataccaattagagtttgttgca

SEQ ID NO: 9275946 - DNA, 22 bp, Homo sapiens
ataccatttccatgttacatta

SEQ ID NO: 9275947 - DNA, 21 bp, Homo sapiens
ataccatttgccaaaaggatc

SEQ ID NO: 9275948 - DNA, 22 bp, Homo sapiens
ataccatggcagtttattcacg

SEQ ID NO: 9275949 - DNA, 22 bp, Homo sapiens
ataccattgtttctaccagctg

SEQ ID NO: 9275950 - DNA, 22 bp, Homo sapiens
ataccttttactcattatccat

SEQ ID NO: 9275951 - DNA, 22 bp, Homo sapiens
atacgtaagttgaacatcagaa

SEQ ID NO: 9275952 - DNA, 22 bp, Homo sapiens
ataccttttagacatgtagttg

SEQ ID NO: 9275953 - DNA, 22 bp, Homo sapiens
atacctgtgtatccacaagcgt

SEQ ID NO: 9275954 - DNA, 22 bp, Homo sapiens
atacctgatcaaggcaaaaatg

SEQ ID NO: 9275955 - DNA, 22 bp, Homo sapiens
ctggccccaggcagcctgctgg

SEQ ID NO: 9275956 - DNA, 22 bp, Homo sapiens
ctggccccagagtttcacttgg

SEQ ID NO: 9275957 - DNA, 22 bp, Homo sapiens
ctggccccatctggagtctgag

SEQ ID NO: 9275958 - DNA, 22 bp, Homo sapiens
ctggcccccacacctgtcaggg

SEQ ID NO: 9275959 - DNA, 22 bp, Homo sapiens
ctggccccggttcctaaaaacc

SEQ ID NO: 9275960 - DNA, 22 bp, Homo sapiens
ctggcccctgtggctaaaatca

SEQ ID NO: 9275961 - DNA, 22 bp, Homo sapiens
ctggcccccacacctgtcaggg

SEQ ID NO: 9275962 - DNA, 22 bp, Homo sapiens
atagagactatagagcacttac

SEQ ID NO: 9275963 - DNA, 22 bp, Homo sapiens
atagattagccctatagtttta

SEQ ID NO: 9275964 - DNA, 22 bp, Homo sapiens
atagattatttgctcattactt

SEQ ID NO: 9275965 - DNA, 22 bp, Homo sapiens
atactaaagtatagaacttagt

SEQ ID NO: 9275966 - DNA, 22 bp, Homo sapiens
atactaagcccaagaacacatg

SEQ ID NO: 9275967 - DNA, 19 bp, Homo sapiens
atagcagctatacccagat

SEQ ID NO: 9275968 - DNA, 22 bp, Homo sapiens
ctggctggccatgtagagatga

SEQ ID NO: 9275969 - DNA, 22 bp, Homo sapiens
atagcagcatttcttccaagga

SEQ ID NO: 9275970 - DNA, 22 bp, Homo sapiens
atagcagcatttcttccaagga

SEQ ID NO: 9275971 - DNA, 22 bp, Homo sapiens
atagcacatcactccagtgagt

SEQ ID NO: 9275972 - DNA, 22 bp, Homo sapiens
atagcaaatattttaatgagca

SEQ ID NO: 9275973 - DNA, 22 bp, Homo sapiens
atagcaagcgttcccaagccac

SEQ ID NO: 9275974 - DNA, 22 bp, Homo sapiens
ctggctcacaggtgagatgcat

SEQ ID NO: 9275975 - DNA, 22 bp, Homo sapiens
ctggctcacaggtgagatgcat

SEQ ID NO: 9275976 - DNA, 22 bp, Homo sapiens
ctggctcacaggtgagatgcat

SEQ ID NO: 9275977 - DNA, 22 bp, Homo sapiens
cttccagtagtatcattctcat

SEQ ID NO: 9275978 - DNA, 22 bp, Homo sapiens
cttccagtcttttcagtggagt

SEQ ID NO: 9275979 - DNA, 22 bp, Homo sapiens
cttccagtgcataggtagatca

SEQ ID NO: 9275980 - DNA, 22 bp, Homo sapiens
cttccagtcttttcagtggagt

SEQ ID NO: 9275981 - DNA, 22 bp, Homo sapiens
cttcccaagactgtattgcaag

SEQ ID NO: 9275982 - DNA, 22 bp, Homo sapiens
cttcccacagaattcaatcagt

SEQ ID NO: 9275983 - DNA, 18 bp, Homo sapiens
cttcctcatcgctctccc

SEQ ID NO: 9275984 - DNA, 18 bp, Homo sapiens
cttcctcatcgctctccc

SEQ ID NO: 9275985 - DNA, 22 bp, Homo sapiens
cttcctcccccacacactcact

SEQ ID NO: 9275986 - DNA, 22 bp, Homo sapiens
cttcctcccccacacactcact

SEQ ID NO: 9275987 - DNA, 22 bp, Homo sapiens
cttcctcccccacacactcact

SEQ ID NO: 9275988 - DNA, 22 bp, Homo sapiens
cttcctcccggcccatgctctg

SEQ ID NO: 9275989 - DNA, 22 bp, Homo sapiens
cttcctcccggcccatgctctg

SEQ ID NO: 9275990 - DNA, 22 bp, Homo sapiens
cttcctcccggcccatgctctg

SEQ ID NO: 9275991 - DNA, 22 bp, Homo sapiens
cttcctcccggcccatgctctg

SEQ ID NO: 9275992 - DNA, 22 bp, Homo sapiens
cttcctagtgtctactttggag

SEQ ID NO: 9275993 - DNA, 22 bp, Homo sapiens
cttcctagcttcagagtctgtt

SEQ ID NO: 9275994 - DNA, 22 bp, Homo sapiens
cttcctaaaagcttcaagagaa

SEQ ID NO: 9275995 - DNA, 22 bp, Homo sapiens
cttcccagaacaatgtaggctt

SEQ ID NO: 9275996 - DNA, 22 bp, Homo sapiens
cttcattaaccaaaatgcaata

SEQ ID NO: 9275997 - DNA, 22 bp, Homo sapiens
cttagaattttaatccagaaag

SEQ ID NO: 9275998 - DNA, 22 bp, Homo sapiens
cttagatgaagtcacagaaccc

SEQ ID NO: 9275999 - DNA, 22 bp, Homo sapiens
cttagagatgggttttacttag

SEQ ID NO: 9276000 - DNA, 22 bp, Homo sapiens
cttagagatgggttttacttag

SEQ ID NO: 9276001 - DNA, 22 bp, Homo sapiens
cttagaattttgcctactacaa

SEQ ID NO: 9276002 - DNA, 22 bp, Homo sapiens
cttagaatgtctactcttacca

SEQ ID NO: 9276003 - DNA, 22 bp, Homo sapiens
cttagaataaaagggggctata

SEQ ID NO: 9276004 - DNA, 22 bp, Homo sapiens
cttagaatgggacccaatgggt

SEQ ID NO: 9276005 - DNA, 22 bp, Homo sapiens
atccttaagaaagttttctata

SEQ ID NO: 9276006 - DNA, 22 bp, Homo sapiens
atccttaagaaagttttctata

SEQ ID NO: 9276007 - DNA, 22 bp, Homo sapiens
atcctgtggctccagggagccg

SEQ ID NO: 9276008 - DNA, 21 bp, Homo sapiens
cttcttggggagcagctagac

SEQ ID NO: 9276009 - DNA, 22 bp, Homo sapiens
cttcttgggtcagagaatcatt

SEQ ID NO: 9276010 - DNA, 22 bp, Homo sapiens
cttcttggtgatggcttacctg

SEQ ID NO: 9276011 - DNA, 22 bp, Homo sapiens
cttcttggtgatggcttacctg

SEQ ID NO: 9276012 - DNA, 20 bp, Homo sapiens
cttcttggagatggtgtttt

SEQ ID NO: 9276013 - DNA, 22 bp, Homo sapiens
cttcttggctgcaagtctctgt

SEQ ID NO: 9276014 - DNA, 22 bp, Homo sapiens
cttcttaatgcataaactgtgt

SEQ ID NO: 9276015 - DNA, 22 bp, Homo sapiens
cttcttaatgacagattaaaat

SEQ ID NO: 9276016 - DNA, 22 bp, Homo sapiens
atctgcagtttgttttctcttg

SEQ ID NO: 9276017 - DNA, 22 bp, Homo sapiens
cttcttgctgggggcctcagtg

SEQ ID NO: 9276018 - DNA, 22 bp, Homo sapiens
cttcttggaagtcgtccttcca

SEQ ID NO: 9276019 - DNA, 22 bp, Homo sapiens
cttcttgcaattttcatcttat

SEQ ID NO: 9276020 - DNA, 22 bp, Homo sapiens
cttcttattaatccttctctgt

SEQ ID NO: 9276021 - DNA, 22 bp, Homo sapiens
atctgacatctccctctgacat

SEQ ID NO: 9276022 - DNA, 22 bp, Homo sapiens
atctgacatctactagaacaga

SEQ ID NO: 9276023 - DNA, 22 bp, Homo sapiens
atctgacaagttgtgtgtatag

SEQ ID NO: 9276024 - DNA, 22 bp, Homo sapiens
atctgacaagttgtgtgtatag

SEQ ID NO: 9276025 - DNA, 22 bp, Homo sapiens
atctgacaaggccacatattct

SEQ ID NO: 9276026 - DNA, 22 bp, Homo sapiens
atctgacaaggccacatattct

SEQ ID NO: 9276027 - DNA, 22 bp, Homo sapiens
atctgagtgttggatttattgt

SEQ ID NO: 9276028 - DNA, 22 bp, Homo sapiens
atctgagtcaaatatttcattt

SEQ ID NO: 9276029 - DNA, 22 bp, Homo sapiens
atctgagggtttgggcatcagc

SEQ ID NO: 9276030 - DNA, 22 bp, Homo sapiens
atctgcaggaatgtgtgcagag

SEQ ID NO: 9276031 - DNA, 22 bp, Homo sapiens
atctctgatttacagcatctct

SEQ ID NO: 9276032 - DNA, 22 bp, Homo sapiens
atctctgatttacagcatctct

SEQ ID NO: 9276033 - DNA, 22 bp, Homo sapiens
cttcctctagcctagtaatgcc

SEQ ID NO: 9276034 - DNA, 22 bp, Homo sapiens
cttcctccgaagaagttgctgg

SEQ ID NO: 9276035 - DNA, 23 bp, Homo sapiens
atctgaaaaggcattttcttccc

SEQ ID NO: 9276036 - DNA, 22 bp, Homo sapiens
atctgaaaagctttaatgagct

SEQ ID NO: 9276037 - DNA, 22 bp, Homo sapiens
atctgaaactctgacattgtct

SEQ ID NO: 9276038 - DNA, 22 bp, Homo sapiens
atctgaaactctgacattgtct

SEQ ID NO: 9276039 - DNA, 22 bp, Homo sapiens
atctgaaaaatctcctttgtca

SEQ ID NO: 9276040 - DNA, 23 bp, Homo sapiens
atctgaaaagcatttgcagtttg

SEQ ID NO: 9276041 - DNA, 22 bp, Homo sapiens
atctgaaaagcctcttactcct

SEQ ID NO: 9276042 - DNA, 21 bp, Homo sapiens
atctgaaatgtcaaagcagat

SEQ ID NO: 9276043 - DNA, 22 bp, Homo sapiens
atctgaaatagtcttatctgag

SEQ ID NO: 9276044 - DNA, 21 bp, Homo sapiens
atctgaaatgtcaaagcagat

SEQ ID NO: 9276045 - DNA, 21 bp, Homo sapiens
atctgaaaggttagtgttgag

SEQ ID NO: 9276046 - DNA, 22 bp, Homo sapiens
atctgaaagtttagaattcttg

SEQ ID NO: 9276047 - DNA, 22 bp, Homo sapiens
atctgaaatagtcttatctgag

SEQ ID NO: 9276048 - DNA, 22 bp, Homo sapiens
atctgaaagctaggagttctca

SEQ ID NO: 9276049 - DNA, 22 bp, Homo sapiens
atctgaaagctaggagttctca

SEQ ID NO: 9276050 - DNA, 21 bp, Homo sapiens
atctgaaaggttagtgttgag

SEQ ID NO: 9276051 - DNA, 22 bp, Homo sapiens
atctgaaagctaggagttctca

SEQ ID NO: 9276052 - DNA, 21 bp, Homo sapiens
atctgaagtttgagaggaaag

SEQ ID NO: 9276053 - DNA, 19 bp, Homo sapiens
atctgaagtaggtgcagct

SEQ ID NO: 9276054 - DNA, 22 bp, Homo sapiens
atctgaagaggtcatggctgac

SEQ ID NO: 9276055 - DNA, 22 bp, Homo sapiens
atctgaagggaagtggaaggca

SEQ ID NO: 9276056 - DNA, 22 bp, Homo sapiens
ctgtggctcaaaatcccatgat

SEQ ID NO: 9276057 - DNA, 22 bp, Homo sapiens
ctgtggctcaattgcctactga

SEQ ID NO: 9276058 - DNA, 18 bp, Homo sapiens
ctgtgggaagagtttggg

SEQ ID NO: 9276059 - DNA, 22 bp, Homo sapiens
ctgtgggaacactgaggacttc

SEQ ID NO: 9276060 - DNA, 21 bp, Homo sapiens
ctgtgggaccaagcactggga

SEQ ID NO: 9276061 - DNA, 22 bp, Homo sapiens
ctgtgggaatactgcgagtgta

SEQ ID NO: 9276062 - DNA, 22 bp, Homo sapiens
ctgtggagttccatcaggggag

SEQ ID NO: 9276063 - DNA, 23 bp, Homo sapiens
ctgtggccctgcttcatgcagcc

SEQ ID NO: 9276064 - DNA, 19 bp, Homo sapiens
ctgtggcctccaggaggga

SEQ ID NO: 9276065 - DNA, 22 bp, Homo sapiens
ctgtggccttggaccagcatct

SEQ ID NO: 9276066 - DNA, 22 bp, Homo sapiens
ctgtggagtgtagatgctgggt

SEQ ID NO: 9276067 - DNA, 22 bp, Homo sapiens
atcagacctgtctcctcttgcc

SEQ ID NO: 9276068 - DNA, 22 bp, Homo sapiens
atcagaccatccagcgtggatg

SEQ ID NO: 9276069 - DNA, 22 bp, Homo sapiens
atcagaatggagcccacatggt

SEQ ID NO: 9276070 - DNA, 22 bp, Homo sapiens
atcagaatcttctgaacagtgg

SEQ ID NO: 9276071 - DNA, 22 bp, Homo sapiens
atccactccctaacaccatgtt

SEQ ID NO: 9276072 - DNA, 22 bp, Homo sapiens
atccaggctgcgggtctcaagt

SEQ ID NO: 9276073 - DNA, 22 bp, Homo sapiens
atccagggataaaagtaaggtt

SEQ ID NO: 9276074 - DNA, 22 bp, Homo sapiens
atccagggataaaagtaaggtt

SEQ ID NO: 9276075 - DNA, 19 bp, Homo sapiens
atccaggtcatgtagttct

SEQ ID NO: 9276076 - DNA, 22 bp, Homo sapiens
atccaggtatgaattgtgtgac

SEQ ID NO: 9276077 - DNA, 22 bp, Homo sapiens
atccagggtgtggagagagctc

SEQ ID NO: 9276078 - DNA, 22 bp, Homo sapiens
ctgtgtgcaacttgcagttttg

SEQ ID NO: 9276079 - DNA, 22 bp, Homo sapiens
ctgtgtgtcatttgtcaatcct

SEQ ID NO: 9276080 - DNA, 22 bp, Homo sapiens
ctgtgtgctgaaatgcagtgag

SEQ ID NO: 9276081 - DNA, 22 bp, Homo sapiens
ctgtgtggactggttgaggccc

SEQ ID NO: 9276082 - DNA, 22 bp, Homo sapiens
ctgtgtgctgaaatgcagtgag

SEQ ID NO: 9276083 - DNA, 22 bp, Homo sapiens
ctgtgtggcctcaagccagcct

SEQ ID NO: 9276084 - DNA, 19 bp, Homo sapiens
atcctgggtcctccagctg

SEQ ID NO: 9276085 - DNA, 22 bp, Homo sapiens
atcctgggcctcagaggtgtgt

SEQ ID NO: 9276086 - DNA, 22 bp, Homo sapiens
atcctgggctgcaccctcagcc

SEQ ID NO: 9276087 - DNA, 22 bp, Homo sapiens
atcctgggcaaagtatgctgtc

SEQ ID NO: 9276088 - DNA, 22 bp, Homo sapiens
atcctgaaaacttacgaagtgg

SEQ ID NO: 9276089 - DNA, 22 bp, Homo sapiens
atcctgggcaagtcaatgtccc

SEQ ID NO: 9276090 - DNA, 22 bp, Homo sapiens
atcctgggcagtgtgtcactct

SEQ ID NO: 9276091 - DNA, 22 bp, Homo sapiens
atcctgggcagttttgagtgct

SEQ ID NO: 9276092 - DNA, 18 bp, Homo sapiens
atcctgggccagtctttc

SEQ ID NO: 9276093 - DNA, 22 bp, Homo sapiens
atcagaaaggtgggcaagcaga

SEQ ID NO: 9276094 - DNA, 21 bp, Homo sapiens
atcagaaaatgtaatggagca

SEQ ID NO: 9276095 - DNA, 22 bp, Homo sapiens
atcagaacaaaagaacagttta

SEQ ID NO: 9276096 - DNA, 22 bp, Homo sapiens
atcagaagaaatggatgtgact

SEQ ID NO: 9276097 - DNA, 22 bp, Homo sapiens
atcagaaattgctaccagtgga

SEQ ID NO: 9276098 - DNA, 22 bp, Homo sapiens
atcagaaggggaggtaaagaag

SEQ ID NO: 9276099 - DNA, 22 bp, Homo sapiens
atcagaagcttgtagtctctct

SEQ ID NO: 9276100 - DNA, 22 bp, Homo sapiens
atcagaagtgatgtgtgttatt

SEQ ID NO: 9276101 - DNA, 22 bp, Homo sapiens
atcagaagttgtgcatgcatgg

SEQ ID NO: 9276102 - DNA, 22 bp, Homo sapiens
atcagaaaaacataatgttatt

SEQ ID NO: 9276103 - DNA, 22 bp, Homo sapiens
atcagaaaaacataatgttatt

SEQ ID NO: 9276104 - DNA, 22 bp, Homo sapiens
atcacattatgtagtgaaaagg

SEQ ID NO: 9276105 - DNA, 22 bp, Homo sapiens
atcaacttttagcatggtacct

SEQ ID NO: 9276106 - DNA, 22 bp, Homo sapiens
atcacattctttcaaagcagtc

SEQ ID NO: 9276107 - DNA, 22 bp, Homo sapiens
atcaacttaaagaaaagatact

SEQ ID NO: 9276108 - DNA, 22 bp, Homo sapiens
atcaacttaaagaaaagatact

SEQ ID NO: 9276109 - DNA, 22 bp, Homo sapiens
atcaaagtttcccagaagttgt

SEQ ID NO: 9276110 - DNA, 22 bp, Homo sapiens
atcaaagtttcccagaagttgt

SEQ ID NO: 9276111 - DNA, 22 bp, Homo sapiens
atcaacaggtatggatgagatt

SEQ ID NO: 9276112 - DNA, 22 bp, Homo sapiens
atcaaattatgtgctacaagaa

SEQ ID NO: 9276113 - DNA, 22 bp, Homo sapiens
atcaaattatgtgctacaagaa

SEQ ID NO: 9276114 - DNA, 23 bp, Homo sapiens
atcaaatgattggccattcagtg

SEQ ID NO: 9276115 - DNA, 22 bp, Homo sapiens
atattgcaatagatgcatcatt

SEQ ID NO: 9276116 - DNA, 20 bp, Homo sapiens
atattgcaaggaagctggat

SEQ ID NO: 9276117 - DNA, 22 bp, Homo sapiens
atattgcagggacagtctggat

SEQ ID NO: 9276118 - DNA, 22 bp, Homo sapiens
atattgcattggctggtcttga

SEQ ID NO: 9276119 - DNA, 22 bp, Homo sapiens
atattgctagcctatgagttca

SEQ ID NO: 9276120 - DNA, 22 bp, Homo sapiens
atattgcagtgtgtttatgtga

SEQ ID NO: 9276121 - DNA, 22 bp, Homo sapiens
atattgcatggctttgctggtt

SEQ ID NO: 9276122 - DNA, 22 bp, Homo sapiens
atattcttgtgattataaagta

SEQ ID NO: 9276123 - DNA, 22 bp, Homo sapiens
atattgaaccctacagactgta

SEQ ID NO: 9276124 - DNA, 22 bp, Homo sapiens
atattgtactagggttacatgt

SEQ ID NO: 9276125 - DNA, 22 bp, Homo sapiens
atattgtgtgtacaagtagtta

SEQ ID NO: 9276126 - DNA, 22 bp, Homo sapiens
atattgttagtaatatttcgaa

SEQ ID NO: 9276127 - DNA, 22 bp, Homo sapiens
atatttaaacagggtaccaata

SEQ ID NO: 9276128 - DNA, 22 bp, Homo sapiens
atcaaagtggaagtttactagg

SEQ ID NO: 9276129 - DNA, 22 bp, Homo sapiens
atcaaagttcgtaactgataac

SEQ ID NO: 9276130 - DNA, 22 bp, Homo sapiens
atcaaagtggaagtttactagg

SEQ ID NO: 9276131 - DNA, 22 bp, Homo sapiens
atcaaagtccatcagaaggtag

SEQ ID NO: 9276132 - DNA, 22 bp, Homo sapiens
atcaaagtccatcagaaggtag

SEQ ID NO: 9276133 - DNA, 22 bp, Homo sapiens
atcaaagagcttgacaatccta

SEQ ID NO: 9276134 - DNA, 22 bp, Homo sapiens
atcaaagaatgtgactgaaata

SEQ ID NO: 9276135 - DNA, 22 bp, Homo sapiens
atcaaaatggaagaatttggct

SEQ ID NO: 9276136 - DNA, 22 bp, Homo sapiens
atatttaactggtcccaatata

SEQ ID NO: 9276137 - DNA, 22 bp, Homo sapiens
atattttggcaaatgtctagat

SEQ ID NO: 9276138 - DNA, 22 bp, Homo sapiens
atattacataaacatgagtgaa

SEQ ID NO: 9276139 - DNA, 22 bp, Homo sapiens
atattacataaacatgagtgaa

SEQ ID NO: 9276140 - DNA, 22 bp, Homo sapiens
atattagcagtgatcaaaatgg

SEQ ID NO: 9276141 - DNA, 22 bp, Homo sapiens
atattagcagtgatcaaaatgg

SEQ ID NO: 9276142 - DNA, 22 bp, Homo sapiens
atattagtgtaggtagctaata

SEQ ID NO: 9276143 - DNA, 22 bp, Homo sapiens
atattataagttatttcaagtt

SEQ ID NO: 9276144 - DNA, 22 bp, Homo sapiens
ctgggctctgcggtgtcgctct

SEQ ID NO: 9276145 - DNA, 22 bp, Homo sapiens
atattatgctaagggaaataag

SEQ ID NO: 9276146 - DNA, 22 bp, Homo sapiens
atattataagttatttcaagtt

SEQ ID NO: 9276147 - DNA, 22 bp, Homo sapiens
atattatagacagagtcttctg

SEQ ID NO: 9276148 - DNA, 22 bp, Homo sapiens
ctgggctcttcccagatccaga

SEQ ID NO: 9276149 - DNA, 22 bp, Homo sapiens
ctgggctctgtgtttcagtttc

SEQ ID NO: 9276150 - DNA, 22 bp, Homo sapiens
ctgggctctgtgtttcagtttc

SEQ ID NO: 9276151 - DNA, 19 bp, Homo sapiens
ctgggctgaggtctgcctt

SEQ ID NO: 9276152 - DNA, 19 bp, Homo sapiens
ctgggctgaggtctgcctt

SEQ ID NO: 9276153 - DNA, 22 bp, Homo sapiens
atattcactgggtactaaaaag

SEQ ID NO: 9276154 - DNA, 22 bp, Homo sapiens
atattcactgggtactaaaaag

SEQ ID NO: 9276155 - DNA, 22 bp, Homo sapiens
ctgggctgagcctgggctgtgt

SEQ ID NO: 9276156 - DNA, 22 bp, Homo sapiens
ctgggctcagatgagaggaagg

SEQ ID NO: 9276157 - DNA, 22 bp, Homo sapiens
ctgggctcagatgagaggaagg

SEQ ID NO: 9276158 - DNA, 22 bp, Homo sapiens
ctgggctcagaaccttgttaag

SEQ ID NO: 9276159 - DNA, 22 bp, Homo sapiens
atatgcatatgtcaaaacttat

SEQ ID NO: 9276160 - DNA, 22 bp, Homo sapiens
atatgcagtctcttgcccttct

SEQ ID NO: 9276161 - DNA, 22 bp, Homo sapiens
atatgcacatacatacataggt

SEQ ID NO: 9276162 - DNA, 22 bp, Homo sapiens
ctgggctcaagaagtcttccct

SEQ ID NO: 9276163 - DNA, 21 bp, Homo sapiens
ctgggctcaagcaatcctttc

SEQ ID NO: 9276164 - DNA, 21 bp, Homo sapiens
ctgggctcaagcaatcctttc

SEQ ID NO: 9276165 - DNA, 22 bp, Homo sapiens
ctgggcctggtagggcttgaaa

SEQ ID NO: 9276166 - DNA, 20 bp, Homo sapiens
ctgggctcaagtgatcctcc

SEQ ID NO: 9276167 - DNA, 20 bp, Homo sapiens
ctgggctcaagtgatcctcc

SEQ ID NO: 9276168 - DNA, 22 bp, Homo sapiens
ctgggctcaagtgatccaccca

SEQ ID NO: 9276169 - DNA, 20 bp, Homo sapiens
ctgggctcaagtgagcctcc

SEQ ID NO: 9276170 - DNA, 20 bp, Homo sapiens
ctgggctcaagtgagcctcc

SEQ ID NO: 9276171 - DNA, 22 bp, Homo sapiens
ctggctgggagcgagctgctca

SEQ ID NO: 9276172 - DNA, 22 bp, Homo sapiens
ctggctggccggaggcatccct

SEQ ID NO: 9276173 - DNA, 22 bp, Homo sapiens
ctggctggccggaggcatccct

SEQ ID NO: 9276174 - DNA, 22 bp, Homo sapiens
ctggctggccggagcgaggcgg

SEQ ID NO: 9276175 - DNA, 22 bp, Homo sapiens
ctggcttccaccatggcccctg

SEQ ID NO: 9276176 - DNA, 22 bp, Homo sapiens
ctggcttccatgctgtagtggc

SEQ ID NO: 9276177 - DNA, 22 bp, Homo sapiens
ctggcttcctcaggagcagtgg

SEQ ID NO: 9276178 - DNA, 19 bp, Homo sapiens
ctggcttcaagcagtcctc

SEQ ID NO: 9276179 - DNA, 22 bp, Homo sapiens
ctgagctgggactcagtagcaa

SEQ ID NO: 9276180 - DNA, 22 bp, Homo sapiens
ctgagcagccccaccagccatt

SEQ ID NO: 9276181 - DNA, 22 bp, Homo sapiens
ctgagctgggactcagtagcaa

SEQ ID NO: 9276182 - DNA, 22 bp, Homo sapiens
ctgaggagagatcacgtggtgt

SEQ ID NO: 9276183 - DNA, 22 bp, Homo sapiens
ctgagcagcaacccagagcctc

SEQ ID NO: 9276184 - DNA, 22 bp, Homo sapiens
ctgagcagcaccttcaagaaac

SEQ ID NO: 9276185 - DNA, 22 bp, Homo sapiens
ctgagcagcaacccagagcctc

SEQ ID NO: 9276186 - DNA, 22 bp, Homo sapiens
agttagaaagtaaatcatttga

SEQ ID NO: 9276187 - DNA, 22 bp, Homo sapiens
agttagaagtgtgtcatctgtg

SEQ ID NO: 9276188 - DNA, 22 bp, Homo sapiens
agttagaatagtcagattgtag

SEQ ID NO: 9276189 - DNA, 22 bp, Homo sapiens
agttagaatagtcagattgtag

SEQ ID NO: 9276190 - DNA, 22 bp, Homo sapiens
agttacttgagacgtttatgaa

SEQ ID NO: 9276191 - DNA, 22 bp, Homo sapiens
agttaagaatacacatcataat

SEQ ID NO: 9276192 - DNA, 22 bp, Homo sapiens
agttaagaaggtcaacgaggga

SEQ ID NO: 9276193 - DNA, 22 bp, Homo sapiens
agttaagagtgtgaaaatgtta

SEQ ID NO: 9276194 - DNA, 22 bp, Homo sapiens
agttaactcattttataatgcc

SEQ ID NO: 9276195 - DNA, 22 bp, Homo sapiens
ctgagaaacatatttccatcta

SEQ ID NO: 9276196 - DNA, 22 bp, Homo sapiens
ctgagaaaccaggtgctctgat

SEQ ID NO: 9276197 - DNA, 22 bp, Homo sapiens
agttagaatggatgttgagagc

SEQ ID NO: 9276198 - DNA, 22 bp, Homo sapiens
agttagaatataattatgttaa

SEQ ID NO: 9276199 - DNA, 22 bp, Homo sapiens
agttagaatataattatgttaa

SEQ ID NO: 9276200 - DNA, 22 bp, Homo sapiens
agttataatctgctactgatat

SEQ ID NO: 9276201 - DNA, 22 bp, Homo sapiens
agttataccttatacacatatg

SEQ ID NO: 9276202 - DNA, 22 bp, Homo sapiens
agttataccttatacacatatg

SEQ ID NO: 9276203 - DNA, 22 bp, Homo sapiens
agttataatctgctactgatat

SEQ ID NO: 9276204 - DNA, 20 bp, Homo sapiens
agttagtgagtaattgagct

SEQ ID NO: 9276205 - DNA, 22 bp, Homo sapiens
agttataaaaggagcactgatt

SEQ ID NO: 9276206 - DNA, 22 bp, Homo sapiens
agttataaaaggagcactgatt

SEQ ID NO: 9276207 - DNA, 22 bp, Homo sapiens
ctgagaaaagctttcttataca

SEQ ID NO: 9276208 - DNA, 20 bp, Homo sapiens
ctgacagaaaatatttcatc

SEQ ID NO: 9276209 - DNA, 22 bp, Homo sapiens
ctgaatgtcgatcagcttgggt

SEQ ID NO: 9276210 - DNA, 22 bp, Homo sapiens
ctgaatggcgagttagttagtt

SEQ ID NO: 9276211 - DNA, 22 bp, Homo sapiens
ctgaatggaatcatccctgctt

SEQ ID NO: 9276212 - DNA, 22 bp, Homo sapiens
ctgaatgataatcttttgctgg

SEQ ID NO: 9276213 - DNA, 22 bp, Homo sapiens
ctgaatgatataagatctttct

SEQ ID NO: 9276214 - DNA, 22 bp, Homo sapiens
ctgaatgatataagatctttct

SEQ ID NO: 9276215 - DNA, 22 bp, Homo sapiens
ctgaatgcctgcagagccagag

SEQ ID NO: 9276216 - DNA, 22 bp, Homo sapiens
ctgacacactgagcatttgata

SEQ ID NO: 9276217 - DNA, 22 bp, Homo sapiens
ctgacaaaggcaaggcaggggg

SEQ ID NO: 9276218 - DNA, 22 bp, Homo sapiens
ctgacaaaggcaaggcaggggg

SEQ ID NO: 9276219 - DNA, 22 bp, Homo sapiens
ctgacaaaccactgctccagct

SEQ ID NO: 9276220 - DNA, 22 bp, Homo sapiens
ctgacaaacttaattttctgaa

SEQ ID NO: 9276221 - DNA, 22 bp, Homo sapiens
ctgacaaaccactgctccagct

SEQ ID NO: 9276222 - DNA, 22 bp, Homo sapiens
ctgaaattctgcctctgcacaa

SEQ ID NO: 9276223 - DNA, 22 bp, Homo sapiens
agtgtctgctaggttcatcaac

SEQ ID NO: 9276224 - DNA, 22 bp, Homo sapiens
ctgaatgagtggatttttcatt

SEQ ID NO: 9276225 - DNA, 22 bp, Homo sapiens
ctgaatgagggattctgagggc

SEQ ID NO: 9276226 - DNA, 22 bp, Homo sapiens
ctgaatgaggaaaagagtgagg

SEQ ID NO: 9276227 - DNA, 22 bp, Homo sapiens
ctgaatgaatggtttgtcttat

SEQ ID NO: 9276228 - DNA, 22 bp, Homo sapiens
ctgaatgactgaagtcacaatt

SEQ ID NO: 9276229 - DNA, 22 bp, Homo sapiens
ctgaatgaaatcaaggactgag

SEQ ID NO: 9276230 - DNA, 20 bp, Homo sapiens
agtgtctgggcctcaggccc

SEQ ID NO: 9276231 - DNA, 22 bp, Homo sapiens
ctgaaggaagcaggtggcctgt

SEQ ID NO: 9276232 - DNA, 22 bp, Homo sapiens
ctgaatccacacaaggtgatgg

SEQ ID NO: 9276233 - DNA, 22 bp, Homo sapiens
ctgaaggaagcagaagcgaggt

SEQ ID NO: 9276234 - DNA, 18 bp, Homo sapiens
agtgtctggatatttggg

SEQ ID NO: 9276235 - DNA, 17 bp, Homo sapiens
ctgaaatattatgataa

SEQ ID NO: 9276236 - DNA, 22 bp, Homo sapiens
ctgaaatattttaatctcagga

SEQ ID NO: 9276237 - DNA, 22 bp, Homo sapiens
ctgaaataaagttgctaaaatt

SEQ ID NO: 9276238 - DNA, 22 bp, Homo sapiens
ctgaaagggagaacaccaagag

SEQ ID NO: 9276239 - DNA, 22 bp, Homo sapiens
ctgaaaggcagtgggtagtgtg

SEQ ID NO: 9276240 - DNA, 22 bp, Homo sapiens
ctgaaaggtataaataagactt

SEQ ID NO: 9276241 - DNA, 22 bp, Homo sapiens
ctgaaagggttacatagtaagt

SEQ ID NO: 9276242 - DNA, 22 bp, Homo sapiens
ctctggggttaagcttccatgg

SEQ ID NO: 9276243 - DNA, 22 bp, Homo sapiens
ctctggggttaagcttccatgg

SEQ ID NO: 9276244 - DNA, 22 bp, Homo sapiens
ctctggggaagcagccagctgg

SEQ ID NO: 9276245 - DNA, 22 bp, Homo sapiens
ctctgggcttgttgacctgcac

SEQ ID NO: 9276246 - DNA, 17 bp, Homo sapiens
ctctggggacagttcta

SEQ ID NO: 9276247 - DNA, 22 bp, Homo sapiens
ctctgggaaagattgtgcaggc

SEQ ID NO: 9276248 - DNA, 22 bp, Homo sapiens
ctctggctttgctcatgcatcc

SEQ ID NO: 9276249 - DNA, 22 bp, Homo sapiens
ctctggctttgctcatgcatcc

SEQ ID NO: 9276250 - DNA, 22 bp, Homo sapiens
ctctggcttgttaatgcatatt

SEQ ID NO: 9276251 - DNA, 22 bp, Homo sapiens
ctctgggctgccttttagctct

SEQ ID NO: 9276252 - DNA, 19 bp, Homo sapiens
ctctgggctgcatcttggt

SEQ ID NO: 9276253 - DNA, 22 bp, Homo sapiens
ctctgggcttacctgcttcctg

SEQ ID NO: 9276254 - DNA, 22 bp, Homo sapiens
ctctgggcttgttgacctgcac

SEQ ID NO: 9276255 - DNA, 22 bp, Homo sapiens
ctctgggacatcccttggccta

SEQ ID NO: 9276256 - DNA, 22 bp, Homo sapiens
ctctgcctgtctcatcctgcaa

SEQ ID NO: 9276257 - DNA, 22 bp, Homo sapiens
ctctgcctgcccaccgacccat

SEQ ID NO: 9276258 - DNA, 22 bp, Homo sapiens
ctctgcctgtgtcgccaccaca

SEQ ID NO: 9276259 - DNA, 22 bp, Homo sapiens
ctctgcctgtgtcgccaccaca

SEQ ID NO: 9276260 - DNA, 22 bp, Homo sapiens
ctctgcctgccactgttcaggc

SEQ ID NO: 9276261 - DNA, 21 bp, Homo sapiens
ctctgctgagtcctaggattc

SEQ ID NO: 9276262 - DNA, 22 bp, Homo sapiens
ctctgctcaccagccatgtgat

SEQ ID NO: 9276263 - DNA, 17 bp, Homo sapiens
ctctgcagtgcatggct

SEQ ID NO: 9276264 - DNA, 22 bp, Homo sapiens
ctctgcaggcacccagggtggg

SEQ ID NO: 9276265 - DNA, 23 bp, Homo sapiens
ctctgcaggagagtgggcagggc

SEQ ID NO: 9276266 - DNA, 22 bp, Homo sapiens
ctctcagcaggaaagcatgcaa

SEQ ID NO: 9276267 - DNA, 19 bp, Homo sapiens
ctctcagcctgtctccttg

SEQ ID NO: 9276268 - DNA, 19 bp, Homo sapiens
ctctcagcctgtctccttg

SEQ ID NO: 9276269 - DNA, 19 bp, Homo sapiens
ctctcagcctgtctccttg

SEQ ID NO: 9276270 - DNA, 22 bp, Homo sapiens
ctcctgggaaaggctggacaca

SEQ ID NO: 9276271 - DNA, 22 bp, Homo sapiens
ctcctgggaaaggctggacaca

SEQ ID NO: 9276272 - DNA, 22 bp, Homo sapiens
ctcctggctttcccagaccagg

SEQ ID NO: 9276273 - DNA, 22 bp, Homo sapiens
ctcctgggaatttagttgtgag

SEQ ID NO: 9276274 - DNA, 22 bp, Homo sapiens
ctcctgggaaaggctggacaca

SEQ ID NO: 9276275 - DNA, 22 bp, Homo sapiens
ctcctgggggacagcggcaggg

SEQ ID NO: 9276276 - DNA, 22 bp, Homo sapiens
ctcctgggtcattgccagcaaa

SEQ ID NO: 9276277 - DNA, 22 bp, Homo sapiens
ctcctgggggacagcggcaggg

SEQ ID NO: 9276278 - DNA, 22 bp, Homo sapiens
ctcctgggggacagcggcaggg

SEQ ID NO: 9276279 - DNA, 22 bp, Homo sapiens
ctcctggggccatggaaggaac

SEQ ID NO: 9276280 - DNA, 22 bp, Homo sapiens
ctcctgggcttcgaaggctccc

SEQ ID NO: 9276281 - DNA, 20 bp, Homo sapiens
ctcctgggactgctggttat

SEQ ID NO: 9276282 - DNA, 22 bp, Homo sapiens
ctcctgggagcagggatggatg

SEQ ID NO: 9276283 - DNA, 22 bp, Homo sapiens
ctcctggggcacttagaagcaa

SEQ ID NO: 9276284 - DNA, 22 bp, Homo sapiens
agtggcagagtgcactcaggca

SEQ ID NO: 9276285 - DNA, 22 bp, Homo sapiens
agtggcagagtgcactcaggca

SEQ ID NO: 9276286 - DNA, 22 bp, Homo sapiens
ctcctgggtcattgccagcaaa

SEQ ID NO: 9276287 - DNA, 20 bp, Homo sapiens
ctcctggtccaggagcctga

SEQ ID NO: 9276288 - DNA, 22 bp, Homo sapiens
ctcctggtgactcccagataaa

SEQ ID NO: 9276289 - DNA, 22 bp, Homo sapiens
ctcctggtgctggggctgccgc

SEQ ID NO: 9276290 - DNA, 23 bp, Homo sapiens
ctcctggtgctgctatcaggggt

SEQ ID NO: 9276291 - DNA, 22 bp, Homo sapiens
agtggcagaggttgactgcagt

SEQ ID NO: 9276292 - DNA, 22 bp, Homo sapiens
agtggcagaagccaagtctgca

SEQ ID NO: 9276293 - DNA, 22 bp, Homo sapiens
agtggcagatctctggtctgga

SEQ ID NO: 9276294 - DNA, 19 bp, Homo sapiens
agtggcagatctggaagta

SEQ ID NO: 9276295 - DNA, 19 bp, Homo sapiens
agtggcagatctggaagta

SEQ ID NO: 9276296 - DNA, 22 bp, Homo sapiens
ctctcagacacccatttggaaa

SEQ ID NO: 9276297 - DNA, 22 bp, Homo sapiens
ctctcagatggagtgtgaatgg

SEQ ID NO: 9276298 - DNA, 22 bp, Homo sapiens
ctccctctctaaggcaaagaga

SEQ ID NO: 9276299 - DNA, 22 bp, Homo sapiens
ctcctacagtgtttgagtccag

SEQ ID NO: 9276300 - DNA, 22 bp, Homo sapiens
ctcctcacacccactgcaacca

SEQ ID NO: 9276301 - DNA, 22 bp, Homo sapiens
ctcctaggtgctcactggggtc

SEQ ID NO: 9276302 - DNA, 19 bp, Homo sapiens
ctcctggctctgtcatttt

SEQ ID NO: 9276303 - DNA, 20 bp, Homo sapiens
ctccagggaacagactggag

SEQ ID NO: 9276304 - DNA, 22 bp, Homo sapiens
ctccctcacacccttgcccaga

SEQ ID NO: 9276305 - DNA, 22 bp, Homo sapiens
ctcccaggttgattctttccct

SEQ ID NO: 9276306 - DNA, 22 bp, Homo sapiens
ctccctcagaggagcacctgtt

SEQ ID NO: 9276307 - DNA, 22 bp, Homo sapiens
ctccctcaccatgacccgctgt

SEQ ID NO: 9276308 - DNA, 22 bp, Homo sapiens
ctccctctcaccggagccctgg

SEQ ID NO: 9276309 - DNA, 22 bp, Homo sapiens
ctccctcctcaaatatctttgt

SEQ ID NO: 9276310 - DNA, 22 bp, Homo sapiens
ctccctcctcaaatatctttgt

SEQ ID NO: 9276311 - DNA, 22 bp, Homo sapiens
ctccctcaggccttagccctgc

SEQ ID NO: 9276312 - DNA, 22 bp, Homo sapiens
ctccctcatatacccagcgaga

SEQ ID NO: 9276313 - DNA, 22 bp, Homo sapiens
ctccctccctacgtgagctcac

SEQ ID NO: 9276314 - DNA, 22 bp, Homo sapiens
agtcttcagagaaattaactct

SEQ ID NO: 9276315 - DNA, 22 bp, Homo sapiens
agtcttcactcttcactactat

SEQ ID NO: 9276316 - DNA, 22 bp, Homo sapiens
agtcttatggttaaatagatgc

SEQ ID NO: 9276317 - DNA, 22 bp, Homo sapiens
agtcttctcatttcacatgctt

SEQ ID NO: 9276318 - DNA, 22 bp, Homo sapiens
agtcttctgaataagaatcact

SEQ ID NO: 9276319 - DNA, 22 bp, Homo sapiens
agtcttctgaataagaatcact

SEQ ID NO: 9276320 - DNA, 22 bp, Homo sapiens
agtcttccctgtgccagagtgt

SEQ ID NO: 9276321 - DNA, 22 bp, Homo sapiens
agtcttctcatttcacatgctt

SEQ ID NO: 9276322 - DNA, 22 bp, Homo sapiens
ctccagctcgcgagctctgctc

SEQ ID NO: 9276323 - DNA, 22 bp, Homo sapiens
ctccagctgccaccagatgttt

SEQ ID NO: 9276324 - DNA, 22 bp, Homo sapiens
ctccaggctggggtgcaggttg

SEQ ID NO: 9276325 - DNA, 22 bp, Homo sapiens
ctccagggaaaggggcgtccgc

SEQ ID NO: 9276326 - DNA, 22 bp, Homo sapiens
ctccaggacactaacccaggct

SEQ ID NO: 9276327 - DNA, 22 bp, Homo sapiens
ctccaggaaagcctgaggcccg

SEQ ID NO: 9276328 - DNA, 22 bp, Homo sapiens
ctccaggaaagcctgaggcccg

SEQ ID NO: 9276329 - DNA, 22 bp, Homo sapiens
ctccagctttttcccagttggc

SEQ ID NO: 9276330 - DNA, 22 bp, Homo sapiens
ctccaggaaaatagggaatgag

SEQ ID NO: 9276331 - DNA, 22 bp, Homo sapiens
ctccagctttagctctccaggg

SEQ ID NO: 9276332 - DNA, 22 bp, Homo sapiens
ctccagcttccctcagctgtgg

SEQ ID NO: 9276333 - DNA, 22 bp, Homo sapiens
ctccagctgctggtctgagact

SEQ ID NO: 9276334 - DNA, 22 bp, Homo sapiens
ctccagctagggctggcttact

SEQ ID NO: 9276335 - DNA, 22 bp, Homo sapiens
ctccagcttccctcagctgtgg

SEQ ID NO: 9276336 - DNA, 22 bp, Homo sapiens
agtccctggattgtctctgtca

SEQ ID NO: 9276337 - DNA, 22 bp, Homo sapiens
agtccctggattgtctctgtca

SEQ ID NO: 9276338 - DNA, 22 bp, Homo sapiens
agtccctgtactttccactgcc

SEQ ID NO: 9276339 - DNA, 21 bp, Homo sapiens
agtcccctgtccttacttcta

SEQ ID NO: 9276340 - DNA, 23 bp, Homo sapiens
agtcccctacatagttcctgggg

SEQ ID NO: 9276341 - DNA, 22 bp, Homo sapiens
agtcccctggcaggagggacgt

SEQ ID NO: 9276342 - DNA, 22 bp, Homo sapiens
agtcccctctaacccaacttta

SEQ ID NO: 9276343 - DNA, 22 bp, Homo sapiens
agtcccctctcgcttggctgag

SEQ ID NO: 9276344 - DNA, 22 bp, Homo sapiens
agtcctggcatataggtcctca

SEQ ID NO: 9276345 - DNA, 22 bp, Homo sapiens
agtcctggcatataggtcctca

SEQ ID NO: 9276346 - DNA, 22 bp, Homo sapiens
agtcctggacttggagtcaggg

SEQ ID NO: 9276347 - DNA, 22 bp, Homo sapiens
agtcctggacttggagtcaggg

SEQ ID NO: 9276348 - DNA, 22 bp, Homo sapiens
agtcctggacttggagtcaggg

SEQ ID NO: 9276349 - DNA, 22 bp, Homo sapiens
agtcctctgctgtgcgtctttg

SEQ ID NO: 9276350 - DNA, 22 bp, Homo sapiens
agtcctctggagtatgccttat

SEQ ID NO: 9276351 - DNA, 22 bp, Homo sapiens
agtcctgggtccagcaggtcct

SEQ ID NO: 9276352 - DNA, 22 bp, Homo sapiens
ctcatggagggagtgctcttcc

SEQ ID NO: 9276353 - DNA, 22 bp, Homo sapiens
agtcctgggtccagcaggtcct

SEQ ID NO: 9276354 - DNA, 22 bp, Homo sapiens
agtcctgggtccagcaggtcct

SEQ ID NO: 9276355 - DNA, 18 bp, Homo sapiens
agtcctggctctaccacc

SEQ ID NO: 9276356 - DNA, 18 bp, Homo sapiens
agtcctggctctaccacc

SEQ ID NO: 9276357 - DNA, 22 bp, Homo sapiens
agtcctggccccaaggaaggat

SEQ ID NO: 9276358 - DNA, 22 bp, Homo sapiens
ctcatgtaagagagcattagtt

SEQ ID NO: 9276359 - DNA, 22 bp, Homo sapiens
ctcatgtcaggggtgtcaatgt

SEQ ID NO: 9276360 - DNA, 22 bp, Homo sapiens
ctcatgtcttcacccattctaa

SEQ ID NO: 9276361 - DNA, 22 bp, Homo sapiens
ctcatgtcttcacccattctaa

SEQ ID NO: 9276362 - DNA, 22 bp, Homo sapiens
ctcattagacaggtatacttta

SEQ ID NO: 9276363 - DNA, 22 bp, Homo sapiens
ctcattgcaacctccgcctccc

SEQ ID NO: 9276364 - DNA, 22 bp, Homo sapiens
ctcattgcccagatccccacag

SEQ ID NO: 9276365 - DNA, 22 bp, Homo sapiens
ctcattgcccagatccccacag

SEQ ID NO: 9276366 - DNA, 22 bp, Homo sapiens
ctcattgcaacctccgcctccc

SEQ ID NO: 9276367 - DNA, 22 bp, Homo sapiens
ctcattgcaacctccgcctccc

SEQ ID NO: 9276368 - DNA, 22 bp, Homo sapiens
ctagaacaaattaggaggcata

SEQ ID NO: 9276369 - DNA, 20 bp, Homo sapiens
ctagaagcagaattgctgat

SEQ ID NO: 9276370 - DNA, 22 bp, Homo sapiens
agtccatacattgagaataaca

SEQ ID NO: 9276371 - DNA, 22 bp, Homo sapiens
agtccagggagcccaggctttg

SEQ ID NO: 9276372 - DNA, 22 bp, Homo sapiens
agtccaggctcttcctgaagaa

SEQ ID NO: 9276373 - DNA, 22 bp, Homo sapiens
agtccaggtctctgagtcacaa

SEQ ID NO: 9276374 - DNA, 22 bp, Homo sapiens
ctagtaaagctatgattctgcc

SEQ ID NO: 9276375 - DNA, 22 bp, Homo sapiens
ctaggtggtggtgggttgacat

SEQ ID NO: 9276376 - DNA, 22 bp, Homo sapiens
ctaggtggtggtgggttgacat

SEQ ID NO: 9276377 - DNA, 22 bp, Homo sapiens
ctaggtgatccactgctctctt

SEQ ID NO: 9276378 - DNA, 22 bp, Homo sapiens
ctagtattaagtgtgagtaaaa

SEQ ID NO: 9276379 - DNA, 22 bp, Homo sapiens
ctagtcacacagtaaggacggg

SEQ ID NO: 9276380 - DNA, 20 bp, Homo sapiens
ctagtctcacatccctggca

SEQ ID NO: 9276381 - DNA, 22 bp, Homo sapiens
ctagtcacgtctttcagttacc

SEQ ID NO: 9276382 - DNA, 22 bp, Homo sapiens
ctagtcactgtaataatctgct

SEQ ID NO: 9276383 - DNA, 22 bp, Homo sapiens
ctagtcactcagcactgacaaa

SEQ ID NO: 9276384 - DNA, 22 bp, Homo sapiens
agtcccagctactcaagaggct

SEQ ID NO: 9276385 - DNA, 22 bp, Homo sapiens
agtcccagctactcaagaggct

SEQ ID NO: 9276386 - DNA, 22 bp, Homo sapiens
agtccatggttgtagttctctc

SEQ ID NO: 9276387 - DNA, 22 bp, Homo sapiens
ctagggtcaggggcctgcgtcg

SEQ ID NO: 9276388 - DNA, 19 bp, Homo sapiens
ctagggcttggcagcaggc

SEQ ID NO: 9276389 - DNA, 22 bp, Homo sapiens
ctagggtggatttgtgcagagt

SEQ ID NO: 9276390 - DNA, 22 bp, Homo sapiens
ctagggtgtgcagattttgcct

SEQ ID NO: 9276391 - DNA, 22 bp, Homo sapiens
ctaggtgatccactgctctctt

SEQ ID NO: 9276392 - DNA, 22 bp, Homo sapiens
ctagggtgtgcagattttgcct

SEQ ID NO: 9276393 - DNA, 22 bp, Homo sapiens
ctacatttggagagtataggaa

SEQ ID NO: 9276394 - DNA, 22 bp, Homo sapiens
ctacatttcccagctgccttcc

SEQ ID NO: 9276395 - DNA, 22 bp, Homo sapiens
ctacatttcccagctgccttcc

SEQ ID NO: 9276396 - DNA, 22 bp, Homo sapiens
ctacatttgttcaaataagctg

SEQ ID NO: 9276397 - DNA, 22 bp, Homo sapiens
ctacatttgttcaaataagctg

SEQ ID NO: 9276398 - DNA, 22 bp, Homo sapiens
ctacatttgttcaaataagctg

SEQ ID NO: 9276399 - DNA, 22 bp, Homo sapiens
ctacatttggagagtataggaa

SEQ ID NO: 9276400 - DNA, 22 bp, Homo sapiens
ctacattttgtgattatgaaat

SEQ ID NO: 9276401 - DNA, 22 bp, Homo sapiens
ctacattttaataagctgctta

SEQ ID NO: 9276402 - DNA, 22 bp, Homo sapiens
ctacattttgtgattatgaaat

SEQ ID NO: 9276403 - DNA, 22 bp, Homo sapiens
ctacatttgttctatagctttt

SEQ ID NO: 9276404 - DNA, 22 bp, Homo sapiens
ctacatttgttctatagctttt

SEQ ID NO: 9276405 - DNA, 22 bp, Homo sapiens
ctacattttaataagctgctta

SEQ ID NO: 9276406 - DNA, 22 bp, Homo sapiens
ctagaaatctctgtttacatca

SEQ ID NO: 9276407 - DNA, 22 bp, Homo sapiens
ctagaacagaaagtacaggaaa

SEQ ID NO: 9276408 - DNA, 22 bp, Homo sapiens
ctacatttttcaccgagcctct

SEQ ID NO: 9276409 - DNA, 22 bp, Homo sapiens
ctacatttttcaccgagcctct

SEQ ID NO: 9276410 - DNA, 22 bp, Homo sapiens
ctaaggaaaggaaatacagtaa

SEQ ID NO: 9276411 - DNA, 22 bp, Homo sapiens
ctaaggaaaaggatatatatgt

SEQ ID NO: 9276412 - DNA, 22 bp, Homo sapiens
ctaaggaattcaaatagttagt

SEQ ID NO: 9276413 - DNA, 22 bp, Homo sapiens
agtatgtcagagtgaaaatggt

SEQ ID NO: 9276414 - DNA, 19 bp, Homo sapiens
agtatgtctatgagtcttt

SEQ ID NO: 9276415 - DNA, 22 bp, Homo sapiens
agtatttagagacacaagatgg

SEQ ID NO: 9276416 - DNA, 22 bp, Homo sapiens
aggtttctgctgtcctccttct

SEQ ID NO: 9276417 - DNA, 22 bp, Homo sapiens
aggtttctgcaatgtgtgtaca

SEQ ID NO: 9276418 - DNA, 22 bp, Homo sapiens
cgcaggtgaaagaggctgggca

SEQ ID NO: 9276419 - DNA, 22 bp, Homo sapiens
aggtttctggatttattatggc

SEQ ID NO: 9276420 - DNA, 22 bp, Homo sapiens
aggtttctggaaaggttttgct

SEQ ID NO: 9276421 - DNA, 22 bp, Homo sapiens
aggtttctttatgctgctagaa

SEQ ID NO: 9276422 - DNA, 22 bp, Homo sapiens
aggtttcttcttaggaatatgt

SEQ ID NO: 9276423 - DNA, 23 bp, Homo sapiens
aggtttgtctcagaggcagagtt

SEQ ID NO: 9276424 - DNA, 22 bp, Homo sapiens
aggtttgttaaaccagattgct

SEQ ID NO: 9276425 - DNA, 22 bp, Homo sapiens
aggtttgtgtcttgcttaaggt

SEQ ID NO: 9276426 - DNA, 22 bp, Homo sapiens
aggtttgtttatgtatcattgg

SEQ ID NO: 9276427 - DNA, 22 bp, Homo sapiens
aggtttgttttggaaagatcat

SEQ ID NO: 9276428 - DNA, 19 bp, Homo sapiens
cgcaggagccgaggtgacc

SEQ ID NO: 9276429 - DNA, 19 bp, Homo sapiens
cgcaggagccgaggtgacc

SEQ ID NO: 9276430 - DNA, 22 bp, Homo sapiens
cgaggccatgcatgctgaggac

SEQ ID NO: 9276431 - DNA, 17 bp, Homo sapiens
cctgttgttgcctttgc

SEQ ID NO: 9276432 - DNA, 22 bp, Homo sapiens
cctgttgagagagctcactgag

SEQ ID NO: 9276433 - DNA, 21 bp, Homo sapiens
cgggctggccgggccctcacc

SEQ ID NO: 9276434 - DNA, 22 bp, Homo sapiens
cgggcgcactccgggcagctgt

SEQ ID NO: 9276435 - DNA, 22 bp, Homo sapiens
agtacaagtagaatgctacaag

SEQ ID NO: 9276436 - DNA, 22 bp, Homo sapiens
agtacaaattatagcgcttgga

SEQ ID NO: 9276437 - DNA, 22 bp, Homo sapiens
agtacaatgtctgacacagtag

SEQ ID NO: 9276438 - DNA, 17 bp, Homo sapiens
cgggcatggagggcagg

SEQ ID NO: 9276439 - DNA, 22 bp, Homo sapiens
cgggcaaggcgagactaggccc

SEQ ID NO: 9276440 - DNA, 22 bp, Homo sapiens
cgggcagcggcgtggccatggt

SEQ ID NO: 9276441 - DNA, 22 bp, Homo sapiens
cgggcagcggcgtggccatggt

SEQ ID NO: 9276442 - DNA, 22 bp, Homo sapiens
ctaagaagtcaggggacagagg

SEQ ID NO: 9276443 - DNA, 22 bp, Homo sapiens
ctaagacatgccctgcatgata

SEQ ID NO: 9276444 - DNA, 22 bp, Homo sapiens
ctaagaaggaggaaaagtgcca

SEQ ID NO: 9276445 - DNA, 22 bp, Homo sapiens
ctaagaaatgttgtgaatgcca

SEQ ID NO: 9276446 - DNA, 22 bp, Homo sapiens
ctaaacttcatatgttgcttta

SEQ ID NO: 9276447 - DNA, 19 bp, Homo sapiens
ctaaacttatgtgaccaca

SEQ ID NO: 9276448 - DNA, 22 bp, Homo sapiens
ctaagaggaagtactctgttat

SEQ ID NO: 9276449 - DNA, 20 bp, Homo sapiens
ctaagaggaggactaggttt

SEQ ID NO: 9276450 - DNA, 22 bp, Homo sapiens
ctaagaggaagtactctgttat

SEQ ID NO: 9276451 - DNA, 20 bp, Homo sapiens
ctaagaggtccttccacatc

SEQ ID NO: 9276452 - DNA, 18 bp, Homo sapiens
ctaagaggtcgtttctca

SEQ ID NO: 9276453 - DNA, 20 bp, Homo sapiens
ctaagaggtccttccacatc

SEQ ID NO: 9276454 - DNA, 22 bp, Homo sapiens
agtacagacctgtctcttcctg

SEQ ID NO: 9276455 - DNA, 22 bp, Homo sapiens
agtacacagaattctacttgtt

SEQ ID NO: 9276456 - DNA, 22 bp, Homo sapiens
aggtggggagtatatgtaattg

SEQ ID NO: 9276457 - DNA, 22 bp, Homo sapiens
aggtggggccaaatgctacagt

SEQ ID NO: 9276458 - DNA, 22 bp, Homo sapiens
aggtggggccaaatgctacagt

SEQ ID NO: 9276459 - DNA, 22 bp, Homo sapiens
aggtggggcccaccaatttgca

SEQ ID NO: 9276460 - DNA, 21 bp, Homo sapiens
aggtggggctgcacctctgct

SEQ ID NO: 9276461 - DNA, 21 bp, Homo sapiens
aggtggggctgcacctctgct

SEQ ID NO: 9276462 - DNA, 18 bp, Homo sapiens
cctgtgtgtgttgcaggc

SEQ ID NO: 9276463 - DNA, 22 bp, Homo sapiens
aggtggggaggagtgtctcttt

SEQ ID NO: 9276464 - DNA, 22 bp, Homo sapiens
aggtgggcacagatggagaagt

SEQ ID NO: 9276465 - DNA, 22 bp, Homo sapiens
cctgtgccaaaaggctgcttat

SEQ ID NO: 9276466 - DNA, 22 bp, Homo sapiens
cctgtcctccaagagcacatct

SEQ ID NO: 9276467 - DNA, 22 bp, Homo sapiens
cctgtcccccaggcctgtacca

SEQ ID NO: 9276468 - DNA, 22 bp, Homo sapiens
cctgtcattttctcctgtcagc

SEQ ID NO: 9276469 - DNA, 22 bp, Homo sapiens
cctgtcatactaacgtagtggg

SEQ ID NO: 9276470 - DNA, 22 bp, Homo sapiens
cctgtctccctggcatggctca

SEQ ID NO: 9276471 - DNA, 20 bp, Homo sapiens
cctgtctcctcttacctggc

SEQ ID NO: 9276472 - DNA, 22 bp, Homo sapiens
cctgtcctccaagagcacatct

SEQ ID NO: 9276473 - DNA, 22 bp, Homo sapiens
cctgtcctccggagcgggctgt

SEQ ID NO: 9276474 - DNA, 22 bp, Homo sapiens
cctgtctaccagtcacttagcg

SEQ ID NO: 9276475 - DNA, 22 bp, Homo sapiens
cctgggctcaagtgatggtccc

SEQ ID NO: 9276476 - DNA, 22 bp, Homo sapiens
cctgggctccactccaagagca

SEQ ID NO: 9276477 - DNA, 22 bp, Homo sapiens
cctgggctccactccaagagca

SEQ ID NO: 9276478 - DNA, 22 bp, Homo sapiens
cctggctctgtcctcgcgcaaa

SEQ ID NO: 9276479 - DNA, 22 bp, Homo sapiens
cctgggcataaatcactccaag

SEQ ID NO: 9276480 - DNA, 22 bp, Homo sapiens
cctgggcataaatcactccaag

SEQ ID NO: 9276481 - DNA, 22 bp, Homo sapiens
cctgggctttcaaaaccagcct

SEQ ID NO: 9276482 - DNA, 22 bp, Homo sapiens
cctgggctttcaaaaccagcct

SEQ ID NO: 9276483 - DNA, 22 bp, Homo sapiens
cctgggctttcggcggcttcct

SEQ ID NO: 9276484 - DNA, 22 bp, Homo sapiens
cctgtcagttgctgtcagggat

SEQ ID NO: 9276485 - DNA, 22 bp, Homo sapiens
cctgtcagctgatggctatgta

SEQ ID NO: 9276486 - DNA, 22 bp, Homo sapiens
cctgtcagggtttgcctcagaa

SEQ ID NO: 9276487 - DNA, 22 bp, Homo sapiens
cctggtgctgctatcaggggta

SEQ ID NO: 9276488 - DNA, 22 bp, Homo sapiens
cctggtgccggtagacgcgcag

SEQ ID NO: 9276489 - DNA, 22 bp, Homo sapiens
cctgggcttggttgttgagaac

SEQ ID NO: 9276490 - DNA, 22 bp, Homo sapiens
cctgggcttctgtctagatgtt

SEQ ID NO: 9276491 - DNA, 22 bp, Homo sapiens
cctgggcttgcatctgtgctgg

SEQ ID NO: 9276492 - DNA, 22 bp, Homo sapiens
cctgggcttgcatctgtgctgg

SEQ ID NO: 9276493 - DNA, 22 bp, Homo sapiens
cctgggctcgcgcacttcaccc

SEQ ID NO: 9276494 - DNA, 22 bp, Homo sapiens
cctgggcttctgtctagatgtt

SEQ ID NO: 9276495 - DNA, 22 bp, Homo sapiens
cctgggcttctgtctagatgtt

SEQ ID NO: 9276496 - DNA, 20 bp, Homo sapiens
cctgggctccaggagccccg

SEQ ID NO: 9276497 - DNA, 22 bp, Homo sapiens
cctggatgatccatgtcatgga

SEQ ID NO: 9276498 - DNA, 22 bp, Homo sapiens
cctggatgatccatgtcatgga

SEQ ID NO: 9276499 - DNA, 22 bp, Homo sapiens
cctggagtaccgtggccatcca

SEQ ID NO: 9276500 - DNA, 23 bp, Homo sapiens
cctggagtactaaggggatggaa

SEQ ID NO: 9276501 - DNA, 22 bp, Homo sapiens
cctggagtctgtgactttcctc

SEQ ID NO: 9276502 - DNA, 19 bp, Homo sapiens
cctggagtcgcgctgcctc

SEQ ID NO: 9276503 - DNA, 22 bp, Homo sapiens
cctggatcagagccagagaagc

SEQ ID NO: 9276504 - DNA, 22 bp, Homo sapiens
cctggatgatccatgtcatgga

SEQ ID NO: 9276505 - DNA, 22 bp, Homo sapiens
cctggatcccgatggctgtgag

SEQ ID NO: 9276506 - DNA, 18 bp, Homo sapiens
cctggagtgtgttaggct

SEQ ID NO: 9276507 - DNA, 22 bp, Homo sapiens
cctggagtggggtccgtgcatg

SEQ ID NO: 9276508 - DNA, 22 bp, Homo sapiens
cctggagtgacaggtgtagcct

SEQ ID NO: 9276509 - DNA, 22 bp, Homo sapiens
cctggagttttttggttgactc

SEQ ID NO: 9276510 - DNA, 22 bp, Homo sapiens
cctggagttgaaggaaggtggg

SEQ ID NO: 9276511 - DNA, 22 bp, Homo sapiens
aggtcctctgtgcctgctggcg

SEQ ID NO: 9276512 - DNA, 21 bp, Homo sapiens
aggtcccaggtttgggcagca

SEQ ID NO: 9276513 - DNA, 22 bp, Homo sapiens
aggtcccaggcatagctggtct

SEQ ID NO: 9276514 - DNA, 22 bp, Homo sapiens
aggtccatggcagcgggtactt

SEQ ID NO: 9276515 - DNA, 22 bp, Homo sapiens
cctgccagcccgcgttcatgcc

SEQ ID NO: 9276516 - DNA, 22 bp, Homo sapiens
cctgccagcccgcgttcatgcc

SEQ ID NO: 9276517 - DNA, 22 bp, Homo sapiens
cctgccagcccgcgttcatgcc

SEQ ID NO: 9276518 - DNA, 22 bp, Homo sapiens
cctgccagccagatcactcgcc

SEQ ID NO: 9276519 - DNA, 22 bp, Homo sapiens
cctgccagcatggcttatctcc

SEQ ID NO: 9276520 - DNA, 22 bp, Homo sapiens
cctgccagatcccctgagctga

SEQ ID NO: 9276521 - DNA, 23 bp, Homo sapiens
cctgcagctgctggggctccacc

SEQ ID NO: 9276522 - DNA, 22 bp, Homo sapiens
cctgcagccgtcctgtttgtct

SEQ ID NO: 9276523 - DNA, 22 bp, Homo sapiens
cctgcagaggtcaggccagaaa

SEQ ID NO: 9276524 - DNA, 18 bp, Homo sapiens
cctgcagcccaggaggcc

SEQ ID NO: 9276525 - DNA, 22 bp, Homo sapiens
cctgcagagggactggcaggaa

SEQ ID NO: 9276526 - DNA, 22 bp, Homo sapiens
cctgcagagccacgtgccagcg

SEQ ID NO: 9276527 - DNA, 22 bp, Homo sapiens
cctgcagagccacgtgccagcg

SEQ ID NO: 9276528 - DNA, 22 bp, Homo sapiens
aggtagggttaatggagatata

SEQ ID NO: 9276529 - DNA, 22 bp, Homo sapiens
aggtagggttaatggagatata

SEQ ID NO: 9276530 - DNA, 23 bp, Homo sapiens
aggtaggttattgctgctacctg

SEQ ID NO: 9276531 - DNA, 23 bp, Homo sapiens
aggtaggttattgctgctacctg

SEQ ID NO: 9276532 - DNA, 22 bp, Homo sapiens
aggtagggttaatggagatata

SEQ ID NO: 9276533 - DNA, 22 bp, Homo sapiens
aggtagggggtttgggaactgc

SEQ ID NO: 9276534 - DNA, 22 bp, Homo sapiens
aggtagggctaggctgcgtctg

SEQ ID NO: 9276535 - DNA, 22 bp, Homo sapiens
aggtagggaagaaggcatgaaa

SEQ ID NO: 9276536 - DNA, 22 bp, Homo sapiens
aggtagggaagaaggcatgaaa

SEQ ID NO: 9276537 - DNA, 19 bp, Homo sapiens
aggtaggcagtggcatgga

SEQ ID NO: 9276538 - DNA, 22 bp, Homo sapiens
aggtaggatgggtggagatgat

SEQ ID NO: 9276539 - DNA, 22 bp, Homo sapiens
aggtaggccctgagtgctgttg

SEQ ID NO: 9276540 - DNA, 22 bp, Homo sapiens
cctgccagcgcttatctctcgg

SEQ ID NO: 9276541 - DNA, 22 bp, Homo sapiens
cctgccagctgtgggccagcct

SEQ ID NO: 9276542 - DNA, 21 bp, Homo sapiens
cctgccaggaaactgagtgtc

SEQ ID NO: 9276543 - DNA, 21 bp, Homo sapiens
cctgccaggaaactgagtgtc

SEQ ID NO: 9276544 - DNA, 22 bp, Homo sapiens
aggtaggatagataggaagacc

SEQ ID NO: 9276545 - DNA, 22 bp, Homo sapiens
aggtaggatgggtggagatgat

SEQ ID NO: 9276546 - DNA, 22 bp, Homo sapiens
aggtaggatgggtggagatgat

SEQ ID NO: 9276547 - DNA, 20 bp, Homo sapiens
aggtaggatcggtgtcataa

SEQ ID NO: 9276548 - DNA, 22 bp, Homo sapiens
aggtaggatagataggaagacc

SEQ ID NO: 9276549 - DNA, 22 bp, Homo sapiens
aggtaggatagataggaagacc

SEQ ID NO: 9276550 - DNA, 18 bp, Homo sapiens
ccagaggcccgggcaggc

SEQ ID NO: 9276551 - DNA, 21 bp, Homo sapiens
ccagaggcctctcttggccac

SEQ ID NO: 9276552 - DNA, 22 bp, Homo sapiens
ccagaggcggaggtttgcagtg

SEQ ID NO: 9276553 - DNA, 20 bp, Homo sapiens
ccagaggctgacagactttg

SEQ ID NO: 9276554 - DNA, 22 bp, Homo sapiens
ccagaggctggcaagggctcct

SEQ ID NO: 9276555 - DNA, 22 bp, Homo sapiens
ccagaggcggaggtttgcagtg

SEQ ID NO: 9276556 - DNA, 20 bp, Homo sapiens
ccagaggctgacagactttg

SEQ ID NO: 9276557 - DNA, 22 bp, Homo sapiens
ccagaggtggtggtgtctagaa

SEQ ID NO: 9276558 - DNA, 21 bp, Homo sapiens
ccagaggttctgggcctccct

SEQ ID NO: 9276559 - DNA, 20 bp, Homo sapiens
ccagagctgatggctgcccg

SEQ ID NO: 9276560 - DNA, 22 bp, Homo sapiens
ccagaggatgctggtcagcctc

SEQ ID NO: 9276561 - DNA, 19 bp, Homo sapiens
aggcaggtgcagaggtccc

SEQ ID NO: 9276562 - DNA, 19 bp, Homo sapiens
ccagaggcagcttctgtaa

SEQ ID NO: 9276563 - DNA, 22 bp, Homo sapiens
ccagaggatgctggtcagcctc

SEQ ID NO: 9276564 - DNA, 22 bp, Homo sapiens
ccactccccacgtgctgtcaga

SEQ ID NO: 9276565 - DNA, 20 bp, Homo sapiens
ccactccaggtgattctgat

SEQ ID NO: 9276566 - DNA, 22 bp, Homo sapiens
ccactcccttccggtccagggc

SEQ ID NO: 9276567 - DNA, 22 bp, Homo sapiens
aggcaggtcacatgcttggcga

SEQ ID NO: 9276568 - DNA, 22 bp, Homo sapiens
aggcaggtcccctggaaggcac

SEQ ID NO: 9276569 - DNA, 22 bp, Homo sapiens
aggcaggtcccctggaaggcac

SEQ ID NO: 9276570 - DNA, 22 bp, Homo sapiens
ccagccagccttgatctgagta

SEQ ID NO: 9276571 - DNA, 22 bp, Homo sapiens
ccagccagccttgatctgagta

SEQ ID NO: 9276572 - DNA, 22 bp, Homo sapiens
ccagccagctggttggacgcct

SEQ ID NO: 9276573 - DNA, 22 bp, Homo sapiens
ccagccagctgcccttggggcc

SEQ ID NO: 9276574 - DNA, 22 bp, Homo sapiens
ccagccaggctggctgtggagg

SEQ ID NO: 9276575 - DNA, 22 bp, Homo sapiens
ccagccaggcattgcaaactga

SEQ ID NO: 9276576 - DNA, 22 bp, Homo sapiens
ccagccaggctggctgtggagg

SEQ ID NO: 9276577 - DNA, 22 bp, Homo sapiens
ccagccaggcattgcaaactga

SEQ ID NO: 9276578 - DNA, 22 bp, Homo sapiens
aggccctgcccagtgccacaag

SEQ ID NO: 9276579 - DNA, 23 bp, Homo sapiens
aggccctgcctgtccctcttttt

SEQ ID NO: 9276580 - DNA, 18 bp, Homo sapiens
ccagccctgcagcacctg

SEQ ID NO: 9276581 - DNA, 22 bp, Homo sapiens
ccagccagtatattccaaagcc

SEQ ID NO: 9276582 - DNA, 23 bp, Homo sapiens
ccagccctccaccagctctaggc

SEQ ID NO: 9276583 - DNA, 22 bp, Homo sapiens
ccagccctgaaccctgctgcat

SEQ ID NO: 9276584 - DNA, 22 bp, Homo sapiens
ccagccctcggtagtcccatag

SEQ ID NO: 9276585 - DNA, 20 bp, Homo sapiens
aggctcagagcagtagtaca

SEQ ID NO: 9276586 - DNA, 22 bp, Homo sapiens
ccaggcaccaaagtatgcttta

SEQ ID NO: 9276587 - DNA, 20 bp, Homo sapiens
ccaggcactgtcccatgcag

SEQ ID NO: 9276588 - DNA, 22 bp, Homo sapiens
aggcctgggtctcgtgcctacc

SEQ ID NO: 9276589 - DNA, 19 bp, Homo sapiens
aggcctggggttttgcact

SEQ ID NO: 9276590 - DNA, 22 bp, Homo sapiens
aggcctgggcaagaaggggcgt

SEQ ID NO: 9276591 - DNA, 22 bp, Homo sapiens
aggcctgggcaagaaggggcgt

SEQ ID NO: 9276592 - DNA, 22 bp, Homo sapiens
aggcctggtgtgccggatgcag

SEQ ID NO: 9276593 - DNA, 22 bp, Homo sapiens
aggcctggtgaatgaagtatct

SEQ ID NO: 9276594 - DNA, 22 bp, Homo sapiens
aggcctgggtctcgtgcctacc

SEQ ID NO: 9276595 - DNA, 22 bp, Homo sapiens
aggcctgggtgttcaccagaag

SEQ ID NO: 9276596 - DNA, 22 bp, Homo sapiens
aggcctgggtgttcaccagaag

SEQ ID NO: 9276597 - DNA, 22 bp, Homo sapiens
aggctagaggcttctggcttca

SEQ ID NO: 9276598 - DNA, 22 bp, Homo sapiens
aggcctggtgaatgaagtatct

SEQ ID NO: 9276599 - DNA, 22 bp, Homo sapiens
aggcctggtgtgccggatgcag

SEQ ID NO: 9276600 - DNA, 22 bp, Homo sapiens
aggccctggacactcaagccgg

SEQ ID NO: 9276601 - DNA, 22 bp, Homo sapiens
aggccctgctttccagagctca

SEQ ID NO: 9276602 - DNA, 22 bp, Homo sapiens
aggccctggcactgcctgggag

SEQ ID NO: 9276603 - DNA, 21 bp, Homo sapiens
aggccctggaggtcagagaaa

SEQ ID NO: 9276604 - DNA, 22 bp, Homo sapiens
ccagctccaggtagatgggcag

SEQ ID NO: 9276605 - DNA, 22 bp, Homo sapiens
ccagctccctgaagcctggtct

SEQ ID NO: 9276606 - DNA, 22 bp, Homo sapiens
ccagctcccgcaggctgcacag

SEQ ID NO: 9276607 - DNA, 22 bp, Homo sapiens
ccagctccgggagttgctgctg

SEQ ID NO: 9276608 - DNA, 23 bp, Homo sapiens
ccagctcccaggtctgaggactg

SEQ ID NO: 9276609 - DNA, 22 bp, Homo sapiens
ccagctcccattcttcacctgt

SEQ ID NO: 9276610 - DNA, 22 bp, Homo sapiens
ccagctcccctcagcaggtaat

SEQ ID NO: 9276611 - DNA, 22 bp, Homo sapiens
ccagctcccgcaggctgcacag

SEQ ID NO: 9276612 - DNA, 22 bp, Homo sapiens
ccaggaggtctgagtgtggaca

SEQ ID NO: 9276613 - DNA, 22 bp, Homo sapiens
ccaggaggatgaggggcataga

SEQ ID NO: 9276614 - DNA, 22 bp, Homo sapiens
ccaggaggggtctctgtctccc

SEQ ID NO: 9276615 - DNA, 22 bp, Homo sapiens
ccaggaggtggagattgcagtg

SEQ ID NO: 9276616 - DNA, 22 bp, Homo sapiens
ccaggaggtggagattgcagtg

SEQ ID NO: 9276617 - DNA, 22 bp, Homo sapiens
ccaggaggttgaggctgcagtg

SEQ ID NO: 9276618 - DNA, 22 bp, Homo sapiens
ccaggaggtggcaggacttgcc

SEQ ID NO: 9276619 - DNA, 22 bp, Homo sapiens
ccaggaggtggcaggacttgcc

SEQ ID NO: 9276620 - DNA, 22 bp, Homo sapiens
aggctgtgcgaggtctcagagt

SEQ ID NO: 9276621 - DNA, 22 bp, Homo sapiens
aggctgtggcatcacatcagga

SEQ ID NO: 9276622 - DNA, 22 bp, Homo sapiens
aggctgtggccctggtctagca

SEQ ID NO: 9276623 - DNA, 22 bp, Homo sapiens
aggctgtggccctggtctagca

SEQ ID NO: 9276624 - DNA, 22 bp, Homo sapiens
aggctgtggccctggtctagca

SEQ ID NO: 9276625 - DNA, 22 bp, Homo sapiens
aggctgtgggagttgagagtct

SEQ ID NO: 9276626 - DNA, 22 bp, Homo sapiens
aggctgtgggacagttaggaga

SEQ ID NO: 9276627 - DNA, 22 bp, Homo sapiens
aggctgtgggacagttaggaga

SEQ ID NO: 9276628 - DNA, 22 bp, Homo sapiens
aggctgtgggacagttaggaga

SEQ ID NO: 9276629 - DNA, 22 bp, Homo sapiens
cccagaggtgaaggaggtggga

SEQ ID NO: 9276630 - DNA, 22 bp, Homo sapiens
cccagaggtgaaggaggtggga

SEQ ID NO: 9276631 - DNA, 22 bp, Homo sapiens
cccagaggtgacatcccattct

SEQ ID NO: 9276632 - DNA, 22 bp, Homo sapiens
aggctgtggtgctgaaggaggg

SEQ ID NO: 9276633 - DNA, 22 bp, Homo sapiens
cccagaggtgcttcagaggtgc

SEQ ID NO: 9276634 - DNA, 22 bp, Homo sapiens
cccagaggttccttagggacca

SEQ ID NO: 9276635 - DNA, 20 bp, Homo sapiens
cccagaggttgcggcaggag

SEQ ID NO: 9276636 - DNA, 22 bp, Homo sapiens
cccagaggttccttagggacca

SEQ ID NO: 9276637 - DNA, 22 bp, Homo sapiens
cccagaggttccttagggacca

SEQ ID NO: 9276638 - DNA, 22 bp, Homo sapiens
cccactccctacgacacgctcc

SEQ ID NO: 9276639 - DNA, 22 bp, Homo sapiens
cccacgttgaaccgcttacaga

SEQ ID NO: 9276640 - DNA, 22 bp, Homo sapiens
cccacctctcagagagccttgc

SEQ ID NO: 9276641 - DNA, 22 bp, Homo sapiens
aggctgtgcattttggagggcc

SEQ ID NO: 9276642 - DNA, 22 bp, Homo sapiens
aggctgtgcacagggcacctgc

SEQ ID NO: 9276643 - DNA, 22 bp, Homo sapiens
cccactcctggagctagggctc

SEQ ID NO: 9276644 - DNA, 22 bp, Homo sapiens
aggctgtgacagggtcatggag

SEQ ID NO: 9276645 - DNA, 22 bp, Homo sapiens
cccactgagcctatacaaacag

SEQ ID NO: 9276646 - DNA, 22 bp, Homo sapiens
ccagtgggtaggccatggtgag

SEQ ID NO: 9276647 - DNA, 20 bp, Homo sapiens
aggctgccaggtctcacatc

SEQ ID NO: 9276648 - DNA, 23 bp, Homo sapiens
aggctgcagaagaatagggtcat

SEQ ID NO: 9276649 - DNA, 23 bp, Homo sapiens
aggctgcagaagaatagggtcat

SEQ ID NO: 9276650 - DNA, 23 bp, Homo sapiens
aggctgcagaagaatagggtcat

SEQ ID NO: 9276651 - DNA, 22 bp, Homo sapiens
aggctgcaggtctgggtcatgt

SEQ ID NO: 9276652 - DNA, 22 bp, Homo sapiens
aggctgcagtgcaggtaggatt

SEQ ID NO: 9276653 - DNA, 22 bp, Homo sapiens
aggctgcagtgcaggtaggatt

SEQ ID NO: 9276654 - DNA, 22 bp, Homo sapiens
aggctgccagaagccttcagga

SEQ ID NO: 9276655 - DNA, 22 bp, Homo sapiens
aggctgccaaagcttctgtctc

SEQ ID NO: 9276656 - DNA, 18 bp, Homo sapiens
cccacacagcagtagctc

SEQ ID NO: 9276657 - DNA, 22 bp, Homo sapiens
cccacacatttttcacttaccg

SEQ ID NO: 9276658 - DNA, 22 bp, Homo sapiens
cccacacatttttcacttaccg

SEQ ID NO: 9276659 - DNA, 22 bp, Homo sapiens
cccaataaaattcattttcatt

SEQ ID NO: 9276660 - DNA, 22 bp, Homo sapiens
cccacacacatttatgatagga

SEQ ID NO: 9276661 - DNA, 22 bp, Homo sapiens
ccagtgtgcaatctctggctta

SEQ ID NO: 9276662 - DNA, 22 bp, Homo sapiens
ccagtgtgaaaggtcatttatc

SEQ ID NO: 9276663 - DNA, 22 bp, Homo sapiens
ccaggtgggcgtgtcttcacct

SEQ ID NO: 9276664 - DNA, 22 bp, Homo sapiens
ccaggtgcaaactcccagcagg

SEQ ID NO: 9276665 - DNA, 22 bp, Homo sapiens
ccaggtgcactcaagacctgct

SEQ ID NO: 9276666 - DNA, 22 bp, Homo sapiens
ccaggtgcctccagtcacagtg

SEQ ID NO: 9276667 - DNA, 22 bp, Homo sapiens
ccaggtggtgaaagtgggccct

SEQ ID NO: 9276668 - DNA, 16 bp, Homo sapiens
ccaggtggggctgtga

SEQ ID NO: 9276669 - DNA, 22 bp, Homo sapiens
ccagggcagccaacccagatgc

SEQ ID NO: 9276670 - DNA, 22 bp, Homo sapiens
ccagggcagcgcccctccacgc

SEQ ID NO: 9276671 - DNA, 22 bp, Homo sapiens
ccagggcagcagaattggggca

SEQ ID NO: 9276672 - DNA, 22 bp, Homo sapiens
ccagggcagaaaaagagggaat

SEQ ID NO: 9276673 - DNA, 22 bp, Homo sapiens
ccagggcacttaggcccagccc

SEQ ID NO: 9276674 - DNA, 22 bp, Homo sapiens
ccagggcagaaaaagagggaat

SEQ ID NO: 9276675 - DNA, 22 bp, Homo sapiens
aggctctgtatgaaggtttggg

SEQ ID NO: 9276676 - DNA, 20 bp, Homo sapiens
ccaggtggtgcctggagagg

SEQ ID NO: 9276677 - DNA, 20 bp, Homo sapiens
ccaggtggtgcctggagagg

SEQ ID NO: 9276678 - DNA, 22 bp, Homo sapiens
ccaggtggtgcctctgttcgca

SEQ ID NO: 9276679 - DNA, 20 bp, Homo sapiens
ccaggtggtgcctggagagg

SEQ ID NO: 9276680 - DNA, 18 bp, Homo sapiens
ccaggtggtgacagagat

SEQ ID NO: 9276681 - DNA, 18 bp, Homo sapiens
ccaggtggtgacagagat

SEQ ID NO: 9276682 - DNA, 18 bp, Homo sapiens
ccaggtggtgacagagat

SEQ ID NO: 9276683 - DNA, 22 bp, Homo sapiens
ccaggtgttctttgtccctgtt

SEQ ID NO: 9276684 - DNA, 20 bp, Homo sapiens
ccaggtggtgcctggagagg

SEQ ID NO: 9276685 - DNA, 22 bp, Homo sapiens
ccagtaaaaagcgacaggaagt

SEQ ID NO: 9276686 - DNA, 22 bp, Homo sapiens
ccagtaaaccaagtgtttacta

SEQ ID NO: 9276687 - DNA, 22 bp, Homo sapiens
ccagtaaattacttgatgtcat

SEQ ID NO: 9276688 - DNA, 23 bp, Homo sapiens
ccagtaaacccttcctcagtgtc

SEQ ID NO: 9276689 - DNA, 22 bp, Homo sapiens
aggctgagtgctcccctagatg

SEQ ID NO: 9276690 - DNA, 22 bp, Homo sapiens
aggctgagtcgggaggatcact

SEQ ID NO: 9276691 - DNA, 22 bp, Homo sapiens
aggctgagtcgggaggatcact

SEQ ID NO: 9276692 - DNA, 19 bp, Homo sapiens
ccagtagagacagctgcag

SEQ ID NO: 9276693 - DNA, 22 bp, Homo sapiens
aggctctgggaagcagtgagtt

SEQ ID NO: 9276694 - DNA, 22 bp, Homo sapiens
aggctctgggaagcagtgagtt

SEQ ID NO: 9276695 - DNA, 22 bp, Homo sapiens
aggctctgggaagcagtgagtt

SEQ ID NO: 9276696 - DNA, 22 bp, Homo sapiens
aggctctgggaacagacgggtg

SEQ ID NO: 9276697 - DNA, 22 bp, Homo sapiens
aggctctggttcatcatgatgg

SEQ ID NO: 9276698 - DNA, 22 bp, Homo sapiens
aggctctgggctctagattttg

SEQ ID NO: 9276699 - DNA, 22 bp, Homo sapiens
aggctcagcccctgggaggaga

SEQ ID NO: 9276700 - DNA, 22 bp, Homo sapiens
aggctcagcccaaggtggagag

SEQ ID NO: 9276701 - DNA, 22 bp, Homo sapiens
ccaggcctgtgttgtgtggagg

SEQ ID NO: 9276702 - DNA, 22 bp, Homo sapiens
ccaggccttccagtacgcagaa

SEQ ID NO: 9276703 - DNA, 22 bp, Homo sapiens
ccaggccttctgaggacactct

SEQ ID NO: 9276704 - DNA, 22 bp, Homo sapiens
ccaggcctttcttcttggtctg

SEQ ID NO: 9276705 - DNA, 22 bp, Homo sapiens
agggccacctctctgggttccc

SEQ ID NO: 9276706 - DNA, 23 bp, Homo sapiens
agggccactgggaaggattactg

SEQ ID NO: 9276707 - DNA, 19 bp, Homo sapiens
agggccacggggaggtatt

SEQ ID NO: 9276708 - DNA, 22 bp, Homo sapiens
ccctgaggatagggcaggaccc

SEQ ID NO: 9276709 - DNA, 22 bp, Homo sapiens
ccctgaggatagggcaggaccc

SEQ ID NO: 9276710 - DNA, 22 bp, Homo sapiens
agggccaccagagcagggcagt

SEQ ID NO: 9276711 - DNA, 22 bp, Homo sapiens
agggccaccagagcagggcagt

SEQ ID NO: 9276712 - DNA, 22 bp, Homo sapiens
agggccacagtggggcctgaga

SEQ ID NO: 9276713 - DNA, 22 bp, Homo sapiens
agggcattggcacagatctgct

SEQ ID NO: 9276714 - DNA, 22 bp, Homo sapiens
agggccaagtccaggacctcgg

SEQ ID NO: 9276715 - DNA, 22 bp, Homo sapiens
cccctggggatcagctggaatt

SEQ ID NO: 9276716 - DNA, 19 bp, Homo sapiens
ccccttaggggttaagcct

SEQ ID NO: 9276717 - DNA, 22 bp, Homo sapiens
agggcatgtgggagaggagcct

SEQ ID NO: 9276718 - DNA, 20 bp, Homo sapiens
agggcccaggaagagagtta

SEQ ID NO: 9276719 - DNA, 22 bp, Homo sapiens
agggcccaggacagcatcaggg

SEQ ID NO: 9276720 - DNA, 20 bp, Homo sapiens
agggcccaggaagagagtta

SEQ ID NO: 9276721 - DNA, 22 bp, Homo sapiens
agggcccacagttcctatggcc

SEQ ID NO: 9276722 - DNA, 22 bp, Homo sapiens
agggcccaccttggtgctgagg

SEQ ID NO: 9276723 - DNA, 22 bp, Homo sapiens
agggccagggaagctgtatttt

SEQ ID NO: 9276724 - DNA, 23 bp, Homo sapiens
agggccaggtgcggaaacagctc

SEQ ID NO: 9276725 - DNA, 23 bp, Homo sapiens
agggccaggtgcggaaacagctc

SEQ ID NO: 9276726 - DNA, 23 bp, Homo sapiens
agggcccaagcctggacagcagg

SEQ ID NO: 9276727 - DNA, 23 bp, Homo sapiens
agggcccaagcctggacagcagg

SEQ ID NO: 9276728 - DNA, 19 bp, Homo sapiens
ccctgaggcaaaagccttt

SEQ ID NO: 9276729 - DNA, 22 bp, Homo sapiens
ccctgaggcagtaggagctttt

SEQ ID NO: 9276730 - DNA, 22 bp, Homo sapiens
ccctgaggctgaggataggtgg

SEQ ID NO: 9276731 - DNA, 20 bp, Homo sapiens
cccaggtgtctgaagctctg

SEQ ID NO: 9276732 - DNA, 23 bp, Homo sapiens
cccaggtgtggaggcggtggcag

SEQ ID NO: 9276733 - DNA, 19 bp, Homo sapiens
cccaggtgtttgaggctgc

SEQ ID NO: 9276734 - DNA, 19 bp, Homo sapiens
cccaggtgtttgaggctgc

SEQ ID NO: 9276735 - DNA, 22 bp, Homo sapiens
cccaggtgtttgtggcagaggt

SEQ ID NO: 9276736 - DNA, 22 bp, Homo sapiens
agggcagaaatattgatactgt

SEQ ID NO: 9276737 - DNA, 22 bp, Homo sapiens
agggatggtggaggttgcaagt

SEQ ID NO: 9276738 - DNA, 22 bp, Homo sapiens
agggatggtggaggaatttcaa

SEQ ID NO: 9276739 - DNA, 22 bp, Homo sapiens
agggatgggtctaacccagaac

SEQ ID NO: 9276740 - DNA, 22 bp, Homo sapiens
cccaggtgggttggcctctgtc

SEQ ID NO: 9276741 - DNA, 22 bp, Homo sapiens
cccaggtgggttggcctctgtc

SEQ ID NO: 9276742 - DNA, 21 bp, Homo sapiens
cccaggtgggatggttgcctc

SEQ ID NO: 9276743 - DNA, 22 bp, Homo sapiens
cccaggtgggcacctcgaggaa

SEQ ID NO: 9276744 - DNA, 22 bp, Homo sapiens
cccaggtgggcacctcgaggaa

SEQ ID NO: 9276745 - DNA, 22 bp, Homo sapiens
cccaggtggcagaagctgcagt

SEQ ID NO: 9276746 - DNA, 22 bp, Homo sapiens
cccaggtggcagaagctgcagt

SEQ ID NO: 9276747 - DNA, 22 bp, Homo sapiens
cccaggtctgtgccagctctga

SEQ ID NO: 9276748 - DNA, 22 bp, Homo sapiens
cccaggtctgtgccagctctga

SEQ ID NO: 9276749 - DNA, 22 bp, Homo sapiens
cccctgccagctatccctgaac

SEQ ID NO: 9276750 - DNA, 22 bp, Homo sapiens
cccctgccagctatccctgaac

SEQ ID NO: 9276751 - DNA, 22 bp, Homo sapiens
agggcagagaaatgtagttgag

SEQ ID NO: 9276752 - DNA, 22 bp, Homo sapiens
agggcagaccacgtgcaaggat

SEQ ID NO: 9276753 - DNA, 22 bp, Homo sapiens
agggcagactaggatggaagtg

SEQ ID NO: 9276754 - DNA, 22 bp, Homo sapiens
agggcagactaggatggaagtg
